United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 65

SEQ ID NO: 2955216 - RNA, 21 nt, Human
ccuucucuccagccccuggau

SEQ ID NO: 2955217 - RNA, 14 nt, Human
ccuucucugaagga

SEQ ID NO: 2955218 - RNA, 16 nt, Human
ccuucucugaaggaca

SEQ ID NO: 2955219 - RNA, 20 nt, Human
ccuucucuccagccccugga

SEQ ID NO: 2955220 - RNA, 13 nt, Human
ccuuccccuggca

SEQ ID NO: 2955221 - RNA, 15 nt, Human
ccuuucaauaggaaa

SEQ ID NO: 2955222 - RNA, 13 nt, Human
ccuuucccuuggu

SEQ ID NO: 2955223 - RNA, 17 nt, Human
ccuuucaauaggaaaaa

SEQ ID NO: 2955224 - RNA, 13 nt, Human
ccuguucagcucc

SEQ ID NO: 2955225 - RNA, 18 nt, Human
ccuguucccaugagauga

SEQ ID NO: 2955226 - RNA, 17 nt, Human
ccuguucuggcagaguu

SEQ ID NO: 2955227 - RNA, 12 nt, Human
ccuguucuggca

SEQ ID NO: 2955228 - RNA, 23 nt, Human
ccuguucagcuccagcucaccag

SEQ ID NO: 2955229 - RNA, 20 nt, Human
ccuguucagcuccagcucac

SEQ ID NO: 2955230 - RNA, 21 nt, Human
ccuguucagcuccagcucacc

SEQ ID NO: 2955231 - RNA, 14 nt, Human
ccuguucagcucca

SEQ ID NO: 2955232 - RNA, 15 nt, Human
ccuguucagcuccag

SEQ ID NO: 2955233 - RNA, 16 nt, Human
ccuguucagcuccagc

SEQ ID NO: 2955234 - RNA, 19 nt, Human
ccuguucagcuccagcuca

SEQ ID NO: 2955235 - RNA, 16 nt, Human
ccuguugggccaggag

SEQ ID NO: 2955236 - RNA, 20 nt, Human
ccuguugggccaggagccuc

SEQ ID NO: 2955237 - RNA, 19 nt, Human
ccuguugggccaggagccu

SEQ ID NO: 2955238 - RNA, 18 nt, Human
ccuguugggccaggagcc

SEQ ID NO: 2955239 - RNA, 17 nt, Human
ccuguugggccaggagc

SEQ ID NO: 2955240 - RNA, 16 nt, Human
ccuuagcaaauucugu

SEQ ID NO: 2955241 - RNA, 19 nt, Human
ccuuagcagggaaacagcu

SEQ ID NO: 2955242 - RNA, 20 nt, Human
ccuuagcagggaaacagcua

SEQ ID NO: 2955243 - RNA, 12 nt, Human
ccuucccaccuc

SEQ ID NO: 2955244 - RNA, 19 nt, Human
ccuucccaccucucucacu

SEQ ID NO: 2955245 - RNA, 14 nt, Human
ccuucccaccucuc

SEQ ID NO: 2955246 - RNA, 18 nt, Human
ccuuauggaacacucuga

SEQ ID NO: 2955247 - RNA, 17 nt, Human
ccuuauggaacacucug

SEQ ID NO: 2955248 - RNA, 16 nt, Human
ccuuauggaacacucu

SEQ ID NO: 2955249 - RNA, 14 nt, Human
ccuuauggaacacu

SEQ ID NO: 2955250 - RNA, 20 nt, Human
ccuuauggaacacucugaga

SEQ ID NO: 2955251 - RNA, 19 nt, Human
ccuuauggaacacucugag

SEQ ID NO: 2955252 - RNA, 22 nt, Human
ccuuauggaacacucugagacu

SEQ ID NO: 2955253 - RNA, 12 nt, Human
ccuuauggaaca

SEQ ID NO: 2955254 - RNA, 16 nt, Human
ccucaugcugccaaua

SEQ ID NO: 2955255 - RNA, 15 nt, Human
ccucaugcugccaau

SEQ ID NO: 2955256 - RNA, 13 nt, Human
ccucaugcugcca

SEQ ID NO: 2955257 - RNA, 11 nt, Human
ccucaggcagg

SEQ ID NO: 2955258 - RNA, 23 nt, Human
ccucccaacucaccccagcccca

SEQ ID NO: 2955259 - RNA, 21 nt, Human
ccucccaacucaccccagccc

SEQ ID NO: 2955260 - RNA, 20 nt, Human
ccucccaacucaccccagcc

SEQ ID NO: 2955261 - RNA, 17 nt, Human
ccucccaacucacccca

SEQ ID NO: 2955262 - RNA, 14 nt, Human
ccuccuaaaacaac

SEQ ID NO: 2955263 - RNA, 16 nt, Human
ccucgaacuggcugca

SEQ ID NO: 2955264 - RNA, 15 nt, Human
ccucgaacuggcugc

SEQ ID NO: 2955265 - RNA, 18 nt, Human
ccuccuuugugaggaagc

SEQ ID NO: 2955266 - RNA, 20 nt, Human
ccuccuuugugaggaagccg

SEQ ID NO: 2955267 - RNA, 19 nt, Human
ccuccuuugugaggaagcc

SEQ ID NO: 2955268 - RNA, 20 nt, Human
ccucugccucugacacacag

SEQ ID NO: 2955269 - RNA, 21 nt, Human
ccucugccucugacacacagc

SEQ ID NO: 2955270 - RNA, 23 nt, Human
ccucugccucugacacacagcuc

SEQ ID NO: 2955271 - RNA, 11 nt, Human
ccucugccuga

SEQ ID NO: 2955272 - RNA, 20 nt, Human
ccucugccugaagucacaca

SEQ ID NO: 2955273 - RNA, 21 nt, Human
ccucuccugggcagcugccuc

SEQ ID NO: 2955274 - RNA, 22 nt, Human
ccucuccugggcagcugccucc

SEQ ID NO: 2955275 - RNA, 17 nt, Human
ccucuccugggcagcug

SEQ ID NO: 2955276 - RNA, 18 nt, Human
ccucuccugggcagcugc

SEQ ID NO: 2955277 - RNA, 19 nt, Human
ccucuccugggcagcugcc

SEQ ID NO: 2955278 - RNA, 20 nt, Human
ccucuccugggcagcugccu

SEQ ID NO: 2955279 - RNA, 14 nt, Human
ccucuccugggcag

SEQ ID NO: 2955280 - RNA, 15 nt, Human
ccucuccugggcagc

SEQ ID NO: 2955281 - RNA, 16 nt, Human
ccucuccugggcagcu

SEQ ID NO: 2955282 - RNA, 12 nt, Human
ccugaggggccu

SEQ ID NO: 2955283 - RNA, 16 nt, Human
ccugaggggccucuua

SEQ ID NO: 2955284 - RNA, 21 nt, Human
ccugaggcugggcucccuucc

SEQ ID NO: 2955285 - RNA, 19 nt, Human
ccugaggcugggcucccuu

SEQ ID NO: 2955286 - RNA, 17 nt, Human
ccugaggcugggcuccc

SEQ ID NO: 2955287 - RNA, 16 nt, Human
ccugaggcugggcucc

SEQ ID NO: 2955288 - RNA, 17 nt, Human
ccugcaggcagccaggc

SEQ ID NO: 2955289 - RNA, 16 nt, Human
ccugcaggcagccagg

SEQ ID NO: 2955290 - RNA, 12 nt, Human
ccugcagagggc

SEQ ID NO: 2955291 - RNA, 15 nt, Human
ccugcaggcagccag

SEQ ID NO: 2955292 - RNA, 21 nt, Human
ccugcaggcagccaggccaca

SEQ ID NO: 2955293 - RNA, 20 nt, Human
ccugcaggcagccaggccac

SEQ ID NO: 2955294 - RNA, 19 nt, Human
ccugcaggcagccaggcca

SEQ ID NO: 2955295 - RNA, 18 nt, Human
ccugcaggcagccaggcc

SEQ ID NO: 2955296 - RNA, 23 nt, Human
ccugcaggcagccaggccacaag

SEQ ID NO: 2955297 - RNA, 19 nt, Human
ccucuuuggucuacacugu

SEQ ID NO: 2955298 - RNA, 16 nt, Human
ccucuuugagugaagc

SEQ ID NO: 2955299 - RNA, 22 nt, Human
ccugcugcaguugccagucacc

SEQ ID NO: 2955300 - RNA, 11 nt, Human
ccugcugcagu

SEQ ID NO: 2955301 - RNA, 16 nt, Human
ccugcugcaguugcca

SEQ ID NO: 2955302 - RNA, 12 nt, Human
ccugcugcaguu

SEQ ID NO: 2955303 - RNA, 15 nt, Human
ccugccucuucucua

SEQ ID NO: 2955304 - RNA, 20 nt, Human
ccugccuccuuugugaggaa

SEQ ID NO: 2955305 - RNA, 19 nt, Human
ccugccuccuuugugagga

SEQ ID NO: 2955306 - RNA, 15 nt, Human
ccugccuccuuugug

SEQ ID NO: 2955307 - RNA, 13 nt, Human
ccugccuccuuug

SEQ ID NO: 2955308 - RNA, 22 nt, Human
ccugccuccuuugugaggaagc

SEQ ID NO: 2955309 - RNA, 21 nt, Human
ccugccuccuuugugaggaag

SEQ ID NO: 2955310 - RNA, 23 nt, Human
ccugccuccuuugugaggaagcc

SEQ ID NO: 2955311 - RNA, 16 nt, Human
cccugaaagcccugag

SEQ ID NO: 2955312 - RNA, 12 nt, Human
cccugaaggccc

SEQ ID NO: 2955313 - RNA, 19 nt, Human
cccugaaggccccgcccag

SEQ ID NO: 2955314 - RNA, 16 nt, Human
cccugaaggccccgcc

SEQ ID NO: 2955315 - RNA, 14 nt, Human
cccugaaggccccg

SEQ ID NO: 2955316 - RNA, 13 nt, Human
cccugaaggcccc

SEQ ID NO: 2955317 - RNA, 14 nt, Human
cccugacaacacuc

SEQ ID NO: 2955318 - RNA, 22 nt, Human
cccugaaggccccgcccaggcu

SEQ ID NO: 2955319 - RNA, 20 nt, Human
cccugaaggccccgcccagg

SEQ ID NO: 2955320 - RNA, 20 nt, Human
cccugaauuuaaauagcuuu

SEQ ID NO: 2955321 - RNA, 22 nt, Human
cccugacaacacucauugaccu

SEQ ID NO: 2955322 - RNA, 16 nt, Human
cccugacaacacucau

SEQ ID NO: 2955323 - RNA, 18 nt, Human
cccugaaagcccugagcu

SEQ ID NO: 2955324 - RNA, 13 nt, Human
cccucggagaaga

SEQ ID NO: 2955325 - RNA, 20 nt, Human
cccuggcacuggcaaacagg

SEQ ID NO: 2955326 - RNA, 16 nt, Human
cccuggcacuggcaaa

SEQ ID NO: 2955327 - RNA, 13 nt, Human
cccuggcacuggc

SEQ ID NO: 2955328 - RNA, 13 nt, Human
cccuggaugcagc

SEQ ID NO: 2955329 - RNA, 21 nt, Human
cccuggaugcagccucacagu

SEQ ID NO: 2955330 - RNA, 17 nt, Human
cccuggaugcagccuca

SEQ ID NO: 2955331 - RNA, 22 nt, Human
cccugcccaccuggccucugca

SEQ ID NO: 2955332 - RNA, 14 nt, Human
cccugcccggcugc

SEQ ID NO: 2955333 - RNA, 17 nt, Human
cccugcccggcugcgga

SEQ ID NO: 2955334 - RNA, 14 nt, Human
cccugagcaggauu

SEQ ID NO: 2955335 - RNA, 20 nt, Human
cccugcccaccuggccucug

SEQ ID NO: 2955336 - RNA, 16 nt, Human
cccugagcuuucugcu

SEQ ID NO: 2955337 - RNA, 15 nt, Human
cccuuccucuuucca

SEQ ID NO: 2955338 - RNA, 19 nt, Human
ccgaaagggacuuggaagc

SEQ ID NO: 2955339 - RNA, 17 nt, Human
ccgaaaacguggcugcu

SEQ ID NO: 2955340 - RNA, 16 nt, Human
ccgaaaacguggcugc

SEQ ID NO: 2955341 - RNA, 16 nt, Human
ccgaauagcugggacu

SEQ ID NO: 2955342 - RNA, 17 nt, Human
ccgaauagcugggacua

SEQ ID NO: 2955343 - RNA, 15 nt, Human
ccgcagacaggacca

SEQ ID NO: 2955344 - RNA, 13 nt, Human
ccgaccagacacc

SEQ ID NO: 2955345 - RNA, 17 nt, Human
ccgaccagacaccuuga

SEQ ID NO: 2955346 - RNA, 12 nt, Human
ccgcccaggcuu

SEQ ID NO: 2955347 - RNA, 12 nt, Human
ccgcccaaggcc

SEQ ID NO: 2955348 - RNA, 13 nt, Human
ccgcccaaggccu

SEQ ID NO: 2955349 - RNA, 14 nt, Human
ccgcccaaggccuu

SEQ ID NO: 2955350 - RNA, 17 nt, Human
ccgcccaaggccuuccc

SEQ ID NO: 2955351 - RNA, 17 nt, Human
ccgcagacaggaccagg

SEQ ID NO: 2955352 - RNA, 16 nt, Human
ccgcagacaggaccag

SEQ ID NO: 2955353 - RNA, 23 nt, Human
cccugugauggggcccugccucc

SEQ ID NO: 2955354 - RNA, 22 nt, Human
cccugugauggggcccugccuc

SEQ ID NO: 2955355 - RNA, 21 nt, Human
cccugugauggggcccugccu

SEQ ID NO: 2955356 - RNA, 18 nt, Human
ccggcaggguccuagaaa

SEQ ID NO: 2955357 - RNA, 17 nt, Human
ccggcccuccagagccc

SEQ ID NO: 2955358 - RNA, 13 nt, Human
ccggcccuccaga

SEQ ID NO: 2955359 - RNA, 16 nt, Human
ccggcccuccagagcc

SEQ ID NO: 2955360 - RNA, 15 nt, Human
ccggccccugcuggu

SEQ ID NO: 2955361 - RNA, 16 nt, Human
ccggccaccugcggug

SEQ ID NO: 2955362 - RNA, 19 nt, Human
ccuagcauacguacacauu

SEQ ID NO: 2955363 - RNA, 17 nt, Human
ccuagcacuuugggagg

SEQ ID NO: 2955364 - RNA, 20 nt, Human
ccuagccugugccucuggga

SEQ ID NO: 2955365 - RNA, 14 nt, Human
ccuaaucuucugaa

SEQ ID NO: 2955366 - RNA, 12 nt, Human
ccggcuccaggc

SEQ ID NO: 2955367 - RNA, 13 nt, Human
ccggcuccaggcu

SEQ ID NO: 2955368 - RNA, 14 nt, Human
ccggcuccaggcuc

SEQ ID NO: 2955369 - RNA, 15 nt, Human
ccggcuccaggcucc

SEQ ID NO: 2955370 - RNA, 15 nt, Human
ccgucuaccugaggg

SEQ ID NO: 2955371 - RNA, 14 nt, Human
ccgucuaccugagg

SEQ ID NO: 2955372 - RNA, 15 nt, Human
ccuaacgaaguaucc

SEQ ID NO: 2955373 - RNA, 20 nt, Human
ccuaacgaaguauccuucag

SEQ ID NO: 2955374 - RNA, 16 nt, Human
ccgugaggccagagac

SEQ ID NO: 2955375 - RNA, 14 nt, Human
ccgugaggccagag

SEQ ID NO: 2955376 - RNA, 13 nt, Human
ccgugaggccaga

SEQ ID NO: 2955377 - RNA, 12 nt, Human
ccgugaggccag

SEQ ID NO: 2955378 - RNA, 17 nt, Human
ccgucuaccugaggggc

SEQ ID NO: 2955379 - RNA, 22 nt, Human
ccauuguggucacaggaaguag

SEQ ID NO: 2955380 - RNA, 22 nt, Human
ccauuggggcucccagccaggc

SEQ ID NO: 2955381 - RNA, 20 nt, Human
ccauuggggcucccagccag

SEQ ID NO: 2955382 - RNA, 21 nt, Human
ccauuggggcucccagccagg

SEQ ID NO: 2955383 - RNA, 19 nt, Human
ccauuggggcucccagcca

SEQ ID NO: 2955384 - RNA, 13 nt, Human
ccauuuaaagcuu

SEQ ID NO: 2955385 - RNA, 18 nt, Human
cccaccaucaugucuggc

SEQ ID NO: 2955386 - RNA, 15 nt, Human
cccacccaagggccu

SEQ ID NO: 2955387 - RNA, 15 nt, Human
cccaagcucugcucc

SEQ ID NO: 2955388 - RNA, 17 nt, Human
cccaagcucugcuccuc

SEQ ID NO: 2955389 - RNA, 18 nt, Human
cccaccgcagacaggacc

SEQ ID NO: 2955390 - RNA, 15 nt, Human
cccaccgcagacagg

SEQ ID NO: 2955391 - RNA, 17 nt, Human
ccaugggccuccugugu

SEQ ID NO: 2955392 - RNA, 18 nt, Human
ccaugggcacugugggua

SEQ ID NO: 2955393 - RNA, 18 nt, Human
ccaugaggaacaaggcaa

SEQ ID NO: 2955394 - RNA, 17 nt, Human
ccaugaggaacaaggca

SEQ ID NO: 2955395 - RNA, 16 nt, Human
ccaugaggaacaaggc

SEQ ID NO: 2955396 - RNA, 17 nt, Human
cccagcccacuucugcc

SEQ ID NO: 2955397 - RNA, 19 nt, Human
cccagcccacuucugccau

SEQ ID NO: 2955398 - RNA, 23 nt, Human
cccagccccaaaacucuccucug

SEQ ID NO: 2955399 - RNA, 21 nt, Human
cccagccccaaaacucuccuc

SEQ ID NO: 2955400 - RNA, 19 nt, Human
cccaggcuggcgugcagug

SEQ ID NO: 2955401 - RNA, 20 nt, Human
cccaggcuggcgugcagugg

SEQ ID NO: 2955402 - RNA, 18 nt, Human
cccaggcuggcgugcagu

SEQ ID NO: 2955403 - RNA, 16 nt, Human
cccagggcaucuggga

SEQ ID NO: 2955404 - RNA, 17 nt, Human
cccagggcaucugggag

SEQ ID NO: 2955405 - RNA, 14 nt, Human
cccauccucuguac

SEQ ID NO: 2955406 - RNA, 19 nt, Human
cccauccucuguacagagc

SEQ ID NO: 2955407 - RNA, 15 nt, Human
cccauccucuguaca

SEQ ID NO: 2955408 - RNA, 20 nt, Human
cccauccucuguacagagcc

SEQ ID NO: 2955409 - RNA, 14 nt, Human
cccauucuuggccc

SEQ ID NO: 2955410 - RNA, 23 nt, Human
cccauucugccugcccaggcccc

SEQ ID NO: 2955411 - RNA, 12 nt, Human
ccccagccccaa

SEQ ID NO: 2955412 - RNA, 10 nt, Human
ccccagcccc

SEQ ID NO: 2955413 - RNA, 21 nt, Human
ccccauucugccugcccaggc

SEQ ID NO: 2955414 - RNA, 14 nt, Human
ccccagccccaaaa

SEQ ID NO: 2955415 - RNA, 14 nt, Human
ccccagccccaucc

SEQ ID NO: 2955416 - RNA, 20 nt, Human
ccccaaaacucuccucugcu

SEQ ID NO: 2955417 - RNA, 18 nt, Human
ccccaaaacucuccucug

SEQ ID NO: 2955418 - RNA, 13 nt, Human
ccccggccaccug

SEQ ID NO: 2955419 - RNA, 18 nt, Human
ccccggccaccugcggug

SEQ ID NO: 2955420 - RNA, 14 nt, Human
ccccggccaccugc

SEQ ID NO: 2955421 - RNA, 14 nt, Human
ccccgcccaggcuu

SEQ ID NO: 2955422 - RNA, 12 nt, Human
ccccgcccaggc

SEQ ID NO: 2955423 - RNA, 20 nt, Human
cccccuguggaugcugcugc

SEQ ID NO: 2955424 - RNA, 14 nt, Human
cccccuuccaugga

SEQ ID NO: 2955425 - RNA, 15 nt, Human
ccccauuguggucac

SEQ ID NO: 2955426 - RNA, 13 nt, Human
ccagaugcaccag

SEQ ID NO: 2955427 - RNA, 14 nt, Human
ccagaugcaccagc

SEQ ID NO: 2955428 - RNA, 13 nt, Human
ccagagagggugg

SEQ ID NO: 2955429 - RNA, 18 nt, Human
ccagagacacaagccuuc

SEQ ID NO: 2955430 - RNA, 16 nt, Human
ccagagacacaagccu

SEQ ID NO: 2955431 - RNA, 17 nt, Human
ccagacccggcugcgug

SEQ ID NO: 2955432 - RNA, 16 nt, Human
ccagacccggcugcgu

SEQ ID NO: 2955433 - RNA, 14 nt, Human
ccacuuuuguucuu

SEQ ID NO: 2955434 - RNA, 15 nt, Human
ccacuuuuguucuug

SEQ ID NO: 2955435 - RNA, 21 nt, Human
ccacuuuuguucuugguuugu

SEQ ID NO: 2955436 - RNA, 22 nt, Human
ccacuuuuguucuugguuugua

SEQ ID NO: 2955437 - RNA, 13 nt, Human
ccacuuucuagcc

SEQ ID NO: 2955438 - RNA, 19 nt, Human
ccacuuucuagccagagga

SEQ ID NO: 2955439 - RNA, 18 nt, Human
ccacuuucuagccagagg

SEQ ID NO: 2955440 - RNA, 20 nt, Human
ccacuuucuagccagaggag

SEQ ID NO: 2955441 - RNA, 20 nt, Human
ccacuuggucugugagaugc

SEQ ID NO: 2955442 - RNA, 22 nt, Human
ccacuuggucugugagaugcua

SEQ ID NO: 2955443 - RNA, 15 nt, Human
ccacuuggucuguga

SEQ ID NO: 2955444 - RNA, 16 nt, Human
ccacuuggucugugag

SEQ ID NO: 2955445 - RNA, 17 nt, Human
ccacuuggucugugaga

SEQ ID NO: 2955446 - RNA, 19 nt, Human
ccacuuggucugugagaug

SEQ ID NO: 2955447 - RNA, 19 nt, Human
ccacugcacuauagccuag

SEQ ID NO: 2955448 - RNA, 20 nt, Human
ccacugcacuauagccuagg

SEQ ID NO: 2955449 - RNA, 13 nt, Human
ccacugcaccggg

SEQ ID NO: 2955450 - RNA, 14 nt, Human
ccacugcaccgggc

SEQ ID NO: 2955451 - RNA, 17 nt, Human
ccacugcaccgggccac

SEQ ID NO: 2955452 - RNA, 19 nt, Human
ccacugcaccgggccacag

SEQ ID NO: 2955453 - RNA, 12 nt, Human
ccacuuggucug

SEQ ID NO: 2955454 - RNA, 18 nt, Human
ccacuugagugucaagcu

SEQ ID NO: 2955455 - RNA, 17 nt, Human
ccaggaaaggcuccagg

SEQ ID NO: 2955456 - RNA, 19 nt, Human
ccaggaaaggcuccaggag

SEQ ID NO: 2955457 - RNA, 18 nt, Human
ccaggaaaggcuccagga

SEQ ID NO: 2955458 - RNA, 20 nt, Human
ccaggaaaggcuccaggagc

SEQ ID NO: 2955459 - RNA, 21 nt, Human
ccagcgagcccugguggcagu

SEQ ID NO: 2955460 - RNA, 18 nt, Human
ccagccccuucugaccca

SEQ ID NO: 2955461 - RNA, 17 nt, Human
ccagccccuucugaccc

SEQ ID NO: 2955462 - RNA, 16 nt, Human
ccagccccuucugacc

SEQ ID NO: 2955463 - RNA, 15 nt, Human
ccagccccuucugac

SEQ ID NO: 2955464 - RNA, 18 nt, Human
ccagccccuggaugcagc

SEQ ID NO: 2955465 - RNA, 18 nt, Human
ccagccccauccucugua

SEQ ID NO: 2955466 - RNA, 23 nt, Human
ccagccccauccucuguacagag

SEQ ID NO: 2955467 - RNA, 13 nt, Human
ccagcagccugga

SEQ ID NO: 2955468 - RNA, 15 nt, Human
ccagccccuggaugc

SEQ ID NO: 2955469 - RNA, 14 nt, Human
ccagccccuggaug

SEQ ID NO: 2955470 - RNA, 13 nt, Human
ccagccccuggau

SEQ ID NO: 2955471 - RNA, 12 nt, Human
ccagcagaaaug

SEQ ID NO: 2955472 - RNA, 12 nt, Human
ccagcagccugg

SEQ ID NO: 2955473 - RNA, 11 nt, Human
ccagcagccug

SEQ ID NO: 2955474 - RNA, 16 nt, Human
ccagcagaaaugccuu

SEQ ID NO: 2955475 - RNA, 17 nt, Human
ccagcagaaaugccuua

SEQ ID NO: 2955476 - RNA, 22 nt, Human
ccagcagaaaugccuuacccuc

SEQ ID NO: 2955477 - RNA, 15 nt, Human
ccaggcagcagacac

SEQ ID NO: 2955478 - RNA, 17 nt, Human
ccaggcagcagacacau

SEQ ID NO: 2955479 - RNA, 18 nt, Human
ccaggaguuuggccagaa

SEQ ID NO: 2955480 - RNA, 17 nt, Human
ccaggaguuuggccaga

SEQ ID NO: 2955481 - RNA, 16 nt, Human
ccaggaguuuggccag

SEQ ID NO: 2955482 - RNA, 15 nt, Human
ccaggaguuuggcca

SEQ ID NO: 2955483 - RNA, 14 nt, Human
ccaggaguuuggcc

SEQ ID NO: 2955484 - RNA, 18 nt, Human
ccagucaccccggccacc

SEQ ID NO: 2955485 - RNA, 17 nt, Human
ccagucaccccggccac

SEQ ID NO: 2955486 - RNA, 16 nt, Human
ccagucaccccggcca

SEQ ID NO: 2955487 - RNA, 22 nt, Human
ccaguaucuugaagacuuuucu

SEQ ID NO: 2955488 - RNA, 19 nt, Human
ccaguaucuugaagacuuu

SEQ ID NO: 2955489 - RNA, 13 nt, Human
ccaguaucuugaa

SEQ ID NO: 2955490 - RNA, 22 nt, Human
ccaggggugggacacccuguga

SEQ ID NO: 2955491 - RNA, 21 nt, Human
ccaggggugggacacccugug

SEQ ID NO: 2955492 - RNA, 20 nt, Human
ccaggggugggacacccugu

SEQ ID NO: 2955493 - RNA, 19 nt, Human
ccaggggugggacacccug

SEQ ID NO: 2955494 - RNA, 15 nt, Human
ccaggggccaugaau

SEQ ID NO: 2955495 - RNA, 19 nt, Human
cauuauauuuauuacugua

SEQ ID NO: 2955496 - RNA, 18 nt, Human
cauguucuuaauucuuag

SEQ ID NO: 2955497 - RNA, 18 nt, Human
cauguuggccaggcuggu

SEQ ID NO: 2955498 - RNA, 17 nt, Human
cauguuggccaggcugg

SEQ ID NO: 2955499 - RNA, 19 nt, Human
caugucagucugcuuagaa

SEQ ID NO: 2955500 - RNA, 21 nt, Human
cauguuacauaagauaaaugu

SEQ ID NO: 2955501 - RNA, 13 nt, Human
cauguucuuaauu

SEQ ID NO: 2955502 - RNA, 16 nt, Human
cauguucuuaauucuu

SEQ ID NO: 2955503 - RNA, 16 nt, Human
cauguccaagaagccc

SEQ ID NO: 2955504 - RNA, 15 nt, Human
cauguccaagaagcc

SEQ ID NO: 2955505 - RNA, 16 nt, Human
cauguuacauaagaua

SEQ ID NO: 2955506 - RNA, 17 nt, Human
cauguuacauaagauaa

SEQ ID NO: 2955507 - RNA, 20 nt, Human
cauucuccuuguguuacuaa

SEQ ID NO: 2955508 - RNA, 16 nt, Human
cauuauguuaauauuu

SEQ ID NO: 2955509 - RNA, 15 nt, Human
cauuauguuaauauu

SEQ ID NO: 2955510 - RNA, 14 nt, Human
cauuauguuaauau

SEQ ID NO: 2955511 - RNA, 17 nt, Human
cauuauguuaauauuuc

SEQ ID NO: 2955512 - RNA, 21 nt, Human
cauucuccaccugccagggac

SEQ ID NO: 2955513 - RNA, 19 nt, Human
cauucuccaccugccaggg

SEQ ID NO: 2955514 - RNA, 18 nt, Human
cauucuccaccugccagg

SEQ ID NO: 2955515 - RNA, 17 nt, Human
cauucuccaccugccag

SEQ ID NO: 2955516 - RNA, 12 nt, Human
caugcaagguca

SEQ ID NO: 2955517 - RNA, 15 nt, Human
caugcaaggucauuu

SEQ ID NO: 2955518 - RNA, 13 nt, Human
caugacaaagacu

SEQ ID NO: 2955519 - RNA, 17 nt, Human
caugcuccuggcccacu

SEQ ID NO: 2955520 - RNA, 16 nt, Human
caugcuccuggcccac

SEQ ID NO: 2955521 - RNA, 14 nt, Human
caugcuccuggccc

SEQ ID NO: 2955522 - RNA, 18 nt, Human
caugggaaaggggaaguu

SEQ ID NO: 2955523 - RNA, 21 nt, Human
cauggccucuucagaucucua

SEQ ID NO: 2955524 - RNA, 14 nt, Human
ccaaagugcuggga

SEQ ID NO: 2955525 - RNA, 22 nt, Human
ccaaaguacacuguuucaaacu

SEQ ID NO: 2955526 - RNA, 23 nt, Human
ccaauggacuaacuugucuuugg

SEQ ID NO: 2955527 - RNA, 15 nt, Human
ccaaaucagcugcua

SEQ ID NO: 2955528 - RNA, 23 nt, Human
ccaaaucagcugcuacuacuccu

SEQ ID NO: 2955529 - RNA, 13 nt, Human
ccaacucacccca

SEQ ID NO: 2955530 - RNA, 16 nt, Human
ccaagcucugcuccuc

SEQ ID NO: 2955531 - RNA, 14 nt, Human
ccaagcucugcucc

SEQ ID NO: 2955532 - RNA, 15 nt, Human
ccaagcucugcuccu

SEQ ID NO: 2955533 - RNA, 21 nt, Human
ccaacucaccccagccccaaa

SEQ ID NO: 2955534 - RNA, 21 nt, Human
ccaacuccagaaagugacaag

SEQ ID NO: 2955535 - RNA, 16 nt, Human
cauuggggcucccagc

SEQ ID NO: 2955536 - RNA, 18 nt, Human
cauuuaggugaggaagca

SEQ ID NO: 2955537 - RNA, 22 nt, Human
cauuggggcucccagccaggcc

SEQ ID NO: 2955538 - RNA, 17 nt, Human
cauuggggcucccagcc

SEQ ID NO: 2955539 - RNA, 18 nt, Human
cauuggggcucccagcca

SEQ ID NO: 2955540 - RNA, 19 nt, Human
cauuggggcucccagccag

SEQ ID NO: 2955541 - RNA, 21 nt, Human
cauuggggcucccagccaggc

SEQ ID NO: 2955542 - RNA, 16 nt, Human
cauuuaggugaggaag

SEQ ID NO: 2955543 - RNA, 23 nt, Human
cauuuuuuuuaagaaaaaggaug

SEQ ID NO: 2955544 - RNA, 14 nt, Human
cauuuguauaaaau

SEQ ID NO: 2955545 - RNA, 16 nt, Human
cauuuguauaaaauaa

SEQ ID NO: 2955546 - RNA, 14 nt, Human
ccaaaaggcagaag

SEQ ID NO: 2955547 - RNA, 23 nt, Human
cauaaugcgugcauaccacuuuu

SEQ ID NO: 2955548 - RNA, 16 nt, Human
cauacaguuugcacuu

SEQ ID NO: 2955549 - RNA, 23 nt, Human
cauacaggaagguagaaauaucu

SEQ ID NO: 2955550 - RNA, 22 nt, Human
cauauuaccacagacauacuaa

SEQ ID NO: 2955551 - RNA, 16 nt, Human
cauagguuuaauaauu

SEQ ID NO: 2955552 - RNA, 23 nt, Human
cauagcagagaaugaaagggccc

SEQ ID NO: 2955553 - RNA, 19 nt, Human
cauagcagcuuauucacaa

SEQ ID NO: 2955554 - RNA, 21 nt, Human
caguuguuauuuauugaaaug

SEQ ID NO: 2955555 - RNA, 22 nt, Human
caguuguuagugugucuuagug

SEQ ID NO: 2955556 - RNA, 19 nt, Human
caguuguuauuuauugaaa

SEQ ID NO: 2955557 - RNA, 14 nt, Human
caguuguuauuuau

SEQ ID NO: 2955558 - RNA, 18 nt, Human
caguuguuagugugucuu

SEQ ID NO: 2955559 - RNA, 21 nt, Human
caguuuguuaguaugaggcau

SEQ ID NO: 2955560 - RNA, 23 nt, Human
caguuuguuaguaugaggcauuu

SEQ ID NO: 2955561 - RNA, 21 nt, Human
caucagcacgauuucuguuua

SEQ ID NO: 2955562 - RNA, 19 nt, Human
caucagcacgauuucuguu

SEQ ID NO: 2955563 - RNA, 19 nt, Human
caucccaaacccuucagug

SEQ ID NO: 2955564 - RNA, 22 nt, Human
cauccucuguacagagcccacg

SEQ ID NO: 2955565 - RNA, 21 nt, Human
cauccucuguacagagcccac

SEQ ID NO: 2955566 - RNA, 20 nt, Human
caucccaaacccuucagugc

SEQ ID NO: 2955567 - RNA, 11 nt, Human
caucccagccc

SEQ ID NO: 2955568 - RNA, 18 nt, Human
cauccugaggcuccacuu

SEQ ID NO: 2955569 - RNA, 19 nt, Human
cauccugaggcuccacuug

SEQ ID NO: 2955570 - RNA, 20 nt, Human
caguuacucagaauucucua

SEQ ID NO: 2955571 - RNA, 21 nt, Human
cagugguaugaucacggcuca

SEQ ID NO: 2955572 - RNA, 19 nt, Human
caguggugcgaucuggguu

SEQ ID NO: 2955573 - RNA, 13 nt, Human
caguuauggcuau

SEQ ID NO: 2955574 - RNA, 20 nt, Human
caguuauggcuauaggugcu

SEQ ID NO: 2955575 - RNA, 19 nt, Human
caguuauggcuauaggugc

SEQ ID NO: 2955576 - RNA, 21 nt, Human
caguuauuauauuuacaaaug

SEQ ID NO: 2955577 - RNA, 17 nt, Human
caguuauuauauuuaca

SEQ ID NO: 2955578 - RNA, 16 nt, Human
cagugggagcugccug

SEQ ID NO: 2955579 - RNA, 15 nt, Human
cagugggagcugccu

SEQ ID NO: 2955580 - RNA, 17 nt, Human
cagugggagcugccugu

SEQ ID NO: 2955581 - RNA, 18 nt, Human
cagugggagcugccuguu

SEQ ID NO: 2955582 - RNA, 20 nt, Human
cagugguaugaucacggcuc

SEQ ID NO: 2955583 - RNA, 21 nt, Human
cagugcccacaggaucagucu

SEQ ID NO: 2955584 - RNA, 18 nt, Human
cagugcccacaggaucag

SEQ ID NO: 2955585 - RNA, 22 nt, Human
cagugcccacaggaucagucug

SEQ ID NO: 2955586 - RNA, 23 nt, Human
cagucugauucccaagcucugcu

SEQ ID NO: 2955587 - RNA, 22 nt, Human
cagugauuaccagggacugagg

SEQ ID NO: 2955588 - RNA, 21 nt, Human
cagucugauucccaagcucug

SEQ ID NO: 2955589 - RNA, 22 nt, Human
cagucugauucccaagcucugc

SEQ ID NO: 2955590 - RNA, 23 nt, Human
caguucagagcugcccucuccug

SEQ ID NO: 2955591 - RNA, 24 nt, Human
caguucagagcugcccucuccugg

SEQ ID NO: 2955592 - RNA, 18 nt, Human
caguucagagcugcccuc

SEQ ID NO: 2955593 - RNA, 19 nt, Human
caguucagagcugcccucu

SEQ ID NO: 2955594 - RNA, 21 nt, Human
caguucagagcugcccucucc

SEQ ID NO: 2955595 - RNA, 22 nt, Human
caguucagagcugcccucuccu

SEQ ID NO: 2955596 - RNA, 22 nt, Human
caguuauuauauuuacaaaugg

SEQ ID NO: 2955597 - RNA, 15 nt, Human
caguucagagcugcc

SEQ ID NO: 2955598 - RNA, 16 nt, Human
caguucagagcugccc

SEQ ID NO: 2955599 - RNA, 17 nt, Human
caguucagagcugcccu

SEQ ID NO: 2955600 - RNA, 23 nt, Human
cagacucuacagaggccaugggc

SEQ ID NO: 2955601 - RNA, 18 nt, Human
cagacucuacagaggcca

SEQ ID NO: 2955602 - RNA, 19 nt, Human
cagacucuacagaggccau

SEQ ID NO: 2955603 - RNA, 20 nt, Human
cagacucuacagaggccaug

SEQ ID NO: 2955604 - RNA, 21 nt, Human
cagacucuacagaggccaugg

SEQ ID NO: 2955605 - RNA, 17 nt, Human
cagacucuacagaggcc

SEQ ID NO: 2955606 - RNA, 22 nt, Human
cagacaggcaagcaccuccugc

SEQ ID NO: 2955607 - RNA, 23 nt, Human
cagacaggcaagcaccuccugcc

SEQ ID NO: 2955608 - RNA, 13 nt, Human
cagacuggaagca

SEQ ID NO: 2955609 - RNA, 14 nt, Human
cagacuggaagcac

SEQ ID NO: 2955610 - RNA, 16 nt, Human
cagacuggaagcacag

SEQ ID NO: 2955611 - RNA, 17 nt, Human
cagacuggaagcacagc

SEQ ID NO: 2955612 - RNA, 18 nt, Human
cagacuggaagcacagcu

SEQ ID NO: 2955613 - RNA, 19 nt, Human
cagacuggauaguccgucu

SEQ ID NO: 2955614 - RNA, 23 nt, Human
cagacuggcacaguuuucugaga

SEQ ID NO: 2955615 - RNA, 22 nt, Human
cagacuggcacaguuuucugag

SEQ ID NO: 2955616 - RNA, 20 nt, Human
cagacuggaagcacagcuuc

SEQ ID NO: 2955617 - RNA, 21 nt, Human
cagacuggaagcacagcuuca

SEQ ID NO: 2955618 - RNA, 18 nt, Human
cagacuggcacaguuuuc

SEQ ID NO: 2955619 - RNA, 17 nt, Human
cagacuggcacaguuuu

SEQ ID NO: 2955620 - RNA, 11 nt, Human
cagacaggcaa

SEQ ID NO: 2955621 - RNA, 24 nt, Human
cagacaggaccagggauuuccaug

SEQ ID NO: 2955622 - RNA, 17 nt, Human
cagacaggaccagggau

SEQ ID NO: 2955623 - RNA, 13 nt, Human
cagacaggcaagc

SEQ ID NO: 2955624 - RNA, 18 nt, Human
cagacaggcaagcaccuc

SEQ ID NO: 2955625 - RNA, 20 nt, Human
cagacaggcaagcaccuccu

SEQ ID NO: 2955626 - RNA, 21 nt, Human
cagacaggcaagcaccuccug

SEQ ID NO: 2955627 - RNA, 18 nt, Human
cagacagcugccugggau

SEQ ID NO: 2955628 - RNA, 17 nt, Human
cagacagcugccuggga

SEQ ID NO: 2955629 - RNA, 16 nt, Human
cagacagcugccuggg

SEQ ID NO: 2955630 - RNA, 15 nt, Human
cagacagcugccugg

SEQ ID NO: 2955631 - RNA, 16 nt, Human
cagacaggaccaggga

SEQ ID NO: 2955632 - RNA, 15 nt, Human
cagacaggaccaggg

SEQ ID NO: 2955633 - RNA, 13 nt, Human
cagacaggaccag

SEQ ID NO: 2955634 - RNA, 14 nt, Human
cagacagcugccug

SEQ ID NO: 2955635 - RNA, 13 nt, Human
cagacagcugccu

SEQ ID NO: 2955636 - RNA, 14 nt, Human
cagauaugauucaa

SEQ ID NO: 2955637 - RNA, 19 nt, Human
cagauagauauaugcucug

SEQ ID NO: 2955638 - RNA, 19 nt, Human
cagauacuuggggggcuga

SEQ ID NO: 2955639 - RNA, 16 nt, Human
cagaggggguggccuc

SEQ ID NO: 2955640 - RNA, 14 nt, Human
cagaggggguggcc

SEQ ID NO: 2955641 - RNA, 23 nt, Human
cagagacuccugcaggcagccag

SEQ ID NO: 2955642 - RNA, 12 nt, Human
cagagagggugg

SEQ ID NO: 2955643 - RNA, 17 nt, Human
cagagaggguggugacc

SEQ ID NO: 2955644 - RNA, 20 nt, Human
cagagaggguggugaccucu

SEQ ID NO: 2955645 - RNA, 22 nt, Human
cagagaggguggugaccucugc

SEQ ID NO: 2955646 - RNA, 23 nt, Human
cagagagggugggagugggccca

SEQ ID NO: 2955647 - RNA, 23 nt, Human
cagagaggguggugaccucugcc

SEQ ID NO: 2955648 - RNA, 20 nt, Human
cagagagguuaaggugggua

SEQ ID NO: 2955649 - RNA, 17 nt, Human
cagagcugcccucuccu

SEQ ID NO: 2955650 - RNA, 13 nt, Human
cagagcugccacc

SEQ ID NO: 2955651 - RNA, 13 nt, Human
cagaggggguggc

SEQ ID NO: 2955652 - RNA, 19 nt, Human
cagaggaaagcaaaggaga

SEQ ID NO: 2955653 - RNA, 17 nt, Human
cagaggaaagcaaagga

SEQ ID NO: 2955654 - RNA, 23 nt, Human
cagagcugcccucuccugggcag

SEQ ID NO: 2955655 - RNA, 18 nt, Human
cagagcugcccucuccug

SEQ ID NO: 2955656 - RNA, 19 nt, Human
cagagcugcccucuccugg

SEQ ID NO: 2955657 - RNA, 20 nt, Human
cagagcugcccucuccuggg

SEQ ID NO: 2955658 - RNA, 21 nt, Human
cagagcugcccucuccugggc

SEQ ID NO: 2955659 - RNA, 19 nt, Human
cagauuucacucuccuugg

SEQ ID NO: 2955660 - RNA, 17 nt, Human
cagcaccaucucuccuc

SEQ ID NO: 2955661 - RNA, 19 nt, Human
cagcaccaucucuccuccu

SEQ ID NO: 2955662 - RNA, 20 nt, Human
cagauuucacucuccuuggu

SEQ ID NO: 2955663 - RNA, 19 nt, Human
cagauugcaacaggcuggg

SEQ ID NO: 2955664 - RNA, 20 nt, Human
cagauugcaacaggcugggc

SEQ ID NO: 2955665 - RNA, 18 nt, Human
cagauugcaacaggcugg

SEQ ID NO: 2955666 - RNA, 14 nt, Human
cagcacgauuucug

SEQ ID NO: 2955667 - RNA, 15 nt, Human
cagcacgauuucugu

SEQ ID NO: 2955668 - RNA, 14 nt, Human
cagccagacuggca

SEQ ID NO: 2955669 - RNA, 22 nt, Human
cagccagcaguucagagcugcc

SEQ ID NO: 2955670 - RNA, 23 nt, Human
cagccagcaguucagagcugccc

SEQ ID NO: 2955671 - RNA, 18 nt, Human
cagccagacuggcacagu

SEQ ID NO: 2955672 - RNA, 15 nt, Human
cagccagacuggcac

SEQ ID NO: 2955673 - RNA, 12 nt, Human
cagccaggcccu

SEQ ID NO: 2955674 - RNA, 15 nt, Human
cagccugcuccagcu

SEQ ID NO: 2955675 - RNA, 19 nt, Human
cagccugcuccagcuguuc

SEQ ID NO: 2955676 - RNA, 17 nt, Human
cagccugcuccagcugu

SEQ ID NO: 2955677 - RNA, 16 nt, Human
cagccugcuccagcug

SEQ ID NO: 2955678 - RNA, 19 nt, Human
cagcguuucuaugacacau

SEQ ID NO: 2955679 - RNA, 22 nt, Human
cagcuaaagaaguuugaacauu

SEQ ID NO: 2955680 - RNA, 15 nt, Human
cagcuaacauggaag

SEQ ID NO: 2955681 - RNA, 21 nt, Human
cagcugacuuuucuguccgag

SEQ ID NO: 2955682 - RNA, 10 nt, Human
cagcugccuc

SEQ ID NO: 2955683 - RNA, 11 nt, Human
cagcugccucc

SEQ ID NO: 2955684 - RNA, 9 nt, Human
cagcugccu

SEQ ID NO: 2955685 - RNA, 14 nt, Human
cagcugccuccccu

SEQ ID NO: 2955686 - RNA, 15 nt, Human
cagcugccuccccuc

SEQ ID NO: 2955687 - RNA, 16 nt, Human
cagcugccuccccucc

SEQ ID NO: 2955688 - RNA, 17 nt, Human
cagcugccuccccuccu

SEQ ID NO: 2955689 - RNA, 18 nt, Human
cagcugccuccccuccuc

SEQ ID NO: 2955690 - RNA, 19 nt, Human
cagcugccuccccuccucu

SEQ ID NO: 2955691 - RNA, 20 nt, Human
cagcugccuccccuccucug

SEQ ID NO: 2955692 - RNA, 19 nt, Human
cagcuguaugauucccagc

SEQ ID NO: 2955693 - RNA, 17 nt, Human
cagcuuauucacaagac

SEQ ID NO: 2955694 - RNA, 20 nt, Human
cagcuuauugucuagugaaa

SEQ ID NO: 2955695 - RNA, 20 nt, Human
cagcuguaugauucccagcc

SEQ ID NO: 2955696 - RNA, 14 nt, Human
cagcuuauugucua

SEQ ID NO: 2955697 - RNA, 20 nt, Human
caggaaaggcuccaggagca

SEQ ID NO: 2955698 - RNA, 19 nt, Human
caggaaaggcuccaggagc

SEQ ID NO: 2955699 - RNA, 16 nt, Human
caggaaagagaacuuc

SEQ ID NO: 2955700 - RNA, 17 nt, Human
caggaaaggcuccagga

SEQ ID NO: 2955701 - RNA, 16 nt, Human
caggaaaggcuccagg

SEQ ID NO: 2955702 - RNA, 19 nt, Human
caggcaccuguagucccag

SEQ ID NO: 2955703 - RNA, 12 nt, Human
caggccaggccc

SEQ ID NO: 2955704 - RNA, 11 nt, Human
caggccaggcc

SEQ ID NO: 2955705 - RNA, 19 nt, Human
caggaggaucacuugaguc

SEQ ID NO: 2955706 - RNA, 22 nt, Human
caggaggccagccuugaccauu

SEQ ID NO: 2955707 - RNA, 19 nt, Human
caggaggccagccuugacc

SEQ ID NO: 2955708 - RNA, 18 nt, Human
caggaggccagccuugac

SEQ ID NO: 2955709 - RNA, 14 nt, Human
caggcaaugcuggc

SEQ ID NO: 2955710 - RNA, 15 nt, Human
caggcaaugcuggcu

SEQ ID NO: 2955711 - RNA, 16 nt, Human
caggcaaugcuggcug

SEQ ID NO: 2955712 - RNA, 17 nt, Human
caggcaaugcuggcugu

SEQ ID NO: 2955713 - RNA, 23 nt, Human
caggaccucaggugagaagcaga

SEQ ID NO: 2955714 - RNA, 16 nt, Human
caggaccucaggugag

SEQ ID NO: 2955715 - RNA, 21 nt, Human
caggaccagggauuuccauga

SEQ ID NO: 2955716 - RNA, 23 nt, Human
caggcugggagagccuuccaggg

SEQ ID NO: 2955717 - RNA, 22 nt, Human
caggcugggagagccuuccagg

SEQ ID NO: 2955718 - RNA, 17 nt, Human
caggggaaaaucagccu

SEQ ID NO: 2955719 - RNA, 16 nt, Human
caggggaaaagaggag

SEQ ID NO: 2955720 - RNA, 14 nt, Human
caggggaaaagagg

SEQ ID NO: 2955721 - RNA, 14 nt, Human
caggccuccuacag

SEQ ID NO: 2955722 - RNA, 12 nt, Human
caggccuccuac

SEQ ID NO: 2955723 - RNA, 20 nt, Human
caggcugggagagccuucca

SEQ ID NO: 2955724 - RNA, 21 nt, Human
caggcugggagagccuuccag

SEQ ID NO: 2955725 - RNA, 11 nt, Human
caggcuacugu

SEQ ID NO: 2955726 - RNA, 18 nt, Human
caauauuuaaucuuuuau

SEQ ID NO: 2955727 - RNA, 21 nt, Human
caauauuucagauaaucacaa

SEQ ID NO: 2955728 - RNA, 22 nt, Human
caauugugaaaaaauuuacuuu

SEQ ID NO: 2955729 - RNA, 13 nt, Human
caauggcagccuu

SEQ ID NO: 2955730 - RNA, 14 nt, Human
caauggcagccuug

SEQ ID NO: 2955731 - RNA, 15 nt, Human
caauggcagccuugg

SEQ ID NO: 2955732 - RNA, 14 nt, Human
caaucaaaucugcu

SEQ ID NO: 2955733 - RNA, 17 nt, Human
caaucagccuaguugau

SEQ ID NO: 2955734 - RNA, 17 nt, Human
cacaaggaaauaaaauu

SEQ ID NO: 2955735 - RNA, 13 nt, Human
caauuuauuaugg

SEQ ID NO: 2955736 - RNA, 23 nt, Human
caauugugaaaaaauuuacuuua

SEQ ID NO: 2955737 - RNA, 20 nt, Human
caauuuauuauggcacauca

SEQ ID NO: 2955738 - RNA, 15 nt, Human
caagcucugcuccuc

SEQ ID NO: 2955739 - RNA, 16 nt, Human
caagcucugcuccucu

SEQ ID NO: 2955740 - RNA, 17 nt, Human
caagcucccaggcauuc

SEQ ID NO: 2955741 - RNA, 15 nt, Human
caagcucccaggcau

SEQ ID NO: 2955742 - RNA, 14 nt, Human
caagcucccaggca

SEQ ID NO: 2955743 - RNA, 12 nt, Human
caagcucccagg

SEQ ID NO: 2955744 - RNA, 21 nt, Human
caagcuccaagcucccaggca

SEQ ID NO: 2955745 - RNA, 19 nt, Human
caagcuccaagcucccagg

SEQ ID NO: 2955746 - RNA, 18 nt, Human
caagcuccaagcucccag

SEQ ID NO: 2955747 - RNA, 17 nt, Human
caagcuccaagcuccca

SEQ ID NO: 2955748 - RNA, 13 nt, Human
caaguauuauacc

SEQ ID NO: 2955749 - RNA, 17 nt, Human
caaguauuauaccuuuu

SEQ ID NO: 2955750 - RNA, 22 nt, Human
caaguauuauaccuuuuuuaga

SEQ ID NO: 2955751 - RNA, 13 nt, Human
caaggcaaauguu

SEQ ID NO: 2955752 - RNA, 14 nt, Human
caaggcaaggcugu

SEQ ID NO: 2955753 - RNA, 19 nt, Human
caaggauugcuacuguccu

SEQ ID NO: 2955754 - RNA, 20 nt, Human
caaggauugcuacuguccua

SEQ ID NO: 2955755 - RNA, 20 nt, Human
caaguuauuuuuaauuuggu

SEQ ID NO: 2955756 - RNA, 19 nt, Human
caacuauauuguuugcuaa

SEQ ID NO: 2955757 - RNA, 19 nt, Human
caacuaucucauuuccaag

SEQ ID NO: 2955758 - RNA, 17 nt, Human
caaccccuucgcuccug

SEQ ID NO: 2955759 - RNA, 14 nt, Human
caaccccuucgcuc

SEQ ID NO: 2955760 - RNA, 16 nt, Human
caaccccuucgcuccu

SEQ ID NO: 2955761 - RNA, 14 nt, Human
caacccccagccug

SEQ ID NO: 2955762 - RNA, 17 nt, Human
caagaaggaugauucaa

SEQ ID NO: 2955763 - RNA, 18 nt, Human
caagaagcccaggaaagg

SEQ ID NO: 2955764 - RNA, 15 nt, Human
caagaagcccaggaa

SEQ ID NO: 2955765 - RNA, 12 nt, Human
caacuccagaaa

SEQ ID NO: 2955766 - RNA, 14 nt, Human
caagcaaguauuag

SEQ ID NO: 2955767 - RNA, 14 nt, Human
caagaccacguuuc

SEQ ID NO: 2955768 - RNA, 16 nt, Human
caagaccacguuucua

SEQ ID NO: 2955769 - RNA, 13 nt, Human
caagcaccuccug

SEQ ID NO: 2955770 - RNA, 14 nt, Human
caagcaccuccugc

SEQ ID NO: 2955771 - RNA, 15 nt, Human
cacuacauucuguua

SEQ ID NO: 2955772 - RNA, 22 nt, Human
cacggaagagccuugcggaagg

SEQ ID NO: 2955773 - RNA, 16 nt, Human
cacggaagagccuugc

SEQ ID NO: 2955774 - RNA, 21 nt, Human
cacuacauuauaaaugucucu

SEQ ID NO: 2955775 - RNA, 13 nt, Human
cacuacauucugu

SEQ ID NO: 2955776 - RNA, 14 nt, Human
cacuacauucuguu

SEQ ID NO: 2955777 - RNA, 21 nt, Human
cacgcuggagugcagugagcc

SEQ ID NO: 2955778 - RNA, 16 nt, Human
cacgcuggagugcagu

SEQ ID NO: 2955779 - RNA, 17 nt, Human
cacgcuggagugcagug

SEQ ID NO: 2955780 - RNA, 18 nt, Human
cacgcuggagugcaguga

SEQ ID NO: 2955781 - RNA, 20 nt, Human
cacgcuggagugcagugagc

SEQ ID NO: 2955782 - RNA, 15 nt, Human
cacgcuggagugcag

SEQ ID NO: 2955783 - RNA, 11 nt, Human
cacugaagaag

SEQ ID NO: 2955784 - RNA, 23 nt, Human
cacugaagaagcaccaaucauga

SEQ ID NO: 2955785 - RNA, 16 nt, Human
cacuccagugagacag

SEQ ID NO: 2955786 - RNA, 21 nt, Human
cacuccagugagacagcucug

SEQ ID NO: 2955787 - RNA, 17 nt, Human
cacccuggggagaaagu

SEQ ID NO: 2955788 - RNA, 12 nt, Human
caccugccaggg

SEQ ID NO: 2955789 - RNA, 11 nt, Human
caccugccagg

SEQ ID NO: 2955790 - RNA, 21 nt, Human
caccugccccucaacucuccu

SEQ ID NO: 2955791 - RNA, 18 nt, Human
caccugccccucaacucu

SEQ ID NO: 2955792 - RNA, 12 nt, Human
cacccugcucuc

SEQ ID NO: 2955793 - RNA, 12 nt, Human
cacccuccuuuc

SEQ ID NO: 2955794 - RNA, 16 nt, Human
caccugcggugcuauc

SEQ ID NO: 2955795 - RNA, 19 nt, Human
caccugcggugcuaucucc

SEQ ID NO: 2955796 - RNA, 17 nt, Human
caccugcggugcuaucu

SEQ ID NO: 2955797 - RNA, 19 nt, Human
cacccaguccugcccgcca

SEQ ID NO: 2955798 - RNA, 12 nt, Human
cacccagcccac

SEQ ID NO: 2955799 - RNA, 23 nt, Human
cacaucuugcucugcugacagac

SEQ ID NO: 2955800 - RNA, 19 nt, Human
cacaucuugcucugcugac

SEQ ID NO: 2955801 - RNA, 17 nt, Human
cacauuuauucugcuca

SEQ ID NO: 2955802 - RNA, 18 nt, Human
cacauuuauucugcucac

SEQ ID NO: 2955803 - RNA, 17 nt, Human
caccagccccagugccc

SEQ ID NO: 2955804 - RNA, 18 nt, Human
caccagccccagugccca

SEQ ID NO: 2955805 - RNA, 21 nt, Human
caccagccccagugcccacag

SEQ ID NO: 2955806 - RNA, 22 nt, Human
caccagccccagugcccacagg

SEQ ID NO: 2955807 - RNA, 19 nt, Human
caccagcccuuagcaggga

SEQ ID NO: 2955808 - RNA, 13 nt, Human
cacaucuugcucu

SEQ ID NO: 2955809 - RNA, 14 nt, Human
cacaucuugcucug

SEQ ID NO: 2955810 - RNA, 15 nt, Human
cacaucuugcucugc

SEQ ID NO: 2955811 - RNA, 20 nt, Human
cacaucuugcucugcugaca

SEQ ID NO: 2955812 - RNA, 21 nt, Human
cacaucuugcucugcugacag

SEQ ID NO: 2955813 - RNA, 22 nt, Human
cacaucuugcucugcugacaga

SEQ ID NO: 2955814 - RNA, 23 nt, Human
cacaucagcuugcccuguuaaaa

SEQ ID NO: 2955815 - RNA, 13 nt, Human
cacaucagcuugc

SEQ ID NO: 2955816 - RNA, 17 nt, Human
auuuucuccaaauguuc

SEQ ID NO: 2955817 - RNA, 19 nt, Human
auuuucuauaauuuaaaua

SEQ ID NO: 2955818 - RNA, 18 nt, Human
auuuucuauaauuuaaau

SEQ ID NO: 2955819 - RNA, 17 nt, Human
auuuucuauaauuuaaa

SEQ ID NO: 2955820 - RNA, 14 nt, Human
auuuguuauaauga

SEQ ID NO: 2955821 - RNA, 18 nt, Human
auuuguguugaagagguu

SEQ ID NO: 2955822 - RNA, 22 nt, Human
auuuguguugaagagguuuuaa

SEQ ID NO: 2955823 - RNA, 20 nt, Human
auuugcacauuaaaugacuc

SEQ ID NO: 2955824 - RNA, 21 nt, Human
auuugcacauuaaaugacucu

SEQ ID NO: 2955825 - RNA, 14 nt, Human
auuuguguugaaga

SEQ ID NO: 2955826 - RNA, 15 nt, Human
auuuguguugaagag

SEQ ID NO: 2955827 - RNA, 16 nt, Human
caaaccaucauugaaa

SEQ ID NO: 2955828 - RNA, 14 nt, Human
caaaccaucauuga

SEQ ID NO: 2955829 - RNA, 17 nt, Human
caaaccaucauugaaau

SEQ ID NO: 2955830 - RNA, 16 nt, Human
auuuuuauuaaauuau

SEQ ID NO: 2955831 - RNA, 16 nt, Human
auuuuuuucugaaauu

SEQ ID NO: 2955832 - RNA, 17 nt, Human
auuuuuuucugaaauuu

SEQ ID NO: 2955833 - RNA, 22 nt, Human
auuuuguuuuugucuuaaaaag

SEQ ID NO: 2955834 - RNA, 16 nt, Human
auuuuuauauuugaaa

SEQ ID NO: 2955835 - RNA, 19 nt, Human
auuuuuauauuugaaauau

SEQ ID NO: 2955836 - RNA, 17 nt, Human
caaacauauauaacaau

SEQ ID NO: 2955837 - RNA, 20 nt, Human
caaaagguuaauaaaguaau

SEQ ID NO: 2955838 - RNA, 21 nt, Human
caaaagguauuuuaaucacca

SEQ ID NO: 2955839 - RNA, 19 nt, Human
caaaagcaucuaugugaga

SEQ ID NO: 2955840 - RNA, 13 nt, Human
caaaagcauguga

SEQ ID NO: 2955841 - RNA, 17 nt, Human
auuucacaguguguggu

SEQ ID NO: 2955842 - RNA, 16 nt, Human
auuuauccucuguuga

SEQ ID NO: 2955843 - RNA, 12 nt, Human
auuuauccucug

SEQ ID NO: 2955844 - RNA, 12 nt, Human
auuucacucucc

SEQ ID NO: 2955845 - RNA, 16 nt, Human
auuucagcagcugcag

SEQ ID NO: 2955846 - RNA, 14 nt, Human
auuucacucuccuu

SEQ ID NO: 2955847 - RNA, 22 nt, Human
auuuaauuugaagguagaaugu

SEQ ID NO: 2955848 - RNA, 15 nt, Human
auuuaauuugaaggu

SEQ ID NO: 2955849 - RNA, 13 nt, Human
auuuaauuugaag

SEQ ID NO: 2955850 - RNA, 19 nt, Human
auuuaauugggcacuauuu

SEQ ID NO: 2955851 - RNA, 22 nt, Human
auuuaauagguuuggacaaaau

SEQ ID NO: 2955852 - RNA, 14 nt, Human
auuugcacauuaaa

SEQ ID NO: 2955853 - RNA, 15 nt, Human
auuugcacauuaaau

SEQ ID NO: 2955854 - RNA, 17 nt, Human
auuugcacauuaaauga

SEQ ID NO: 2955855 - RNA, 19 nt, Human
auuugcacauuaaaugacu

SEQ ID NO: 2955856 - RNA, 17 nt, Human
auuucucucaucuguua

SEQ ID NO: 2955857 - RNA, 20 nt, Human
auuucuguuuagauaauaca

SEQ ID NO: 2955858 - RNA, 19 nt, Human
auuucuguuuagauaauac

SEQ ID NO: 2955859 - RNA, 21 nt, Human
auuucuguuuagauaauacac

SEQ ID NO: 2955860 - RNA, 15 nt, Human
auucauuaguuuuga

SEQ ID NO: 2955861 - RNA, 14 nt, Human
auucauuaguuuug

SEQ ID NO: 2955862 - RNA, 14 nt, Human
auucauauuuacuu

SEQ ID NO: 2955863 - RNA, 15 nt, Human
auucucuuauccaac

SEQ ID NO: 2955864 - RNA, 15 nt, Human
auucauucuuuuuga

SEQ ID NO: 2955865 - RNA, 21 nt, Human
auucauucuuuuugaaauguc

SEQ ID NO: 2955866 - RNA, 16 nt, Human
auucauucuuuuugaa

SEQ ID NO: 2955867 - RNA, 20 nt, Human
auucucuaguuugauuaaau

SEQ ID NO: 2955868 - RNA, 19 nt, Human
auucucuaguuugauuaaa

SEQ ID NO: 2955869 - RNA, 23 nt, Human
auucucuaguuugauuaaauucu

SEQ ID NO: 2955870 - RNA, 12 nt, Human
auucucuuaucc

SEQ ID NO: 2955871 - RNA, 14 nt, Human
auucucuuauccaa

SEQ ID NO: 2955872 - RNA, 22 nt, Human
auugaggacacugauauggguc

SEQ ID NO: 2955873 - RNA, 20 nt, Human
auuaaugucaguauuucaac

SEQ ID NO: 2955874 - RNA, 22 nt, Human
auuacaagcgugagccacugca

SEQ ID NO: 2955875 - RNA, 16 nt, Human
ggcucccuucccaccu

SEQ ID NO: 2955876 - RNA, 18 nt, Human
ggcucccuucccaccucu

SEQ ID NO: 2955877 - RNA, 17 nt, Human
ggcucccuucccaccuc

SEQ ID NO: 2955878 - RNA, 22 nt, Human
ggcucccuucccaccucucuca

SEQ ID NO: 2955879 - RNA, 20 nt, Human
ggcucccuucccaccucucu

SEQ ID NO: 2955880 - RNA, 14 nt, Human
ggcugccagugccu

SEQ ID NO: 2955881 - RNA, 20 nt, Human
ggcugcaugcgggcuuccuc

SEQ ID NO: 2955882 - RNA, 17 nt, Human
ggcugcagggaguccga

SEQ ID NO: 2955883 - RNA, 18 nt, Human
ggcucgagcaugccugga

SEQ ID NO: 2955884 - RNA, 24 nt, Human
ggcucuuccaggcugggagagccu

SEQ ID NO: 2955885 - RNA, 23 nt, Human
ggcucuuccaggcugggagagcc

SEQ ID NO: 2955886 - RNA, 20 nt, Human
ggcucuuccaggcugggaga

SEQ ID NO: 2955887 - RNA, 15 nt, Human
ggcugccagugccug

SEQ ID NO: 2955888 - RNA, 17 nt, Human
ggcugccagugccuggg

SEQ ID NO: 2955889 - RNA, 18 nt, Human
ggcugccagugccugggu

SEQ ID NO: 2955890 - RNA, 14 nt, Human
ggcuggcgugcagu

SEQ ID NO: 2955891 - RNA, 16 nt, Human
ggcuggcgugcagugg

SEQ ID NO: 2955892 - RNA, 20 nt, Human
ggcuggcgugcaguggugcg

SEQ ID NO: 2955893 - RNA, 22 nt, Human
ggcuggccuggccccucagggu

SEQ ID NO: 2955894 - RNA, 17 nt, Human
ggcuggccuggccccuc

SEQ ID NO: 2955895 - RNA, 13 nt, Human
aaaaaaacacaaa

SEQ ID NO: 2955896 - RNA, 15 nt, Human
ggcuucaguggcagc

SEQ ID NO: 2955897 - RNA, 20 nt, Human
ggcuguaucccaugagccuc

SEQ ID NO: 2955898 - RNA, 22 nt, Human
ggcuguaucccaugagccucag

SEQ ID NO: 2955899 - RNA, 23 nt, Human
ggcuguaucccaugagccucagc

SEQ ID NO: 2955900 - RNA, 15 nt, Human
ggcugucaauuacag

SEQ ID NO: 2955901 - RNA, 19 nt, Human
ggcuguaucccaugagccu

SEQ ID NO: 2955902 - RNA, 16 nt, Human
ggcuggugucaccuga

SEQ ID NO: 2955903 - RNA, 16 nt, Human
ggcuucaguggcagcu

SEQ ID NO: 2955904 - RNA, 13 nt, Human
gggaaaaucagcc

SEQ ID NO: 2955905 - RNA, 23 nt, Human
gggaaaaucagccugcuccagcu

SEQ ID NO: 2955906 - RNA, 21 nt, Human
gggauuuucagcccucagaau

SEQ ID NO: 2955907 - RNA, 23 nt, Human
gggcagagcagagaccaucccug

SEQ ID NO: 2955908 - RNA, 15 nt, Human
gggauuuccaugaug

SEQ ID NO: 2955909 - RNA, 17 nt, Human
gggauugaaggaugcug

SEQ ID NO: 2955910 - RNA, 20 nt, Human
gggcagcugccuccccuccu

SEQ ID NO: 2955911 - RNA, 23 nt, Human
gggcagcugccuccccuccucug

SEQ ID NO: 2955912 - RNA, 12 nt, Human
gggcagcugccu

SEQ ID NO: 2955913 - RNA, 13 nt, Human
gggcagcugccuc

SEQ ID NO: 2955914 - RNA, 14 nt, Human
gggcagcugccucc

SEQ ID NO: 2955915 - RNA, 19 nt, Human
gggcagcugccuccccucc

SEQ ID NO: 2955916 - RNA, 18 nt, Human
aaaauaguggugugauuu

SEQ ID NO: 2955917 - RNA, 12 nt, Human
aaaauagccugc

SEQ ID NO: 2955918 - RNA, 14 nt, Human
aaaauaccaaggaa

SEQ ID NO: 2955919 - RNA, 15 nt, Human
aaaauaccagccagu

SEQ ID NO: 2955920 - RNA, 14 nt, Human
aaaauaccagccag

SEQ ID NO: 2955921 - RNA, 21 nt, Human
aaaauaauuuuuauauuugaa

SEQ ID NO: 2955922 - RNA, 23 nt, Human
aaaauaauuuuuauauuugaaau

SEQ ID NO: 2955923 - RNA, 20 nt, Human
aaaauaauuuuuauauuuga

SEQ ID NO: 2955924 - RNA, 12 nt, Human
aaaauaaauuau

SEQ ID NO: 2955925 - RNA, 21 nt, Human
aaaacguggcugcuucaagga

SEQ ID NO: 2955926 - RNA, 22 nt, Human
aaaacugauuuuuuuuuccuuc

SEQ ID NO: 2955927 - RNA, 18 nt, Human
aaaacugauuuuuuuuuc

SEQ ID NO: 2955928 - RNA, 15 nt, Human
aaaaccaauguucuc

SEQ ID NO: 2955929 - RNA, 18 nt, Human
aaaacguggcugcuucaa

SEQ ID NO: 2955930 - RNA, 17 nt, Human
aaaacguggcugcuuca

SEQ ID NO: 2955931 - RNA, 16 nt, Human
aaaacguggcugcuuc

SEQ ID NO: 2955932 - RNA, 14 nt, Human
aaaacguggcugcu

SEQ ID NO: 2955933 - RNA, 14 nt, Human
gggaacagacugga

SEQ ID NO: 2955934 - RNA, 22 nt, Human
gggaacagacuggaagcacagc

SEQ ID NO: 2955935 - RNA, 17 nt, Human
aaaaaucucaaauuucu

SEQ ID NO: 2955936 - RNA, 19 nt, Human
aaaaaucucaaauuucuaa

SEQ ID NO: 2955937 - RNA, 20 nt, Human
aaaaaucucaaauuucuaaa

SEQ ID NO: 2955938 - RNA, 13 nt, Human
gggagggcuccag

SEQ ID NO: 2955939 - RNA, 11 nt, Human
gggagggcucc

SEQ ID NO: 2955940 - RNA, 20 nt, Human
gggaggcagagguugcagug

SEQ ID NO: 2955941 - RNA, 11 nt, Human
gggaggcagag

SEQ ID NO: 2955942 - RNA, 14 nt, Human
aaaagcugggcagg

SEQ ID NO: 2955943 - RNA, 22 nt, Human
aaaagcuccauuuuuagugaaa

SEQ ID NO: 2955944 - RNA, 20 nt, Human
aaaagccucuguuuugauau

SEQ ID NO: 2955945 - RNA, 21 nt, Human
aaaacuuuaugcuaagugaaa

SEQ ID NO: 2955946 - RNA, 22 nt, Human
aaaacuugauguguuaucucuu

SEQ ID NO: 2955947 - RNA, 18 nt, Human
aaacuacauugacagauu

SEQ ID NO: 2955948 - RNA, 16 nt, Human
aaacucauuucuagca

SEQ ID NO: 2955949 - RNA, 15 nt, Human
aaacuggcaaagcag

SEQ ID NO: 2955950 - RNA, 16 nt, Human
aaacuggcaaagcaga

SEQ ID NO: 2955951 - RNA, 16 nt, Human
aaacuggauuaaacuu

SEQ ID NO: 2955952 - RNA, 21 nt, Human
aaacuacauuagguugugaau

SEQ ID NO: 2955953 - RNA, 22 nt, Human
aaacuacauuagguugugaaug

SEQ ID NO: 2955954 - RNA, 20 nt, Human
aaacuacauuagguugugaa

SEQ ID NO: 2955955 - RNA, 17 nt, Human
aaacguggcugcuucaa

SEQ ID NO: 2955956 - RNA, 15 nt, Human
aaacgucuuaaauau

SEQ ID NO: 2955957 - RNA, 16 nt, Human
aaacguggcugcuuca

SEQ ID NO: 2955958 - RNA, 15 nt, Human
aaaccacagcaguug

SEQ ID NO: 2955959 - RNA, 16 nt, Human
aaaccacagcaguuga

SEQ ID NO: 2955960 - RNA, 22 nt, Human
gggucucacuauguugcccagg

SEQ ID NO: 2955961 - RNA, 23 nt, Human
gggucucacuauguugcccaggc

SEQ ID NO: 2955962 - RNA, 22 nt, Human
gggucacucuggcagcucagag

SEQ ID NO: 2955963 - RNA, 20 nt, Human
ggguaucaggugcugccauc

SEQ ID NO: 2955964 - RNA, 21 nt, Human
aaaauguaggguuauaauaau

SEQ ID NO: 2955965 - RNA, 12 nt, Human
aaaauggaauac

SEQ ID NO: 2955966 - RNA, 21 nt, Human
aaaauggacguguuaugacuc

SEQ ID NO: 2955967 - RNA, 16 nt, Human
aaacaaaauagaaagu

SEQ ID NO: 2955968 - RNA, 19 nt, Human
aaaauuuuuucucuaggaa

SEQ ID NO: 2955969 - RNA, 17 nt, Human
aaacaaggaugaauuaa

SEQ ID NO: 2955970 - RNA, 23 nt, Human
aaacaugcuguacauacuuuuug

SEQ ID NO: 2955971 - RNA, 22 nt, Human
aaacaugcuguacauacuuuuu

SEQ ID NO: 2955972 - RNA, 24 nt, Human
ggggaaaaucagccugcuccagcu

SEQ ID NO: 2955973 - RNA, 20 nt, Human
aaacaugcuguacauacuuu

SEQ ID NO: 2955974 - RNA, 21 nt, Human
aaacaugcuguacauacuuuu

SEQ ID NO: 2955975 - RNA, 17 nt, Human
ggggaccucaggccugg

SEQ ID NO: 2955976 - RNA, 16 nt, Human
ggggaccucaggccug

SEQ ID NO: 2955977 - RNA, 15 nt, Human
ggggaccucaggccu

SEQ ID NO: 2955978 - RNA, 13 nt, Human
ggggaccucaggc

SEQ ID NO: 2955979 - RNA, 23 nt, Human
ggggcccugccuccuuugugagg

SEQ ID NO: 2955980 - RNA, 19 nt, Human
ggggcccugccuccuuugu

SEQ ID NO: 2955981 - RNA, 15 nt, Human
ggggcccugccuccu

SEQ ID NO: 2955982 - RNA, 16 nt, Human
ggggcccugccuccuu

SEQ ID NO: 2955983 - RNA, 17 nt, Human
ggggccaguuggucccc

SEQ ID NO: 2955984 - RNA, 19 nt, Human
aaacaagucagucauucag

SEQ ID NO: 2955985 - RNA, 14 nt, Human
aaacacaacuauau

SEQ ID NO: 2955986 - RNA, 13 nt, Human
aaacauauauaac

SEQ ID NO: 2955987 - RNA, 16 nt, Human
aaacauauauaacaau

SEQ ID NO: 2955988 - RNA, 19 nt, Human
aaacauauauaacaaugcu

SEQ ID NO: 2955989 - RNA, 21 nt, Human
aaacauauauaacaaugcugu

SEQ ID NO: 2955990 - RNA, 16 nt, Human
aaacaugcuacacacu

SEQ ID NO: 2955991 - RNA, 22 nt, Human
aaacaugcuacacacugcaugu

SEQ ID NO: 2955992 - RNA, 19 nt, Human
aaacauauccaaguuugaa

SEQ ID NO: 2955993 - RNA, 14 nt, Human
aaacauaucucuua

SEQ ID NO: 2955994 - RNA, 15 nt, Human
aaacaugcuguacau

SEQ ID NO: 2955995 - RNA, 16 nt, Human
aaacaugcuguacaua

SEQ ID NO: 2955996 - RNA, 18 nt, Human
aaacaugcuguacauacu

SEQ ID NO: 2955997 - RNA, 20 nt, Human
ggugauuuagcaggaagcug

SEQ ID NO: 2955998 - RNA, 22 nt, Human
ggugcacaagcuccaagcuccc

SEQ ID NO: 2955999 - RNA, 16 nt, Human
ggugcacaagcuccaa

SEQ ID NO: 2956000 - RNA, 15 nt, Human
ggugccaguuauggc

SEQ ID NO: 2956001 - RNA, 21 nt, Human
ggucuugaacuccuggccuca

SEQ ID NO: 2956002 - RNA, 22 nt, Human
ggucuugaacuccuggccucaa

SEQ ID NO: 2956003 - RNA, 17 nt, Human
ggucuguucuuuccaaa

SEQ ID NO: 2956004 - RNA, 19 nt, Human
ggucuguucuuuccaaagu

SEQ ID NO: 2956005 - RNA, 14 nt, Human
ggucugucuuuuaa

SEQ ID NO: 2956006 - RNA, 13 nt, Human
ggucugucuuuua

SEQ ID NO: 2956007 - RNA, 12 nt, Human
ggucuguucuuu

SEQ ID NO: 2956008 - RNA, 14 nt, Human
ggucugugagaugc

SEQ ID NO: 2956009 - RNA, 24 nt, Human
ggucugugagaugcuagaacuccc

SEQ ID NO: 2956010 - RNA, 16 nt, Human
aaagcuacuuauugua

SEQ ID NO: 2956011 - RNA, 17 nt, Human
aaagcuacuuauuguag

SEQ ID NO: 2956012 - RNA, 17 nt, Human
aaagcuaggccuggcca

SEQ ID NO: 2956013 - RNA, 18 nt, Human
aaagcuaggccuggccag

SEQ ID NO: 2956014 - RNA, 16 nt, Human
aaagcagugcaugcug

SEQ ID NO: 2956015 - RNA, 22 nt, Human
aaagcagugcaugcugucccuu

SEQ ID NO: 2956016 - RNA, 21 nt, Human
aaagcagugcaugcugucccu

SEQ ID NO: 2956017 - RNA, 17 nt, Human
aaagcagugcaugcugu

SEQ ID NO: 2956018 - RNA, 13 nt, Human
aaagcuuauuaaa

SEQ ID NO: 2956019 - RNA, 19 nt, Human
aaaggaaugcaaagaugaa

SEQ ID NO: 2956020 - RNA, 22 nt, Human
aaaggaaugcaaagaugaaggu

SEQ ID NO: 2956021 - RNA, 11 nt, Human
aaaggaaagag

SEQ ID NO: 2956022 - RNA, 13 nt, Human
aaaggaauuuaaa

SEQ ID NO: 2956023 - RNA, 15 nt, Human
aaagaugagugagca

SEQ ID NO: 2956024 - RNA, 18 nt, Human
aaagaggcuaugugagca

SEQ ID NO: 2956025 - RNA, 13 nt, Human
aaagaggcuaugu

SEQ ID NO: 2956026 - RNA, 20 nt, Human
aaagaggcagcuugaaacug

SEQ ID NO: 2956027 - RNA, 23 nt, Human
aaagacuucucuacccaucuuaa

SEQ ID NO: 2956028 - RNA, 19 nt, Human
aaagacuuuuccaacccuc

SEQ ID NO: 2956029 - RNA, 18 nt, Human
aaagagaacuuccagauc

SEQ ID NO: 2956030 - RNA, 22 nt, Human
aaagacuauucaaacagucuca

SEQ ID NO: 2956031 - RNA, 23 nt, Human
aaagacuauucaaacagucucag

SEQ ID NO: 2956032 - RNA, 13 nt, Human
aaagacuccaaag

SEQ ID NO: 2956033 - RNA, 15 nt, Human
aaagacuguacaaag

SEQ ID NO: 2956034 - RNA, 19 nt, Human
gguccacccaggagccccg

SEQ ID NO: 2956035 - RNA, 23 nt, Human
gguauuggcuagagguucaaaga

SEQ ID NO: 2956036 - RNA, 20 nt, Human
gguccacccaggagccccga

SEQ ID NO: 2956037 - RNA, 22 nt, Human
gguccacccaggagccccgagg

SEQ ID NO: 2956038 - RNA, 12 nt, Human
ggucccacccca

SEQ ID NO: 2956039 - RNA, 14 nt, Human
aaacuuuaccuuuu

SEQ ID NO: 2956040 - RNA, 16 nt, Human
aaagaaugauuaugaa

SEQ ID NO: 2956041 - RNA, 12 nt, Human
ggcagaaggaag

SEQ ID NO: 2956042 - RNA, 17 nt, Human
ggcagccaggccacaag

SEQ ID NO: 2956043 - RNA, 15 nt, Human
ggcagccaggccaca

SEQ ID NO: 2956044 - RNA, 10 nt, Human
ggcagagcag

SEQ ID NO: 2956045 - RNA, 14 nt, Human
ggcagccaggccac

SEQ ID NO: 2956046 - RNA, 20 nt, Human
ggcaacagagcaagacucca

SEQ ID NO: 2956047 - RNA, 21 nt, Human
ggaugaauuccaaauucugcu

SEQ ID NO: 2956048 - RNA, 12 nt, Human
ggaugagaaagg

SEQ ID NO: 2956049 - RNA, 22 nt, Human
ggaugagaaagguugaagcacc

SEQ ID NO: 2956050 - RNA, 22 nt, Human
ggaugguucccuugaugaagaa

SEQ ID NO: 2956051 - RNA, 23 nt, Human
ggaugguucccuugaugaagaag

SEQ ID NO: 2956052 - RNA, 22 nt, Human
ggauguugaaaaaguucugcag

SEQ ID NO: 2956053 - RNA, 16 nt, Human
ggcaaauguuuauuua

SEQ ID NO: 2956054 - RNA, 16 nt, Human
ggcaacagagcaagac

SEQ ID NO: 2956055 - RNA, 17 nt, Human
ggcaacagagcaagacu

SEQ ID NO: 2956056 - RNA, 14 nt, Human
ggcaaacagggccu

SEQ ID NO: 2956057 - RNA, 17 nt, Human
ggcaaacagggccucug

SEQ ID NO: 2956058 - RNA, 18 nt, Human
ggcaaacagggccucugc

SEQ ID NO: 2956059 - RNA, 23 nt, Human
ggauuaaacuuaaucuaaaugga

SEQ ID NO: 2956060 - RNA, 21 nt, Human
ggauuuugauccaagcugguc

SEQ ID NO: 2956061 - RNA, 12 nt, Human
ggauuuucagcc

SEQ ID NO: 2956062 - RNA, 16 nt, Human
ggccuccauccugagg

SEQ ID NO: 2956063 - RNA, 14 nt, Human
ggccucccaacuca

SEQ ID NO: 2956064 - RNA, 13 nt, Human
ggccucccaacuc

SEQ ID NO: 2956065 - RNA, 21 nt, Human
ggcccaggaguuuggccagaa

SEQ ID NO: 2956066 - RNA, 23 nt, Human
ggcccaggaguuuggccagaagu

SEQ ID NO: 2956067 - RNA, 22 nt, Human
ggcccaggaguuuggccagaag

SEQ ID NO: 2956068 - RNA, 12 nt, Human
ggcccagggcau

SEQ ID NO: 2956069 - RNA, 15 nt, Human
ggcccagggcaucug

SEQ ID NO: 2956070 - RNA, 16 nt, Human
ggccccaccagugccu

SEQ ID NO: 2956071 - RNA, 15 nt, Human
ggccccaccagugcc

SEQ ID NO: 2956072 - RNA, 16 nt, Human
ggcccagggcaucugg

SEQ ID NO: 2956073 - RNA, 23 nt, Human
ggcccuccagagccccacagccc

SEQ ID NO: 2956074 - RNA, 17 nt, Human
ggcccuccagagcccca

SEQ ID NO: 2956075 - RNA, 21 nt, Human
ggcccuccagagccccacagc

SEQ ID NO: 2956076 - RNA, 14 nt, Human
ggcccuccagagcc

SEQ ID NO: 2956077 - RNA, 15 nt, Human
ggcccuccagagccc

SEQ ID NO: 2956078 - RNA, 21 nt, Human
ggccaaaggaagcacaugccu

SEQ ID NO: 2956079 - RNA, 15 nt, Human
ggccaaagccaaagc

SEQ ID NO: 2956080 - RNA, 12 nt, Human
ggccaaaggaag

SEQ ID NO: 2956081 - RNA, 21 nt, Human
ggccaaacucaccugccccuc

SEQ ID NO: 2956082 - RNA, 12 nt, Human
ggcauuguggga

SEQ ID NO: 2956083 - RNA, 13 nt, Human
ggccaagguggga

SEQ ID NO: 2956084 - RNA, 22 nt, Human
ggccagagggagugacagaggc

SEQ ID NO: 2956085 - RNA, 23 nt, Human
ggccagagggagugacagaggca

SEQ ID NO: 2956086 - RNA, 17 nt, Human
ggccagaugcaccagcc

SEQ ID NO: 2956087 - RNA, 19 nt, Human
ggccagaugcaccagcccu

SEQ ID NO: 2956088 - RNA, 20 nt, Human
ggccagaugcaccagcccuu

SEQ ID NO: 2956089 - RNA, 21 nt, Human
ggagcagccacauuccugaug

SEQ ID NO: 2956090 - RNA, 13 nt, Human
ggagcagccacau

SEQ ID NO: 2956091 - RNA, 18 nt, Human
ggaggucgaggcaggagg

SEQ ID NO: 2956092 - RNA, 12 nt, Human
ggaggcugaggc

SEQ ID NO: 2956093 - RNA, 14 nt, Human
ggaggucgaggcag

SEQ ID NO: 2956094 - RNA, 16 nt, Human
ggaggucgaggcagga

SEQ ID NO: 2956095 - RNA, 15 nt, Human
ggaggucgaggcagg

SEQ ID NO: 2956096 - RNA, 15 nt, Human
ggaggcugagauggg

SEQ ID NO: 2956097 - RNA, 19 nt, Human
ggaggcugagaugggagaa

SEQ ID NO: 2956098 - RNA, 20 nt, Human
ggaggaaccgagggggcugc

SEQ ID NO: 2956099 - RNA, 12 nt, Human
ggaggaagagaa

SEQ ID NO: 2956100 - RNA, 21 nt, Human
ggaggcaugugaugagaggaa

SEQ ID NO: 2956101 - RNA, 13 nt, Human
ggaggccagccuu

SEQ ID NO: 2956102 - RNA, 18 nt, Human
ggaggccaaggugggagg

SEQ ID NO: 2956103 - RNA, 12 nt, Human
ggaggccagccu

SEQ ID NO: 2956104 - RNA, 22 nt, Human
ggagcugccuguucagcuccag

SEQ ID NO: 2956105 - RNA, 16 nt, Human
ggagcugaguggggga

SEQ ID NO: 2956106 - RNA, 19 nt, Human
gcuuguaccacuuuugcaa

SEQ ID NO: 2956107 - RNA, 22 nt, Human
gcuuguaccacuuuugcaaaua

SEQ ID NO: 2956108 - RNA, 19 nt, Human
gcuuguacauaaugcgugc

SEQ ID NO: 2956109 - RNA, 19 nt, Human
ggacccugaggcccagagg

SEQ ID NO: 2956110 - RNA, 14 nt, Human
ggacccugaggccc

SEQ ID NO: 2956111 - RNA, 18 nt, Human
ggacccugaggcccagag

SEQ ID NO: 2956112 - RNA, 15 nt, Human
ggacccugaggccca

SEQ ID NO: 2956113 - RNA, 15 nt, Human
ggagagcuagcagca

SEQ ID NO: 2956114 - RNA, 16 nt, Human
ggagagccuuccaggg

SEQ ID NO: 2956115 - RNA, 13 nt, Human
ggagagccuucca

SEQ ID NO: 2956116 - RNA, 18 nt, Human
ggagagccuuccaggggu

SEQ ID NO: 2956117 - RNA, 17 nt, Human
ggagagccuuccagggg

SEQ ID NO: 2956118 - RNA, 22 nt, Human
ggagagccuuccagggguggga

SEQ ID NO: 2956119 - RNA, 9 nt, Human
ggacuuugu

SEQ ID NO: 2956120 - RNA, 19 nt, Human
ggagaaaauggacguguua

SEQ ID NO: 2956121 - RNA, 15 nt, Human
ggacuuggaagcucc

SEQ ID NO: 2956122 - RNA, 17 nt, Human
ggacuuggaagcuccgc

SEQ ID NO: 2956123 - RNA, 22 nt, Human
ggagaaccaaaaagaggcuaug

SEQ ID NO: 2956124 - RNA, 22 nt, Human
ggacucaaugcacugacauugu

SEQ ID NO: 2956125 - RNA, 12 nt, Human
ggaccucaggcc

SEQ ID NO: 2956126 - RNA, 20 nt, Human
ggacuacaggugugagucac

SEQ ID NO: 2956127 - RNA, 13 nt, Human
gccuccuccagcc

SEQ ID NO: 2956128 - RNA, 18 nt, Human
gccuccugcccuuaccug

SEQ ID NO: 2956129 - RNA, 12 nt, Human
gccucugggacu

SEQ ID NO: 2956130 - RNA, 17 nt, Human
gccugcccaggccccug

SEQ ID NO: 2956131 - RNA, 18 nt, Human
gccugcccaggccccugc

SEQ ID NO: 2956132 - RNA, 19 nt, Human
gccugcccaggccccugcc

SEQ ID NO: 2956133 - RNA, 23 nt, Human
gccucuucucuacucuagggaaa

SEQ ID NO: 2956134 - RNA, 12 nt, Human
gccucuucucua

SEQ ID NO: 2956135 - RNA, 15 nt, Human
gccuaccaauauuua

SEQ ID NO: 2956136 - RNA, 17 nt, Human
gccuggccccucagggu

SEQ ID NO: 2956137 - RNA, 16 nt, Human
gccuggccccucaggg

SEQ ID NO: 2956138 - RNA, 15 nt, Human
gccuggccccucagg

SEQ ID NO: 2956139 - RNA, 10 nt, Human
gccuggccug

SEQ ID NO: 2956140 - RNA, 22 nt, Human
gccuggccccucagggucccug

SEQ ID NO: 2956141 - RNA, 20 nt, Human
gccuggccccucaggguccc

SEQ ID NO: 2956142 - RNA, 21 nt, Human
gccugggaggucaaggcugca

SEQ ID NO: 2956143 - RNA, 14 nt, Human
gccugggaucccuc

SEQ ID NO: 2956144 - RNA, 22 nt, Human
gccugggaggucaaggcugcag

SEQ ID NO: 2956145 - RNA, 18 nt, Human
gccugggaucccucaucc

SEQ ID NO: 2956146 - RNA, 16 nt, Human
gccugccucuucucua

SEQ ID NO: 2956147 - RNA, 13 nt, Human
gccgcccaaggcc

SEQ ID NO: 2956148 - RNA, 16 nt, Human
gccgccaugcuccugg

SEQ ID NO: 2956149 - RNA, 20 nt, Human
gcccuuaccugccaggaagc

SEQ ID NO: 2956150 - RNA, 16 nt, Human
gcccuuaccugccagg

SEQ ID NO: 2956151 - RNA, 15 nt, Human
gccgccaugcuccug

SEQ ID NO: 2956152 - RNA, 22 nt, Human
gcccugccuccuuugugaggaa

SEQ ID NO: 2956153 - RNA, 16 nt, Human
gcccugccuccuuugu

SEQ ID NO: 2956154 - RNA, 14 nt, Human
gcccugccuccuuu

SEQ ID NO: 2956155 - RNA, 21 nt, Human
gcccugugggcccccaaaugg

SEQ ID NO: 2956156 - RNA, 17 nt, Human
gcccuguuaaaagauga

SEQ ID NO: 2956157 - RNA, 14 nt, Human
gcccuguuaaaaga

SEQ ID NO: 2956158 - RNA, 13 nt, Human
gcccuguuaaaag

SEQ ID NO: 2956159 - RNA, 13 nt, Human
gcccacucccugc

SEQ ID NO: 2956160 - RNA, 19 nt, Human
gcccacucccugcaaccug

SEQ ID NO: 2956161 - RNA, 15 nt, Human
gcccacucccugcaa

SEQ ID NO: 2956162 - RNA, 14 nt, Human
gcccacucccugca

SEQ ID NO: 2956163 - RNA, 22 nt, Human
gcccuaaaguguauuuuuuuac

SEQ ID NO: 2956164 - RNA, 22 nt, Human
gccccuggaugcagccucacag

SEQ ID NO: 2956165 - RNA, 18 nt, Human
gccccuggaugcagccuc

SEQ ID NO: 2956166 - RNA, 16 nt, Human
gccccuggaugcagcc

SEQ ID NO: 2956167 - RNA, 13 nt, Human
gccccugcccggc

SEQ ID NO: 2956168 - RNA, 14 nt, Human
gccccugcccggcu

SEQ ID NO: 2956169 - RNA, 18 nt, Human
gccccaaaacucuccucu

SEQ ID NO: 2956170 - RNA, 16 nt, Human
gcccccaggugccagu

SEQ ID NO: 2956171 - RNA, 19 nt, Human
gccccaaaacucuccucug

SEQ ID NO: 2956172 - RNA, 20 nt, Human
gccacauuccugaugcuucu

SEQ ID NO: 2956173 - RNA, 16 nt, Human
gccacauuccugaugc

SEQ ID NO: 2956174 - RNA, 19 nt, Human
gccaccaacauacucccau

SEQ ID NO: 2956175 - RNA, 21 nt, Human
gccaccaacauacucccaucu

SEQ ID NO: 2956176 - RNA, 20 nt, Human
gccaccaacauacucccauc

SEQ ID NO: 2956177 - RNA, 22 nt, Human
gccaccaacauacucccaucug

SEQ ID NO: 2956178 - RNA, 22 nt, Human
gccacugcaccgggccacagag

SEQ ID NO: 2956179 - RNA, 21 nt, Human
gccacugcacuauagccuagg

SEQ ID NO: 2956180 - RNA, 13 nt, Human
gccacccugggga

SEQ ID NO: 2956181 - RNA, 19 nt, Human
gccacccuggggagaaagu

SEQ ID NO: 2956182 - RNA, 23 nt, Human
gccacugcaccgggccacagaga

SEQ ID NO: 2956183 - RNA, 19 nt, Human
gccacugugcuccagccug

SEQ ID NO: 2956184 - RNA, 19 nt, Human
gccacugugaagagaacca

SEQ ID NO: 2956185 - RNA, 18 nt, Human
gccacugugaagagaacc

SEQ ID NO: 2956186 - RNA, 14 nt, Human
gccacuuuauuucu

SEQ ID NO: 2956187 - RNA, 20 nt, Human
gccagaaaccuuccugcuga

SEQ ID NO: 2956188 - RNA, 16 nt, Human
gccauaugaaaaggcu

SEQ ID NO: 2956189 - RNA, 19 nt, Human
gccauauucuguuggccag

SEQ ID NO: 2956190 - RNA, 20 nt, Human
gccauauucuguuggccagu

SEQ ID NO: 2956191 - RNA, 15 nt, Human
gccaugucagacaca

SEQ ID NO: 2956192 - RNA, 14 nt, Human
gccaugucagacac

SEQ ID NO: 2956193 - RNA, 16 nt, Human
gccaugucagacacag

SEQ ID NO: 2956194 - RNA, 14 nt, Human
gccauguuggccag

SEQ ID NO: 2956195 - RNA, 15 nt, Human
gccauguuggccagg

SEQ ID NO: 2956196 - RNA, 16 nt, Human
gccauguuggccaggc

SEQ ID NO: 2956197 - RNA, 17 nt, Human
gccauguuggccaggcu

SEQ ID NO: 2956198 - RNA, 18 nt, Human
gccauguuggccaggcug

SEQ ID NO: 2956199 - RNA, 15 nt, Human
gcccacgcuggagug

SEQ ID NO: 2956200 - RNA, 16 nt, Human
gcccacgcuggagugc

SEQ ID NO: 2956201 - RNA, 17 nt, Human
gcccacgcuggagugca

SEQ ID NO: 2956202 - RNA, 18 nt, Human
gcccaccuuggcucaagu

SEQ ID NO: 2956203 - RNA, 14 nt, Human
gcccacgcccccac

SEQ ID NO: 2956204 - RNA, 13 nt, Human
gcccacgccccca

SEQ ID NO: 2956205 - RNA, 19 nt, Human
gccauguuggccaggcugg

SEQ ID NO: 2956206 - RNA, 20 nt, Human
gccauguuggccaggcuggu

SEQ ID NO: 2956207 - RNA, 22 nt, Human
gccauguuggccaggcuggucu

SEQ ID NO: 2956208 - RNA, 24 nt, Human
gccauguuggccaggcuggucuca

SEQ ID NO: 2956209 - RNA, 13 nt, Human
gccaggccagagg

SEQ ID NO: 2956210 - RNA, 15 nt, Human
gccaggcccucugcc

SEQ ID NO: 2956211 - RNA, 17 nt, Human
gccaggcccucugccca

SEQ ID NO: 2956212 - RNA, 16 nt, Human
gccaggcccucugccc

SEQ ID NO: 2956213 - RNA, 21 nt, Human
gccaggcccuugucggcccca

SEQ ID NO: 2956214 - RNA, 21 nt, Human
gccaggcccucugcccacucc

SEQ ID NO: 2956215 - RNA, 20 nt, Human
gccaggcccucugcccacuc

SEQ ID NO: 2956216 - RNA, 19 nt, Human
gccaggcccucugcccacu

SEQ ID NO: 2956217 - RNA, 23 nt, Human
gccaggccacaagacccuugugg

SEQ ID NO: 2956218 - RNA, 12 nt, Human
gccaggccagag

SEQ ID NO: 2956219 - RNA, 16 nt, Human
gccagcaggcucucag

SEQ ID NO: 2956220 - RNA, 13 nt, Human
gccagcaggcucu

SEQ ID NO: 2956221 - RNA, 22 nt, Human
gccagcaguucagagcugcccu

SEQ ID NO: 2956222 - RNA, 23 nt, Human
gccagcaguucagagcugcccuc

SEQ ID NO: 2956223 - RNA, 23 nt, Human
gccagcaggcucucaggccagcu

SEQ ID NO: 2956224 - RNA, 21 nt, Human
gccagcaggcucucaggccag

SEQ ID NO: 2956225 - RNA, 20 nt, Human
gccagcaggcucucaggcca

SEQ ID NO: 2956226 - RNA, 19 nt, Human
gccagcaggcucucaggcc

SEQ ID NO: 2956227 - RNA, 18 nt, Human
gccagcaggcucucaggc

SEQ ID NO: 2956228 - RNA, 17 nt, Human
gccagcaggcucucagg

SEQ ID NO: 2956229 - RNA, 19 nt, Human
gccagauuuuccugaaaac

SEQ ID NO: 2956230 - RNA, 22 nt, Human
gccagaagucaaggcuuagacc

SEQ ID NO: 2956231 - RNA, 20 nt, Human
gccagaagucaaggcuuaga

SEQ ID NO: 2956232 - RNA, 16 nt, Human
gccagaagucaaggcu

SEQ ID NO: 2956233 - RNA, 23 nt, Human
gccagaagucaaggcuuagaccc

SEQ ID NO: 2956234 - RNA, 22 nt, Human
gccagacaucaacagauaaaua

SEQ ID NO: 2956235 - RNA, 14 nt, Human
gcugacagacacag

SEQ ID NO: 2956236 - RNA, 15 nt, Human
gcugacagacacagg

SEQ ID NO: 2956237 - RNA, 16 nt, Human
gcugacagacacaggc

SEQ ID NO: 2956238 - RNA, 20 nt, Human
gcugaaggcucgagcaugcc

SEQ ID NO: 2956239 - RNA, 12 nt, Human
gcugaaggcucg

SEQ ID NO: 2956240 - RNA, 17 nt, Human
gcugaaugguuuucaaa

SEQ ID NO: 2956241 - RNA, 22 nt, Human
gcugaauacagaggcaacugca

SEQ ID NO: 2956242 - RNA, 12 nt, Human
gcucuuccaggc

SEQ ID NO: 2956243 - RNA, 16 nt, Human
gcucuuccaggcuggg

SEQ ID NO: 2956244 - RNA, 15 nt, Human
gcucuuccaggcugg

SEQ ID NO: 2956245 - RNA, 15 nt, Human
gcucuguccugggag

SEQ ID NO: 2956246 - RNA, 14 nt, Human
gcucuguccuggga

SEQ ID NO: 2956247 - RNA, 16 nt, Human
gcucuguccugggagu

SEQ ID NO: 2956248 - RNA, 16 nt, Human
gcucucaggccagcug

SEQ ID NO: 2956249 - RNA, 15 nt, Human
gcucucaggccagcu

SEQ ID NO: 2956250 - RNA, 14 nt, Human
gcucucaggccagc

SEQ ID NO: 2956251 - RNA, 13 nt, Human
gcucucaggccag

SEQ ID NO: 2956252 - RNA, 22 nt, Human
gcucccaggcauuccccaggag

SEQ ID NO: 2956253 - RNA, 14 nt, Human
gcuccccagcccca

SEQ ID NO: 2956254 - RNA, 21 nt, Human
gcucccaggcauuccccagga

SEQ ID NO: 2956255 - RNA, 20 nt, Human
gcucccaggcauuccccagg

SEQ ID NO: 2956256 - RNA, 15 nt, Human
gcuccccucggagaa

SEQ ID NO: 2956257 - RNA, 22 nt, Human
gcucagguggggucacucuggc

SEQ ID NO: 2956258 - RNA, 21 nt, Human
gcucagguggggucacucugg

SEQ ID NO: 2956259 - RNA, 12 nt, Human
gcucagggccug

SEQ ID NO: 2956260 - RNA, 16 nt, Human
gcucagggccuggcuc

SEQ ID NO: 2956261 - RNA, 13 nt, Human
gcucagggccugg

SEQ ID NO: 2956262 - RNA, 15 nt, Human
gcucagagagggugg

SEQ ID NO: 2956263 - RNA, 20 nt, Human
gcucagagagggugggagug

SEQ ID NO: 2956264 - RNA, 18 nt, Human
gcucagagagggugggag

SEQ ID NO: 2956265 - RNA, 22 nt, Human
gcucagagagggugggaguggg

SEQ ID NO: 2956266 - RNA, 20 nt, Human
gccuguucagcuccagcuca

SEQ ID NO: 2956267 - RNA, 19 nt, Human
gccuguucagcuccagcuc

SEQ ID NO: 2956268 - RNA, 16 nt, Human
gcuaggaacacuccuu

SEQ ID NO: 2956269 - RNA, 18 nt, Human
gcuaggaacacuccuuca

SEQ ID NO: 2956270 - RNA, 21 nt, Human
gcuaggaacacuccuucacag

SEQ ID NO: 2956271 - RNA, 19 nt, Human
gcuaggaacacuccuucac

SEQ ID NO: 2956272 - RNA, 22 nt, Human
gcuaggaccccuccaugugggc

SEQ ID NO: 2956273 - RNA, 14 nt, Human
gcuaggccuggcca

SEQ ID NO: 2956274 - RNA, 15 nt, Human
gcuaggccuggccag

SEQ ID NO: 2956275 - RNA, 16 nt, Human
gcuaguaucaaaagaa

SEQ ID NO: 2956276 - RNA, 21 nt, Human
gcuaguaauuggaaaggcagc

SEQ ID NO: 2956277 - RNA, 12 nt, Human
gcuggagugcag

SEQ ID NO: 2956278 - RNA, 17 nt, Human
gcuggagcucugcccau

SEQ ID NO: 2956279 - RNA, 14 nt, Human
gcuggagcucugcc

SEQ ID NO: 2956280 - RNA, 15 nt, Human
gcuggguguggcgca

SEQ ID NO: 2956281 - RNA, 20 nt, Human
gcugggcucccuucccaccu

SEQ ID NO: 2956282 - RNA, 17 nt, Human
gcugggcucccuuccca

SEQ ID NO: 2956283 - RNA, 16 nt, Human
gcugggcucccuuccc

SEQ ID NO: 2956284 - RNA, 12 nt, Human
gcugggcucccu

SEQ ID NO: 2956285 - RNA, 17 nt, Human
gcugggcagaggaaagc

SEQ ID NO: 2956286 - RNA, 16 nt, Human
gcugggcagaggaaag

SEQ ID NO: 2956287 - RNA, 19 nt, Human
gcugggcagaggaaagcaa

SEQ ID NO: 2956288 - RNA, 19 nt, Human
gcugggauuacagguguga

SEQ ID NO: 2956289 - RNA, 18 nt, Human
gcugggauuacaggugug

SEQ ID NO: 2956290 - RNA, 13 nt, Human
gcugggcagagga

SEQ ID NO: 2956291 - RNA, 15 nt, Human
gcugggcagaggaaa

SEQ ID NO: 2956292 - RNA, 14 nt, Human
gcugggcagaggaa

SEQ ID NO: 2956293 - RNA, 14 nt, Human
gcuggagugcagug

SEQ ID NO: 2956294 - RNA, 15 nt, Human
gcuggagugcaguga

SEQ ID NO: 2956295 - RNA, 17 nt, Human
gcuggccuggccccuca

SEQ ID NO: 2956296 - RNA, 16 nt, Human
gcuggccuggccccuc

SEQ ID NO: 2956297 - RNA, 16 nt, Human
gcugggauuacaggug

SEQ ID NO: 2956298 - RNA, 19 nt, Human
gcuggccuggccccucagg

SEQ ID NO: 2956299 - RNA, 18 nt, Human
gcuggccuggccccucag

SEQ ID NO: 2956300 - RNA, 22 nt, Human
gcugcaccggcuggccuggccc

SEQ ID NO: 2956301 - RNA, 19 nt, Human
gcugcaccggcuggccugg

SEQ ID NO: 2956302 - RNA, 18 nt, Human
gcugcaccggcuggccug

SEQ ID NO: 2956303 - RNA, 17 nt, Human
gcugcaccggcuggccu

SEQ ID NO: 2956304 - RNA, 16 nt, Human
gcugcaccggcuggcc

SEQ ID NO: 2956305 - RNA, 14 nt, Human
gcugcaccggcugg

SEQ ID NO: 2956306 - RNA, 21 nt, Human
gcugccauccagguucagcuu

SEQ ID NO: 2956307 - RNA, 23 nt, Human
gcugccauccagguucagcuugu

SEQ ID NO: 2956308 - RNA, 21 nt, Human
gcugccagccgagauagccaa

SEQ ID NO: 2956309 - RNA, 19 nt, Human
gcugccagccgagauagcc

SEQ ID NO: 2956310 - RNA, 14 nt, Human
gcugcugccccugc

SEQ ID NO: 2956311 - RNA, 15 nt, Human
gcugcugccccugca

SEQ ID NO: 2956312 - RNA, 23 nt, Human
gcugcugccccugcacagcaggc

SEQ ID NO: 2956313 - RNA, 13 nt, Human
gcugcugccccug

SEQ ID NO: 2956314 - RNA, 16 nt, Human
gcugcugauuuaaaca

SEQ ID NO: 2956315 - RNA, 18 nt, Human
gcugccugggaucccuca

SEQ ID NO: 2956316 - RNA, 16 nt, Human
gcugccugggaucccu

SEQ ID NO: 2956317 - RNA, 19 nt, Human
gcugccugggaucccucau

SEQ ID NO: 2956318 - RNA, 22 nt, Human
gcugcuccuaggacccgucucc

SEQ ID NO: 2956319 - RNA, 13 nt, Human
gcugccugggauc

SEQ ID NO: 2956320 - RNA, 14 nt, Human
gcugccuccccucc

SEQ ID NO: 2956321 - RNA, 16 nt, Human
gcugccuccccuccuc

SEQ ID NO: 2956322 - RNA, 17 nt, Human
gcugccuccccuccucu

SEQ ID NO: 2956323 - RNA, 20 nt, Human
gcugccuccccuccucugcu

SEQ ID NO: 2956324 - RNA, 21 nt, Human
gcugccuccccuccucugcuu

SEQ ID NO: 2956325 - RNA, 22 nt, Human
gcugccuccccuccucugcuug

SEQ ID NO: 2956326 - RNA, 14 nt, Human
gcuuguacauaaug

SEQ ID NO: 2956327 - RNA, 16 nt, Human
gcuuguacauaaugcg

SEQ ID NO: 2956328 - RNA, 14 nt, Human
gcuggguuggaggg

SEQ ID NO: 2956329 - RNA, 21 nt, Human
gcuggguuggaggguguccca

SEQ ID NO: 2956330 - RNA, 15 nt, Human
gcuggguucugaucc

SEQ ID NO: 2956331 - RNA, 15 nt, Human
gcuggguucuaccca

SEQ ID NO: 2956332 - RNA, 17 nt, Human
gcuguacauacuuuuug

SEQ ID NO: 2956333 - RNA, 19 nt, Human
gcuguaucccaugagccuc

SEQ ID NO: 2956334 - RNA, 20 nt, Human
gcuguaucccaugagccuca

SEQ ID NO: 2956335 - RNA, 23 nt, Human
gcuguaucccaugagccucagca

SEQ ID NO: 2956336 - RNA, 13 nt, Human
gcuguacauacuu

SEQ ID NO: 2956337 - RNA, 14 nt, Human
gcuguacauacuuu

SEQ ID NO: 2956338 - RNA, 15 nt, Human
gcuguacauacuuuu

SEQ ID NO: 2956339 - RNA, 16 nt, Human
gcuguacauacuuuuu

SEQ ID NO: 2956340 - RNA, 20 nt, Human
gcuucacggaagagccuugc

SEQ ID NO: 2956341 - RNA, 19 nt, Human
gcuucacggaagagccuug

SEQ ID NO: 2956342 - RNA, 22 nt, Human
gcuucaaggauccugagccaga

SEQ ID NO: 2956343 - RNA, 18 nt, Human
gcugugcucuggacaggc

SEQ ID NO: 2956344 - RNA, 13 nt, Human
gcugugcugcccu

SEQ ID NO: 2956345 - RNA, 21 nt, Human
gcugugcucuggacaggcaug

SEQ ID NO: 2956346 - RNA, 12 nt, Human
gcugugcugccc

SEQ ID NO: 2956347 - RNA, 21 nt, Human
gcuguuggcugggggccucag

SEQ ID NO: 2956348 - RNA, 22 nt, Human
gcuguuggcugggggccucagu

SEQ ID NO: 2956349 - RNA, 22 nt, Human
gcugugcugcccugcccaccug

SEQ ID NO: 2956350 - RNA, 19 nt, Human
gcugugcugcccugcccac

SEQ ID NO: 2956351 - RNA, 20 nt, Human
gagccuuccaggggugggac

SEQ ID NO: 2956352 - RNA, 23 nt, Human
gagccuuccaggggugggacacc

SEQ ID NO: 2956353 - RNA, 13 nt, Human
gagccuugaacuu

SEQ ID NO: 2956354 - RNA, 15 nt, Human
gaggcagggucucac

SEQ ID NO: 2956355 - RNA, 22 nt, Human
gaggcagggucucacucugucg

SEQ ID NO: 2956356 - RNA, 22 nt, Human
gaggccaaggugggaggauugc

SEQ ID NO: 2956357 - RNA, 17 nt, Human
gaggccaaggugggagg

SEQ ID NO: 2956358 - RNA, 14 nt, Human
gaggcagggucuca

SEQ ID NO: 2956359 - RNA, 15 nt, Human
gaggacgcucucugg

SEQ ID NO: 2956360 - RNA, 22 nt, Human
gaggcuagugugguguuuccug

SEQ ID NO: 2956361 - RNA, 19 nt, Human
gaggccagagacacaagcc

SEQ ID NO: 2956362 - RNA, 14 nt, Human
gaggccagagacac

SEQ ID NO: 2956363 - RNA, 13 nt, Human
gaggccagagaca

SEQ ID NO: 2956364 - RNA, 19 nt, Human
gaggcuccacuuggucugu

SEQ ID NO: 2956365 - RNA, 18 nt, Human
gaggcuccacuuggucug

SEQ ID NO: 2956366 - RNA, 16 nt, Human
gaggcugaggcaggag

SEQ ID NO: 2956367 - RNA, 18 nt, Human
gaggcugaggcaggagac

SEQ ID NO: 2956368 - RNA, 23 nt, Human
gaggcuccacuuggucugugaga

SEQ ID NO: 2956369 - RNA, 18 nt, Human
gaguugauucagcucugc

SEQ ID NO: 2956370 - RNA, 22 nt, Human
gaguuguuacauuuuuaagugc

SEQ ID NO: 2956371 - RNA, 23 nt, Human
gaggugaccccagguuucuaugu

SEQ ID NO: 2956372 - RNA, 15 nt, Human
gaggucgaggcagga

SEQ ID NO: 2956373 - RNA, 17 nt, Human
gaguggaguuacugaac

SEQ ID NO: 2956374 - RNA, 22 nt, Human
gaguugauagcacagacccugc

SEQ ID NO: 2956375 - RNA, 17 nt, Human
gaguugauucagcucug

SEQ ID NO: 2956376 - RNA, 16 nt, Human
gaguugauucagcucu

SEQ ID NO: 2956377 - RNA, 15 nt, Human
gaguugauucagcuc

SEQ ID NO: 2956378 - RNA, 11 nt, Human
gaguggaguua

SEQ ID NO: 2956379 - RNA, 20 nt, Human
gagugacagaggcagcccca

SEQ ID NO: 2956380 - RNA, 12 nt, Human
gagucccaccuu

SEQ ID NO: 2956381 - RNA, 18 nt, Human
gagugacagaggcagccc

SEQ ID NO: 2956382 - RNA, 22 nt, Human
gagucagaaguuucugccgcag

SEQ ID NO: 2956383 - RNA, 15 nt, Human
gagucaccaagccca

SEQ ID NO: 2956384 - RNA, 16 nt, Human
gagucaccaagcccag

SEQ ID NO: 2956385 - RNA, 17 nt, Human
gagucaccaagcccagu

SEQ ID NO: 2956386 - RNA, 15 nt, Human
gaugaucuaggaaga

SEQ ID NO: 2956387 - RNA, 16 nt, Human
gaugaucuuuaaaaua

SEQ ID NO: 2956388 - RNA, 21 nt, Human
gaugaucuaggaagacuuugg

SEQ ID NO: 2956389 - RNA, 16 nt, Human
gaugagugagcaugcc

SEQ ID NO: 2956390 - RNA, 22 nt, Human
gaugguucccuugaugaagaag

SEQ ID NO: 2956391 - RNA, 17 nt, Human
gauguagaggagaaacu

SEQ ID NO: 2956392 - RNA, 18 nt, Human
gauguagaggagaaacug

SEQ ID NO: 2956393 - RNA, 18 nt, Human
gauucuccugccucagcc

SEQ ID NO: 2956394 - RNA, 15 nt, Human
gauucuccugccuca

SEQ ID NO: 2956395 - RNA, 17 nt, Human
gauucuccugccucagc

SEQ ID NO: 2956396 - RNA, 16 nt, Human
gauuuaccacuugugu

SEQ ID NO: 2956397 - RNA, 15 nt, Human
gauuuaccacuugug

SEQ ID NO: 2956398 - RNA, 17 nt, Human
gauucuuccucccuccc

SEQ ID NO: 2956399 - RNA, 18 nt, Human
gauucuuccucccucccu

SEQ ID NO: 2956400 - RNA, 12 nt, Human
gauuauuggaaa

SEQ ID NO: 2956401 - RNA, 20 nt, Human
gauguaugcacacacauaua

SEQ ID NO: 2956402 - RNA, 20 nt, Human
gcaaguauuagaauaccaca

SEQ ID NO: 2956403 - RNA, 22 nt, Human
gcaauagucaaauugugugaaa

SEQ ID NO: 2956404 - RNA, 19 nt, Human
gcaagugagagcugggugu

SEQ ID NO: 2956405 - RNA, 23 nt, Human
gcacaguuuucugagaaagacua

SEQ ID NO: 2956406 - RNA, 22 nt, Human
gcacaguuuucugagaaagacu

SEQ ID NO: 2956407 - RNA, 20 nt, Human
gcacaguuuucugagaaaga

SEQ ID NO: 2956408 - RNA, 14 nt, Human
gcacacauuuuuua

SEQ ID NO: 2956409 - RNA, 14 nt, Human
gcacaccgggcacu

SEQ ID NO: 2956410 - RNA, 22 nt, Human
gcacaagcugcacccucaggca

SEQ ID NO: 2956411 - RNA, 16 nt, Human
gcacuccccugcuggg

SEQ ID NO: 2956412 - RNA, 22 nt, Human
gcacuccccugcuggguguggc

SEQ ID NO: 2956413 - RNA, 13 nt, Human
gcacucagaagac

SEQ ID NO: 2956414 - RNA, 16 nt, Human
gcacucagaagacacu

SEQ ID NO: 2956415 - RNA, 17 nt, Human
gcacuccccugcugggu

SEQ ID NO: 2956416 - RNA, 13 nt, Human
gcacaucauuuca

SEQ ID NO: 2956417 - RNA, 14 nt, Human
gcaccgggccacag

SEQ ID NO: 2956418 - RNA, 22 nt, Human
gcacaucagcacgauuucuguu

SEQ ID NO: 2956419 - RNA, 23 nt, Human
gcacaucagcacgauuucuguuu

SEQ ID NO: 2956420 - RNA, 23 nt, Human
gcaccgggccacagagaaaguac

SEQ ID NO: 2956421 - RNA, 19 nt, Human
gaacccgggaggcagaggu

SEQ ID NO: 2956422 - RNA, 20 nt, Human
gaaccgagggggcugcuccc

SEQ ID NO: 2956423 - RNA, 21 nt, Human
gaaccgagggggcugcuccca

SEQ ID NO: 2956424 - RNA, 22 nt, Human
gaaccgagggggcugcucccac

SEQ ID NO: 2956425 - RNA, 15 nt, Human
gaacuccuggccuca

SEQ ID NO: 2956426 - RNA, 14 nt, Human
gaacugaaaucaua

SEQ ID NO: 2956427 - RNA, 13 nt, Human
gaacugaaaucau

SEQ ID NO: 2956428 - RNA, 11 nt, Human
gaacuggcugc

SEQ ID NO: 2956429 - RNA, 12 nt, Human
gaacuggcugca

SEQ ID NO: 2956430 - RNA, 11 nt, Human
gaagcagagug

SEQ ID NO: 2956431 - RNA, 23 nt, Human
gaagcagaccauuggggcuccca

SEQ ID NO: 2956432 - RNA, 15 nt, Human
gaagcagaggaagga

SEQ ID NO: 2956433 - RNA, 14 nt, Human
gaagcacaugccuc

SEQ ID NO: 2956434 - RNA, 12 nt, Human
gaagcagagugg

SEQ ID NO: 2956435 - RNA, 15 nt, Human
gaagcacaugccucu

SEQ ID NO: 2956436 - RNA, 20 nt, Human
gaagcacaugccucucucag

SEQ ID NO: 2956437 - RNA, 17 nt, Human
gaagcacaugccucucu

SEQ ID NO: 2956438 - RNA, 23 nt, Human
gaagcaacccaaauguucaucaa

SEQ ID NO: 2956439 - RNA, 16 nt, Human
gaagacaaugacuuac

SEQ ID NO: 2956440 - RNA, 22 nt, Human
gaagacaaugacuuacuguaca

SEQ ID NO: 2956441 - RNA, 23 nt, Human
gaagacaaugugaaaagaaaaau

SEQ ID NO: 2956442 - RNA, 23 nt, Human
gaagauuuugaaauuuuuauuaa

SEQ ID NO: 2956443 - RNA, 14 nt, Human
gaagcaaaauuuuu

SEQ ID NO: 2956444 - RNA, 19 nt, Human
gaagcuccgcuuucuaccc

SEQ ID NO: 2956445 - RNA, 22 nt, Human
gaagcuccgcuuucuacccagc

SEQ ID NO: 2956446 - RNA, 17 nt, Human
gaaggccccgcccaggc

SEQ ID NO: 2956447 - RNA, 21 nt, Human
gaaggcucgagcaugccugga

SEQ ID NO: 2956448 - RNA, 19 nt, Human
gaaggccccgcccaggcuu

SEQ ID NO: 2956449 - RNA, 18 nt, Human
gaaggccccgcccaggcu

SEQ ID NO: 2956450 - RNA, 19 nt, Human
gaaggcucgagcaugccug

SEQ ID NO: 2956451 - RNA, 19 nt, Human
gaaggcuggguucugaucc

SEQ ID NO: 2956452 - RNA, 15 nt, Human
gaaggcuggguucug

SEQ ID NO: 2956453 - RNA, 22 nt, Human
gaaggcuggguucugauccuag

SEQ ID NO: 2956454 - RNA, 20 nt, Human
gaaggcuggguucugauccu

SEQ ID NO: 2956455 - RNA, 15 nt, Human
gaauauugcugaugg

SEQ ID NO: 2956456 - RNA, 14 nt, Human
gaauauugcugaug

SEQ ID NO: 2956457 - RNA, 20 nt, Human
gaauauugcugauggugcaa

SEQ ID NO: 2956458 - RNA, 19 nt, Human
gaauauugcugauggugca

SEQ ID NO: 2956459 - RNA, 22 nt, Human
gaaggggagauaaggguaucug

SEQ ID NO: 2956460 - RNA, 15 nt, Human
gaaguucuaguguuu

SEQ ID NO: 2956461 - RNA, 16 nt, Human
gaaguucuaguguuuu

SEQ ID NO: 2956462 - RNA, 16 nt, Human
gaaguucuauuuauuu

SEQ ID NO: 2956463 - RNA, 17 nt, Human
gacagcccgggcucugc

SEQ ID NO: 2956464 - RNA, 21 nt, Human
gacagaaagcagaacagugau

SEQ ID NO: 2956465 - RNA, 22 nt, Human
gacacagcucuucuccaggcug

SEQ ID NO: 2956466 - RNA, 23 nt, Human
gacacagcucuucuccaggcugu

SEQ ID NO: 2956467 - RNA, 14 nt, Human
gacacacugaagaa

SEQ ID NO: 2956468 - RNA, 15 nt, Human
gacacacugaagaag

SEQ ID NO: 2956469 - RNA, 16 nt, Human
gacacacugaagaagc

SEQ ID NO: 2956470 - RNA, 13 nt, Human
gacacagcucuuc

SEQ ID NO: 2956471 - RNA, 14 nt, Human
gacacagcucuucu

SEQ ID NO: 2956472 - RNA, 16 nt, Human
gacacagcucuucucc

SEQ ID NO: 2956473 - RNA, 18 nt, Human
gaccagggauuuccauga

SEQ ID NO: 2956474 - RNA, 20 nt, Human
gaccagggauuuccaugaug

SEQ ID NO: 2956475 - RNA, 19 nt, Human
gaccaucccugaaggcccc

SEQ ID NO: 2956476 - RNA, 18 nt, Human
gaccaucccugaaggccc

SEQ ID NO: 2956477 - RNA, 13 nt, Human
gaccaucccugaa

SEQ ID NO: 2956478 - RNA, 12 nt, Human
gaccaucccuga

SEQ ID NO: 2956479 - RNA, 16 nt, Human
gacauuugcucaugga

SEQ ID NO: 2956480 - RNA, 17 nt, Human
gacauuugcucauggaa

SEQ ID NO: 2956481 - RNA, 19 nt, Human
gacauuguuggccaaagcc

SEQ ID NO: 2956482 - RNA, 14 nt, Human
gacauugaaaucua

SEQ ID NO: 2956483 - RNA, 22 nt, Human
gacauugacuauuuuuguuuuu

SEQ ID NO: 2956484 - RNA, 14 nt, Human
gacauugacuauuu

SEQ ID NO: 2956485 - RNA, 21 nt, Human
gacauugaaaucuaggaaaau

SEQ ID NO: 2956486 - RNA, 14 nt, Human
gacauugcggacag

SEQ ID NO: 2956487 - RNA, 15 nt, Human
gacauugcggacagc

SEQ ID NO: 2956488 - RNA, 14 nt, Human
gacagugaaagaaa

SEQ ID NO: 2956489 - RNA, 20 nt, Human
gacagcccgggcucugccuc

SEQ ID NO: 2956490 - RNA, 19 nt, Human
gacagcccgggcucugccu

SEQ ID NO: 2956491 - RNA, 18 nt, Human
gacagcccgggcucugcc

SEQ ID NO: 2956492 - RNA, 12 nt, Human
gacauucccugc

SEQ ID NO: 2956493 - RNA, 21 nt, Human
gacagugagacucugucucag

SEQ ID NO: 2956494 - RNA, 16 nt, Human
gacgcucucuggccuu

SEQ ID NO: 2956495 - RNA, 17 nt, Human
gacgcucucuggccuuc

SEQ ID NO: 2956496 - RNA, 15 nt, Human
gacgccaucccagcc

SEQ ID NO: 2956497 - RNA, 18 nt, Human
gacgccaucccagcccca

SEQ ID NO: 2956498 - RNA, 17 nt, Human
gacgccaucccagcccc

SEQ ID NO: 2956499 - RNA, 15 nt, Human
gacgcucucuggccu

SEQ ID NO: 2956500 - RNA, 19 nt, Human
gacgcuacccgggaagggg

SEQ ID NO: 2956501 - RNA, 18 nt, Human
gacgcuacccgggaaggg

SEQ ID NO: 2956502 - RNA, 16 nt, Human
gacgcuacccgggaag

SEQ ID NO: 2956503 - RNA, 16 nt, Human
gaccugaagagugguc

SEQ ID NO: 2956504 - RNA, 16 nt, Human
gacgccaucccagccc

SEQ ID NO: 2956505 - RNA, 14 nt, Human
gaccugaggcccuu

SEQ ID NO: 2956506 - RNA, 13 nt, Human
gaccugaggcccu

SEQ ID NO: 2956507 - RNA, 11 nt, Human
gaccugaggcc

SEQ ID NO: 2956508 - RNA, 20 nt, Human
gaccaucccugaaggccccg

SEQ ID NO: 2956509 - RNA, 13 nt, Human
gaccucugccuga

SEQ ID NO: 2956510 - RNA, 14 nt, Human
gaccucugcagcaa

SEQ ID NO: 2956511 - RNA, 16 nt, Human
gacugaauggacuuug

SEQ ID NO: 2956512 - RNA, 14 nt, Human
gacugaauuaugaa

SEQ ID NO: 2956513 - RNA, 14 nt, Human
gacugaauuucuuu

SEQ ID NO: 2956514 - RNA, 20 nt, Human
gacugaauuaugaaacuuuu

SEQ ID NO: 2956515 - RNA, 13 nt, Human
gacucuucccuca

SEQ ID NO: 2956516 - RNA, 21 nt, Human
gacucuuaagaagacugcauu

SEQ ID NO: 2956517 - RNA, 19 nt, Human
gacucugucucaaaaaaac

SEQ ID NO: 2956518 - RNA, 14 nt, Human
gacucuuaagaaga

SEQ ID NO: 2956519 - RNA, 18 nt, Human
gacucuuaagaagacugc

SEQ ID NO: 2956520 - RNA, 13 nt, Human
cuuggcccaggag

SEQ ID NO: 2956521 - RNA, 14 nt, Human
cuuggcccaggagu

SEQ ID NO: 2956522 - RNA, 12 nt, Human
cuugcucugcug

SEQ ID NO: 2956523 - RNA, 23 nt, Human
cuugccgucuaccugaggggccu

SEQ ID NO: 2956524 - RNA, 12 nt, Human
cuugacagggca

SEQ ID NO: 2956525 - RNA, 20 nt, Human
cuugccgucuaccugagggg

SEQ ID NO: 2956526 - RNA, 23 nt, Human
cuugaaugaugccaugaggaaca

SEQ ID NO: 2956527 - RNA, 20 nt, Human
cuugaaugaugccaugagga

SEQ ID NO: 2956528 - RNA, 22 nt, Human
cuucuucagagacuccugcagg

SEQ ID NO: 2956529 - RNA, 18 nt, Human
cuucuucagagacuccug

SEQ ID NO: 2956530 - RNA, 21 nt, Human
cuucuucagagacuccugcag

SEQ ID NO: 2956531 - RNA, 20 nt, Human
cuucuucagagacuccugca

SEQ ID NO: 2956532 - RNA, 15 nt, Human
cuucuguuuuauaau

SEQ ID NO: 2956533 - RNA, 20 nt, Human
cuucuguuuuauaauuuugu

SEQ ID NO: 2956534 - RNA, 22 nt, Human
cuuucaauaggaaaaacugauu

SEQ ID NO: 2956535 - RNA, 21 nt, Human
cuuucaauaggaaaaacugau

SEQ ID NO: 2956536 - RNA, 20 nt, Human
cuuucaauaggaaaaacuga

SEQ ID NO: 2956537 - RNA, 18 nt, Human
cuuucaauaggaaaaacu

SEQ ID NO: 2956538 - RNA, 13 nt, Human
cuuguggacacag

SEQ ID NO: 2956539 - RNA, 14 nt, Human
cuuguggacacagc

SEQ ID NO: 2956540 - RNA, 15 nt, Human
cuuguggacacagcu

SEQ ID NO: 2956541 - RNA, 20 nt, Human
cuuuaaagggauggcaagau

SEQ ID NO: 2956542 - RNA, 22 nt, Human
cuuugacgccaucccagcccca

SEQ ID NO: 2956543 - RNA, 21 nt, Human
cuuugacgccaucccagcccc

SEQ ID NO: 2956544 - RNA, 19 nt, Human
cuuugacgccaucccagcc

SEQ ID NO: 2956545 - RNA, 18 nt, Human
cuuugacgccaucccagc

SEQ ID NO: 2956546 - RNA, 21 nt, Human
cuuugagugucuuaauuaaaa

SEQ ID NO: 2956547 - RNA, 15 nt, Human
cuuuucaaaacauuu

SEQ ID NO: 2956548 - RNA, 20 nt, Human
cuuuggucuacacugugcug

SEQ ID NO: 2956549 - RNA, 16 nt, Human
cuuuggucuacacugu

SEQ ID NO: 2956550 - RNA, 14 nt, Human
cuuuuauaaacuuu

SEQ ID NO: 2956551 - RNA, 16 nt, Human
cuuuuauaaacuuuac

SEQ ID NO: 2956552 - RNA, 18 nt, Human
cuuuuauaaacuuuaccu

SEQ ID NO: 2956553 - RNA, 15 nt, Human
cuuuuauaaacuuua

SEQ ID NO: 2956554 - RNA, 19 nt, Human
cugugucagguggggcagc

SEQ ID NO: 2956555 - RNA, 20 nt, Human
cugugucagcauagaaguaa

SEQ ID NO: 2956556 - RNA, 21 nt, Human
cugugucagguggggcagcuu

SEQ ID NO: 2956557 - RNA, 14 nt, Human
cugugucuugcaau

SEQ ID NO: 2956558 - RNA, 19 nt, Human
cugugucucccuucauccu

SEQ ID NO: 2956559 - RNA, 14 nt, Human
cugugucucccuuc

SEQ ID NO: 2956560 - RNA, 11 nt, Human
cugugcugccc

SEQ ID NO: 2956561 - RNA, 22 nt, Human
cugugcugagucugaaggcugg

SEQ ID NO: 2956562 - RNA, 20 nt, Human
cugugcugagucugaaggcu

SEQ ID NO: 2956563 - RNA, 13 nt, Human
cuguucagcucca

SEQ ID NO: 2956564 - RNA, 16 nt, Human
cugugucuugcaaugg

SEQ ID NO: 2956565 - RNA, 19 nt, Human
cugugucuugcaauggcag

SEQ ID NO: 2956566 - RNA, 19 nt, Human
cuuagauguauauauuucc

SEQ ID NO: 2956567 - RNA, 21 nt, Human
cuuaccucggugccuuccucu

SEQ ID NO: 2956568 - RNA, 19 nt, Human
cuuaccucggugccuuccu

SEQ ID NO: 2956569 - RNA, 13 nt, Human
cuuaccucggugc

SEQ ID NO: 2956570 - RNA, 17 nt, Human
cuuacccucauguucuu

SEQ ID NO: 2956571 - RNA, 18 nt, Human
cuuacccucauguucuua

SEQ ID NO: 2956572 - RNA, 19 nt, Human
cuuacccucauguucuuaa

SEQ ID NO: 2956573 - RNA, 16 nt, Human
cuguugggccaggagc

SEQ ID NO: 2956574 - RNA, 20 nt, Human
cuguugggccaggagccucc

SEQ ID NO: 2956575 - RNA, 17 nt, Human
cuguugggccaggagcc

SEQ ID NO: 2956576 - RNA, 13 nt, Human
cuuacacaauggu

SEQ ID NO: 2956577 - RNA, 17 nt, Human
cuuccauggacuuuguu

SEQ ID NO: 2956578 - RNA, 16 nt, Human
cuuccauggacuuugu

SEQ ID NO: 2956579 - RNA, 20 nt, Human
cuuccagugaggcucugccc

SEQ ID NO: 2956580 - RNA, 19 nt, Human
cuuccagugaggcucugcc

SEQ ID NO: 2956581 - RNA, 17 nt, Human
cuuccagugaggcucug

SEQ ID NO: 2956582 - RNA, 18 nt, Human
cuuccagugaggcucugc

SEQ ID NO: 2956583 - RNA, 14 nt, Human
cuucaccuuugucc

SEQ ID NO: 2956584 - RNA, 18 nt, Human
cuuauugcccacgcugga

SEQ ID NO: 2956585 - RNA, 20 nt, Human
cuucaccuuuguccccaccg

SEQ ID NO: 2956586 - RNA, 17 nt, Human
cuucaccuuugucccca

SEQ ID NO: 2956587 - RNA, 11 nt, Human
cuucagacaua

SEQ ID NO: 2956588 - RNA, 22 nt, Human
cuucagagacuccugcaggcag

SEQ ID NO: 2956589 - RNA, 21 nt, Human
cuucagagacuccugcaggca

SEQ ID NO: 2956590 - RNA, 16 nt, Human
cuucagagacuccugc

SEQ ID NO: 2956591 - RNA, 15 nt, Human
cuucauccuccucag

SEQ ID NO: 2956592 - RNA, 13 nt, Human
cuucaucccucug

SEQ ID NO: 2956593 - RNA, 18 nt, Human
cuucaguggcagcugcuu

SEQ ID NO: 2956594 - RNA, 23 nt, Human
cuucagagacuccugcaggcagc

SEQ ID NO: 2956595 - RNA, 16 nt, Human
cuucauccuccucaga

SEQ ID NO: 2956596 - RNA, 21 nt, Human
cuucauggaauucacaaagua

SEQ ID NO: 2956597 - RNA, 23 nt, Human
cuucaugcugucuacacuaagag

SEQ ID NO: 2956598 - RNA, 21 nt, Human
cuuauggaacacucugagacu

SEQ ID NO: 2956599 - RNA, 21 nt, Human
cuuaugggcuggguucuaccc

SEQ ID NO: 2956600 - RNA, 14 nt, Human
cuuaugggcugggu

SEQ ID NO: 2956601 - RNA, 23 nt, Human
cuuaugggcuggguucuacccag

SEQ ID NO: 2956602 - RNA, 22 nt, Human
cuuaugggcuggguucuaccca

SEQ ID NO: 2956603 - RNA, 12 nt, Human
cuuauugcccac

SEQ ID NO: 2956604 - RNA, 13 nt, Human
cuuauugcccacg

SEQ ID NO: 2956605 - RNA, 21 nt, Human
cuuagcagggaaacagcuaau

SEQ ID NO: 2956606 - RNA, 18 nt, Human
cuuagcagggaaacagcu

SEQ ID NO: 2956607 - RNA, 22 nt, Human
cuggaugcccccuguggaugcu

SEQ ID NO: 2956608 - RNA, 12 nt, Human
cuggaugccauc

SEQ ID NO: 2956609 - RNA, 23 nt, Human
cuggaugcccauccacugggugu

SEQ ID NO: 2956610 - RNA, 17 nt, Human
cuggaugcccccugugg

SEQ ID NO: 2956611 - RNA, 18 nt, Human
cuggaugcccccugugga

SEQ ID NO: 2956612 - RNA, 19 nt, Human
cuggaugcccccuguggau

SEQ ID NO: 2956613 - RNA, 22 nt, Human
cuggaugcagccucacaguccu

SEQ ID NO: 2956614 - RNA, 15 nt, Human
cuggaguucugguuc

SEQ ID NO: 2956615 - RNA, 17 nt, Human
cuggaguucugguuccu

SEQ ID NO: 2956616 - RNA, 16 nt, Human
cuggaguucugguucc

SEQ ID NO: 2956617 - RNA, 23 nt, Human
cugcuuagaaauaacagaagaaa

SEQ ID NO: 2956618 - RNA, 20 nt, Human
cugcuuauccguuagccgug

SEQ ID NO: 2956619 - RNA, 20 nt, Human
cugcuuaacuucacauauug

SEQ ID NO: 2956620 - RNA, 14 nt, Human
cugcucacauaucu

SEQ ID NO: 2956621 - RNA, 12 nt, Human
cugcugaaggcu

SEQ ID NO: 2956622 - RNA, 16 nt, Human
cugcucacauaucugu

SEQ ID NO: 2956623 - RNA, 19 nt, Human
cugcucacauaucugucau

SEQ ID NO: 2956624 - RNA, 13 nt, Human
cugcugacagugu

SEQ ID NO: 2956625 - RNA, 15 nt, Human
cugcugacaguguug

SEQ ID NO: 2956626 - RNA, 11 nt, Human
cugcugacagu

SEQ ID NO: 2956627 - RNA, 12 nt, Human
cugcugacagug

SEQ ID NO: 2956628 - RNA, 15 nt, Human
cugcugaaggcucga

SEQ ID NO: 2956629 - RNA, 14 nt, Human
cugcugaaggcucg

SEQ ID NO: 2956630 - RNA, 13 nt, Human
cugcugaaggcuc

SEQ ID NO: 2956631 - RNA, 16 nt, Human
cugcugauuuaaacac

SEQ ID NO: 2956632 - RNA, 22 nt, Human
cugcugauuuaaacacauuaaa

SEQ ID NO: 2956633 - RNA, 12 nt, Human
cuggcccuuccu

SEQ ID NO: 2956634 - RNA, 14 nt, Human
cuggcucacccagu

SEQ ID NO: 2956635 - RNA, 13 nt, Human
cuggcucacccag

SEQ ID NO: 2956636 - RNA, 22 nt, Human
cuggcuaugcauuugaaaauuu

SEQ ID NO: 2956637 - RNA, 15 nt, Human
cuggcuaugcauuug

SEQ ID NO: 2956638 - RNA, 16 nt, Human
cuggcuaugcauuuga

SEQ ID NO: 2956639 - RNA, 13 nt, Human
cuggcuaugcauu

SEQ ID NO: 2956640 - RNA, 14 nt, Human
cuggcuaugcauuu

SEQ ID NO: 2956641 - RNA, 13 nt, Human
cugggacuacagg

SEQ ID NO: 2956642 - RNA, 15 nt, Human
cugggacuacaggca

SEQ ID NO: 2956643 - RNA, 22 nt, Human
cugggagaaccaaaaagaggcu

SEQ ID NO: 2956644 - RNA, 14 nt, Human
cugggacaugggaa

SEQ ID NO: 2956645 - RNA, 22 nt, Human
cugggacaugggaaaggggaag

SEQ ID NO: 2956646 - RNA, 18 nt, Human
cugggacaugggaaaggg

SEQ ID NO: 2956647 - RNA, 17 nt, Human
cuggcucacccaguccu

SEQ ID NO: 2956648 - RNA, 12 nt, Human
cuggugccucac

SEQ ID NO: 2956649 - RNA, 21 nt, Human
cuggugccucaccccuugcca

SEQ ID NO: 2956650 - RNA, 16 nt, Human
cuggguguaaacacau

SEQ ID NO: 2956651 - RNA, 15 nt, Human
cuggguguggcgcag

SEQ ID NO: 2956652 - RNA, 21 nt, Human
cuggguggcaccagcagccug

SEQ ID NO: 2956653 - RNA, 14 nt, Human
cuggguguggcgca

SEQ ID NO: 2956654 - RNA, 15 nt, Human
cuggguguaaacaca

SEQ ID NO: 2956655 - RNA, 12 nt, Human
cugggcagagga

SEQ ID NO: 2956656 - RNA, 16 nt, Human
cugggcagaggaaagc

SEQ ID NO: 2956657 - RNA, 13 nt, Human
cugggcagaggaa

SEQ ID NO: 2956658 - RNA, 20 nt, Human
cugggcagaggaaagcaaag

SEQ ID NO: 2956659 - RNA, 13 nt, Human
cugggcagcugcc

SEQ ID NO: 2956660 - RNA, 20 nt, Human
cugggcagguuggugggggc

SEQ ID NO: 2956661 - RNA, 14 nt, Human
cugggcagcugccu

SEQ ID NO: 2956662 - RNA, 15 nt, Human
cugggcagcugccuc

SEQ ID NO: 2956663 - RNA, 16 nt, Human
cuggguggaugggcca

SEQ ID NO: 2956664 - RNA, 20 nt, Human
cuggguggcaccagcagccu

SEQ ID NO: 2956665 - RNA, 18 nt, Human
cuggguggcaccagcagc

SEQ ID NO: 2956666 - RNA, 13 nt, Human
cuggggagaaagu

SEQ ID NO: 2956667 - RNA, 14 nt, Human
cugcauuuaaaaga

SEQ ID NO: 2956668 - RNA, 13 nt, Human
cugcauuggcuuu

SEQ ID NO: 2956669 - RNA, 19 nt, Human
cugcccugugggcccccaa

SEQ ID NO: 2956670 - RNA, 12 nt, Human
cugcccuuaccu

SEQ ID NO: 2956671 - RNA, 17 nt, Human
cugcccuuaccugccag

SEQ ID NO: 2956672 - RNA, 16 nt, Human
cugcccuuaccugcca

SEQ ID NO: 2956673 - RNA, 16 nt, Human
cugccauauucuguug

SEQ ID NO: 2956674 - RNA, 16 nt, Human
cugccauccagguuca

SEQ ID NO: 2956675 - RNA, 18 nt, Human
cugccauccagguucagc

SEQ ID NO: 2956676 - RNA, 19 nt, Human
cugccauccagguucagcu

SEQ ID NO: 2956677 - RNA, 17 nt, Human
cugccagugccugggug

SEQ ID NO: 2956678 - RNA, 13 nt, Human
cugccagugccug

SEQ ID NO: 2956679 - RNA, 16 nt, Human
cugccagugccugggu

SEQ ID NO: 2956680 - RNA, 12 nt, Human
cugccagugccu

SEQ ID NO: 2956681 - RNA, 23 nt, Human
cugccagggacagaggggguggc

SEQ ID NO: 2956682 - RNA, 22 nt, Human
cugccagggacagagggggugg

SEQ ID NO: 2956683 - RNA, 20 nt, Human
cugccagggacagagggggu

SEQ ID NO: 2956684 - RNA, 17 nt, Human
cugcauuuaaaagauac

SEQ ID NO: 2956685 - RNA, 18 nt, Human
cugcauuuaaaagauaca

SEQ ID NO: 2956686 - RNA, 22 nt, Human
cugcaaccugauugugucucuu

SEQ ID NO: 2956687 - RNA, 18 nt, Human
cugcaagaauugaagcag

SEQ ID NO: 2956688 - RNA, 20 nt, Human
cugcaaccuccgccucuugg

SEQ ID NO: 2956689 - RNA, 22 nt, Human
cugcaaccuccgccucuugggu

SEQ ID NO: 2956690 - RNA, 14 nt, Human
cugcaaccugauug

SEQ ID NO: 2956691 - RNA, 21 nt, Human
cugcaaccugauugugucucu

SEQ ID NO: 2956692 - RNA, 19 nt, Human
cugcaaccugauugugucu

SEQ ID NO: 2956693 - RNA, 20 nt, Human
cugcaccgggccacagagaa

SEQ ID NO: 2956694 - RNA, 23 nt, Human
cugcaccgggccacagagaaagu

SEQ ID NO: 2956695 - RNA, 12 nt, Human
cugcaagggagu

SEQ ID NO: 2956696 - RNA, 20 nt, Human
cugcaagaauugaagcagga

SEQ ID NO: 2956697 - RNA, 24 nt, Human
cugaugggcaacccccagccugcu

SEQ ID NO: 2956698 - RNA, 22 nt, Human
cugaugggcaacccccagccug

SEQ ID NO: 2956699 - RNA, 23 nt, Human
cugaugggcaacccccagccugc

SEQ ID NO: 2956700 - RNA, 21 nt, Human
cugcaaaggguaucaggugcu

SEQ ID NO: 2956701 - RNA, 22 nt, Human
cugcaaaggguaucaggugcug

SEQ ID NO: 2956702 - RNA, 20 nt, Human
cugaugcuucuucagagacu

SEQ ID NO: 2956703 - RNA, 19 nt, Human
cugaugcuucuucagagac

SEQ ID NO: 2956704 - RNA, 18 nt, Human
cugaugcuucuucagaga

SEQ ID NO: 2956705 - RNA, 18 nt, Human
cugaugggcaacccccag

SEQ ID NO: 2956706 - RNA, 21 nt, Human
cugaugggcaacccccagccu

SEQ ID NO: 2956707 - RNA, 15 nt, Human
cucuuaugggcuggg

SEQ ID NO: 2956708 - RNA, 15 nt, Human
cucuuauaucuauau

SEQ ID NO: 2956709 - RNA, 18 nt, Human
cucuuauaucuauauuuu

SEQ ID NO: 2956710 - RNA, 14 nt, Human
cucuuaugggcugg

SEQ ID NO: 2956711 - RNA, 17 nt, Human
cugaugcuucuucagag

SEQ ID NO: 2956712 - RNA, 16 nt, Human
cugaugcuucuucaga

SEQ ID NO: 2956713 - RNA, 12 nt, Human
cugcagcuuugu

SEQ ID NO: 2956714 - RNA, 20 nt, Human
cugcaggcagccaggccaca

SEQ ID NO: 2956715 - RNA, 19 nt, Human
cugcaggcagccaggccac

SEQ ID NO: 2956716 - RNA, 18 nt, Human
cugcaggcagccaggcca

SEQ ID NO: 2956717 - RNA, 17 nt, Human
cugcaggcagccaggcc

SEQ ID NO: 2956718 - RNA, 16 nt, Human
cugcaggcagccaggc

SEQ ID NO: 2956719 - RNA, 15 nt, Human
cugcaggcagccagg

SEQ ID NO: 2956720 - RNA, 14 nt, Human
cugcaggcagccag

SEQ ID NO: 2956721 - RNA, 13 nt, Human
cugcaggcagcca

SEQ ID NO: 2956722 - RNA, 23 nt, Human
cugcagccucaaccuccugggcu

SEQ ID NO: 2956723 - RNA, 19 nt, Human
cugcacuccagccugggug

SEQ ID NO: 2956724 - RNA, 24 nt, Human
cugcagccucaaccuccugggcua

SEQ ID NO: 2956725 - RNA, 18 nt, Human
cugcacuccagccugggu

SEQ ID NO: 2956726 - RNA, 16 nt, Human
cugcacuccagccugg

SEQ ID NO: 2956727 - RNA, 17 nt, Human
cugcacuccagccuggg

SEQ ID NO: 2956728 - RNA, 16 nt, Human
cugcacuauagccuag

SEQ ID NO: 2956729 - RNA, 17 nt, Human
cugcacuauagccuagg

SEQ ID NO: 2956730 - RNA, 18 nt, Human
cugcacuauagccuaggu

SEQ ID NO: 2956731 - RNA, 20 nt, Human
cugcacuauagccuagguga

SEQ ID NO: 2956732 - RNA, 22 nt, Human
cugcacuauagccuaggugaca

SEQ ID NO: 2956733 - RNA, 23 nt, Human
cugcacuauagccuaggugacag

SEQ ID NO: 2956734 - RNA, 13 nt, Human
cugcacuccagcc

SEQ ID NO: 2956735 - RNA, 17 nt, Human
cugcacuccagccugag

SEQ ID NO: 2956736 - RNA, 20 nt, Human
cugcacuccagccugagcga

SEQ ID NO: 2956737 - RNA, 16 nt, Human
cugcacuccagccuga

SEQ ID NO: 2956738 - RNA, 15 nt, Human
cugcacuccagccug

SEQ ID NO: 2956739 - RNA, 17 nt, Human
aaauuuacuuuaaacua

SEQ ID NO: 2956740 - RNA, 20 nt, Human
aaauuuacuuuaaacuacau

SEQ ID NO: 2956741 - RNA, 20 nt, Human
aaauuuaguauuuuguuuca

SEQ ID NO: 2956742 - RNA, 18 nt, Human
aaauuucagcagcugcag

SEQ ID NO: 2956743 - RNA, 17 nt, Human
aaauuucagcagcugca

SEQ ID NO: 2956744 - RNA, 22 nt, Human
aaauuuccugggagcuuuugua

SEQ ID NO: 2956745 - RNA, 14 nt, Human
guauuuuuuuacua

SEQ ID NO: 2956746 - RNA, 15 nt, Human
guauuuuuuuacuaa

SEQ ID NO: 2956747 - RNA, 17 nt, Human
guauuuuuuuacuaaua

SEQ ID NO: 2956748 - RNA, 21 nt, Human
guauuuuuuuacuaauagaca

SEQ ID NO: 2956749 - RNA, 18 nt, Human
gucaaaguggugagaggc

SEQ ID NO: 2956750 - RNA, 19 nt, Human
gucaaaguggugagaggca

SEQ ID NO: 2956751 - RNA, 17 nt, Human
gucaacauuucucaugu

SEQ ID NO: 2956752 - RNA, 13 nt, Human
gucaacauuucuc

SEQ ID NO: 2956753 - RNA, 19 nt, Human
gucaacucauauuuucaug

SEQ ID NO: 2956754 - RNA, 16 nt, Human
gucacacacuuuggcu

SEQ ID NO: 2956755 - RNA, 20 nt, Human
gucacacaguauuacuucug

SEQ ID NO: 2956756 - RNA, 14 nt, Human
aaauucaugcugcu

SEQ ID NO: 2956757 - RNA, 16 nt, Human
aaauuccccacccuga

SEQ ID NO: 2956758 - RNA, 20 nt, Human
guauuuaauagguuuggaca

SEQ ID NO: 2956759 - RNA, 22 nt, Human
guauuggcuagagguucaaaga

SEQ ID NO: 2956760 - RNA, 19 nt, Human
aaauuaacuuuuauaaacu

SEQ ID NO: 2956761 - RNA, 21 nt, Human
aaauuaacuuuuauaaacuuu

SEQ ID NO: 2956762 - RNA, 22 nt, Human
aaauuaacuuuuauaaacuuua

SEQ ID NO: 2956763 - RNA, 23 nt, Human
aaauuaacuuuuauaaacuuuac

SEQ ID NO: 2956764 - RNA, 22 nt, Human
aaauguaagggaaacugccagc

SEQ ID NO: 2956765 - RNA, 17 nt, Human
aaaugggggugcauuug

SEQ ID NO: 2956766 - RNA, 18 nt, Human
aaaugggggugcauuuga

SEQ ID NO: 2956767 - RNA, 15 nt, Human
aaaugggggugcauu

SEQ ID NO: 2956768 - RNA, 16 nt, Human
aaaugggggugcauuu

SEQ ID NO: 2956769 - RNA, 15 nt, Human
guaugggagagaaga

SEQ ID NO: 2956770 - RNA, 15 nt, Human
guauucuuauuuaau

SEQ ID NO: 2956771 - RNA, 15 nt, Human
guauguguaauaaau

SEQ ID NO: 2956772 - RNA, 21 nt, Human
guauucucuccuguaccucuu

SEQ ID NO: 2956773 - RNA, 15 nt, Human
guaucccuacuguaa

SEQ ID NO: 2956774 - RNA, 22 nt, Human
guaugaucacggcucacugcag

SEQ ID NO: 2956775 - RNA, 18 nt, Human
guaucaaguauagaaaau

SEQ ID NO: 2956776 - RNA, 21 nt, Human
guaucccaugagccucagcau

SEQ ID NO: 2956777 - RNA, 14 nt, Human
guaugggagagaag

SEQ ID NO: 2956778 - RNA, 14 nt, Human
guaugcacacacau

SEQ ID NO: 2956779 - RNA, 14 nt, Human
guaugauucccagc

SEQ ID NO: 2956780 - RNA, 17 nt, Human
aaaugaaaaucgugaca

SEQ ID NO: 2956781 - RNA, 15 nt, Human
aaaucucaaauuucu

SEQ ID NO: 2956782 - RNA, 16 nt, Human
aaaucucaaauuucua

SEQ ID NO: 2956783 - RNA, 17 nt, Human
aaaucucaaauuucuaa

SEQ ID NO: 2956784 - RNA, 19 nt, Human
aaaucucaaauuucuaaau

SEQ ID NO: 2956785 - RNA, 22 nt, Human
aaaucuaggaaaauuauucuau

SEQ ID NO: 2956786 - RNA, 17 nt, Human
aaaucuaggaaaauuau

SEQ ID NO: 2956787 - RNA, 19 nt, Human
aaaucuacacuccagugag

SEQ ID NO: 2956788 - RNA, 14 nt, Human
aaauccuugaagau

SEQ ID NO: 2956789 - RNA, 13 nt, Human
aaaucgaugcagu

SEQ ID NO: 2956790 - RNA, 18 nt, Human
aaaucccuuaccucggug

SEQ ID NO: 2956791 - RNA, 15 nt, Human
aaaucccauuuaaaa

SEQ ID NO: 2956792 - RNA, 15 nt, Human
guaggaagacuuugg

SEQ ID NO: 2956793 - RNA, 18 nt, Human
guaggaagguuaauguuc

SEQ ID NO: 2956794 - RNA, 18 nt, Human
aaauccauacauuugugu

SEQ ID NO: 2956795 - RNA, 17 nt, Human
aaaggauacuuauuuaa

SEQ ID NO: 2956796 - RNA, 15 nt, Human
aaaggauacuuauuu

SEQ ID NO: 2956797 - RNA, 12 nt, Human
guagcugggacu

SEQ ID NO: 2956798 - RNA, 18 nt, Human
guagcugggacuacaggc

SEQ ID NO: 2956799 - RNA, 19 nt, Human
guagcugggacuacaggca

SEQ ID NO: 2956800 - RNA, 21 nt, Human
guagcugggacuacaggcacc

SEQ ID NO: 2956801 - RNA, 14 nt, Human
aaaugaaugucacu

SEQ ID NO: 2956802 - RNA, 19 nt, Human
aaaugaaugucacuucugg

SEQ ID NO: 2956803 - RNA, 21 nt, Human
aaaugaaugucacuucuggau

SEQ ID NO: 2956804 - RNA, 21 nt, Human
aaaugaaagcagggacuugaa

SEQ ID NO: 2956805 - RNA, 22 nt, Human
aaaugaaagcagggacuugaac

SEQ ID NO: 2956806 - RNA, 19 nt, Human
aaaugagccuggcaagaau

SEQ ID NO: 2956807 - RNA, 13 nt, Human
aaaugagccuggc

SEQ ID NO: 2956808 - RNA, 17 nt, Human
aaaugaggucagagccu

SEQ ID NO: 2956809 - RNA, 19 nt, Human
aaaugaggucagagccugc

SEQ ID NO: 2956810 - RNA, 16 nt, Human
aaaugagguacucucc

SEQ ID NO: 2956811 - RNA, 23 nt, Human
aaaugagguacucuccuggaaau

SEQ ID NO: 2956812 - RNA, 18 nt, Human
aaaugcaccuggaauaua

SEQ ID NO: 2956813 - RNA, 22 nt, Human
aaaugcaccuggaauauauaac

SEQ ID NO: 2956814 - RNA, 15 nt, Human
aaaugcaaaaaaaau

SEQ ID NO: 2956815 - RNA, 15 nt, Human
aaaugauuucacagu

SEQ ID NO: 2956816 - RNA, 17 nt, Human
aaaugcaaaaaaaauua

SEQ ID NO: 2956817 - RNA, 18 nt, Human
aaaugcaaaaaaaauuag

SEQ ID NO: 2956818 - RNA, 14 nt, Human
aaaugcaccuggaa

SEQ ID NO: 2956819 - RNA, 15 nt, Human
aaaugggcagagcag

SEQ ID NO: 2956820 - RNA, 20 nt, Human
aaaugggcagagcagagacc

SEQ ID NO: 2956821 - RNA, 18 nt, Human
aaaugggcagagcagaga

SEQ ID NO: 2956822 - RNA, 19 nt, Human
aaauggcuuccuggcaaua

SEQ ID NO: 2956823 - RNA, 18 nt, Human
aaauggcuuccuggcaau

SEQ ID NO: 2956824 - RNA, 13 nt, Human
aaaugcccagccc

SEQ ID NO: 2956825 - RNA, 14 nt, Human
aaaugcauuucuaa

SEQ ID NO: 2956826 - RNA, 15 nt, Human
aaaugcccagccccu

SEQ ID NO: 2956827 - RNA, 14 nt, Human
aaaugcccagcccc

SEQ ID NO: 2956828 - RNA, 18 nt, Human
aaaugcccagccccuucu

SEQ ID NO: 2956829 - RNA, 13 nt, Human
aaaugcccagcuu

SEQ ID NO: 2956830 - RNA, 22 nt, Human
aacaguaacauagcugugauuu

SEQ ID NO: 2956831 - RNA, 19 nt, Human
aacaguuguguuugaagca

SEQ ID NO: 2956832 - RNA, 19 nt, Human
aacagacuggaagcacagc

SEQ ID NO: 2956833 - RNA, 22 nt, Human
aacaggcugggcuucaguggca

SEQ ID NO: 2956834 - RNA, 13 nt, Human
aacaggcugggcu

SEQ ID NO: 2956835 - RNA, 23 nt, Human
aacaggcugggcuucaguggcag

SEQ ID NO: 2956836 - RNA, 18 nt, Human
aacaggcuuagugaugua

SEQ ID NO: 2956837 - RNA, 19 nt, Human
aacagguuuuccugaagaa

SEQ ID NO: 2956838 - RNA, 15 nt, Human
aacaguaacauagcu

SEQ ID NO: 2956839 - RNA, 22 nt, Human
aacaguagugauaguuguaccg

SEQ ID NO: 2956840 - RNA, 13 nt, Human
guccgagcuuuga

SEQ ID NO: 2956841 - RNA, 21 nt, Human
guccggucccugucccagugc

SEQ ID NO: 2956842 - RNA, 21 nt, Human
aacagaaauguacagcaagga

SEQ ID NO: 2956843 - RNA, 10 nt, Human
aacagaaaug

SEQ ID NO: 2956844 - RNA, 15 nt, Human
aacagaaauguacag

SEQ ID NO: 2956845 - RNA, 19 nt, Human
aacauuuggguuacuauuu

SEQ ID NO: 2956846 - RNA, 15 nt, Human
aacauacucccaucu

SEQ ID NO: 2956847 - RNA, 14 nt, Human
aacauacucccauc

SEQ ID NO: 2956848 - RNA, 22 nt, Human
aacauuuauuugaguggaguua

SEQ ID NO: 2956849 - RNA, 18 nt, Human
aacauuugguaaggggaa

SEQ ID NO: 2956850 - RNA, 18 nt, Human
aacaagucagucauucag

SEQ ID NO: 2956851 - RNA, 15 nt, Human
aacaagucagucauu

SEQ ID NO: 2956852 - RNA, 23 nt, Human
aacaaggccugucagcuaaagaa

SEQ ID NO: 2956853 - RNA, 23 nt, Human
aacaaggcaaggcugucaauuac

SEQ ID NO: 2956854 - RNA, 16 nt, Human
gucacaggcaggucca

SEQ ID NO: 2956855 - RNA, 13 nt, Human
gucacaggcaggu

SEQ ID NO: 2956856 - RNA, 15 nt, Human
gucacaggcaggucc

SEQ ID NO: 2956857 - RNA, 19 nt, Human
aacaagaccacguuucuaa

SEQ ID NO: 2956858 - RNA, 16 nt, Human
aacaagaccacguuuc

SEQ ID NO: 2956859 - RNA, 17 nt, Human
aacaagaccacguuucu

SEQ ID NO: 2956860 - RNA, 15 nt, Human
aacaaggaugaauua

SEQ ID NO: 2956861 - RNA, 21 nt, Human
aacaagccuccuuuuaaagua

SEQ ID NO: 2956862 - RNA, 21 nt, Human
aacacucuauaacaaaggaua

SEQ ID NO: 2956863 - RNA, 14 nt, Human
aacacucugagacu

SEQ ID NO: 2956864 - RNA, 13 nt, Human
aacacucugagac

SEQ ID NO: 2956865 - RNA, 12 nt, Human
aacacucugaga

SEQ ID NO: 2956866 - RNA, 11 nt, Human
aacacucugag

SEQ ID NO: 2956867 - RNA, 12 nt, Human
aacacuccuuca

SEQ ID NO: 2956868 - RNA, 21 nt, Human
aacacucauugaccugaggcc

SEQ ID NO: 2956869 - RNA, 17 nt, Human
aacacucauugaccuga

SEQ ID NO: 2956870 - RNA, 22 nt, Human
aacacugguuuuaaauauuuug

SEQ ID NO: 2956871 - RNA, 20 nt, Human
aacacuguucucugcccucc

SEQ ID NO: 2956872 - RNA, 15 nt, Human
aacacuguucucugc

SEQ ID NO: 2956873 - RNA, 21 nt, Human
aacacuguucucugcccucca

SEQ ID NO: 2956874 - RNA, 21 nt, Human
gucauuugagcagggcucagc

SEQ ID NO: 2956875 - RNA, 22 nt, Human
gucauuugagcagggcucagcg

SEQ ID NO: 2956876 - RNA, 24 nt, Human
guccaagcauaccaacacgagcag

SEQ ID NO: 2956877 - RNA, 21 nt, Human
guccaagcauuuagauguaua

SEQ ID NO: 2956878 - RNA, 15 nt, Human
aacguggcugcuuca

SEQ ID NO: 2956879 - RNA, 19 nt, Human
aacguggcugcuucaagga

SEQ ID NO: 2956880 - RNA, 16 nt, Human
aacguggcugcuucaa

SEQ ID NO: 2956881 - RNA, 22 nt, Human
aacguggcugcuucaaggaucc

SEQ ID NO: 2956882 - RNA, 19 nt, Human
gugaaccaccacacccagc

SEQ ID NO: 2956883 - RNA, 15 nt, Human
gugaacacaucagcu

SEQ ID NO: 2956884 - RNA, 18 nt, Human
aacucguuaauuuguagu

SEQ ID NO: 2956885 - RNA, 13 nt, Human
aacucccuuucaa

SEQ ID NO: 2956886 - RNA, 14 nt, Human
aacucccuuucaac

SEQ ID NO: 2956887 - RNA, 21 nt, Human
aacuccagaaagugacaagcu

SEQ ID NO: 2956888 - RNA, 14 nt, Human
aacuccagaaagug

SEQ ID NO: 2956889 - RNA, 15 nt, Human
gucuuagauguauau

SEQ ID NO: 2956890 - RNA, 24 nt, Human
gucuuuucuugcaugaggcuagug

SEQ ID NO: 2956891 - RNA, 19 nt, Human
gucuuuucuugcaugaggc

SEQ ID NO: 2956892 - RNA, 14 nt, Human
gucuuuucuugcau

SEQ ID NO: 2956893 - RNA, 17 nt, Human
gucuuuggacccugagg

SEQ ID NO: 2956894 - RNA, 15 nt, Human
gucuuuggacccuga

SEQ ID NO: 2956895 - RNA, 14 nt, Human
gucuuuggacccug

SEQ ID NO: 2956896 - RNA, 13 nt, Human
gucugcuuagaaa

SEQ ID NO: 2956897 - RNA, 12 nt, Human
gucugcuuagaa

SEQ ID NO: 2956898 - RNA, 22 nt, Human
gucuuaauuaaaagaauauuuu

SEQ ID NO: 2956899 - RNA, 21 nt, Human
gucuuaauuaaaagaauauuu

SEQ ID NO: 2956900 - RNA, 19 nt, Human
gucuuaauuaaaagaauau

SEQ ID NO: 2956901 - RNA, 17 nt, Human
aacccagcucuggucca

SEQ ID NO: 2956902 - RNA, 16 nt, Human
aaccccaaguuaguuc

SEQ ID NO: 2956903 - RNA, 20 nt, Human
aacccauauuuguacaccaa

SEQ ID NO: 2956904 - RNA, 18 nt, Human
aacccaaauguucaucaa

SEQ ID NO: 2956905 - RNA, 11 nt, Human
aacccagcucu

SEQ ID NO: 2956906 - RNA, 14 nt, Human
aacccagcucuggu

SEQ ID NO: 2956907 - RNA, 13 nt, Human
aacccagcucugg

SEQ ID NO: 2956908 - RNA, 13 nt, Human
aacccaaauguuc

SEQ ID NO: 2956909 - RNA, 23 nt, Human
aaccauuuugcugucccuuuucc

SEQ ID NO: 2956910 - RNA, 17 nt, Human
aaccuccgccucuuggg

SEQ ID NO: 2956911 - RNA, 14 nt, Human
aaccuccugggcua

SEQ ID NO: 2956912 - RNA, 24 nt, Human
aaccucuaaauucuuucauuuuag

SEQ ID NO: 2956913 - RNA, 13 nt, Human
aacccccagccug

SEQ ID NO: 2956914 - RNA, 14 nt, Human
aacccccagccugc

SEQ ID NO: 2956915 - RNA, 15 nt, Human
aacccccagccugcu

SEQ ID NO: 2956916 - RNA, 20 nt, Human
aaccuagggugauauuaacc

SEQ ID NO: 2956917 - RNA, 16 nt, Human
aacauuuugucauaua

SEQ ID NO: 2956918 - RNA, 20 nt, Human
aaccacaucuugcucugcug

SEQ ID NO: 2956919 - RNA, 22 nt, Human
aaccacaucuugcucugcugac

SEQ ID NO: 2956920 - RNA, 20 nt, Human
aaccaucauugaaaucuuuu

SEQ ID NO: 2956921 - RNA, 19 nt, Human
aaccaucauugaaaucuuu

SEQ ID NO: 2956922 - RNA, 21 nt, Human
aaccaucauugaaaucuuuuu

SEQ ID NO: 2956923 - RNA, 18 nt, Human
aaccacaucuugcucugc

SEQ ID NO: 2956924 - RNA, 12 nt, Human
aaccacagcagu

SEQ ID NO: 2956925 - RNA, 17 nt, Human
aaggaugcuuguacaua

SEQ ID NO: 2956926 - RNA, 19 nt, Human
aaggaugcuuguacauaau

SEQ ID NO: 2956927 - RNA, 18 nt, Human
aaggaugcacagaguugu

SEQ ID NO: 2956928 - RNA, 15 nt, Human
aaggaugcuuguaca

SEQ ID NO: 2956929 - RNA, 16 nt, Human
aaggaugcuuguacau

SEQ ID NO: 2956930 - RNA, 23 nt, Human
guugaugaucuuugcagacaggc

SEQ ID NO: 2956931 - RNA, 13 nt, Human
aaggauccugagc

SEQ ID NO: 2956932 - RNA, 14 nt, Human
aaggauccugagcc

SEQ ID NO: 2956933 - RNA, 23 nt, Human
aaggaugaucuaggaagacuuug

SEQ ID NO: 2956934 - RNA, 18 nt, Human
aaggaugaucuaggaaga

SEQ ID NO: 2956935 - RNA, 17 nt, Human
aaggauccugagccaga

SEQ ID NO: 2956936 - RNA, 15 nt, Human
aaggauccugagcca

SEQ ID NO: 2956937 - RNA, 19 nt, Human
aaggcuaccuuuguauucu

SEQ ID NO: 2956938 - RNA, 18 nt, Human
aaggccaaaggaagcaca

SEQ ID NO: 2956939 - RNA, 17 nt, Human
guugcccaggcaggucu

SEQ ID NO: 2956940 - RNA, 14 nt, Human
aaggcuccaggagc

SEQ ID NO: 2956941 - RNA, 18 nt, Human
guugcccaggcaggucuu

SEQ ID NO: 2956942 - RNA, 19 nt, Human
guugcccaggcaggucuug

SEQ ID NO: 2956943 - RNA, 21 nt, Human
guugcccaggcuggcgugcag

SEQ ID NO: 2956944 - RNA, 15 nt, Human
guugcccaggcaggu

SEQ ID NO: 2956945 - RNA, 17 nt, Human
guugcccaggcuggcgu

SEQ ID NO: 2956946 - RNA, 16 nt, Human
guuuaaaaucauuucu

SEQ ID NO: 2956947 - RNA, 10 nt, Human
guuuaaaauc

SEQ ID NO: 2956948 - RNA, 13 nt, Human
guuggguggaugc

SEQ ID NO: 2956949 - RNA, 18 nt, Human
guuggucccccuuccaug

SEQ ID NO: 2956950 - RNA, 18 nt, Human
guuguaccgcaaugugac

SEQ ID NO: 2956951 - RNA, 16 nt, Human
aaggguaucaggugcu

SEQ ID NO: 2956952 - RNA, 15 nt, Human
aaguaauaugcacac

SEQ ID NO: 2956953 - RNA, 16 nt, Human
aaguaauaugcacaca

SEQ ID NO: 2956954 - RNA, 19 nt, Human
guuucuaaaggcuaccuuu

SEQ ID NO: 2956955 - RNA, 12 nt, Human
aaguaauaugca

SEQ ID NO: 2956956 - RNA, 22 nt, Human
aaggggaauguuugccucugcc

SEQ ID NO: 2956957 - RNA, 23 nt, Human
aaggggaauguuugccucugccu

SEQ ID NO: 2956958 - RNA, 17 nt, Human
aagggccuggccugagc

SEQ ID NO: 2956959 - RNA, 14 nt, Human
aagggccuggccug

SEQ ID NO: 2956960 - RNA, 19 nt, Human
aagggccuggccugagcug

SEQ ID NO: 2956961 - RNA, 13 nt, Human
aagggccuggccu

SEQ ID NO: 2956962 - RNA, 21 nt, Human
guuucaaacauauauaacaau

SEQ ID NO: 2956963 - RNA, 14 nt, Human
guuuuacaguguuu

SEQ ID NO: 2956964 - RNA, 19 nt, Human
guuuucuguucuuucuggc

SEQ ID NO: 2956965 - RNA, 23 nt, Human
guuuucugagaaagacuauucaa

SEQ ID NO: 2956966 - RNA, 11 nt, Human
guuuucuguuc

SEQ ID NO: 2956967 - RNA, 22 nt, Human
guuugauucagacagcugccug

SEQ ID NO: 2956968 - RNA, 22 nt, Human
guuucuaaaggcuaccuuugua

SEQ ID NO: 2956969 - RNA, 23 nt, Human
guuucuaaaggcuaccuuuguau

SEQ ID NO: 2956970 - RNA, 13 nt, Human
guuugccucugcc

SEQ ID NO: 2956971 - RNA, 16 nt, Human
guuugccucugccucu

SEQ ID NO: 2956972 - RNA, 23 nt, Human
aagcuuguauuccuuuuucucuc

SEQ ID NO: 2956973 - RNA, 22 nt, Human
aagcuauucaguaauaacucua

SEQ ID NO: 2956974 - RNA, 21 nt, Human
aagcucuacugaggugcuaug

SEQ ID NO: 2956975 - RNA, 20 nt, Human
guuccauggccucuucagau

SEQ ID NO: 2956976 - RNA, 16 nt, Human
guucccauuugcuccu

SEQ ID NO: 2956977 - RNA, 20 nt, Human
guucccauuugcuccuuucu

SEQ ID NO: 2956978 - RNA, 16 nt, Human
guucuacccaggugcu

SEQ ID NO: 2956979 - RNA, 22 nt, Human
guucccuuugacgccaucccag

SEQ ID NO: 2956980 - RNA, 21 nt, Human
guucccuuugacgccauccca

SEQ ID NO: 2956981 - RNA, 20 nt, Human
guucccuuugacgccauccc

SEQ ID NO: 2956982 - RNA, 23 nt, Human
guucugggacacaguucaauucu

SEQ ID NO: 2956983 - RNA, 21 nt, Human
guucuugguuuguaaauuaac

SEQ ID NO: 2956984 - RNA, 17 nt, Human
guucuuaguuugcaguu

SEQ ID NO: 2956985 - RNA, 13 nt, Human
guugacaugggac

SEQ ID NO: 2956986 - RNA, 22 nt, Human
guugaugaucuuugcagacagg

SEQ ID NO: 2956987 - RNA, 14 nt, Human
guugacaugggaca

SEQ ID NO: 2956988 - RNA, 18 nt, Human
guugacaugggacauuug

SEQ ID NO: 2956989 - RNA, 14 nt, Human
guuacacaaagaac

SEQ ID NO: 2956990 - RNA, 20 nt, Human
guuaguaugaggcauuuguu

SEQ ID NO: 2956991 - RNA, 17 nt, Human
guuaguaugaggcauuu

SEQ ID NO: 2956992 - RNA, 18 nt, Human
guuaaugauagcuacugu

SEQ ID NO: 2956993 - RNA, 15 nt, Human
guucagcuccagcuc

SEQ ID NO: 2956994 - RNA, 18 nt, Human
guucagcuccagcucacc

SEQ ID NO: 2956995 - RNA, 16 nt, Human
guucagcuccagcuca

SEQ ID NO: 2956996 - RNA, 17 nt, Human
guucagcuccagcucac

SEQ ID NO: 2956997 - RNA, 17 nt, Human
guucaggguuggccccu

SEQ ID NO: 2956998 - RNA, 18 nt, Human
guucaggguuggccccug

SEQ ID NO: 2956999 - RNA, 19 nt, Human
guucaggguuggccccugc

SEQ ID NO: 2957000 - RNA, 19 nt, Human
aagccuccuccagccgcca

SEQ ID NO: 2957001 - RNA, 17 nt, Human
aagcuaggccuggccag

SEQ ID NO: 2957002 - RNA, 18 nt, Human
aagcuaggccuggccaga

SEQ ID NO: 2957003 - RNA, 16 nt, Human
aagcuaggccuggcca

SEQ ID NO: 2957004 - RNA, 22 nt, Human
aagcuaggccuggccagaugca

SEQ ID NO: 2957005 - RNA, 18 nt, Human
aagaugugacauguuuua

SEQ ID NO: 2957006 - RNA, 14 nt, Human
aagaugugacaugu

SEQ ID NO: 2957007 - RNA, 13 nt, Human
aagcaaaggagau

SEQ ID NO: 2957008 - RNA, 12 nt, Human
aagcaaaggaga

SEQ ID NO: 2957009 - RNA, 12 nt, Human
aagaugcagccg

SEQ ID NO: 2957010 - RNA, 14 nt, Human
aagagguuuuaaag

SEQ ID NO: 2957011 - RNA, 18 nt, Human
aagagguuuuaaagcuuc

SEQ ID NO: 2957012 - RNA, 18 nt, Human
aagagguuuuaaaaaaau

SEQ ID NO: 2957013 - RNA, 20 nt, Human
guggugguuuucuguucuuu

SEQ ID NO: 2957014 - RNA, 17 nt, Human
gugguuuucuguucuuu

SEQ ID NO: 2957015 - RNA, 23 nt, Human
guguuuccuggcacugcuuccag

SEQ ID NO: 2957016 - RNA, 17 nt, Human
gugucuugcaauggcag

SEQ ID NO: 2957017 - RNA, 18 nt, Human
gugucuugcaauggcagc

SEQ ID NO: 2957018 - RNA, 18 nt, Human
gugucuuuuuucacuaca

SEQ ID NO: 2957019 - RNA, 21 nt, Human
gugugaccacugcagaagaca

SEQ ID NO: 2957020 - RNA, 17 nt, Human
gugugacuacuccccca

SEQ ID NO: 2957021 - RNA, 14 nt, Human
guggguacgggagg

SEQ ID NO: 2957022 - RNA, 20 nt, Human
gugggggaucacagccucug

SEQ ID NO: 2957023 - RNA, 15 nt, Human
guggguggggcagug

SEQ ID NO: 2957024 - RNA, 16 nt, Human
gugguuucagaaaugu

SEQ ID NO: 2957025 - RNA, 14 nt, Human
guggugguuuucug

SEQ ID NO: 2957026 - RNA, 23 nt, Human
gugggaggaucucuugagccugg

SEQ ID NO: 2957027 - RNA, 13 nt, Human
gugggauccucca

SEQ ID NO: 2957028 - RNA, 14 nt, Human
gugggagugggccc

SEQ ID NO: 2957029 - RNA, 13 nt, Human
gugggagugggcc

SEQ ID NO: 2957030 - RNA, 23 nt, Human
guggcgcagcauauucaggaagc

SEQ ID NO: 2957031 - RNA, 22 nt, Human
guggcgcagcauauucaggaag

SEQ ID NO: 2957032 - RNA, 17 nt, Human
guggcuaacuuggguua

SEQ ID NO: 2957033 - RNA, 22 nt, Human
gugggacacccugugauggggc

SEQ ID NO: 2957034 - RNA, 21 nt, Human
gugggacagucaccucaugga

SEQ ID NO: 2957035 - RNA, 22 nt, Human
aagacccuuguggucccacccc

SEQ ID NO: 2957036 - RNA, 21 nt, Human
aagacccuuguggucccaccc

SEQ ID NO: 2957037 - RNA, 18 nt, Human
aagacccuugugguccca

SEQ ID NO: 2957038 - RNA, 16 nt, Human
aagacuaucuaaaugu

SEQ ID NO: 2957039 - RNA, 17 nt, Human
aagacuaucuaaauguu

SEQ ID NO: 2957040 - RNA, 18 nt, Human
aagacuaucuaaauguug

SEQ ID NO: 2957041 - RNA, 17 nt, Human
aagacugaguacguugu

SEQ ID NO: 2957042 - RNA, 17 nt, Human
aagacuguacaaaguag

SEQ ID NO: 2957043 - RNA, 21 nt, Human
aagacugaguacguugugcau

SEQ ID NO: 2957044 - RNA, 16 nt, Human
aagacuguacaaagua

SEQ ID NO: 2957045 - RNA, 13 nt, Human
aagagcaaaguag

SEQ ID NO: 2957046 - RNA, 16 nt, Human
aagacuuaaugagacu

SEQ ID NO: 2957047 - RNA, 19 nt, Human
aagagcuguucacagccag

SEQ ID NO: 2957048 - RNA, 17 nt, Human
aagacccucucaaacua

SEQ ID NO: 2957049 - RNA, 16 nt, Human
aagacaaaaagcuacu

SEQ ID NO: 2957050 - RNA, 14 nt, Human
aagacaaacugcau

SEQ ID NO: 2957051 - RNA, 23 nt, Human
aagaauugauugggcacaucauu

SEQ ID NO: 2957052 - RNA, 20 nt, Human
aagacaaaaagcuacuuauu

SEQ ID NO: 2957053 - RNA, 23 nt, Human
aagacaaaaagcuacuuauugua

SEQ ID NO: 2957054 - RNA, 16 nt, Human
aagaauugaagcagga

SEQ ID NO: 2957055 - RNA, 24 nt, Human
aagaaugcaguacuaacauuuauu

SEQ ID NO: 2957056 - RNA, 18 nt, Human
aagaaugauuaugaauua

SEQ ID NO: 2957057 - RNA, 19 nt, Human
guggcaccagcagccugga

SEQ ID NO: 2957058 - RNA, 18 nt, Human
guggauuuaacagaaaug

SEQ ID NO: 2957059 - RNA, 19 nt, Human
guggauuuaacagaaaugu

SEQ ID NO: 2957060 - RNA, 18 nt, Human
guggcaccagcagccugg

SEQ ID NO: 2957061 - RNA, 20 nt, Human
guggcagcucaccucucccu

SEQ ID NO: 2957062 - RNA, 16 nt, Human
guggcagcucaccucu

SEQ ID NO: 2957063 - RNA, 14 nt, Human
guggcagcucaccu

SEQ ID NO: 2957064 - RNA, 16 nt, Human
aagaaugauuaugaau

SEQ ID NO: 2957065 - RNA, 22 nt, Human
gugcuaucucccccagccccau

SEQ ID NO: 2957066 - RNA, 19 nt, Human
gugcuaucucccccagccc

SEQ ID NO: 2957067 - RNA, 12 nt, Human
gugcuauguucu

SEQ ID NO: 2957068 - RNA, 21 nt, Human
gugcugggauuacaagcguga

SEQ ID NO: 2957069 - RNA, 22 nt, Human
gugcugggauuacaagcgugag

SEQ ID NO: 2957070 - RNA, 20 nt, Human
gugcugggauuacaggugug

SEQ ID NO: 2957071 - RNA, 17 nt, Human
guggacacagcucuucu

SEQ ID NO: 2957072 - RNA, 23 nt, Human
guggacacagcucuucuccaggc

SEQ ID NO: 2957073 - RNA, 18 nt, Human
guggacacagcucuucuc

SEQ ID NO: 2957074 - RNA, 22 nt, Human
guggacacagcucuucuccagg

SEQ ID NO: 2957075 - RNA, 20 nt, Human
guggaugcugcugccccugc

SEQ ID NO: 2957076 - RNA, 21 nt, Human
guggaugccugguggcagcug

SEQ ID NO: 2957077 - RNA, 12 nt, Human
gugccucuggga

SEQ ID NO: 2957078 - RNA, 13 nt, Human
gugccucugggac

SEQ ID NO: 2957079 - RNA, 14 nt, Human
gugccuuauggaac

SEQ ID NO: 2957080 - RNA, 23 nt, Human
gugccuuauggaacacucugaga

SEQ ID NO: 2957081 - RNA, 21 nt, Human
gugccuuauggaacacucuga

SEQ ID NO: 2957082 - RNA, 21 nt, Human
gugaaccaccacacccagccc

SEQ ID NO: 2957083 - RNA, 22 nt, Human
gugccgagaaggaagccuccca

SEQ ID NO: 2957084 - RNA, 15 nt, Human
gugccucaagagaag

SEQ ID NO: 2957085 - RNA, 15 nt, Human
gugccuaauguguuu

SEQ ID NO: 2957086 - RNA, 17 nt, Human
aacuuggcgcugccccu

SEQ ID NO: 2957087 - RNA, 11 nt, Human
gugccuuaugg

SEQ ID NO: 2957088 - RNA, 18 nt, Human
aacuugucuuuggacccu

SEQ ID NO: 2957089 - RNA, 21 nt, Human
aacuuuaagaacuaaaauguu

SEQ ID NO: 2957090 - RNA, 13 nt, Human
aacuuuaccuuuu

SEQ ID NO: 2957091 - RNA, 20 nt, Human
aagaaagacuaucuaaaugu

SEQ ID NO: 2957092 - RNA, 22 nt, Human
aagaaagacuaucuaaauguug

SEQ ID NO: 2957093 - RNA, 15 nt, Human
aagaaaaaggaugca

SEQ ID NO: 2957094 - RNA, 17 nt, Human
aagaaaaaggaugcaca

SEQ ID NO: 2957095 - RNA, 18 nt, Human
aagaaaaaggaugcacag

SEQ ID NO: 2957096 - RNA, 18 nt, Human
gugcuaggaacacuccuu

SEQ ID NO: 2957097 - RNA, 17 nt, Human
gugcuaggaacacuccu

SEQ ID NO: 2957098 - RNA, 22 nt, Human
gugcuaggaacacuccuucaca

SEQ ID NO: 2957099 - RNA, 21 nt, Human
gugcuaucucccccagcccca

SEQ ID NO: 2957100 - RNA, 16 nt, Human
aagaagugaaaaucua

SEQ ID NO: 2957101 - RNA, 22 nt, Human
aagaagugaaaaucuacacucc

SEQ ID NO: 2957102 - RNA, 14 nt, Human
uaauagguuuggac

SEQ ID NO: 2957103 - RNA, 19 nt, Human
uaauagguuuggacaaaau

SEQ ID NO: 2957104 - RNA, 23 nt, Human
aaucuucauggaauucacaaagu

SEQ ID NO: 2957105 - RNA, 21 nt, Human
aaucuucauggaauucacaaa

SEQ ID NO: 2957106 - RNA, 20 nt, Human
aaucuucugaacuuggcgcu

SEQ ID NO: 2957107 - RNA, 13 nt, Human
aaucuucugaacu

SEQ ID NO: 2957108 - RNA, 14 nt, Human
uaaugaaagacugu

SEQ ID NO: 2957109 - RNA, 17 nt, Human
uaaugaaagacuguaca

SEQ ID NO: 2957110 - RNA, 18 nt, Human
uaaugaaagacuguacaa

SEQ ID NO: 2957111 - RNA, 19 nt, Human
uaaugaaagacuguacaaa

SEQ ID NO: 2957112 - RNA, 22 nt, Human
uaaugaaagacuguacaaagua

SEQ ID NO: 2957113 - RNA, 23 nt, Human
uaaugaaagacuguacaaaguag

SEQ ID NO: 2957114 - RNA, 14 nt, Human
uaaugaccaugaaa

SEQ ID NO: 2957115 - RNA, 16 nt, Human
uaaugaccaugaaaga

SEQ ID NO: 2957116 - RNA, 18 nt, Human
uaaugaccaugaaagacu

SEQ ID NO: 2957117 - RNA, 15 nt, Human
uaaugacuuaagcac

SEQ ID NO: 2957118 - RNA, 18 nt, Human
uaaugagcuuaagaaauu

SEQ ID NO: 2957119 - RNA, 19 nt, Human
uaaugagacuuuaaaagca

SEQ ID NO: 2957120 - RNA, 20 nt, Human
uaaugaccaugaaagacuuc

SEQ ID NO: 2957121 - RNA, 14 nt, Human
uaaugagacuuuaa

SEQ ID NO: 2957122 - RNA, 21 nt, Human
uaaugacuuaagcacacuuga

SEQ ID NO: 2957123 - RNA, 16 nt, Human
aaugaaaacaaugcag

SEQ ID NO: 2957124 - RNA, 12 nt, Human
aaugaaaacaau

SEQ ID NO: 2957125 - RNA, 18 nt, Human
uaaugguaguuuuacagu

SEQ ID NO: 2957126 - RNA, 16 nt, Human
uaaugauaacuggaaa

SEQ ID NO: 2957127 - RNA, 13 nt, Human
uaaugaggaaacu

SEQ ID NO: 2957128 - RNA, 13 nt, Human
aaugacucuuccc

SEQ ID NO: 2957129 - RNA, 17 nt, Human
aaugaaaacaaugcagu

SEQ ID NO: 2957130 - RNA, 18 nt, Human
aaugacuuacuguacaug

SEQ ID NO: 2957131 - RNA, 14 nt, Human
aaugacuuacugua

SEQ ID NO: 2957132 - RNA, 17 nt, Human
aaugacuuacuguacau

SEQ ID NO: 2957133 - RNA, 16 nt, Human
aaugagacuuuaaaag

SEQ ID NO: 2957134 - RNA, 17 nt, Human
aaugagacuuuaaaagc

SEQ ID NO: 2957135 - RNA, 20 nt, Human
aaugagacuuuaaaagcauu

SEQ ID NO: 2957136 - RNA, 21 nt, Human
aaugagagacacacugaagaa

SEQ ID NO: 2957137 - RNA, 15 nt, Human
aaugagccuggcaag

SEQ ID NO: 2957138 - RNA, 22 nt, Human
aaucaugucagucugcuuagaa

SEQ ID NO: 2957139 - RNA, 23 nt, Human
aaucaugucagucugcuuagaaa

SEQ ID NO: 2957140 - RNA, 23 nt, Human
aaucaugaauuaguuuuauaugc

SEQ ID NO: 2957141 - RNA, 19 nt, Human
aaucaugaauuaguuuuau

SEQ ID NO: 2957142 - RNA, 17 nt, Human
aaucaugaauuaguuuu

SEQ ID NO: 2957143 - RNA, 15 nt, Human
aaucaucaagucuuu

SEQ ID NO: 2957144 - RNA, 19 nt, Human
uaaguaucaaguauagaaa

SEQ ID NO: 2957145 - RNA, 20 nt, Human
uaaguaucaaguauagaaaa

SEQ ID NO: 2957146 - RNA, 17 nt, Human
uaaguaucaaguauaga

SEQ ID NO: 2957147 - RNA, 19 nt, Human
uaaguacuauguaucaaug

SEQ ID NO: 2957148 - RNA, 20 nt, Human
uaaguuuuuauggcuuuugu

SEQ ID NO: 2957149 - RNA, 22 nt, Human
uaaguuauuaagagguaagacu

SEQ ID NO: 2957150 - RNA, 23 nt, Human
uaaguuauuaagagguaagacuu

SEQ ID NO: 2957151 - RNA, 15 nt, Human
aaucuaggaaaauua

SEQ ID NO: 2957152 - RNA, 13 nt, Human
aaucucaaauaac

SEQ ID NO: 2957153 - RNA, 14 nt, Human
aaucucaaauuucu

SEQ ID NO: 2957154 - RNA, 12 nt, Human
aaucucaaauuu

SEQ ID NO: 2957155 - RNA, 15 nt, Human
aaucucaaauaacua

SEQ ID NO: 2957156 - RNA, 16 nt, Human
aaucuuauaauuuaaa

SEQ ID NO: 2957157 - RNA, 14 nt, Human
aaucuuauaauuua

SEQ ID NO: 2957158 - RNA, 18 nt, Human
aaucuaaauggaaccacu

SEQ ID NO: 2957159 - RNA, 13 nt, Human
aaucuaaauggaa

SEQ ID NO: 2957160 - RNA, 15 nt, Human
aaucuaaauggaacc

SEQ ID NO: 2957161 - RNA, 12 nt, Human
aaucuaaaugga

SEQ ID NO: 2957162 - RNA, 13 nt, Human
aauccuugaagau

SEQ ID NO: 2957163 - RNA, 18 nt, Human
uaauuauugauguuuuca

SEQ ID NO: 2957164 - RNA, 14 nt, Human
aaugagccuggcaa

SEQ ID NO: 2957165 - RNA, 14 nt, Human
aaugagcuuaagaa

SEQ ID NO: 2957166 - RNA, 16 nt, Human
uaauuuccauuuacuu

SEQ ID NO: 2957167 - RNA, 14 nt, Human
uacaaaaacacagc

SEQ ID NO: 2957168 - RNA, 13 nt, Human
uacaaaaacacag

SEQ ID NO: 2957169 - RNA, 15 nt, Human
uacaaaagcauguga

SEQ ID NO: 2957170 - RNA, 20 nt, Human
uacaaaaagcauaaaaauua

SEQ ID NO: 2957171 - RNA, 15 nt, Human
uacaaaaacacagca

SEQ ID NO: 2957172 - RNA, 15 nt, Human
uacaaaaagcauaaa

SEQ ID NO: 2957173 - RNA, 18 nt, Human
aauggaagacagcucuua

SEQ ID NO: 2957174 - RNA, 16 nt, Human
aauggacguguuauga

SEQ ID NO: 2957175 - RNA, 21 nt, Human
aaugccccugaauuuaaauag

SEQ ID NO: 2957176 - RNA, 13 nt, Human
aaugcugugcccu

SEQ ID NO: 2957177 - RNA, 20 nt, Human
aaugcugugcccuaaagugu

SEQ ID NO: 2957178 - RNA, 21 nt, Human
aaugcugugcccuaaagugua

SEQ ID NO: 2957179 - RNA, 24 nt, Human
aaugcccagccccuucugacccau

SEQ ID NO: 2957180 - RNA, 23 nt, Human
aaugcccagccccuucugaccca

SEQ ID NO: 2957181 - RNA, 22 nt, Human
aaugcccagccccuucugaccc

SEQ ID NO: 2957182 - RNA, 20 nt, Human
aaugcccagccccuucugac

SEQ ID NO: 2957183 - RNA, 22 nt, Human
aaugcaguacaggacauauauu

SEQ ID NO: 2957184 - RNA, 20 nt, Human
aaugcaguacaggacauaua

SEQ ID NO: 2957185 - RNA, 18 nt, Human
aaugcaguacuaacauuu

SEQ ID NO: 2957186 - RNA, 13 nt, Human
aaugcccagcccc

SEQ ID NO: 2957187 - RNA, 15 nt, Human
aaugcccagccccuu

SEQ ID NO: 2957188 - RNA, 14 nt, Human
aaugcccagccccu

SEQ ID NO: 2957189 - RNA, 19 nt, Human
uacaccacuacauucuguu

SEQ ID NO: 2957190 - RNA, 20 nt, Human
uacaccacuacauucuguua

SEQ ID NO: 2957191 - RNA, 15 nt, Human
uacaccacuacauuc

SEQ ID NO: 2957192 - RNA, 16 nt, Human
uacaccacuacauucu

SEQ ID NO: 2957193 - RNA, 17 nt, Human
uacaccacuacauucug

SEQ ID NO: 2957194 - RNA, 18 nt, Human
uacaccacuacauucugu

SEQ ID NO: 2957195 - RNA, 23 nt, Human
aauggacuuugcacacuuuggcc

SEQ ID NO: 2957196 - RNA, 18 nt, Human
aauggacuuugcacacuu

SEQ ID NO: 2957197 - RNA, 19 nt, Human
aauggacuuuuguacauag

SEQ ID NO: 2957198 - RNA, 13 nt, Human
uacaguaauaaau

SEQ ID NO: 2957199 - RNA, 18 nt, Human
uacagaggccaugggccu

SEQ ID NO: 2957200 - RNA, 23 nt, Human
uacagagcccacgcccccacugg

SEQ ID NO: 2957201 - RNA, 18 nt, Human
uacacuaagagagaauga

SEQ ID NO: 2957202 - RNA, 19 nt, Human
uacacuaagagagaaugag

SEQ ID NO: 2957203 - RNA, 12 nt, Human
aauguacugcau

SEQ ID NO: 2957204 - RNA, 15 nt, Human
uacauaaugcgugca

SEQ ID NO: 2957205 - RNA, 19 nt, Human
uacauaaugcgugcauacc

SEQ ID NO: 2957206 - RNA, 20 nt, Human
uacauaaugcgugcauacca

SEQ ID NO: 2957207 - RNA, 17 nt, Human
uacauaaugcgugcaua

SEQ ID NO: 2957208 - RNA, 15 nt, Human
uacaguaucucaggg

SEQ ID NO: 2957209 - RNA, 12 nt, Human
aauguaugugua

SEQ ID NO: 2957210 - RNA, 14 nt, Human
aauguauguguaag

SEQ ID NO: 2957211 - RNA, 14 nt, Human
aauguacugcauau

SEQ ID NO: 2957212 - RNA, 18 nt, Human
aauguacugcauaugaaa

SEQ ID NO: 2957213 - RNA, 11 nt, Human
aaugugauaug

SEQ ID NO: 2957214 - RNA, 21 nt, Human
aauaacaaugaaaguugauaa

SEQ ID NO: 2957215 - RNA, 17 nt, Human
aauaacuggaacacucu

SEQ ID NO: 2957216 - RNA, 22 nt, Human
aauaacauguaauuaaguacua

SEQ ID NO: 2957217 - RNA, 18 nt, Human
aauaaaacuuuuuaaaau

SEQ ID NO: 2957218 - RNA, 12 nt, Human
aauaaaacuuuu

SEQ ID NO: 2957219 - RNA, 14 nt, Human
aauaaaacuuuuua

SEQ ID NO: 2957220 - RNA, 15 nt, Human
aauaaaacuuuuuaa

SEQ ID NO: 2957221 - RNA, 23 nt, Human
aauaaaugaaugucacuucugga

SEQ ID NO: 2957222 - RNA, 16 nt, Human
aauaaaucauaaaacu

SEQ ID NO: 2957223 - RNA, 14 nt, Human
guuuucuuuuaaga

SEQ ID NO: 2957224 - RNA, 20 nt, Human
guuuugaagauucuauguua

SEQ ID NO: 2957225 - RNA, 17 nt, Human
guuuugaagauucuaug

SEQ ID NO: 2957226 - RNA, 16 nt, Human
guuuugaagauucuau

SEQ ID NO: 2957227 - RNA, 20 nt, Human
aaguuuuuauggcuuuugug

SEQ ID NO: 2957228 - RNA, 13 nt, Human
aauaaaaagguga

SEQ ID NO: 2957229 - RNA, 12 nt, Human
aauaaaaaggug

SEQ ID NO: 2957230 - RNA, 16 nt, Human
aauaaaaaggugacca

SEQ ID NO: 2957231 - RNA, 12 nt, Human
uaaauuaacuuu

SEQ ID NO: 2957232 - RNA, 14 nt, Human
uaaauuaacuuuua

SEQ ID NO: 2957233 - RNA, 17 nt, Human
uaaauuaacuuuuauaa

SEQ ID NO: 2957234 - RNA, 15 nt, Human
uaaauuaacuuuuau

SEQ ID NO: 2957235 - RNA, 16 nt, Human
uaaauuaacuuuuaua

SEQ ID NO: 2957236 - RNA, 15 nt, Human
uaaauguugaaagau

SEQ ID NO: 2957237 - RNA, 20 nt, Human
uaaauguugaaagaucaaaa

SEQ ID NO: 2957238 - RNA, 23 nt, Human
uaaaugcaccuggaauauauaac

SEQ ID NO: 2957239 - RNA, 22 nt, Human
uaaaucuccaaaauaaaacuuu

SEQ ID NO: 2957240 - RNA, 14 nt, Human
uaaaucuccaaaau

SEQ ID NO: 2957241 - RNA, 15 nt, Human
uaaaucuccaaaaua

SEQ ID NO: 2957242 - RNA, 18 nt, Human
uaaaucuccaaaauaaaa

SEQ ID NO: 2957243 - RNA, 14 nt, Human
uaaauagaugacau

SEQ ID NO: 2957244 - RNA, 19 nt, Human
uaaauagaugacauugacu

SEQ ID NO: 2957245 - RNA, 21 nt, Human
uaaauagaugacauugacuau

SEQ ID NO: 2957246 - RNA, 17 nt, Human
aauaauuuuuauauuug

SEQ ID NO: 2957247 - RNA, 19 nt, Human
aauaauuuuuauauuugaa

SEQ ID NO: 2957248 - RNA, 16 nt, Human
aauaauuuuuauauuu

SEQ ID NO: 2957249 - RNA, 19 nt, Human
uaaauaaugugaaacugga

SEQ ID NO: 2957250 - RNA, 20 nt, Human
aauaauuuuuauauuugaaa

SEQ ID NO: 2957251 - RNA, 19 nt, Human
aauaucuuuuuuuuaauaa

SEQ ID NO: 2957252 - RNA, 20 nt, Human
aauaucugaaaauguaugug

SEQ ID NO: 2957253 - RNA, 16 nt, Human
aauaucuccgucaacu

SEQ ID NO: 2957254 - RNA, 21 nt, Human
aauaucuccgucaacucauau

SEQ ID NO: 2957255 - RNA, 16 nt, Human
aauaucugaaaaugua

SEQ ID NO: 2957256 - RNA, 17 nt, Human
aauaucugaaaauguau

SEQ ID NO: 2957257 - RNA, 18 nt, Human
aauaucugaaaauguaug

SEQ ID NO: 2957258 - RNA, 19 nt, Human
aauaucugaaaauguaugu

SEQ ID NO: 2957259 - RNA, 15 nt, Human
uaacuuuuauaaacu

SEQ ID NO: 2957260 - RNA, 17 nt, Human
uaacuuuuauaaacuuu

SEQ ID NO: 2957261 - RNA, 18 nt, Human
uaacuuuuauaaacuuua

SEQ ID NO: 2957262 - RNA, 15 nt, Human
aauauugguugggau

SEQ ID NO: 2957263 - RNA, 21 nt, Human
aauauugguugggaugacuug

SEQ ID NO: 2957264 - RNA, 14 nt, Human
aauauuucagauaa

SEQ ID NO: 2957265 - RNA, 15 nt, Human
aauauuucagauaau

SEQ ID NO: 2957266 - RNA, 21 nt, Human
aauauuuuagguguaaaauaa

SEQ ID NO: 2957267 - RNA, 14 nt, Human
aauaugcaaagucu

SEQ ID NO: 2957268 - RNA, 18 nt, Human
aauaugcaaagucuaggu

SEQ ID NO: 2957269 - RNA, 17 nt, Human
aauauugauaugcuuau

SEQ ID NO: 2957270 - RNA, 18 nt, Human
aauauugauaugcuuaua

SEQ ID NO: 2957271 - RNA, 24 nt, Human
aauaugcaaagcacugacuucuaa

SEQ ID NO: 2957272 - RNA, 15 nt, Human
aauaugcacacauuu

SEQ ID NO: 2957273 - RNA, 16 nt, Human
aauaugaugacuguuu

SEQ ID NO: 2957274 - RNA, 17 nt, Human
aauaugaugacuguuuu

SEQ ID NO: 2957275 - RNA, 17 nt, Human
aauaugcaaagcacuga

SEQ ID NO: 2957276 - RNA, 15 nt, Human
aauaugcaaagcacu

SEQ ID NO: 2957277 - RNA, 22 nt, Human
aauauugcugauggugcaauga

SEQ ID NO: 2957278 - RNA, 21 nt, Human
aauauugcugauggugcaaug

SEQ ID NO: 2957279 - RNA, 18 nt, Human
aauauugcugauggugca

SEQ ID NO: 2957280 - RNA, 15 nt, Human
aauauugcugauggu

SEQ ID NO: 2957281 - RNA, 13 nt, Human
aauauugcugaug

SEQ ID NO: 2957282 - RNA, 12 nt, Human
aauauugcugau

SEQ ID NO: 2957283 - RNA, 11 nt, Human
aauauugcuga

SEQ ID NO: 2957284 - RNA, 23 nt, Human
aauauugccaaugcuacaguaau

SEQ ID NO: 2957285 - RNA, 18 nt, Human
aauagacaauuuauuaug

SEQ ID NO: 2957286 - RNA, 23 nt, Human
aauagacaauuuauuauggcaca

SEQ ID NO: 2957287 - RNA, 19 nt, Human
aauagauugcucaaaucag

SEQ ID NO: 2957288 - RNA, 20 nt, Human
aauagcauguccuaaugcuu

SEQ ID NO: 2957289 - RNA, 22 nt, Human
aauagauugcucaaaucagguu

SEQ ID NO: 2957290 - RNA, 19 nt, Human
aauagaugacauugacuau

SEQ ID NO: 2957291 - RNA, 21 nt, Human
aauagaugacauugacuauuu

SEQ ID NO: 2957292 - RNA, 22 nt, Human
aauagaugacauugacuauuuu

SEQ ID NO: 2957293 - RNA, 13 nt, Human
aauagcugggacu

SEQ ID NO: 2957294 - RNA, 14 nt, Human
aauagcugggacua

SEQ ID NO: 2957295 - RNA, 24 nt, Human
aauagcuuuuuucucugauacaga

SEQ ID NO: 2957296 - RNA, 19 nt, Human
aauaggaaaaacugauuuu

SEQ ID NO: 2957297 - RNA, 18 nt, Human
aauaggaaaaacugauuu

SEQ ID NO: 2957298 - RNA, 17 nt, Human
aauaggaaaaacugauu

SEQ ID NO: 2957299 - RNA, 16 nt, Human
aauaggaaaaacugau

SEQ ID NO: 2957300 - RNA, 15 nt, Human
aauaggaaaaacuga

SEQ ID NO: 2957301 - RNA, 18 nt, Human
aauaggcacuuuaaaaca

SEQ ID NO: 2957302 - RNA, 14 nt, Human
aauaggcacuuuaa

SEQ ID NO: 2957303 - RNA, 15 nt, Human
aauaggcacuuuaaa

SEQ ID NO: 2957304 - RNA, 17 nt, Human
aauaggcacuuuaaaac

SEQ ID NO: 2957305 - RNA, 18 nt, Human
aauaggcguaacuaauuu

SEQ ID NO: 2957306 - RNA, 16 nt, Human
uaaccucuaaauucuu

SEQ ID NO: 2957307 - RNA, 15 nt, Human
uaacauggaaguacu

SEQ ID NO: 2957308 - RNA, 16 nt, Human
uaacauggaaguacua

SEQ ID NO: 2957309 - RNA, 15 nt, Human
uaacuaaaagguaug

SEQ ID NO: 2957310 - RNA, 14 nt, Human
uaacuaaaagguau

SEQ ID NO: 2957311 - RNA, 14 nt, Human
uaacauggaaguac

SEQ ID NO: 2957312 - RNA, 21 nt, Human
aauauccuaauaaaaagguga

SEQ ID NO: 2957313 - RNA, 19 nt, Human
aauauccuaauaaaaaggu

SEQ ID NO: 2957314 - RNA, 15 nt, Human
aauauccuaauaaaa

SEQ ID NO: 2957315 - RNA, 12 nt, Human
aauaucacuugu

SEQ ID NO: 2957316 - RNA, 20 nt, Human
aauauccaauugcugcuugu

SEQ ID NO: 2957317 - RNA, 15 nt, Human
aauaucacuugucaa

SEQ ID NO: 2957318 - RNA, 14 nt, Human
aauauccuaauaaa

SEQ ID NO: 2957319 - RNA, 13 nt, Human
aauauccuaauaa

SEQ ID NO: 2957320 - RNA, 12 nt, Human
aauauccuaaua

SEQ ID NO: 2957321 - RNA, 22 nt, Human
aauaucccuuggacauuuuaug

SEQ ID NO: 2957322 - RNA, 20 nt, Human
aauaucccuuggacauuuua

SEQ ID NO: 2957323 - RNA, 21 nt, Human
aauaucccuuggacauuuuau

SEQ ID NO: 2957324 - RNA, 22 nt, Human
acaagcuccaagcucccaggca

SEQ ID NO: 2957325 - RNA, 19 nt, Human
acaagcuccaagcucccag

SEQ ID NO: 2957326 - RNA, 17 nt, Human
acaagcuccaagcuccc

SEQ ID NO: 2957327 - RNA, 16 nt, Human
acaagcuccaagcucc

SEQ ID NO: 2957328 - RNA, 15 nt, Human
acaagcuccaagcuc

SEQ ID NO: 2957329 - RNA, 16 nt, Human
uagcucaggugucccu

SEQ ID NO: 2957330 - RNA, 16 nt, Human
uagcuacuaauuuuaa

SEQ ID NO: 2957331 - RNA, 17 nt, Human
acaaauuuacagagaca

SEQ ID NO: 2957332 - RNA, 17 nt, Human
acaacaucuuuuucuac

SEQ ID NO: 2957333 - RNA, 16 nt, Human
acaagaccacguuucu

SEQ ID NO: 2957334 - RNA, 17 nt, Human
acaagaccacguuucua

SEQ ID NO: 2957335 - RNA, 18 nt, Human
acaagagcccaggccucc

SEQ ID NO: 2957336 - RNA, 22 nt, Human
acaagagcccaggccuccuaca

SEQ ID NO: 2957337 - RNA, 17 nt, Human
acaagcgugagccacug

SEQ ID NO: 2957338 - RNA, 22 nt, Human
acaagcucacagaccuuugaac

SEQ ID NO: 2957339 - RNA, 13 nt, Human
acaagcuccaagc

SEQ ID NO: 2957340 - RNA, 15 nt, Human
acaaagcuuuugcau

SEQ ID NO: 2957341 - RNA, 22 nt, Human
acaaagcuuuugcauauugcau

SEQ ID NO: 2957342 - RNA, 23 nt, Human
acaaagcuuuugcauauugcaua

SEQ ID NO: 2957343 - RNA, 21 nt, Human
acaaaggauacuuauuuaaau

SEQ ID NO: 2957344 - RNA, 23 nt, Human
acaaaggauacuuauuuaaauag

SEQ ID NO: 2957345 - RNA, 21 nt, Human
acaaagcgugguggacaugca

SEQ ID NO: 2957346 - RNA, 14 nt, Human
acaaaacuuuucua

SEQ ID NO: 2957347 - RNA, 24 nt, Human
acaaaggauacuuauuuaaauaga

SEQ ID NO: 2957348 - RNA, 17 nt, Human
uagauaggccaugggca

SEQ ID NO: 2957349 - RNA, 22 nt, Human
uagauaggucagugcaaauacu

SEQ ID NO: 2957350 - RNA, 20 nt, Human
uagaugaaugucaguuguua

SEQ ID NO: 2957351 - RNA, 21 nt, Human
uagaugcaguucugaagaaga

SEQ ID NO: 2957352 - RNA, 20 nt, Human
uagaugcaguucugaagaag

SEQ ID NO: 2957353 - RNA, 23 nt, Human
aauuugccuaauaugaugacugu

SEQ ID NO: 2957354 - RNA, 13 nt, Human
aauuugguuuuca

SEQ ID NO: 2957355 - RNA, 16 nt, Human
aauuuguuauaaugaa

SEQ ID NO: 2957356 - RNA, 15 nt, Human
aauuugguuuucaca

SEQ ID NO: 2957357 - RNA, 21 nt, Human
aauuugguuuucacauuggaa

SEQ ID NO: 2957358 - RNA, 20 nt, Human
aauuugugauacaaugcugu

SEQ ID NO: 2957359 - RNA, 10 nt, Human
uacuuuuugg

SEQ ID NO: 2957360 - RNA, 21 nt, Human
aauuuuucuuauuucauuucu

SEQ ID NO: 2957361 - RNA, 22 nt, Human
aauuuuuuuaucgucacugcuu

SEQ ID NO: 2957362 - RNA, 22 nt, Human
aauuuuuucucuaggaaauauu

SEQ ID NO: 2957363 - RNA, 20 nt, Human
uacuucuccacccugcucuc

SEQ ID NO: 2957364 - RNA, 15 nt, Human
uacuucugcuacaua

SEQ ID NO: 2957365 - RNA, 19 nt, Human
uacuucuuaggguuaugau

SEQ ID NO: 2957366 - RNA, 14 nt, Human
uacuucuuauacau

SEQ ID NO: 2957367 - RNA, 15 nt, Human
uacuucuuauacauu

SEQ ID NO: 2957368 - RNA, 16 nt, Human
uacuucuuauacauuu

SEQ ID NO: 2957369 - RNA, 12 nt, Human
aauuugcacauu

SEQ ID NO: 2957370 - RNA, 12 nt, Human
uacuuauuuaaa

SEQ ID NO: 2957371 - RNA, 14 nt, Human
uacuuauuuaaaua

SEQ ID NO: 2957372 - RNA, 21 nt, Human
uacuuauuuaaauagaugaca

SEQ ID NO: 2957373 - RNA, 16 nt, Human
aauuugcacauuaaau

SEQ ID NO: 2957374 - RNA, 14 nt, Human
aauuugcacauuaa

SEQ ID NO: 2957375 - RNA, 13 nt, Human
uacuucuccaccc

SEQ ID NO: 2957376 - RNA, 18 nt, Human
uacuucuccacccugcuc

SEQ ID NO: 2957377 - RNA, 16 nt, Human
uacuucaugcugucua

SEQ ID NO: 2957378 - RNA, 17 nt, Human
aauuucuaggacugaau

SEQ ID NO: 2957379 - RNA, 18 nt, Human
aauuucuaggacugaauu

SEQ ID NO: 2957380 - RNA, 22 nt, Human
aauuucuaggacugaauuauga

SEQ ID NO: 2957381 - RNA, 13 nt, Human
aauuuauuauggc

SEQ ID NO: 2957382 - RNA, 14 nt, Human
aauuuauuauggca

SEQ ID NO: 2957383 - RNA, 23 nt, Human
aauuucuaggacugaauuaugaa

SEQ ID NO: 2957384 - RNA, 16 nt, Human
aauuuacuuuaaacua

SEQ ID NO: 2957385 - RNA, 15 nt, Human
aauuuacuuuaaacu

SEQ ID NO: 2957386 - RNA, 18 nt, Human
aauuuacuuuaaacuaca

SEQ ID NO: 2957387 - RNA, 13 nt, Human
aauuuaguauuuu

SEQ ID NO: 2957388 - RNA, 17 nt, Human
aauuuacagagacagaa

SEQ ID NO: 2957389 - RNA, 18 nt, Human
aauuuacagagacagaaa

SEQ ID NO: 2957390 - RNA, 17 nt, Human
aauuuaccugaagucuu

SEQ ID NO: 2957391 - RNA, 15 nt, Human
aauuuacauacucug

SEQ ID NO: 2957392 - RNA, 15 nt, Human
aauuuaccugaaguc

SEQ ID NO: 2957393 - RNA, 17 nt, Human
aauugacauugaaaucu

SEQ ID NO: 2957394 - RNA, 18 nt, Human
aauugacauugaaaucua

SEQ ID NO: 2957395 - RNA, 15 nt, Human
uacgucugacaggca

SEQ ID NO: 2957396 - RNA, 22 nt, Human
uacuauuucuugugguuauaac

SEQ ID NO: 2957397 - RNA, 21 nt, Human
uacuauuucuugugguuauaa

SEQ ID NO: 2957398 - RNA, 12 nt, Human
uacuauuucuug

SEQ ID NO: 2957399 - RNA, 22 nt, Human
uacucuacccucuuagaaaaac

SEQ ID NO: 2957400 - RNA, 16 nt, Human
uacucuacccucuuag

SEQ ID NO: 2957401 - RNA, 16 nt, Human
uacgucugacaggcaa

SEQ ID NO: 2957402 - RNA, 14 nt, Human
uacuaaaaauacaa

SEQ ID NO: 2957403 - RNA, 13 nt, Human
uacgugaguccug

SEQ ID NO: 2957404 - RNA, 21 nt, Human
uacuaaaaguuuugagaaauu

SEQ ID NO: 2957405 - RNA, 16 nt, Human
uacuaaaaaugcaaaa

SEQ ID NO: 2957406 - RNA, 18 nt, Human
uacuaaaaauacaaaaaa

SEQ ID NO: 2957407 - RNA, 15 nt, Human
uacuguaauuuguga

SEQ ID NO: 2957408 - RNA, 16 nt, Human
uacuguaauuugugau

SEQ ID NO: 2957409 - RNA, 17 nt, Human
uacuguaauuugugaua

SEQ ID NO: 2957410 - RNA, 23 nt, Human
uacugggaaagggauuuucagcc

SEQ ID NO: 2957411 - RNA, 14 nt, Human
uacugaacaguaac

SEQ ID NO: 2957412 - RNA, 19 nt, Human
uacugaaauaaacgucuua

SEQ ID NO: 2957413 - RNA, 22 nt, Human
uacugaaauaaacgucuuaaau

SEQ ID NO: 2957414 - RNA, 17 nt, Human
uacugagagugaacaaa

SEQ ID NO: 2957415 - RNA, 20 nt, Human
aauugauugggcacaucauu

SEQ ID NO: 2957416 - RNA, 23 nt, Human
aauugauugggcacaucauuuca

SEQ ID NO: 2957417 - RNA, 19 nt, Human
aauugauugggcacaucau

SEQ ID NO: 2957418 - RNA, 23 nt, Human
uacuguaauuugugauacaaugc

SEQ ID NO: 2957419 - RNA, 18 nt, Human
aauugaggacacugauau

SEQ ID NO: 2957420 - RNA, 13 nt, Human
uaguagagacagg

SEQ ID NO: 2957421 - RNA, 16 nt, Human
uaguguuggagaagaa

SEQ ID NO: 2957422 - RNA, 12 nt, Human
uaguguuggaga

SEQ ID NO: 2957423 - RNA, 12 nt, Human
uagguugugaau

SEQ ID NO: 2957424 - RNA, 21 nt, Human
uagguuggcaaaaaggcagga

SEQ ID NO: 2957425 - RNA, 11 nt, Human
acacagugagu

SEQ ID NO: 2957426 - RNA, 22 nt, Human
acacagcucuucuccaggcugu

SEQ ID NO: 2957427 - RNA, 14 nt, Human
acacacugaagaag

SEQ ID NO: 2957428 - RNA, 24 nt, Human
acaaugcaguacaggacauauauu

SEQ ID NO: 2957429 - RNA, 15 nt, Human
acaaugguuuucuug

SEQ ID NO: 2957430 - RNA, 14 nt, Human
acaaugcuguauuu

SEQ ID NO: 2957431 - RNA, 17 nt, Human
acaaugcuguauuuuaa

SEQ ID NO: 2957432 - RNA, 21 nt, Human
acaaugguuuucuuguguguu

SEQ ID NO: 2957433 - RNA, 14 nt, Human
acacaacuauauug

SEQ ID NO: 2957434 - RNA, 17 nt, Human
acacaacuauauuguuu

SEQ ID NO: 2957435 - RNA, 11 nt, Human
acacacagcuc

SEQ ID NO: 2957436 - RNA, 12 nt, Human
acacacagcucu

SEQ ID NO: 2957437 - RNA, 19 nt, Human
acacacagcucuguccugg

SEQ ID NO: 2957438 - RNA, 18 nt, Human
acacacauauauuauuug

SEQ ID NO: 2957439 - RNA, 14 nt, Human
acacaccuaacuua

SEQ ID NO: 2957440 - RNA, 13 nt, Human
acacacugaagaa

SEQ ID NO: 2957441 - RNA, 20 nt, Human
acacacucaaaucaagaaac

SEQ ID NO: 2957442 - RNA, 22 nt, Human
uauaaccaguguuguggauuua

SEQ ID NO: 2957443 - RNA, 14 nt, Human
acacuaagagagaa

SEQ ID NO: 2957444 - RNA, 18 nt, Human
acacuaagagagaaugag

SEQ ID NO: 2957445 - RNA, 16 nt, Human
acacuaaccacgcugg

SEQ ID NO: 2957446 - RNA, 17 nt, Human
acacuaaccacgcugga

SEQ ID NO: 2957447 - RNA, 19 nt, Human
acacuaaccacgcuggacc

SEQ ID NO: 2957448 - RNA, 17 nt, Human
acacuaagagagaauga

SEQ ID NO: 2957449 - RNA, 14 nt, Human
acaccuugacaggg

SEQ ID NO: 2957450 - RNA, 15 nt, Human
acaccuugacagggc

SEQ ID NO: 2957451 - RNA, 16 nt, Human
acaccuugacagggca

SEQ ID NO: 2957452 - RNA, 18 nt, Human
acaccucugcacaagcug

SEQ ID NO: 2957453 - RNA, 23 nt, Human
uaguucaaucuggauucauauuu

SEQ ID NO: 2957454 - RNA, 23 nt, Human
uauaaaauaauuuuuauauuuga

SEQ ID NO: 2957455 - RNA, 12 nt, Human
acacccagccca

SEQ ID NO: 2957456 - RNA, 13 nt, Human
acacccagcccac

SEQ ID NO: 2957457 - RNA, 22 nt, Human
acacauguccaagaagcccagg

SEQ ID NO: 2957458 - RNA, 21 nt, Human
acacauguccaagaagcccag

SEQ ID NO: 2957459 - RNA, 13 nt, Human
acacauguccaag

SEQ ID NO: 2957460 - RNA, 19 nt, Human
acacauguccaagaagccc

SEQ ID NO: 2957461 - RNA, 18 nt, Human
acacauguccaagaagcc

SEQ ID NO: 2957462 - RNA, 18 nt, Human
acacaugcugaacaucac

SEQ ID NO: 2957463 - RNA, 21 nt, Human
acagacuggaagcacagcuuc

SEQ ID NO: 2957464 - RNA, 17 nt, Human
acagacuggaagcacag

SEQ ID NO: 2957465 - RNA, 19 nt, Human
acagacuggaagcacagcu

SEQ ID NO: 2957466 - RNA, 18 nt, Human
acagacacaggcccggcu

SEQ ID NO: 2957467 - RNA, 22 nt, Human
acagacacaggcccggcuccag

SEQ ID NO: 2957468 - RNA, 17 nt, Human
acagacacaggcccggc

SEQ ID NO: 2957469 - RNA, 15 nt, Human
acagacacaggcccg

SEQ ID NO: 2957470 - RNA, 19 nt, Human
uauauucauucuuuuugaa

SEQ ID NO: 2957471 - RNA, 20 nt, Human
uauauucauucuuuuugaaa

SEQ ID NO: 2957472 - RNA, 14 nt, Human
uauauuauuugcag

SEQ ID NO: 2957473 - RNA, 12 nt, Human
uauauuuacaaa

SEQ ID NO: 2957474 - RNA, 17 nt, Human
acacuuuggcccagggu

SEQ ID NO: 2957475 - RNA, 18 nt, Human
acacuuuggcccagggug

SEQ ID NO: 2957476 - RNA, 18 nt, Human
acagaaaauucuucucca

SEQ ID NO: 2957477 - RNA, 18 nt, Human
acacuugugaauaaagag

SEQ ID NO: 2957478 - RNA, 12 nt, Human
acacuugugaau

SEQ ID NO: 2957479 - RNA, 13 nt, Human
acacuugugaaua

SEQ ID NO: 2957480 - RNA, 23 nt, Human
acacuguuucaaacuuuacuaug

SEQ ID NO: 2957481 - RNA, 15 nt, Human
acacuguuucaaacu

SEQ ID NO: 2957482 - RNA, 13 nt, Human
acacuuaaaaaug

SEQ ID NO: 2957483 - RNA, 15 nt, Human
acacuuaaaaauggu

SEQ ID NO: 2957484 - RNA, 12 nt, Human
acacugaagaag

SEQ ID NO: 2957485 - RNA, 14 nt, Human
acacugaagaagca

SEQ ID NO: 2957486 - RNA, 15 nt, Human
acacuguucucugcc

SEQ ID NO: 2957487 - RNA, 14 nt, Human
acacuguucucugc

SEQ ID NO: 2957488 - RNA, 20 nt, Human
acacuguucucugcccucca

SEQ ID NO: 2957489 - RNA, 18 nt, Human
acacuguucucugcccuc

SEQ ID NO: 2957490 - RNA, 17 nt, Human
acacuguucucugcccu

SEQ ID NO: 2957491 - RNA, 16 nt, Human
acacuguucucugccc

SEQ ID NO: 2957492 - RNA, 23 nt, Human
acacuguucucugcccuccaaga

SEQ ID NO: 2957493 - RNA, 22 nt, Human
acacuguucucugcccuccaag

SEQ ID NO: 2957494 - RNA, 22 nt, Human
acacucacauuuauucugcuca

SEQ ID NO: 2957495 - RNA, 11 nt, Human
acacucugaga

SEQ ID NO: 2957496 - RNA, 15 nt, Human
acacucuauaacaaa

SEQ ID NO: 2957497 - RNA, 13 nt, Human
acacucugagacu

SEQ ID NO: 2957498 - RNA, 13 nt, Human
acacuccuucaca

SEQ ID NO: 2957499 - RNA, 14 nt, Human
acacuccagugaga

SEQ ID NO: 2957500 - RNA, 19 nt, Human
acagcccuucuuuccacag

SEQ ID NO: 2957501 - RNA, 20 nt, Human
acagcccuucuuuccacaga

SEQ ID NO: 2957502 - RNA, 21 nt, Human
acagcccuucuuuccacagaa

SEQ ID NO: 2957503 - RNA, 23 nt, Human
acagcccgggcucugccucccau

SEQ ID NO: 2957504 - RNA, 20 nt, Human
acagcaacacaaagcuuuug

SEQ ID NO: 2957505 - RNA, 22 nt, Human
acagcccgggcucugccuccca

SEQ ID NO: 2957506 - RNA, 21 nt, Human
acagcccgggcucugccuccc

SEQ ID NO: 2957507 - RNA, 17 nt, Human
acagcaacacaaagcuu

SEQ ID NO: 2957508 - RNA, 20 nt, Human
acagcccgggcucugccucc

SEQ ID NO: 2957509 - RNA, 15 nt, Human
acagaguuguuacau

SEQ ID NO: 2957510 - RNA, 21 nt, Human
acagaguuguuacauuuuuaa

SEQ ID NO: 2957511 - RNA, 22 nt, Human
acagaguuguuacauuuuuaag

SEQ ID NO: 2957512 - RNA, 20 nt, Human
acagauagauauaugcucug

SEQ ID NO: 2957513 - RNA, 20 nt, Human
acagauacuccuccaagguu

SEQ ID NO: 2957514 - RNA, 23 nt, Human
acagaugggugcuuggaggaagg

SEQ ID NO: 2957515 - RNA, 12 nt, Human
acagagcaagac

SEQ ID NO: 2957516 - RNA, 21 nt, Human
acagagcaagugagacccugu

SEQ ID NO: 2957517 - RNA, 16 nt, Human
acagaguuguuacauu

SEQ ID NO: 2957518 - RNA, 17 nt, Human
acagaguuguuacauuu

SEQ ID NO: 2957519 - RNA, 18 nt, Human
acagaguuguuacauuuu

SEQ ID NO: 2957520 - RNA, 19 nt, Human
acagaguuguuacauuuuu

SEQ ID NO: 2957521 - RNA, 20 nt, Human
acagaguuguuacauuuuua

SEQ ID NO: 2957522 - RNA, 15 nt, Human
uaucucagggccugg

SEQ ID NO: 2957523 - RNA, 13 nt, Human
uaucucagggccu

SEQ ID NO: 2957524 - RNA, 20 nt, Human
uauccuagucauucuucccu

SEQ ID NO: 2957525 - RNA, 17 nt, Human
uaucucaaaacugcacu

SEQ ID NO: 2957526 - RNA, 19 nt, Human
uaucccuacuguaauuugu

SEQ ID NO: 2957527 - RNA, 20 nt, Human
uaucccuacuguaauuugug

SEQ ID NO: 2957528 - RNA, 15 nt, Human
uauauuuauuacugu

SEQ ID NO: 2957529 - RNA, 19 nt, Human
uauauuuauuacuguaaga

SEQ ID NO: 2957530 - RNA, 14 nt, Human
ucaaagcugaaaug

SEQ ID NO: 2957531 - RNA, 18 nt, Human
ucaaauaacuaaaaggua

SEQ ID NO: 2957532 - RNA, 20 nt, Human
acaugagcaucaggccaggc

SEQ ID NO: 2957533 - RNA, 22 nt, Human
acaugcuacacacugcauguuu

SEQ ID NO: 2957534 - RNA, 15 nt, Human
acaugaucuucuuua

SEQ ID NO: 2957535 - RNA, 17 nt, Human
acaugaucuucuuuaua

SEQ ID NO: 2957536 - RNA, 19 nt, Human
acaugauccugcaauucca

SEQ ID NO: 2957537 - RNA, 19 nt, Human
acaugagcaucaggccagg

SEQ ID NO: 2957538 - RNA, 18 nt, Human
acaugagcaucaggccag

SEQ ID NO: 2957539 - RNA, 17 nt, Human
acaugagcaucaggcca

SEQ ID NO: 2957540 - RNA, 15 nt, Human
uauuugugagacugu

SEQ ID NO: 2957541 - RNA, 18 nt, Human
ucaaaagaaagaaaauca

SEQ ID NO: 2957542 - RNA, 21 nt, Human
ucaaaauaccaugccauuuaa

SEQ ID NO: 2957543 - RNA, 21 nt, Human
ucaaaauaugccccauucaac

SEQ ID NO: 2957544 - RNA, 23 nt, Human
ucaaaauaccaugccauuuaaag

SEQ ID NO: 2957545 - RNA, 12 nt, Human
acauucuguuaa

SEQ ID NO: 2957546 - RNA, 15 nt, Human
ucaaauuucuaaauc

SEQ ID NO: 2957547 - RNA, 16 nt, Human
ucaaauuucuaaaucu

SEQ ID NO: 2957548 - RNA, 15 nt, Human
acauucuguuaauca

SEQ ID NO: 2957549 - RNA, 14 nt, Human
ucaaauuucuaaau

SEQ ID NO: 2957550 - RNA, 17 nt, Human
ucaaauuucuaaaucuc

SEQ ID NO: 2957551 - RNA, 16 nt, Human
ucaacagguuuuccug

SEQ ID NO: 2957552 - RNA, 15 nt, Human
acauuagguugugaa

SEQ ID NO: 2957553 - RNA, 16 nt, Human
acauuagguugugaau

SEQ ID NO: 2957554 - RNA, 17 nt, Human
acauuagguugugaaug

SEQ ID NO: 2957555 - RNA, 21 nt, Human
acaugcugaacaucacagcuu

SEQ ID NO: 2957556 - RNA, 14 nt, Human
acaugcugaacauc

SEQ ID NO: 2957557 - RNA, 21 nt, Human
acauguccaagaagcccagga

SEQ ID NO: 2957558 - RNA, 19 nt, Human
acauguccaagaagcccag

SEQ ID NO: 2957559 - RNA, 17 nt, Human
acaugcuguacauacuu

SEQ ID NO: 2957560 - RNA, 19 nt, Human
acaugcuguacauacuuuu

SEQ ID NO: 2957561 - RNA, 19 nt, Human
acauuaaaugacucuuccc

SEQ ID NO: 2957562 - RNA, 21 nt, Human
acauuaaaugacucuucccuc

SEQ ID NO: 2957563 - RNA, 16 nt, Human
ucaacagugagagacu

SEQ ID NO: 2957564 - RNA, 16 nt, Human
ucaagaaugcaguacu

SEQ ID NO: 2957565 - RNA, 11 nt, Human
ucaaguauuau

SEQ ID NO: 2957566 - RNA, 15 nt, Human
ucaaguauagaaaau

SEQ ID NO: 2957567 - RNA, 17 nt, Human
ucaaguauagaaaaucu

SEQ ID NO: 2957568 - RNA, 15 nt, Human
ucaaguauuauaccu

SEQ ID NO: 2957569 - RNA, 23 nt, Human
ucaaguauuauaccuuuuuuaga

SEQ ID NO: 2957570 - RNA, 16 nt, Human
ucaaguauuauaccuu

SEQ ID NO: 2957571 - RNA, 21 nt, Human
ucaaguauuauaccuuuuuua

SEQ ID NO: 2957572 - RNA, 14 nt, Human
ucaaggcuuagacc

SEQ ID NO: 2957573 - RNA, 22 nt, Human
ucaagaugaugaugaucuuuaa

SEQ ID NO: 2957574 - RNA, 21 nt, Human
acaguuuucugagaaagacua

SEQ ID NO: 2957575 - RNA, 20 nt, Human
acaguuuucugagaaagacu

SEQ ID NO: 2957576 - RNA, 19 nt, Human
acaguuuucugagaaagac

SEQ ID NO: 2957577 - RNA, 18 nt, Human
acaguuuucugagaaaga

SEQ ID NO: 2957578 - RNA, 16 nt, Human
acaguuuguuaguaug

SEQ ID NO: 2957579 - RNA, 20 nt, Human
acaguuuguuaguaugaggc

SEQ ID NO: 2957580 - RNA, 15 nt, Human
acaguuuucugagaa

SEQ ID NO: 2957581 - RNA, 17 nt, Human
acaguuuucugagaaag

SEQ ID NO: 2957582 - RNA, 16 nt, Human
acaguuuucugagaaa

SEQ ID NO: 2957583 - RNA, 17 nt, Human
acauacucccaucugug

SEQ ID NO: 2957584 - RNA, 14 nt, Human
acauacucugcuua

SEQ ID NO: 2957585 - RNA, 11 nt, Human
acauacuuuuu

SEQ ID NO: 2957586 - RNA, 13 nt, Human
acauacuuuuugg

SEQ ID NO: 2957587 - RNA, 17 nt, Human
acauacuuuuuggguuu

SEQ ID NO: 2957588 - RNA, 20 nt, Human
acauacuuuuuggguuuauu

SEQ ID NO: 2957589 - RNA, 13 nt, Human
acauacuaaccag

SEQ ID NO: 2957590 - RNA, 21 nt, Human
acauacuaaccagcagaaaug

SEQ ID NO: 2957591 - RNA, 22 nt, Human
acauacuaaccagcagaaaugc

SEQ ID NO: 2957592 - RNA, 13 nt, Human
acauacucccauc

SEQ ID NO: 2957593 - RNA, 18 nt, Human
acaguuggguuuuuuaag

SEQ ID NO: 2957594 - RNA, 16 nt, Human
acaguuggguuuuuua

SEQ ID NO: 2957595 - RNA, 20 nt, Human
acaguugaaaaacagcugag

SEQ ID NO: 2957596 - RNA, 16 nt, Human
acaguugaaaaacagc

SEQ ID NO: 2957597 - RNA, 15 nt, Human
acaguugaaaaacag

SEQ ID NO: 2957598 - RNA, 23 nt, Human
uauuuccuauauuguuuucagug

SEQ ID NO: 2957599 - RNA, 22 nt, Human
uauuucccucaccuuucccauc

SEQ ID NO: 2957600 - RNA, 13 nt, Human
uauuucauuucuu

SEQ ID NO: 2957601 - RNA, 13 nt, Human
acaucuguuuugu

SEQ ID NO: 2957602 - RNA, 13 nt, Human
acaucuugcucug

SEQ ID NO: 2957603 - RNA, 16 nt, Human
acaugaaaacacauuu

SEQ ID NO: 2957604 - RNA, 18 nt, Human
acaugaaaacacauuuuu

SEQ ID NO: 2957605 - RNA, 19 nt, Human
acaugaaaacacauuuuuc

SEQ ID NO: 2957606 - RNA, 21 nt, Human
acaucuugcucugcugacaga

SEQ ID NO: 2957607 - RNA, 17 nt, Human
acaugaaaacacauuuu

SEQ ID NO: 2957608 - RNA, 18 nt, Human
acaucuugcucugcugac

SEQ ID NO: 2957609 - RNA, 19 nt, Human
acaucuugcucugcugaca

SEQ ID NO: 2957610 - RNA, 20 nt, Human
acaucuaguaguuguucuga

SEQ ID NO: 2957611 - RNA, 16 nt, Human
acaucuaguaguuguu

SEQ ID NO: 2957612 - RNA, 13 nt, Human
acaucaacagaua

SEQ ID NO: 2957613 - RNA, 16 nt, Human
acaucaacaucuuggu

SEQ ID NO: 2957614 - RNA, 18 nt, Human
acaucaacaucuugguca

SEQ ID NO: 2957615 - RNA, 14 nt, Human
acauauugauuucc

SEQ ID NO: 2957616 - RNA, 16 nt, Human
acauauugauuuccgu

SEQ ID NO: 2957617 - RNA, 23 nt, Human
acauauugauuuccguuaaaaua

SEQ ID NO: 2957618 - RNA, 18 nt, Human
acauauugauuuccguua

SEQ ID NO: 2957619 - RNA, 22 nt, Human
acauauugauuuccguuaaaau

SEQ ID NO: 2957620 - RNA, 18 nt, Human
acauauauuuuuuaaaau

SEQ ID NO: 2957621 - RNA, 19 nt, Human
acauauauuuuuuaaaaua

SEQ ID NO: 2957622 - RNA, 20 nt, Human
acauauauuuuuuaaaauaa

SEQ ID NO: 2957623 - RNA, 19 nt, Human
acauaucucuuaucuuacg

SEQ ID NO: 2957624 - RNA, 13 nt, Human
acauauacauacu

SEQ ID NO: 2957625 - RNA, 17 nt, Human
acauauacauacuuaca

SEQ ID NO: 2957626 - RNA, 22 nt, Human
acauauacauacuuacaugugu

SEQ ID NO: 2957627 - RNA, 19 nt, Human
acauauauaacaaugcugu

SEQ ID NO: 2957628 - RNA, 14 nt, Human
acauagcugugauu

SEQ ID NO: 2957629 - RNA, 14 nt, Human
acauagaauuaaca

SEQ ID NO: 2957630 - RNA, 18 nt, Human
acauagaauuaacacaug

SEQ ID NO: 2957631 - RNA, 12 nt, Human
ucacauaucugu

SEQ ID NO: 2957632 - RNA, 15 nt, Human
ucacauaucugucau

SEQ ID NO: 2957633 - RNA, 15 nt, Human
ucacaguucucuccu

SEQ ID NO: 2957634 - RNA, 19 nt, Human
ucacccaguccugcccgcc

SEQ ID NO: 2957635 - RNA, 13 nt, Human
ucacccaguccug

SEQ ID NO: 2957636 - RNA, 13 nt, Human
ucaccccagcccc

SEQ ID NO: 2957637 - RNA, 20 nt, Human
ucaccccagccccaaaacuc

SEQ ID NO: 2957638 - RNA, 14 nt, Human
ucaccccagcccca

SEQ ID NO: 2957639 - RNA, 15 nt, Human
ucaccccggccaccu

SEQ ID NO: 2957640 - RNA, 15 nt, Human
ucaagugaaaaagga

SEQ ID NO: 2957641 - RNA, 23 nt, Human
ucaagugaaaaaggaggaagaga

SEQ ID NO: 2957642 - RNA, 22 nt, Human
accaacauacucccaucuguga

SEQ ID NO: 2957643 - RNA, 21 nt, Human
accaacauacucccaucugug

SEQ ID NO: 2957644 - RNA, 19 nt, Human
accaacauacucccaucug

SEQ ID NO: 2957645 - RNA, 17 nt, Human
accaacauacucccauc

SEQ ID NO: 2957646 - RNA, 17 nt, Human
accaauauuuaaucuuu

SEQ ID NO: 2957647 - RNA, 16 nt, Human
accaauauuuaaucuu

SEQ ID NO: 2957648 - RNA, 13 nt, Human
accaaucaugaau

SEQ ID NO: 2957649 - RNA, 20 nt, Human
accaauauuuaaucuuuuau

SEQ ID NO: 2957650 - RNA, 23 nt, Human
accaauauuuaaucuuuuaugau

SEQ ID NO: 2957651 - RNA, 15 nt, Human
accaaucaugaauua

SEQ ID NO: 2957652 - RNA, 15 nt, Human
accaauguucucucu

SEQ ID NO: 2957653 - RNA, 14 nt, Human
accaauugccaaag

SEQ ID NO: 2957654 - RNA, 23 nt, Human
ucaauuuuucuuauuucauuucu

SEQ ID NO: 2957655 - RNA, 20 nt, Human
ucaauuuuucuuauuucauu

SEQ ID NO: 2957656 - RNA, 15 nt, Human
ucaauucuugccaaa

SEQ ID NO: 2957657 - RNA, 14 nt, Human
accagacaccuuga

SEQ ID NO: 2957658 - RNA, 11 nt, Human
accagacaggu

SEQ ID NO: 2957659 - RNA, 12 nt, Human
accagagcccac

SEQ ID NO: 2957660 - RNA, 14 nt, Human
accagagcccaccu

SEQ ID NO: 2957661 - RNA, 16 nt, Human
accagagcccaccuug

SEQ ID NO: 2957662 - RNA, 22 nt, Human
accacuuuuguucuugguuugu

SEQ ID NO: 2957663 - RNA, 21 nt, Human
accacugcacuccagccuggg

SEQ ID NO: 2957664 - RNA, 18 nt, Human
ucaccccggccaccugcg

SEQ ID NO: 2957665 - RNA, 17 nt, Human
ucaccccggccaccugc

SEQ ID NO: 2957666 - RNA, 20 nt, Human
accacugcacuccagccugg

SEQ ID NO: 2957667 - RNA, 17 nt, Human
accacugcacuccagcc

SEQ ID NO: 2957668 - RNA, 18 nt, Human
accacuuguguuuugcaa

SEQ ID NO: 2957669 - RNA, 15 nt, Human
accacuuuuguucuu

SEQ ID NO: 2957670 - RNA, 16 nt, Human
accacuuuuguucuug

SEQ ID NO: 2957671 - RNA, 21 nt, Human
accacuuuuguucuugguuug

SEQ ID NO: 2957672 - RNA, 18 nt, Human
ucacuauguugcccaggc

SEQ ID NO: 2957673 - RNA, 17 nt, Human
ucacuauguugcccagg

SEQ ID NO: 2957674 - RNA, 19 nt, Human
ucacuauguugcccaggca

SEQ ID NO: 2957675 - RNA, 15 nt, Human
ucaccugccccucaa

SEQ ID NO: 2957676 - RNA, 13 nt, Human
ucaccugccccuc

SEQ ID NO: 2957677 - RNA, 15 nt, Human
ucaccucucccuugg

SEQ ID NO: 2957678 - RNA, 14 nt, Human
accagggacugagg

SEQ ID NO: 2957679 - RNA, 22 nt, Human
ucagccaagaauucuuaaauau

SEQ ID NO: 2957680 - RNA, 12 nt, Human
ucagagcugccc

SEQ ID NO: 2957681 - RNA, 23 nt, Human
ucagccguguaaccauggaccca

SEQ ID NO: 2957682 - RNA, 19 nt, Human
acccagcgagcccuggugg

SEQ ID NO: 2957683 - RNA, 23 nt, Human
acccagcgagcccugguggcagu

SEQ ID NO: 2957684 - RNA, 24 nt, Human
acccagcgagcccugguggcagug

SEQ ID NO: 2957685 - RNA, 16 nt, Human
accccuucgcuccugu

SEQ ID NO: 2957686 - RNA, 14 nt, Human
accccuucgcuccu

SEQ ID NO: 2957687 - RNA, 15 nt, Human
accccuucgcuccug

SEQ ID NO: 2957688 - RNA, 12 nt, Human
acccccacccaa

SEQ ID NO: 2957689 - RNA, 14 nt, Human
ucagcggggacagc

SEQ ID NO: 2957690 - RNA, 20 nt, Human
ucagcuuguaaauagcucag

SEQ ID NO: 2957691 - RNA, 19 nt, Human
ucaggaaagagaacuucca

SEQ ID NO: 2957692 - RNA, 21 nt, Human
ucaggaaaucaaauaugcaaa

SEQ ID NO: 2957693 - RNA, 20 nt, Human
ucaggaaaucaaauaugcaa

SEQ ID NO: 2957694 - RNA, 13 nt, Human
ucaggaaagagaa

SEQ ID NO: 2957695 - RNA, 18 nt, Human
ucagaaucucaaauaacu

SEQ ID NO: 2957696 - RNA, 19 nt, Human
ucagaaucucaaauaacua

SEQ ID NO: 2957697 - RNA, 16 nt, Human
ucagagacuccugcag

SEQ ID NO: 2957698 - RNA, 21 nt, Human
ucagagacuccugcaggcagc

SEQ ID NO: 2957699 - RNA, 20 nt, Human
ucagagacuccugcaggcag

SEQ ID NO: 2957700 - RNA, 17 nt, Human
ucagagacuccugcagg

SEQ ID NO: 2957701 - RNA, 12 nt, Human
ucagagccugca

SEQ ID NO: 2957702 - RNA, 23 nt, Human
ucagagagggugggagugggccc

SEQ ID NO: 2957703 - RNA, 21 nt, Human
ucagagagggugggagugggc

SEQ ID NO: 2957704 - RNA, 16 nt, Human
ucagagagggugggag

SEQ ID NO: 2957705 - RNA, 13 nt, Human
ucagagccugcag

SEQ ID NO: 2957706 - RNA, 14 nt, Human
ucagagccugcagu

SEQ ID NO: 2957707 - RNA, 15 nt, Human
ucagagccugcaguu

SEQ ID NO: 2957708 - RNA, 18 nt, Human
ucagagccugcaguuauu

SEQ ID NO: 2957709 - RNA, 14 nt, Human
ucagaagacacuga

SEQ ID NO: 2957710 - RNA, 22 nt, Human
ucagaaguuucugccgcagccc

SEQ ID NO: 2957711 - RNA, 19 nt, Human
ucagaaguuucugccgcag

SEQ ID NO: 2957712 - RNA, 16 nt, Human
accauuggggcuccca

SEQ ID NO: 2957713 - RNA, 17 nt, Human
accauuggggcucccag

SEQ ID NO: 2957714 - RNA, 18 nt, Human
accauuggggcucccagc

SEQ ID NO: 2957715 - RNA, 21 nt, Human
ucacucuuauugcccacgcug

SEQ ID NO: 2957716 - RNA, 23 nt, Human
ucacucuuauugcccacgcugga

SEQ ID NO: 2957717 - RNA, 22 nt, Human
accauggucggaaaacaugcua

SEQ ID NO: 2957718 - RNA, 13 nt, Human
acccacugcucug

SEQ ID NO: 2957719 - RNA, 14 nt, Human
acccacugcucugg

SEQ ID NO: 2957720 - RNA, 15 nt, Human
acccacugcucuggu

SEQ ID NO: 2957721 - RNA, 11 nt, Human
acccacugcuu

SEQ ID NO: 2957722 - RNA, 10 nt, Human
acccacugcu

SEQ ID NO: 2957723 - RNA, 11 nt, Human
acccacugcuc

SEQ ID NO: 2957724 - RNA, 23 nt, Human
accauuucuugagguaaaagcau

SEQ ID NO: 2957725 - RNA, 17 nt, Human
acuacucccccaggugg

SEQ ID NO: 2957726 - RNA, 12 nt, Human
acucaccccagc

SEQ ID NO: 2957727 - RNA, 21 nt, Human
acucacauuuauucugcucac

SEQ ID NO: 2957728 - RNA, 20 nt, Human
ucccgaauagcugggacuac

SEQ ID NO: 2957729 - RNA, 15 nt, Human
ucccgaguagcuggg

SEQ ID NO: 2957730 - RNA, 18 nt, Human
ucccgaguagcugggacu

SEQ ID NO: 2957731 - RNA, 16 nt, Human
ucccgaguagcuggga

SEQ ID NO: 2957732 - RNA, 17 nt, Human
ucccgaguagcugggac

SEQ ID NO: 2957733 - RNA, 16 nt, Human
uccccucggagaagag

SEQ ID NO: 2957734 - RNA, 17 nt, Human
uccccucggagaagagc

SEQ ID NO: 2957735 - RNA, 14 nt, Human
uccccucuccucca

SEQ ID NO: 2957736 - RNA, 13 nt, Human
ucccugauuuaau

SEQ ID NO: 2957737 - RNA, 16 nt, Human
ucccugaaggccccgc

SEQ ID NO: 2957738 - RNA, 11 nt, Human
ucccugagcag

SEQ ID NO: 2957739 - RNA, 21 nt, Human
ucccuccaccucccugcaaua

SEQ ID NO: 2957740 - RNA, 23 nt, Human
ucccuccaccucccugcaauaaa

SEQ ID NO: 2957741 - RNA, 16 nt, Human
ucccggcuuuggugcg

SEQ ID NO: 2957742 - RNA, 13 nt, Human
ucccucccuccac

SEQ ID NO: 2957743 - RNA, 14 nt, Human
ucccucccuccacc

SEQ ID NO: 2957744 - RNA, 15 nt, Human
ucccucccuccaccu

SEQ ID NO: 2957745 - RNA, 16 nt, Human
ucccucccuccaccuc

SEQ ID NO: 2957746 - RNA, 14 nt, Human
ucccucuuucccuc

SEQ ID NO: 2957747 - RNA, 18 nt, Human
ucccucuuucccucccuu

SEQ ID NO: 2957748 - RNA, 20 nt, Human
ucccucuuucccucccuucc

SEQ ID NO: 2957749 - RNA, 15 nt, Human
ucccugaaggccccg

SEQ ID NO: 2957750 - RNA, 11 nt, Human
ucccugaaggc

SEQ ID NO: 2957751 - RNA, 21 nt, Human
ucccucuuucccucccuuccu

SEQ ID NO: 2957752 - RNA, 15 nt, Human
acucauucuucugua

SEQ ID NO: 2957753 - RNA, 14 nt, Human
acucauugaccuga

SEQ ID NO: 2957754 - RNA, 18 nt, Human
acuccagaaagugacaag

SEQ ID NO: 2957755 - RNA, 21 nt, Human
acuccaaagaaauguaaggga

SEQ ID NO: 2957756 - RNA, 17 nt, Human
acuccagaauuucccaa

SEQ ID NO: 2957757 - RNA, 15 nt, Human
acuccagaauuuccc

SEQ ID NO: 2957758 - RNA, 14 nt, Human
acuccaaagaaaug

SEQ ID NO: 2957759 - RNA, 15 nt, Human
acucauugaccugag

SEQ ID NO: 2957760 - RNA, 18 nt, Human
acuccaaagaaauguaag

SEQ ID NO: 2957761 - RNA, 15 nt, Human
acuccaaagaaaugu

SEQ ID NO: 2957762 - RNA, 17 nt, Human
acuccugcaggcagcca

SEQ ID NO: 2957763 - RNA, 19 nt, Human
acuccugcaggcagccagg

SEQ ID NO: 2957764 - RNA, 18 nt, Human
acuccugcaggcagccag

SEQ ID NO: 2957765 - RNA, 23 nt, Human
acuccagaauuucccaaagcagu

SEQ ID NO: 2957766 - RNA, 12 nt, Human
acuccagccugg

SEQ ID NO: 2957767 - RNA, 13 nt, Human
acuccagccuggg

SEQ ID NO: 2957768 - RNA, 12 nt, Human
ucccuuuuccuu

SEQ ID NO: 2957769 - RNA, 11 nt, Human
uccuaaauagc

SEQ ID NO: 2957770 - RNA, 17 nt, Human
uccggucccugucccag

SEQ ID NO: 2957771 - RNA, 16 nt, Human
uccuagaaauucccca

SEQ ID NO: 2957772 - RNA, 17 nt, Human
ucccugugucauuucaa

SEQ ID NO: 2957773 - RNA, 16 nt, Human
ucccugugucauuuca

SEQ ID NO: 2957774 - RNA, 17 nt, Human
ucccuuacgugaguccu

SEQ ID NO: 2957775 - RNA, 15 nt, Human
ucccugguggcagcu

SEQ ID NO: 2957776 - RNA, 12 nt, Human
ucccugucccag

SEQ ID NO: 2957777 - RNA, 21 nt, Human
acuccugcaggcagccaggcc

SEQ ID NO: 2957778 - RNA, 11 nt, Human
acuacaggcac

SEQ ID NO: 2957779 - RNA, 15 nt, Human
acuacaggcacccac

SEQ ID NO: 2957780 - RNA, 17 nt, Human
acuacaguccucccauc

SEQ ID NO: 2957781 - RNA, 13 nt, Human
acuacaguuuguu

SEQ ID NO: 2957782 - RNA, 14 nt, Human
acuacaguuuguua

SEQ ID NO: 2957783 - RNA, 12 nt, Human
acuaaccacgcu

SEQ ID NO: 2957784 - RNA, 18 nt, Human
acuaacauuuauuugagu

SEQ ID NO: 2957785 - RNA, 12 nt, Human
acuaacaggcuu

SEQ ID NO: 2957786 - RNA, 17 nt, Human
acuaacaggcuuaguga

SEQ ID NO: 2957787 - RNA, 18 nt, Human
acuaacaggcuuagugau

SEQ ID NO: 2957788 - RNA, 13 nt, Human
ucccagcacuuug

SEQ ID NO: 2957789 - RNA, 22 nt, Human
ucccagcacuuugggaggcuga

SEQ ID NO: 2957790 - RNA, 14 nt, Human
acuacauucuguua

SEQ ID NO: 2957791 - RNA, 15 nt, Human
acuacaguuuguuag

SEQ ID NO: 2957792 - RNA, 11 nt, Human
acuacauucug

SEQ ID NO: 2957793 - RNA, 12 nt, Human
acuacauucugu

SEQ ID NO: 2957794 - RNA, 13 nt, Human
acuacauucuguu

SEQ ID NO: 2957795 - RNA, 12 nt, Human
ucccagccccaa

SEQ ID NO: 2957796 - RNA, 13 nt, Human
ucccagccaggcc

SEQ ID NO: 2957797 - RNA, 14 nt, Human
ucccagccaggccc

SEQ ID NO: 2957798 - RNA, 15 nt, Human
ucccagccaggcccu

SEQ ID NO: 2957799 - RNA, 17 nt, Human
ucccagcugugcucugg

SEQ ID NO: 2957800 - RNA, 23 nt, Human
ucccagcacuuugggaggcugag

SEQ ID NO: 2957801 - RNA, 17 nt, Human
ucccagccagcaguuca

SEQ ID NO: 2957802 - RNA, 18 nt, Human
ucccagccagcaguucag

SEQ ID NO: 2957803 - RNA, 15 nt, Human
acuacauucuguuaa

SEQ ID NO: 2957804 - RNA, 17 nt, Human
uccccaccgcagacagg

SEQ ID NO: 2957805 - RNA, 21 nt, Human
uccccaccgcagacaggacca

SEQ ID NO: 2957806 - RNA, 18 nt, Human
uccccaccgcagacagga

SEQ ID NO: 2957807 - RNA, 22 nt, Human
uccccaccgcagacaggaccag

SEQ ID NO: 2957808 - RNA, 22 nt, Human
ucccauaugccugggcagaagg

SEQ ID NO: 2957809 - RNA, 16 nt, Human
ucccauaugccugggc

SEQ ID NO: 2957810 - RNA, 15 nt, Human
ucccaucacccgcua

SEQ ID NO: 2957811 - RNA, 22 nt, Human
ucccagucauuuaauaaaugug

SEQ ID NO: 2957812 - RNA, 14 nt, Human
ucccagucauuuaa

SEQ ID NO: 2957813 - RNA, 20 nt, Human
acgggaggguaaggcugugg

SEQ ID NO: 2957814 - RNA, 12 nt, Human
ucccaagugcca

SEQ ID NO: 2957815 - RNA, 13 nt, Human
ucccaagugccaa

SEQ ID NO: 2957816 - RNA, 15 nt, Human
ucccaagugccaaag

SEQ ID NO: 2957817 - RNA, 23 nt, Human
ucccaagugccaaagaagcagac

SEQ ID NO: 2957818 - RNA, 16 nt, Human
ucccacaaaggagagc

SEQ ID NO: 2957819 - RNA, 20 nt, Human
ucccaccccacacacgccag

SEQ ID NO: 2957820 - RNA, 15 nt, Human
ucccaccccacacac

SEQ ID NO: 2957821 - RNA, 17 nt, Human
acgugggcauucaaaug

SEQ ID NO: 2957822 - RNA, 20 nt, Human
acgugggcauucaaauguau

SEQ ID NO: 2957823 - RNA, 23 nt, Human
acguggcugcuucaaggauccug

SEQ ID NO: 2957824 - RNA, 17 nt, Human
acgguuuuacugcagcu

SEQ ID NO: 2957825 - RNA, 15 nt, Human
acgguuuuacugcag

SEQ ID NO: 2957826 - RNA, 22 nt, Human
uccauuuacuuaagacuuaaug

SEQ ID NO: 2957827 - RNA, 16 nt, Human
ucccaaagcagugcau

SEQ ID NO: 2957828 - RNA, 18 nt, Human
ucccaaacccuucagugc

SEQ ID NO: 2957829 - RNA, 13 nt, Human
ucccaaagugcug

SEQ ID NO: 2957830 - RNA, 14 nt, Human
ucccaaagugcugg

SEQ ID NO: 2957831 - RNA, 18 nt, Human
ucccaaagcagugcaugc

SEQ ID NO: 2957832 - RNA, 17 nt, Human
ucccaaagcagugcaug

SEQ ID NO: 2957833 - RNA, 21 nt, Human
ucccaaagcagugcaugcugu

SEQ ID NO: 2957834 - RNA, 17 nt, Human
uccauuuacuuaagacu

SEQ ID NO: 2957835 - RNA, 19 nt, Human
uccauuuacuuaagacuua

SEQ ID NO: 2957836 - RNA, 20 nt, Human
uccauuuacuuaagacuuaa

SEQ ID NO: 2957837 - RNA, 13 nt, Human
uccaugaagaugu

SEQ ID NO: 2957838 - RNA, 21 nt, Human
uccaugaagauguagaggaga

SEQ ID NO: 2957839 - RNA, 19 nt, Human
uccauccugaggcuccacu

SEQ ID NO: 2957840 - RNA, 20 nt, Human
uccauccugaggcuccacuu

SEQ ID NO: 2957841 - RNA, 21 nt, Human
uccauccugaggcuccacuug

SEQ ID NO: 2957842 - RNA, 23 nt, Human
acgccagauucuuuccugaggcu

SEQ ID NO: 2957843 - RNA, 22 nt, Human
acgccagauucuuuccugaggc

SEQ ID NO: 2957844 - RNA, 22 nt, Human
accgccuugcccagccuggaug

SEQ ID NO: 2957845 - RNA, 16 nt, Human
accgccuugcccagcc

SEQ ID NO: 2957846 - RNA, 17 nt, Human
accgccuugcccagccu

SEQ ID NO: 2957847 - RNA, 15 nt, Human
accgccuugcccagc

SEQ ID NO: 2957848 - RNA, 15 nt, Human
ucaggaagcucaggg

SEQ ID NO: 2957849 - RNA, 14 nt, Human
ucaggaagcucagg

SEQ ID NO: 2957850 - RNA, 13 nt, Human
ucaggaagcucag

SEQ ID NO: 2957851 - RNA, 12 nt, Human
ucaggaagcuca

SEQ ID NO: 2957852 - RNA, 23 nt, Human
ucaggaaaucaaauaugcaaagc

SEQ ID NO: 2957853 - RNA, 22 nt, Human
ucaggaaaucaaauaugcaaag

SEQ ID NO: 2957854 - RNA, 16 nt, Human
accuagggugauauua

SEQ ID NO: 2957855 - RNA, 21 nt, Human
accuagggugauauuaaccag

SEQ ID NO: 2957856 - RNA, 23 nt, Human
accuccugccucgaacuggcugc

SEQ ID NO: 2957857 - RNA, 15 nt, Human
ucauccuaagcuauu

SEQ ID NO: 2957858 - RNA, 13 nt, Human
accuccugccucg

SEQ ID NO: 2957859 - RNA, 12 nt, Human
accuccugccuc

SEQ ID NO: 2957860 - RNA, 12 nt, Human
accucccugcaa

SEQ ID NO: 2957861 - RNA, 13 nt, Human
accucccugcaau

SEQ ID NO: 2957862 - RNA, 14 nt, Human
ucauccuucuggaa

SEQ ID NO: 2957863 - RNA, 18 nt, Human
ucauccucauacccaccc

SEQ ID NO: 2957864 - RNA, 19 nt, Human
ucauccuccucagaucuuc

SEQ ID NO: 2957865 - RNA, 13 nt, Human
ucauccuccucag

SEQ ID NO: 2957866 - RNA, 22 nt, Human
ucauccuucuggaauaaggaga

SEQ ID NO: 2957867 - RNA, 16 nt, Human
ucaugaauuaguuuua

SEQ ID NO: 2957868 - RNA, 12 nt, Human
ucauuacuaaaa

SEQ ID NO: 2957869 - RNA, 21 nt, Human
ucauucuuuuugaaaugucaa

SEQ ID NO: 2957870 - RNA, 12 nt, Human
ucauucuucugu

SEQ ID NO: 2957871 - RNA, 13 nt, Human
ucauugaaaucuu

SEQ ID NO: 2957872 - RNA, 12 nt, Human
ucauugaaaucu

SEQ ID NO: 2957873 - RNA, 15 nt, Human
ucauugaccugaggc

SEQ ID NO: 2957874 - RNA, 14 nt, Human
ucauugaccugagg

SEQ ID NO: 2957875 - RNA, 12 nt, Human
ucauugaccuga

SEQ ID NO: 2957876 - RNA, 22 nt, Human
ucauugaaaucuuuuugcuuug

SEQ ID NO: 2957877 - RNA, 13 nt, Human
accuccugggcua

SEQ ID NO: 2957878 - RNA, 19 nt, Human
accucggugccuuccucuu

SEQ ID NO: 2957879 - RNA, 14 nt, Human
accugauugugucu

SEQ ID NO: 2957880 - RNA, 18 nt, Human
accugauugugucucuug

SEQ ID NO: 2957881 - RNA, 17 nt, Human
accugauugugucucuu

SEQ ID NO: 2957882 - RNA, 15 nt, Human
accugauugugucuc

SEQ ID NO: 2957883 - RNA, 22 nt, Human
accugaggcccuucucuccagc

SEQ ID NO: 2957884 - RNA, 21 nt, Human
accugaggcccuucucuccag

SEQ ID NO: 2957885 - RNA, 20 nt, Human
accugaggcccuucucucca

SEQ ID NO: 2957886 - RNA, 16 nt, Human
accugaggcccuucuc

SEQ ID NO: 2957887 - RNA, 15 nt, Human
accugaggcccuucu

SEQ ID NO: 2957888 - RNA, 14 nt, Human
accucuaaauucuu

SEQ ID NO: 2957889 - RNA, 14 nt, Human
accugaggcccuuc

SEQ ID NO: 2957890 - RNA, 14 nt, Human
accuggccucugca

SEQ ID NO: 2957891 - RNA, 17 nt, Human
accuggccucugcacuc

SEQ ID NO: 2957892 - RNA, 16 nt, Human
accuggccucugcacu

SEQ ID NO: 2957893 - RNA, 22 nt, Human
accuggauugugccuaaugugu

SEQ ID NO: 2957894 - RNA, 17 nt, Human
uccacccaccucagccu

SEQ ID NO: 2957895 - RNA, 22 nt, Human
uccaaucugugaugacauuccc

SEQ ID NO: 2957896 - RNA, 18 nt, Human
uccacccaccucagccuc

SEQ ID NO: 2957897 - RNA, 19 nt, Human
uccacccaccucagccucc

SEQ ID NO: 2957898 - RNA, 12 nt, Human
uccacccaggag

SEQ ID NO: 2957899 - RNA, 14 nt, Human
uccacccaggagcc

SEQ ID NO: 2957900 - RNA, 15 nt, Human
uccacccaggagccc

SEQ ID NO: 2957901 - RNA, 20 nt, Human
accuggccucugcacucccc

SEQ ID NO: 2957902 - RNA, 18 nt, Human
accuggccucugcacucc

SEQ ID NO: 2957903 - RNA, 23 nt, Human
accuggccucugcacuccccugc

SEQ ID NO: 2957904 - RNA, 14 nt, Human
accuggcucugugg

SEQ ID NO: 2957905 - RNA, 23 nt, Human
accuggcucuguggcgagccauu

SEQ ID NO: 2957906 - RNA, 19 nt, Human
accuguuucugcagccacu

SEQ ID NO: 2957907 - RNA, 18 nt, Human
accuuagacagucccugc

SEQ ID NO: 2957908 - RNA, 20 nt, Human
accuuagacagucccugcca

SEQ ID NO: 2957909 - RNA, 19 nt, Human
accuuagacagucccugcc

SEQ ID NO: 2957910 - RNA, 14 nt, Human
accugccaggaagc

SEQ ID NO: 2957911 - RNA, 12 nt, Human
accugccaggaa

SEQ ID NO: 2957912 - RNA, 15 nt, Human
accugccaggaagcc

SEQ ID NO: 2957913 - RNA, 14 nt, Human
uccaacccucauca

SEQ ID NO: 2957914 - RNA, 17 nt, Human
uccaacccucaucacca

SEQ ID NO: 2957915 - RNA, 16 nt, Human
uccaacccucaucacc

SEQ ID NO: 2957916 - RNA, 23 nt, Human
uccaacccucaucaccaacgucu

SEQ ID NO: 2957917 - RNA, 21 nt, Human
uccaagcuggucccacucagu

SEQ ID NO: 2957918 - RNA, 18 nt, Human
uccaaggguacuaaggaa

SEQ ID NO: 2957919 - RNA, 12 nt, Human
uccaagaagccc

SEQ ID NO: 2957920 - RNA, 16 nt, Human
uccaagcuggucccac

SEQ ID NO: 2957921 - RNA, 20 nt, Human
uccaagcuggucccacucag

SEQ ID NO: 2957922 - RNA, 21 nt, Human
uccaacuaucucauuuccaag

SEQ ID NO: 2957923 - RNA, 19 nt, Human
uccagacccggcugcgugg

SEQ ID NO: 2957924 - RNA, 15 nt, Human
uccagacccggcugc

SEQ ID NO: 2957925 - RNA, 18 nt, Human
uccagacccggcugcgug

SEQ ID NO: 2957926 - RNA, 14 nt, Human
uccagacccggcug

SEQ ID NO: 2957927 - RNA, 22 nt, Human
uccagaauuucccaaagcagug

SEQ ID NO: 2957928 - RNA, 20 nt, Human
uccagaauuucccaaagcag

SEQ ID NO: 2957929 - RNA, 16 nt, Human
uccagaauuucccaaa

SEQ ID NO: 2957930 - RNA, 14 nt, Human
accuuuugagugcc

SEQ ID NO: 2957931 - RNA, 20 nt, Human
accuuuugagugccuuacac

SEQ ID NO: 2957932 - RNA, 17 nt, Human
accuuuugagugccuua

SEQ ID NO: 2957933 - RNA, 13 nt, Human
uccagccccugga

SEQ ID NO: 2957934 - RNA, 12 nt, Human
uccagccccugg

SEQ ID NO: 2957935 - RNA, 18 nt, Human
uccaggcagcagacacau

SEQ ID NO: 2957936 - RNA, 17 nt, Human
uccaggcagcagacaca

SEQ ID NO: 2957937 - RNA, 14 nt, Human
uccaggcuguaucc

SEQ ID NO: 2957938 - RNA, 16 nt, Human
acgagcaggcuucuuc

SEQ ID NO: 2957939 - RNA, 17 nt, Human
acgccagauucuuuccu

SEQ ID NO: 2957940 - RNA, 19 nt, Human
acgccagauucuuuccuga

SEQ ID NO: 2957941 - RNA, 20 nt, Human
acgagcaggcuacugucagc

SEQ ID NO: 2957942 - RNA, 19 nt, Human
acgagcaggcuacugucag

SEQ ID NO: 2957943 - RNA, 21 nt, Human
uccaggcuguaucccaugagc

SEQ ID NO: 2957944 - RNA, 19 nt, Human
accuuuuuuauacauaaac

SEQ ID NO: 2957945 - RNA, 20 nt, Human
accuuuuuuauacauaaaca

SEQ ID NO: 2957946 - RNA, 22 nt, Human
accuuuuuuauacauaaacaag

SEQ ID NO: 2957947 - RNA, 21 nt, Human
accuuuuuuauacauaaacaa

SEQ ID NO: 2957948 - RNA, 14 nt, Human
acgagaaaacaaua

SEQ ID NO: 2957949 - RNA, 21 nt, Human
acugucagcuccccucggaga

SEQ ID NO: 2957950 - RNA, 18 nt, Human
acugggacaggggagaac

SEQ ID NO: 2957951 - RNA, 18 nt, Human
acuguccuacccacccuc

SEQ ID NO: 2957952 - RNA, 17 nt, Human
acuguccuacccacccu

SEQ ID NO: 2957953 - RNA, 13 nt, Human
acuguggguagac

SEQ ID NO: 2957954 - RNA, 18 nt, Human
acuguggguagacacaca

SEQ ID NO: 2957955 - RNA, 17 nt, Human
ucgggaggucgaggcag

SEQ ID NO: 2957956 - RNA, 21 nt, Human
ucgggaggucgaggcaggagg

SEQ ID NO: 2957957 - RNA, 19 nt, Human
ucgggaggucgaggcagga

SEQ ID NO: 2957958 - RNA, 12 nt, Human
ucgggcaugaca

SEQ ID NO: 2957959 - RNA, 11 nt, Human
ucgggcaugac

SEQ ID NO: 2957960 - RNA, 22 nt, Human
ucggguuuuauuguuuaaaauc

SEQ ID NO: 2957961 - RNA, 13 nt, Human
acuuaaucuaaau

SEQ ID NO: 2957962 - RNA, 15 nt, Human
acuuaaucuaaaugg

SEQ ID NO: 2957963 - RNA, 16 nt, Human
acuuaaucuaaaugga

SEQ ID NO: 2957964 - RNA, 17 nt, Human
acuguugcccaggcugg

SEQ ID NO: 2957965 - RNA, 18 nt, Human
acuguugcccaggcuggc

SEQ ID NO: 2957966 - RNA, 12 nt, Human
acuguugcccag

SEQ ID NO: 2957967 - RNA, 13 nt, Human
acuguugcccagg

SEQ ID NO: 2957968 - RNA, 14 nt, Human
acuguugcccaggc

SEQ ID NO: 2957969 - RNA, 17 nt, Human
acuuaaauaaugugaaa

SEQ ID NO: 2957970 - RNA, 18 nt, Human
acuuaaauaaugugaaac

SEQ ID NO: 2957971 - RNA, 16 nt, Human
acuuaaauaaugugaa

SEQ ID NO: 2957972 - RNA, 15 nt, Human
acuuaaauaauguga

SEQ ID NO: 2957973 - RNA, 19 nt, Human
acuguucucugcccuccaa

SEQ ID NO: 2957974 - RNA, 21 nt, Human
acuguucucugcccuccaaga

SEQ ID NO: 2957975 - RNA, 20 nt, Human
acuguucucugcccuccaag

SEQ ID NO: 2957976 - RNA, 15 nt, Human
acuguucucugcccu

SEQ ID NO: 2957977 - RNA, 14 nt, Human
acuguucucugccc

SEQ ID NO: 2957978 - RNA, 23 nt, Human
ucuaaguaaaaccacagcaguug

SEQ ID NO: 2957979 - RNA, 16 nt, Human
ucuacauacuauggaa

SEQ ID NO: 2957980 - RNA, 20 nt, Human
ucuaaguaaaaccacagcag

SEQ ID NO: 2957981 - RNA, 22 nt, Human
ucuaaguaaaaccacagcaguu

SEQ ID NO: 2957982 - RNA, 21 nt, Human
ucuaaguaaaaccacagcagu

SEQ ID NO: 2957983 - RNA, 16 nt, Human
ucuaaagcugccagcc

SEQ ID NO: 2957984 - RNA, 15 nt, Human
ucuaaagcugccagc

SEQ ID NO: 2957985 - RNA, 20 nt, Human
ucuaaagccauuguaguccu

SEQ ID NO: 2957986 - RNA, 14 nt, Human
ucuaaagcugccag

SEQ ID NO: 2957987 - RNA, 13 nt, Human
ucuaaagcugcca

SEQ ID NO: 2957988 - RNA, 15 nt, Human
uccuucagugccuua

SEQ ID NO: 2957989 - RNA, 14 nt, Human
uccuucagugccuu

SEQ ID NO: 2957990 - RNA, 17 nt, Human
uccuucagugccuuaug

SEQ ID NO: 2957991 - RNA, 16 nt, Human
uccuucagugccuuau

SEQ ID NO: 2957992 - RNA, 15 nt, Human
uccuuuagcgcccag

SEQ ID NO: 2957993 - RNA, 19 nt, Human
uccuuuagcgcccaguugg

SEQ ID NO: 2957994 - RNA, 14 nt, Human
uccuuguguuacua

SEQ ID NO: 2957995 - RNA, 23 nt, Human
uccuuguguuacuaaguuuuuau

SEQ ID NO: 2957996 - RNA, 22 nt, Human
uccuuuagcgcccaguugggug

SEQ ID NO: 2957997 - RNA, 23 nt, Human
uccuuuagcgcccaguugggugg

SEQ ID NO: 2957998 - RNA, 15 nt, Human
ucgagcaugccugga

SEQ ID NO: 2957999 - RNA, 18 nt, Human
ucgagcaugccuggaugg

SEQ ID NO: 2958000 - RNA, 16 nt, Human
ucgagcaugccuggau

SEQ ID NO: 2958001 - RNA, 19 nt, Human
ucgcgacaaugcaaaccau

SEQ ID NO: 2958002 - RNA, 16 nt, Human
ucgcgacaaugcaaac

SEQ ID NO: 2958003 - RNA, 18 nt, Human
ucgcuccaccuugcagcu

SEQ ID NO: 2958004 - RNA, 20 nt, Human
acugcuuaacuucacauauu

SEQ ID NO: 2958005 - RNA, 17 nt, Human
acugcuuccagugaggc

SEQ ID NO: 2958006 - RNA, 21 nt, Human
acugcuugugaaaggaaagag

SEQ ID NO: 2958007 - RNA, 15 nt, Human
acuggauuaaacuua

SEQ ID NO: 2958008 - RNA, 13 nt, Human
acuggcacaguuu

SEQ ID NO: 2958009 - RNA, 20 nt, Human
acuggcacaguuuucugaga

SEQ ID NO: 2958010 - RNA, 19 nt, Human
acuggcacaguuuucugag

SEQ ID NO: 2958011 - RNA, 18 nt, Human
acugcuuaacuucacaua

SEQ ID NO: 2958012 - RNA, 13 nt, Human
acugccuucucaa

SEQ ID NO: 2958013 - RNA, 19 nt, Human
acugccuucucaacuccaa

SEQ ID NO: 2958014 - RNA, 22 nt, Human
acugcaucaagaugugacaugu

SEQ ID NO: 2958015 - RNA, 20 nt, Human
acugcaucaagaugugacau

SEQ ID NO: 2958016 - RNA, 15 nt, Human
acugcauguuuguga

SEQ ID NO: 2958017 - RNA, 16 nt, Human
acugcauguuugugau

SEQ ID NO: 2958018 - RNA, 22 nt, Human
uccuagaaauuccccacccuga

SEQ ID NO: 2958019 - RNA, 21 nt, Human
uccuagaaauuccccacccug

SEQ ID NO: 2958020 - RNA, 16 nt, Human
acugcauaugaaagga

SEQ ID NO: 2958021 - RNA, 15 nt, Human
acugcauuauauuua

SEQ ID NO: 2958022 - RNA, 14 nt, Human
acugcauuauauuu

SEQ ID NO: 2958023 - RNA, 12 nt, Human
ucugaagaagau

SEQ ID NO: 2958024 - RNA, 20 nt, Human
agaaauaucugaaaauguau

SEQ ID NO: 2958025 - RNA, 14 nt, Human
agaaauauaauuga

SEQ ID NO: 2958026 - RNA, 19 nt, Human
agaaauaucugaaaaugua

SEQ ID NO: 2958027 - RNA, 13 nt, Human
ucugauacagaaa

SEQ ID NO: 2958028 - RNA, 19 nt, Human
ucugcacuccccugcuggg

SEQ ID NO: 2958029 - RNA, 18 nt, Human
ucugcacuccccugcugg

SEQ ID NO: 2958030 - RNA, 12 nt, Human
ucugacuauaac

SEQ ID NO: 2958031 - RNA, 23 nt, Human
ucugagacucgcgacaaugcaaa

SEQ ID NO: 2958032 - RNA, 22 nt, Human
ucugagacucgcgacaaugcaa

SEQ ID NO: 2958033 - RNA, 18 nt, Human
ucugcagcaauaaagcag

SEQ ID NO: 2958034 - RNA, 20 nt, Human
ucugcacuccccugcugggu

SEQ ID NO: 2958035 - RNA, 17 nt, Human
ucucucacuuguuuuau

SEQ ID NO: 2958036 - RNA, 21 nt, Human
ucucucaggccaaacucaccu

SEQ ID NO: 2958037 - RNA, 15 nt, Human
ucucucacuccuuga

SEQ ID NO: 2958038 - RNA, 13 nt, Human
ucucucacuccuu

SEQ ID NO: 2958039 - RNA, 18 nt, Human
acuuugaccucugcagca

SEQ ID NO: 2958040 - RNA, 15 nt, Human
acuuugaccucugca

SEQ ID NO: 2958041 - RNA, 16 nt, Human
acuuugaccucugcag

SEQ ID NO: 2958042 - RNA, 18 nt, Human
ucucucaucuguuacaca

SEQ ID NO: 2958043 - RNA, 19 nt, Human
ucucuccagccccuggaug

SEQ ID NO: 2958044 - RNA, 18 nt, Human
ucucuccagccccuggau

SEQ ID NO: 2958045 - RNA, 16 nt, Human
ucucuccagccccugg

SEQ ID NO: 2958046 - RNA, 17 nt, Human
ucucuccagccccugga

SEQ ID NO: 2958047 - RNA, 16 nt, Human
ucucuccuguaccucu

SEQ ID NO: 2958048 - RNA, 14 nt, Human
ucucuccuguaccu

SEQ ID NO: 2958049 - RNA, 17 nt, Human
ucucugcccuccaagac

SEQ ID NO: 2958050 - RNA, 16 nt, Human
ucucugcccuccaaga

SEQ ID NO: 2958051 - RNA, 15 nt, Human
ucucugcccuccaag

SEQ ID NO: 2958052 - RNA, 11 nt, Human
ucucugcccuc

SEQ ID NO: 2958053 - RNA, 12 nt, Human
ucucuggccuuc

SEQ ID NO: 2958054 - RNA, 13 nt, Human
agaaaaagaaaaa

SEQ ID NO: 2958055 - RNA, 20 nt, Human
ucucuuuaaugucacaggca

SEQ ID NO: 2958056 - RNA, 21 nt, Human
ucucuuuaaugucacaggcag

SEQ ID NO: 2958057 - RNA, 18 nt, Human
ucucuugagccugggagg

SEQ ID NO: 2958058 - RNA, 16 nt, Human
ucucuugauucauaau

SEQ ID NO: 2958059 - RNA, 14 nt, Human
ucucuugauucaua

SEQ ID NO: 2958060 - RNA, 21 nt, Human
ucucuggccuucggccuccau

SEQ ID NO: 2958061 - RNA, 22 nt, Human
ucucuggccuucggccuccauc

SEQ ID NO: 2958062 - RNA, 17 nt, Human
ucucuugagccugggag

SEQ ID NO: 2958063 - RNA, 17 nt, Human
agaaaaaggaugcacag

SEQ ID NO: 2958064 - RNA, 23 nt, Human
agaaacuuaagguuaccuuuguu

SEQ ID NO: 2958065 - RNA, 11 nt, Human
acuuuaaacua

SEQ ID NO: 2958066 - RNA, 16 nt, Human
acuuguguuuugcaag

SEQ ID NO: 2958067 - RNA, 21 nt, Human
ucuccuccuuuucacaguucu

SEQ ID NO: 2958068 - RNA, 14 nt, Human
acuuugaccucugc

SEQ ID NO: 2958069 - RNA, 17 nt, Human
acuuucuagccagagga

SEQ ID NO: 2958070 - RNA, 16 nt, Human
acuuucuagccagagg

SEQ ID NO: 2958071 - RNA, 16 nt, Human
ucuccauguuugaugu

SEQ ID NO: 2958072 - RNA, 13 nt, Human
ucucagggccugg

SEQ ID NO: 2958073 - RNA, 12 nt, Human
ucucagggccug

SEQ ID NO: 2958074 - RNA, 15 nt, Human
acuuguggacacagc

SEQ ID NO: 2958075 - RNA, 19 nt, Human
ucucagggccuggucguuu

SEQ ID NO: 2958076 - RNA, 15 nt, Human
ucucagggccugguc

SEQ ID NO: 2958077 - RNA, 14 nt, Human
ucucagggccuggu

SEQ ID NO: 2958078 - RNA, 11 nt, Human
ucuccaggcug

SEQ ID NO: 2958079 - RNA, 17 nt, Human
ucuccaaaauaaaacuu

SEQ ID NO: 2958080 - RNA, 19 nt, Human
ucuccaaaauaaaacuuuu

SEQ ID NO: 2958081 - RNA, 22 nt, Human
ucuccaaaauaaaacuuuuuaa

SEQ ID NO: 2958082 - RNA, 13 nt, Human
ucuccaaaauaaa

SEQ ID NO: 2958083 - RNA, 16 nt, Human
ucuccaggcuguaucc

SEQ ID NO: 2958084 - RNA, 16 nt, Human
acuucagcugacuuuu

SEQ ID NO: 2958085 - RNA, 11 nt, Human
acuucagcuga

SEQ ID NO: 2958086 - RNA, 23 nt, Human
ucucacacaugagcaucaggcca

SEQ ID NO: 2958087 - RNA, 21 nt, Human
ucuauuucuggaugaaugccc

SEQ ID NO: 2958088 - RNA, 11 nt, Human
ucucacuccuu

SEQ ID NO: 2958089 - RNA, 22 nt, Human
acuucgggaggucgaggcagga

SEQ ID NO: 2958090 - RNA, 13 nt, Human
ucucacuccuuga

SEQ ID NO: 2958091 - RNA, 12 nt, Human
ucucacucuguc

SEQ ID NO: 2958092 - RNA, 21 nt, Human
acuucuaaguaaaaccacagc

SEQ ID NO: 2958093 - RNA, 14 nt, Human
acuucuccacccug

SEQ ID NO: 2958094 - RNA, 23 nt, Human
acuucuaaguaaaaccacagcag

SEQ ID NO: 2958095 - RNA, 16 nt, Human
acuuguggacacagcu

SEQ ID NO: 2958096 - RNA, 17 nt, Human
acuuguggacacagcuc

SEQ ID NO: 2958097 - RNA, 18 nt, Human
acuuguggacacagcucu

SEQ ID NO: 2958098 - RNA, 16 nt, Human
acuugucaauaaaauc

SEQ ID NO: 2958099 - RNA, 19 nt, Human
acuugagcccagagugaac

SEQ ID NO: 2958100 - RNA, 15 nt, Human
acuucuccacccugc

SEQ ID NO: 2958101 - RNA, 16 nt, Human
acuucuccacccugcu

SEQ ID NO: 2958102 - RNA, 21 nt, Human
acuugaacccauauuuguaca

SEQ ID NO: 2958103 - RNA, 19 nt, Human
acuugaacccgggaggcag

SEQ ID NO: 2958104 - RNA, 20 nt, Human
acuugaacccgggaggcaga

SEQ ID NO: 2958105 - RNA, 15 nt, Human
ucuuacaucugaaau

SEQ ID NO: 2958106 - RNA, 18 nt, Human
ucuuaugggcuggguucu

SEQ ID NO: 2958107 - RNA, 22 nt, Human
ucuuagaugcaguucugaagaa

SEQ ID NO: 2958108 - RNA, 23 nt, Human
ucuuagaugcaguucugaagaag

SEQ ID NO: 2958109 - RNA, 12 nt, Human
ucuuagauguau

SEQ ID NO: 2958110 - RNA, 14 nt, Human
agacaguuggguuu

SEQ ID NO: 2958111 - RNA, 19 nt, Human
agacagucccugccaaugg

SEQ ID NO: 2958112 - RNA, 13 nt, Human
agacagucccugc

SEQ ID NO: 2958113 - RNA, 16 nt, Human
agacagcugccuggga

SEQ ID NO: 2958114 - RNA, 15 nt, Human
agacagcugccuggg

SEQ ID NO: 2958115 - RNA, 12 nt, Human
agacagucccug

SEQ ID NO: 2958116 - RNA, 22 nt, Human
agacaccuugacagggcacacc

SEQ ID NO: 2958117 - RNA, 19 nt, Human
agacaccuugacagggcac

SEQ ID NO: 2958118 - RNA, 24 nt, Human
agacacauguccaagaagcccagg

SEQ ID NO: 2958119 - RNA, 23 nt, Human
agacacaggcccggcuccaggcu

SEQ ID NO: 2958120 - RNA, 22 nt, Human
agacacauguccaagaagccca

SEQ ID NO: 2958121 - RNA, 21 nt, Human
agacacauguccaagaagccc

SEQ ID NO: 2958122 - RNA, 14 nt, Human
agacagcugccugg

SEQ ID NO: 2958123 - RNA, 13 nt, Human
agacagcugccug

SEQ ID NO: 2958124 - RNA, 17 nt, Human
agaauucucuuauccaa

SEQ ID NO: 2958125 - RNA, 18 nt, Human
agaauucucuaguuugau

SEQ ID NO: 2958126 - RNA, 19 nt, Human
agaauucucuaguuugauu

SEQ ID NO: 2958127 - RNA, 13 nt, Human
agacacaagccuu

SEQ ID NO: 2958128 - RNA, 15 nt, Human
agacacacaugaagu

SEQ ID NO: 2958129 - RNA, 14 nt, Human
agacacaagccuuc

SEQ ID NO: 2958130 - RNA, 19 nt, Human
agacacaggcccggcucca

SEQ ID NO: 2958131 - RNA, 20 nt, Human
agacacaggcccggcuccag

SEQ ID NO: 2958132 - RNA, 21 nt, Human
agacacaggcccggcuccagg

SEQ ID NO: 2958133 - RNA, 22 nt, Human
agacacaggcccggcuccaggc

SEQ ID NO: 2958134 - RNA, 17 nt, Human
agacacaggcccggcuc

SEQ ID NO: 2958135 - RNA, 17 nt, Human
agacacacugaagaagc

SEQ ID NO: 2958136 - RNA, 16 nt, Human
agacacacugaagaag

SEQ ID NO: 2958137 - RNA, 23 nt, Human
ucuguuuagauaauacaccacua

SEQ ID NO: 2958138 - RNA, 16 nt, Human
ucuguuuagauaauac

SEQ ID NO: 2958139 - RNA, 19 nt, Human
ucuguuuagauaauacacc

SEQ ID NO: 2958140 - RNA, 20 nt, Human
ucugugaugacauucccugc

SEQ ID NO: 2958141 - RNA, 12 nt, Human
ucuguauguguu

SEQ ID NO: 2958142 - RNA, 15 nt, Human
ucuguauguguucua

SEQ ID NO: 2958143 - RNA, 18 nt, Human
ucuguacgucugacaggc

SEQ ID NO: 2958144 - RNA, 20 nt, Human
agaauucucagaaucucaaa

SEQ ID NO: 2958145 - RNA, 20 nt, Human
agaauuauaauuaguuccuc

SEQ ID NO: 2958146 - RNA, 14 nt, Human
agaauucucuaguu

SEQ ID NO: 2958147 - RNA, 23 nt, Human
agaaccccaggguccuguagccc

SEQ ID NO: 2958148 - RNA, 21 nt, Human
agaauguguuuaaacuugguu

SEQ ID NO: 2958149 - RNA, 19 nt, Human
agaauuaguggcacuugcu

SEQ ID NO: 2958150 - RNA, 23 nt, Human
agaauuaacacaugauccugcaa

SEQ ID NO: 2958151 - RNA, 12 nt, Human
agaauguuuuca

SEQ ID NO: 2958152 - RNA, 18 nt, Human
ucuugagccuugaacuuu

SEQ ID NO: 2958153 - RNA, 19 nt, Human
ucuugagccuugaacuuug

SEQ ID NO: 2958154 - RNA, 15 nt, Human
agacucauucuucug

SEQ ID NO: 2958155 - RNA, 17 nt, Human
ucuugagccuugaacuu

SEQ ID NO: 2958156 - RNA, 22 nt, Human
agaccugcccucaagagcaaag

SEQ ID NO: 2958157 - RNA, 23 nt, Human
agacuauucaaacagucucagga

SEQ ID NO: 2958158 - RNA, 14 nt, Human
agacccggcugcgu

SEQ ID NO: 2958159 - RNA, 17 nt, Human
agacccucaugcugcca

SEQ ID NO: 2958160 - RNA, 20 nt, Human
ucuucuguacgucugacagg

SEQ ID NO: 2958161 - RNA, 23 nt, Human
agacauacuaaccagcagaaaug

SEQ ID NO: 2958162 - RNA, 22 nt, Human
ucuucugcuucagccucccgag

SEQ ID NO: 2958163 - RNA, 19 nt, Human
ucuucugcuucagccuccc

SEQ ID NO: 2958164 - RNA, 21 nt, Human
ucuucuguacgucugacaggc

SEQ ID NO: 2958165 - RNA, 22 nt, Human
ucuucuguacgucugacaggca

SEQ ID NO: 2958166 - RNA, 16 nt, Human
ucuuauuucauuucuu

SEQ ID NO: 2958167 - RNA, 15 nt, Human
ucuuauuucauuucu

SEQ ID NO: 2958168 - RNA, 17 nt, Human
ucuuauuuaaugaaaga

SEQ ID NO: 2958169 - RNA, 14 nt, Human
ucuugguuuguaaa

SEQ ID NO: 2958170 - RNA, 22 nt, Human
ucuuuaaugucacaggcagguc

SEQ ID NO: 2958171 - RNA, 16 nt, Human
ucuugguuuguaaauu

SEQ ID NO: 2958172 - RNA, 20 nt, Human
ucuuuaaugucacaggcagg

SEQ ID NO: 2958173 - RNA, 19 nt, Human
agacucgcgacaaugcaaa

SEQ ID NO: 2958174 - RNA, 18 nt, Human
agacucgcgacaaugcaa

SEQ ID NO: 2958175 - RNA, 17 nt, Human
agacucgcgacaaugca

SEQ ID NO: 2958176 - RNA, 15 nt, Human
agacucgcgacaaug

SEQ ID NO: 2958177 - RNA, 18 nt, Human
ucuuucuggcuaugcauu

SEQ ID NO: 2958178 - RNA, 13 nt, Human
ucuuucugcuuug

SEQ ID NO: 2958179 - RNA, 20 nt, Human
ucuuuauaauucuacuuuga

SEQ ID NO: 2958180 - RNA, 20 nt, Human
agacuuaaugagacuuuaaa

SEQ ID NO: 2958181 - RNA, 21 nt, Human
agacuuaaugagacuuuaaaa

SEQ ID NO: 2958182 - RNA, 20 nt, Human
agacucgcgacaaugcaaac

SEQ ID NO: 2958183 - RNA, 14 nt, Human
agacuguacaaagu

SEQ ID NO: 2958184 - RNA, 15 nt, Human
agacuguacaaagua

SEQ ID NO: 2958185 - RNA, 16 nt, Human
agacuguacaaaguag

SEQ ID NO: 2958186 - RNA, 14 nt, Human
agacuuuaaaagca

SEQ ID NO: 2958187 - RNA, 22 nt, Human
agacuucucuacccaucuuaaa

SEQ ID NO: 2958188 - RNA, 22 nt, Human
agagaaaaaauauuuuccugcc

SEQ ID NO: 2958189 - RNA, 19 nt, Human
agacuuuucuuucagccaa

SEQ ID NO: 2958190 - RNA, 24 nt, Human
agagacagaaagcagaacagugau

SEQ ID NO: 2958191 - RNA, 15 nt, Human
agagacagaaagcag

SEQ ID NO: 2958192 - RNA, 20 nt, Human
ugacacacagcucuguccug

SEQ ID NO: 2958193 - RNA, 16 nt, Human
ugaauuuuacauggcu

SEQ ID NO: 2958194 - RNA, 15 nt, Human
ugaauuucuuuugcc

SEQ ID NO: 2958195 - RNA, 17 nt, Human
agaucacgccacugcac

SEQ ID NO: 2958196 - RNA, 18 nt, Human
agaucacgccacugcacu

SEQ ID NO: 2958197 - RNA, 15 nt, Human
agaguuuagcccuga

SEQ ID NO: 2958198 - RNA, 12 nt, Human
agauaaaugugc

SEQ ID NO: 2958199 - RNA, 12 nt, Human
agauacugaaau

SEQ ID NO: 2958200 - RNA, 13 nt, Human
agauacugaaaua

SEQ ID NO: 2958201 - RNA, 15 nt, Human
agauacugaaauaaa

SEQ ID NO: 2958202 - RNA, 14 nt, Human
agaucacgccacug

SEQ ID NO: 2958203 - RNA, 15 nt, Human
agaucacgccacugc

SEQ ID NO: 2958204 - RNA, 16 nt, Human
agaucacgccacugca

SEQ ID NO: 2958205 - RNA, 12 nt, Human
ugaagcagagug

SEQ ID NO: 2958206 - RNA, 13 nt, Human
ugaagcagagugg

SEQ ID NO: 2958207 - RNA, 16 nt, Human
ugaagcagaguggcag

SEQ ID NO: 2958208 - RNA, 20 nt, Human
ugaaugguuuucaaaauaaa

SEQ ID NO: 2958209 - RNA, 15 nt, Human
ugaaugucaguuguu

SEQ ID NO: 2958210 - RNA, 19 nt, Human
ugaaugucagugugacuga

SEQ ID NO: 2958211 - RNA, 22 nt, Human
agagucagaaguuucugccgca

SEQ ID NO: 2958212 - RNA, 17 nt, Human
agaguugauacuacagu

SEQ ID NO: 2958213 - RNA, 20 nt, Human
agaguugauacuacaguuug

SEQ ID NO: 2958214 - RNA, 22 nt, Human
agaguugauacuacaguuuguu

SEQ ID NO: 2958215 - RNA, 12 nt, Human
agaguuguuaca

SEQ ID NO: 2958216 - RNA, 21 nt, Human
agaguuguuacauuuuuaagu

SEQ ID NO: 2958217 - RNA, 16 nt, Human
agaguuuagcuggaaa

SEQ ID NO: 2958218 - RNA, 17 nt, Human
agaguuuagcuggaaaa

SEQ ID NO: 2958219 - RNA, 11 nt, Human
ugacagggcac

SEQ ID NO: 2958220 - RNA, 16 nt, Human
ugacagggcacaccgg

SEQ ID NO: 2958221 - RNA, 20 nt, Human
ugacagggcacaccgggcac

SEQ ID NO: 2958222 - RNA, 20 nt, Human
ugacaggcaaugcuggcugu

SEQ ID NO: 2958223 - RNA, 21 nt, Human
ugacacacagcucuguccugg

SEQ ID NO: 2958224 - RNA, 14 nt, Human
agaucaugcauaga

SEQ ID NO: 2958225 - RNA, 15 nt, Human
agaucagccugggca

SEQ ID NO: 2958226 - RNA, 13 nt, Human
agaucagccuggg

SEQ ID NO: 2958227 - RNA, 20 nt, Human
ugacauuguuggccaaagcc

SEQ ID NO: 2958228 - RNA, 21 nt, Human
ugacauuguuggccaaagcca

SEQ ID NO: 2958229 - RNA, 18 nt, Human
ugaccaaugauggucacc

SEQ ID NO: 2958230 - RNA, 15 nt, Human
agaugcuucucacug

SEQ ID NO: 2958231 - RNA, 12 nt, Human
ugacccacugcu

SEQ ID NO: 2958232 - RNA, 13 nt, Human
ugacccacugcuu

SEQ ID NO: 2958233 - RNA, 17 nt, Human
ugacccacaagaaauga

SEQ ID NO: 2958234 - RNA, 23 nt, Human
ugaccauucuccaccugccaggg

SEQ ID NO: 2958235 - RNA, 14 nt, Human
agaugcaccagccc

SEQ ID NO: 2958236 - RNA, 15 nt, Human
agaugcaccagcccu

SEQ ID NO: 2958237 - RNA, 17 nt, Human
agaugcaguucugaaga

SEQ ID NO: 2958238 - RNA, 18 nt, Human
agaugcaguucugaagaa

SEQ ID NO: 2958239 - RNA, 19 nt, Human
agaugcaguucugaagaag

SEQ ID NO: 2958240 - RNA, 14 nt, Human
agaugcuagaacuc

SEQ ID NO: 2958241 - RNA, 14 nt, Human
ugaaauaaggaaug

SEQ ID NO: 2958242 - RNA, 18 nt, Human
ugaaauaaggaaugauau

SEQ ID NO: 2958243 - RNA, 15 nt, Human
ugaaauuguauuaca

SEQ ID NO: 2958244 - RNA, 23 nt, Human
ugaaauuuccugggagcuuuugu

SEQ ID NO: 2958245 - RNA, 18 nt, Human
agagcugccaccugccug

SEQ ID NO: 2958246 - RNA, 13 nt, Human
agagcugcccucu

SEQ ID NO: 2958247 - RNA, 14 nt, Human
agagcugcccucuc

SEQ ID NO: 2958248 - RNA, 14 nt, Human
ugaaauaagccaga

SEQ ID NO: 2958249 - RNA, 17 nt, Human
ugaaauaagccagacau

SEQ ID NO: 2958250 - RNA, 18 nt, Human
ugaaauaagccagacauc

SEQ ID NO: 2958251 - RNA, 20 nt, Human
ugaaauaagccagacaucaa

SEQ ID NO: 2958252 - RNA, 23 nt, Human
ugaaauaagccagacaucaacag

SEQ ID NO: 2958253 - RNA, 11 nt, Human
agagccuugcg

SEQ ID NO: 2958254 - RNA, 21 nt, Human
agagccuugcggaagguucua

SEQ ID NO: 2958255 - RNA, 13 nt, Human
agagcaggccagg

SEQ ID NO: 2958256 - RNA, 15 nt, Human
agagcaggccaggcg

SEQ ID NO: 2958257 - RNA, 21 nt, Human
agagcaggccaggcgcggugg

SEQ ID NO: 2958258 - RNA, 20 nt, Human
agagcagagaccaucccuga

SEQ ID NO: 2958259 - RNA, 18 nt, Human
agagcagagaccaucccu

SEQ ID NO: 2958260 - RNA, 17 nt, Human
agagcagagaccauccc

SEQ ID NO: 2958261 - RNA, 12 nt, Human
agagcagagacc

SEQ ID NO: 2958262 - RNA, 21 nt, Human
ucuuuggacccugaggcccag

SEQ ID NO: 2958263 - RNA, 17 nt, Human
ucuuuggacccugaggc

SEQ ID NO: 2958264 - RNA, 22 nt, Human
ugaaccgaugagaaauaaaguu

SEQ ID NO: 2958265 - RNA, 19 nt, Human
ugaacaaauuuacagagac

SEQ ID NO: 2958266 - RNA, 20 nt, Human
ugaacaaauuuacagagaca

SEQ ID NO: 2958267 - RNA, 18 nt, Human
ugaacaaauuuacagaga

SEQ ID NO: 2958268 - RNA, 15 nt, Human
ugaaauuuuuauuaa

SEQ ID NO: 2958269 - RNA, 14 nt, Human
ugaacuccuggccu

SEQ ID NO: 2958270 - RNA, 15 nt, Human
ugaacuccuggccuc

SEQ ID NO: 2958271 - RNA, 11 nt, Human
ugaacuccugg

SEQ ID NO: 2958272 - RNA, 12 nt, Human
ugaacuccuggc

SEQ ID NO: 2958273 - RNA, 23 nt, Human
ugaacuagaguuuagcuggaaaa

SEQ ID NO: 2958274 - RNA, 22 nt, Human
agagcugcccucuccugggcag

SEQ ID NO: 2958275 - RNA, 19 nt, Human
ugaacuuugaccucugcag

SEQ ID NO: 2958276 - RNA, 20 nt, Human
ugaacuuugaccucugcagc

SEQ ID NO: 2958277 - RNA, 17 nt, Human
ugaacuuugaccucugc

SEQ ID NO: 2958278 - RNA, 22 nt, Human
ugaacuuugaccucugcagcaa

SEQ ID NO: 2958279 - RNA, 19 nt, Human
agagcuguucacagccaga

SEQ ID NO: 2958280 - RNA, 21 nt, Human
agagcuguucacagccagacu

SEQ ID NO: 2958281 - RNA, 24 nt, Human
agaggcagccccauucugccugcc

SEQ ID NO: 2958282 - RNA, 13 nt, Human
agaggcagcccca

SEQ ID NO: 2958283 - RNA, 19 nt, Human
agaggcagccccauucugc

SEQ ID NO: 2958284 - RNA, 19 nt, Human
agaggccaugggccuccug

SEQ ID NO: 2958285 - RNA, 17 nt, Human
agaggcuaugugagcac

SEQ ID NO: 2958286 - RNA, 10 nt, Human
agaggcaggg

SEQ ID NO: 2958287 - RNA, 13 nt, Human
agaggcagggucu

SEQ ID NO: 2958288 - RNA, 12 nt, Human
agagguuuuaaa

SEQ ID NO: 2958289 - RNA, 22 nt, Human
ugaagcacagugaucaaguuau

SEQ ID NO: 2958290 - RNA, 15 nt, Human
agagguugcagugag

SEQ ID NO: 2958291 - RNA, 22 nt, Human
agcauuuagauguauagguuga

SEQ ID NO: 2958292 - RNA, 19 nt, Human
agcauggcugccaauggga

SEQ ID NO: 2958293 - RNA, 20 nt, Human
agcauuuuaaacaaaauaga

SEQ ID NO: 2958294 - RNA, 17 nt, Human
agcauuuguguugaaga

SEQ ID NO: 2958295 - RNA, 18 nt, Human
agcauuuguguugaagag

SEQ ID NO: 2958296 - RNA, 13 nt, Human
agcauuuuaaaca

SEQ ID NO: 2958297 - RNA, 15 nt, Human
agcauuuuaaacaaa

SEQ ID NO: 2958298 - RNA, 17 nt, Human
agcauuuuaaacaaaau

SEQ ID NO: 2958299 - RNA, 19 nt, Human
agcauuuuaaacaaaauag

SEQ ID NO: 2958300 - RNA, 15 nt, Human
agcauuuuuuaaccu

SEQ ID NO: 2958301 - RNA, 15 nt, Human
agccaaaacugagca

SEQ ID NO: 2958302 - RNA, 22 nt, Human
agcauuuugcuaaaugugaaug

SEQ ID NO: 2958303 - RNA, 15 nt, Human
agcauuuugcuaaau

SEQ ID NO: 2958304 - RNA, 23 nt, Human
agcaucaggccaggcccucugcc

SEQ ID NO: 2958305 - RNA, 21 nt, Human
agcaucaggccaggcccucug

SEQ ID NO: 2958306 - RNA, 22 nt, Human
agcaucaggccaggcccucugc

SEQ ID NO: 2958307 - RNA, 16 nt, Human
agcauauucaggaagc

SEQ ID NO: 2958308 - RNA, 13 nt, Human
agcauccuggaau

SEQ ID NO: 2958309 - RNA, 14 nt, Human
agcauccuggaaua

SEQ ID NO: 2958310 - RNA, 15 nt, Human
agcauccuggaauau

SEQ ID NO: 2958311 - RNA, 13 nt, Human
agcauggcugcca

SEQ ID NO: 2958312 - RNA, 21 nt, Human
ugauacagaaaaguugaauuu

SEQ ID NO: 2958313 - RNA, 15 nt, Human
ugaucacggcucacu

SEQ ID NO: 2958314 - RNA, 13 nt, Human
ugaucacggcuca

SEQ ID NO: 2958315 - RNA, 14 nt, Human
ugaucacggcucac

SEQ ID NO: 2958316 - RNA, 20 nt, Human
agcaucacaugaacuuguaa

SEQ ID NO: 2958317 - RNA, 21 nt, Human
agcauauucaggaagcucagg

SEQ ID NO: 2958318 - RNA, 19 nt, Human
agcauauucaggaagcuca

SEQ ID NO: 2958319 - RNA, 17 nt, Human
agcauauucaggaagcu

SEQ ID NO: 2958320 - RNA, 13 nt, Human
ugaucuaggaaga

SEQ ID NO: 2958321 - RNA, 19 nt, Human
ugauccucccaccucagcc

SEQ ID NO: 2958322 - RNA, 20 nt, Human
ugauccucccaccucagccu

SEQ ID NO: 2958323 - RNA, 18 nt, Human
ugauccucccaccucagc

SEQ ID NO: 2958324 - RNA, 21 nt, Human
ugaugggcaacccccagccug

SEQ ID NO: 2958325 - RNA, 22 nt, Human
ugaugggcaacccccagccugc

SEQ ID NO: 2958326 - RNA, 13 nt, Human
ugauggggcccug

SEQ ID NO: 2958327 - RNA, 21 nt, Human
ugaugaucuuugcagacaggc

SEQ ID NO: 2958328 - RNA, 22 nt, Human
ugaugaaaugaggucagagccu

SEQ ID NO: 2958329 - RNA, 15 nt, Human
ugaucuaggaagacu

SEQ ID NO: 2958330 - RNA, 14 nt, Human
ugaucuaggaagac

SEQ ID NO: 2958331 - RNA, 23 nt, Human
ugaugaaaugaggucagagccug

SEQ ID NO: 2958332 - RNA, 19 nt, Human
ugaugaucuuugcagacag

SEQ ID NO: 2958333 - RNA, 20 nt, Human
ugaugaucuuugcagacagg

SEQ ID NO: 2958334 - RNA, 22 nt, Human
ugauggggcccugccuccuuug

SEQ ID NO: 2958335 - RNA, 19 nt, Human
ugauguuuuccaugagucc

SEQ ID NO: 2958336 - RNA, 17 nt, Human
ugauguuuuccaugagu

SEQ ID NO: 2958337 - RNA, 21 nt, Human
ugauguuuuaaggaugcuugu

SEQ ID NO: 2958338 - RNA, 20 nt, Human
ugauuaaccacuucagcuga

SEQ ID NO: 2958339 - RNA, 17 nt, Human
ugauuaaauucuugcaa

SEQ ID NO: 2958340 - RNA, 13 nt, Human
ugauuaaauucuu

SEQ ID NO: 2958341 - RNA, 16 nt, Human
ugauuaaauucuugca

SEQ ID NO: 2958342 - RNA, 15 nt, Human
ugauuaaguaaugau

SEQ ID NO: 2958343 - RNA, 16 nt, Human
agccacggccaggcca

SEQ ID NO: 2958344 - RNA, 16 nt, Human
ugauuaaguaaugaua

SEQ ID NO: 2958345 - RNA, 14 nt, Human
agcaggcuacuguc

SEQ ID NO: 2958346 - RNA, 20 nt, Human
agcaggcuacugucagcucc

SEQ ID NO: 2958347 - RNA, 19 nt, Human
agcaggcuacugucagcuc

SEQ ID NO: 2958348 - RNA, 17 nt, Human
agcaggcuacugucagc

SEQ ID NO: 2958349 - RNA, 16 nt, Human
agcaggcuacugucag

SEQ ID NO: 2958350 - RNA, 17 nt, Human
ugacccaugcugcccug

SEQ ID NO: 2958351 - RNA, 19 nt, Human
ugacccaugcugcccugug

SEQ ID NO: 2958352 - RNA, 18 nt, Human
ugacccaugcugcccugu

SEQ ID NO: 2958353 - RNA, 20 nt, Human
ugacccaugcugcccuguga

SEQ ID NO: 2958354 - RNA, 16 nt, Human
agcagcagggagggcu

SEQ ID NO: 2958355 - RNA, 20 nt, Human
agcaggaagcugugagagca

SEQ ID NO: 2958356 - RNA, 13 nt, Human
agcaggacaugga

SEQ ID NO: 2958357 - RNA, 11 nt, Human
agcagccacau

SEQ ID NO: 2958358 - RNA, 15 nt, Human
agcagccacauuccu

SEQ ID NO: 2958359 - RNA, 13 nt, Human
agcagggaaacag

SEQ ID NO: 2958360 - RNA, 14 nt, Human
agcagggaaacagc

SEQ ID NO: 2958361 - RNA, 15 nt, Human
agcagggaaacagcu

SEQ ID NO: 2958362 - RNA, 13 nt, Human
agcaggcugccag

SEQ ID NO: 2958363 - RNA, 14 nt, Human
agcaggcugccagu

SEQ ID NO: 2958364 - RNA, 17 nt, Human
agcaggcugccagugcc

SEQ ID NO: 2958365 - RNA, 18 nt, Human
agcaggcugccagugccu

SEQ ID NO: 2958366 - RNA, 20 nt, Human
agcaggcugccagugccugg

SEQ ID NO: 2958367 - RNA, 22 nt, Human
agcaggcugccagugccugggu

SEQ ID NO: 2958368 - RNA, 23 nt, Human
agcaggcucucaggccagcugcu

SEQ ID NO: 2958369 - RNA, 22 nt, Human
agcaggcucucaggccagcugc

SEQ ID NO: 2958370 - RNA, 21 nt, Human
agcaggcucucaggccagcug

SEQ ID NO: 2958371 - RNA, 19 nt, Human
agcaggcucucaggccagc

SEQ ID NO: 2958372 - RNA, 18 nt, Human
agcaggcucucaggccag

SEQ ID NO: 2958373 - RNA, 17 nt, Human
agcaggcucucaggcca

SEQ ID NO: 2958374 - RNA, 16 nt, Human
agcaggcucucaggcc

SEQ ID NO: 2958375 - RNA, 15 nt, Human
agcaggcucucaggc

SEQ ID NO: 2958376 - RNA, 14 nt, Human
agcaggcucucagg

SEQ ID NO: 2958377 - RNA, 13 nt, Human
agcaggcucucag

SEQ ID NO: 2958378 - RNA, 17 nt, Human
agcaggcucgggcuccc

SEQ ID NO: 2958379 - RNA, 22 nt, Human
agcagggcucagcggggacagc

SEQ ID NO: 2958380 - RNA, 13 nt, Human
agcagggcucagc

SEQ ID NO: 2958381 - RNA, 14 nt, Human
agcagggcucagcg

SEQ ID NO: 2958382 - RNA, 15 nt, Human
agcagggcucagcgg

SEQ ID NO: 2958383 - RNA, 20 nt, Human
agcagggagggcuucugcca

SEQ ID NO: 2958384 - RNA, 19 nt, Human
agcagggcauggcugggaa

SEQ ID NO: 2958385 - RNA, 17 nt, Human
agcagucaggaaagaga

SEQ ID NO: 2958386 - RNA, 18 nt, Human
agcagucaggaaagagaa

SEQ ID NO: 2958387 - RNA, 20 nt, Human
agcaguuugguuucuagcau

SEQ ID NO: 2958388 - RNA, 23 nt, Human
agcaguuugguuucuagcaugaa

SEQ ID NO: 2958389 - RNA, 22 nt, Human
agcaguuugguuucuagcauga

SEQ ID NO: 2958390 - RNA, 19 nt, Human
agcauaaaaauuagccaag

SEQ ID NO: 2958391 - RNA, 19 nt, Human
agcagucaggaaagagaac

SEQ ID NO: 2958392 - RNA, 16 nt, Human
ugaguacguugugcau

SEQ ID NO: 2958393 - RNA, 17 nt, Human
ugaguacguugugcauu

SEQ ID NO: 2958394 - RNA, 18 nt, Human
ugaguacguugugcauuu

SEQ ID NO: 2958395 - RNA, 19 nt, Human
ugaguacguugugcauuug

SEQ ID NO: 2958396 - RNA, 23 nt, Human
agcauaaaaauuagccaagugug

SEQ ID NO: 2958397 - RNA, 13 nt, Human
agcauaccaacac

SEQ ID NO: 2958398 - RNA, 22 nt, Human
agcauaccaacacgagcaggcu

SEQ ID NO: 2958399 - RNA, 19 nt, Human
agcauaccaacacgagcag

SEQ ID NO: 2958400 - RNA, 14 nt, Human
ugagugccuuacac

SEQ ID NO: 2958401 - RNA, 13 nt, Human
ugagugccuuaca

SEQ ID NO: 2958402 - RNA, 17 nt, Human
ugagugcagcucuggag

SEQ ID NO: 2958403 - RNA, 18 nt, Human
ugagugcaaacuucagag

SEQ ID NO: 2958404 - RNA, 20 nt, Human
ugagugcaaacuucagaguu

SEQ ID NO: 2958405 - RNA, 22 nt, Human
ugagugcaaacuucagaguucu

SEQ ID NO: 2958406 - RNA, 18 nt, Human
ugagucaccaagcccagu

SEQ ID NO: 2958407 - RNA, 20 nt, Human
ugaguacguugugcauuugg

SEQ ID NO: 2958408 - RNA, 14 nt, Human
ugauacaaugcugu

SEQ ID NO: 2958409 - RNA, 15 nt, Human
ugauacaaugcugug

SEQ ID NO: 2958410 - RNA, 18 nt, Human
ugaguucauacccuguua

SEQ ID NO: 2958411 - RNA, 18 nt, Human
ugagugucuuaauuaaaa

SEQ ID NO: 2958412 - RNA, 21 nt, Human
ugagugggggaucacagccuc

SEQ ID NO: 2958413 - RNA, 19 nt, Human
agccuugaccauucuccac

SEQ ID NO: 2958414 - RNA, 18 nt, Human
agccuugaccauucucca

SEQ ID NO: 2958415 - RNA, 21 nt, Human
agccuugaccauucuccaccu

SEQ ID NO: 2958416 - RNA, 19 nt, Human
agccuugcggaagguucua

SEQ ID NO: 2958417 - RNA, 20 nt, Human
agccuuagaagucacacagu

SEQ ID NO: 2958418 - RNA, 23 nt, Human
agccuugaacuuugaccucugca

SEQ ID NO: 2958419 - RNA, 17 nt, Human
agccugugccucuggga

SEQ ID NO: 2958420 - RNA, 18 nt, Human
agccugugccucugggac

SEQ ID NO: 2958421 - RNA, 19 nt, Human
agccugugccucugggacu

SEQ ID NO: 2958422 - RNA, 19 nt, Human
agccugagcgacagugaga

SEQ ID NO: 2958423 - RNA, 17 nt, Human
ugccaaugcuacaguaa

SEQ ID NO: 2958424 - RNA, 22 nt, Human
ugccaaugcuacaguaauaaau

SEQ ID NO: 2958425 - RNA, 14 nt, Human
ugccaaugggagcu

SEQ ID NO: 2958426 - RNA, 13 nt, Human
ugccaauggacua

SEQ ID NO: 2958427 - RNA, 16 nt, Human
ugcauuuaaaagauac

SEQ ID NO: 2958428 - RNA, 22 nt, Human
ugccagccgagauagccaaggc

SEQ ID NO: 2958429 - RNA, 17 nt, Human
ugccagccgagauagcc

SEQ ID NO: 2958430 - RNA, 17 nt, Human
ugccaguuauggcuaua

SEQ ID NO: 2958431 - RNA, 13 nt, Human
ugccauaauuacu

SEQ ID NO: 2958432 - RNA, 18 nt, Human
ugcaucuagccucaagcu

SEQ ID NO: 2958433 - RNA, 17 nt, Human
ugcaucguuucaucuuc

SEQ ID NO: 2958434 - RNA, 18 nt, Human
ugcaugcugucccuuacg

SEQ ID NO: 2958435 - RNA, 21 nt, Human
ugcaugcugucccuuacguga

SEQ ID NO: 2958436 - RNA, 19 nt, Human
ugcaugcugucccuuacgu

SEQ ID NO: 2958437 - RNA, 14 nt, Human
ugcaguauagaaua

SEQ ID NO: 2958438 - RNA, 13 nt, Human
ugcaguauagaau

SEQ ID NO: 2958439 - RNA, 16 nt, Human
ugcauaccacuuuugu

SEQ ID NO: 2958440 - RNA, 18 nt, Human
ugcauaccacuuuuguuc

SEQ ID NO: 2958441 - RNA, 20 nt, Human
ugcauaccacuuuuguucuu

SEQ ID NO: 2958442 - RNA, 20 nt, Human
ugcauagauucccugagcag

SEQ ID NO: 2958443 - RNA, 19 nt, Human
ugcauacucauuaggaugg

SEQ ID NO: 2958444 - RNA, 13 nt, Human
ugcauacucauua

SEQ ID NO: 2958445 - RNA, 14 nt, Human
ugcauaccacuuuu

SEQ ID NO: 2958446 - RNA, 13 nt, Human
agccuccugcccu

SEQ ID NO: 2958447 - RNA, 18 nt, Human
agccuccugcccuuaccu

SEQ ID NO: 2958448 - RNA, 14 nt, Human
agccuccugcccuu

SEQ ID NO: 2958449 - RNA, 12 nt, Human
ugcagacaggca

SEQ ID NO: 2958450 - RNA, 13 nt, Human
ugcagacaggcaa

SEQ ID NO: 2958451 - RNA, 21 nt, Human
ugcagacaggcaagcaccucc

SEQ ID NO: 2958452 - RNA, 17 nt, Human
agccucuguuuugauau

SEQ ID NO: 2958453 - RNA, 14 nt, Human
agccucuguuuuga

SEQ ID NO: 2958454 - RNA, 18 nt, Human
ugcagccucacaguccuu

SEQ ID NO: 2958455 - RNA, 21 nt, Human
ugcagccucacaguccuuacc

SEQ ID NO: 2958456 - RNA, 17 nt, Human
ugcagccucacaguccu

SEQ ID NO: 2958457 - RNA, 17 nt, Human
ugcaauaaaauggguuu

SEQ ID NO: 2958458 - RNA, 21 nt, Human
ugcaauaaaauggguuuuacu

SEQ ID NO: 2958459 - RNA, 12 nt, Human
agcccaggccuc

SEQ ID NO: 2958460 - RNA, 14 nt, Human
ugcaaggcaaaugu

SEQ ID NO: 2958461 - RNA, 15 nt, Human
ugcaaggucauuuuu

SEQ ID NO: 2958462 - RNA, 21 nt, Human
ugcaaauaaguguauuuugaa

SEQ ID NO: 2958463 - RNA, 23 nt, Human
ugcaaauaaguguauuuugaaau

SEQ ID NO: 2958464 - RNA, 15 nt, Human
ugcaaauaaguguau

SEQ ID NO: 2958465 - RNA, 18 nt, Human
ugcaaauaaguguauuuu

SEQ ID NO: 2958466 - RNA, 13 nt, Human
ugcaacaggcugg

SEQ ID NO: 2958467 - RNA, 15 nt, Human
ugcaagccagauuuu

SEQ ID NO: 2958468 - RNA, 21 nt, Human
ugcaagccagauuuuccugaa

SEQ ID NO: 2958469 - RNA, 13 nt, Human
ugcaaaccaucau

SEQ ID NO: 2958470 - RNA, 12 nt, Human
ugcaaaccauca

SEQ ID NO: 2958471 - RNA, 17 nt, Human
agccacggccaggccag

SEQ ID NO: 2958472 - RNA, 18 nt, Human
agccacggccaggccaga

SEQ ID NO: 2958473 - RNA, 13 nt, Human
ugauuucauucaa

SEQ ID NO: 2958474 - RNA, 16 nt, Human
ugauuucacagugugu

SEQ ID NO: 2958475 - RNA, 14 nt, Human
ugauuucacagugu

SEQ ID NO: 2958476 - RNA, 21 nt, Human
ugcaaaggguaucaggugcug

SEQ ID NO: 2958477 - RNA, 20 nt, Human
ugcaaaguaucccuacugua

SEQ ID NO: 2958478 - RNA, 16 nt, Human
ugcaaacuucagaguu

SEQ ID NO: 2958479 - RNA, 20 nt, Human
ugcaaaccaucauugaaauc

SEQ ID NO: 2958480 - RNA, 18 nt, Human
ugcaaaccaucauugaaa

SEQ ID NO: 2958481 - RNA, 18 nt, Human
ugcaaagcacugacuucu

SEQ ID NO: 2958482 - RNA, 23 nt, Human
ugcaaagaugaaggucuguuuug

SEQ ID NO: 2958483 - RNA, 12 nt, Human
ugcaaagaugaa

SEQ ID NO: 2958484 - RNA, 22 nt, Human
ugcaaagcacugacuucuaagu

SEQ ID NO: 2958485 - RNA, 20 nt, Human
ugcaaagcacugacuucuaa

SEQ ID NO: 2958486 - RNA, 13 nt, Human
ugcaccagcccuu

SEQ ID NO: 2958487 - RNA, 21 nt, Human
ugcaccacugcacuccagccu

SEQ ID NO: 2958488 - RNA, 15 nt, Human
ugcacauuaaaugac

SEQ ID NO: 2958489 - RNA, 18 nt, Human
ugcacauuaaaugacucu

SEQ ID NO: 2958490 - RNA, 15 nt, Human
ugcaccacugcacuc

SEQ ID NO: 2958491 - RNA, 13 nt, Human
ugcacauuaaaug

SEQ ID NO: 2958492 - RNA, 15 nt, Human
ugcaccggcuggccu

SEQ ID NO: 2958493 - RNA, 14 nt, Human
ugcaccggcuggcc

SEQ ID NO: 2958494 - RNA, 16 nt, Human
ugcaccggcuggccug

SEQ ID NO: 2958495 - RNA, 14 nt, Human
ugcacuccagccug

SEQ ID NO: 2958496 - RNA, 15 nt, Human
ugcacuccagccuga

SEQ ID NO: 2958497 - RNA, 16 nt, Human
ugcacuccagccuggg

SEQ ID NO: 2958498 - RNA, 15 nt, Human
ugcacuccagccugg

SEQ ID NO: 2958499 - RNA, 17 nt, Human
ugcacuccagccugagc

SEQ ID NO: 2958500 - RNA, 22 nt, Human
ugcagaagacaguauggcagcu

SEQ ID NO: 2958501 - RNA, 22 nt, Human
agccccuggaugcagccucaca

SEQ ID NO: 2958502 - RNA, 14 nt, Human
agccccgaggccuu

SEQ ID NO: 2958503 - RNA, 19 nt, Human
agcccaggccuccuacagc

SEQ ID NO: 2958504 - RNA, 14 nt, Human
agcccaggccuccu

SEQ ID NO: 2958505 - RNA, 16 nt, Human
agcccgggcucugccu

SEQ ID NO: 2958506 - RNA, 19 nt, Human
agcccugcagagggcacag

SEQ ID NO: 2958507 - RNA, 16 nt, Human
agcccugcagagggca

SEQ ID NO: 2958508 - RNA, 15 nt, Human
agcccugcagagggc

SEQ ID NO: 2958509 - RNA, 14 nt, Human
agcccugcagaggg

SEQ ID NO: 2958510 - RNA, 14 nt, Human
agccccuucugacc

SEQ ID NO: 2958511 - RNA, 16 nt, Human
agccccuucugaccca

SEQ ID NO: 2958512 - RNA, 15 nt, Human
agccccuucugaccc

SEQ ID NO: 2958513 - RNA, 15 nt, Human
agcccgggcucugcc

SEQ ID NO: 2958514 - RNA, 14 nt, Human
agcccgggcucugc

SEQ ID NO: 2958515 - RNA, 13 nt, Human
agcccgggcucug

SEQ ID NO: 2958516 - RNA, 19 nt, Human
agccccuucugacccaugc

SEQ ID NO: 2958517 - RNA, 17 nt, Human
aggacuuuucuuugugg

SEQ ID NO: 2958518 - RNA, 19 nt, Human
aggacuuuucuuuguggcu

SEQ ID NO: 2958519 - RNA, 22 nt, Human
aggacuuuucuuuguggcuucc

SEQ ID NO: 2958520 - RNA, 17 nt, Human
aggagaaacuggaacuc

SEQ ID NO: 2958521 - RNA, 18 nt, Human
aggagaaacuggaacucu

SEQ ID NO: 2958522 - RNA, 19 nt, Human
aggagaaacuggaacucuc

SEQ ID NO: 2958523 - RNA, 20 nt, Human
aggagaucgagaccauccug

SEQ ID NO: 2958524 - RNA, 13 nt, Human
aggagcagccaca

SEQ ID NO: 2958525 - RNA, 12 nt, Human
aggagcagccac

SEQ ID NO: 2958526 - RNA, 17 nt, Human
aggagccccgaggccuu

SEQ ID NO: 2958527 - RNA, 16 nt, Human
aggagccuccugcccu

SEQ ID NO: 2958528 - RNA, 18 nt, Human
aggacuccaggcagcaga

SEQ ID NO: 2958529 - RNA, 14 nt, Human
aggacuccaggcag

SEQ ID NO: 2958530 - RNA, 19 nt, Human
aggacuccaggcagcagac

SEQ ID NO: 2958531 - RNA, 23 nt, Human
aggacuccaggcagcagacacau

SEQ ID NO: 2958532 - RNA, 13 nt, Human
aggacgcucucug

SEQ ID NO: 2958533 - RNA, 14 nt, Human
aggacgcucucugg

SEQ ID NO: 2958534 - RNA, 16 nt, Human
aggacgcucucuggcc

SEQ ID NO: 2958535 - RNA, 17 nt, Human
aggacgcucucuggccu

SEQ ID NO: 2958536 - RNA, 19 nt, Human
aggacgcucucuggccuuc

SEQ ID NO: 2958537 - RNA, 20 nt, Human
aggacgcucucuggccuucg

SEQ ID NO: 2958538 - RNA, 15 nt, Human
uggaagacagcucuu

SEQ ID NO: 2958539 - RNA, 16 nt, Human
uggaagacagcucuua

SEQ ID NO: 2958540 - RNA, 21 nt, Human
uggaaauuuguuauaaugaau

SEQ ID NO: 2958541 - RNA, 23 nt, Human
uggaaauuuguuauaaugaauga

SEQ ID NO: 2958542 - RNA, 15 nt, Human
ugcuugagcucagga

SEQ ID NO: 2958543 - RNA, 17 nt, Human
aggagccuccugcccuu

SEQ ID NO: 2958544 - RNA, 17 nt, Human
ugcuuugugauuuuugu

SEQ ID NO: 2958545 - RNA, 22 nt, Human
ugcuuugugauuuuuguaauuu

SEQ ID NO: 2958546 - RNA, 20 nt, Human
ugcuuuugucuaugggacuc

SEQ ID NO: 2958547 - RNA, 23 nt, Human
ugcuuuuuaauauugauaugcuu

SEQ ID NO: 2958548 - RNA, 18 nt, Human
ugcuuuuggucuguguga

SEQ ID NO: 2958549 - RNA, 17 nt, Human
ugcuuuuaaaaaaaaau

SEQ ID NO: 2958550 - RNA, 16 nt, Human
aggauucuuccucccu

SEQ ID NO: 2958551 - RNA, 22 nt, Human
aggaugcacagaguuguuacau

SEQ ID NO: 2958552 - RNA, 23 nt, Human
aggaugaucuaggaagacuuugg

SEQ ID NO: 2958553 - RNA, 22 nt, Human
aggaugaucuaggaagacuuug

SEQ ID NO: 2958554 - RNA, 17 nt, Human
aggauucuuccucccuc

SEQ ID NO: 2958555 - RNA, 19 nt, Human
aggauucuuccucccuccc

SEQ ID NO: 2958556 - RNA, 13 nt, Human
aggaucagucuga

SEQ ID NO: 2958557 - RNA, 23 nt, Human
uggcacaucagcacgauuucugu

SEQ ID NO: 2958558 - RNA, 21 nt, Human
uggcacaucagcacgauuucu

SEQ ID NO: 2958559 - RNA, 17 nt, Human
uggauucauauuuaauu

SEQ ID NO: 2958560 - RNA, 14 nt, Human
uggauucauauuua

SEQ ID NO: 2958561 - RNA, 20 nt, Human
uggaugccugguggcagcug

SEQ ID NO: 2958562 - RNA, 21 nt, Human
uggaugccugguggcagcugc

SEQ ID NO: 2958563 - RNA, 23 nt, Human
uggaugccugguggcagcugcgg

SEQ ID NO: 2958564 - RNA, 20 nt, Human
uggagguacgaaaagagggg

SEQ ID NO: 2958565 - RNA, 20 nt, Human
aggcauuugcugaauacaga

SEQ ID NO: 2958566 - RNA, 16 nt, Human
aggcauuugcugaaua

SEQ ID NO: 2958567 - RNA, 14 nt, Human
uggagugcagugag

SEQ ID NO: 2958568 - RNA, 20 nt, Human
uggaguuauugaagcagagu

SEQ ID NO: 2958569 - RNA, 14 nt, Human
uggaguugaaaauc

SEQ ID NO: 2958570 - RNA, 18 nt, Human
uggcacccggccccugcu

SEQ ID NO: 2958571 - RNA, 19 nt, Human
uggcacccggccccugcug

SEQ ID NO: 2958572 - RNA, 20 nt, Human
uggcacccggccccugcugg

SEQ ID NO: 2958573 - RNA, 22 nt, Human
uggcagcucaccucucccuugg

SEQ ID NO: 2958574 - RNA, 21 nt, Human
uggcagcucaccucucccuug

SEQ ID NO: 2958575 - RNA, 23 nt, Human
uggcagcucaccucucccuugga

SEQ ID NO: 2958576 - RNA, 13 nt, Human
uggcagcucagag

SEQ ID NO: 2958577 - RNA, 15 nt, Human
aggccagccuugacc

SEQ ID NO: 2958578 - RNA, 13 nt, Human
aggccagccuuga

SEQ ID NO: 2958579 - RNA, 13 nt, Human
aggcccagagggc

SEQ ID NO: 2958580 - RNA, 13 nt, Human
aggcccggcucca

SEQ ID NO: 2958581 - RNA, 17 nt, Human
aggcccggcuccaggcu

SEQ ID NO: 2958582 - RNA, 14 nt, Human
aggccccgcccagg

SEQ ID NO: 2958583 - RNA, 15 nt, Human
aggcccccaggugcc

SEQ ID NO: 2958584 - RNA, 14 nt, Human
aggcaggggaaugu

SEQ ID NO: 2958585 - RNA, 19 nt, Human
aggcaggggaauguaugug

SEQ ID NO: 2958586 - RNA, 16 nt, Human
aggcaggggaauguau

SEQ ID NO: 2958587 - RNA, 15 nt, Human
aggcagcuugaaacu

SEQ ID NO: 2958588 - RNA, 20 nt, Human
aggcagcucuaaaugucaau

SEQ ID NO: 2958589 - RNA, 22 nt, Human
aggcaggucuugaacuccuggc

SEQ ID NO: 2958590 - RNA, 12 nt, Human
aggcagggucuc

SEQ ID NO: 2958591 - RNA, 15 nt, Human
aggcauaaagucagg

SEQ ID NO: 2958592 - RNA, 17 nt, Human
aggcaggugggauggau

SEQ ID NO: 2958593 - RNA, 20 nt, Human
aggcauuuaggccaugggac

SEQ ID NO: 2958594 - RNA, 18 nt, Human
aggcauugugggaagggg

SEQ ID NO: 2958595 - RNA, 22 nt, Human
aggcauaaagucagggguuccc

SEQ ID NO: 2958596 - RNA, 19 nt, Human
uggacuucuggaugcccau

SEQ ID NO: 2958597 - RNA, 18 nt, Human
aggauugcuacuguccua

SEQ ID NO: 2958598 - RNA, 15 nt, Human
aggauugcuacuguc

SEQ ID NO: 2958599 - RNA, 17 nt, Human
aggauugcuacuguccu

SEQ ID NO: 2958600 - RNA, 11 nt, Human
uggacuucugg

SEQ ID NO: 2958601 - RNA, 14 nt, Human
uggagaaaauggac

SEQ ID NO: 2958602 - RNA, 16 nt, Human
aggcaaggcugucaau

SEQ ID NO: 2958603 - RNA, 17 nt, Human
aggcaaggcugucaauu

SEQ ID NO: 2958604 - RNA, 18 nt, Human
aggcaagcaccuccugcc

SEQ ID NO: 2958605 - RNA, 19 nt, Human
aggcaagcaccuccugccu

SEQ ID NO: 2958606 - RNA, 20 nt, Human
aggcaagcaccuccugccuc

SEQ ID NO: 2958607 - RNA, 14 nt, Human
uggagcucguggaa

SEQ ID NO: 2958608 - RNA, 17 nt, Human
aggcaagcaccuccugc

SEQ ID NO: 2958609 - RNA, 17 nt, Human
uggagcucguggaacag

SEQ ID NO: 2958610 - RNA, 21 nt, Human
uggagcucguggaacaguuac

SEQ ID NO: 2958611 - RNA, 11 nt, Human
aggaaaauuau

SEQ ID NO: 2958612 - RNA, 21 nt, Human
aggaaaauuauucuauaauuu

SEQ ID NO: 2958613 - RNA, 16 nt, Human
aggaaaagcugcugac

SEQ ID NO: 2958614 - RNA, 13 nt, Human
ugcuaucuccccc

SEQ ID NO: 2958615 - RNA, 17 nt, Human
ugcuaucucccccagcc

SEQ ID NO: 2958616 - RNA, 14 nt, Human
ugcuaucuccccca

SEQ ID NO: 2958617 - RNA, 16 nt, Human
ugcucccaccuggcuc

SEQ ID NO: 2958618 - RNA, 14 nt, Human
ugcucugcugacag

SEQ ID NO: 2958619 - RNA, 15 nt, Human
ugcucugcugacaga

SEQ ID NO: 2958620 - RNA, 15 nt, Human
ugcucccaccuggcu

SEQ ID NO: 2958621 - RNA, 15 nt, Human
ugcuccauccuccug

SEQ ID NO: 2958622 - RNA, 20 nt, Human
ugcuccagcuguucagcugg

SEQ ID NO: 2958623 - RNA, 21 nt, Human
ugcuccagcuguucagcuggu

SEQ ID NO: 2958624 - RNA, 15 nt, Human
aggaagcucagggcc

SEQ ID NO: 2958625 - RNA, 16 nt, Human
aggaagcucagggccu

SEQ ID NO: 2958626 - RNA, 14 nt, Human
aggaagcucagggc

SEQ ID NO: 2958627 - RNA, 13 nt, Human
aggaagcucaggg

SEQ ID NO: 2958628 - RNA, 18 nt, Human
ugcugagccucacagcag

SEQ ID NO: 2958629 - RNA, 14 nt, Human
ugcugagauccugg

SEQ ID NO: 2958630 - RNA, 18 nt, Human
ugcugagauccuggacug

SEQ ID NO: 2958631 - RNA, 19 nt, Human
ugcugagccucacagcagu

SEQ ID NO: 2958632 - RNA, 21 nt, Human
ugcugagccucacagcaguga

SEQ ID NO: 2958633 - RNA, 23 nt, Human
aggaaaggcuccaggagcagcca

SEQ ID NO: 2958634 - RNA, 19 nt, Human
aggaaaucaaauaugcaaa

SEQ ID NO: 2958635 - RNA, 20 nt, Human
aggaaaucaaauaugcaaag

SEQ ID NO: 2958636 - RNA, 22 nt, Human
aggaaaucaaauaugcaaagca

SEQ ID NO: 2958637 - RNA, 21 nt, Human
aggaaaucaaauaugcaaagc

SEQ ID NO: 2958638 - RNA, 19 nt, Human
agcuugcccuguuaaaaga

SEQ ID NO: 2958639 - RNA, 18 nt, Human
agcuugcccuguuaaaag

SEQ ID NO: 2958640 - RNA, 16 nt, Human
agcuugcccuguuaaa

SEQ ID NO: 2958641 - RNA, 22 nt, Human
agcuugaccgugaggccagaga

SEQ ID NO: 2958642 - RNA, 20 nt, Human
agcuugaccgugaggccaga

SEQ ID NO: 2958643 - RNA, 22 nt, Human
agcuugaggguugggcuggugu

SEQ ID NO: 2958644 - RNA, 23 nt, Human
agcuugaccgugaggccagagac

SEQ ID NO: 2958645 - RNA, 20 nt, Human
agcuugcccuggugccucac

SEQ ID NO: 2958646 - RNA, 14 nt, Human
aggaaaagcugcug

SEQ ID NO: 2958647 - RNA, 20 nt, Human
agcuuaagaaauuuguggaa

SEQ ID NO: 2958648 - RNA, 20 nt, Human
agcuuaaaggggcuagagug

SEQ ID NO: 2958649 - RNA, 13 nt, Human
ugcuacaguaaua

SEQ ID NO: 2958650 - RNA, 14 nt, Human
ugcuacaaaaacac

SEQ ID NO: 2958651 - RNA, 11 nt, Human
ugcuacacacu

SEQ ID NO: 2958652 - RNA, 20 nt, Human
ugccuuuuuauaacuuuuua

SEQ ID NO: 2958653 - RNA, 14 nt, Human
ugcgguccacccag

SEQ ID NO: 2958654 - RNA, 15 nt, Human
ugcgguccacccagg

SEQ ID NO: 2958655 - RNA, 17 nt, Human
ugccuuuucccaacucc

SEQ ID NO: 2958656 - RNA, 19 nt, Human
ugccuuuucccaacuccag

SEQ ID NO: 2958657 - RNA, 21 nt, Human
agcugcugagauccuggacug

SEQ ID NO: 2958658 - RNA, 16 nt, Human
agcugcuugggcuuca

SEQ ID NO: 2958659 - RNA, 20 nt, Human
agcugcuugggcuucauccu

SEQ ID NO: 2958660 - RNA, 18 nt, Human
agcugccuguucagcucc

SEQ ID NO: 2958661 - RNA, 14 nt, Human
agcugccuguucag

SEQ ID NO: 2958662 - RNA, 16 nt, Human
agcugccuguucagcu

SEQ ID NO: 2958663 - RNA, 21 nt, Human
ugccuggauggggcugcaccg

SEQ ID NO: 2958664 - RNA, 20 nt, Human
ugccuggauggggcugcacc

SEQ ID NO: 2958665 - RNA, 17 nt, Human
ugccuggauggggcugc

SEQ ID NO: 2958666 - RNA, 16 nt, Human
ugccuggauggggcug

SEQ ID NO: 2958667 - RNA, 20 nt, Human
ugccugcccaggccccugcc

SEQ ID NO: 2958668 - RNA, 22 nt, Human
ugccugcccaggccccugccac

SEQ ID NO: 2958669 - RNA, 23 nt, Human
ugccugcccaggccccugccacc

SEQ ID NO: 2958670 - RNA, 14 nt, Human
ugccucagccuccc

SEQ ID NO: 2958671 - RNA, 18 nt, Human
ugccucugccucugacac

SEQ ID NO: 2958672 - RNA, 20 nt, Human
ugccucugccucugacacac

SEQ ID NO: 2958673 - RNA, 17 nt, Human
ugccucugccucugaca

SEQ ID NO: 2958674 - RNA, 20 nt, Human
agcugggacuacaggcaccc

SEQ ID NO: 2958675 - RNA, 23 nt, Human
agcugggacuacaggcacccacc

SEQ ID NO: 2958676 - RNA, 16 nt, Human
agcugggacuacaggu

SEQ ID NO: 2958677 - RNA, 20 nt, Human
agcugggguggggaccucag

SEQ ID NO: 2958678 - RNA, 23 nt, Human
agcugggguggggaccucaggcc

SEQ ID NO: 2958679 - RNA, 22 nt, Human
agcugggguggggaccucaggc

SEQ ID NO: 2958680 - RNA, 17 nt, Human
agcugugcucuggacag

SEQ ID NO: 2958681 - RNA, 18 nt, Human
agcugugcucuggacagg

SEQ ID NO: 2958682 - RNA, 23 nt, Human
agcugugcucuggacaggcaugu

SEQ ID NO: 2958683 - RNA, 14 nt, Human
agcuguuacugucu

SEQ ID NO: 2958684 - RNA, 18 nt, Human
agcuguuacugucuucag

SEQ ID NO: 2958685 - RNA, 21 nt, Human
ugccuuacccucauguucuua

SEQ ID NO: 2958686 - RNA, 16 nt, Human
ugccuuggggacaaga

SEQ ID NO: 2958687 - RNA, 20 nt, Human
ugccuuacccucauguucuu

SEQ ID NO: 2958688 - RNA, 17 nt, Human
ugccuguugggccagga

SEQ ID NO: 2958689 - RNA, 16 nt, Human
ugccuguugggccagg

SEQ ID NO: 2958690 - RNA, 14 nt, Human
agcuguucacagcc

SEQ ID NO: 2958691 - RNA, 19 nt, Human
agcuguuacugucuucagu

SEQ ID NO: 2958692 - RNA, 16 nt, Human
agcuccuucuguccua

SEQ ID NO: 2958693 - RNA, 21 nt, Human
agcuccuucuguccuacucug

SEQ ID NO: 2958694 - RNA, 14 nt, Human
agcucuguccuggg

SEQ ID NO: 2958695 - RNA, 17 nt, Human
agcucugguccauagag

SEQ ID NO: 2958696 - RNA, 12 nt, Human
agcucuggucca

SEQ ID NO: 2958697 - RNA, 13 nt, Human
agcucccaggcau

SEQ ID NO: 2958698 - RNA, 15 nt, Human
agcuccuucuguccu

SEQ ID NO: 2958699 - RNA, 23 nt, Human
agcucccaggcauuccccaggag

SEQ ID NO: 2958700 - RNA, 14 nt, Human
agcugccagccgag

SEQ ID NO: 2958701 - RNA, 20 nt, Human
agcugccagccgagauagcc

SEQ ID NO: 2958702 - RNA, 16 nt, Human
agcucuguccugggag

SEQ ID NO: 2958703 - RNA, 21 nt, Human
agcucuguccugggagugagc

SEQ ID NO: 2958704 - RNA, 23 nt, Human
agcucuguccugggagugagcug

SEQ ID NO: 2958705 - RNA, 12 nt, Human
ugccucagccuc

SEQ ID NO: 2958706 - RNA, 13 nt, Human
ugccucagccucc

SEQ ID NO: 2958707 - RNA, 12 nt, Human
ugccgcagcccu

SEQ ID NO: 2958708 - RNA, 14 nt, Human
ugccgcagcccugc

SEQ ID NO: 2958709 - RNA, 18 nt, Human
ugcccuuaccugccagga

SEQ ID NO: 2958710 - RNA, 19 nt, Human
ugcccuguuaaaagaugaa

SEQ ID NO: 2958711 - RNA, 20 nt, Human
ugcccuguuaaaagaugaaa

SEQ ID NO: 2958712 - RNA, 13 nt, Human
agcugcccucucc

SEQ ID NO: 2958713 - RNA, 14 nt, Human
agcugcccucuccu

SEQ ID NO: 2958714 - RNA, 15 nt, Human
agcugcccucuccug

SEQ ID NO: 2958715 - RNA, 15 nt, Human
uguaaauagcucagg

SEQ ID NO: 2958716 - RNA, 16 nt, Human
uguaaauagcucaggu

SEQ ID NO: 2958717 - RNA, 16 nt, Human
uguaaaggaauuuaaa

SEQ ID NO: 2958718 - RNA, 21 nt, Human
ugguuaguagagguacacuug

SEQ ID NO: 2958719 - RNA, 17 nt, Human
ugguuauaacuuaauga

SEQ ID NO: 2958720 - RNA, 16 nt, Human
ugguuauaacuuaaug

SEQ ID NO: 2958721 - RNA, 14 nt, Human
ugguuauggagagg

SEQ ID NO: 2958722 - RNA, 15 nt, Human
ugguuuguaaauuaa

SEQ ID NO: 2958723 - RNA, 14 nt, Human
ugguuuucaaaaua

SEQ ID NO: 2958724 - RNA, 15 nt, Human
ugguuuucaaaauaa

SEQ ID NO: 2958725 - RNA, 17 nt, Human
ugguuuucaaaauaaaa

SEQ ID NO: 2958726 - RNA, 12 nt, Human
aggugugcucug

SEQ ID NO: 2958727 - RNA, 14 nt, Human
agguuuaagcuguu

SEQ ID NO: 2958728 - RNA, 20 nt, Human
aggugucccugcacuugcag

SEQ ID NO: 2958729 - RNA, 19 nt, Human
agguggggucacucuggca

SEQ ID NO: 2958730 - RNA, 17 nt, Human
aggugugaaccaccaca

SEQ ID NO: 2958731 - RNA, 15 nt, Human
aggugugcucugauc

SEQ ID NO: 2958732 - RNA, 20 nt, Human
aggugugcucugaucaucca

SEQ ID NO: 2958733 - RNA, 14 nt, Human
aggugauccaccca

SEQ ID NO: 2958734 - RNA, 20 nt, Human
aggugauccacccaccucag

SEQ ID NO: 2958735 - RNA, 15 nt, Human
aggugggauccucca

SEQ ID NO: 2958736 - RNA, 18 nt, Human
aggugccucaagagaagg

SEQ ID NO: 2958737 - RNA, 16 nt, Human
agguggggcagcuuga

SEQ ID NO: 2958738 - RNA, 18 nt, Human
aggugggauccuccaggu

SEQ ID NO: 2958739 - RNA, 23 nt, Human
agguggggcagcuugaggguugg

SEQ ID NO: 2958740 - RNA, 17 nt, Human
aggugggauccuccagg

SEQ ID NO: 2958741 - RNA, 16 nt, Human
aggugggauccuccag

SEQ ID NO: 2958742 - RNA, 21 nt, Human
aggucaggagaucgagaccau

SEQ ID NO: 2958743 - RNA, 16 nt, Human
aggucuugaacuccug

SEQ ID NO: 2958744 - RNA, 13 nt, Human
aggucagagccug

SEQ ID NO: 2958745 - RNA, 16 nt, Human
uggucagauuugaacu

SEQ ID NO: 2958746 - RNA, 15 nt, Human
uggucagauuugaac

SEQ ID NO: 2958747 - RNA, 14 nt, Human
aggucagagccugc

SEQ ID NO: 2958748 - RNA, 15 nt, Human
aggucagagccugca

SEQ ID NO: 2958749 - RNA, 17 nt, Human
aggucagagccugcagu

SEQ ID NO: 2958750 - RNA, 18 nt, Human
aggucagagccugcaguu

SEQ ID NO: 2958751 - RNA, 22 nt, Human
aggugacagagugagacucugu

SEQ ID NO: 2958752 - RNA, 15 nt, Human
aggugacauauacau

SEQ ID NO: 2958753 - RNA, 13 nt, Human
aggugaccccagg

SEQ ID NO: 2958754 - RNA, 17 nt, Human
aggucuugaacuccugg

SEQ ID NO: 2958755 - RNA, 13 nt, Human
aggugacagagug

SEQ ID NO: 2958756 - RNA, 15 nt, Human
aggugacagagugag

SEQ ID NO: 2958757 - RNA, 23 nt, Human
aggugagaagcagaggaaggaga

SEQ ID NO: 2958758 - RNA, 21 nt, Human
aggugagaagcagaggaagga

SEQ ID NO: 2958759 - RNA, 16 nt, Human
aggugagaagcagagg

SEQ ID NO: 2958760 - RNA, 20 nt, Human
ugguuaggcauugugggaag

SEQ ID NO: 2958761 - RNA, 18 nt, Human
ugguuaggcauuguggga

SEQ ID NO: 2958762 - RNA, 14 nt, Human
ugguggcagcugcg

SEQ ID NO: 2958763 - RNA, 13 nt, Human
ugguggcagcugc

SEQ ID NO: 2958764 - RNA, 15 nt, Human
ugguggcagcugcgg

SEQ ID NO: 2958765 - RNA, 19 nt, Human
uggugucgggcaugacacg

SEQ ID NO: 2958766 - RNA, 16 nt, Human
uggugcgaucuggguu

SEQ ID NO: 2958767 - RNA, 17 nt, Human
uggugcgaucuggguuc

SEQ ID NO: 2958768 - RNA, 17 nt, Human
aguagaagucuuagaug

SEQ ID NO: 2958769 - RNA, 21 nt, Human
aguagaagucuuagauguaua

SEQ ID NO: 2958770 - RNA, 19 nt, Human
aguagaagucuuagaugua

SEQ ID NO: 2958771 - RNA, 20 nt, Human
aguagaagucuuagauguau

SEQ ID NO: 2958772 - RNA, 11 nt, Human
aguagagacag

SEQ ID NO: 2958773 - RNA, 20 nt, Human
uguaggcauaaagucagggg

SEQ ID NO: 2958774 - RNA, 17 nt, Human
uguaggcauaaagucag

SEQ ID NO: 2958775 - RNA, 16 nt, Human
uguagagccagggucu

SEQ ID NO: 2958776 - RNA, 18 nt, Human
uguagagccagggucuca

SEQ ID NO: 2958777 - RNA, 20 nt, Human
aguaaaaccacagcaguuga

SEQ ID NO: 2958778 - RNA, 13 nt, Human
aguaaaauccaca

SEQ ID NO: 2958779 - RNA, 16 nt, Human
aguaaaauguggcagg

SEQ ID NO: 2958780 - RNA, 14 nt, Human
aguaauaugcacac

SEQ ID NO: 2958781 - RNA, 15 nt, Human
aguaauaugcacaca

SEQ ID NO: 2958782 - RNA, 13 nt, Human
aguaaugauaacu

SEQ ID NO: 2958783 - RNA, 17 nt, Human
aguaaugauaacuggaa

SEQ ID NO: 2958784 - RNA, 18 nt, Human
aguaaugauaacuggaaa

SEQ ID NO: 2958785 - RNA, 20 nt, Human
aguaaugauaacuggaaacu

SEQ ID NO: 2958786 - RNA, 14 nt, Human
aguaugguggcugg

SEQ ID NO: 2958787 - RNA, 23 nt, Human
agucacacaguauuacuucugcu

SEQ ID NO: 2958788 - RNA, 18 nt, Human
aguauuucuaugaaauau

SEQ ID NO: 2958789 - RNA, 17 nt, Human
aguauuucuaugaaaua

SEQ ID NO: 2958790 - RNA, 16 nt, Human
aguauuucuaugaaau

SEQ ID NO: 2958791 - RNA, 19 nt, Human
agucaccccggccaccugc

SEQ ID NO: 2958792 - RNA, 15 nt, Human
agucacacagugagu

SEQ ID NO: 2958793 - RNA, 23 nt, Human
agucacacagugagucgaggaca

SEQ ID NO: 2958794 - RNA, 17 nt, Human
agucaccucauggaauu

SEQ ID NO: 2958795 - RNA, 14 nt, Human
agucaccucaugga

SEQ ID NO: 2958796 - RNA, 15 nt, Human
agucaccucauggaa

SEQ ID NO: 2958797 - RNA, 18 nt, Human
aguaggggucugucuuuu

SEQ ID NO: 2958798 - RNA, 20 nt, Human
aguaggggucugucuuuuaa

SEQ ID NO: 2958799 - RNA, 17 nt, Human
ugucaauuacaggaagu

SEQ ID NO: 2958800 - RNA, 15 nt, Human
ugucaauuacaggaa

SEQ ID NO: 2958801 - RNA, 14 nt, Human
ugucaauuacagga

SEQ ID NO: 2958802 - RNA, 15 nt, Human
aguaugguggcuggg

SEQ ID NO: 2958803 - RNA, 16 nt, Human
aguaugguggcugggu

SEQ ID NO: 2958804 - RNA, 13 nt, Human
aguagucagacug

SEQ ID NO: 2958805 - RNA, 15 nt, Human
aguauuacuucugcu

SEQ ID NO: 2958806 - RNA, 17 nt, Human
aguaugguggcuggguu

SEQ ID NO: 2958807 - RNA, 18 nt, Human
aguauuacuucugcuaca

SEQ ID NO: 2958808 - RNA, 18 nt, Human
aguauuagaauaccacag

SEQ ID NO: 2958809 - RNA, 19 nt, Human
ugucaagcugaccuugcug

SEQ ID NO: 2958810 - RNA, 16 nt, Human
uguauuuuuuuacuaa

SEQ ID NO: 2958811 - RNA, 19 nt, Human
uguauucucuccuguaccu

SEQ ID NO: 2958812 - RNA, 20 nt, Human
uguauucucuccuguaccuc

SEQ ID NO: 2958813 - RNA, 13 nt, Human
uguauuacaaauc

SEQ ID NO: 2958814 - RNA, 22 nt, Human
uguauuacaaauccaaugaaau

SEQ ID NO: 2958815 - RNA, 17 nt, Human
uguaucaaugaguaaca

SEQ ID NO: 2958816 - RNA, 18 nt, Human
uguaucacaaaucuuaac

SEQ ID NO: 2958817 - RNA, 15 nt, Human
uguaucacaaaucuu

SEQ ID NO: 2958818 - RNA, 14 nt, Human
uguaguguuggaga

SEQ ID NO: 2958819 - RNA, 15 nt, Human
uguaguguuggagaa

SEQ ID NO: 2958820 - RNA, 21 nt, Human
aggcccggcuccaggcuccuu

SEQ ID NO: 2958821 - RNA, 18 nt, Human
aggcccggcuccaggcuc

SEQ ID NO: 2958822 - RNA, 20 nt, Human
aggcccggcuccaggcuccu

SEQ ID NO: 2958823 - RNA, 13 nt, Human
agggaaauuucag

SEQ ID NO: 2958824 - RNA, 22 nt, Human
agggaaggauacaaaagcaugu

SEQ ID NO: 2958825 - RNA, 22 nt, Human
ugggagaaccaaaaagaggcua

SEQ ID NO: 2958826 - RNA, 20 nt, Human
ugggacucaaugcacugaca

SEQ ID NO: 2958827 - RNA, 16 nt, Human
ugggagagccuuccag

SEQ ID NO: 2958828 - RNA, 18 nt, Human
ugggaggaucucuugagc

SEQ ID NO: 2958829 - RNA, 21 nt, Human
ugggagagaagagaaugcaca

SEQ ID NO: 2958830 - RNA, 19 nt, Human
ugggagagaagagaaugca

SEQ ID NO: 2958831 - RNA, 14 nt, Human
ugggacuacaggca

SEQ ID NO: 2958832 - RNA, 15 nt, Human
ugggacuacaggcac

SEQ ID NO: 2958833 - RNA, 16 nt, Human
ugggacuacaggcacc

SEQ ID NO: 2958834 - RNA, 23 nt, Human
agggaggacgcucucuggccuuc

SEQ ID NO: 2958835 - RNA, 21 nt, Human
agggaggacgcucucuggccu

SEQ ID NO: 2958836 - RNA, 22 nt, Human
agggaggacgcucucuggccuu

SEQ ID NO: 2958837 - RNA, 13 nt, Human
agggagggcucca

SEQ ID NO: 2958838 - RNA, 15 nt, Human
agggagggagggcuc

SEQ ID NO: 2958839 - RNA, 16 nt, Human
ugggcccccaaaugga

SEQ ID NO: 2958840 - RNA, 21 nt, Human
ugggcccccaaauggaaaugg

SEQ ID NO: 2958841 - RNA, 20 nt, Human
ugggcacuauuuauuuacaa

SEQ ID NO: 2958842 - RNA, 20 nt, Human
ugggaggccaaggugggagg

SEQ ID NO: 2958843 - RNA, 19 nt, Human
ugggaggccaaggugggag

SEQ ID NO: 2958844 - RNA, 22 nt, Human
ugggaggaucucuugagccugg

SEQ ID NO: 2958845 - RNA, 21 nt, Human
ugggaggaucucuugagccug

SEQ ID NO: 2958846 - RNA, 20 nt, Human
ugggaggaucucuugagccu

SEQ ID NO: 2958847 - RNA, 12 nt, Human
ugggcagaagga

SEQ ID NO: 2958848 - RNA, 18 nt, Human
ugggccaggagccuccug

SEQ ID NO: 2958849 - RNA, 12 nt, Human
ugggcagagcag

SEQ ID NO: 2958850 - RNA, 11 nt, Human
ugggcagagca

SEQ ID NO: 2958851 - RNA, 16 nt, Human
agggagggcuccagac

SEQ ID NO: 2958852 - RNA, 15 nt, Human
agggagggcuccaga

SEQ ID NO: 2958853 - RNA, 14 nt, Human
agggagggcuccag

SEQ ID NO: 2958854 - RNA, 19 nt, Human
agggcucagcggggacagc

SEQ ID NO: 2958855 - RNA, 20 nt, Human
agggcucagcggggacagcu

SEQ ID NO: 2958856 - RNA, 22 nt, Human
agggcucagcggggacagcucc

SEQ ID NO: 2958857 - RNA, 23 nt, Human
agggcucagcggggacagcuccu

SEQ ID NO: 2958858 - RNA, 17 nt, Human
agggcccuuuuucaaua

SEQ ID NO: 2958859 - RNA, 21 nt, Human
uggguggcaccagcagccugg

SEQ ID NO: 2958860 - RNA, 20 nt, Human
uggguggcaccagcagccug

SEQ ID NO: 2958861 - RNA, 17 nt, Human
uggguggcaccagcagc

SEQ ID NO: 2958862 - RNA, 12 nt, Human
ugguagcauuuu

SEQ ID NO: 2958863 - RNA, 18 nt, Human
ugguagcauuuuaaacaa

SEQ ID NO: 2958864 - RNA, 19 nt, Human
ugguagcauuuuaaacaaa

SEQ ID NO: 2958865 - RNA, 20 nt, Human
ugguagagugugccugaagu

SEQ ID NO: 2958866 - RNA, 16 nt, Human
aggguggugaccucug

SEQ ID NO: 2958867 - RNA, 15 nt, Human
agggugggagugggc

SEQ ID NO: 2958868 - RNA, 18 nt, Human
aggggugggacacccugu

SEQ ID NO: 2958869 - RNA, 20 nt, Human
aggggguggccucccaacuc

SEQ ID NO: 2958870 - RNA, 15 nt, Human
aggguaaggcugugg

SEQ ID NO: 2958871 - RNA, 14 nt, Human
agggucucacucug

SEQ ID NO: 2958872 - RNA, 15 nt, Human
agggucucacucugu

SEQ ID NO: 2958873 - RNA, 16 nt, Human
agggucucacucuguc

SEQ ID NO: 2958874 - RNA, 14 nt, Human
agggggcugcuccc

SEQ ID NO: 2958875 - RNA, 15 nt, Human
agggggcugcuccca

SEQ ID NO: 2958876 - RNA, 16 nt, Human
agggggcugcucccac

SEQ ID NO: 2958877 - RNA, 19 nt, Human
agggggcugcucccaccug

SEQ ID NO: 2958878 - RNA, 22 nt, Human
agggggcugcucccaccuggcu

SEQ ID NO: 2958879 - RNA, 17 nt, Human
agggggccuggaugccc

SEQ ID NO: 2958880 - RNA, 15 nt, Human
agggggccuggaugc

SEQ ID NO: 2958881 - RNA, 21 nt, Human
aggggaauguuugccucugcc

SEQ ID NO: 2958882 - RNA, 19 nt, Human
aggggaauguuugccucug

SEQ ID NO: 2958883 - RNA, 20 nt, Human
aggggaauguuugccucugc

SEQ ID NO: 2958884 - RNA, 18 nt, Human
aggggagcaugggaagug

SEQ ID NO: 2958885 - RNA, 13 nt, Human
aggggaaaagagg

SEQ ID NO: 2958886 - RNA, 14 nt, Human
aggggaacagacug

SEQ ID NO: 2958887 - RNA, 22 nt, Human
aggggaaaaucagccugcucca

SEQ ID NO: 2958888 - RNA, 18 nt, Human
aggggaaaaucagccugc

SEQ ID NO: 2958889 - RNA, 13 nt, Human
aggggaauguuug

SEQ ID NO: 2958890 - RNA, 17 nt, Human
ugggguacccacugcuc

SEQ ID NO: 2958891 - RNA, 18 nt, Human
ugggguacccacugcucu

SEQ ID NO: 2958892 - RNA, 19 nt, Human
ugggguacccacugcucug

SEQ ID NO: 2958893 - RNA, 15 nt, Human
ugggguaugggagag

SEQ ID NO: 2958894 - RNA, 14 nt, Human
uggggucacucugg

SEQ ID NO: 2958895 - RNA, 13 nt, Human
uggggucacucug

SEQ ID NO: 2958896 - RNA, 16 nt, Human
uggggucacucuggca

SEQ ID NO: 2958897 - RNA, 22 nt, Human
uggggucacucuggcagcucag

SEQ ID NO: 2958898 - RNA, 12 nt, Human
uggggcucccag

SEQ ID NO: 2958899 - RNA, 13 nt, Human
uggggcucccagc

SEQ ID NO: 2958900 - RNA, 15 nt, Human
uggggcucccagcca

SEQ ID NO: 2958901 - RNA, 18 nt, Human
uggggcucccagccaggc

SEQ ID NO: 2958902 - RNA, 19 nt, Human
uggggcucccagccaggcc

SEQ ID NO: 2958903 - RNA, 20 nt, Human
uggggcucccagccaggccc

SEQ ID NO: 2958904 - RNA, 21 nt, Human
uggggcucccagccaggcccu

SEQ ID NO: 2958905 - RNA, 23 nt, Human
uggggcucccagccaggcccuug

SEQ ID NO: 2958906 - RNA, 23 nt, Human
uggggcugcaccggcuggccugg

SEQ ID NO: 2958907 - RNA, 22 nt, Human
uggggcugcaccggcuggccug

SEQ ID NO: 2958908 - RNA, 12 nt, Human
uggggcccugcc

SEQ ID NO: 2958909 - RNA, 21 nt, Human
uggggccaguuggucccccuu

SEQ ID NO: 2958910 - RNA, 17 nt, Human
uggggaccucaggccug

SEQ ID NO: 2958911 - RNA, 16 nt, Human
uggggaccucaggccu

SEQ ID NO: 2958912 - RNA, 15 nt, Human
uggggaccucaggcc

SEQ ID NO: 2958913 - RNA, 14 nt, Human
uggggaccucaggc

SEQ ID NO: 2958914 - RNA, 15 nt, Human
agggcuccagacaca

SEQ ID NO: 2958915 - RNA, 12 nt, Human
agggcuccagac

SEQ ID NO: 2958916 - RNA, 19 nt, Human
uguuuucauuaucucaaaa

SEQ ID NO: 2958917 - RNA, 20 nt, Human
uguuuuccaugaguccccug

SEQ ID NO: 2958918 - RNA, 21 nt, Human
uguuuuauuuaaccucuaaau

SEQ ID NO: 2958919 - RNA, 21 nt, Human
uguuuuauuuuaauucaguug

SEQ ID NO: 2958920 - RNA, 16 nt, Human
uguuuuaucuucuaua

SEQ ID NO: 2958921 - RNA, 14 nt, Human
aguucugguuccua

SEQ ID NO: 2958922 - RNA, 14 nt, Human
uguuuugcaagcca

SEQ ID NO: 2958923 - RNA, 19 nt, Human
uguuuugccaauuugcaca

SEQ ID NO: 2958924 - RNA, 17 nt, Human
uguuuugccaauuugca

SEQ ID NO: 2958925 - RNA, 16 nt, Human
aguucugaagaagaug

SEQ ID NO: 2958926 - RNA, 21 nt, Human
uguuuugccaauuugcacauu

SEQ ID NO: 2958927 - RNA, 22 nt, Human
uguuuugccaauuugcacauua

SEQ ID NO: 2958928 - RNA, 23 nt, Human
uguuuugccaauuugcacauuaa

SEQ ID NO: 2958929 - RNA, 16 nt, Human
aguucugcagauaaac

SEQ ID NO: 2958930 - RNA, 21 nt, Human
aguucugcagauaaacaguag

SEQ ID NO: 2958931 - RNA, 22 nt, Human
uguuugagcaucgcuuaggaga

SEQ ID NO: 2958932 - RNA, 22 nt, Human
uguuugauucagacagcugccu

SEQ ID NO: 2958933 - RNA, 17 nt, Human
uguuugauucagacagc

SEQ ID NO: 2958934 - RNA, 14 nt, Human
uguugcuaacagca

SEQ ID NO: 2958935 - RNA, 19 nt, Human
uguugcccaggcaggucuu

SEQ ID NO: 2958936 - RNA, 19 nt, Human
uguuuauugucaaaguggu

SEQ ID NO: 2958937 - RNA, 17 nt, Human
uguuuauugucaaagug

SEQ ID NO: 2958938 - RNA, 20 nt, Human
uuaaauucuugcaaaguauc

SEQ ID NO: 2958939 - RNA, 13 nt, Human
aguuuauaaaagu

SEQ ID NO: 2958940 - RNA, 22 nt, Human
uuaaaaacaacgaaagaaggca

SEQ ID NO: 2958941 - RNA, 20 nt, Human
uuaaaaagaaaaguuuauaa

SEQ ID NO: 2958942 - RNA, 16 nt, Human
aguuggcuaggacccc

SEQ ID NO: 2958943 - RNA, 17 nt, Human
aguuggguggaugccug

SEQ ID NO: 2958944 - RNA, 21 nt, Human
aguuggguggaugccuggugg

SEQ ID NO: 2958945 - RNA, 23 nt, Human
aguuguuugauucagacagcugc

SEQ ID NO: 2958946 - RNA, 21 nt, Human
aguuguuugauucagacagcu

SEQ ID NO: 2958947 - RNA, 15 nt, Human
aguuggguuuuuuaa

SEQ ID NO: 2958948 - RNA, 18 nt, Human
aguuggucccccuuccau

SEQ ID NO: 2958949 - RNA, 16 nt, Human
aguuuagcuggaaaag

SEQ ID NO: 2958950 - RNA, 14 nt, Human
uuaccuuacagaag

SEQ ID NO: 2958951 - RNA, 12 nt, Human
uuaccugggaaa

SEQ ID NO: 2958952 - RNA, 20 nt, Human
uuacauaagauaaaugugcu

SEQ ID NO: 2958953 - RNA, 12 nt, Human
uuacuauuucuu

SEQ ID NO: 2958954 - RNA, 15 nt, Human
uuacuauuucuugug

SEQ ID NO: 2958955 - RNA, 19 nt, Human
uuacuauggcccuggccua

SEQ ID NO: 2958956 - RNA, 18 nt, Human
uuacucagaauucucuag

SEQ ID NO: 2958957 - RNA, 23 nt, Human
uuacucagaauucucuaguuuga

SEQ ID NO: 2958958 - RNA, 11 nt, Human
uuagacagagu

SEQ ID NO: 2958959 - RNA, 16 nt, Human
uuagaaauaacagaag

SEQ ID NO: 2958960 - RNA, 11 nt, Human
uuagaaauaua

SEQ ID NO: 2958961 - RNA, 12 nt, Human
uuagaaauauaa

SEQ ID NO: 2958962 - RNA, 14 nt, Human
uuagaaauauaauu

SEQ ID NO: 2958963 - RNA, 15 nt, Human
uuacuguaagaaaau

SEQ ID NO: 2958964 - RNA, 15 nt, Human
auaaaugaaugucac

SEQ ID NO: 2958965 - RNA, 12 nt, Human
auaaaugaaugu

SEQ ID NO: 2958966 - RNA, 16 nt, Human
auaacuaaaagguaug

SEQ ID NO: 2958967 - RNA, 14 nt, Human
uuacaggaaguacu

SEQ ID NO: 2958968 - RNA, 18 nt, Human
auaaauauguuucacaca

SEQ ID NO: 2958969 - RNA, 23 nt, Human
auaaauauugguugggaugacuu

SEQ ID NO: 2958970 - RNA, 15 nt, Human
auaaaauaauuuuua

SEQ ID NO: 2958971 - RNA, 16 nt, Human
auaaaauaauuuuuau

SEQ ID NO: 2958972 - RNA, 21 nt, Human
auaaaauaauuuuuauauuug

SEQ ID NO: 2958973 - RNA, 18 nt, Human
auaaaauccauacauuug

SEQ ID NO: 2958974 - RNA, 19 nt, Human
auaaaauccauacauuugu

SEQ ID NO: 2958975 - RNA, 22 nt, Human
uuaagugcugcauuuaaaagau

SEQ ID NO: 2958976 - RNA, 18 nt, Human
uuaaguaaugauaacugg

SEQ ID NO: 2958977 - RNA, 17 nt, Human
uuaaguacuauguauca

SEQ ID NO: 2958978 - RNA, 15 nt, Human
uuaagaggcaggguc

SEQ ID NO: 2958979 - RNA, 16 nt, Human
uuaagaggcagggucu

SEQ ID NO: 2958980 - RNA, 13 nt, Human
uuaagaggcaggg

SEQ ID NO: 2958981 - RNA, 20 nt, Human
uuaagaagacugcauuauau

SEQ ID NO: 2958982 - RNA, 22 nt, Human
uuaagaagacugcauuauauuu

SEQ ID NO: 2958983 - RNA, 19 nt, Human
uuaauuuuuuugagacaga

SEQ ID NO: 2958984 - RNA, 23 nt, Human
auaaacaagaccacguuucuaaa

SEQ ID NO: 2958985 - RNA, 15 nt, Human
auaaacaagaccacg

SEQ ID NO: 2958986 - RNA, 22 nt, Human
auaaacaagaccacguuucuaa

SEQ ID NO: 2958987 - RNA, 15 nt, Human
uuaauucuuagcuca

SEQ ID NO: 2958988 - RNA, 23 nt, Human
uuaaugaaagacuguacaaagua

SEQ ID NO: 2958989 - RNA, 20 nt, Human
uuaaugaaagacuguacaaa

SEQ ID NO: 2958990 - RNA, 19 nt, Human
ugugaaccaccacacccag

SEQ ID NO: 2958991 - RNA, 20 nt, Human
ugugaacaguuguguuugaa

SEQ ID NO: 2958992 - RNA, 20 nt, Human
ugugaaccaccacacccagc

SEQ ID NO: 2958993 - RNA, 21 nt, Human
ugugaaccaccacacccagcc

SEQ ID NO: 2958994 - RNA, 17 nt, Human
ugugaaccaccacaccc

SEQ ID NO: 2958995 - RNA, 15 nt, Human
ugugaaaggaaagag

SEQ ID NO: 2958996 - RNA, 21 nt, Human
ugugaaaggaaagagggaggu

SEQ ID NO: 2958997 - RNA, 18 nt, Human
ugugaaaggaaagaggcu

SEQ ID NO: 2958998 - RNA, 14 nt, Human
ugucagacacagau

SEQ ID NO: 2958999 - RNA, 13 nt, Human
ugucagacacaga

SEQ ID NO: 2959000 - RNA, 12 nt, Human
ugucagacacag

SEQ ID NO: 2959001 - RNA, 16 nt, Human
ugugacugaauuucuu

SEQ ID NO: 2959002 - RNA, 15 nt, Human
ugugacugaauuucu

SEQ ID NO: 2959003 - RNA, 15 nt, Human
ugugagaugcuagaa

SEQ ID NO: 2959004 - RNA, 19 nt, Human
ugugagaugcuagaacucc

SEQ ID NO: 2959005 - RNA, 22 nt, Human
agucucaggaaaucaaauaugc

SEQ ID NO: 2959006 - RNA, 16 nt, Human
agucucaggaaaucaa

SEQ ID NO: 2959007 - RNA, 23 nt, Human
agucuuagauguauauauuuccu

SEQ ID NO: 2959008 - RNA, 18 nt, Human
agucuucaguuugcagag

SEQ ID NO: 2959009 - RNA, 20 nt, Human
agucuucaguuugcagagua

SEQ ID NO: 2959010 - RNA, 21 nt, Human
agucuucaguuugcagaguag

SEQ ID NO: 2959011 - RNA, 14 nt, Human
agucuuuguacaga

SEQ ID NO: 2959012 - RNA, 20 nt, Human
agugaaacucguuaauuugu

SEQ ID NO: 2959013 - RNA, 18 nt, Human
agucuuucacauuuaaau

SEQ ID NO: 2959014 - RNA, 17 nt, Human
agugaggcucugcccuu

SEQ ID NO: 2959015 - RNA, 16 nt, Human
agugaggcucugcccu

SEQ ID NO: 2959016 - RNA, 14 nt, Human
agugaggcucugcc

SEQ ID NO: 2959017 - RNA, 15 nt, Human
agugaggcucugccc

SEQ ID NO: 2959018 - RNA, 15 nt, Human
agugagucgaggaca

SEQ ID NO: 2959019 - RNA, 21 nt, Human
agugaguugauagcacagacc

SEQ ID NO: 2959020 - RNA, 21 nt, Human
agugaggcucugcccuugguu

SEQ ID NO: 2959021 - RNA, 20 nt, Human
agugaggcucugcccuuggu

SEQ ID NO: 2959022 - RNA, 19 nt, Human
agugaggcucugcccuugg

SEQ ID NO: 2959023 - RNA, 21 nt, Human
ugugcccccauguaagcaccc

SEQ ID NO: 2959024 - RNA, 21 nt, Human
uguggaguucaucuugaauug

SEQ ID NO: 2959025 - RNA, 17 nt, Human
uguggaguucaucuuga

SEQ ID NO: 2959026 - RNA, 23 nt, Human
ugugcauuuggugguuucagaaa

SEQ ID NO: 2959027 - RNA, 20 nt, Human
ugugccagguuuuuggucug

SEQ ID NO: 2959028 - RNA, 12 nt, Human
ugugccaugugc

SEQ ID NO: 2959029 - RNA, 16 nt, Human
ugugccaugugccagg

SEQ ID NO: 2959030 - RNA, 18 nt, Human
ugugaugacauucccugc

SEQ ID NO: 2959031 - RNA, 18 nt, Human
ugugauggggcccugccu

SEQ ID NO: 2959032 - RNA, 20 nt, Human
ugugauggggcccugccucc

SEQ ID NO: 2959033 - RNA, 19 nt, Human
ugugauggggcccugccuc

SEQ ID NO: 2959034 - RNA, 15 nt, Human
agugaaagaaaauaa

SEQ ID NO: 2959035 - RNA, 16 nt, Human
agugaacaaauuuaca

SEQ ID NO: 2959036 - RNA, 20 nt, Human
agugaacaaauuuacagaga

SEQ ID NO: 2959037 - RNA, 20 nt, Human
uguuccacaaguuaaauaaa

SEQ ID NO: 2959038 - RNA, 20 nt, Human
agugugucuuagugugugca

SEQ ID NO: 2959039 - RNA, 15 nt, Human
uguuauaaucuuuca

SEQ ID NO: 2959040 - RNA, 16 nt, Human
uguucugggacacagu

SEQ ID NO: 2959041 - RNA, 18 nt, Human
uguuccuagugaaagagg

SEQ ID NO: 2959042 - RNA, 14 nt, Human
uguuccuagugaaa

SEQ ID NO: 2959043 - RNA, 13 nt, Human
uguugcccaggca

SEQ ID NO: 2959044 - RNA, 12 nt, Human
uguugcccaggc

SEQ ID NO: 2959045 - RNA, 15 nt, Human
uguugcccaggcagg

SEQ ID NO: 2959046 - RNA, 16 nt, Human
uguugcccaggcaggu

SEQ ID NO: 2959047 - RNA, 17 nt, Human
uguugcccaggcagguc

SEQ ID NO: 2959048 - RNA, 18 nt, Human
uguugcccaggcaggucu

SEQ ID NO: 2959049 - RNA, 16 nt, Human
aguggugcgaucuggg

SEQ ID NO: 2959050 - RNA, 17 nt, Human
aguggugcgaucugggu

SEQ ID NO: 2959051 - RNA, 14 nt, Human
aguggaauaagaca

SEQ ID NO: 2959052 - RNA, 21 nt, Human
agugguggugaacagaacaaa

SEQ ID NO: 2959053 - RNA, 17 nt, Human
aguggugguuuucuguu

SEQ ID NO: 2959054 - RNA, 18 nt, Human
aguggugguuuucuguuc

SEQ ID NO: 2959055 - RNA, 19 nt, Human
aguggugguuuucuguucu

SEQ ID NO: 2959056 - RNA, 20 nt, Human
aguggugguuuucuguucuu

SEQ ID NO: 2959057 - RNA, 21 nt, Human
aguggugguuuucuguucuuu

SEQ ID NO: 2959058 - RNA, 23 nt, Human
aguggugguuuucuguucuuucu

SEQ ID NO: 2959059 - RNA, 23 nt, Human
agugugauguauguguaauaaau

SEQ ID NO: 2959060 - RNA, 18 nt, Human
agugugauguauguguaa

SEQ ID NO: 2959061 - RNA, 22 nt, Human
agugugauguauguguaauaaa

SEQ ID NO: 2959062 - RNA, 17 nt, Human
agugugguguuuccugg

SEQ ID NO: 2959063 - RNA, 19 nt, Human
agugugguguuuccuggca

SEQ ID NO: 2959064 - RNA, 16 nt, Human
agugugguguuuccug

SEQ ID NO: 2959065 - RNA, 13 nt, Human
uguguugaagagg

SEQ ID NO: 2959066 - RNA, 23 nt, Human
uguguguuuauugucaaaguggu

SEQ ID NO: 2959067 - RNA, 19 nt, Human
uguguguuuauugucaaag

SEQ ID NO: 2959068 - RNA, 21 nt, Human
ugugucuugcaauggcagccu

SEQ ID NO: 2959069 - RNA, 20 nt, Human
ugugucuugcaauggcagcc

SEQ ID NO: 2959070 - RNA, 21 nt, Human
ugugucucuugguccugcugc

SEQ ID NO: 2959071 - RNA, 13 nt, Human
uguguaaguagau

SEQ ID NO: 2959072 - RNA, 20 nt, Human
ugugucucuugguccugcug

SEQ ID NO: 2959073 - RNA, 17 nt, Human
ugugucucuugguccug

SEQ ID NO: 2959074 - RNA, 20 nt, Human
agugcugggauuacaggugu

SEQ ID NO: 2959075 - RNA, 19 nt, Human
agugcugcauuuaaaagau

SEQ ID NO: 2959076 - RNA, 16 nt, Human
agugcugcauuuaaaa

SEQ ID NO: 2959077 - RNA, 17 nt, Human
agugcugcauuuaaaag

SEQ ID NO: 2959078 - RNA, 21 nt, Human
agugcugggauuacaggugug

SEQ ID NO: 2959079 - RNA, 12 nt, Human
agugcugcauuu

SEQ ID NO: 2959080 - RNA, 13 nt, Human
agugcugcauuua

SEQ ID NO: 2959081 - RNA, 23 nt, Human
agugaguugauagcacagacccu

SEQ ID NO: 2959082 - RNA, 22 nt, Human
agugaguugauagcacagaccc

SEQ ID NO: 2959083 - RNA, 15 nt, Human
uguggucccacccca

SEQ ID NO: 2959084 - RNA, 13 nt, Human
uguggucccaccc

SEQ ID NO: 2959085 - RNA, 18 nt, Human
uguguaagacaaaaagcu

SEQ ID NO: 2959086 - RNA, 16 nt, Human
ugugguguuuccuggc

SEQ ID NO: 2959087 - RNA, 14 nt, Human
ugugguguuuccug

SEQ ID NO: 2959088 - RNA, 21 nt, Human
uguggguuucuaaagcugcca

SEQ ID NO: 2959089 - RNA, 20 nt, Human
uguggucacaggaaguagag

SEQ ID NO: 2959090 - RNA, 23 nt, Human
uguggguuucuaaagcugccagc

SEQ ID NO: 2959091 - RNA, 18 nt, Human
auauuuucaugcuguuca

SEQ ID NO: 2959092 - RNA, 21 nt, Human
auauuuucaugcuguucauga

SEQ ID NO: 2959093 - RNA, 14 nt, Human
uuccuucagugccu

SEQ ID NO: 2959094 - RNA, 11 nt, Human
uuccuucagug

SEQ ID NO: 2959095 - RNA, 17 nt, Human
uuccuguucccaugaga

SEQ ID NO: 2959096 - RNA, 16 nt, Human
uuccugggagcuuuug

SEQ ID NO: 2959097 - RNA, 11 nt, Human
uuccucuuucc

SEQ ID NO: 2959098 - RNA, 15 nt, Human
uuccugggagcuuuu

SEQ ID NO: 2959099 - RNA, 15 nt, Human
uuccuaauccucuag

SEQ ID NO: 2959100 - RNA, 13 nt, Human
uuccuaauccucu

SEQ ID NO: 2959101 - RNA, 17 nt, Human
aucaaguauagaaaauc

SEQ ID NO: 2959102 - RNA, 19 nt, Human
aucaaguauagaaaaucuu

SEQ ID NO: 2959103 - RNA, 21 nt, Human
aucaaguauagaaaaucuuca

SEQ ID NO: 2959104 - RNA, 15 nt, Human
aucaaguauagaaaa

SEQ ID NO: 2959105 - RNA, 16 nt, Human
aucaaguauagaaaau

SEQ ID NO: 2959106 - RNA, 13 nt, Human
aucaaguauagaa

SEQ ID NO: 2959107 - RNA, 13 nt, Human
aucaaguauuaua

SEQ ID NO: 2959108 - RNA, 14 nt, Human
aucaaguauuauac

SEQ ID NO: 2959109 - RNA, 18 nt, Human
aucaaguauuauaccuuu

SEQ ID NO: 2959110 - RNA, 22 nt, Human
aucacggcucacugcagccuca

SEQ ID NO: 2959111 - RNA, 19 nt, Human
aucaauuuuucuuauuuca

SEQ ID NO: 2959112 - RNA, 20 nt, Human
auauguuuuaagaggcaggg

SEQ ID NO: 2959113 - RNA, 18 nt, Human
auauguuuuaagaggcag

SEQ ID NO: 2959114 - RNA, 21 nt, Human
auauguuucacacaaacaagg

SEQ ID NO: 2959115 - RNA, 14 nt, Human
auauguuucacaca

SEQ ID NO: 2959116 - RNA, 18 nt, Human
auauguuucacacaaaca

SEQ ID NO: 2959117 - RNA, 24 nt, Human
auauuaagaaagacuaucuaaaug

SEQ ID NO: 2959118 - RNA, 22 nt, Human
auauuaaggaagacaaugugaa

SEQ ID NO: 2959119 - RNA, 19 nt, Human
auauugauuuccguuaaaa

SEQ ID NO: 2959120 - RNA, 21 nt, Human
auauugauuuccguuaaaaua

SEQ ID NO: 2959121 - RNA, 22 nt, Human
auauugauuuccguuaaaauac

SEQ ID NO: 2959122 - RNA, 16 nt, Human
auauucuguuggccag

SEQ ID NO: 2959123 - RNA, 21 nt, Human
auauucucacagcuccaagaa

SEQ ID NO: 2959124 - RNA, 16 nt, Human
auauucucagcagagu

SEQ ID NO: 2959125 - RNA, 15 nt, Human
auauucucagcagag

SEQ ID NO: 2959126 - RNA, 17 nt, Human
auauucucagcagagug

SEQ ID NO: 2959127 - RNA, 18 nt, Human
auauucucagcagagugc

SEQ ID NO: 2959128 - RNA, 22 nt, Human
auauucucacagcuccaagaau

SEQ ID NO: 2959129 - RNA, 23 nt, Human
auauucucacagcuccaagaauu

SEQ ID NO: 2959130 - RNA, 23 nt, Human
auauuugaaauauugacuuuuua

SEQ ID NO: 2959131 - RNA, 14 nt, Human
auauuugaaauauu

SEQ ID NO: 2959132 - RNA, 19 nt, Human
auauuugaaauauugacuu

SEQ ID NO: 2959133 - RNA, 22 nt, Human
auauuuguaucacaaaucuuaa

SEQ ID NO: 2959134 - RNA, 12 nt, Human
auauuuuaacuu

SEQ ID NO: 2959135 - RNA, 16 nt, Human
auauugccaaugcuac

SEQ ID NO: 2959136 - RNA, 22 nt, Human
auauugcauacuauuaaacaug

SEQ ID NO: 2959137 - RNA, 20 nt, Human
auauugcauacuauuaaaca

SEQ ID NO: 2959138 - RNA, 21 nt, Human
auauugcugauggugcaauga

SEQ ID NO: 2959139 - RNA, 17 nt, Human
auauugcugauggugca

SEQ ID NO: 2959140 - RNA, 17 nt, Human
auauuguuuucagugua

SEQ ID NO: 2959141 - RNA, 20 nt, Human
auauuguuuucaguguacau

SEQ ID NO: 2959142 - RNA, 23 nt, Human
auauuucugaggagccugcaaca

SEQ ID NO: 2959143 - RNA, 13 nt, Human
auauuugaaauau

SEQ ID NO: 2959144 - RNA, 15 nt, Human
uucugaaagggacgc

SEQ ID NO: 2959145 - RNA, 19 nt, Human
aucauugaaaucuuuuugc

SEQ ID NO: 2959146 - RNA, 16 nt, Human
uucugcaucagcugcu

SEQ ID NO: 2959147 - RNA, 14 nt, Human
uucugaagaagaug

SEQ ID NO: 2959148 - RNA, 23 nt, Human
uucugcaucagcugcugaaacaa

SEQ ID NO: 2959149 - RNA, 12 nt, Human
uucugaagaaga

SEQ ID NO: 2959150 - RNA, 13 nt, Human
uucugaagaagau

SEQ ID NO: 2959151 - RNA, 21 nt, Human
uucugaaauuuccugggagcu

SEQ ID NO: 2959152 - RNA, 20 nt, Human
uucugaaaugucaguucuga

SEQ ID NO: 2959153 - RNA, 16 nt, Human
uucugccgcagcccug

SEQ ID NO: 2959154 - RNA, 23 nt, Human
uucugccgcagcccugcagaggg

SEQ ID NO: 2959155 - RNA, 10 nt, Human
uucugggaca

SEQ ID NO: 2959156 - RNA, 11 nt, Human
uucugggacac

SEQ ID NO: 2959157 - RNA, 22 nt, Human
uucugggacacaguucaauucu

SEQ ID NO: 2959158 - RNA, 15 nt, Human
auccagguucagcuu

SEQ ID NO: 2959159 - RNA, 16 nt, Human
auccagguucagcuug

SEQ ID NO: 2959160 - RNA, 20 nt, Human
aucauuucugcaucagcugc

SEQ ID NO: 2959161 - RNA, 16 nt, Human
aucccauaugccuggg

SEQ ID NO: 2959162 - RNA, 17 nt, Human
aucccauaugccugggc

SEQ ID NO: 2959163 - RNA, 21 nt, Human
aucccucccuccaccucccug

SEQ ID NO: 2959164 - RNA, 23 nt, Human
aucccucccuccaccucccugca

SEQ ID NO: 2959165 - RNA, 11 nt, Human
aucccucccuc

SEQ ID NO: 2959166 - RNA, 13 nt, Human
aucccucccucca

SEQ ID NO: 2959167 - RNA, 23 nt, Human
uucuaggacugaauuaugaaacu

SEQ ID NO: 2959168 - RNA, 13 nt, Human
uucuaggccuggg

SEQ ID NO: 2959169 - RNA, 14 nt, Human
uucucaacuccaaa

SEQ ID NO: 2959170 - RNA, 18 nt, Human
uucucaacuccaaacuga

SEQ ID NO: 2959171 - RNA, 13 nt, Human
uucucacagaaga

SEQ ID NO: 2959172 - RNA, 23 nt, Human
uucucagaaucucaaauaacuaa

SEQ ID NO: 2959173 - RNA, 19 nt, Human
uucucagaaucucaaauaa

SEQ ID NO: 2959174 - RNA, 22 nt, Human
uucucagaaucucaaauaacua

SEQ ID NO: 2959175 - RNA, 15 nt, Human
aucagcacgauuucu

SEQ ID NO: 2959176 - RNA, 16 nt, Human
aucagcacgauuucug

SEQ ID NO: 2959177 - RNA, 17 nt, Human
aucagcacgauuucugu

SEQ ID NO: 2959178 - RNA, 18 nt, Human
aucagcacgauuucuguu

SEQ ID NO: 2959179 - RNA, 17 nt, Human
aucauguuuaugagaaa

SEQ ID NO: 2959180 - RNA, 22 nt, Human
aucauuaaagccugaguuugcu

SEQ ID NO: 2959181 - RNA, 15 nt, Human
aucauugaaaucuuu

SEQ ID NO: 2959182 - RNA, 14 nt, Human
aucauugaaaucuu

SEQ ID NO: 2959183 - RNA, 16 nt, Human
uuauuuaguuccuuga

SEQ ID NO: 2959184 - RNA, 14 nt, Human
uuauuuacaaaugu

SEQ ID NO: 2959185 - RNA, 11 nt, Human
uuauuuauuga

SEQ ID NO: 2959186 - RNA, 13 nt, Human
uuauuuaaauaga

SEQ ID NO: 2959187 - RNA, 14 nt, Human
uuauuuaaauuuua

SEQ ID NO: 2959188 - RNA, 18 nt, Human
uuauuuaaugaaagacug

SEQ ID NO: 2959189 - RNA, 22 nt, Human
uuauuuaaugaaagacuguaca

SEQ ID NO: 2959190 - RNA, 23 nt, Human
auagcuggucuuauuuguaaagc

SEQ ID NO: 2959191 - RNA, 17 nt, Human
auagcugggacuacagg

SEQ ID NO: 2959192 - RNA, 22 nt, Human
auagcuggucuuauuuguaaag

SEQ ID NO: 2959193 - RNA, 17 nt, Human
uuauuguuuaaaaucau

SEQ ID NO: 2959194 - RNA, 19 nt, Human
auagcugugauuuuuggua

SEQ ID NO: 2959195 - RNA, 18 nt, Human
auaacuuuuuauauucuc

SEQ ID NO: 2959196 - RNA, 12 nt, Human
auaacuuuuuau

SEQ ID NO: 2959197 - RNA, 13 nt, Human
auaagauaaaugu

SEQ ID NO: 2959198 - RNA, 17 nt, Human
auaagauaaaugugcug

SEQ ID NO: 2959199 - RNA, 18 nt, Human
auagccugccucuucucu

SEQ ID NO: 2959200 - RNA, 17 nt, Human
auagcuacuaauuuuaa

SEQ ID NO: 2959201 - RNA, 14 nt, Human
auagcuacuaauuu

SEQ ID NO: 2959202 - RNA, 22 nt, Human
auagcucaggugucccugcacu

SEQ ID NO: 2959203 - RNA, 20 nt, Human
auagcucaggugucccugca

SEQ ID NO: 2959204 - RNA, 21 nt, Human
auagcucaggugucccugcac

SEQ ID NO: 2959205 - RNA, 12 nt, Human
auagcugggacu

SEQ ID NO: 2959206 - RNA, 19 nt, Human
auagcucaggugucccugc

SEQ ID NO: 2959207 - RNA, 22 nt, Human
auagcuaggugacauauacaua

SEQ ID NO: 2959208 - RNA, 18 nt, Human
auagcuacuaauuuuaaa

SEQ ID NO: 2959209 - RNA, 13 nt, Human
uucacauuggaaa

SEQ ID NO: 2959210 - RNA, 17 nt, Human
uucacauauugauuucc

SEQ ID NO: 2959211 - RNA, 14 nt, Human
uucacauuggaaac

SEQ ID NO: 2959212 - RNA, 22 nt, Human
uucaccacaugugcacaugcac

SEQ ID NO: 2959213 - RNA, 17 nt, Human
auaggcacuuuaaaaca

SEQ ID NO: 2959214 - RNA, 22 nt, Human
auagcugugauuuuugguauuu

SEQ ID NO: 2959215 - RNA, 19 nt, Human
auaggaacuuaaauaaugu

SEQ ID NO: 2959216 - RNA, 21 nt, Human
auaggaauugacccacaagaa

SEQ ID NO: 2959217 - RNA, 15 nt, Human
uucaaggauccugag

SEQ ID NO: 2959218 - RNA, 21 nt, Human
uucaaggauccugagccagau

SEQ ID NO: 2959219 - RNA, 19 nt, Human
uucaaggauccugagccag

SEQ ID NO: 2959220 - RNA, 18 nt, Human
uucaaggauccugagcca

SEQ ID NO: 2959221 - RNA, 16 nt, Human
uucaaggauccugagc

SEQ ID NO: 2959222 - RNA, 21 nt, Human
uuauuucucucaucuguuaca

SEQ ID NO: 2959223 - RNA, 17 nt, Human
uucaaaauaaaaaugag

SEQ ID NO: 2959224 - RNA, 14 nt, Human
uucaaacauauaua

SEQ ID NO: 2959225 - RNA, 15 nt, Human
uucaaacauauauaa

SEQ ID NO: 2959226 - RNA, 23 nt, Human
auaugcaaagcacugacuucuaa

SEQ ID NO: 2959227 - RNA, 15 nt, Human
auaugcaaagcacug

SEQ ID NO: 2959228 - RNA, 16 nt, Human
auaugcaaagcacuga

SEQ ID NO: 2959229 - RNA, 14 nt, Human
auaugucaagccau

SEQ ID NO: 2959230 - RNA, 13 nt, Human
auaugugaacagu

SEQ ID NO: 2959231 - RNA, 12 nt, Human
auaugauucaaa

SEQ ID NO: 2959232 - RNA, 13 nt, Human
auaugauucaaau

SEQ ID NO: 2959233 - RNA, 22 nt, Human
auaugauucaaaugucuauaaa

SEQ ID NO: 2959234 - RNA, 20 nt, Human
auaugauuuaaaucagccgu

SEQ ID NO: 2959235 - RNA, 22 nt, Human
auaucugaaaauguauguguaa

SEQ ID NO: 2959236 - RNA, 17 nt, Human
auaucuauauuuuacau

SEQ ID NO: 2959237 - RNA, 16 nt, Human
auaucuauauuuuaca

SEQ ID NO: 2959238 - RNA, 20 nt, Human
auaucuauauuuuacauaaa

SEQ ID NO: 2959239 - RNA, 22 nt, Human
auaucuauauuuuacauaaauu

SEQ ID NO: 2959240 - RNA, 14 nt, Human
auauauuauuugca

SEQ ID NO: 2959241 - RNA, 21 nt, Human
uucaucauccuaagcuauuca

SEQ ID NO: 2959242 - RNA, 18 nt, Human
uucaucauccuaagcuau

SEQ ID NO: 2959243 - RNA, 20 nt, Human
uucauauuuaauuugaaggu

SEQ ID NO: 2959244 - RNA, 18 nt, Human
uucauagagaauauaaaa

SEQ ID NO: 2959245 - RNA, 11 nt, Human
uucauagagaa

SEQ ID NO: 2959246 - RNA, 16 nt, Human
uucauauuuacuucuu

SEQ ID NO: 2959247 - RNA, 21 nt, Human
uucauauuuacuucuuauaca

SEQ ID NO: 2959248 - RNA, 14 nt, Human
uucaguaauaacuc

SEQ ID NO: 2959249 - RNA, 18 nt, Human
uucacugguacucugcca

SEQ ID NO: 2959250 - RNA, 19 nt, Human
uucagccaagaauucuuaa

SEQ ID NO: 2959251 - RNA, 14 nt, Human
uucagccaagaauu

SEQ ID NO: 2959252 - RNA, 15 nt, Human
uucagcccucagaau

SEQ ID NO: 2959253 - RNA, 17 nt, Human
uucagaucucuaacuuc

SEQ ID NO: 2959254 - RNA, 12 nt, Human
auauaacaaugc

SEQ ID NO: 2959255 - RNA, 15 nt, Human
auauaacaaugcugu

SEQ ID NO: 2959256 - RNA, 13 nt, Human
auauaagguuuuu

SEQ ID NO: 2959257 - RNA, 19 nt, Human
auauaagcuuguauuccuu

SEQ ID NO: 2959258 - RNA, 14 nt, Human
auauauaacaaugc

SEQ ID NO: 2959259 - RNA, 17 nt, Human
auauauaacaaugcugu

SEQ ID NO: 2959260 - RNA, 18 nt, Human
auauauaacaaugcugua

SEQ ID NO: 2959261 - RNA, 17 nt, Human
auagucaaauuguguga

SEQ ID NO: 2959262 - RNA, 18 nt, Human
auagucaaauugugugaa

SEQ ID NO: 2959263 - RNA, 18 nt, Human
uuggugguuucagaaaug

SEQ ID NO: 2959264 - RNA, 19 nt, Human
uuggugguuucagaaaugu

SEQ ID NO: 2959265 - RNA, 18 nt, Human
augaaugucagugugacu

SEQ ID NO: 2959266 - RNA, 16 nt, Human
augaaugucaguguga

SEQ ID NO: 2959267 - RNA, 17 nt, Human
uuggugucgggcaugac

SEQ ID NO: 2959268 - RNA, 19 nt, Human
uuggugucgggcaugacac

SEQ ID NO: 2959269 - RNA, 18 nt, Human
uuggugucgggcaugaca

SEQ ID NO: 2959270 - RNA, 14 nt, Human
uugguuuguaaauu

SEQ ID NO: 2959271 - RNA, 20 nt, Human
uugguuuucacauuggaaac

SEQ ID NO: 2959272 - RNA, 23 nt, Human
augaaccacaucuugcucugcug

SEQ ID NO: 2959273 - RNA, 22 nt, Human
augaaccacaucuugcucugcu

SEQ ID NO: 2959274 - RNA, 20 nt, Human
uuggcccaggauuauuguca

SEQ ID NO: 2959275 - RNA, 22 nt, Human
uuggcccaggaguuuggccaga

SEQ ID NO: 2959276 - RNA, 21 nt, Human
uuggcccaggaguuuggccag

SEQ ID NO: 2959277 - RNA, 20 nt, Human
uuggcccaggaguuuggcca

SEQ ID NO: 2959278 - RNA, 15 nt, Human
uuggcccaggaguuu

SEQ ID NO: 2959279 - RNA, 14 nt, Human
uuggcccaggaguu

SEQ ID NO: 2959280 - RNA, 13 nt, Human
uuggcccaggagu

SEQ ID NO: 2959281 - RNA, 19 nt, Human
augaaugucacuucuggau

SEQ ID NO: 2959282 - RNA, 21 nt, Human
augaaugucacuucuggauau

SEQ ID NO: 2959283 - RNA, 17 nt, Human
augaaugaaacauuuug

SEQ ID NO: 2959284 - RNA, 18 nt, Human
augaacuuguaaaggaau

SEQ ID NO: 2959285 - RNA, 15 nt, Human
aucuugcucugcuga

SEQ ID NO: 2959286 - RNA, 16 nt, Human
aucuugcucugcugac

SEQ ID NO: 2959287 - RNA, 14 nt, Human
aucuuauaauuuaa

SEQ ID NO: 2959288 - RNA, 14 nt, Human
aucuugcucugcug

SEQ ID NO: 2959289 - RNA, 16 nt, Human
aucuuauaauuuaaaa

SEQ ID NO: 2959290 - RNA, 15 nt, Human
aucuuauaauuuaaa

SEQ ID NO: 2959291 - RNA, 21 nt, Human
aucugugaugacauucccugc

SEQ ID NO: 2959292 - RNA, 19 nt, Human
aucugugaugacauucccu

SEQ ID NO: 2959293 - RNA, 13 nt, Human
aucuuaaaaacaa

SEQ ID NO: 2959294 - RNA, 14 nt, Human
aucuuaaaaacaac

SEQ ID NO: 2959295 - RNA, 21 nt, Human
aucuuaaaaacaacgaaagaa

SEQ ID NO: 2959296 - RNA, 12 nt, Human
aucugucauuug

SEQ ID NO: 2959297 - RNA, 17 nt, Human
aucugucauuugagcag

SEQ ID NO: 2959298 - RNA, 22 nt, Human
aucugucauuugagcagggcuc

SEQ ID NO: 2959299 - RNA, 15 nt, Human
aucuuuaaaauacac

SEQ ID NO: 2959300 - RNA, 12 nt, Human
aucuuuaaaaua

SEQ ID NO: 2959301 - RNA, 15 nt, Human
uugcuuugugauuuu

SEQ ID NO: 2959302 - RNA, 20 nt, Human
uugcuuugugauuuuuguaa

SEQ ID NO: 2959303 - RNA, 17 nt, Human
uuggaaaauaaauuauu

SEQ ID NO: 2959304 - RNA, 15 nt, Human
uuggagaagaacuga

SEQ ID NO: 2959305 - RNA, 17 nt, Human
uuggagaagaacugaaa

SEQ ID NO: 2959306 - RNA, 22 nt, Human
uuggagaagaacugaaaucaua

SEQ ID NO: 2959307 - RNA, 19 nt, Human
aucuagauacuguaucaug

SEQ ID NO: 2959308 - RNA, 16 nt, Human
aucuaggaaaauuauu

SEQ ID NO: 2959309 - RNA, 14 nt, Human
aucuaggaaaauua

SEQ ID NO: 2959310 - RNA, 19 nt, Human
aucuaggaagacuuuggaa

SEQ ID NO: 2959311 - RNA, 18 nt, Human
aucuaggaagacuuugga

SEQ ID NO: 2959312 - RNA, 17 nt, Human
aucuaggaagacuuugg

SEQ ID NO: 2959313 - RNA, 15 nt, Human
aucucaaaacugcac

SEQ ID NO: 2959314 - RNA, 20 nt, Human
aucucaaaacugcacuguca

SEQ ID NO: 2959315 - RNA, 19 nt, Human
aucucaaaacugcacuguc

SEQ ID NO: 2959316 - RNA, 14 nt, Human
aucucaaauuucua

SEQ ID NO: 2959317 - RNA, 23 nt, Human
aucucaaauaacuaaaagguaug

SEQ ID NO: 2959318 - RNA, 14 nt, Human
aucucaaauaacua

SEQ ID NO: 2959319 - RNA, 21 nt, Human
aucucaaauaacuaaaaggua

SEQ ID NO: 2959320 - RNA, 14 nt, Human
uugagugucaagcu

SEQ ID NO: 2959321 - RNA, 11 nt, Human
uugagugccuu

SEQ ID NO: 2959322 - RNA, 21 nt, Human
uugagugcugucuccauguuu

SEQ ID NO: 2959323 - RNA, 18 nt, Human
uugauagcacagacccug

SEQ ID NO: 2959324 - RNA, 15 nt, Human
uugauacuacaguuu

SEQ ID NO: 2959325 - RNA, 17 nt, Human
uugauacuacaguuugu

SEQ ID NO: 2959326 - RNA, 20 nt, Human
aucuaauauguaacaagcca

SEQ ID NO: 2959327 - RNA, 23 nt, Human
aucuaauauguaacaagccaccc

SEQ ID NO: 2959328 - RNA, 18 nt, Human
aucuagauacuguaucau

SEQ ID NO: 2959329 - RNA, 11 nt, Human
uugagacagag

SEQ ID NO: 2959330 - RNA, 12 nt, Human
uugagcagggcu

SEQ ID NO: 2959331 - RNA, 16 nt, Human
uugagcagggcucagc

SEQ ID NO: 2959332 - RNA, 14 nt, Human
uugacauugaaauc

SEQ ID NO: 2959333 - RNA, 23 nt, Human
uugacauugaaaucuaggaaaau

SEQ ID NO: 2959334 - RNA, 12 nt, Human
uugacuuuuuau

SEQ ID NO: 2959335 - RNA, 19 nt, Human
aucccuuggacauuuuaug

SEQ ID NO: 2959336 - RNA, 17 nt, Human
aucccuuggacauuuua

SEQ ID NO: 2959337 - RNA, 21 nt, Human
aucccuuggacauuuuauguc

SEQ ID NO: 2959338 - RNA, 20 nt, Human
aucccuuggacauuuuaugu

SEQ ID NO: 2959339 - RNA, 16 nt, Human
aucccuuucccuuggu

SEQ ID NO: 2959340 - RNA, 19 nt, Human
uugacaggauuauuggaaa

SEQ ID NO: 2959341 - RNA, 10 nt, Human
uugacagggc

SEQ ID NO: 2959342 - RNA, 12 nt, Human
uugacagggcac

SEQ ID NO: 2959343 - RNA, 13 nt, Human
uugacaugggaca

SEQ ID NO: 2959344 - RNA, 16 nt, Human
uugacaucaacugcau

SEQ ID NO: 2959345 - RNA, 13 nt, Human
uugacaucaacug

SEQ ID NO: 2959346 - RNA, 21 nt, Human
uugcaccacugcacuccagcc

SEQ ID NO: 2959347 - RNA, 14 nt, Human
uugcaauggcagcc

SEQ ID NO: 2959348 - RNA, 19 nt, Human
uugcaugguuuggagcuga

SEQ ID NO: 2959349 - RNA, 12 nt, Human
uugcaugaggcu

SEQ ID NO: 2959350 - RNA, 14 nt, Human
uugcaugaggcuag

SEQ ID NO: 2959351 - RNA, 19 nt, Human
uugccaauuugcacauuaa

SEQ ID NO: 2959352 - RNA, 22 nt, Human
uugccaauuugcacauuaaaug

SEQ ID NO: 2959353 - RNA, 23 nt, Human
uugccaauuugcacauuaaauga

SEQ ID NO: 2959354 - RNA, 13 nt, Human
uugcccaggcagg

SEQ ID NO: 2959355 - RNA, 14 nt, Human
uugcccaggcaggu

SEQ ID NO: 2959356 - RNA, 16 nt, Human
uugcccaggcaggucu

SEQ ID NO: 2959357 - RNA, 18 nt, Human
uugcccaggcaggucuug

SEQ ID NO: 2959358 - RNA, 11 nt, Human
uugcccaggcu

SEQ ID NO: 2959359 - RNA, 12 nt, Human
uugcccaggcug

SEQ ID NO: 2959360 - RNA, 14 nt, Human
uugcccaggcuggc

SEQ ID NO: 2959361 - RNA, 23 nt, Human
uugcccaggcuggcgugcagugg

SEQ ID NO: 2959362 - RNA, 15 nt, Human
uugauuaaauucuug

SEQ ID NO: 2959363 - RNA, 16 nt, Human
uugauuaaauucuugc

SEQ ID NO: 2959364 - RNA, 20 nt, Human
uugauuaaauucuugcaaag

SEQ ID NO: 2959365 - RNA, 21 nt, Human
uugauuaaauucuugcaaagu

SEQ ID NO: 2959366 - RNA, 23 nt, Human
uugauguucuuucacccuuuucu

SEQ ID NO: 2959367 - RNA, 23 nt, Human
aucucacacaugagcaucaggcc

SEQ ID NO: 2959368 - RNA, 16 nt, Human
aucucaaauuucuaaa

SEQ ID NO: 2959369 - RNA, 17 nt, Human
aucucaaauuucuaaau

SEQ ID NO: 2959370 - RNA, 11 nt, Human
uuuacuuaaac

SEQ ID NO: 2959371 - RNA, 16 nt, Human
uuuacugcagcuuugu

SEQ ID NO: 2959372 - RNA, 15 nt, Human
augcuacaguaauaa

SEQ ID NO: 2959373 - RNA, 17 nt, Human
augcuacaguaauaaau

SEQ ID NO: 2959374 - RNA, 18 nt, Human
uuuaccugaagucuuugu

SEQ ID NO: 2959375 - RNA, 22 nt, Human
uuuaccugaagucuuuguacag

SEQ ID NO: 2959376 - RNA, 15 nt, Human
uuuacuucuuauaca

SEQ ID NO: 2959377 - RNA, 14 nt, Human
uuuacuucuuauac

SEQ ID NO: 2959378 - RNA, 14 nt, Human
uuuacuuaagacuu

SEQ ID NO: 2959379 - RNA, 12 nt, Human
uuuacuuaagac

SEQ ID NO: 2959380 - RNA, 13 nt, Human
uuuacuucuuaua

SEQ ID NO: 2959381 - RNA, 17 nt, Human
uuuagggguagcauuug

SEQ ID NO: 2959382 - RNA, 19 nt, Human
uuuauaugcuucuguuuua

SEQ ID NO: 2959383 - RNA, 16 nt, Human
uuuaucagaacuaugu

SEQ ID NO: 2959384 - RNA, 17 nt, Human
uuuaucagaacuauguu

SEQ ID NO: 2959385 - RNA, 21 nt, Human
uuuauaugcuucuguuuuaua

SEQ ID NO: 2959386 - RNA, 23 nt, Human
augccagggccaugucagacaca

SEQ ID NO: 2959387 - RNA, 21 nt, Human
augccagggccaugucagaca

SEQ ID NO: 2959388 - RNA, 18 nt, Human
uuuaaucuuuuaugauug

SEQ ID NO: 2959389 - RNA, 21 nt, Human
uuuaaugaaagacuguacaaa

SEQ ID NO: 2959390 - RNA, 23 nt, Human
uuuaaugaaagacuguacaaagu

SEQ ID NO: 2959391 - RNA, 15 nt, Human
augccccugaauuua

SEQ ID NO: 2959392 - RNA, 20 nt, Human
augccccugaauuuaaauag

SEQ ID NO: 2959393 - RNA, 17 nt, Human
augcccagccccuucug

SEQ ID NO: 2959394 - RNA, 16 nt, Human
augcccagugagacug

SEQ ID NO: 2959395 - RNA, 15 nt, Human
augcccagugagacu

SEQ ID NO: 2959396 - RNA, 15 nt, Human
augcccagccccuuc

SEQ ID NO: 2959397 - RNA, 16 nt, Human
augcccagccccuucu

SEQ ID NO: 2959398 - RNA, 21 nt, Human
augccaugaggaacaaggcaa

SEQ ID NO: 2959399 - RNA, 20 nt, Human
augcgugcauaccacuuuug

SEQ ID NO: 2959400 - RNA, 22 nt, Human
augcgugcauaccacuuuuguu

SEQ ID NO: 2959401 - RNA, 18 nt, Human
augcuacaggauuugaaa

SEQ ID NO: 2959402 - RNA, 14 nt, Human
augccucucucagg

SEQ ID NO: 2959403 - RNA, 13 nt, Human
augccucucucag

SEQ ID NO: 2959404 - RNA, 14 nt, Human
augccuuuucccaa

SEQ ID NO: 2959405 - RNA, 15 nt, Human
augccucucucaggc

SEQ ID NO: 2959406 - RNA, 20 nt, Human
augccuuuucccaacuccag

SEQ ID NO: 2959407 - RNA, 22 nt, Human
augccuuuucccaacuccagaa

SEQ ID NO: 2959408 - RNA, 23 nt, Human
augcuguucaugaaagauucaau

SEQ ID NO: 2959409 - RNA, 23 nt, Human
augcuguauuuuaaaagaaugau

SEQ ID NO: 2959410 - RNA, 19 nt, Human
augcuggcuguuggcuggg

SEQ ID NO: 2959411 - RNA, 20 nt, Human
augcuggcuguuggcugggg

SEQ ID NO: 2959412 - RNA, 19 nt, Human
augcuguauuuuaaaagaa

SEQ ID NO: 2959413 - RNA, 22 nt, Human
augcuguauuuuaaaagaauga

SEQ ID NO: 2959414 - RNA, 18 nt, Human
auggaagacagcucuuau

SEQ ID NO: 2959415 - RNA, 17 nt, Human
auggaagacagcucuua

SEQ ID NO: 2959416 - RNA, 20 nt, Human
augcuucucacugccaugcc

SEQ ID NO: 2959417 - RNA, 16 nt, Human
augcuucucacugcca

SEQ ID NO: 2959418 - RNA, 18 nt, Human
uuuaucagaacuauguuu

SEQ ID NO: 2959419 - RNA, 14 nt, Human
uuuaucagaauucu

SEQ ID NO: 2959420 - RNA, 19 nt, Human
augcuccuggcccacugca

SEQ ID NO: 2959421 - RNA, 14 nt, Human
augcuccuggccca

SEQ ID NO: 2959422 - RNA, 18 nt, Human
augcuggcuguuggcugg

SEQ ID NO: 2959423 - RNA, 17 nt, Human
auggaauucacaaagua

SEQ ID NO: 2959424 - RNA, 16 nt, Human
auggaauucacaaagu

SEQ ID NO: 2959425 - RNA, 17 nt, Human
uuucaaacauauauaac

SEQ ID NO: 2959426 - RNA, 20 nt, Human
auggaauucacaaaguaauu

SEQ ID NO: 2959427 - RNA, 19 nt, Human
uuucaaacauauauaacaa

SEQ ID NO: 2959428 - RNA, 12 nt, Human
uuucaaacuuua

SEQ ID NO: 2959429 - RNA, 14 nt, Human
uuucacauuggaaa

SEQ ID NO: 2959430 - RNA, 19 nt, Human
uuucacauuggaaacaagu

SEQ ID NO: 2959431 - RNA, 13 nt, Human
uuucacauuggaa

SEQ ID NO: 2959432 - RNA, 17 nt, Human
uuuccauuuacuuaaga

SEQ ID NO: 2959433 - RNA, 16 nt, Human
uuucccuauuagagaa

SEQ ID NO: 2959434 - RNA, 21 nt, Human
uuucaugcuguucaugaaaga

SEQ ID NO: 2959435 - RNA, 19 nt, Human
uuucaugcuguucaugaaa

SEQ ID NO: 2959436 - RNA, 11 nt, Human
uuucagaaaug

SEQ ID NO: 2959437 - RNA, 12 nt, Human
uuucagaaaugu

SEQ ID NO: 2959438 - RNA, 13 nt, Human
uugugaggaagcc

SEQ ID NO: 2959439 - RNA, 19 nt, Human
uugugauacaaugcugugc

SEQ ID NO: 2959440 - RNA, 20 nt, Human
uugugauacaaugcugugcc

SEQ ID NO: 2959441 - RNA, 18 nt, Human
uugugaggaagccgcugg

SEQ ID NO: 2959442 - RNA, 17 nt, Human
uugugaggaagccgcug

SEQ ID NO: 2959443 - RNA, 22 nt, Human
uugugaaugcagguuuuaucag

SEQ ID NO: 2959444 - RNA, 16 nt, Human
uuguccccgacccuug

SEQ ID NO: 2959445 - RNA, 15 nt, Human
uuguccccgacccuu

SEQ ID NO: 2959446 - RNA, 15 nt, Human
uugucccaagugcca

SEQ ID NO: 2959447 - RNA, 20 nt, Human
uuguccccaccgcagacagg

SEQ ID NO: 2959448 - RNA, 18 nt, Human
uuguccccaccgcagaca

SEQ ID NO: 2959449 - RNA, 16 nt, Human
uuguguacuuuuaaga

SEQ ID NO: 2959450 - RNA, 21 nt, Human
uugucauauaagauucauauu

SEQ ID NO: 2959451 - RNA, 17 nt, Human
uugucacacacuuuggc

SEQ ID NO: 2959452 - RNA, 13 nt, Human
augaguccccugu

SEQ ID NO: 2959453 - RNA, 23 nt, Human
augaguccccuguuuguuucuga

SEQ ID NO: 2959454 - RNA, 20 nt, Human
uugucaauaaaauccauaca

SEQ ID NO: 2959455 - RNA, 19 nt, Human
augaggucagagccugcag

SEQ ID NO: 2959456 - RNA, 20 nt, Human
augaggucagagccugcagu

SEQ ID NO: 2959457 - RNA, 15 nt, Human
augaggucagagccu

SEQ ID NO: 2959458 - RNA, 16 nt, Human
augaggucagagccug

SEQ ID NO: 2959459 - RNA, 18 nt, Human
augaggucagagccugca

SEQ ID NO: 2959460 - RNA, 16 nt, Human
uuguagcauccuggaa

SEQ ID NO: 2959461 - RNA, 18 nt, Human
uuguagcauccuggaaua

SEQ ID NO: 2959462 - RNA, 17 nt, Human
augagguacugagagug

SEQ ID NO: 2959463 - RNA, 18 nt, Human
augagguacugagaguga

SEQ ID NO: 2959464 - RNA, 15 nt, Human
augagguacugagag

SEQ ID NO: 2959465 - RNA, 17 nt, Human
uuguucuugguuuguaa

SEQ ID NO: 2959466 - RNA, 19 nt, Human
uuguucuugguuuguaaau

SEQ ID NO: 2959467 - RNA, 16 nt, Human
augcaaaaaaaauuag

SEQ ID NO: 2959468 - RNA, 13 nt, Human
augauuucauuca

SEQ ID NO: 2959469 - RNA, 23 nt, Human
augcacuuuguucuggcucuucc

SEQ ID NO: 2959470 - RNA, 18 nt, Human
uuuaaaaaaauuccaagu

SEQ ID NO: 2959471 - RNA, 21 nt, Human
augcacuuuguucuggcucuu

SEQ ID NO: 2959472 - RNA, 20 nt, Human
augcaaagaugaaggucugu

SEQ ID NO: 2959473 - RNA, 14 nt, Human
augcaaagcacuga

SEQ ID NO: 2959474 - RNA, 13 nt, Human
augcaaagcacug

SEQ ID NO: 2959475 - RNA, 12 nt, Human
augcaaagcacu

SEQ ID NO: 2959476 - RNA, 22 nt, Human
uuuaaggaugcuuguacauaau

SEQ ID NO: 2959477 - RNA, 20 nt, Human
uuuaaggaugcuuguacaua

SEQ ID NO: 2959478 - RNA, 21 nt, Human
uuuaaggaugcuuguacauaa

SEQ ID NO: 2959479 - RNA, 18 nt, Human
uuuaagggcccuuuuuca

SEQ ID NO: 2959480 - RNA, 20 nt, Human
uuuaagggcccuuuuucaau

SEQ ID NO: 2959481 - RNA, 21 nt, Human
uuuaagggcccuuuuucaaua

SEQ ID NO: 2959482 - RNA, 15 nt, Human
uuuaaucuuuuauga

SEQ ID NO: 2959483 - RNA, 16 nt, Human
uuuaaugaaagacugu

SEQ ID NO: 2959484 - RNA, 19 nt, Human
uuuaaggaugcuuguacau

SEQ ID NO: 2959485 - RNA, 21 nt, Human
uuuaagcuguuacugucuuca

SEQ ID NO: 2959486 - RNA, 16 nt, Human
uuuaagacuuugguua

SEQ ID NO: 2959487 - RNA, 12 nt, Human
uuuaagagaaau

SEQ ID NO: 2959488 - RNA, 11 nt, Human
uuuaaaugcac

SEQ ID NO: 2959489 - RNA, 21 nt, Human
uuuaaauauaugcuaagucuu

SEQ ID NO: 2959490 - RNA, 16 nt, Human
uuuuguuuuugucuua

SEQ ID NO: 2959491 - RNA, 15 nt, Human
uuuuguuuucauuau

SEQ ID NO: 2959492 - RNA, 20 nt, Human
uuuuguuuuuauuaaaagga

SEQ ID NO: 2959493 - RNA, 23 nt, Human
uuuuuauacauaaacaagaccac

SEQ ID NO: 2959494 - RNA, 21 nt, Human
uuuuuauauucucagcagagu

SEQ ID NO: 2959495 - RNA, 22 nt, Human
uuuuuauauucucagcagagug

SEQ ID NO: 2959496 - RNA, 14 nt, Human
uuuuggaaaagaau

SEQ ID NO: 2959497 - RNA, 12 nt, Human
uuuuguguacuu

SEQ ID NO: 2959498 - RNA, 23 nt, Human
uuuugugcauuaucuagauacug

SEQ ID NO: 2959499 - RNA, 14 nt, Human
uuuugugaagcaaa

SEQ ID NO: 2959500 - RNA, 18 nt, Human
uuuuuggaaaagaauaaa

SEQ ID NO: 2959501 - RNA, 15 nt, Human
uuuuugaagcuguau

SEQ ID NO: 2959502 - RNA, 18 nt, Human
auuaaguacuauguauca

SEQ ID NO: 2959503 - RNA, 16 nt, Human
auuaaguacuauguau

SEQ ID NO: 2959504 - RNA, 19 nt, Human
auuaaguacuauguaucaa

SEQ ID NO: 2959505 - RNA, 13 nt, Human
auuaaggaagaca

SEQ ID NO: 2959506 - RNA, 15 nt, Human
uuuuugguauuugaa

SEQ ID NO: 2959507 - RNA, 14 nt, Human
auuacuucugcuac

SEQ ID NO: 2959508 - RNA, 12 nt, Human
auuacuucugcu

SEQ ID NO: 2959509 - RNA, 13 nt, Human
auuacuucugcua

SEQ ID NO: 2959510 - RNA, 13 nt, Human
auuagagaagaga

SEQ ID NO: 2959511 - RNA, 15 nt, Human
auuacuguaagaaaa

SEQ ID NO: 2959512 - RNA, 16 nt, Human
auuacuguaagaaaau

SEQ ID NO: 2959513 - RNA, 17 nt, Human
auuauugauguuuucau

SEQ ID NO: 2959514 - RNA, 19 nt, Human
auucaccuccuaaaacaac

SEQ ID NO: 2959515 - RNA, 18 nt, Human
auucaccuccuaaaacaa

SEQ ID NO: 2959516 - RNA, 21 nt, Human
auucaccuccuaaaacaacag

SEQ ID NO: 2959517 - RNA, 22 nt, Human
auucaaacagucucaggaaauc

SEQ ID NO: 2959518 - RNA, 20 nt, Human
auuauauggcuugaguuuaa

SEQ ID NO: 2959519 - RNA, 21 nt, Human
auuccuaacuaucacugguuu

SEQ ID NO: 2959520 - RNA, 22 nt, Human
auuccccaggaggccagccuug

SEQ ID NO: 2959521 - RNA, 20 nt, Human
auuccccaggaggccagccu

SEQ ID NO: 2959522 - RNA, 18 nt, Human
auucccaagcucugcucc

SEQ ID NO: 2959523 - RNA, 19 nt, Human
auucccaagcucugcuccu

SEQ ID NO: 2959524 - RNA, 17 nt, Human
auucccaagcucugcuc

SEQ ID NO: 2959525 - RNA, 17 nt, Human
auuccaagugauugaaa

SEQ ID NO: 2959526 - RNA, 18 nt, Human
uuugauucagacagcugc

SEQ ID NO: 2959527 - RNA, 22 nt, Human
uuuggauuggaugaauuccaaa

SEQ ID NO: 2959528 - RNA, 20 nt, Human
uuugcuggagcucugcccau

SEQ ID NO: 2959529 - RNA, 22 nt, Human
uuugcuggggccgaaagaacag

SEQ ID NO: 2959530 - RNA, 19 nt, Human
uuugcuggggccgaaagaa

SEQ ID NO: 2959531 - RNA, 22 nt, Human
uuugggguacccacugcucugg

SEQ ID NO: 2959532 - RNA, 21 nt, Human
uuugggguacccacugcucug

SEQ ID NO: 2959533 - RNA, 13 nt, Human
uuuggcugcugaa

SEQ ID NO: 2959534 - RNA, 12 nt, Human
uuuggcugcuga

SEQ ID NO: 2959535 - RNA, 15 nt, Human
uuugauucagacagc

SEQ ID NO: 2959536 - RNA, 14 nt, Human
uuugauccaagcug

SEQ ID NO: 2959537 - RNA, 15 nt, Human
uuugauccaagcugg

SEQ ID NO: 2959538 - RNA, 13 nt, Human
uuugagacagagu

SEQ ID NO: 2959539 - RNA, 23 nt, Human
uuugagaaauuuuuuuuuccagu

SEQ ID NO: 2959540 - RNA, 18 nt, Human
uuugaccucugcagcaau

SEQ ID NO: 2959541 - RNA, 14 nt, Human
uuugacaaggggca

SEQ ID NO: 2959542 - RNA, 19 nt, Human
uuugaccucugcagcaaua

SEQ ID NO: 2959543 - RNA, 21 nt, Human
uuugaccucugcagcaauaaa

SEQ ID NO: 2959544 - RNA, 23 nt, Human
uuucccucccuuccucuuuccau

SEQ ID NO: 2959545 - RNA, 16 nt, Human
uuuguuucugaaaggg

SEQ ID NO: 2959546 - RNA, 14 nt, Human
uuuguuucugaaag

SEQ ID NO: 2959547 - RNA, 22 nt, Human
uuugugcauuaucuagauacug

SEQ ID NO: 2959548 - RNA, 15 nt, Human
uuugugauacaaugc

SEQ ID NO: 2959549 - RNA, 22 nt, Human
uuugugauacaaugcugugccc

SEQ ID NO: 2959550 - RNA, 19 nt, Human
uuugugcauuaucuagaua

SEQ ID NO: 2959551 - RNA, 14 nt, Human
uuugucuuaaaaag

SEQ ID NO: 2959552 - RNA, 13 nt, Human
uuugucuuaaaaa

SEQ ID NO: 2959553 - RNA, 16 nt, Human
uuugugauacaaugcu

SEQ ID NO: 2959554 - RNA, 23 nt, Human
uuugucuuaaaaaguggaaaaau

SEQ ID NO: 2959555 - RNA, 16 nt, Human
uuuguaauuuuuuuau

SEQ ID NO: 2959556 - RNA, 14 nt, Human
uuuguacagacaac

SEQ ID NO: 2959557 - RNA, 17 nt, Human
auguccaagaagcccag

SEQ ID NO: 2959558 - RNA, 16 nt, Human
auguccaagaagccca

SEQ ID NO: 2959559 - RNA, 12 nt, Human
auguaucaauga

SEQ ID NO: 2959560 - RNA, 19 nt, Human
auguauauuuuauaucaau

SEQ ID NO: 2959561 - RNA, 14 nt, Human
augugagacugguu

SEQ ID NO: 2959562 - RNA, 13 nt, Human
augugagaccauu

SEQ ID NO: 2959563 - RNA, 23 nt, Human
augucgucaaagcugaaauggac

SEQ ID NO: 2959564 - RNA, 21 nt, Human
augugcuaguaauuggaaagg

SEQ ID NO: 2959565 - RNA, 21 nt, Human
augugccagguuuuuggucug

SEQ ID NO: 2959566 - RNA, 20 nt, Human
augugcuaguaauuggaaag

SEQ ID NO: 2959567 - RNA, 17 nt, Human
uuuguuuuuauuaaaag

SEQ ID NO: 2959568 - RNA, 18 nt, Human
uuuuaaaaaacugcugac

SEQ ID NO: 2959569 - RNA, 17 nt, Human
uuuuagaguugauacua

SEQ ID NO: 2959570 - RNA, 21 nt, Human
uuuuagacccuauugcugcuu

SEQ ID NO: 2959571 - RNA, 14 nt, Human
auguugcuaacagc

SEQ ID NO: 2959572 - RNA, 12 nt, Human
auguugaaagau

SEQ ID NO: 2959573 - RNA, 13 nt, Human
auguugcccaggc

SEQ ID NO: 2959574 - RNA, 18 nt, Human
auguugaaagaucaaaag

SEQ ID NO: 2959575 - RNA, 14 nt, Human
auguugcccaggca

SEQ ID NO: 2959576 - RNA, 15 nt, Human
auguugcccaggcag

SEQ ID NO: 2959577 - RNA, 20 nt, Human
auguuacauaagauaaaugu

SEQ ID NO: 2959578 - RNA, 19 nt, Human
auguuacauaagauaaaug

SEQ ID NO: 2959579 - RNA, 15 nt, Human
uuuuaguagagacag

SEQ ID NO: 2959580 - RNA, 22 nt, Human
uuuuauggcacuaguauuucua

SEQ ID NO: 2959581 - RNA, 18 nt, Human
uuuuauggcuuuugugca

SEQ ID NO: 2959582 - RNA, 19 nt, Human
uuuuauggcuuuugugcau

SEQ ID NO: 2959583 - RNA, 12 nt, Human
uuuuauuaaauu

SEQ ID NO: 2959584 - RNA, 21 nt, Human
uuuuauggcuuuugugcauua

SEQ ID NO: 2959585 - RNA, 20 nt, Human
uuuucaggcuagauguaugu

SEQ ID NO: 2959586 - RNA, 16 nt, Human
uuuucucuaggaaaua

SEQ ID NO: 2959587 - RNA, 17 nt, Human
uuuucucugauacagaa

SEQ ID NO: 2959588 - RNA, 19 nt, Human
auuaaaacacaacaucuuu

SEQ ID NO: 2959589 - RNA, 23 nt, Human
auuaaaaaucucaaauuucuaaa

SEQ ID NO: 2959590 - RNA, 17 nt, Human
auguuggccaggcuggu

SEQ ID NO: 2959591 - RNA, 13 nt, Human
uuuucuguucuuu

SEQ ID NO: 2959592 - RNA, 23 nt, Human
auuggcuagagguucaaagauau

SEQ ID NO: 2959593 - RNA, 14 nt, Human
auuggggcucccag

SEQ ID NO: 2959594 - RNA, 19 nt, Human
auuggcuagagguucaaag

SEQ ID NO: 2959595 - RNA, 20 nt, Human
auuggcuagagguucaaaga

SEQ ID NO: 2959596 - RNA, 22 nt, Human
auuggcuagagguucaaagaua

SEQ ID NO: 2959597 - RNA, 16 nt, Human
auuggagcucguggaa

SEQ ID NO: 2959598 - RNA, 17 nt, Human
auuggagcucgugggac

SEQ ID NO: 2959599 - RNA, 22 nt, Human
auugcauacuauuaaacaugcu

SEQ ID NO: 2959600 - RNA, 19 nt, Human
auugcauacuauuaaacau

SEQ ID NO: 2959601 - RNA, 20 nt, Human
auugcauacuauuaaacaug

SEQ ID NO: 2959602 - RNA, 19 nt, Human
auugccuuuuuauaacuuu

SEQ ID NO: 2959603 - RNA, 20 nt, Human
auugccuuuuuauaacuuuu

SEQ ID NO: 2959604 - RNA, 21 nt, Human
auugccuuuuuauaacuuuuu

SEQ ID NO: 2959605 - RNA, 14 nt, Human
auuggaaacaaguc

SEQ ID NO: 2959606 - RNA, 13 nt, Human
auuggaaacaagu

SEQ ID NO: 2959607 - RNA, 15 nt, Human
auugaaguaaaaugu

SEQ ID NO: 2959608 - RNA, 24 nt, Human
auuccuagaaacugacacaugcug

SEQ ID NO: 2959609 - RNA, 17 nt, Human
auugaaggaugcugucu

SEQ ID NO: 2959610 - RNA, 14 nt, Human
auugaaguaaaaug

SEQ ID NO: 2959611 - RNA, 17 nt, Human
auugauguuuucauaga

SEQ ID NO: 2959612 - RNA, 16 nt, Human
auugauguuuucauag

SEQ ID NO: 2959613 - RNA, 13 nt, Human
auugauguuuuca

SEQ ID NO: 2959614 - RNA, 19 nt, Human
auugcaacaggcugggcuu

SEQ ID NO: 2959615 - RNA, 12 nt, Human
auugcaccacug

SEQ ID NO: 2959616 - RNA, 17 nt, Human
auugcaacaggcugggc

SEQ ID NO: 2959617 - RNA, 18 nt, Human
auugcaacaggcugggcu

SEQ ID NO: 2959618 - RNA, 18 nt, Human
auugcauacuauuaaaca

SEQ ID NO: 2959619 - RNA, 17 nt, Human
auugcauacuauuaaac

SEQ ID NO: 2959620 - RNA, 17 nt, Human
auugcaccuggauguac

SEQ ID NO: 2959621 - RNA, 16 nt, Human
auugcaacaggcuggg

SEQ ID NO: 2959622 - RNA, 16 nt, Human
auuucuuccacaagag

SEQ ID NO: 2959623 - RNA, 20 nt, Human
auuucuugagguaaaagcau

SEQ ID NO: 2959624 - RNA, 15 nt, Human
auuugagcagggcuc

SEQ ID NO: 2959625 - RNA, 15 nt, Human
auuugaggucuguuc

SEQ ID NO: 2959626 - RNA, 17 nt, Human
auuugaggucuguucuu

SEQ ID NO: 2959627 - RNA, 18 nt, Human
auuugaggucuguucuuu

SEQ ID NO: 2959628 - RNA, 21 nt, Human
auuuggugguuucagaaaugu

SEQ ID NO: 2959629 - RNA, 12 nt, Human
auuugguuuuca

SEQ ID NO: 2959630 - RNA, 14 nt, Human
auuugguuuucaca

SEQ ID NO: 2959631 - RNA, 21 nt, Human
auuugaggucuguucuuucca

SEQ ID NO: 2959632 - RNA, 19 nt, Human
auuugauaugugaacaguu

SEQ ID NO: 2959633 - RNA, 18 nt, Human
auuugauaugugaacagu

SEQ ID NO: 2959634 - RNA, 18 nt, Human
auuuccauuuacuuaaga

SEQ ID NO: 2959635 - RNA, 21 nt, Human
auuuauuuuaauaauguuuca

SEQ ID NO: 2959636 - RNA, 22 nt, Human
auuuccauuuacuuaagacuua

SEQ ID NO: 2959637 - RNA, 19 nt, Human
auuuccauuuacuuaagac

SEQ ID NO: 2959638 - RNA, 20 nt, Human
auuuccauuuacuuaagacu

SEQ ID NO: 2959639 - RNA, 16 nt, Human
auuucccaaagcagug

SEQ ID NO: 2959640 - RNA, 14 nt, Human
auuucccaaagcag

SEQ ID NO: 2959641 - RNA, 17 nt, Human
auuuccguuaaaauacc

SEQ ID NO: 2959642 - RNA, 19 nt, Human
auuuauuacuguaagaaaa

SEQ ID NO: 2959643 - RNA, 20 nt, Human
auuuauuacuguaagaaaau

SEQ ID NO: 2959644 - RNA, 22 nt, Human
auuuauugaaaugauuucacag

SEQ ID NO: 2959645 - RNA, 15 nt, Human
auuuauugaaaugau

SEQ ID NO: 2959646 - RNA, 13 nt, Human
auuuauugaaaug

SEQ ID NO: 2959647 - RNA, 12 nt, Human
auuuauuacaac

SEQ ID NO: 2959648 - RNA, 15 nt, Human
auuuacuuuaaacua

SEQ ID NO: 2959649 - RNA, 19 nt, Human
auuuacuucuuauacauuu

SEQ ID NO: 2959650 - RNA, 20 nt, Human
auuuacuucuuauacauuug

SEQ ID NO: 2959651 - RNA, 22 nt, Human
auuuacaacugggggaggguga

SEQ ID NO: 2959652 - RNA, 15 nt, Human
auuggggcucccagc

SEQ ID NO: 2959653 - RNA, 14 nt, Human
auuuaaauagauga

SEQ ID NO: 2959654 - RNA, 15 nt, Human
auuuaaauagaugac

SEQ ID NO: 2959655 - RNA, 16 nt, Human
auuuaaauagcuuuuu

SEQ ID NO: 2959656 - RNA, 22 nt, Human
auuuaccacuuguguuuugcaa

SEQ ID NO: 2959657 - RNA, 15 nt, Human
auuuaccacuugugu

SEQ ID NO: 2959658 - RNA, 17 nt, Human
auuguuuucaguguaca

SEQ ID NO: 2959659 - RNA, 20 nt, Human
auuguagcauccuggaauau

SEQ ID NO: 2959660 - RNA, 16 nt, Human
auuguaguccuguaau

SEQ ID NO: 2959661 - RNA, 17 nt, Human
auuguagcauccuggaa

SEQ ID NO: 2959662 - RNA, 14 nt, Human
auuuaaaaaaaauc

SEQ ID NO: 2959663 - RNA, 17 nt, Human
auuuaaaaaaaaaccug

SEQ ID NO: 2959664 - RNA, 18 nt, Human
auuguuuucaguguacau

SEQ ID NO: 2959665 - RNA, 19 nt, Human
auuguuuucaguguacaug

SEQ ID NO: 2959666 - RNA, 17 nt, Human
aaaacacauuuuucuua

SEQ ID NO: 2959667 - RNA, 19 nt, Human
aaaacacuguucucugccc

SEQ ID NO: 2959668 - RNA, 11 nt, Human
aaaagaaaaag

SEQ ID NO: 2959669 - RNA, 13 nt, Human
aaaagacuccaaa

SEQ ID NO: 2959670 - RNA, 11 nt, Human
aaaagaaugau

SEQ ID NO: 2959671 - RNA, 13 nt, Human
aaaagaauauuuu

SEQ ID NO: 2959672 - RNA, 20 nt, Human
aaaagacaaggaaaaaauaa

SEQ ID NO: 2959673 - RNA, 12 nt, Human
aaaagaauauuu

SEQ ID NO: 2959674 - RNA, 13 nt, Human
aaaagaaaaguuu

SEQ ID NO: 2959675 - RNA, 17 nt, Human
aaaagaaagaaaaucag

SEQ ID NO: 2959676 - RNA, 14 nt, Human
aaaauaaaacuuuu

SEQ ID NO: 2959677 - RNA, 18 nt, Human
aaaaguugaauuuuacau

SEQ ID NO: 2959678 - RNA, 10 nt, Human
aaaaucauuu

SEQ ID NO: 2959679 - RNA, 12 nt, Human
aaaaucauuucu

SEQ ID NO: 2959680 - RNA, 11 nt, Human
aaaaucauuuc

SEQ ID NO: 2959681 - RNA, 21 nt, Human
aaaaucagccugcuccagcug

SEQ ID NO: 2959682 - RNA, 17 nt, Human
aaaaucagccugcucca

SEQ ID NO: 2959683 - RNA, 16 nt, Human
aaaauaaaacuuuuua

SEQ ID NO: 2959684 - RNA, 13 nt, Human
aaaaucagccugc

SEQ ID NO: 2959685 - RNA, 17 nt, Human
aaagccucuguuuugau

SEQ ID NO: 2959686 - RNA, 16 nt, Human
aaagccucuguuuuga

SEQ ID NO: 2959687 - RNA, 17 nt, Human
aaagcauuguaaaugug

SEQ ID NO: 2959688 - RNA, 15 nt, Human
aaagcauuguaaaug

SEQ ID NO: 2959689 - RNA, 20 nt, Human
aaagauauuuugcuuuguga

SEQ ID NO: 2959690 - RNA, 15 nt, Human
aaacugcacugucaa

SEQ ID NO: 2959691 - RNA, 23 nt, Human
aaacugauuuuuuuuuccuucag

SEQ ID NO: 2959692 - RNA, 22 nt, Human
aaacugauuuuuuuuuccuuca

SEQ ID NO: 2959693 - RNA, 23 nt, Human
aaacucuuaaaacccaagugccu

SEQ ID NO: 2959694 - RNA, 12 nt, Human
aaacucuuaaaa

SEQ ID NO: 2959695 - RNA, 19 nt, Human
aaacccuugccaugugcua

SEQ ID NO: 2959696 - RNA, 22 nt, Human
aaaccgaacugauguaaguaaa

SEQ ID NO: 2959697 - RNA, 16 nt, Human
aaacccagcucugguc

SEQ ID NO: 2959698 - RNA, 12 nt, Human
aaacccagcucu

SEQ ID NO: 2959699 - RNA, 16 nt, Human
aaaccgccaaggcugg

SEQ ID NO: 2959700 - RNA, 15 nt, Human
aaaccgccaaggcug

SEQ ID NO: 2959701 - RNA, 21 nt, Human
aaaaucauuucugcaucagcu

SEQ ID NO: 2959702 - RNA, 15 nt, Human
aaaaucucaaauuuc

SEQ ID NO: 2959703 - RNA, 16 nt, Human
aaaaucucaaauuucu

SEQ ID NO: 2959704 - RNA, 18 nt, Human
aaaaucucaaauuucuaa

SEQ ID NO: 2959705 - RNA, 11 nt, Human
aaauguuuugc

SEQ ID NO: 2959706 - RNA, 22 nt, Human
aaauguuuugcucaauagauug

SEQ ID NO: 2959707 - RNA, 23 nt, Human
aaauguugacaugggacauuugc

SEQ ID NO: 2959708 - RNA, 13 nt, Human
aaauguucaucaa

SEQ ID NO: 2959709 - RNA, 22 nt, Human
aaauguugacaugggacauuug

SEQ ID NO: 2959710 - RNA, 20 nt, Human
aaaggaugcccaaagaugca

SEQ ID NO: 2959711 - RNA, 14 nt, Human
aaaggaugcacaga

SEQ ID NO: 2959712 - RNA, 19 nt, Human
aaaugcuguaacuuucuga

SEQ ID NO: 2959713 - RNA, 14 nt, Human
aaaucuuuuugcuu

SEQ ID NO: 2959714 - RNA, 13 nt, Human
aaaucuuuuugcu

SEQ ID NO: 2959715 - RNA, 18 nt, Human
aaaucucaauauuucaga

SEQ ID NO: 2959716 - RNA, 22 nt, Human
aaauagcagcccucaauuguga

SEQ ID NO: 2959717 - RNA, 21 nt, Human
aaauagaugacauugacuauu

SEQ ID NO: 2959718 - RNA, 14 nt, Human
aaauagaugacauu

SEQ ID NO: 2959719 - RNA, 21 nt, Human
aaauauuuauuuuaauaaugu

SEQ ID NO: 2959720 - RNA, 23 nt, Human
aacauggccuuugcuugaaagaa

SEQ ID NO: 2959721 - RNA, 23 nt, Human
aaccuuuugagugccuuacacaa

SEQ ID NO: 2959722 - RNA, 16 nt, Human
aaccuuuugagugccu

SEQ ID NO: 2959723 - RNA, 22 nt, Human
aacauggccuuugcuugaaaga

SEQ ID NO: 2959724 - RNA, 11 nt, Human
aacaggcagau

SEQ ID NO: 2959725 - RNA, 23 nt, Human
aaauucuucuccacuuucuagcc

SEQ ID NO: 2959726 - RNA, 15 nt, Human
aaauucuugcaaagu

SEQ ID NO: 2959727 - RNA, 20 nt, Human
aaugaagauacugaaauaaa

SEQ ID NO: 2959728 - RNA, 21 nt, Human
aaugaaagacuguacaaagua

SEQ ID NO: 2959729 - RNA, 18 nt, Human
aaugaaagacuguacaaa

SEQ ID NO: 2959730 - RNA, 20 nt, Human
aaugaaagacuguacaaagu

SEQ ID NO: 2959731 - RNA, 20 nt, Human
aaugaugccaugaggaacaa

SEQ ID NO: 2959732 - RNA, 20 nt, Human
aaugaauacuuuauaaagga

SEQ ID NO: 2959733 - RNA, 16 nt, Human
aaucucaauauuucag

SEQ ID NO: 2959734 - RNA, 21 nt, Human
aaucaaucaugucagucugcu

SEQ ID NO: 2959735 - RNA, 21 nt, Human
aaucaccgaaaacguggcugc

SEQ ID NO: 2959736 - RNA, 23 nt, Human
aaucaccgaaaacguggcugcuu

SEQ ID NO: 2959737 - RNA, 23 nt, Human
aauauguggaguucaucuugaau

SEQ ID NO: 2959738 - RNA, 13 nt, Human
aauauuaagaaag

SEQ ID NO: 2959739 - RNA, 12 nt, Human
aagugcugggau

SEQ ID NO: 2959740 - RNA, 22 nt, Human
aagugcugcauuuaaaagauac

SEQ ID NO: 2959741 - RNA, 17 nt, Human
aauaaugugaaacugga

SEQ ID NO: 2959742 - RNA, 22 nt, Human
aauaaugugaaacuggauuaaa

SEQ ID NO: 2959743 - RNA, 14 nt, Human
aauaaagcagcguu

SEQ ID NO: 2959744 - RNA, 19 nt, Human
aauaauguuaacauggaca

SEQ ID NO: 2959745 - RNA, 20 nt, Human
aagaagacugcauuauauuu

SEQ ID NO: 2959746 - RNA, 21 nt, Human
aagacaaggaaaaaauaacaa

SEQ ID NO: 2959747 - RNA, 15 nt, Human
aagaagacugcauua

SEQ ID NO: 2959748 - RNA, 22 nt, Human
aagacaaugacuuacuguacau

SEQ ID NO: 2959749 - RNA, 19 nt, Human
aagacaaugugaaaagaaa

SEQ ID NO: 2959750 - RNA, 20 nt, Human
aagacaaugugaaaagaaaa

SEQ ID NO: 2959751 - RNA, 15 nt, Human
aagaacugaaaucau

SEQ ID NO: 2959752 - RNA, 11 nt, Human
aagaacugaaa

SEQ ID NO: 2959753 - RNA, 12 nt, Human
aagaacugaaau

SEQ ID NO: 2959754 - RNA, 13 nt, Human
aagaacugaaauc

SEQ ID NO: 2959755 - RNA, 20 nt, Human
aacgcaggcccccaggugcc

SEQ ID NO: 2959756 - RNA, 17 nt, Human
aagacuuuuccaacccu

SEQ ID NO: 2959757 - RNA, 15 nt, Human
aagaccacguuucua

SEQ ID NO: 2959758 - RNA, 17 nt, Human
aagaccacguuucuaaa

SEQ ID NO: 2959759 - RNA, 12 nt, Human
aagacuuuucuu

SEQ ID NO: 2959760 - RNA, 21 nt, Human
aagacuuuuccaacccucauc

SEQ ID NO: 2959761 - RNA, 19 nt, Human
aagacuuuucuuucagcca

SEQ ID NO: 2959762 - RNA, 13 nt, Human
aagagaaaaaaua

SEQ ID NO: 2959763 - RNA, 23 nt, Human
aagacagauacuccuccaagguu

SEQ ID NO: 2959764 - RNA, 22 nt, Human
aagacagagccccacccucaga

SEQ ID NO: 2959765 - RNA, 20 nt, Human
aagaguaggaagacuuugga

SEQ ID NO: 2959766 - RNA, 14 nt, Human
aagauaaaugugcu

SEQ ID NO: 2959767 - RNA, 21 nt, Human
aagauaauauuaaggaagaca

SEQ ID NO: 2959768 - RNA, 19 nt, Human
aagauaauauuaaggaaga

SEQ ID NO: 2959769 - RNA, 17 nt, Human
aagauacaguuacucag

SEQ ID NO: 2959770 - RNA, 14 nt, Human
aagcggcuggcagc

SEQ ID NO: 2959771 - RNA, 15 nt, Human
aagcgugagccacug

SEQ ID NO: 2959772 - RNA, 13 nt, Human
aagcuacuuauug

SEQ ID NO: 2959773 - RNA, 20 nt, Human
aaggcaggggaauguaugug

SEQ ID NO: 2959774 - RNA, 18 nt, Human
aaggcaggggaauguaug

SEQ ID NO: 2959775 - RNA, 15 nt, Human
aaggcaaggcuguca

SEQ ID NO: 2959776 - RNA, 13 nt, Human
aaggcaaggcugu

SEQ ID NO: 2959777 - RNA, 19 nt, Human
aagcugcacccucaggcag

SEQ ID NO: 2959778 - RNA, 13 nt, Human
aagcugcacccuc

SEQ ID NO: 2959779 - RNA, 15 nt, Human
aauugggcacuauuu

SEQ ID NO: 2959780 - RNA, 22 nt, Human
aauuguaaggaaugauuaauua

SEQ ID NO: 2959781 - RNA, 16 nt, Human
aauugggcacuauuua

SEQ ID NO: 2959782 - RNA, 18 nt, Human
aauugggcacuauuuauu

SEQ ID NO: 2959783 - RNA, 15 nt, Human
aauuggagcucgugg

SEQ ID NO: 2959784 - RNA, 18 nt, Human
aauucuguuuuucuaggc

SEQ ID NO: 2959785 - RNA, 14 nt, Human
aauucuguuuuucu

SEQ ID NO: 2959786 - RNA, 21 nt, Human
aauucucauuugucacacacu

SEQ ID NO: 2959787 - RNA, 15 nt, Human
aauucucuuauccaa

SEQ ID NO: 2959788 - RNA, 15 nt, Human
aauucucuaguuuga

SEQ ID NO: 2959789 - RNA, 17 nt, Human
aauucucuaguuugauu

SEQ ID NO: 2959790 - RNA, 14 nt, Human
aauucuacuuugag

SEQ ID NO: 2959791 - RNA, 19 nt, Human
aauucucagaaucucaaau

SEQ ID NO: 2959792 - RNA, 19 nt, Human
aauuccuguuuuuauuauu

SEQ ID NO: 2959793 - RNA, 21 nt, Human
aauuccuguuuuuauuauuaa

SEQ ID NO: 2959794 - RNA, 22 nt, Human
aauuccuguuuuuauuauuaac

SEQ ID NO: 2959795 - RNA, 13 nt, Human
aauuccuguuuuu

SEQ ID NO: 2959796 - RNA, 20 nt, Human
aauuaugguuaguagaggua

SEQ ID NO: 2959797 - RNA, 18 nt, Human
aauuaugaaacuuuugga

SEQ ID NO: 2959798 - RNA, 19 nt, Human
aauuaugaguuauuuuuau

SEQ ID NO: 2959799 - RNA, 13 nt, Human
aauuaugaaacuu

SEQ ID NO: 2959800 - RNA, 15 nt, Human
aauuaugaaacuuuu

SEQ ID NO: 2959801 - RNA, 12 nt, Human
aauuaugaaacu

SEQ ID NO: 2959802 - RNA, 13 nt, Human
aauuaugaaaaua

SEQ ID NO: 2959803 - RNA, 22 nt, Human
aauuucauaccuaucaucuuaa

SEQ ID NO: 2959804 - RNA, 11 nt, Human
aauuguaauag

SEQ ID NO: 2959805 - RNA, 22 nt, Human
aauuuccauuuacuuaagacuu

SEQ ID NO: 2959806 - RNA, 21 nt, Human
aauuuccauuuacuuaagacu

SEQ ID NO: 2959807 - RNA, 17 nt, Human
aauuucccaaagcagug

SEQ ID NO: 2959808 - RNA, 15 nt, Human
aauuucccaaagcag

SEQ ID NO: 2959809 - RNA, 12 nt, Human
aauuuccuggga

SEQ ID NO: 2959810 - RNA, 15 nt, Human
aauuuccugggagcu

SEQ ID NO: 2959811 - RNA, 15 nt, Human
acaaguuaaauaaau

SEQ ID NO: 2959812 - RNA, 15 nt, Human
acaaggcaaggcugu

SEQ ID NO: 2959813 - RNA, 19 nt, Human
acaaggcaaggcugucaau

SEQ ID NO: 2959814 - RNA, 17 nt, Human
acaaggcaaggcuguca

SEQ ID NO: 2959815 - RNA, 16 nt, Human
acaaggcaaggcuguc

SEQ ID NO: 2959816 - RNA, 21 nt, Human
acaaacaaggccugucagcua

SEQ ID NO: 2959817 - RNA, 14 nt, Human
acacagcucuucuc

SEQ ID NO: 2959818 - RNA, 16 nt, Human
acacagcucuucucca

SEQ ID NO: 2959819 - RNA, 18 nt, Human
acacagcucuucuccagg

SEQ ID NO: 2959820 - RNA, 18 nt, Human
acaccagagcccaccuug

SEQ ID NO: 2959821 - RNA, 23 nt, Human
acaccagagcccaccuuggcuca

SEQ ID NO: 2959822 - RNA, 13 nt, Human
acaccagagccca

SEQ ID NO: 2959823 - RNA, 15 nt, Human
acaccaauauucaua

SEQ ID NO: 2959824 - RNA, 19 nt, Human
acauguuuuucuucucccu

SEQ ID NO: 2959825 - RNA, 20 nt, Human
acauacaggaagguagaaau

SEQ ID NO: 2959826 - RNA, 16 nt, Human
acauacaauuccaaac

SEQ ID NO: 2959827 - RNA, 14 nt, Human
acaucauuucaaga

SEQ ID NO: 2959828 - RNA, 20 nt, Human
acauaaauuuaguauuuugu

SEQ ID NO: 2959829 - RNA, 13 nt, Human
acaugcacgugug

SEQ ID NO: 2959830 - RNA, 20 nt, Human
acaugccucucucaggccaa

SEQ ID NO: 2959831 - RNA, 22 nt, Human
acauguguguauauguagaugu

SEQ ID NO: 2959832 - RNA, 12 nt, Human
accagagcugcc

SEQ ID NO: 2959833 - RNA, 13 nt, Human
accagagcugcca

SEQ ID NO: 2959834 - RNA, 16 nt, Human
accagagcugccaccu

SEQ ID NO: 2959835 - RNA, 14 nt, Human
accagagcugccac

SEQ ID NO: 2959836 - RNA, 13 nt, Human
accacguuucuaa

SEQ ID NO: 2959837 - RNA, 14 nt, Human
accacguuucuaaa

SEQ ID NO: 2959838 - RNA, 18 nt, Human
accacgcuggaccuugaa

SEQ ID NO: 2959839 - RNA, 14 nt, Human
accacgcuggaccu

SEQ ID NO: 2959840 - RNA, 16 nt, Human
accacgcuggaccuug

SEQ ID NO: 2959841 - RNA, 21 nt, Human
accaacgucugugccauuuug

SEQ ID NO: 2959842 - RNA, 21 nt, Human
acauuuguauaaaauaauuuu

SEQ ID NO: 2959843 - RNA, 17 nt, Human
accaacgucugugccau

SEQ ID NO: 2959844 - RNA, 14 nt, Human
accaacgucugugc

SEQ ID NO: 2959845 - RNA, 15 nt, Human
acauuugcucaugga

SEQ ID NO: 2959846 - RNA, 16 nt, Human
acauuuguauaaaaua

SEQ ID NO: 2959847 - RNA, 19 nt, Human
acauuuguauaaaauaauu

SEQ ID NO: 2959848 - RNA, 23 nt, Human
acaggcacccaccaucaugucug

SEQ ID NO: 2959849 - RNA, 23 nt, Human
acagugaucaaguuauuuuuaau

SEQ ID NO: 2959850 - RNA, 19 nt, Human
acagugauuaccagggacu

SEQ ID NO: 2959851 - RNA, 19 nt, Human
acagcucuucuccaggcug

SEQ ID NO: 2959852 - RNA, 20 nt, Human
acagcucuucuccaggcugu

SEQ ID NO: 2959853 - RNA, 18 nt, Human
acagcucuucuccaggcu

SEQ ID NO: 2959854 - RNA, 15 nt, Human
acaggcaaugcuggc

SEQ ID NO: 2959855 - RNA, 16 nt, Human
acaggcaaugcuggcu

SEQ ID NO: 2959856 - RNA, 14 nt, Human
acaggcacccacca

SEQ ID NO: 2959857 - RNA, 17 nt, Human
acaggcaaugcuggcug

SEQ ID NO: 2959858 - RNA, 24 nt, Human
acaggaugguucccuugaugaaga

SEQ ID NO: 2959859 - RNA, 22 nt, Human
acaggaugguucccuugaugaa

SEQ ID NO: 2959860 - RNA, 19 nt, Human
acuguuucaaacuuuacua

SEQ ID NO: 2959861 - RNA, 15 nt, Human
acuguuucaaacuuu

SEQ ID NO: 2959862 - RNA, 18 nt, Human
acuguuucaaacuuuacu

SEQ ID NO: 2959863 - RNA, 17 nt, Human
acuucaaauccuugaag

SEQ ID NO: 2959864 - RNA, 18 nt, Human
acuucaaauccuugaaga

SEQ ID NO: 2959865 - RNA, 22 nt, Human
acuuaaaaaugguuuaaauggu

SEQ ID NO: 2959866 - RNA, 21 nt, Human
acuuaaaaaugguuuaaaugg

SEQ ID NO: 2959867 - RNA, 23 nt, Human
acuuggggggcugaggugggagg

SEQ ID NO: 2959868 - RNA, 21 nt, Human
acuucagacauagaauuaaca

SEQ ID NO: 2959869 - RNA, 17 nt, Human
acugugccaugugccag

SEQ ID NO: 2959870 - RNA, 18 nt, Human
acugugccaugugccagg

SEQ ID NO: 2959871 - RNA, 16 nt, Human
acugugccaugugcca

SEQ ID NO: 2959872 - RNA, 16 nt, Human
acugugaagagaacca

SEQ ID NO: 2959873 - RNA, 14 nt, Human
acugccaugccagc

SEQ ID NO: 2959874 - RNA, 19 nt, Human
acuggaacacucuauaaca

SEQ ID NO: 2959875 - RNA, 17 nt, Human
acuguaaaauaauaacu

SEQ ID NO: 2959876 - RNA, 13 nt, Human
acugacacaugcu

SEQ ID NO: 2959877 - RNA, 23 nt, Human
acugaauuucuuuugccguuauu

SEQ ID NO: 2959878 - RNA, 17 nt, Human
acugacauuguuggcca

SEQ ID NO: 2959879 - RNA, 18 nt, Human
acugacauuguuggccaa

SEQ ID NO: 2959880 - RNA, 22 nt, Human
acugaauggacuuugcacacuu

SEQ ID NO: 2959881 - RNA, 17 nt, Human
acugaauggacuuugca

SEQ ID NO: 2959882 - RNA, 13 nt, Human
acugaauuaugaa

SEQ ID NO: 2959883 - RNA, 14 nt, Human
acugaauuaugaaa

SEQ ID NO: 2959884 - RNA, 15 nt, Human
acugaauuaugaaac

SEQ ID NO: 2959885 - RNA, 20 nt, Human
acugaauuaugaaacuuuug

SEQ ID NO: 2959886 - RNA, 12 nt, Human
acugaauuucuu

SEQ ID NO: 2959887 - RNA, 16 nt, Human
acugauuuuuuuuucc

SEQ ID NO: 2959888 - RNA, 20 nt, Human
acugauuuuuuuuuccuuca

SEQ ID NO: 2959889 - RNA, 19 nt, Human
acugauuuuuuuuuccuuc

SEQ ID NO: 2959890 - RNA, 18 nt, Human
acugauuuuuuuuuccuu

SEQ ID NO: 2959891 - RNA, 17 nt, Human
acugauuuuuuuuuccu

SEQ ID NO: 2959892 - RNA, 23 nt, Human
acugaugggcaacccccagccug

SEQ ID NO: 2959893 - RNA, 23 nt, Human
acugaucauguuuaugagaaacu

SEQ ID NO: 2959894 - RNA, 19 nt, Human
acugauaugggucuugaua

SEQ ID NO: 2959895 - RNA, 21 nt, Human
acugaucauguuuaugagaaa

SEQ ID NO: 2959896 - RNA, 15 nt, Human
acucuacagaggcca

SEQ ID NO: 2959897 - RNA, 14 nt, Human
acucguuaauuugu

SEQ ID NO: 2959898 - RNA, 19 nt, Human
acucguuaauuuguagugu

SEQ ID NO: 2959899 - RNA, 19 nt, Human
acuccggcccuccagagcc

SEQ ID NO: 2959900 - RNA, 17 nt, Human
acucccaugagggagau

SEQ ID NO: 2959901 - RNA, 22 nt, Human
acucccaugagggagaugccau

SEQ ID NO: 2959902 - RNA, 23 nt, Human
acucccaugagggagaugccaug

SEQ ID NO: 2959903 - RNA, 22 nt, Human
acucccaucugugaaaggaaag

SEQ ID NO: 2959904 - RNA, 16 nt, Human
acuccggcccuccaga

SEQ ID NO: 2959905 - RNA, 14 nt, Human
acucccuuucaaca

SEQ ID NO: 2959906 - RNA, 18 nt, Human
accgugaggccagagaca

SEQ ID NO: 2959907 - RNA, 23 nt, Human
accgugaggccagagacacaagc

SEQ ID NO: 2959908 - RNA, 12 nt, Human
accucagccucc

SEQ ID NO: 2959909 - RNA, 11 nt, Human
accucagccuc

SEQ ID NO: 2959910 - RNA, 12 nt, Human
accgggcacuca

SEQ ID NO: 2959911 - RNA, 14 nt, Human
accgggcacucaga

SEQ ID NO: 2959912 - RNA, 20 nt, Human
accgggccacagagaaagua

SEQ ID NO: 2959913 - RNA, 16 nt, Human
accgggcacucagaag

SEQ ID NO: 2959914 - RNA, 21 nt, Human
acccugugauggggcccugcc

SEQ ID NO: 2959915 - RNA, 20 nt, Human
acccugugauggggcccugc

SEQ ID NO: 2959916 - RNA, 19 nt, Human
acccugugauggggcccug

SEQ ID NO: 2959917 - RNA, 17 nt, Human
acccugugauggggccc

SEQ ID NO: 2959918 - RNA, 11 nt, Human
accucaggccu

SEQ ID NO: 2959919 - RNA, 20 nt, Human
accucaggugauccacccac

SEQ ID NO: 2959920 - RNA, 21 nt, Human
accucaggugauccacccacc

SEQ ID NO: 2959921 - RNA, 17 nt, Human
acccgucuccagcugcu

SEQ ID NO: 2959922 - RNA, 13 nt, Human
acccuauugcugc

SEQ ID NO: 2959923 - RNA, 19 nt, Human
acccuauugcugcuugagg

SEQ ID NO: 2959924 - RNA, 14 nt, Human
acccuauugcugcu

SEQ ID NO: 2959925 - RNA, 23 nt, Human
acccuggcacuauaauguaagcu

SEQ ID NO: 2959926 - RNA, 22 nt, Human
acccucaugcugccaauauccu

SEQ ID NO: 2959927 - RNA, 16 nt, Human
acccucaugcugccaa

SEQ ID NO: 2959928 - RNA, 14 nt, Human
acccucaugcugcc

SEQ ID NO: 2959929 - RNA, 23 nt, Human
acccucaucaccaacgucugugc

SEQ ID NO: 2959930 - RNA, 13 nt, Human
acccucaucacca

SEQ ID NO: 2959931 - RNA, 16 nt, Human
acccucaggcaggugg

SEQ ID NO: 2959932 - RNA, 15 nt, Human
acccucaggcaggug

SEQ ID NO: 2959933 - RNA, 20 nt, Human
acccucagaugcacaugagc

SEQ ID NO: 2959934 - RNA, 14 nt, Human
acccucaggcaggu

SEQ ID NO: 2959935 - RNA, 13 nt, Human
acccucaggcagg

SEQ ID NO: 2959936 - RNA, 16 nt, Human
acccuggggagaaagu

SEQ ID NO: 2959937 - RNA, 16 nt, Human
acccugugauggggcc

SEQ ID NO: 2959938 - RNA, 21 nt, Human
acccugucucuacuaaaaaua

SEQ ID NO: 2959939 - RNA, 20 nt, Human
acuaauguguaagacaaaaa

SEQ ID NO: 2959940 - RNA, 18 nt, Human
acuaauggggcggugaga

SEQ ID NO: 2959941 - RNA, 17 nt, Human
acggacacucaaaagcu

SEQ ID NO: 2959942 - RNA, 19 nt, Human
acggaauaguuggcuagga

SEQ ID NO: 2959943 - RNA, 13 nt, Human
acgucuuaaauau

SEQ ID NO: 2959944 - RNA, 14 nt, Human
acgucuuaaauauu

SEQ ID NO: 2959945 - RNA, 13 nt, Human
acgucugugccau

SEQ ID NO: 2959946 - RNA, 12 nt, Human
acgucugugcca

SEQ ID NO: 2959947 - RNA, 19 nt, Human
acgcugugcugcccugccc

SEQ ID NO: 2959948 - RNA, 22 nt, Human
acgcugugcugcccugcccacc

SEQ ID NO: 2959949 - RNA, 14 nt, Human
acgcacacugucug

SEQ ID NO: 2959950 - RNA, 20 nt, Human
acgauuucuguuuagauaau

SEQ ID NO: 2959951 - RNA, 23 nt, Human
acgauuucuguuuagauaauaca

SEQ ID NO: 2959952 - RNA, 19 nt, Human
acgauuucuguuuagauaa

SEQ ID NO: 2959953 - RNA, 15 nt, Human
accugccccucaacu

SEQ ID NO: 2959954 - RNA, 12 nt, Human
accugccccuca

SEQ ID NO: 2959955 - RNA, 22 nt, Human
accugccaggaagccagcaggc

SEQ ID NO: 2959956 - RNA, 21 nt, Human
accugccaggaagccagcagg

SEQ ID NO: 2959957 - RNA, 23 nt, Human
accugccaggaagccagcaggcu

SEQ ID NO: 2959958 - RNA, 19 nt, Human
accugccaggaagccagca

SEQ ID NO: 2959959 - RNA, 20 nt, Human
accucugccugaagucacac

SEQ ID NO: 2959960 - RNA, 23 nt, Human
accucugccugaagucacacagu

SEQ ID NO: 2959961 - RNA, 12 nt, Human
accucugccuga

SEQ ID NO: 2959962 - RNA, 20 nt, Human
accucugccucagaaaacaa

SEQ ID NO: 2959963 - RNA, 14 nt, Human
aguuugauuaaauu

SEQ ID NO: 2959964 - RNA, 13 nt, Human
aguuugcagagua

SEQ ID NO: 2959965 - RNA, 11 nt, Human
aguuugcaguu

SEQ ID NO: 2959966 - RNA, 15 nt, Human
auaaaagacagugaa

SEQ ID NO: 2959967 - RNA, 16 nt, Human
auaaaagacagugaaa

SEQ ID NO: 2959968 - RNA, 22 nt, Human
aguuguuagugugucuuagugu

SEQ ID NO: 2959969 - RNA, 17 nt, Human
aguuguuagugugucuu

SEQ ID NO: 2959970 - RNA, 17 nt, Human
aguuguuauuuauugaa

SEQ ID NO: 2959971 - RNA, 17 nt, Human
aguugaaaaacagcuga

SEQ ID NO: 2959972 - RNA, 17 nt, Human
aguugaagacagagcua

SEQ ID NO: 2959973 - RNA, 16 nt, Human
aguugaagacagagcu

SEQ ID NO: 2959974 - RNA, 18 nt, Human
aguugaaaaacagcugag

SEQ ID NO: 2959975 - RNA, 21 nt, Human
aguuccaccaucaagccacca

SEQ ID NO: 2959976 - RNA, 18 nt, Human
aguuccaccaucaagcca

SEQ ID NO: 2959977 - RNA, 14 nt, Human
aguucauacccugu

SEQ ID NO: 2959978 - RNA, 14 nt, Human
agugcuauugcaga

SEQ ID NO: 2959979 - RNA, 17 nt, Human
agugcucacccacacca

SEQ ID NO: 2959980 - RNA, 18 nt, Human
agugcucacccacaccau

SEQ ID NO: 2959981 - RNA, 18 nt, Human
aguguuuucaauuuuaaa

SEQ ID NO: 2959982 - RNA, 16 nt, Human
aguguuuucaauuuua

SEQ ID NO: 2959983 - RNA, 17 nt, Human
auacaccacuacauucu

SEQ ID NO: 2959984 - RNA, 21 nt, Human
auaaagaugagugagcaugcc

SEQ ID NO: 2959985 - RNA, 14 nt, Human
auaagcuacugcca

SEQ ID NO: 2959986 - RNA, 16 nt, Human
auaagcuacugccauc

SEQ ID NO: 2959987 - RNA, 21 nt, Human
auaagugcuauugcagagccg

SEQ ID NO: 2959988 - RNA, 12 nt, Human
auaauguuaaca

SEQ ID NO: 2959989 - RNA, 23 nt, Human
auacaaugcugugcccuaaagug

SEQ ID NO: 2959990 - RNA, 20 nt, Human
auacacacucaaaucaagaa

SEQ ID NO: 2959991 - RNA, 15 nt, Human
auacaccacuacauu

SEQ ID NO: 2959992 - RNA, 17 nt, Human
aguaacuuacuuaggug

SEQ ID NO: 2959993 - RNA, 21 nt, Human
aguaaaugggggugcauuuga

SEQ ID NO: 2959994 - RNA, 19 nt, Human
aguaaaugggggugcauuu

SEQ ID NO: 2959995 - RNA, 20 nt, Human
aguaaaugggggugcauuug

SEQ ID NO: 2959996 - RNA, 18 nt, Human
aguaaaugggggugcauu

SEQ ID NO: 2959997 - RNA, 20 nt, Human
aguacuucuccacccugcuc

SEQ ID NO: 2959998 - RNA, 19 nt, Human
aguacuucuccacccugcu

SEQ ID NO: 2959999 - RNA, 21 nt, Human
aguacuucuccacccugcucu

SEQ ID NO: 2960000 - RNA, 15 nt, Human
aguacuggagaaaau

SEQ ID NO: 2960001 - RNA, 13 nt, Human
aguacucauacau

SEQ ID NO: 2960002 - RNA, 17 nt, Human
aguaucaaguauagaaa

SEQ ID NO: 2960003 - RNA, 16 nt, Human
aguaucaaguauagaa

SEQ ID NO: 2960004 - RNA, 21 nt, Human
agucugauucccaagcucugc

SEQ ID NO: 2960005 - RNA, 22 nt, Human
agucugauucccaagcucugcu

SEQ ID NO: 2960006 - RNA, 20 nt, Human
agucugauucccaagcucug

SEQ ID NO: 2960007 - RNA, 11 nt, Human
agucugauuua

SEQ ID NO: 2960008 - RNA, 18 nt, Human
agucuggaaugcaguggu

SEQ ID NO: 2960009 - RNA, 12 nt, Human
agucugauuuaa

SEQ ID NO: 2960010 - RNA, 16 nt, Human
agucgaggacagggag

SEQ ID NO: 2960011 - RNA, 22 nt, Human
agucuggcagacuuucuucucu

SEQ ID NO: 2960012 - RNA, 18 nt, Human
agucuggcccuuccuuuu

SEQ ID NO: 2960013 - RNA, 14 nt, Human
aguccucuuuucug

SEQ ID NO: 2960014 - RNA, 18 nt, Human
aguccuuaccagcagagc

SEQ ID NO: 2960015 - RNA, 16 nt, Human
aguccuuaccagcaga

SEQ ID NO: 2960016 - RNA, 13 nt, Human
agucauuuaauaa

SEQ ID NO: 2960017 - RNA, 16 nt, Human
agugacagaggcagcc

SEQ ID NO: 2960018 - RNA, 19 nt, Human
agugacagaggcagcccca

SEQ ID NO: 2960019 - RNA, 17 nt, Human
agugaauaaccugagga

SEQ ID NO: 2960020 - RNA, 14 nt, Human
agugacagaggcag

SEQ ID NO: 2960021 - RNA, 22 nt, Human
agugcuacacaccuaacuuaug

SEQ ID NO: 2960022 - RNA, 19 nt, Human
agugauucuccugccucag

SEQ ID NO: 2960023 - RNA, 18 nt, Human
agugauucuccugccuca

SEQ ID NO: 2960024 - RNA, 20 nt, Human
agugauucuccugccucagc

SEQ ID NO: 2960025 - RNA, 18 nt, Human
agugccuuauggaacacu

SEQ ID NO: 2960026 - RNA, 22 nt, Human
agugccuuauggaacacucuga

SEQ ID NO: 2960027 - RNA, 21 nt, Human
agugccuuauggaacacucug

SEQ ID NO: 2960028 - RNA, 20 nt, Human
agugccuuauggaacacucu

SEQ ID NO: 2960029 - RNA, 19 nt, Human
agugccuuauggaacacuc

SEQ ID NO: 2960030 - RNA, 19 nt, Human
agugauccucccaccucag

SEQ ID NO: 2960031 - RNA, 20 nt, Human
agugauccucccaccucagc

SEQ ID NO: 2960032 - RNA, 22 nt, Human
agugauccucccaccucagccu

SEQ ID NO: 2960033 - RNA, 19 nt, Human
agugaugucacuagggcag

SEQ ID NO: 2960034 - RNA, 18 nt, Human
agugauguaauuaugguu

SEQ ID NO: 2960035 - RNA, 13 nt, Human
agugauuaccagg

SEQ ID NO: 2960036 - RNA, 14 nt, Human
aucaugcauagagu

SEQ ID NO: 2960037 - RNA, 15 nt, Human
aucaugcauagagug

SEQ ID NO: 2960038 - RNA, 15 nt, Human
aucauccuaagcuau

SEQ ID NO: 2960039 - RNA, 15 nt, Human
aucaucccuuucccu

SEQ ID NO: 2960040 - RNA, 19 nt, Human
aucaucccuuucccuuggu

SEQ ID NO: 2960041 - RNA, 21 nt, Human
aucaugaauuaguuuuauaug

SEQ ID NO: 2960042 - RNA, 20 nt, Human
aucaugacaaagacugagua

SEQ ID NO: 2960043 - RNA, 21 nt, Human
auccacuggguguaaacacau

SEQ ID NO: 2960044 - RNA, 21 nt, Human
auccacugugccaugugccag

SEQ ID NO: 2960045 - RNA, 20 nt, Human
auccacuggguguaaacaca

SEQ ID NO: 2960046 - RNA, 12 nt, Human
auccuugaagau

SEQ ID NO: 2960047 - RNA, 22 nt, Human
aucuaggaagacuuuggaaaga

SEQ ID NO: 2960048 - RNA, 16 nt, Human
auagcaagacauuaua

SEQ ID NO: 2960049 - RNA, 14 nt, Human
auagcacagacccu

SEQ ID NO: 2960050 - RNA, 20 nt, Human
aucaaaagguuaauaaagua

SEQ ID NO: 2960051 - RNA, 19 nt, Human
aucaaagagguuuuaaaaa

SEQ ID NO: 2960052 - RNA, 14 nt, Human
auauuuuuuucuga

SEQ ID NO: 2960053 - RNA, 16 nt, Human
auauuuuuuucugaaa

SEQ ID NO: 2960054 - RNA, 18 nt, Human
auauuuuuuucugaaauu

SEQ ID NO: 2960055 - RNA, 18 nt, Human
auauuuuuuucuuuucuu

SEQ ID NO: 2960056 - RNA, 14 nt, Human
aucaaaagaaagaa

SEQ ID NO: 2960057 - RNA, 19 nt, Human
auauuuuuuucugaaauuu

SEQ ID NO: 2960058 - RNA, 23 nt, Human
augaagcauuuacuuuguguuca

SEQ ID NO: 2960059 - RNA, 16 nt, Human
augaaacuuuuggaag

SEQ ID NO: 2960060 - RNA, 12 nt, Human
augaaagacugu

SEQ ID NO: 2960061 - RNA, 23 nt, Human
augaaguaauaugcacacauuuu

SEQ ID NO: 2960062 - RNA, 14 nt, Human
augaaguaauaugc

SEQ ID NO: 2960063 - RNA, 21 nt, Human
augaaguaauaugcacacauu

SEQ ID NO: 2960064 - RNA, 23 nt, Human
augagcuuaagaaauuuguggaa

SEQ ID NO: 2960065 - RNA, 14 nt, Human
augagcuuaagaaa

SEQ ID NO: 2960066 - RNA, 21 nt, Human
augagccucagcauccuggca

SEQ ID NO: 2960067 - RNA, 19 nt, Human
augagccucagcauccugg

SEQ ID NO: 2960068 - RNA, 11 nt, Human
augagccuggc

SEQ ID NO: 2960069 - RNA, 13 nt, Human
augaccuuucaau

SEQ ID NO: 2960070 - RNA, 18 nt, Human
augaccuuucaauaggaa

SEQ ID NO: 2960071 - RNA, 15 nt, Human
augaccuuucaauag

SEQ ID NO: 2960072 - RNA, 23 nt, Human
aucuaggaagacuuuggaaagag

SEQ ID NO: 2960073 - RNA, 16 nt, Human
augcauagagugugau

SEQ ID NO: 2960074 - RNA, 21 nt, Human
augccugguggcagcugcggu

SEQ ID NO: 2960075 - RNA, 11 nt, Human
augccuggugg

SEQ ID NO: 2960076 - RNA, 12 nt, Human
augccugguggc

SEQ ID NO: 2960077 - RNA, 13 nt, Human
augccugguggca

SEQ ID NO: 2960078 - RNA, 14 nt, Human
augccugguggcag

SEQ ID NO: 2960079 - RNA, 19 nt, Human
augccugguggcagcugcg

SEQ ID NO: 2960080 - RNA, 18 nt, Human
augccugguggcagcugc

SEQ ID NO: 2960081 - RNA, 16 nt, Human
augcuuugaucccuuc

SEQ ID NO: 2960082 - RNA, 18 nt, Human
augcucugcauguuacau

SEQ ID NO: 2960083 - RNA, 19 nt, Human
augcucugcauguuacaua

SEQ ID NO: 2960084 - RNA, 21 nt, Human
augcuucuguuuuauaauuuu

SEQ ID NO: 2960085 - RNA, 20 nt, Human
augcuucuucagagacuccu

SEQ ID NO: 2960086 - RNA, 17 nt, Human
augcuucuucagagacu

SEQ ID NO: 2960087 - RNA, 14 nt, Human
augcuucuucagag

SEQ ID NO: 2960088 - RNA, 15 nt, Human
augggacagggagga

SEQ ID NO: 2960089 - RNA, 20 nt, Human
augggacauuugcucaugga

SEQ ID NO: 2960090 - RNA, 21 nt, Human
augggaaugaaugucagugug

SEQ ID NO: 2960091 - RNA, 20 nt, Human
augggaaagcauuguaaaug

SEQ ID NO: 2960092 - RNA, 14 nt, Human
augggaaagcauug

SEQ ID NO: 2960093 - RNA, 18 nt, Human
auggauaaauauugguug

SEQ ID NO: 2960094 - RNA, 23 nt, Human
auggcuuccuggcaauagucaaa

SEQ ID NO: 2960095 - RNA, 12 nt, Human
aggccagcugcu

SEQ ID NO: 2960096 - RNA, 23 nt, Human
aggcauuccccaggaggccagcc

SEQ ID NO: 2960097 - RNA, 22 nt, Human
aggcauuccccaggaggccagc

SEQ ID NO: 2960098 - RNA, 21 nt, Human
aggcauuccccaggaggccag

SEQ ID NO: 2960099 - RNA, 20 nt, Human
aggcauguucucugaggaca

SEQ ID NO: 2960100 - RNA, 22 nt, Human
aggcauguucucugaggacacu

SEQ ID NO: 2960101 - RNA, 24 nt, Human
aggcaugugaugagaggaaaucac

SEQ ID NO: 2960102 - RNA, 23 nt, Human
aggcaugugaugagaggaaauca

SEQ ID NO: 2960103 - RNA, 14 nt, Human
aggccaugggccuc

SEQ ID NO: 2960104 - RNA, 16 nt, Human
aggccaugggccuccu

SEQ ID NO: 2960105 - RNA, 17 nt, Human
aggccaugggccuccug

SEQ ID NO: 2960106 - RNA, 17 nt, Human
aggcccucugcccacuc

SEQ ID NO: 2960107 - RNA, 20 nt, Human
aggccaggcgcgguggcuca

SEQ ID NO: 2960108 - RNA, 23 nt, Human
aggccaugggcacuguggguaga

SEQ ID NO: 2960109 - RNA, 23 nt, Human
aggccaggcccucugcccacucc

SEQ ID NO: 2960110 - RNA, 19 nt, Human
aggccaggcccucugccca

SEQ ID NO: 2960111 - RNA, 18 nt, Human
aggccaggcccucugccc

SEQ ID NO: 2960112 - RNA, 17 nt, Human
aggccaggcccucugcc

SEQ ID NO: 2960113 - RNA, 16 nt, Human
aggccaggcccucugc

SEQ ID NO: 2960114 - RNA, 16 nt, Human
aggccagcugcuuggg

SEQ ID NO: 2960115 - RNA, 14 nt, Human
aggccagcugcuug

SEQ ID NO: 2960116 - RNA, 13 nt, Human
aggccagcugcuu

SEQ ID NO: 2960117 - RNA, 15 nt, Human
aggcacuuuaaaaca

SEQ ID NO: 2960118 - RNA, 14 nt, Human
aggcagccaggcca

SEQ ID NO: 2960119 - RNA, 16 nt, Human
aggcagccaggccaca

SEQ ID NO: 2960120 - RNA, 15 nt, Human
aggcagccaggccac

SEQ ID NO: 2960121 - RNA, 13 nt, Human
aggcagauacagg

SEQ ID NO: 2960122 - RNA, 20 nt, Human
aggcagagguugcagugagc

SEQ ID NO: 2960123 - RNA, 19 nt, Human
aggaaguacuggagaaaau

SEQ ID NO: 2960124 - RNA, 14 nt, Human
aggaggucucuaag

SEQ ID NO: 2960125 - RNA, 22 nt, Human
aggagguaaugaccaugaaaga

SEQ ID NO: 2960126 - RNA, 15 nt, Human
aggaggucucuaaga

SEQ ID NO: 2960127 - RNA, 12 nt, Human
aggagugagcac

SEQ ID NO: 2960128 - RNA, 14 nt, Human
aggagugagcacua

SEQ ID NO: 2960129 - RNA, 23 nt, Human
aggcuguaucccaugagccucag

SEQ ID NO: 2960130 - RNA, 19 nt, Human
aggcugcagugagccgaga

SEQ ID NO: 2960131 - RNA, 17 nt, Human
aggcugcagugagccga

SEQ ID NO: 2960132 - RNA, 12 nt, Human
aggcugucaauu

SEQ ID NO: 2960133 - RNA, 11 nt, Human
aggcugccagu

SEQ ID NO: 2960134 - RNA, 13 nt, Human
aggcugccagugc

SEQ ID NO: 2960135 - RNA, 24 nt, Human
aggcuguaucccaugagccucagc

SEQ ID NO: 2960136 - RNA, 12 nt, Human
aggcuuagaccc

SEQ ID NO: 2960137 - RNA, 21 nt, Human
aggcuuagacccucaugcugc

SEQ ID NO: 2960138 - RNA, 14 nt, Human
aggcuuagacccuc

SEQ ID NO: 2960139 - RNA, 22 nt, Human
aggcuuagacccucaugcugcc

SEQ ID NO: 2960140 - RNA, 23 nt, Human
aggcuuagacccucaugcugcca

SEQ ID NO: 2960141 - RNA, 17 nt, Human
agggacaggauaagagg

SEQ ID NO: 2960142 - RNA, 20 nt, Human
aggcccucugcccacucccu

SEQ ID NO: 2960143 - RNA, 19 nt, Human
aggcccucugcccacuccc

SEQ ID NO: 2960144 - RNA, 18 nt, Human
agggccuggccugagcug

SEQ ID NO: 2960145 - RNA, 14 nt, Human
agggccuggcucag

SEQ ID NO: 2960146 - RNA, 13 nt, Human
agggccuggcuca

SEQ ID NO: 2960147 - RNA, 18 nt, Human
agggccuggcucaggugg

SEQ ID NO: 2960148 - RNA, 20 nt, Human
agggauuagggagagaagau

SEQ ID NO: 2960149 - RNA, 15 nt, Human
aggaaguacuggaga

SEQ ID NO: 2960150 - RNA, 11 nt, Human
aggaaguacug

SEQ ID NO: 2960151 - RNA, 14 nt, Human
aggaagguagaaau

SEQ ID NO: 2960152 - RNA, 23 nt, Human
aggaacaaggcaaggcugucaau

SEQ ID NO: 2960153 - RNA, 12 nt, Human
aggaacacuccu

SEQ ID NO: 2960154 - RNA, 23 nt, Human
aggaacuuaaauaaugugaaacu

SEQ ID NO: 2960155 - RNA, 15 nt, Human
aggaacacuccuuca

SEQ ID NO: 2960156 - RNA, 21 nt, Human
agcuuuguuuguugucagcug

SEQ ID NO: 2960157 - RNA, 23 nt, Human
agcuuuuuucucugauacagaaa

SEQ ID NO: 2960158 - RNA, 19 nt, Human
agcuuuuuucucugauaca

SEQ ID NO: 2960159 - RNA, 20 nt, Human
agcuuuuuucucugauacag

SEQ ID NO: 2960160 - RNA, 22 nt, Human
agcuuuuuucucugauacagaa

SEQ ID NO: 2960161 - RNA, 18 nt, Human
aggaaaaaauaacaauga

SEQ ID NO: 2960162 - RNA, 17 nt, Human
agcuguaugauucccag

SEQ ID NO: 2960163 - RNA, 18 nt, Human
agcuguaugauucccagc

SEQ ID NO: 2960164 - RNA, 22 nt, Human
agcucaccagccccagugccca

SEQ ID NO: 2960165 - RNA, 23 nt, Human
agcucaccagccccagugcccac

SEQ ID NO: 2960166 - RNA, 21 nt, Human
agcugacuuuucuguccgagc

SEQ ID NO: 2960167 - RNA, 15 nt, Human
agcugacuuuucugu

SEQ ID NO: 2960168 - RNA, 15 nt, Human
agcuggucccacuca

SEQ ID NO: 2960169 - RNA, 14 nt, Human
agcuguaugauucc

SEQ ID NO: 2960170 - RNA, 22 nt, Human
agcugccuguucagcuccagcu

SEQ ID NO: 2960171 - RNA, 20 nt, Human
agcugcugaaacaacaaaua

SEQ ID NO: 2960172 - RNA, 16 nt, Human
agcugcugaaacaaca

SEQ ID NO: 2960173 - RNA, 15 nt, Human
agcugcugaaacaac

SEQ ID NO: 2960174 - RNA, 14 nt, Human
agcugcugaaacaa

SEQ ID NO: 2960175 - RNA, 10 nt, Human
agccuggaug

SEQ ID NO: 2960176 - RNA, 11 nt, Human
agccuggaugc

SEQ ID NO: 2960177 - RNA, 13 nt, Human
agccuggaugcca

SEQ ID NO: 2960178 - RNA, 15 nt, Human
agccuggaugccauc

SEQ ID NO: 2960179 - RNA, 16 nt, Human
agccuggaugccaucc

SEQ ID NO: 2960180 - RNA, 14 nt, Human
agccuggacccugu

SEQ ID NO: 2960181 - RNA, 20 nt, Human
agccugggaggucaaggcug

SEQ ID NO: 2960182 - RNA, 21 nt, Human
agccugggcaacagagcaaga

SEQ ID NO: 2960183 - RNA, 18 nt, Human
agccugggcaaugugaua

SEQ ID NO: 2960184 - RNA, 20 nt, Human
agcuaacauggaaguacuau

SEQ ID NO: 2960185 - RNA, 16 nt, Human
agcuaaagaaguuuga

SEQ ID NO: 2960186 - RNA, 19 nt, Human
agcuaacauggaaguacua

SEQ ID NO: 2960187 - RNA, 17 nt, Human
agcgauucuucugcuuc

SEQ ID NO: 2960188 - RNA, 19 nt, Human
agcgauucuucugcuucag

SEQ ID NO: 2960189 - RNA, 15 nt, Human
agcgauucuucugcu

SEQ ID NO: 2960190 - RNA, 13 nt, Human
agcgacagugaga

SEQ ID NO: 2960191 - RNA, 15 nt, Human
agcgacagugagacu

SEQ ID NO: 2960192 - RNA, 13 nt, Human
agcuaaugggaca

SEQ ID NO: 2960193 - RNA, 14 nt, Human
agcuaaugggacac

SEQ ID NO: 2960194 - RNA, 15 nt, Human
agcuaaugggacacu

SEQ ID NO: 2960195 - RNA, 12 nt, Human
agcuacaaaugc

SEQ ID NO: 2960196 - RNA, 13 nt, Human
agcucaccagccc

SEQ ID NO: 2960197 - RNA, 14 nt, Human
agcucaccagcccc

SEQ ID NO: 2960198 - RNA, 21 nt, Human
agcucaccagccccagugccc

SEQ ID NO: 2960199 - RNA, 13 nt, Human
agcuacaaaugca

SEQ ID NO: 2960200 - RNA, 18 nt, Human
agagaaaguacuucucca

SEQ ID NO: 2960201 - RNA, 17 nt, Human
agagcccacgcccccac

SEQ ID NO: 2960202 - RNA, 18 nt, Human
agagcccacgcccccacu

SEQ ID NO: 2960203 - RNA, 23 nt, Human
agagagcaagacgcugugcugcc

SEQ ID NO: 2960204 - RNA, 19 nt, Human
agagagcaagacgcugugc

SEQ ID NO: 2960205 - RNA, 11 nt, Human
agagagcaaga

SEQ ID NO: 2960206 - RNA, 16 nt, Human
agacucuuuggacacu

SEQ ID NO: 2960207 - RNA, 23 nt, Human
agacagcccgggcucugccuccc

SEQ ID NO: 2960208 - RNA, 22 nt, Human
agacagcccgggcucugccucc

SEQ ID NO: 2960209 - RNA, 14 nt, Human
agacaauuuauuau

SEQ ID NO: 2960210 - RNA, 21 nt, Human
agacagcccgggcucugccuc

SEQ ID NO: 2960211 - RNA, 19 nt, Human
agaccauuggggcucccag

SEQ ID NO: 2960212 - RNA, 20 nt, Human
agaccauuggggcucccagc

SEQ ID NO: 2960213 - RNA, 22 nt, Human
agaccauuggggcucccagcca

SEQ ID NO: 2960214 - RNA, 23 nt, Human
agaccauuggggcucccagccag

SEQ ID NO: 2960215 - RNA, 23 nt, Human
agaccaucccugaaggccccgcc

SEQ ID NO: 2960216 - RNA, 14 nt, Human
agaccacguuucua

SEQ ID NO: 2960217 - RNA, 15 nt, Human
agaccauccuggcua

SEQ ID NO: 2960218 - RNA, 18 nt, Human
agaccauuggggcuccca

SEQ ID NO: 2960219 - RNA, 17 nt, Human
agacgcugugcugcccu

SEQ ID NO: 2960220 - RNA, 19 nt, Human
agacgcugugcugcccugc

SEQ ID NO: 2960221 - RNA, 18 nt, Human
agacgcugugcugcccug

SEQ ID NO: 2960222 - RNA, 20 nt, Human
agacgcugugcugcccugcc

SEQ ID NO: 2960223 - RNA, 20 nt, Human
agacaaugugaaaagaaaaa

SEQ ID NO: 2960224 - RNA, 23 nt, Human
agacaaugacuuacuguacauga

SEQ ID NO: 2960225 - RNA, 19 nt, Human
agacaaggaaaaaauaaca

SEQ ID NO: 2960226 - RNA, 13 nt, Human
agaagagcuguuc

SEQ ID NO: 2960227 - RNA, 23 nt, Human
agaagagaaugcacaaacagagg

SEQ ID NO: 2960228 - RNA, 15 nt, Human
agaagagaaugcaca

SEQ ID NO: 2960229 - RNA, 13 nt, Human
agaagauagcagg

SEQ ID NO: 2960230 - RNA, 20 nt, Human
agaagagcuguucacagcca

SEQ ID NO: 2960231 - RNA, 21 nt, Human
agaaccaaaaagaggcuaugu

SEQ ID NO: 2960232 - RNA, 18 nt, Human
agaagacugcauuauauu

SEQ ID NO: 2960233 - RNA, 21 nt, Human
agaagacugcauuauauuuau

SEQ ID NO: 2960234 - RNA, 18 nt, Human
agaagucuucuauuuauu

SEQ ID NO: 2960235 - RNA, 17 nt, Human
agaagucuuagauguau

SEQ ID NO: 2960236 - RNA, 19 nt, Human
agaagucuuagauguauau

SEQ ID NO: 2960237 - RNA, 14 nt, Human
agaagucacacagu

SEQ ID NO: 2960238 - RNA, 19 nt, Human
agaagucaaggcuuagacc

SEQ ID NO: 2960239 - RNA, 18 nt, Human
agaagucaaggcuuagac

SEQ ID NO: 2960240 - RNA, 17 nt, Human
agaagucaaggcuuaga

SEQ ID NO: 2960241 - RNA, 16 nt, Human
agaagucaaggcuuag

SEQ ID NO: 2960242 - RNA, 23 nt, Human
agaaugcacaaacagaggccgcc

SEQ ID NO: 2960243 - RNA, 23 nt, Human
agaaugcaguacuaacauuuauu

SEQ ID NO: 2960244 - RNA, 18 nt, Human
agaaugcucuuuacuuca

SEQ ID NO: 2960245 - RNA, 16 nt, Human
agaaugaaagggccca

SEQ ID NO: 2960246 - RNA, 17 nt, Human
agaaucucaaauaacua

SEQ ID NO: 2960247 - RNA, 18 nt, Human
agaaccaaaaagaggcua

SEQ ID NO: 2960248 - RNA, 17 nt, Human
agaaccaaaaagaggcu

SEQ ID NO: 2960249 - RNA, 22 nt, Human
agaacagugauuaccagggacu

SEQ ID NO: 2960250 - RNA, 13 nt, Human
agcaaaucaguuu

SEQ ID NO: 2960251 - RNA, 19 nt, Human
agcaaauucuguuuuucua

SEQ ID NO: 2960252 - RNA, 20 nt, Human
agcaaaguagaucaugcaua

SEQ ID NO: 2960253 - RNA, 14 nt, Human
agauugcucaaauc

SEQ ID NO: 2960254 - RNA, 16 nt, Human
agauugcucaaaucag

SEQ ID NO: 2960255 - RNA, 17 nt, Human
agauugcaacaggcugg

SEQ ID NO: 2960256 - RNA, 19 nt, Human
agauugcaacaggcugggc

SEQ ID NO: 2960257 - RNA, 16 nt, Human
agauugcaccacugca

SEQ ID NO: 2960258 - RNA, 21 nt, Human
agauucuauguuaauauuuua

SEQ ID NO: 2960259 - RNA, 16 nt, Human
agauucuuuccugagg

SEQ ID NO: 2960260 - RNA, 15 nt, Human
agauucuuuccugag

SEQ ID NO: 2960261 - RNA, 16 nt, Human
agauugcaacaggcug

SEQ ID NO: 2960262 - RNA, 23 nt, Human
agaugacauugacuauuuuuguu

SEQ ID NO: 2960263 - RNA, 18 nt, Human
agaugacauugacuauuu

SEQ ID NO: 2960264 - RNA, 15 nt, Human
agaugaaugucaguu

SEQ ID NO: 2960265 - RNA, 18 nt, Human
agaugacaucugucuagg

SEQ ID NO: 2960266 - RNA, 11 nt, Human
agaugaauguc

SEQ ID NO: 2960267 - RNA, 22 nt, Human
agaugggugcuuggaggaagga

SEQ ID NO: 2960268 - RNA, 20 nt, Human
agaugggugcuuggaggaag

SEQ ID NO: 2960269 - RNA, 18 nt, Human
agauucuauguuaauauu

SEQ ID NO: 2960270 - RNA, 14 nt, Human
agauucuuuccuga

SEQ ID NO: 2960271 - RNA, 20 nt, Human
agagggucugaggaauccag

SEQ ID NO: 2960272 - RNA, 23 nt, Human
agaggggguggccucccaacuca

SEQ ID NO: 2960273 - RNA, 15 nt, Human
agaguugaagacaga

SEQ ID NO: 2960274 - RNA, 14 nt, Human
agaguugaagacag

SEQ ID NO: 2960275 - RNA, 13 nt, Human
agaguugaagaca

SEQ ID NO: 2960276 - RNA, 20 nt, Human
agauagccaaggccaaagga

SEQ ID NO: 2960277 - RNA, 20 nt, Human
agauagauaggucagugcaa

SEQ ID NO: 2960278 - RNA, 15 nt, Human
agauaugauucaaau

SEQ ID NO: 2960279 - RNA, 16 nt, Human
agauaugauucaaaug

SEQ ID NO: 2960280 - RNA, 14 nt, Human
agauaugauucaaa

SEQ ID NO: 2960281 - RNA, 16 nt, Human
agcaucuaugugagac

SEQ ID NO: 2960282 - RNA, 22 nt, Human
agccagauuucacucuccuugg

SEQ ID NO: 2960283 - RNA, 20 nt, Human
agccagauuucacucuccuu

SEQ ID NO: 2960284 - RNA, 17 nt, Human
agccagauuucacucuc

SEQ ID NO: 2960285 - RNA, 14 nt, Human
agccagauuucacu

SEQ ID NO: 2960286 - RNA, 13 nt, Human
agcccaccuuggc

SEQ ID NO: 2960287 - RNA, 23 nt, Human
agcccaccccucaacaccucugc

SEQ ID NO: 2960288 - RNA, 19 nt, Human
agcccacgcccccacuggu

SEQ ID NO: 2960289 - RNA, 15 nt, Human
agcccacgcccccac

SEQ ID NO: 2960290 - RNA, 18 nt, Human
agcccacgcccccacugg

SEQ ID NO: 2960291 - RNA, 17 nt, Human
agcccacgcccccacug

SEQ ID NO: 2960292 - RNA, 19 nt, Human
agccauuugucccaagugc

SEQ ID NO: 2960293 - RNA, 14 nt, Human
agccagcaguucag

SEQ ID NO: 2960294 - RNA, 23 nt, Human
agccagcaggcucucaggccagc

SEQ ID NO: 2960295 - RNA, 21 nt, Human
agccagcaggcucucaggcca

SEQ ID NO: 2960296 - RNA, 22 nt, Human
agccagcaggcucucaggccag

SEQ ID NO: 2960297 - RNA, 20 nt, Human
agcacuaaggugugcucuga

SEQ ID NO: 2960298 - RNA, 21 nt, Human
agcacagacccugcccugugg

SEQ ID NO: 2960299 - RNA, 17 nt, Human
agcagugcaugcugucc

SEQ ID NO: 2960300 - RNA, 20 nt, Human
agcagccuggacccugugga

SEQ ID NO: 2960301 - RNA, 18 nt, Human
agcagcguuucuaugaca

SEQ ID NO: 2960302 - RNA, 19 nt, Human
agcagcguuucuaugacac

SEQ ID NO: 2960303 - RNA, 16 nt, Human
agcagugcaugcuguc

SEQ ID NO: 2960304 - RNA, 13 nt, Human
agcagugcaugcu

SEQ ID NO: 2960305 - RNA, 17 nt, Human
agcacugacuucuaagu

SEQ ID NO: 2960306 - RNA, 19 nt, Human
agcacugacuucuaaguaa

SEQ ID NO: 2960307 - RNA, 16 nt, Human
agcagccuggacccug

SEQ ID NO: 2960308 - RNA, 14 nt, Human
caaagaaauguaag

SEQ ID NO: 2960309 - RNA, 21 nt, Human
caaagagguuuuaaaaaaauc

SEQ ID NO: 2960310 - RNA, 14 nt, Human
caaagagguuuuaa

SEQ ID NO: 2960311 - RNA, 18 nt, Human
auuuuaauaauguuucaa

SEQ ID NO: 2960312 - RNA, 19 nt, Human
auuuuaauaauguuucaaa

SEQ ID NO: 2960313 - RNA, 16 nt, Human
auuuuaauaauguuuc

SEQ ID NO: 2960314 - RNA, 16 nt, Human
caaauguuuauuuaaa

SEQ ID NO: 2960315 - RNA, 17 nt, Human
caaauguuuauuuaaaa

SEQ ID NO: 2960316 - RNA, 18 nt, Human
caaauguuuauuuaaaag

SEQ ID NO: 2960317 - RNA, 20 nt, Human
caaaggguaucaggugcugc

SEQ ID NO: 2960318 - RNA, 21 nt, Human
caaaggguaucaggugcugcc

SEQ ID NO: 2960319 - RNA, 23 nt, Human
caaaggguaucaggugcugccau

SEQ ID NO: 2960320 - RNA, 17 nt, Human
caaaguggugagaggca

SEQ ID NO: 2960321 - RNA, 16 nt, Human
caaaguggugagaggc

SEQ ID NO: 2960322 - RNA, 20 nt, Human
caaaggagauuggaaggaac

SEQ ID NO: 2960323 - RNA, 14 nt, Human
caaaggagauugga

SEQ ID NO: 2960324 - RNA, 20 nt, Human
caacaggcugggcuucagug

SEQ ID NO: 2960325 - RNA, 14 nt, Human
caagugagacccug

SEQ ID NO: 2960326 - RNA, 23 nt, Human
caagugaaaaaggaggaagagaa

SEQ ID NO: 2960327 - RNA, 15 nt, Human
caagguuuaaguuau

SEQ ID NO: 2960328 - RNA, 17 nt, Human
caagguuuaaguuauua

SEQ ID NO: 2960329 - RNA, 22 nt, Human
caagugaaaaaggaggaagaga

SEQ ID NO: 2960330 - RNA, 19 nt, Human
caagugauucuccugccuc

SEQ ID NO: 2960331 - RNA, 18 nt, Human
caagugauucuccugccu

SEQ ID NO: 2960332 - RNA, 19 nt, Human
caagugagacccugucuca

SEQ ID NO: 2960333 - RNA, 15 nt, Human
caagugagacccugu

SEQ ID NO: 2960334 - RNA, 20 nt, Human
caagugauucuccugccuca

SEQ ID NO: 2960335 - RNA, 21 nt, Human
caaggggaauguuugccucug

SEQ ID NO: 2960336 - RNA, 15 nt, Human
caagggccuggccug

SEQ ID NO: 2960337 - RNA, 14 nt, Human
caagggccuggccu

SEQ ID NO: 2960338 - RNA, 13 nt, Human
caagggccuggcc

SEQ ID NO: 2960339 - RNA, 23 nt, Human
caaggggaauguuugccucugcc

SEQ ID NO: 2960340 - RNA, 13 nt, Human
caaggucauuuuu

SEQ ID NO: 2960341 - RNA, 14 nt, Human
caaggcugucaauu

SEQ ID NO: 2960342 - RNA, 13 nt, Human
caaggcugucaau

SEQ ID NO: 2960343 - RNA, 21 nt, Human
caaggcugggggaagaagcuc

SEQ ID NO: 2960344 - RNA, 17 nt, Human
caaggauccugagccag

SEQ ID NO: 2960345 - RNA, 16 nt, Human
caaggauccugagcca

SEQ ID NO: 2960346 - RNA, 15 nt, Human
caaggauccugagcc

SEQ ID NO: 2960347 - RNA, 14 nt, Human
caaggauccugagc

SEQ ID NO: 2960348 - RNA, 16 nt, Human
caagcauuuagaugua

SEQ ID NO: 2960349 - RNA, 19 nt, Human
caagcauuuagauguauag

SEQ ID NO: 2960350 - RNA, 15 nt, Human
caagcauguauuuuu

SEQ ID NO: 2960351 - RNA, 21 nt, Human
caagcauguauuuuugucaau

SEQ ID NO: 2960352 - RNA, 21 nt, Human
caagcauaccaacacgagcag

SEQ ID NO: 2960353 - RNA, 16 nt, Human
caagcauaccaacacg

SEQ ID NO: 2960354 - RNA, 17 nt, Human
caagagcccaggccucc

SEQ ID NO: 2960355 - RNA, 12 nt, Human
caagagggucug

SEQ ID NO: 2960356 - RNA, 16 nt, Human
caagagggucugagga

SEQ ID NO: 2960357 - RNA, 17 nt, Human
caagagggucugaggaa

SEQ ID NO: 2960358 - RNA, 23 nt, Human
caagacccuuguggucccacccc

SEQ ID NO: 2960359 - RNA, 13 nt, Human
caagaaaugaaag

SEQ ID NO: 2960360 - RNA, 19 nt, Human
caagacugcacaucaaaau

SEQ ID NO: 2960361 - RNA, 22 nt, Human
caagacgcugugcugcccugcc

SEQ ID NO: 2960362 - RNA, 21 nt, Human
caagacgcugugcugcccugc

SEQ ID NO: 2960363 - RNA, 20 nt, Human
caagacgcugugcugcccug

SEQ ID NO: 2960364 - RNA, 19 nt, Human
caagacgcugugcugcccu

SEQ ID NO: 2960365 - RNA, 13 nt, Human
caagaccuucucc

SEQ ID NO: 2960366 - RNA, 13 nt, Human
caacaggcugggc

SEQ ID NO: 2960367 - RNA, 17 nt, Human
caacaggcugggcuuca

SEQ ID NO: 2960368 - RNA, 14 nt, Human
caacaggcugggcu

SEQ ID NO: 2960369 - RNA, 23 nt, Human
caaauuuacagagacagaaagca

SEQ ID NO: 2960370 - RNA, 16 nt, Human
caaauuuacagagaca

SEQ ID NO: 2960371 - RNA, 17 nt, Human
caaauuuacagagacag

SEQ ID NO: 2960372 - RNA, 16 nt, Human
caacauacucccaucu

SEQ ID NO: 2960373 - RNA, 17 nt, Human
caacauaacucaagucu

SEQ ID NO: 2960374 - RNA, 15 nt, Human
caacauacucccauc

SEQ ID NO: 2960375 - RNA, 14 nt, Human
caacauacucccau

SEQ ID NO: 2960376 - RNA, 17 nt, Human
caaccugauugugucuc

SEQ ID NO: 2960377 - RNA, 21 nt, Human
caaccugauugugucucuugg

SEQ ID NO: 2960378 - RNA, 19 nt, Human
caaccugauugugucucuu

SEQ ID NO: 2960379 - RNA, 17 nt, Human
caacugcaucaagaugu

SEQ ID NO: 2960380 - RNA, 23 nt, Human
caacugcaucaagaugugacaug

SEQ ID NO: 2960381 - RNA, 20 nt, Human
caacugcaucaagaugugac

SEQ ID NO: 2960382 - RNA, 23 nt, Human
caacugggguggguggggcagug

SEQ ID NO: 2960383 - RNA, 23 nt, Human
cacaagacccaaaaggcagaagc

SEQ ID NO: 2960384 - RNA, 23 nt, Human
cacaagaaaugaaagcagggacu

SEQ ID NO: 2960385 - RNA, 18 nt, Human
cacaaaguaauuuggaaa

SEQ ID NO: 2960386 - RNA, 17 nt, Human
cacaaagguagcuuuuc

SEQ ID NO: 2960387 - RNA, 15 nt, Human
cacaagaaaugaaag

SEQ ID NO: 2960388 - RNA, 13 nt, Human
cacaagaaaugaa

SEQ ID NO: 2960389 - RNA, 15 nt, Human
caauuaugaaaauaa

SEQ ID NO: 2960390 - RNA, 17 nt, Human
cacaaacgggcucagca

SEQ ID NO: 2960391 - RNA, 15 nt, Human
cacaaacagaggccg

SEQ ID NO: 2960392 - RNA, 11 nt, Human
caauuaugaaa

SEQ ID NO: 2960393 - RNA, 14 nt, Human
caauuaugaaaaua

SEQ ID NO: 2960394 - RNA, 14 nt, Human
caaugcacuuuguu

SEQ ID NO: 2960395 - RNA, 18 nt, Human
caaugguuuucuugugug

SEQ ID NO: 2960396 - RNA, 15 nt, Human
cacacaccagagccc

SEQ ID NO: 2960397 - RNA, 16 nt, Human
cacacaccagagccca

SEQ ID NO: 2960398 - RNA, 20 nt, Human
cacacaccagagcccaccuu

SEQ ID NO: 2960399 - RNA, 14 nt, Human
cacacacuuuggcu

SEQ ID NO: 2960400 - RNA, 21 nt, Human
cacacagaggcugccucuccc

SEQ ID NO: 2960401 - RNA, 17 nt, Human
cacaccgggcacucaga

SEQ ID NO: 2960402 - RNA, 14 nt, Human
cacacccagcccac

SEQ ID NO: 2960403 - RNA, 20 nt, Human
cacacccagcccacuucugc

SEQ ID NO: 2960404 - RNA, 13 nt, Human
cacacagcucugu

SEQ ID NO: 2960405 - RNA, 14 nt, Human
cacacagcucuguc

SEQ ID NO: 2960406 - RNA, 15 nt, Human
cacacagcucugucc

SEQ ID NO: 2960407 - RNA, 21 nt, Human
cacaccagagcccaccuuggc

SEQ ID NO: 2960408 - RNA, 22 nt, Human
cacaccagagcccaccuuggcu

SEQ ID NO: 2960409 - RNA, 13 nt, Human
cacacccagccca

SEQ ID NO: 2960410 - RNA, 20 nt, Human
caaugcaaaccaucauugaa

SEQ ID NO: 2960411 - RNA, 23 nt, Human
caaugcaaaccaucauugaaauc

SEQ ID NO: 2960412 - RNA, 14 nt, Human
caaugcacugacau

SEQ ID NO: 2960413 - RNA, 13 nt, Human
caaugcacuuugu

SEQ ID NO: 2960414 - RNA, 14 nt, Human
caaugcaaaccauc

SEQ ID NO: 2960415 - RNA, 14 nt, Human
caaugauggucacc

SEQ ID NO: 2960416 - RNA, 22 nt, Human
caaugcaaaccaucauugaaau

SEQ ID NO: 2960417 - RNA, 21 nt, Human
caaugcaaaccaucauugaaa

SEQ ID NO: 2960418 - RNA, 13 nt, Human
caaugaccuuuca

SEQ ID NO: 2960419 - RNA, 14 nt, Human
caaugaccuuucaa

SEQ ID NO: 2960420 - RNA, 13 nt, Human
caaugauggucac

SEQ ID NO: 2960421 - RNA, 16 nt, Human
caaugaccuuucaaua

SEQ ID NO: 2960422 - RNA, 15 nt, Human
caaugaccuuucaau

SEQ ID NO: 2960423 - RNA, 21 nt, Human
caauauccuaauaaaaaggug

SEQ ID NO: 2960424 - RNA, 20 nt, Human
caauauccuaauaaaaaggu

SEQ ID NO: 2960425 - RNA, 19 nt, Human
caauauccuaauaaaaagg

SEQ ID NO: 2960426 - RNA, 18 nt, Human
caauauccuaauaaaaag

SEQ ID NO: 2960427 - RNA, 16 nt, Human
caauauccuaauaaaa

SEQ ID NO: 2960428 - RNA, 15 nt, Human
caauauccuaauaaa

SEQ ID NO: 2960429 - RNA, 14 nt, Human
caauauccuaauaa

SEQ ID NO: 2960430 - RNA, 13 nt, Human
caauauccuaaua

SEQ ID NO: 2960431 - RNA, 12 nt, Human
caauauccuaau

SEQ ID NO: 2960432 - RNA, 13 nt, Human
cacccaagggccu

SEQ ID NO: 2960433 - RNA, 19 nt, Human
caccacacccagcccacuu

SEQ ID NO: 2960434 - RNA, 17 nt, Human
caccagagcccaccuug

SEQ ID NO: 2960435 - RNA, 18 nt, Human
caccagagcccaccuugg

SEQ ID NO: 2960436 - RNA, 20 nt, Human
caccagagcccaccuuggcu

SEQ ID NO: 2960437 - RNA, 22 nt, Human
caccagagcccaccuuggcuca

SEQ ID NO: 2960438 - RNA, 15 nt, Human
caccagagcccaccu

SEQ ID NO: 2960439 - RNA, 12 nt, Human
caccaagcccag

SEQ ID NO: 2960440 - RNA, 13 nt, Human
caccaagcccagu

SEQ ID NO: 2960441 - RNA, 17 nt, Human
caccaacgucugugcca

SEQ ID NO: 2960442 - RNA, 22 nt, Human
cacauguccaagaagcccagga

SEQ ID NO: 2960443 - RNA, 21 nt, Human
cacauguccaagaagcccagg

SEQ ID NO: 2960444 - RNA, 19 nt, Human
cacauguccaagaagccca

SEQ ID NO: 2960445 - RNA, 18 nt, Human
cacauguccaagaagccc

SEQ ID NO: 2960446 - RNA, 16 nt, Human
caccaugggauuaaua

SEQ ID NO: 2960447 - RNA, 18 nt, Human
caccaucaugucuggcua

SEQ ID NO: 2960448 - RNA, 15 nt, Human
caccaucaugucugg

SEQ ID NO: 2960449 - RNA, 17 nt, Human
caccaucaugucuggcu

SEQ ID NO: 2960450 - RNA, 24 nt, Human
caccaucaagccaccaacauacuc

SEQ ID NO: 2960451 - RNA, 19 nt, Human
caccaucaagccaccaaca

SEQ ID NO: 2960452 - RNA, 17 nt, Human
caccaucaagccaccaa

SEQ ID NO: 2960453 - RNA, 16 nt, Human
caccaucaagccacca

SEQ ID NO: 2960454 - RNA, 13 nt, Human
caccaucaagcca

SEQ ID NO: 2960455 - RNA, 15 nt, Human
caccaucaagccacc

SEQ ID NO: 2960456 - RNA, 14 nt, Human
caccaucaagccac

SEQ ID NO: 2960457 - RNA, 20 nt, Human
caccauaagcuacugccauc

SEQ ID NO: 2960458 - RNA, 21 nt, Human
caccauaagcuacugccaucc

SEQ ID NO: 2960459 - RNA, 21 nt, Human
caccauauuaccacagacaua

SEQ ID NO: 2960460 - RNA, 16 nt, Human
caccauaagcuacugc

SEQ ID NO: 2960461 - RNA, 18 nt, Human
caccauaagcuacugcca

SEQ ID NO: 2960462 - RNA, 19 nt, Human
caccauaagcuacugccau

SEQ ID NO: 2960463 - RNA, 12 nt, Human
caccagugccuc

SEQ ID NO: 2960464 - RNA, 13 nt, Human
caccagugccucu

SEQ ID NO: 2960465 - RNA, 14 nt, Human
caccagugccucuc

SEQ ID NO: 2960466 - RNA, 17 nt, Human
caccagugccucucccu

SEQ ID NO: 2960467 - RNA, 11 nt, Human
caccagugccu

SEQ ID NO: 2960468 - RNA, 22 nt, Human
cacacggacacucaaaagcugg

SEQ ID NO: 2960469 - RNA, 18 nt, Human
cacagcucuucuccaggc

SEQ ID NO: 2960470 - RNA, 17 nt, Human
cacaggaucagucugau

SEQ ID NO: 2960471 - RNA, 19 nt, Human
cacagcucuucuccaggcu

SEQ ID NO: 2960472 - RNA, 20 nt, Human
cacagcucuucuccaggcug

SEQ ID NO: 2960473 - RNA, 14 nt, Human
cacaggcccggcuc

SEQ ID NO: 2960474 - RNA, 23 nt, Human
cacaguccuuaccagcagagcac

SEQ ID NO: 2960475 - RNA, 19 nt, Human
cacaggcagguccaggguu

SEQ ID NO: 2960476 - RNA, 21 nt, Human
cacaugccucucucaggccaa

SEQ ID NO: 2960477 - RNA, 20 nt, Human
cacaugccucucucaggcca

SEQ ID NO: 2960478 - RNA, 17 nt, Human
cacauguccaagaagcc

SEQ ID NO: 2960479 - RNA, 16 nt, Human
cacauguccaagaagc

SEQ ID NO: 2960480 - RNA, 18 nt, Human
cacaugcacgugugugca

SEQ ID NO: 2960481 - RNA, 20 nt, Human
cacaugcaaggucauuuuuu

SEQ ID NO: 2960482 - RNA, 17 nt, Human
cacaugcaaggucauuu

SEQ ID NO: 2960483 - RNA, 19 nt, Human
cacaugcaaggucauuuuu

SEQ ID NO: 2960484 - RNA, 17 nt, Human
cacaugagcaucaggcc

SEQ ID NO: 2960485 - RNA, 13 nt, Human
cacaugagcauca

SEQ ID NO: 2960486 - RNA, 21 nt, Human
cacaugagcaucaggccaggc

SEQ ID NO: 2960487 - RNA, 20 nt, Human
cacaugagcaucaggccagg

SEQ ID NO: 2960488 - RNA, 19 nt, Human
cacaugagcaucaggccag

SEQ ID NO: 2960489 - RNA, 18 nt, Human
cacaugagcaucaggcca

SEQ ID NO: 2960490 - RNA, 22 nt, Human
cacaguuuucugagaaagacua

SEQ ID NO: 2960491 - RNA, 21 nt, Human
cacaguuuucugagaaagacu

SEQ ID NO: 2960492 - RNA, 17 nt, Human
cacaugaaguccaagca

SEQ ID NO: 2960493 - RNA, 20 nt, Human
cacaugaaguccaagcauuu

SEQ ID NO: 2960494 - RNA, 16 nt, Human
cacaugaaguccaagc

SEQ ID NO: 2960495 - RNA, 20 nt, Human
cacaguuuucugagaaagac

SEQ ID NO: 2960496 - RNA, 17 nt, Human
ccccaagacucccauga

SEQ ID NO: 2960497 - RNA, 13 nt, Human
cccauucugccug

SEQ ID NO: 2960498 - RNA, 22 nt, Human
ccccaaauggaaaugggcagag

SEQ ID NO: 2960499 - RNA, 16 nt, Human
ccccaccagugccucu

SEQ ID NO: 2960500 - RNA, 15 nt, Human
ccccaccagugccuc

SEQ ID NO: 2960501 - RNA, 22 nt, Human
ccccaccagugccucucccugc

SEQ ID NO: 2960502 - RNA, 17 nt, Human
ccccaccagugccucuc

SEQ ID NO: 2960503 - RNA, 18 nt, Human
ccccaccagugccucucc

SEQ ID NO: 2960504 - RNA, 20 nt, Human
ccccacccaagggccuggcc

SEQ ID NO: 2960505 - RNA, 14 nt, Human
ccccacccaagggc

SEQ ID NO: 2960506 - RNA, 15 nt, Human
cccagugcccacagg

SEQ ID NO: 2960507 - RNA, 20 nt, Human
cccagugcccacaggaucag

SEQ ID NO: 2960508 - RNA, 17 nt, Human
cccagugccgagaagga

SEQ ID NO: 2960509 - RNA, 18 nt, Human
cccagugccgagaaggaa

SEQ ID NO: 2960510 - RNA, 16 nt, Human
cccaugcugcccugug

SEQ ID NO: 2960511 - RNA, 15 nt, Human
cccaugcugcccugu

SEQ ID NO: 2960512 - RNA, 18 nt, Human
cccaugcugcccugugag

SEQ ID NO: 2960513 - RNA, 17 nt, Human
cccaugcugcccuguga

SEQ ID NO: 2960514 - RNA, 17 nt, Human
ccccaggaggccagccu

SEQ ID NO: 2960515 - RNA, 11 nt, Human
cccagccccuu

SEQ ID NO: 2960516 - RNA, 19 nt, Human
cccagcaagugagagcugg

SEQ ID NO: 2960517 - RNA, 20 nt, Human
cccagcaagugagagcuggg

SEQ ID NO: 2960518 - RNA, 21 nt, Human
cccagcaagugagagcugggu

SEQ ID NO: 2960519 - RNA, 22 nt, Human
cccagcaagugagagcugggug

SEQ ID NO: 2960520 - RNA, 12 nt, Human
cccagccugcua

SEQ ID NO: 2960521 - RNA, 18 nt, Human
cccagccuggaugccauc

SEQ ID NO: 2960522 - RNA, 14 nt, Human
cccagccuggaugc

SEQ ID NO: 2960523 - RNA, 18 nt, Human
cccagccccuucugaccc

SEQ ID NO: 2960524 - RNA, 19 nt, Human
cccagcgagcccugguggc

SEQ ID NO: 2960525 - RNA, 23 nt, Human
cccagcgagcccugguggcagug

SEQ ID NO: 2960526 - RNA, 17 nt, Human
cccagcgagcccuggug

SEQ ID NO: 2960527 - RNA, 18 nt, Human
cccagcgagcccuggugg

SEQ ID NO: 2960528 - RNA, 15 nt, Human
cccagcgagcccugg

SEQ ID NO: 2960529 - RNA, 19 nt, Human
cccagccuggaugccaucc

SEQ ID NO: 2960530 - RNA, 18 nt, Human
cccagagggccugcaagg

SEQ ID NO: 2960531 - RNA, 20 nt, Human
cccagagggccugcaaggga

SEQ ID NO: 2960532 - RNA, 20 nt, Human
cccagauugcaacaggcugg

SEQ ID NO: 2960533 - RNA, 21 nt, Human
cccagauugcaacaggcuggg

SEQ ID NO: 2960534 - RNA, 22 nt, Human
cccagauugcaacaggcugggc

SEQ ID NO: 2960535 - RNA, 16 nt, Human
cccagcaagugagagc

SEQ ID NO: 2960536 - RNA, 18 nt, Human
cccagcaagugagagcug

SEQ ID NO: 2960537 - RNA, 23 nt, Human
cccaagggccuggccugagcugg

SEQ ID NO: 2960538 - RNA, 19 nt, Human
cccaagggccuggccugag

SEQ ID NO: 2960539 - RNA, 18 nt, Human
cccaagggccuggccuga

SEQ ID NO: 2960540 - RNA, 17 nt, Human
cccaagggccuggccug

SEQ ID NO: 2960541 - RNA, 23 nt, Human
cccaaauggaaaugggcagagca

SEQ ID NO: 2960542 - RNA, 17 nt, Human
cccacaccauaagcuac

SEQ ID NO: 2960543 - RNA, 21 nt, Human
cccacaccauaagcuacugcc

SEQ ID NO: 2960544 - RNA, 23 nt, Human
cccaaugcacuuuguucuggcuc

SEQ ID NO: 2960545 - RNA, 17 nt, Human
cccaggcaggucuugaa

SEQ ID NO: 2960546 - RNA, 18 nt, Human
cccaggcauuccccagga

SEQ ID NO: 2960547 - RNA, 21 nt, Human
cccaggcauuccccaggaggc

SEQ ID NO: 2960548 - RNA, 20 nt, Human
cccaggcauuccccaggagg

SEQ ID NO: 2960549 - RNA, 23 nt, Human
cccaggcauuccccaggaggcca

SEQ ID NO: 2960550 - RNA, 22 nt, Human
cccaggcauuccccaggaggcc

SEQ ID NO: 2960551 - RNA, 11 nt, Human
cccaggccccu

SEQ ID NO: 2960552 - RNA, 16 nt, Human
cccaggccccugccac

SEQ ID NO: 2960553 - RNA, 18 nt, Human
cccaggccccugccaccc

SEQ ID NO: 2960554 - RNA, 21 nt, Human
cccaggccccugccacccugg

SEQ ID NO: 2960555 - RNA, 22 nt, Human
cccaggccccugccacccuggg

SEQ ID NO: 2960556 - RNA, 21 nt, Human
cccaggagccccgaggccuuc

SEQ ID NO: 2960557 - RNA, 18 nt, Human
cccaggagccccgaggcc

SEQ ID NO: 2960558 - RNA, 22 nt, Human
cccaggaggccagccuugacca

SEQ ID NO: 2960559 - RNA, 13 nt, Human
cccaggaggccag

SEQ ID NO: 2960560 - RNA, 11 nt, Human
cccaggcaggu

SEQ ID NO: 2960561 - RNA, 13 nt, Human
cccaggcaggucu

SEQ ID NO: 2960562 - RNA, 16 nt, Human
cccaggaguuuggcca

SEQ ID NO: 2960563 - RNA, 15 nt, Human
cccaggaguuuggcc

SEQ ID NO: 2960564 - RNA, 20 nt, Human
cccaggaguuuggccagaag

SEQ ID NO: 2960565 - RNA, 19 nt, Human
cccaggaguuuggccagaa

SEQ ID NO: 2960566 - RNA, 18 nt, Human
cccaggaguuuggccaga

SEQ ID NO: 2960567 - RNA, 17 nt, Human
cccaggaguuuggccag

SEQ ID NO: 2960568 - RNA, 18 nt, Human
cccaggccuccuacagcu

SEQ ID NO: 2960569 - RNA, 17 nt, Human
cccaggccuccuacagc

SEQ ID NO: 2960570 - RNA, 20 nt, Human
cccagucuggaaugcagugg

SEQ ID NO: 2960571 - RNA, 13 nt, Human
cccagugcccaca

SEQ ID NO: 2960572 - RNA, 23 nt, Human
cccaggugcuaggaacacuccuu

SEQ ID NO: 2960573 - RNA, 13 nt, Human
cccaggugccagu

SEQ ID NO: 2960574 - RNA, 22 nt, Human
cccaggugcuaggaacacuccu

SEQ ID NO: 2960575 - RNA, 16 nt, Human
ccauucuccaccugcc

SEQ ID NO: 2960576 - RNA, 15 nt, Human
ccauucuccaccugc

SEQ ID NO: 2960577 - RNA, 14 nt, Human
ccauggacuuuguu

SEQ ID NO: 2960578 - RNA, 13 nt, Human
ccauggacuuugu

SEQ ID NO: 2960579 - RNA, 21 nt, Human
ccauucugccugcccaggccc

SEQ ID NO: 2960580 - RNA, 14 nt, Human
ccauucuccaccug

SEQ ID NO: 2960581 - RNA, 19 nt, Human
ccauucugccugcccaggc

SEQ ID NO: 2960582 - RNA, 20 nt, Human
ccauucugccugcccaggcc

SEQ ID NO: 2960583 - RNA, 16 nt, Human
ccauucugccugccca

SEQ ID NO: 2960584 - RNA, 17 nt, Human
ccauucuccaccugcca

SEQ ID NO: 2960585 - RNA, 17 nt, Human
ccauucugccugcccag

SEQ ID NO: 2960586 - RNA, 18 nt, Human
ccauucugccugcccagg

SEQ ID NO: 2960587 - RNA, 16 nt, Human
cccaaagcagugcaug

SEQ ID NO: 2960588 - RNA, 15 nt, Human
cccaaagaugcagcc

SEQ ID NO: 2960589 - RNA, 12 nt, Human
cccaaagaugca

SEQ ID NO: 2960590 - RNA, 22 nt, Human
ccauuuugggguacccacugcu

SEQ ID NO: 2960591 - RNA, 20 nt, Human
ccauuuugggguacccacug

SEQ ID NO: 2960592 - RNA, 23 nt, Human
ccauuuuggauucuuauggacaa

SEQ ID NO: 2960593 - RNA, 18 nt, Human
cccaaaaggcagaagcaa

SEQ ID NO: 2960594 - RNA, 13 nt, Human
cccaaaaggcaga

SEQ ID NO: 2960595 - RNA, 20 nt, Human
cccaaaacucuccucugcug

SEQ ID NO: 2960596 - RNA, 13 nt, Human
ccaugcugcccug

SEQ ID NO: 2960597 - RNA, 11 nt, Human
ccaugcugccc

SEQ ID NO: 2960598 - RNA, 14 nt, Human
ccaugcugcccugu

SEQ ID NO: 2960599 - RNA, 16 nt, Human
ccaugauguuuagaaa

SEQ ID NO: 2960600 - RNA, 18 nt, Human
ccaugauguuuuccauga

SEQ ID NO: 2960601 - RNA, 21 nt, Human
ccaugauuaaccacuucagcu

SEQ ID NO: 2960602 - RNA, 19 nt, Human
ccaugauuaaccacuucag

SEQ ID NO: 2960603 - RNA, 14 nt, Human
ccaugaagauguag

SEQ ID NO: 2960604 - RNA, 23 nt, Human
ccauccacuggguguaaacacau

SEQ ID NO: 2960605 - RNA, 22 nt, Human
ccaucauugaaaucuuuuugcu

SEQ ID NO: 2960606 - RNA, 14 nt, Human
ccauccuccuggga

SEQ ID NO: 2960607 - RNA, 19 nt, Human
ccauccucuguacagagcc

SEQ ID NO: 2960608 - RNA, 12 nt, Human
ccauccucugua

SEQ ID NO: 2960609 - RNA, 19 nt, Human
ccagugaggcucugcccuu

SEQ ID NO: 2960610 - RNA, 18 nt, Human
ccagugaggcucugcccu

SEQ ID NO: 2960611 - RNA, 20 nt, Human
ccagugaggcucugcccuug

SEQ ID NO: 2960612 - RNA, 17 nt, Human
ccagugaggcucugccc

SEQ ID NO: 2960613 - RNA, 13 nt, Human
ccaucaccagaca

SEQ ID NO: 2960614 - RNA, 18 nt, Human
ccaucaaggguacacugc

SEQ ID NO: 2960615 - RNA, 20 nt, Human
ccauccucuguacagagccc

SEQ ID NO: 2960616 - RNA, 11 nt, Human
ccagcucuggu

SEQ ID NO: 2960617 - RNA, 13 nt, Human
ccagcucuggucc

SEQ ID NO: 2960618 - RNA, 12 nt, Human
ccagcucugguc

SEQ ID NO: 2960619 - RNA, 14 nt, Human
ccagcgagcccugg

SEQ ID NO: 2960620 - RNA, 22 nt, Human
ccagccuugaccauucuccacc

SEQ ID NO: 2960621 - RNA, 15 nt, Human
ccagcgagcccuggu

SEQ ID NO: 2960622 - RNA, 16 nt, Human
ccagcgagcccuggug

SEQ ID NO: 2960623 - RNA, 22 nt, Human
ccagagcccaccuuggcucaag

SEQ ID NO: 2960624 - RNA, 16 nt, Human
ccagagcccaccuugg

SEQ ID NO: 2960625 - RNA, 20 nt, Human
ccagccuugaccauucucca

SEQ ID NO: 2960626 - RNA, 19 nt, Human
ccagccuugaccauucucc

SEQ ID NO: 2960627 - RNA, 23 nt, Human
ccagcugcuugggcuucauccuc

SEQ ID NO: 2960628 - RNA, 20 nt, Human
ccagcugcuugggcuucauc

SEQ ID NO: 2960629 - RNA, 22 nt, Human
ccagcugcugagauccuggacu

SEQ ID NO: 2960630 - RNA, 23 nt, Human
ccagcugcugagauccuggacug

SEQ ID NO: 2960631 - RNA, 21 nt, Human
ccagcugcugagauccuggac

SEQ ID NO: 2960632 - RNA, 20 nt, Human
ccagcugcugagauccugga

SEQ ID NO: 2960633 - RNA, 22 nt, Human
ccagcucugguccauagagagc

SEQ ID NO: 2960634 - RNA, 21 nt, Human
ccagcucugguccauagagag

SEQ ID NO: 2960635 - RNA, 17 nt, Human
ccagcucugguccauag

SEQ ID NO: 2960636 - RNA, 14 nt, Human
ccagcucuggucca

SEQ ID NO: 2960637 - RNA, 22 nt, Human
ccaggaagccagcaggcucuca

SEQ ID NO: 2960638 - RNA, 20 nt, Human
ccaggaagccagcaggcucu

SEQ ID NO: 2960639 - RNA, 13 nt, Human
ccaggaggccagc

SEQ ID NO: 2960640 - RNA, 12 nt, Human
ccaggaggccag

SEQ ID NO: 2960641 - RNA, 18 nt, Human
ccaggagccuccugcccu

SEQ ID NO: 2960642 - RNA, 14 nt, Human
ccaggagccuccug

SEQ ID NO: 2960643 - RNA, 13 nt, Human
ccaggagccuccu

SEQ ID NO: 2960644 - RNA, 22 nt, Human
ccaggcauuccccaggaggcca

SEQ ID NO: 2960645 - RNA, 23 nt, Human
ccaggcauuccccaggaggccag

SEQ ID NO: 2960646 - RNA, 24 nt, Human
ccaggcauuccccaggaggccagc

SEQ ID NO: 2960647 - RNA, 14 nt, Human
ccaggcauucccca

SEQ ID NO: 2960648 - RNA, 13 nt, Human
ccaggcauggugg

SEQ ID NO: 2960649 - RNA, 15 nt, Human
ccaggagccccgagg

SEQ ID NO: 2960650 - RNA, 16 nt, Human
ccaggagcagccacau

SEQ ID NO: 2960651 - RNA, 15 nt, Human
ccaggagcagccaca

SEQ ID NO: 2960652 - RNA, 15 nt, Human
ccagggcaucuggga

SEQ ID NO: 2960653 - RNA, 16 nt, Human
ccagggcaucugggag

SEQ ID NO: 2960654 - RNA, 20 nt, Human
ccaggcuguaucccaugagc

SEQ ID NO: 2960655 - RNA, 14 nt, Human
ccaggcuggucuca

SEQ ID NO: 2960656 - RNA, 19 nt, Human
ccaggcuggucucaaacuc

SEQ ID NO: 2960657 - RNA, 13 nt, Human
ccaggccccugcc

SEQ ID NO: 2960658 - RNA, 23 nt, Human
ccaguaaaugggggugcauuuga

SEQ ID NO: 2960659 - RNA, 14 nt, Human
ccagguucagcuug

SEQ ID NO: 2960660 - RNA, 19 nt, Human
ccaggugcuaggaacacuc

SEQ ID NO: 2960661 - RNA, 17 nt, Human
ccaggugccaguuaugg

SEQ ID NO: 2960662 - RNA, 13 nt, Human
ccaggugccaguu

SEQ ID NO: 2960663 - RNA, 22 nt, Human
ccaaagccuccuccagccgcca

SEQ ID NO: 2960664 - RNA, 17 nt, Human
ccaaagccuccuccagc

SEQ ID NO: 2960665 - RNA, 19 nt, Human
ccaaagccaaagcuaggcc

SEQ ID NO: 2960666 - RNA, 23 nt, Human
ccaaagcagugcaugcugucccu

SEQ ID NO: 2960667 - RNA, 22 nt, Human
ccaaacugacucuuaagaagac

SEQ ID NO: 2960668 - RNA, 19 nt, Human
ccaaagcagugcaugcugu

SEQ ID NO: 2960669 - RNA, 20 nt, Human
ccaaacucaccugccccuca

SEQ ID NO: 2960670 - RNA, 21 nt, Human
ccaaagcuaggccuggccaga

SEQ ID NO: 2960671 - RNA, 16 nt, Human
ccaaagcuaggccugg

SEQ ID NO: 2960672 - RNA, 17 nt, Human
ccaaagcuaggccuggc

SEQ ID NO: 2960673 - RNA, 15 nt, Human
ccaaagcuaggccug

SEQ ID NO: 2960674 - RNA, 23 nt, Human
ccaaaggaagcacaugccucucu

SEQ ID NO: 2960675 - RNA, 15 nt, Human
ccaaaggaagcacau

SEQ ID NO: 2960676 - RNA, 15 nt, Human
ccaaaguacacuguu

SEQ ID NO: 2960677 - RNA, 18 nt, Human
ccaaaguacacuguuuca

SEQ ID NO: 2960678 - RNA, 23 nt, Human
ccaaauuucauaccuaucaucuu

SEQ ID NO: 2960679 - RNA, 20 nt, Human
ccaaaguacacuguuucaaa

SEQ ID NO: 2960680 - RNA, 22 nt, Human
ccaacauacucccaucugugaa

SEQ ID NO: 2960681 - RNA, 21 nt, Human
ccaacauacucccaucuguga

SEQ ID NO: 2960682 - RNA, 16 nt, Human
ccaacauacucccauc

SEQ ID NO: 2960683 - RNA, 20 nt, Human
ccaacauacucccaucugug

SEQ ID NO: 2960684 - RNA, 19 nt, Human
ccaacauacucccaucugu

SEQ ID NO: 2960685 - RNA, 18 nt, Human
ccaacauacucccaucug

SEQ ID NO: 2960686 - RNA, 17 nt, Human
ccaacauacucccaucu

SEQ ID NO: 2960687 - RNA, 20 nt, Human
ccaagaagcccaggaaaggc

SEQ ID NO: 2960688 - RNA, 19 nt, Human
ccaagaagcccaggaaagg

SEQ ID NO: 2960689 - RNA, 12 nt, Human
ccaacccucauc

SEQ ID NO: 2960690 - RNA, 15 nt, Human
ccaagaagcccagga

SEQ ID NO: 2960691 - RNA, 14 nt, Human
ccaagcaaguauua

SEQ ID NO: 2960692 - RNA, 16 nt, Human
ccaagggaauauugcc

SEQ ID NO: 2960693 - RNA, 15 nt, Human
ccaagggccuggccu

SEQ ID NO: 2960694 - RNA, 21 nt, Human
ccaaggccaaaggaagcacau

SEQ ID NO: 2960695 - RNA, 18 nt, Human
ccaaggccaaaggaagca

SEQ ID NO: 2960696 - RNA, 22 nt, Human
ccaaggggaauguuugccucug

SEQ ID NO: 2960697 - RNA, 18 nt, Human
ccaagggccuggccugag

SEQ ID NO: 2960698 - RNA, 16 nt, Human
ccaagggccuggccug

SEQ ID NO: 2960699 - RNA, 19 nt, Human
ccaagggccuggccugagc

SEQ ID NO: 2960700 - RNA, 20 nt, Human
ccaagucaagugaaaaagga

SEQ ID NO: 2960701 - RNA, 13 nt, Human
ccaaggugggagg

SEQ ID NO: 2960702 - RNA, 23 nt, Human
ccaagguuuggggaagaacgaag

SEQ ID NO: 2960703 - RNA, 14 nt, Human
ccaagcucccaggc

SEQ ID NO: 2960704 - RNA, 17 nt, Human
ccaaggccaaaggaagc

SEQ ID NO: 2960705 - RNA, 22 nt, Human
ccaagcucccaggcauucccca

SEQ ID NO: 2960706 - RNA, 16 nt, Human
ccaagcucccaggcau

SEQ ID NO: 2960707 - RNA, 15 nt, Human
ccaagcucccaggca

SEQ ID NO: 2960708 - RNA, 22 nt, Human
ccaagcauaccaacacgagcag

SEQ ID NO: 2960709 - RNA, 17 nt, Human
ccaagcauuuagaugua

SEQ ID NO: 2960710 - RNA, 17 nt, Human
cauuuaggccaugggac

SEQ ID NO: 2960711 - RNA, 12 nt, Human
cauuuaaaagau

SEQ ID NO: 2960712 - RNA, 15 nt, Human
cauuuaaaagauaca

SEQ ID NO: 2960713 - RNA, 16 nt, Human
cauuuaaaagauacag

SEQ ID NO: 2960714 - RNA, 12 nt, Human
cauuuccugugu

SEQ ID NO: 2960715 - RNA, 13 nt, Human
cauuuccuguguc

SEQ ID NO: 2960716 - RNA, 17 nt, Human
cauuguuggccaaagcc

SEQ ID NO: 2960717 - RNA, 18 nt, Human
cauuguuggccaaagcca

SEQ ID NO: 2960718 - RNA, 15 nt, Human
cacccaagggccugg

SEQ ID NO: 2960719 - RNA, 14 nt, Human
cacccaagggccug

SEQ ID NO: 2960720 - RNA, 16 nt, Human
cauuugagcagggcuc

SEQ ID NO: 2960721 - RNA, 20 nt, Human
cauuugagcagggcucagcg

SEQ ID NO: 2960722 - RNA, 17 nt, Human
cauuugagcagggcuca

SEQ ID NO: 2960723 - RNA, 18 nt, Human
cauuugagcagggcucag

SEQ ID NO: 2960724 - RNA, 17 nt, Human
cauuuguuugaacugau

SEQ ID NO: 2960725 - RNA, 20 nt, Human
cauuuguuugaacugauaaa

SEQ ID NO: 2960726 - RNA, 22 nt, Human
cauuuguuugaacugauaaaga

SEQ ID NO: 2960727 - RNA, 13 nt, Human
cauuugcucaugg

SEQ ID NO: 2960728 - RNA, 18 nt, Human
cauuugcucauggaauug

SEQ ID NO: 2960729 - RNA, 14 nt, Human
cauuugcuccuuuc

SEQ ID NO: 2960730 - RNA, 13 nt, Human
cauuugcuccuuu

SEQ ID NO: 2960731 - RNA, 22 nt, Human
cauuugaaaauuuugauguuuu

SEQ ID NO: 2960732 - RNA, 20 nt, Human
cauuugaaaauuuugauguu

SEQ ID NO: 2960733 - RNA, 17 nt, Human
ccaaacucaccugcccc

SEQ ID NO: 2960734 - RNA, 19 nt, Human
cauuuuagggguagcauuu

SEQ ID NO: 2960735 - RNA, 21 nt, Human
ccacccaggagccccgaggcc

SEQ ID NO: 2960736 - RNA, 23 nt, Human
ccacccaggagccccgaggccuu

SEQ ID NO: 2960737 - RNA, 17 nt, Human
ccacccccacccaaggg

SEQ ID NO: 2960738 - RNA, 16 nt, Human
ccacaugugcacaugc

SEQ ID NO: 2960739 - RNA, 16 nt, Human
ccacauuccugaugcu

SEQ ID NO: 2960740 - RNA, 19 nt, Human
ccacaucuugcucugcuga

SEQ ID NO: 2960741 - RNA, 18 nt, Human
ccacaucuugcucugcug

SEQ ID NO: 2960742 - RNA, 17 nt, Human
ccacaucuugcucugcu

SEQ ID NO: 2960743 - RNA, 21 nt, Human
ccaccaacauacucccaucug

SEQ ID NO: 2960744 - RNA, 21 nt, Human
ccacacccagcccacuucugc

SEQ ID NO: 2960745 - RNA, 22 nt, Human
ccacacccagcccacuucugcc

SEQ ID NO: 2960746 - RNA, 20 nt, Human
ccacacccagcccacuucug

SEQ ID NO: 2960747 - RNA, 15 nt, Human
ccacacccagcccac

SEQ ID NO: 2960748 - RNA, 20 nt, Human
ccacaccauaagcuacugcc

SEQ ID NO: 2960749 - RNA, 21 nt, Human
ccacaccauaagcuacugcca

SEQ ID NO: 2960750 - RNA, 22 nt, Human
ccacaccauaagcuacugccau

SEQ ID NO: 2960751 - RNA, 16 nt, Human
ccacaggaucagucug

SEQ ID NO: 2960752 - RNA, 20 nt, Human
ccacaggaaccacaagacug

SEQ ID NO: 2960753 - RNA, 16 nt, Human
ccaauauucauagcag

SEQ ID NO: 2960754 - RNA, 19 nt, Human
ccaauauccuaauaaaaag

SEQ ID NO: 2960755 - RNA, 18 nt, Human
ccaauauccuaauaaaaa

SEQ ID NO: 2960756 - RNA, 17 nt, Human
ccaauauccuaauaaaa

SEQ ID NO: 2960757 - RNA, 16 nt, Human
ccaauauccuaauaaa

SEQ ID NO: 2960758 - RNA, 15 nt, Human
ccaauauccuaauaa

SEQ ID NO: 2960759 - RNA, 14 nt, Human
ccaauauccuaaua

SEQ ID NO: 2960760 - RNA, 13 nt, Human
ccaauauccuaau

SEQ ID NO: 2960761 - RNA, 12 nt, Human
ccaauauccuaa

SEQ ID NO: 2960762 - RNA, 15 nt, Human
ccaccccacacacgc

SEQ ID NO: 2960763 - RNA, 23 nt, Human
ccacggccaggccagagggagug

SEQ ID NO: 2960764 - RNA, 18 nt, Human
ccacgcuggagugcagug

SEQ ID NO: 2960765 - RNA, 19 nt, Human
ccacgcuggagugcaguga

SEQ ID NO: 2960766 - RNA, 16 nt, Human
ccacggccaggccaga

SEQ ID NO: 2960767 - RNA, 18 nt, Human
ccacggccaggccagagg

SEQ ID NO: 2960768 - RNA, 15 nt, Human
ccacccccacccaag

SEQ ID NO: 2960769 - RNA, 16 nt, Human
ccacgcuggagugcag

SEQ ID NO: 2960770 - RNA, 13 nt, Human
ccacgcuggagug

SEQ ID NO: 2960771 - RNA, 16 nt, Human
ccacuacauucuguua

SEQ ID NO: 2960772 - RNA, 17 nt, Human
ccacuacauucuguuaa

SEQ ID NO: 2960773 - RNA, 11 nt, Human
ccacuacauuc

SEQ ID NO: 2960774 - RNA, 15 nt, Human
ccacuacauucuguu

SEQ ID NO: 2960775 - RNA, 14 nt, Human
ccacuacauucugu

SEQ ID NO: 2960776 - RNA, 19 nt, Human
ccagaauuucccaaagcag

SEQ ID NO: 2960777 - RNA, 12 nt, Human
ccagaauuuccc

SEQ ID NO: 2960778 - RNA, 18 nt, Human
ccagaauuucccaaagca

SEQ ID NO: 2960779 - RNA, 21 nt, Human
ccagaauuucccaaagcagug

SEQ ID NO: 2960780 - RNA, 21 nt, Human
ccagacaccuugacagggcac

SEQ ID NO: 2960781 - RNA, 20 nt, Human
ccagacaccuugacagggca

SEQ ID NO: 2960782 - RNA, 23 nt, Human
ccagaaguuugagaucagccugg

SEQ ID NO: 2960783 - RNA, 18 nt, Human
ccagaagucaaggcuuag

SEQ ID NO: 2960784 - RNA, 22 nt, Human
ccagaaguuugagaucagccug

SEQ ID NO: 2960785 - RNA, 14 nt, Human
ccacuucagcugac

SEQ ID NO: 2960786 - RNA, 13 nt, Human
ccacuucagcuga

SEQ ID NO: 2960787 - RNA, 23 nt, Human
ccacugcacuccagccuggguga

SEQ ID NO: 2960788 - RNA, 13 nt, Human
ccacugcagaaga

SEQ ID NO: 2960789 - RNA, 18 nt, Human
ccacugcagaagacagua

SEQ ID NO: 2960790 - RNA, 13 nt, Human
cgcuccugugucu

SEQ ID NO: 2960791 - RNA, 20 nt, Human
cggaaugaaccacaucuugc

SEQ ID NO: 2960792 - RNA, 20 nt, Human
cggaagaccugaagaguggu

SEQ ID NO: 2960793 - RNA, 15 nt, Human
cggacagccacggcc

SEQ ID NO: 2960794 - RNA, 16 nt, Human
cggacagccacggcca

SEQ ID NO: 2960795 - RNA, 18 nt, Human
cggacagccacggccagg

SEQ ID NO: 2960796 - RNA, 21 nt, Human
cggaccuuguagugagccgag

SEQ ID NO: 2960797 - RNA, 17 nt, Human
cggaccccacuccggcc

SEQ ID NO: 2960798 - RNA, 21 nt, Human
cggaccccacuccggcccucc

SEQ ID NO: 2960799 - RNA, 20 nt, Human
cgggaggauguucugggaca

SEQ ID NO: 2960800 - RNA, 18 nt, Human
cgggaggcugaggcagga

SEQ ID NO: 2960801 - RNA, 16 nt, Human
cgggaggcugaggcag

SEQ ID NO: 2960802 - RNA, 17 nt, Human
cgggaggcugaggcagg

SEQ ID NO: 2960803 - RNA, 16 nt, Human
cgggaggucgaggcag

SEQ ID NO: 2960804 - RNA, 17 nt, Human
cgggaggucgaggcagg

SEQ ID NO: 2960805 - RNA, 15 nt, Human
cgggcaugacacgaa

SEQ ID NO: 2960806 - RNA, 12 nt, Human
cgggcaugacac

SEQ ID NO: 2960807 - RNA, 18 nt, Human
cggcuggccuggccccuc

SEQ ID NO: 2960808 - RNA, 14 nt, Human
cggcuggccuggcc

SEQ ID NO: 2960809 - RNA, 16 nt, Human
cggcuggccuggcccc

SEQ ID NO: 2960810 - RNA, 15 nt, Human
cggcuggccuggccc

SEQ ID NO: 2960811 - RNA, 21 nt, Human
cggccccaccagugccucucc

SEQ ID NO: 2960812 - RNA, 18 nt, Human
cggccccaccagugccuc

SEQ ID NO: 2960813 - RNA, 20 nt, Human
cggccccaccagugccucuc

SEQ ID NO: 2960814 - RNA, 15 nt, Human
cggccccaccagugc

SEQ ID NO: 2960815 - RNA, 16 nt, Human
cggccccaccagugcc

SEQ ID NO: 2960816 - RNA, 17 nt, Human
cggccccaccagugccu

SEQ ID NO: 2960817 - RNA, 13 nt, Human
cggccccaccagu

SEQ ID NO: 2960818 - RNA, 14 nt, Human
cggccuccauccug

SEQ ID NO: 2960819 - RNA, 16 nt, Human
cggccuccauccugag

SEQ ID NO: 2960820 - RNA, 17 nt, Human
cggccuccauccugagg

SEQ ID NO: 2960821 - RNA, 12 nt, Human
cgauuucuguuu

SEQ ID NO: 2960822 - RNA, 23 nt, Human
cgcacuucgggaggucgaggcag

SEQ ID NO: 2960823 - RNA, 11 nt, Human
cgcaaugugac

SEQ ID NO: 2960824 - RNA, 19 nt, Human
cgaucuggguucacugcaa

SEQ ID NO: 2960825 - RNA, 21 nt, Human
cgauucuucugcuucagccuc

SEQ ID NO: 2960826 - RNA, 13 nt, Human
cgauucuucugcu

SEQ ID NO: 2960827 - RNA, 19 nt, Human
cgauucuucugcuucagcc

SEQ ID NO: 2960828 - RNA, 15 nt, Human
ccuuuguauucucuc

SEQ ID NO: 2960829 - RNA, 18 nt, Human
ccuuuguauucucuccug

SEQ ID NO: 2960830 - RNA, 20 nt, Human
ccuuuguauucucuccugua

SEQ ID NO: 2960831 - RNA, 18 nt, Human
cgaggccuucucugaagg

SEQ ID NO: 2960832 - RNA, 19 nt, Human
cgaggccuucucugaagga

SEQ ID NO: 2960833 - RNA, 13 nt, Human
cgaggacagggag

SEQ ID NO: 2960834 - RNA, 12 nt, Human
cgaggacaggga

SEQ ID NO: 2960835 - RNA, 16 nt, Human
ccuuugcuugaaagaa

SEQ ID NO: 2960836 - RNA, 23 nt, Human
ccuuugacgccaucccagcccca

SEQ ID NO: 2960837 - RNA, 12 nt, Human
ccuuggcugcag

SEQ ID NO: 2960838 - RNA, 13 nt, Human
ccuuggcugcagg

SEQ ID NO: 2960839 - RNA, 20 nt, Human
ccuuguggucccaccccaca

SEQ ID NO: 2960840 - RNA, 19 nt, Human
ccuuguggucccaccccac

SEQ ID NO: 2960841 - RNA, 16 nt, Human
ccuuguggucccaccc

SEQ ID NO: 2960842 - RNA, 13 nt, Human
ccuuuaagagaaa

SEQ ID NO: 2960843 - RNA, 14 nt, Human
cgcagacaggacca

SEQ ID NO: 2960844 - RNA, 13 nt, Human
cgcagacaggacc

SEQ ID NO: 2960845 - RNA, 15 nt, Human
cgcccccacugguga

SEQ ID NO: 2960846 - RNA, 15 nt, Human
cgcgacaaugcaaac

SEQ ID NO: 2960847 - RNA, 17 nt, Human
cgcgacaaugcaaacca

SEQ ID NO: 2960848 - RNA, 16 nt, Human
cgcgacaaugcaaacc

SEQ ID NO: 2960849 - RNA, 21 nt, Human
cgcuaagagggagggagggcu

SEQ ID NO: 2960850 - RNA, 14 nt, Human
cgcuaagagggagg

SEQ ID NO: 2960851 - RNA, 16 nt, Human
cgcuaagagggaggga

SEQ ID NO: 2960852 - RNA, 15 nt, Human
cgcuaagagggaggg

SEQ ID NO: 2960853 - RNA, 16 nt, Human
cgcgugcacacaccag

SEQ ID NO: 2960854 - RNA, 19 nt, Human
cgcgugcacacaccagagc

SEQ ID NO: 2960855 - RNA, 20 nt, Human
cgcgugcacacaccagagcc

SEQ ID NO: 2960856 - RNA, 22 nt, Human
cgugcaguggugcgaucugggu

SEQ ID NO: 2960857 - RNA, 22 nt, Human
cgugcacacaccagagcccacc

SEQ ID NO: 2960858 - RNA, 14 nt, Human
cgugcauaccacuu

SEQ ID NO: 2960859 - RNA, 18 nt, Human
cgugcauaccacuuuugu

SEQ ID NO: 2960860 - RNA, 19 nt, Human
cgugcauaccacuuuuguu

SEQ ID NO: 2960861 - RNA, 17 nt, Human
cgugaacccaggaggcg

SEQ ID NO: 2960862 - RNA, 19 nt, Human
cgugaacccaggaggcgga

SEQ ID NO: 2960863 - RNA, 20 nt, Human
cgugcacacaccagagccca

SEQ ID NO: 2960864 - RNA, 21 nt, Human
cgugcacacaccagagcccac

SEQ ID NO: 2960865 - RNA, 14 nt, Human
cguccccugucccc

SEQ ID NO: 2960866 - RNA, 11 nt, Human
cguccccuguc

SEQ ID NO: 2960867 - RNA, 13 nt, Human
cgucugacaggca

SEQ ID NO: 2960868 - RNA, 14 nt, Human
cgucugacaggcaa

SEQ ID NO: 2960869 - RNA, 14 nt, Human
cgucuaccugaggg

SEQ ID NO: 2960870 - RNA, 16 nt, Human
cgucucuacuaaaaau

SEQ ID NO: 2960871 - RNA, 23 nt, Human
cggugcuaucucccccagcccca

SEQ ID NO: 2960872 - RNA, 16 nt, Human
cgucaacucauauuuu

SEQ ID NO: 2960873 - RNA, 20 nt, Human
cgucaacucauauuuucaug

SEQ ID NO: 2960874 - RNA, 17 nt, Human
cguggcugcuucaagga

SEQ ID NO: 2960875 - RNA, 15 nt, Human
cguggcugcuucaag

SEQ ID NO: 2960876 - RNA, 14 nt, Human
cguggcugcuucaa

SEQ ID NO: 2960877 - RNA, 12 nt, Human
cguggcugcuuc

SEQ ID NO: 2960878 - RNA, 20 nt, Human
cguuucuaugacacaugcaa

SEQ ID NO: 2960879 - RNA, 19 nt, Human
cguuucuaaaggcuaccuu

SEQ ID NO: 2960880 - RNA, 21 nt, Human
cguuucuaaaggcuaccuuug

SEQ ID NO: 2960881 - RNA, 19 nt, Human
ccugcugguucaggguugg

SEQ ID NO: 2960882 - RNA, 13 nt, Human
ccugcugguucag

SEQ ID NO: 2960883 - RNA, 21 nt, Human
ccugcuggguguggcgcagca

SEQ ID NO: 2960884 - RNA, 12 nt, Human
ccugcuccagcu

SEQ ID NO: 2960885 - RNA, 22 nt, Human
ccugcuccagcuguucagcugg

SEQ ID NO: 2960886 - RNA, 14 nt, Human
ccugcuccagcugu

SEQ ID NO: 2960887 - RNA, 13 nt, Human
ccugcuccagcug

SEQ ID NO: 2960888 - RNA, 18 nt, Human
ccugcaacaccuuguuuc

SEQ ID NO: 2960889 - RNA, 23 nt, Human
ccugauuuaauaugcaaagucua

SEQ ID NO: 2960890 - RNA, 16 nt, Human
ccugcaaccugauugu

SEQ ID NO: 2960891 - RNA, 19 nt, Human
ccugcaacaccuuguuucc

SEQ ID NO: 2960892 - RNA, 23 nt, Human
ccugcgucucauacucaccucac

SEQ ID NO: 2960893 - RNA, 13 nt, Human
ccuggacugaggg

SEQ ID NO: 2960894 - RNA, 14 nt, Human
ccuggacugagggg

SEQ ID NO: 2960895 - RNA, 21 nt, Human
ccuggacugagggggccugga

SEQ ID NO: 2960896 - RNA, 22 nt, Human
ccuggacugagggggccuggau

SEQ ID NO: 2960897 - RNA, 14 nt, Human
ccuggacccugugg

SEQ ID NO: 2960898 - RNA, 13 nt, Human
ccuggacccugug

SEQ ID NO: 2960899 - RNA, 14 nt, Human
ccuggcaugggaau

SEQ ID NO: 2960900 - RNA, 17 nt, Human
ccuggcaugggaaugaa

SEQ ID NO: 2960901 - RNA, 16 nt, Human
ccuggcaugggaauga

SEQ ID NO: 2960902 - RNA, 16 nt, Human
ccuggcagccccuguu

SEQ ID NO: 2960903 - RNA, 14 nt, Human
ccuggcagccccug

SEQ ID NO: 2960904 - RNA, 22 nt, Human
ccuggcacuggcaaacagggcc

SEQ ID NO: 2960905 - RNA, 23 nt, Human
ccuggcacuggcaaacagggccu

SEQ ID NO: 2960906 - RNA, 21 nt, Human
ccuggcacugcuuccagugag

SEQ ID NO: 2960907 - RNA, 13 nt, Human
ccuggcacuggca

SEQ ID NO: 2960908 - RNA, 23 nt, Human
ccuggacugagggggccuggaug

SEQ ID NO: 2960909 - RNA, 17 nt, Human
ccuggcacugcuuccag

SEQ ID NO: 2960910 - RNA, 20 nt, Human
ccuggcacugcuuccaguga

SEQ ID NO: 2960911 - RNA, 18 nt, Human
ccuggcaugggaaugaau

SEQ ID NO: 2960912 - RNA, 12 nt, Human
ccuggcucugug

SEQ ID NO: 2960913 - RNA, 18 nt, Human
ccuggcucuguggcgagc

SEQ ID NO: 2960914 - RNA, 17 nt, Human
ccuggcuaacacgguga

SEQ ID NO: 2960915 - RNA, 14 nt, Human
ccuggccccucagg

SEQ ID NO: 2960916 - RNA, 20 nt, Human
ccugggaggucaaggcugca

SEQ ID NO: 2960917 - RNA, 20 nt, Human
ccugggaucccucauccuca

SEQ ID NO: 2960918 - RNA, 16 nt, Human
ccugggaucccucauc

SEQ ID NO: 2960919 - RNA, 15 nt, Human
ccugggcagcugccu

SEQ ID NO: 2960920 - RNA, 16 nt, Human
ccugggcagcugccuc

SEQ ID NO: 2960921 - RNA, 17 nt, Human
ccugggcagcugccucc

SEQ ID NO: 2960922 - RNA, 18 nt, Human
ccugggcagcugccuccc

SEQ ID NO: 2960923 - RNA, 14 nt, Human
ccugggcagaagga

SEQ ID NO: 2960924 - RNA, 12 nt, Human
ccugggcagaag

SEQ ID NO: 2960925 - RNA, 17 nt, Human
ccugggcaacagagcaa

SEQ ID NO: 2960926 - RNA, 18 nt, Human
ccuguccccgcacugggc

SEQ ID NO: 2960927 - RNA, 16 nt, Human
ccugucccccugacaa

SEQ ID NO: 2960928 - RNA, 17 nt, Human
ccugucccccugacaac

SEQ ID NO: 2960929 - RNA, 20 nt, Human
ccugugaguacuacaguccu

SEQ ID NO: 2960930 - RNA, 17 nt, Human
ccugugauggggcccug

SEQ ID NO: 2960931 - RNA, 19 nt, Human
ccugugauggggcccugcc

SEQ ID NO: 2960932 - RNA, 18 nt, Human
ccugugauggggcccugc

SEQ ID NO: 2960933 - RNA, 22 nt, Human
ccugugauggggcccugccucc

SEQ ID NO: 2960934 - RNA, 21 nt, Human
ccugugauggggcccugccuc

SEQ ID NO: 2960935 - RNA, 20 nt, Human
ccugugauggggcccugccu

SEQ ID NO: 2960936 - RNA, 19 nt, Human
ccugugccucugggacugg

SEQ ID NO: 2960937 - RNA, 15 nt, Human
ccugugccucuggga

SEQ ID NO: 2960938 - RNA, 17 nt, Human
ccugugccucugggacu

SEQ ID NO: 2960939 - RNA, 23 nt, Human
ccuguagagugggagcugagugg

SEQ ID NO: 2960940 - RNA, 19 nt, Human
ccuguagagugggagcuga

SEQ ID NO: 2960941 - RNA, 21 nt, Human
ccuguagagugggagcugagu

SEQ ID NO: 2960942 - RNA, 20 nt, Human
ccuguaaucccagcacuuug

SEQ ID NO: 2960943 - RNA, 20 nt, Human
ccuguaauccuagcacuuug

SEQ ID NO: 2960944 - RNA, 12 nt, Human
ccuguaccucuu

SEQ ID NO: 2960945 - RNA, 18 nt, Human
ccugguggcagcucaccu

SEQ ID NO: 2960946 - RNA, 17 nt, Human
ccugguggcagcucacc

SEQ ID NO: 2960947 - RNA, 16 nt, Human
ccugguggcagcucac

SEQ ID NO: 2960948 - RNA, 14 nt, Human
ccugguggcagcuc

SEQ ID NO: 2960949 - RNA, 12 nt, Human
ccugguggcagc

SEQ ID NO: 2960950 - RNA, 13 nt, Human
ccugguggcagcu

SEQ ID NO: 2960951 - RNA, 20 nt, Human
ccugggcagcugccuccccu

SEQ ID NO: 2960952 - RNA, 12 nt, Human
ccuucagccuga

SEQ ID NO: 2960953 - RNA, 12 nt, Human
ccuucagugccu

SEQ ID NO: 2960954 - RNA, 14 nt, Human
ccuucagugccuua

SEQ ID NO: 2960955 - RNA, 13 nt, Human
ccuucagugccuu

SEQ ID NO: 2960956 - RNA, 19 nt, Human
ccuucagugccuuauggaa

SEQ ID NO: 2960957 - RNA, 15 nt, Human
ccuucagugccuuau

SEQ ID NO: 2960958 - RNA, 20 nt, Human
ccuucagugccuuauggaac

SEQ ID NO: 2960959 - RNA, 11 nt, Human
ccuuccugcug

SEQ ID NO: 2960960 - RNA, 14 nt, Human
ccuuccucuuucca

SEQ ID NO: 2960961 - RNA, 22 nt, Human
ccuuccaggggugggacacccu

SEQ ID NO: 2960962 - RNA, 18 nt, Human
ccuuccaggggugggaca

SEQ ID NO: 2960963 - RNA, 16 nt, Human
ccuuccagggguggga

SEQ ID NO: 2960964 - RNA, 15 nt, Human
ccuuccagggguggg

SEQ ID NO: 2960965 - RNA, 17 nt, Human
ccuuagacagucccugc

SEQ ID NO: 2960966 - RNA, 16 nt, Human
ccuuagacagucccug

SEQ ID NO: 2960967 - RNA, 19 nt, Human
ccuuagacagucccugcca

SEQ ID NO: 2960968 - RNA, 18 nt, Human
ccuuagacagucccugcc

SEQ ID NO: 2960969 - RNA, 21 nt, Human
ccuuagacagucccugccaau

SEQ ID NO: 2960970 - RNA, 14 nt, Human
ccuuaccugccagg

SEQ ID NO: 2960971 - RNA, 20 nt, Human
ccuuaccucggugccuuccu

SEQ ID NO: 2960972 - RNA, 19 nt, Human
ccuuacccucauguucuua

SEQ ID NO: 2960973 - RNA, 17 nt, Human
ccuuaccagcagagcac

SEQ ID NO: 2960974 - RNA, 16 nt, Human
ccuuaccagcagagca

SEQ ID NO: 2960975 - RNA, 15 nt, Human
ccuuaccagcagagc

SEQ ID NO: 2960976 - RNA, 14 nt, Human
ccuuaccagcagag

SEQ ID NO: 2960977 - RNA, 21 nt, Human
ccuugaccauucuccaccugc

SEQ ID NO: 2960978 - RNA, 23 nt, Human
ccuugaguugauucagcucugca

SEQ ID NO: 2960979 - RNA, 22 nt, Human
ccuugaguugauucagcucugc

SEQ ID NO: 2960980 - RNA, 19 nt, Human
ccuuggauuguccccgacc

SEQ ID NO: 2960981 - RNA, 14 nt, Human
ccuugacagggcac

SEQ ID NO: 2960982 - RNA, 13 nt, Human
ccuugacagggca

SEQ ID NO: 2960983 - RNA, 15 nt, Human
ccuugacagggcaca

SEQ ID NO: 2960984 - RNA, 17 nt, Human
ccuugacagggcacacc

SEQ ID NO: 2960985 - RNA, 20 nt, Human
ccuugaccauucuccaccug

SEQ ID NO: 2960986 - RNA, 19 nt, Human
ccuugaccauucuccaccu

SEQ ID NO: 2960987 - RNA, 15 nt, Human
ccuugaaaacacugu

SEQ ID NO: 2960988 - RNA, 13 nt, Human
ccuucgcuccugu

SEQ ID NO: 2960989 - RNA, 14 nt, Human
ccuucgcuccugug

SEQ ID NO: 2960990 - RNA, 15 nt, Human
ccuucgcuccugugu

SEQ ID NO: 2960991 - RNA, 18 nt, Human
ccuucgcuccugugucuu

SEQ ID NO: 2960992 - RNA, 14 nt, Human
ccuugaacugggua

SEQ ID NO: 2960993 - RNA, 22 nt, Human
ccuugaaaacacuguucucugc

SEQ ID NO: 2960994 - RNA, 21 nt, Human
ccuugaaaacacuguucucug

SEQ ID NO: 2960995 - RNA, 19 nt, Human
ccuugaaaacacuguucuc

SEQ ID NO: 2960996 - RNA, 16 nt, Human
ccuugaacuggguacu

SEQ ID NO: 2960997 - RNA, 17 nt, Human
ccuugaacuuugaccuc

SEQ ID NO: 2960998 - RNA, 17 nt, Human
ccuugaaugaugccaug

SEQ ID NO: 2960999 - RNA, 11 nt, Human
ccuuuggcuuc

SEQ ID NO: 2961000 - RNA, 15 nt, Human
cccugugggccccca

SEQ ID NO: 2961001 - RNA, 16 nt, Human
cccugugggcccccaa

SEQ ID NO: 2961002 - RNA, 16 nt, Human
cccugugucauuucaa

SEQ ID NO: 2961003 - RNA, 18 nt, Human
cccugugggcccccaaau

SEQ ID NO: 2961004 - RNA, 15 nt, Human
cccuguuuguuucug

SEQ ID NO: 2961005 - RNA, 17 nt, Human
ccccucagggucccugg

SEQ ID NO: 2961006 - RNA, 20 nt, Human
ccccucagggucccuggugg

SEQ ID NO: 2961007 - RNA, 18 nt, Human
ccccucagggucccuggu

SEQ ID NO: 2961008 - RNA, 21 nt, Human
cccugguggcagugggagcug

SEQ ID NO: 2961009 - RNA, 15 nt, Human
cccugguggcagugg

SEQ ID NO: 2961010 - RNA, 16 nt, Human
cccugguggcaguggg

SEQ ID NO: 2961011 - RNA, 19 nt, Human
cccugguggcagugggagc

SEQ ID NO: 2961012 - RNA, 21 nt, Human
cccccgcugucagccauuccu

SEQ ID NO: 2961013 - RNA, 12 nt, Human
cccccagcccca

SEQ ID NO: 2961014 - RNA, 22 nt, Human
ccccaggaggccagccuugacc

SEQ ID NO: 2961015 - RNA, 21 nt, Human
ccccaggaggccagccuugac

SEQ ID NO: 2961016 - RNA, 15 nt, Human
ccccaggaggccagc

SEQ ID NO: 2961017 - RNA, 14 nt, Human
ccccaggaggccag

SEQ ID NO: 2961018 - RNA, 13 nt, Human
ccccaggaggcca

SEQ ID NO: 2961019 - RNA, 13 nt, Human
ccccacuggugac

SEQ ID NO: 2961020 - RNA, 12 nt, Human
ccccacugguga

SEQ ID NO: 2961021 - RNA, 16 nt, Human
ccgagggggcugcucc

SEQ ID NO: 2961022 - RNA, 18 nt, Human
ccgagggggcugcuccca

SEQ ID NO: 2961023 - RNA, 19 nt, Human
ccgagggggcugcucccac

SEQ ID NO: 2961024 - RNA, 18 nt, Human
ccgagaucacgccacugc

SEQ ID NO: 2961025 - RNA, 17 nt, Human
ccgaggccuucucugaa

SEQ ID NO: 2961026 - RNA, 19 nt, Human
cccuuuuuuggcugcugaa

SEQ ID NO: 2961027 - RNA, 22 nt, Human
ccgagauagccaaggccaaagg

SEQ ID NO: 2961028 - RNA, 19 nt, Human
ccgagauagccaaggccaa

SEQ ID NO: 2961029 - RNA, 18 nt, Human
ccgagauagccaaggcca

SEQ ID NO: 2961030 - RNA, 17 nt, Human
ccgagaaggaagccucc

SEQ ID NO: 2961031 - RNA, 17 nt, Human
cccuuuuucaauaacug

SEQ ID NO: 2961032 - RNA, 22 nt, Human
cccuuuuucaauaacuggaaca

SEQ ID NO: 2961033 - RNA, 18 nt, Human
cccuuuuuuggcugcuga

SEQ ID NO: 2961034 - RNA, 17 nt, Human
cccuuuuuuggcugcug

SEQ ID NO: 2961035 - RNA, 13 nt, Human
cccuuuucuguuu

SEQ ID NO: 2961036 - RNA, 11 nt, Human
cccuuuuccuu

SEQ ID NO: 2961037 - RNA, 20 nt, Human
cccuuugacgccaucccagc

SEQ ID NO: 2961038 - RNA, 18 nt, Human
cccuuguggucccacccc

SEQ ID NO: 2961039 - RNA, 16 nt, Human
cccuuguggucccacc

SEQ ID NO: 2961040 - RNA, 14 nt, Human
cccuugugguccca

SEQ ID NO: 2961041 - RNA, 18 nt, Human
cccuuggggagcaggcuc

SEQ ID NO: 2961042 - RNA, 22 nt, Human
cccuugccgucuaccugagggg

SEQ ID NO: 2961043 - RNA, 18 nt, Human
cccuugccgucuaccuga

SEQ ID NO: 2961044 - RNA, 17 nt, Human
cccuugccgucuaccug

SEQ ID NO: 2961045 - RNA, 19 nt, Human
cccuuaccucggugccuuc

SEQ ID NO: 2961046 - RNA, 16 nt, Human
cccuugaugaagaagu

SEQ ID NO: 2961047 - RNA, 15 nt, Human
cccuugaugaagaag

SEQ ID NO: 2961048 - RNA, 18 nt, Human
ccucaauaaacauuucau

SEQ ID NO: 2961049 - RNA, 14 nt, Human
ccucaauugugaaa

SEQ ID NO: 2961050 - RNA, 17 nt, Human
ccucacaguccuuacca

SEQ ID NO: 2961051 - RNA, 17 nt, Human
ccucaccuuucccaucu

SEQ ID NO: 2961052 - RNA, 15 nt, Human
ccucaccccacugug

SEQ ID NO: 2961053 - RNA, 12 nt, Human
ccucaccccacu

SEQ ID NO: 2961054 - RNA, 22 nt, Human
ccucacaguccuuaccagcaga

SEQ ID NO: 2961055 - RNA, 20 nt, Human
ccucacaguccuuaccagca

SEQ ID NO: 2961056 - RNA, 23 nt, Human
ccgcuuucuacccagcgagcccu

SEQ ID NO: 2961057 - RNA, 12 nt, Human
ccggcuggccug

SEQ ID NO: 2961058 - RNA, 15 nt, Human
ccgggcacucagaag

SEQ ID NO: 2961059 - RNA, 22 nt, Human
ccgggaggcagagguugcagug

SEQ ID NO: 2961060 - RNA, 13 nt, Human
ccggcuggccugg

SEQ ID NO: 2961061 - RNA, 23 nt, Human
ccucuguacagagcccacgcccc

SEQ ID NO: 2961062 - RNA, 18 nt, Human
ccucuguacagagcccac

SEQ ID NO: 2961063 - RNA, 17 nt, Human
ccucuguacagagccca

SEQ ID NO: 2961064 - RNA, 16 nt, Human
ccucuguacagagccc

SEQ ID NO: 2961065 - RNA, 15 nt, Human
ccucuguacagagcc

SEQ ID NO: 2961066 - RNA, 14 nt, Human
ccucuguacagagc

SEQ ID NO: 2961067 - RNA, 14 nt, Human
ccucuuagaaaaac

SEQ ID NO: 2961068 - RNA, 23 nt, Human
ccucuuagaugcaguucugaaga

SEQ ID NO: 2961069 - RNA, 14 nt, Human
ccucuuaugggcug

SEQ ID NO: 2961070 - RNA, 16 nt, Human
ccucuuaugggcuggg

SEQ ID NO: 2961071 - RNA, 15 nt, Human
ccucuuaugggcugg

SEQ ID NO: 2961072 - RNA, 20 nt, Human
ccugaacaggauauucucac

SEQ ID NO: 2961073 - RNA, 15 nt, Human
ccugaagucacacag

SEQ ID NO: 2961074 - RNA, 13 nt, Human
ccugaaggccccg

SEQ ID NO: 2961075 - RNA, 16 nt, Human
ccugaagucacacagu

SEQ ID NO: 2961076 - RNA, 17 nt, Human
ccugaagucacacagug

SEQ ID NO: 2961077 - RNA, 17 nt, Human
ccucuuaugggcugggu

SEQ ID NO: 2961078 - RNA, 22 nt, Human
ccucuuuggucuacacugugcu

SEQ ID NO: 2961079 - RNA, 18 nt, Human
ccugaaagaggaaugaag

SEQ ID NO: 2961080 - RNA, 13 nt, Human
ccugaaagaggaa

SEQ ID NO: 2961081 - RNA, 23 nt, Human
ccugaaagaggaaugaaguacuc

SEQ ID NO: 2961082 - RNA, 18 nt, Human
ccugaugcuucuucagag

SEQ ID NO: 2961083 - RNA, 17 nt, Human
ccugaugcuucuucaga

SEQ ID NO: 2961084 - RNA, 22 nt, Human
ccugauuuaauaugcaaagucu

SEQ ID NO: 2961085 - RNA, 23 nt, Human
ccugauugugucucuugguccug

SEQ ID NO: 2961086 - RNA, 14 nt, Human
ccugaugcuucuuc

SEQ ID NO: 2961087 - RNA, 18 nt, Human
ccugaggcuccacuuggu

SEQ ID NO: 2961088 - RNA, 20 nt, Human
ccugaggcuccacuuggucu

SEQ ID NO: 2961089 - RNA, 12 nt, Human
ccugaggcccag

SEQ ID NO: 2961090 - RNA, 14 nt, Human
ccugaggcccagag

SEQ ID NO: 2961091 - RNA, 13 nt, Human
ccugaggcccaga

SEQ ID NO: 2961092 - RNA, 16 nt, Human
ccugacaacacucauu

SEQ ID NO: 2961093 - RNA, 15 nt, Human
ccugacaacacucau

SEQ ID NO: 2961094 - RNA, 14 nt, Human
ccugacaacacuca

SEQ ID NO: 2961095 - RNA, 12 nt, Human
ccugacaacacu

SEQ ID NO: 2961096 - RNA, 17 nt, Human
ccugaggcuccacuugg

SEQ ID NO: 2961097 - RNA, 23 nt, Human
ccugaggcccuucucuccagccc

SEQ ID NO: 2961098 - RNA, 22 nt, Human
ccugaggcccuucucuccagcc

SEQ ID NO: 2961099 - RNA, 21 nt, Human
ccugaggcccuucucuccagc

SEQ ID NO: 2961100 - RNA, 20 nt, Human
ccugaggcccuucucuccag

SEQ ID NO: 2961101 - RNA, 19 nt, Human
ccugaggcccuucucucca

SEQ ID NO: 2961102 - RNA, 17 nt, Human
ccugaggcccuucucuc

SEQ ID NO: 2961103 - RNA, 16 nt, Human
ccugaggcccuucucu

SEQ ID NO: 2961104 - RNA, 23 nt, Human
ccuccugugugugcgccuacagg

SEQ ID NO: 2961105 - RNA, 12 nt, Human
ccucucccauca

SEQ ID NO: 2961106 - RNA, 16 nt, Human
ccucugacacacagcu

SEQ ID NO: 2961107 - RNA, 15 nt, Human
ccucugacacacagc

SEQ ID NO: 2961108 - RNA, 23 nt, Human
ccucugaaaaccaauguucucuc

SEQ ID NO: 2961109 - RNA, 11 nt, Human
ccucuccuggg

SEQ ID NO: 2961110 - RNA, 12 nt, Human
ccucuccugggc

SEQ ID NO: 2961111 - RNA, 13 nt, Human
ccucuccugggca

SEQ ID NO: 2961112 - RNA, 17 nt, Human
ccucugacacacagcuc

SEQ ID NO: 2961113 - RNA, 18 nt, Human
ccucugacacacagcucu

SEQ ID NO: 2961114 - RNA, 15 nt, Human
ccucugcacaagcug

SEQ ID NO: 2961115 - RNA, 11 nt, Human
ccucugcacaa

SEQ ID NO: 2961116 - RNA, 19 nt, Human
ccucugcacaagcugcacc

SEQ ID NO: 2961117 - RNA, 17 nt, Human
ccucugcacaagcugca

SEQ ID NO: 2961118 - RNA, 20 nt, Human
ccucugcacaagcugcaccc

SEQ ID NO: 2961119 - RNA, 22 nt, Human
ccucugcacuccccugcugggu

SEQ ID NO: 2961120 - RNA, 21 nt, Human
ccucugcacuccccugcuggg

SEQ ID NO: 2961121 - RNA, 20 nt, Human
ccucugcacuccccugcugg

SEQ ID NO: 2961122 - RNA, 19 nt, Human
ccucugcacuccccugcug

SEQ ID NO: 2961123 - RNA, 14 nt, Human
ccucugcacucccc

SEQ ID NO: 2961124 - RNA, 12 nt, Human
ccucugggacug

SEQ ID NO: 2961125 - RNA, 21 nt, Human
ccucugcuugccaucccuccc

SEQ ID NO: 2961126 - RNA, 17 nt, Human
ccucugcuugccauccc

SEQ ID NO: 2961127 - RNA, 20 nt, Human
ccucugcuugccaucccucc

SEQ ID NO: 2961128 - RNA, 14 nt, Human
ccucagggucccug

SEQ ID NO: 2961129 - RNA, 11 nt, Human
ccucaggccug

SEQ ID NO: 2961130 - RNA, 21 nt, Human
ccucaggccugggggcugggc

SEQ ID NO: 2961131 - RNA, 14 nt, Human
ccucaggccugggg

SEQ ID NO: 2961132 - RNA, 16 nt, Human
ccucagcauccuggca

SEQ ID NO: 2961133 - RNA, 17 nt, Human
ccucagcauccuggcac

SEQ ID NO: 2961134 - RNA, 14 nt, Human
ccucagcauccugg

SEQ ID NO: 2961135 - RNA, 20 nt, Human
ccucagaaaacaaggaugaa

SEQ ID NO: 2961136 - RNA, 16 nt, Human
ccucaggugagaagca

SEQ ID NO: 2961137 - RNA, 22 nt, Human
ccucagggucccugguggcagc

SEQ ID NO: 2961138 - RNA, 15 nt, Human
ccucagggucccugg

SEQ ID NO: 2961139 - RNA, 22 nt, Human
ccucaggugauccacccaccuc

SEQ ID NO: 2961140 - RNA, 22 nt, Human
ccucaggugagaagcagaggaa

SEQ ID NO: 2961141 - RNA, 17 nt, Human
ccucaggugauccaccc

SEQ ID NO: 2961142 - RNA, 19 nt, Human
ccucaggugauccacccac

SEQ ID NO: 2961143 - RNA, 15 nt, Human
ccucagucuggcccu

SEQ ID NO: 2961144 - RNA, 15 nt, Human
ccuccccuccucugc

SEQ ID NO: 2961145 - RNA, 14 nt, Human
ccuccccuccucug

SEQ ID NO: 2961146 - RNA, 13 nt, Human
ccuccugggcuaa

SEQ ID NO: 2961147 - RNA, 20 nt, Human
ccuccugggauuggcuguga

SEQ ID NO: 2961148 - RNA, 13 nt, Human
ccuccugugugug

SEQ ID NO: 2961149 - RNA, 15 nt, Human
ccuccugugugugcg

SEQ ID NO: 2961150 - RNA, 22 nt, Human
ccuccugugugugcgccuacag

SEQ ID NO: 2961151 - RNA, 13 nt, Human
ccuccugccucga

SEQ ID NO: 2961152 - RNA, 11 nt, Human
ccuccucugcu

SEQ ID NO: 2961153 - RNA, 12 nt, Human
ccucccugcaau

SEQ ID NO: 2961154 - RNA, 16 nt, Human
ccucccugcaauaaaa

SEQ ID NO: 2961155 - RNA, 16 nt, Human
ccucccucccucuuuc

SEQ ID NO: 2961156 - RNA, 13 nt, Human
ccucccucccucu

SEQ ID NO: 2961157 - RNA, 15 nt, Human
ccucccucccucuuu

SEQ ID NO: 2961158 - RNA, 17 nt, Human
ccuccccuccucugcuu

SEQ ID NO: 2961159 - RNA, 18 nt, Human
ccuccccuccucugcuug

SEQ ID NO: 2961160 - RNA, 21 nt, Human
cugauaaagaugagugagcau

SEQ ID NO: 2961161 - RNA, 23 nt, Human
cugaucauguuuaugagaaacug

SEQ ID NO: 2961162 - RNA, 14 nt, Human
cugaucgcuucucc

SEQ ID NO: 2961163 - RNA, 16 nt, Human
cugauucccugauuua

SEQ ID NO: 2961164 - RNA, 22 nt, Human
cugauucccaagcucugcuccu

SEQ ID NO: 2961165 - RNA, 19 nt, Human
cugauucccaagcucugcu

SEQ ID NO: 2961166 - RNA, 20 nt, Human
cugauucccaagcucugcuc

SEQ ID NO: 2961167 - RNA, 17 nt, Human
cugauucccaagcucug

SEQ ID NO: 2961168 - RNA, 18 nt, Human
cugauucccaagcucugc

SEQ ID NO: 2961169 - RNA, 15 nt, Human
cugauucccaagcuc

SEQ ID NO: 2961170 - RNA, 21 nt, Human
cugauguuccuagugaaagag

SEQ ID NO: 2961171 - RNA, 20 nt, Human
cugauguuccuagugaaaga

SEQ ID NO: 2961172 - RNA, 18 nt, Human
cugauguuccuagugaaa

SEQ ID NO: 2961173 - RNA, 13 nt, Human
cugauguuccuag

SEQ ID NO: 2961174 - RNA, 22 nt, Human
cugagugggggaucacagccuc

SEQ ID NO: 2961175 - RNA, 13 nt, Human
cugauaaagauga

SEQ ID NO: 2961176 - RNA, 16 nt, Human
cugagucugaaggcug

SEQ ID NO: 2961177 - RNA, 15 nt, Human
cugagucugaaggcu

SEQ ID NO: 2961178 - RNA, 14 nt, Human
cugagucugaaggc

SEQ ID NO: 2961179 - RNA, 13 nt, Human
cugagucugaagg

SEQ ID NO: 2961180 - RNA, 22 nt, Human
cugcacagcaggcugccagugc

SEQ ID NO: 2961181 - RNA, 21 nt, Human
cugcacagcaggcugccagug

SEQ ID NO: 2961182 - RNA, 20 nt, Human
cugcacagcaggcugccagu

SEQ ID NO: 2961183 - RNA, 16 nt, Human
cugcacaagcugcacc

SEQ ID NO: 2961184 - RNA, 15 nt, Human
cugcacaagcugcac

SEQ ID NO: 2961185 - RNA, 14 nt, Human
cugcacaagcugca

SEQ ID NO: 2961186 - RNA, 13 nt, Human
cugcacaagcugc

SEQ ID NO: 2961187 - RNA, 18 nt, Human
cugcacccucaggcaggu

SEQ ID NO: 2961188 - RNA, 16 nt, Human
cugcacccucaggcag

SEQ ID NO: 2961189 - RNA, 17 nt, Human
cugcacccucaggcagg

SEQ ID NO: 2961190 - RNA, 22 nt, Human
cugcagccucaaccuccugggc

SEQ ID NO: 2961191 - RNA, 19 nt, Human
cugcagccucaaccuccug

SEQ ID NO: 2961192 - RNA, 20 nt, Human
cugcagccucaaccuccugg

SEQ ID NO: 2961193 - RNA, 17 nt, Human
cugcagggacagagcau

SEQ ID NO: 2961194 - RNA, 22 nt, Human
cugcagggaguccgaaagggac

SEQ ID NO: 2961195 - RNA, 11 nt, Human
cugcagccuca

SEQ ID NO: 2961196 - RNA, 14 nt, Human
cugcacuugcagac

SEQ ID NO: 2961197 - RNA, 16 nt, Human
cugcacuugcagacuc

SEQ ID NO: 2961198 - RNA, 17 nt, Human
cugcacuugcagacucu

SEQ ID NO: 2961199 - RNA, 19 nt, Human
cugcaccggcuggccuggc

SEQ ID NO: 2961200 - RNA, 18 nt, Human
cugcaccggcuggccugg

SEQ ID NO: 2961201 - RNA, 17 nt, Human
cugcaccggcuggccug

SEQ ID NO: 2961202 - RNA, 23 nt, Human
cugcagaagacaguauggcagcu

SEQ ID NO: 2961203 - RNA, 13 nt, Human
cugcagaagacag

SEQ ID NO: 2961204 - RNA, 16 nt, Human
cugccauuucugagau

SEQ ID NO: 2961205 - RNA, 13 nt, Human
cugcccaggcccc

SEQ ID NO: 2961206 - RNA, 16 nt, Human
cugccccuggcagccc

SEQ ID NO: 2961207 - RNA, 15 nt, Human
cugccccuggcagcc

SEQ ID NO: 2961208 - RNA, 14 nt, Human
cugccccuggcagc

SEQ ID NO: 2961209 - RNA, 16 nt, Human
cugcccugcccaccug

SEQ ID NO: 2961210 - RNA, 15 nt, Human
cugcccugcccaccu

SEQ ID NO: 2961211 - RNA, 14 nt, Human
cugcccugcccacc

SEQ ID NO: 2961212 - RNA, 13 nt, Human
cugcccugcccac

SEQ ID NO: 2961213 - RNA, 11 nt, Human
cugcccggcug

SEQ ID NO: 2961214 - RNA, 15 nt, Human
cugcccggcugcgga

SEQ ID NO: 2961215 - RNA, 19 nt, Human
cugcccuccaagaccuucu

SEQ ID NO: 2961216 - RNA, 15 nt, Human
cugccacccugggga

SEQ ID NO: 2961217 - RNA, 16 nt, Human
cugccacccuggggag

SEQ ID NO: 2961218 - RNA, 20 nt, Human
cugccacccuggggagaaag

SEQ ID NO: 2961219 - RNA, 14 nt, Human
cugccacccugggg

SEQ ID NO: 2961220 - RNA, 19 nt, Human
cugccaugccagcuuaucu

SEQ ID NO: 2961221 - RNA, 17 nt, Human
cugccaugccagcuuau

SEQ ID NO: 2961222 - RNA, 15 nt, Human
cugccaugccagcuu

SEQ ID NO: 2961223 - RNA, 19 nt, Human
cugccagccgagauagcca

SEQ ID NO: 2961224 - RNA, 19 nt, Human
cugccaggaagccagcagg

SEQ ID NO: 2961225 - RNA, 18 nt, Human
cugccaggaagccagcag

SEQ ID NO: 2961226 - RNA, 16 nt, Human
cugccaggaagccagc

SEQ ID NO: 2961227 - RNA, 15 nt, Human
cugccaggaagccag

SEQ ID NO: 2961228 - RNA, 14 nt, Human
cugcuccagcuguu

SEQ ID NO: 2961229 - RNA, 16 nt, Human
cugcgguccacccagg

SEQ ID NO: 2961230 - RNA, 21 nt, Human
cugcggaaugaaccacaucuu

SEQ ID NO: 2961231 - RNA, 15 nt, Human
cugcgguccacccag

SEQ ID NO: 2961232 - RNA, 20 nt, Human
cugcggaaugaaccacaucu

SEQ ID NO: 2961233 - RNA, 16 nt, Human
cugcuccucuccccag

SEQ ID NO: 2961234 - RNA, 17 nt, Human
cugcuccucuccccagc

SEQ ID NO: 2961235 - RNA, 15 nt, Human
cugcuccagcuguuc

SEQ ID NO: 2961236 - RNA, 18 nt, Human
cugcuccucuccccagca

SEQ ID NO: 2961237 - RNA, 23 nt, Human
cugccugaagucacacagugagu

SEQ ID NO: 2961238 - RNA, 13 nt, Human
cugccucuucucu

SEQ ID NO: 2961239 - RNA, 13 nt, Human
cugccugcccagg

SEQ ID NO: 2961240 - RNA, 14 nt, Human
cugccugcccaggc

SEQ ID NO: 2961241 - RNA, 14 nt, Human
cugccucagccucc

SEQ ID NO: 2961242 - RNA, 13 nt, Human
cugccucagccuc

SEQ ID NO: 2961243 - RNA, 15 nt, Human
cugccuaagugcagc

SEQ ID NO: 2961244 - RNA, 17 nt, Human
cuggagcuagaauuuga

SEQ ID NO: 2961245 - RNA, 22 nt, Human
cuggagcuagaauuugauaugu

SEQ ID NO: 2961246 - RNA, 16 nt, Human
cuggagcuagaauuug

SEQ ID NO: 2961247 - RNA, 13 nt, Human
cugcugaaacaac

SEQ ID NO: 2961248 - RNA, 22 nt, Human
cuggacacuucacgcccuuggc

SEQ ID NO: 2961249 - RNA, 20 nt, Human
cuggacacuucacgcccuug

SEQ ID NO: 2961250 - RNA, 14 nt, Human
cuggaaugcagugg

SEQ ID NO: 2961251 - RNA, 15 nt, Human
cuggaaugcaguggu

SEQ ID NO: 2961252 - RNA, 14 nt, Human
cuggaagcacagcu

SEQ ID NO: 2961253 - RNA, 18 nt, Human
cuggaagcacagcuucau

SEQ ID NO: 2961254 - RNA, 15 nt, Human
cuggaagcacagcuu

SEQ ID NO: 2961255 - RNA, 23 nt, Human
cuggaauaauccuaaacauauga

SEQ ID NO: 2961256 - RNA, 23 nt, Human
cuggccuagcauacguacacauu

SEQ ID NO: 2961257 - RNA, 20 nt, Human
cuggcccagggcaucuggga

SEQ ID NO: 2961258 - RNA, 13 nt, Human
cuggcccacugca

SEQ ID NO: 2961259 - RNA, 12 nt, Human
cuggcccacugc

SEQ ID NO: 2961260 - RNA, 17 nt, Human
cuggccuagcauacgua

SEQ ID NO: 2961261 - RNA, 17 nt, Human
cuggcccagggcaucug

SEQ ID NO: 2961262 - RNA, 18 nt, Human
cuggcccagggcaucugg

SEQ ID NO: 2961263 - RNA, 14 nt, Human
cuggcccagggcau

SEQ ID NO: 2961264 - RNA, 13 nt, Human
cuggcccagggca

SEQ ID NO: 2961265 - RNA, 21 nt, Human
cuggccagaugcaccagcccu

SEQ ID NO: 2961266 - RNA, 17 nt, Human
cuggccagaugcaccag

SEQ ID NO: 2961267 - RNA, 18 nt, Human
cuggccagaugcaccagc

SEQ ID NO: 2961268 - RNA, 19 nt, Human
cuggccagaugcaccagcc

SEQ ID NO: 2961269 - RNA, 20 nt, Human
cuggccagaugcaccagccc

SEQ ID NO: 2961270 - RNA, 17 nt, Human
cuggcacugcuuccagu

SEQ ID NO: 2961271 - RNA, 16 nt, Human
cuggcacugcuuccag

SEQ ID NO: 2961272 - RNA, 15 nt, Human
cuggcacugcuucca

SEQ ID NO: 2961273 - RNA, 16 nt, Human
cuggccagaugcacca

SEQ ID NO: 2961274 - RNA, 16 nt, Human
cuggccaacgggguga

SEQ ID NO: 2961275 - RNA, 15 nt, Human
cuggauggggcugca

SEQ ID NO: 2961276 - RNA, 13 nt, Human
cuggauuaaacuu

SEQ ID NO: 2961277 - RNA, 23 nt, Human
cuggauuaaacuuaaucuaaaug

SEQ ID NO: 2961278 - RNA, 16 nt, Human
cuggauggggcugcac

SEQ ID NO: 2961279 - RNA, 12 nt, Human
cuggcaaagcag

SEQ ID NO: 2961280 - RNA, 16 nt, Human
cuggcaaagcagaaug

SEQ ID NO: 2961281 - RNA, 19 nt, Human
cuggcaaagcagaauguga

SEQ ID NO: 2961282 - RNA, 23 nt, Human
cuggcaaacagggccucugcgga

SEQ ID NO: 2961283 - RNA, 20 nt, Human
cuggcaaacagggccucugc

SEQ ID NO: 2961284 - RNA, 21 nt, Human
cuggcaaacagggccucugcg

SEQ ID NO: 2961285 - RNA, 16 nt, Human
cuggcaaacagggccu

SEQ ID NO: 2961286 - RNA, 17 nt, Human
cuggcaaacagggccuc

SEQ ID NO: 2961287 - RNA, 19 nt, Human
cuggcaaacagggccucug

SEQ ID NO: 2961288 - RNA, 19 nt, Human
cuggcacaguuuucugaga

SEQ ID NO: 2961289 - RNA, 18 nt, Human
cuggcacaguuuucugag

SEQ ID NO: 2961290 - RNA, 14 nt, Human
cuggcacugcuucc

SEQ ID NO: 2961291 - RNA, 13 nt, Human
cuggcacugcuuc

SEQ ID NO: 2961292 - RNA, 23 nt, Human
cuggcacuauaauguaagcucua

SEQ ID NO: 2961293 - RNA, 22 nt, Human
cuggcacuauaauguaagcucu

SEQ ID NO: 2961294 - RNA, 13 nt, Human
cuggccugagcug

SEQ ID NO: 2961295 - RNA, 17 nt, Human
cuggcucuuccaggcug

SEQ ID NO: 2961296 - RNA, 20 nt, Human
cuggcucuuccaggcuggga

SEQ ID NO: 2961297 - RNA, 19 nt, Human
cuggcucuuccaggcuggg

SEQ ID NO: 2961298 - RNA, 18 nt, Human
cuggcucuuccaggcugg

SEQ ID NO: 2961299 - RNA, 19 nt, Human
cuggcuguuggcugggggc

SEQ ID NO: 2961300 - RNA, 22 nt, Human
cuggcuggguggcaccagcagc

SEQ ID NO: 2961301 - RNA, 21 nt, Human
cuggcuggguggcaccagcag

SEQ ID NO: 2961302 - RNA, 18 nt, Human
cuggcuguuggcuggggg

SEQ ID NO: 2961303 - RNA, 20 nt, Human
cuggcuguuggcugggggcc

SEQ ID NO: 2961304 - RNA, 20 nt, Human
cugggcaaugugauaaaacc

SEQ ID NO: 2961305 - RNA, 16 nt, Human
cugggagugagcuggu

SEQ ID NO: 2961306 - RNA, 13 nt, Human
cugggagugagcu

SEQ ID NO: 2961307 - RNA, 12 nt, Human
cugggagugagc

SEQ ID NO: 2961308 - RNA, 18 nt, Human
cugggaggaaccgagggg

SEQ ID NO: 2961309 - RNA, 18 nt, Human
cugggaggucaaggcugc

SEQ ID NO: 2961310 - RNA, 16 nt, Human
cugggagcuuuuguag

SEQ ID NO: 2961311 - RNA, 12 nt, Human
cugggaggaacc

SEQ ID NO: 2961312 - RNA, 22 nt, Human
cugggaacccaaguccaagcau

SEQ ID NO: 2961313 - RNA, 21 nt, Human
cugggcuucaguggcagcugc

SEQ ID NO: 2961314 - RNA, 22 nt, Human
cugggcuucaguggcagcugcu

SEQ ID NO: 2961315 - RNA, 23 nt, Human
cugggcuucaguggcagcugcuu

SEQ ID NO: 2961316 - RNA, 13 nt, Human
cugggcuugggga

SEQ ID NO: 2961317 - RNA, 20 nt, Human
cugggcuuggggaccagagc

SEQ ID NO: 2961318 - RNA, 17 nt, Human
cugggcuuggggaccag

SEQ ID NO: 2961319 - RNA, 21 nt, Human
cugggcuuggggaccagagcu

SEQ ID NO: 2961320 - RNA, 18 nt, Human
cugggcuucaguggcagc

SEQ ID NO: 2961321 - RNA, 17 nt, Human
cugggcuucaguggcag

SEQ ID NO: 2961322 - RNA, 19 nt, Human
cugggcuucaguggcagcu

SEQ ID NO: 2961323 - RNA, 20 nt, Human
cugggcuucaguggcagcug

SEQ ID NO: 2961324 - RNA, 19 nt, Human
cuggguacuuguggacaca

SEQ ID NO: 2961325 - RNA, 21 nt, Human
cuggguacuuguggacacagc

SEQ ID NO: 2961326 - RNA, 23 nt, Human
cuggguacuuguggacacagcuc

SEQ ID NO: 2961327 - RNA, 20 nt, Human
cuggguacuuguggacacag

SEQ ID NO: 2961328 - RNA, 23 nt, Human
cugggguggggaccucaggccug

SEQ ID NO: 2961329 - RNA, 22 nt, Human
cugggguggggaccucaggccu

SEQ ID NO: 2961330 - RNA, 21 nt, Human
cugggguggggaccucaggcc

SEQ ID NO: 2961331 - RNA, 13 nt, Human
cugggggccucag

SEQ ID NO: 2961332 - RNA, 17 nt, Human
cugggggccucagugcc

SEQ ID NO: 2961333 - RNA, 18 nt, Human
cugggggccucagugcca

SEQ ID NO: 2961334 - RNA, 17 nt, Human
cugggguggggaccuca

SEQ ID NO: 2961335 - RNA, 19 nt, Human
cugggguggggaccucagg

SEQ ID NO: 2961336 - RNA, 18 nt, Human
cugggguggggaccucag

SEQ ID NO: 2961337 - RNA, 19 nt, Human
cugguggcagugggagcug

SEQ ID NO: 2961338 - RNA, 23 nt, Human
cugguggcagugggagcugccug

SEQ ID NO: 2961339 - RNA, 19 nt, Human
cuggguucuacccaggugc

SEQ ID NO: 2961340 - RNA, 13 nt, Human
cuggguuggaggg

SEQ ID NO: 2961341 - RNA, 17 nt, Human
cugguccauagagagca

SEQ ID NO: 2961342 - RNA, 15 nt, Human
cugguccauagagag

SEQ ID NO: 2961343 - RNA, 15 nt, Human
cuggucccacucagu

SEQ ID NO: 2961344 - RNA, 18 nt, Human
cuggucccacucagucca

SEQ ID NO: 2961345 - RNA, 14 nt, Human
cuggucccacucag

SEQ ID NO: 2961346 - RNA, 18 nt, Human
cugguccauagagagcaa

SEQ ID NO: 2961347 - RNA, 21 nt, Human
cuggucccagccagcaguuca

SEQ ID NO: 2961348 - RNA, 14 nt, Human
cugaagucacacag

SEQ ID NO: 2961349 - RNA, 15 nt, Human
cugaagucacacagu

SEQ ID NO: 2961350 - RNA, 24 nt, Human
cugaagucuuuguacagacaacaa

SEQ ID NO: 2961351 - RNA, 16 nt, Human
cugaauacagaggcaa

SEQ ID NO: 2961352 - RNA, 19 nt, Human
cugaagacucauucuucug

SEQ ID NO: 2961353 - RNA, 21 nt, Human
cugaagacucauucuucugua

SEQ ID NO: 2961354 - RNA, 21 nt, Human
cugaacuuggcgcugccccug

SEQ ID NO: 2961355 - RNA, 16 nt, Human
cugaacuuggcgcugc

SEQ ID NO: 2961356 - RNA, 15 nt, Human
cugaacuuggcgcug

SEQ ID NO: 2961357 - RNA, 16 nt, Human
cugaacuucagagcau

SEQ ID NO: 2961358 - RNA, 21 nt, Human
cugaaccuggguaacuaggga

SEQ ID NO: 2961359 - RNA, 18 nt, Human
cucuuugggccuggcucc

SEQ ID NO: 2961360 - RNA, 21 nt, Human
cucuuuggucuacacugugcu

SEQ ID NO: 2961361 - RNA, 19 nt, Human
cucuuuggucuacacugug

SEQ ID NO: 2961362 - RNA, 11 nt, Human
cugacccacug

SEQ ID NO: 2961363 - RNA, 17 nt, Human
cugacauuguuggccaa

SEQ ID NO: 2961364 - RNA, 20 nt, Human
cugacaggcaaugcuggcug

SEQ ID NO: 2961365 - RNA, 16 nt, Human
cugacaggcaaugcug

SEQ ID NO: 2961366 - RNA, 17 nt, Human
cugacaggcaaugcugg

SEQ ID NO: 2961367 - RNA, 18 nt, Human
cugacaggcaaugcuggc

SEQ ID NO: 2961368 - RNA, 19 nt, Human
cugacaggcaaugcuggcu

SEQ ID NO: 2961369 - RNA, 11 nt, Human
cugacaggcaa

SEQ ID NO: 2961370 - RNA, 21 nt, Human
cugacagacacaggcccggcu

SEQ ID NO: 2961371 - RNA, 19 nt, Human
cugacagacacaggcccgg

SEQ ID NO: 2961372 - RNA, 23 nt, Human
cugaauuuaaauagcuuuuuucu

SEQ ID NO: 2961373 - RNA, 14 nt, Human
cugaauuuaaauag

SEQ ID NO: 2961374 - RNA, 18 nt, Human
cugaauuuaaauagcuuu

SEQ ID NO: 2961375 - RNA, 19 nt, Human
cucuggcagcucagagagg

SEQ ID NO: 2961376 - RNA, 18 nt, Human
cucuggcagcucagagag

SEQ ID NO: 2961377 - RNA, 17 nt, Human
cucuggcagcucagaga

SEQ ID NO: 2961378 - RNA, 13 nt, Human
cucuuaaaaccca

SEQ ID NO: 2961379 - RNA, 24 nt, Human
cucuuaaaacccaagugccuuagc

SEQ ID NO: 2961380 - RNA, 12 nt, Human
cucuucuccagg

SEQ ID NO: 2961381 - RNA, 23 nt, Human
cucuuccaggcugggagagccuu

SEQ ID NO: 2961382 - RNA, 21 nt, Human
cucuuccaggcugggagagcc

SEQ ID NO: 2961383 - RNA, 22 nt, Human
cucuuccaggcugggagagccu

SEQ ID NO: 2961384 - RNA, 19 nt, Human
cucuugguccugcugcagu

SEQ ID NO: 2961385 - RNA, 18 nt, Human
cucuugguccugcugcag

SEQ ID NO: 2961386 - RNA, 16 nt, Human
cucuugaccucaggug

SEQ ID NO: 2961387 - RNA, 13 nt, Human
cucuugaccucag

SEQ ID NO: 2961388 - RNA, 15 nt, Human
cucuugaccucaggu

SEQ ID NO: 2961389 - RNA, 17 nt, Human
cucuuucuauuguuucu

SEQ ID NO: 2961390 - RNA, 18 nt, Human
cucuuuggacacucacac

SEQ ID NO: 2961391 - RNA, 15 nt, Human
cucuuuggacacuca

SEQ ID NO: 2961392 - RNA, 17 nt, Human
cucuuuccaucuacccu

SEQ ID NO: 2961393 - RNA, 22 nt, Human
cucuccuguaccucuugagccu

SEQ ID NO: 2961394 - RNA, 17 nt, Human
cucuccuguaccucuug

SEQ ID NO: 2961395 - RNA, 18 nt, Human
cucuccuguaccucuuga

SEQ ID NO: 2961396 - RNA, 21 nt, Human
cucuccugggcagcugccucc

SEQ ID NO: 2961397 - RNA, 13 nt, Human
cucuccuguaccu

SEQ ID NO: 2961398 - RNA, 14 nt, Human
cucuccuguaccuc

SEQ ID NO: 2961399 - RNA, 15 nt, Human
cucuccuguaccucu

SEQ ID NO: 2961400 - RNA, 14 nt, Human
cucucucacuccuu

SEQ ID NO: 2961401 - RNA, 12 nt, Human
cucucucaggcc

SEQ ID NO: 2961402 - RNA, 16 nt, Human
cucucucacuccuuga

SEQ ID NO: 2961403 - RNA, 15 nt, Human
cucucucacuccuug

SEQ ID NO: 2961404 - RNA, 22 nt, Human
cucucaggccagcugcuugggc

SEQ ID NO: 2961405 - RNA, 23 nt, Human
cucucaggccagcugcuugggcu

SEQ ID NO: 2961406 - RNA, 13 nt, Human
cucucccaucacu

SEQ ID NO: 2961407 - RNA, 20 nt, Human
cucucccaucacuucccuac

SEQ ID NO: 2961408 - RNA, 14 nt, Human
cucucccaucacuu

SEQ ID NO: 2961409 - RNA, 18 nt, Human
cucucccaucacuucccu

SEQ ID NO: 2961410 - RNA, 12 nt, Human
cucuccagcccc

SEQ ID NO: 2961411 - RNA, 13 nt, Human
cucuccagccccu

SEQ ID NO: 2961412 - RNA, 17 nt, Human
cucugcggagcacacug

SEQ ID NO: 2961413 - RNA, 18 nt, Human
cucugcggagcacacugg

SEQ ID NO: 2961414 - RNA, 19 nt, Human
cucugcggagcacacuggc

SEQ ID NO: 2961415 - RNA, 21 nt, Human
cucugcggagcacacuggcuc

SEQ ID NO: 2961416 - RNA, 23 nt, Human
cucugcggagcacacuggcucac

SEQ ID NO: 2961417 - RNA, 14 nt, Human
cucugccucugaca

SEQ ID NO: 2961418 - RNA, 23 nt, Human
cucugcccuccaagaccuucucc

SEQ ID NO: 2961419 - RNA, 16 nt, Human
cucugcccuccaagac

SEQ ID NO: 2961420 - RNA, 15 nt, Human
cucugcccuccaaga

SEQ ID NO: 2961421 - RNA, 14 nt, Human
cucugcccuccaag

SEQ ID NO: 2961422 - RNA, 22 nt, Human
cucugcaagaauugaagcagga

SEQ ID NO: 2961423 - RNA, 23 nt, Human
cucugcauacucauuaggauggc

SEQ ID NO: 2961424 - RNA, 11 nt, Human
cuccacccugc

SEQ ID NO: 2961425 - RNA, 12 nt, Human
cuccacccugcu

SEQ ID NO: 2961426 - RNA, 14 nt, Human
cuccaccucccugc

SEQ ID NO: 2961427 - RNA, 15 nt, Human
cuccaccucccugca

SEQ ID NO: 2961428 - RNA, 16 nt, Human
cuccaccucccugcaa

SEQ ID NO: 2961429 - RNA, 17 nt, Human
cuccaccucccugcaau

SEQ ID NO: 2961430 - RNA, 21 nt, Human
cuccaccugccagggacagag

SEQ ID NO: 2961431 - RNA, 18 nt, Human
cuccaccugccagggaca

SEQ ID NO: 2961432 - RNA, 17 nt, Human
cuccaccugccagggac

SEQ ID NO: 2961433 - RNA, 15 nt, Human
cuccaccugccaggg

SEQ ID NO: 2961434 - RNA, 19 nt, Human
cuccagcucaccagcccca

SEQ ID NO: 2961435 - RNA, 20 nt, Human
cuccagcucaccagccccag

SEQ ID NO: 2961436 - RNA, 19 nt, Human
cuccagcuguucagcuggu

SEQ ID NO: 2961437 - RNA, 18 nt, Human
cuccagcuguucagcugg

SEQ ID NO: 2961438 - RNA, 13 nt, Human
cuccagcuguuca

SEQ ID NO: 2961439 - RNA, 11 nt, Human
cuccaggcucc

SEQ ID NO: 2961440 - RNA, 21 nt, Human
cuccauccugaggcuccacuu

SEQ ID NO: 2961441 - RNA, 20 nt, Human
cuccauccugaggcuccacu

SEQ ID NO: 2961442 - RNA, 23 nt, Human
cuccauccugaggcuccacuugg

SEQ ID NO: 2961443 - RNA, 14 nt, Human
cuccaugugggcua

SEQ ID NO: 2961444 - RNA, 15 nt, Human
cucccaggcauuccc

SEQ ID NO: 2961445 - RNA, 21 nt, Human
cucccaaggggcccaaauucu

SEQ ID NO: 2961446 - RNA, 22 nt, Human
cucccaaggggcccaaauucuu

SEQ ID NO: 2961447 - RNA, 22 nt, Human
cucccaggcauuccccaggagg

SEQ ID NO: 2961448 - RNA, 17 nt, Human
cucccagucauuuaaua

SEQ ID NO: 2961449 - RNA, 21 nt, Human
cucccaggcauuccccaggag

SEQ ID NO: 2961450 - RNA, 20 nt, Human
cucccaggcauuccccagga

SEQ ID NO: 2961451 - RNA, 19 nt, Human
cucccaggcauuccccagg

SEQ ID NO: 2961452 - RNA, 17 nt, Human
cucccaggcauucccca

SEQ ID NO: 2961453 - RNA, 17 nt, Human
cucauuaggauggcuag

SEQ ID NO: 2961454 - RNA, 18 nt, Human
cucauuaggauggcuagu

SEQ ID NO: 2961455 - RNA, 21 nt, Human
cucauuagcauuuugcuaaau

SEQ ID NO: 2961456 - RNA, 14 nt, Human
cucauauuuucaug

SEQ ID NO: 2961457 - RNA, 16 nt, Human
cucauugaccugaggc

SEQ ID NO: 2961458 - RNA, 23 nt, Human
cucauucuucuguacgucugaca

SEQ ID NO: 2961459 - RNA, 15 nt, Human
cucauugaccugagg

SEQ ID NO: 2961460 - RNA, 13 nt, Human
cucauugaccuga

SEQ ID NO: 2961461 - RNA, 17 nt, Human
cucauucauuacuaaaa

SEQ ID NO: 2961462 - RNA, 13 nt, Human
cucauucauuacu

SEQ ID NO: 2961463 - RNA, 13 nt, Human
cucauucuucugu

SEQ ID NO: 2961464 - RNA, 14 nt, Human
cucauucuucugua

SEQ ID NO: 2961465 - RNA, 12 nt, Human
cucauucuucug

SEQ ID NO: 2961466 - RNA, 19 nt, Human
cucaggugucccugcacuu

SEQ ID NO: 2961467 - RNA, 17 nt, Human
cucaggugucccugcac

SEQ ID NO: 2961468 - RNA, 18 nt, Human
cucaggugucccugcacu

SEQ ID NO: 2961469 - RNA, 20 nt, Human
cucauaguaugguggcuggg

SEQ ID NO: 2961470 - RNA, 18 nt, Human
cucauaguaugguggcug

SEQ ID NO: 2961471 - RNA, 19 nt, Human
cucauaguaugguggcugg

SEQ ID NO: 2961472 - RNA, 23 nt, Human
cuaaaagguaugcaaucaaaucu

SEQ ID NO: 2961473 - RNA, 12 nt, Human
cucagggucccu

SEQ ID NO: 2961474 - RNA, 14 nt, Human
cucagggucccugg

SEQ ID NO: 2961475 - RNA, 15 nt, Human
cucaggugucccugc

SEQ ID NO: 2961476 - RNA, 16 nt, Human
cucaggugucccugca

SEQ ID NO: 2961477 - RNA, 23 nt, Human
cucagguggggucacucuggcag

SEQ ID NO: 2961478 - RNA, 22 nt, Human
cucagguggggucacucuggca

SEQ ID NO: 2961479 - RNA, 12 nt, Human
cuccugcaggca

SEQ ID NO: 2961480 - RNA, 14 nt, Human
cuccugcaggcagc

SEQ ID NO: 2961481 - RNA, 13 nt, Human
cuccugcaggcag

SEQ ID NO: 2961482 - RNA, 14 nt, Human
cuccucagaucuuc

SEQ ID NO: 2961483 - RNA, 12 nt, Human
cuccucagaucu

SEQ ID NO: 2961484 - RNA, 23 nt, Human
cucccuucccaccucucucacuc

SEQ ID NO: 2961485 - RNA, 10 nt, Human
cucccuuccu

SEQ ID NO: 2961486 - RNA, 18 nt, Human
cucccaucucacacauga

SEQ ID NO: 2961487 - RNA, 15 nt, Human
cucccaucucacaca

SEQ ID NO: 2961488 - RNA, 14 nt, Human
cucccaucucacac

SEQ ID NO: 2961489 - RNA, 14 nt, Human
cucccuuccucuuu

SEQ ID NO: 2961490 - RNA, 22 nt, Human
cucccuuccuaugcuguucacu

SEQ ID NO: 2961491 - RNA, 13 nt, Human
cucccuuccucuu

SEQ ID NO: 2961492 - RNA, 16 nt, Human
cucccuucucuucaca

SEQ ID NO: 2961493 - RNA, 20 nt, Human
cuccuaggacccgucuccag

SEQ ID NO: 2961494 - RNA, 21 nt, Human
cuccuaggacccgucuccagc

SEQ ID NO: 2961495 - RNA, 22 nt, Human
cuccuaggacccgucuccagcu

SEQ ID NO: 2961496 - RNA, 13 nt, Human
cucccuuucaaca

SEQ ID NO: 2961497 - RNA, 12 nt, Human
cucccuuucaac

SEQ ID NO: 2961498 - RNA, 17 nt, Human
cucccuuggauuguccc

SEQ ID NO: 2961499 - RNA, 15 nt, Human
cuccugugucuugca

SEQ ID NO: 2961500 - RNA, 23 nt, Human
cuccugugucuugcaauggcagc

SEQ ID NO: 2961501 - RNA, 11 nt, Human
cuccugugugu

SEQ ID NO: 2961502 - RNA, 22 nt, Human
cuccugcaggcagccaggccac

SEQ ID NO: 2961503 - RNA, 21 nt, Human
cuccugcaggcagccaggcca

SEQ ID NO: 2961504 - RNA, 15 nt, Human
cuccugcaggcagcc

SEQ ID NO: 2961505 - RNA, 21 nt, Human
cuccuucaccuuuguccccac

SEQ ID NO: 2961506 - RNA, 19 nt, Human
cuccuucaccuuugucccc

SEQ ID NO: 2961507 - RNA, 16 nt, Human
cuccuucaccuuuguc

SEQ ID NO: 2961508 - RNA, 14 nt, Human
cuccuucaccuuug

SEQ ID NO: 2961509 - RNA, 21 nt, Human
cuccuugaaaacacuguucuc

SEQ ID NO: 2961510 - RNA, 11 nt, Human
cuccuucuucc

SEQ ID NO: 2961511 - RNA, 16 nt, Human
cucgaacuggcugcaa

SEQ ID NO: 2961512 - RNA, 13 nt, Human
cuccuucaccuuu

SEQ ID NO: 2961513 - RNA, 14 nt, Human
cuccuucuguccua

SEQ ID NO: 2961514 - RNA, 15 nt, Human
cuccuucuguccuac

SEQ ID NO: 2961515 - RNA, 20 nt, Human
cuccuucuguccuacucugu

SEQ ID NO: 2961516 - RNA, 20 nt, Human
cucgaguuacagacaaagcg

SEQ ID NO: 2961517 - RNA, 16 nt, Human
cucgaguuacagacaa

SEQ ID NO: 2961518 - RNA, 15 nt, Human
cucgcgacaaugcaa

SEQ ID NO: 2961519 - RNA, 13 nt, Human
cucgcgacaaugc

SEQ ID NO: 2961520 - RNA, 13 nt, Human
cucuaaauucuuu

SEQ ID NO: 2961521 - RNA, 17 nt, Human
cucuaaauucuuucauu

SEQ ID NO: 2961522 - RNA, 21 nt, Human
cucggaccccacuccggcccu

SEQ ID NO: 2961523 - RNA, 19 nt, Human
cucggaccccacuccggcc

SEQ ID NO: 2961524 - RNA, 12 nt, Human
cucggagaagag

SEQ ID NO: 2961525 - RNA, 20 nt, Human
cucggagaagagcuguucac

SEQ ID NO: 2961526 - RNA, 13 nt, Human
cucggagaagagc

SEQ ID NO: 2961527 - RNA, 12 nt, Human
cuucagugccuu

SEQ ID NO: 2961528 - RNA, 11 nt, Human
cuucagugccu

SEQ ID NO: 2961529 - RNA, 18 nt, Human
cuucauuuccugugucuu

SEQ ID NO: 2961530 - RNA, 14 nt, Human
cuucagugccuuau

SEQ ID NO: 2961531 - RNA, 13 nt, Human
cuucagugccuua

SEQ ID NO: 2961532 - RNA, 23 nt, Human
cuuccacaagagcccaggccucc

SEQ ID NO: 2961533 - RNA, 22 nt, Human
cuuccacaagagcccaggccuc

SEQ ID NO: 2961534 - RNA, 11 nt, Human
cuucagcugac

SEQ ID NO: 2961535 - RNA, 16 nt, Human
cuucagcgguuuauau

SEQ ID NO: 2961536 - RNA, 18 nt, Human
cuucagcgguuuauauaa

SEQ ID NO: 2961537 - RNA, 14 nt, Human
cuuccagugaggcu

SEQ ID NO: 2961538 - RNA, 15 nt, Human
cuuccagugaggcuc

SEQ ID NO: 2961539 - RNA, 24 nt, Human
cuuccaggggugggacacccugug

SEQ ID NO: 2961540 - RNA, 22 nt, Human
cuuccaggggugggacacccug

SEQ ID NO: 2961541 - RNA, 19 nt, Human
cuuccagauccuggaaauc

SEQ ID NO: 2961542 - RNA, 18 nt, Human
cuucugcuucagccuccc

SEQ ID NO: 2961543 - RNA, 16 nt, Human
cuucugcuucagccuc

SEQ ID NO: 2961544 - RNA, 17 nt, Human
cuucugcuucagccucc

SEQ ID NO: 2961545 - RNA, 15 nt, Human
cuucugccauauucu

SEQ ID NO: 2961546 - RNA, 17 nt, Human
cuucugccauauucugu

SEQ ID NO: 2961547 - RNA, 20 nt, Human
cuucucuacccaucuuaaaa

SEQ ID NO: 2961548 - RNA, 21 nt, Human
cuucugccauauucuguuggc

SEQ ID NO: 2961549 - RNA, 17 nt, Human
cuucuccaggcuguauc

SEQ ID NO: 2961550 - RNA, 14 nt, Human
cuucuccaggcugu

SEQ ID NO: 2961551 - RNA, 14 nt, Human
cuucuccacccugc

SEQ ID NO: 2961552 - RNA, 15 nt, Human
cuucuccacccugcu

SEQ ID NO: 2961553 - RNA, 21 nt, Human
cuucucccccacccccuaggg

SEQ ID NO: 2961554 - RNA, 22 nt, Human
cuucuccuucaccuuugucccc

SEQ ID NO: 2961555 - RNA, 13 nt, Human
cuucgcuccugug

SEQ ID NO: 2961556 - RNA, 14 nt, Human
cuucgcuccugugu

SEQ ID NO: 2961557 - RNA, 15 nt, Human
cuucgcuccuguguc

SEQ ID NO: 2961558 - RNA, 19 nt, Human
cuuccuuggacucauuuua

SEQ ID NO: 2961559 - RNA, 21 nt, Human
cuucgggaggucgaggcagga

SEQ ID NO: 2961560 - RNA, 20 nt, Human
cuucgggaggucgaggcagg

SEQ ID NO: 2961561 - RNA, 17 nt, Human
cuucggccuccauccug

SEQ ID NO: 2961562 - RNA, 18 nt, Human
cuucggccuccauccuga

SEQ ID NO: 2961563 - RNA, 18 nt, Human
cuguuuguuucugaaagg

SEQ ID NO: 2961564 - RNA, 12 nt, Human
cuguuuagauaa

SEQ ID NO: 2961565 - RNA, 17 nt, Human
cuguuuucucuugagag

SEQ ID NO: 2961566 - RNA, 19 nt, Human
cuguuuuauaauuuuguga

SEQ ID NO: 2961567 - RNA, 23 nt, Human
cuguuuguuucugaaagggacgc

SEQ ID NO: 2961568 - RNA, 21 nt, Human
cuguuuguuucugaaagggac

SEQ ID NO: 2961569 - RNA, 21 nt, Human
cuguuuuauuuuaauucaguu

SEQ ID NO: 2961570 - RNA, 14 nt, Human
cuguuuucucuuga

SEQ ID NO: 2961571 - RNA, 13 nt, Human
cuguuuucucuug

SEQ ID NO: 2961572 - RNA, 18 nt, Human
cuuaagaaauuuguggaa

SEQ ID NO: 2961573 - RNA, 19 nt, Human
cuuaauaaacuguggugcu

SEQ ID NO: 2961574 - RNA, 18 nt, Human
cuuaaugccacuaaauug

SEQ ID NO: 2961575 - RNA, 14 nt, Human
cuuaaucuaaaugg

SEQ ID NO: 2961576 - RNA, 16 nt, Human
cuuaaucuaaauggaa

SEQ ID NO: 2961577 - RNA, 23 nt, Human
cuuaaugagacuuuaaaagcauu

SEQ ID NO: 2961578 - RNA, 12 nt, Human
cuuaacuucaca

SEQ ID NO: 2961579 - RNA, 14 nt, Human
cuuaacuucacaua

SEQ ID NO: 2961580 - RNA, 15 nt, Human
cuuaacuucacauau

SEQ ID NO: 2961581 - RNA, 16 nt, Human
cuuaacuucacauauu

SEQ ID NO: 2961582 - RNA, 17 nt, Human
cuuaacuucacauauug

SEQ ID NO: 2961583 - RNA, 22 nt, Human
cuuaacuucacauauugauuuc

SEQ ID NO: 2961584 - RNA, 13 nt, Human
cuuacuguacaug

SEQ ID NO: 2961585 - RNA, 16 nt, Human
cuuacuguacaugaaa

SEQ ID NO: 2961586 - RNA, 22 nt, Human
cuuacgaaaaaaugguagcauu

SEQ ID NO: 2961587 - RNA, 15 nt, Human
cuuacgugaguccug

SEQ ID NO: 2961588 - RNA, 19 nt, Human
cuuacuaguuucccuugca

SEQ ID NO: 2961589 - RNA, 15 nt, Human
cuuagaagucacaca

SEQ ID NO: 2961590 - RNA, 14 nt, Human
cuuagacagucccu

SEQ ID NO: 2961591 - RNA, 16 nt, Human
cuuagacagucccugc

SEQ ID NO: 2961592 - RNA, 15 nt, Human
cuuagacagucccug

SEQ ID NO: 2961593 - RNA, 11 nt, Human
cuuagacaguc

SEQ ID NO: 2961594 - RNA, 19 nt, Human
cuuagacagucccugccaa

SEQ ID NO: 2961595 - RNA, 18 nt, Human
cuuagacagucccugcca

SEQ ID NO: 2961596 - RNA, 17 nt, Human
cuuagacagucccugcc

SEQ ID NO: 2961597 - RNA, 18 nt, Human
cuuagacccucaugcugc

SEQ ID NO: 2961598 - RNA, 14 nt, Human
cuuagacccucaug

SEQ ID NO: 2961599 - RNA, 19 nt, Human
cuuagaugcaguucugaag

SEQ ID NO: 2961600 - RNA, 17 nt, Human
cuuaucuuacgaaaaaa

SEQ ID NO: 2961601 - RNA, 18 nt, Human
cuuauuuaaauagaugac

SEQ ID NO: 2961602 - RNA, 19 nt, Human
cuuauuuaaauagaugaca

SEQ ID NO: 2961603 - RNA, 15 nt, Human
cuuauuuaaugaaag

SEQ ID NO: 2961604 - RNA, 13 nt, Human
cuuauuuaaauag

SEQ ID NO: 2961605 - RNA, 14 nt, Human
cuuauuuaaauaga

SEQ ID NO: 2961606 - RNA, 19 nt, Human
cuuauaggaauugacccac

SEQ ID NO: 2961607 - RNA, 14 nt, Human
cuuauaauuuaaaa

SEQ ID NO: 2961608 - RNA, 21 nt, Human
cuuaggguuaugauuaaguaa

SEQ ID NO: 2961609 - RNA, 17 nt, Human
cuuagguuggcaaaaag

SEQ ID NO: 2961610 - RNA, 13 nt, Human
cuuauaauuuaaa

SEQ ID NO: 2961611 - RNA, 15 nt, Human
cuucuggauauagcu

SEQ ID NO: 2961612 - RNA, 15 nt, Human
cuugaggguugggcu

SEQ ID NO: 2961613 - RNA, 17 nt, Human
cuugaggguugggcugg

SEQ ID NO: 2961614 - RNA, 15 nt, Human
cuugagccugggagg

SEQ ID NO: 2961615 - RNA, 12 nt, Human
cuugagccuggg

SEQ ID NO: 2961616 - RNA, 15 nt, Human
cuugcaauggcagcc

SEQ ID NO: 2961617 - RNA, 16 nt, Human
cuugcaauggcagccu

SEQ ID NO: 2961618 - RNA, 17 nt, Human
cuugcaauggcagccuu

SEQ ID NO: 2961619 - RNA, 18 nt, Human
cuugcaauggcagccuug

SEQ ID NO: 2961620 - RNA, 19 nt, Human
cuugaguugauucagcucu

SEQ ID NO: 2961621 - RNA, 18 nt, Human
cuugaguugauucagcuc

SEQ ID NO: 2961622 - RNA, 20 nt, Human
cuugaguugauucagcucug

SEQ ID NO: 2961623 - RNA, 20 nt, Human
cuugcagacucuacagaggc

SEQ ID NO: 2961624 - RNA, 21 nt, Human
cuugcagacucuacagaggcc

SEQ ID NO: 2961625 - RNA, 23 nt, Human
cuugcaucaauuuuucuuauuuc

SEQ ID NO: 2961626 - RNA, 22 nt, Human
cuugcagcucuccccuucucug

SEQ ID NO: 2961627 - RNA, 14 nt, Human
cuugcaugaggcua

SEQ ID NO: 2961628 - RNA, 13 nt, Human
cuugcaugaggcu

SEQ ID NO: 2961629 - RNA, 14 nt, Human
cuugccaucccucc

SEQ ID NO: 2961630 - RNA, 17 nt, Human
cuugccaucccucccuc

SEQ ID NO: 2961631 - RNA, 15 nt, Human
cuugccaucccuccc

SEQ ID NO: 2961632 - RNA, 16 nt, Human
cuugccaucccucccu

SEQ ID NO: 2961633 - RNA, 19 nt, Human
cuugccaucccucccucca

SEQ ID NO: 2961634 - RNA, 18 nt, Human
cuugcccagccuggaugc

SEQ ID NO: 2961635 - RNA, 18 nt, Human
cuugcccuggugccucac

SEQ ID NO: 2961636 - RNA, 14 nt, Human
cuugcccuguuaaa

SEQ ID NO: 2961637 - RNA, 20 nt, Human
cuuggaagcuccgcuuucua

SEQ ID NO: 2961638 - RNA, 14 nt, Human
cuuggaagcuccgc

SEQ ID NO: 2961639 - RNA, 20 nt, Human
cuugcuugauuguauggugg

SEQ ID NO: 2961640 - RNA, 22 nt, Human
cuugcucugcugacagacacag

SEQ ID NO: 2961641 - RNA, 22 nt, Human
cuugcccuguuaaaagaugaaa

SEQ ID NO: 2961642 - RNA, 17 nt, Human
cuuuaccuuuuuuauac

SEQ ID NO: 2961643 - RNA, 19 nt, Human
cuuuaccuuuuuuauacau

SEQ ID NO: 2961644 - RNA, 20 nt, Human
cuuuaccuuuuuuauacaua

SEQ ID NO: 2961645 - RNA, 20 nt, Human
cuuguugaggguauguuuua

SEQ ID NO: 2961646 - RNA, 21 nt, Human
cuuguugaggguauguuuuau

SEQ ID NO: 2961647 - RNA, 22 nt, Human
cuuguugaggguauguuuuaua

SEQ ID NO: 2961648 - RNA, 16 nt, Human
cuuguugaggguaugu

SEQ ID NO: 2961649 - RNA, 15 nt, Human
cuuguggucccaccc

SEQ ID NO: 2961650 - RNA, 15 nt, Human
cuugucggccccacc

SEQ ID NO: 2961651 - RNA, 20 nt, Human
cuugucggccccaccagugc

SEQ ID NO: 2961652 - RNA, 23 nt, Human
cuugucggccccaccagugccuc

SEQ ID NO: 2961653 - RNA, 21 nt, Human
cuugucggccccaccagugcc

SEQ ID NO: 2961654 - RNA, 22 nt, Human
cuugucggccccaccagugccu

SEQ ID NO: 2961655 - RNA, 19 nt, Human
cuuguggucccaccccaca

SEQ ID NO: 2961656 - RNA, 16 nt, Human
cuuguggucccacccc

SEQ ID NO: 2961657 - RNA, 16 nt, Human
cuuguuaagauaguua

SEQ ID NO: 2961658 - RNA, 22 nt, Human
cuugugguuauaacuuaaugaa

SEQ ID NO: 2961659 - RNA, 20 nt, Human
cuugggccacugugaagaga

SEQ ID NO: 2961660 - RNA, 18 nt, Human
cuugggccacugugaaga

SEQ ID NO: 2961661 - RNA, 16 nt, Human
cuuggacucauuuuaa

SEQ ID NO: 2961662 - RNA, 18 nt, Human
cuuggggcugaugcaguu

SEQ ID NO: 2961663 - RNA, 16 nt, Human
cuuggggcugaugcag

SEQ ID NO: 2961664 - RNA, 16 nt, Human
cuuguacacucauuca

SEQ ID NO: 2961665 - RNA, 17 nt, Human
cuuguacuuuauuuucu

SEQ ID NO: 2961666 - RNA, 14 nt, Human
cuugguuuguaaau

SEQ ID NO: 2961667 - RNA, 15 nt, Human
cuugguuuguaaauu

SEQ ID NO: 2961668 - RNA, 23 nt, Human
cuuugggaggccaaggugggagg

SEQ ID NO: 2961669 - RNA, 23 nt, Human
cuuugugaggaagccgcuggggc

SEQ ID NO: 2961670 - RNA, 13 nt, Human
cuuuguggcuucc

SEQ ID NO: 2961671 - RNA, 19 nt, Human
cuuugugaggaagccgcug

SEQ ID NO: 2961672 - RNA, 12 nt, Human
cuuugugauuuu

SEQ ID NO: 2961673 - RNA, 21 nt, Human
cuuuguucuggcucuuccagg

SEQ ID NO: 2961674 - RNA, 16 nt, Human
cuuuguucuggcucuu

SEQ ID NO: 2961675 - RNA, 12 nt, Human
cuuuggaaagac

SEQ ID NO: 2961676 - RNA, 23 nt, Human
cuuuggaaagacuuuuccaaccc

SEQ ID NO: 2961677 - RNA, 14 nt, Human
cuuugcuugaaaga

SEQ ID NO: 2961678 - RNA, 13 nt, Human
cuuucugaaauaa

SEQ ID NO: 2961679 - RNA, 19 nt, Human
cuuuccucaaaacuucaga

SEQ ID NO: 2961680 - RNA, 15 nt, Human
cuuuuucaauaacug

SEQ ID NO: 2961681 - RNA, 22 nt, Human
cuuuuguucuugguuuguaaau

SEQ ID NO: 2961682 - RNA, 20 nt, Human
cuuuuguucuugguuuguaa

SEQ ID NO: 2961683 - RNA, 14 nt, Human
cuuuuugaaauguc

SEQ ID NO: 2961684 - RNA, 15 nt, Human
cuuuucuguuugcua

SEQ ID NO: 2961685 - RNA, 21 nt, Human
cuuuguuuguugucagcugaa

SEQ ID NO: 2961686 - RNA, 16 nt, Human
cuuuuuuagaguugau

SEQ ID NO: 2961687 - RNA, 14 nt, Human
gaaaacaaggauga

SEQ ID NO: 2961688 - RNA, 19 nt, Human
gaaaacacuguucucugcc

SEQ ID NO: 2961689 - RNA, 18 nt, Human
gaaaacacuguucucugc

SEQ ID NO: 2961690 - RNA, 21 nt, Human
gaaaacacuguucucugcccu

SEQ ID NO: 2961691 - RNA, 20 nt, Human
gaaaacacuguucucugccc

SEQ ID NO: 2961692 - RNA, 16 nt, Human
gaaaacaugcuacaca

SEQ ID NO: 2961693 - RNA, 18 nt, Human
gaaaacaugcuacacacu

SEQ ID NO: 2961694 - RNA, 20 nt, Human
gaaaagggacugcugggagg

SEQ ID NO: 2961695 - RNA, 19 nt, Human
gaaaacaugcuacacacug

SEQ ID NO: 2961696 - RNA, 20 nt, Human
gaaaaguauguuagugcaaa

SEQ ID NO: 2961697 - RNA, 14 nt, Human
gaaaaguauguuag

SEQ ID NO: 2961698 - RNA, 19 nt, Human
gaaaauaacaauaaaagac

SEQ ID NO: 2961699 - RNA, 23 nt, Human
gacaucaacugcaucaagaugug

SEQ ID NO: 2961700 - RNA, 14 nt, Human
gacaucaacagaua

SEQ ID NO: 2961701 - RNA, 16 nt, Human
gacaucaacugcauca

SEQ ID NO: 2961702 - RNA, 17 nt, Human
gacaguuggguuuuuua

SEQ ID NO: 2961703 - RNA, 13 nt, Human
gacaguuggguuu

SEQ ID NO: 2961704 - RNA, 22 nt, Human
gacaggcauguucucugaggac

SEQ ID NO: 2961705 - RNA, 23 nt, Human
gacaggcaaugcuggcuguuggc

SEQ ID NO: 2961706 - RNA, 20 nt, Human
gacaggcauguucucugagg

SEQ ID NO: 2961707 - RNA, 21 nt, Human
gacaggcauguucucugagga

SEQ ID NO: 2961708 - RNA, 20 nt, Human
gacaggcaagcaccuccugc

SEQ ID NO: 2961709 - RNA, 21 nt, Human
gacaggcaagcaccuccugcc

SEQ ID NO: 2961710 - RNA, 18 nt, Human
gacaggcaaugcuggcug

SEQ ID NO: 2961711 - RNA, 19 nt, Human
gacaggcaaugcuggcugu

SEQ ID NO: 2961712 - RNA, 13 nt, Human
gacaggcaagcac

SEQ ID NO: 2961713 - RNA, 17 nt, Human
gacaggcaagcaccucc

SEQ ID NO: 2961714 - RNA, 18 nt, Human
gacaggcaagcaccuccu

SEQ ID NO: 2961715 - RNA, 23 nt, Human
gacaggaugguucccuugaugaa

SEQ ID NO: 2961716 - RNA, 17 nt, Human
gacagacacaggcccgg

SEQ ID NO: 2961717 - RNA, 16 nt, Human
gacacuagaagauuuu

SEQ ID NO: 2961718 - RNA, 20 nt, Human
gacagacacaggcccggcuc

SEQ ID NO: 2961719 - RNA, 22 nt, Human
gacagacacaggcccggcucca

SEQ ID NO: 2961720 - RNA, 22 nt, Human
gacacgaauauugcugauggug

SEQ ID NO: 2961721 - RNA, 18 nt, Human
gaauuucccaaagcagug

SEQ ID NO: 2961722 - RNA, 16 nt, Human
gaauuucccaaagcag

SEQ ID NO: 2961723 - RNA, 22 nt, Human
gaauuucccaaagcagugcaug

SEQ ID NO: 2961724 - RNA, 14 nt, Human
gacagagucucacu

SEQ ID NO: 2961725 - RNA, 23 nt, Human
gacagaggcagccccauucugcc

SEQ ID NO: 2961726 - RNA, 19 nt, Human
gacagagugagacucuguc

SEQ ID NO: 2961727 - RNA, 21 nt, Human
gacagagucucacuguugccc

SEQ ID NO: 2961728 - RNA, 16 nt, Human
gacagagugagacucu

SEQ ID NO: 2961729 - RNA, 21 nt, Human
gacagagccccacccucagau

SEQ ID NO: 2961730 - RNA, 20 nt, Human
gacagagcuacacaggggaa

SEQ ID NO: 2961731 - RNA, 17 nt, Human
gaccccacuccggcccu

SEQ ID NO: 2961732 - RNA, 22 nt, Human
gaccccacuccggcccuccaga

SEQ ID NO: 2961733 - RNA, 15 nt, Human
gaccccacuccggcc

SEQ ID NO: 2961734 - RNA, 17 nt, Human
gacccaugcugcccugu

SEQ ID NO: 2961735 - RNA, 10 nt, Human
gacccugagg

SEQ ID NO: 2961736 - RNA, 12 nt, Human
gacccugaggcc

SEQ ID NO: 2961737 - RNA, 11 nt, Human
gacccugaggc

SEQ ID NO: 2961738 - RNA, 22 nt, Human
gacccugcccugugggccccca

SEQ ID NO: 2961739 - RNA, 20 nt, Human
gacccugcccugugggcccc

SEQ ID NO: 2961740 - RNA, 17 nt, Human
gacccugcccugugggc

SEQ ID NO: 2961741 - RNA, 16 nt, Human
gacccugaggcccaga

SEQ ID NO: 2961742 - RNA, 18 nt, Human
gacccaugcugcccugug

SEQ ID NO: 2961743 - RNA, 20 nt, Human
gacccaugcugcccugugag

SEQ ID NO: 2961744 - RNA, 19 nt, Human
gacccaugcugcccuguga

SEQ ID NO: 2961745 - RNA, 12 nt, Human
gacccacugcuu

SEQ ID NO: 2961746 - RNA, 18 nt, Human
gacccaaaaggcagaagc

SEQ ID NO: 2961747 - RNA, 19 nt, Human
gacccaaaaggcagaagca

SEQ ID NO: 2961748 - RNA, 18 nt, Human
gaccacaaaacuuuucua

SEQ ID NO: 2961749 - RNA, 21 nt, Human
gaccagagcugccaccugccu

SEQ ID NO: 2961750 - RNA, 23 nt, Human
gaccagacaccuugacagggcac

SEQ ID NO: 2961751 - RNA, 21 nt, Human
gaccagcaccaucucuccucc

SEQ ID NO: 2961752 - RNA, 20 nt, Human
gaccagcaccaucucuccuc

SEQ ID NO: 2961753 - RNA, 16 nt, Human
gaccacguuucuaaag

SEQ ID NO: 2961754 - RNA, 22 nt, Human
gaccagacaccuugacagggca

SEQ ID NO: 2961755 - RNA, 21 nt, Human
gaccagacaccuugacagggc

SEQ ID NO: 2961756 - RNA, 16 nt, Human
gaccacugcagaagac

SEQ ID NO: 2961757 - RNA, 18 nt, Human
gaccacugcagaagacag

SEQ ID NO: 2961758 - RNA, 19 nt, Human
gacccuugccgucuaccug

SEQ ID NO: 2961759 - RNA, 23 nt, Human
gacccuugccgucuaccugaggg

SEQ ID NO: 2961760 - RNA, 20 nt, Human
gacccuugccgucuaccuga

SEQ ID NO: 2961761 - RNA, 14 nt, Human
gaccuucuccuuca

SEQ ID NO: 2961762 - RNA, 16 nt, Human
gaccuucuccuucacc

SEQ ID NO: 2961763 - RNA, 15 nt, Human
gaccuucuccuucac

SEQ ID NO: 2961764 - RNA, 14 nt, Human
gaccuugaacuggg

SEQ ID NO: 2961765 - RNA, 21 nt, Human
gaccuucuccuucaccuuugu

SEQ ID NO: 2961766 - RNA, 20 nt, Human
gaccuucuccuucaccuuug

SEQ ID NO: 2961767 - RNA, 23 nt, Human
gacggagucccaccuuggcugca

SEQ ID NO: 2961768 - RNA, 13 nt, Human
gacggagucccac

SEQ ID NO: 2961769 - RNA, 21 nt, Human
gacgcugugcugcccugccca

SEQ ID NO: 2961770 - RNA, 22 nt, Human
gacgcugugcugcccugcccac

SEQ ID NO: 2961771 - RNA, 20 nt, Human
gaccuuucaauaggaaaaac

SEQ ID NO: 2961772 - RNA, 19 nt, Human
gaccuuucaauaggaaaaa

SEQ ID NO: 2961773 - RNA, 11 nt, Human
gaccuuucaau

SEQ ID NO: 2961774 - RNA, 22 nt, Human
gaccuuuaagagaaaugagcug

SEQ ID NO: 2961775 - RNA, 15 nt, Human
gacguguuaugacuc

SEQ ID NO: 2961776 - RNA, 14 nt, Human
gacguguuaugacu

SEQ ID NO: 2961777 - RNA, 11 nt, Human
gacguguuaug

SEQ ID NO: 2961778 - RNA, 23 nt, Human
gacuaacuugucuuuggacccug

SEQ ID NO: 2961779 - RNA, 16 nt, Human
gacuaacuugucuuug

SEQ ID NO: 2961780 - RNA, 18 nt, Human
gacuuacuguacaugaaa

SEQ ID NO: 2961781 - RNA, 23 nt, Human
gacuuacuguacaugaaaacaca

SEQ ID NO: 2961782 - RNA, 15 nt, Human
gacuuacuguacaug

SEQ ID NO: 2961783 - RNA, 16 nt, Human
gacuuacuguacauga

SEQ ID NO: 2961784 - RNA, 12 nt, Human
gacuuacuguac

SEQ ID NO: 2961785 - RNA, 20 nt, Human
gacuucaucccucuggggcu

SEQ ID NO: 2961786 - RNA, 12 nt, Human
gacuucaucccu

SEQ ID NO: 2961787 - RNA, 23 nt, Human
gacuuaaugagacuuuaaaagca

SEQ ID NO: 2961788 - RNA, 22 nt, Human
gacuggauaguccgucucugcu

SEQ ID NO: 2961789 - RNA, 23 nt, Human
gacuggccaagguuuggggaaga

SEQ ID NO: 2961790 - RNA, 14 nt, Human
gacuggcacaguuu

SEQ ID NO: 2961791 - RNA, 17 nt, Human
gacuggauaguccgucu

SEQ ID NO: 2961792 - RNA, 22 nt, Human
gacuggcacaguuuucugagaa

SEQ ID NO: 2961793 - RNA, 18 nt, Human
gacuggcacaguuuucug

SEQ ID NO: 2961794 - RNA, 15 nt, Human
gacucuacagaggcc

SEQ ID NO: 2961795 - RNA, 21 nt, Human
gacucuacagaggccaugggc

SEQ ID NO: 2961796 - RNA, 16 nt, Human
gacugaauuucuuuug

SEQ ID NO: 2961797 - RNA, 18 nt, Human
gacuacaggcacccacca

SEQ ID NO: 2961798 - RNA, 13 nt, Human
gacuacaggcacc

SEQ ID NO: 2961799 - RNA, 15 nt, Human
gacuacaggcaccca

SEQ ID NO: 2961800 - RNA, 21 nt, Human
gacuccugcaggcagccaggc

SEQ ID NO: 2961801 - RNA, 20 nt, Human
gacuccugcaggcagccagg

SEQ ID NO: 2961802 - RNA, 19 nt, Human
gacuccugcaggcagccag

SEQ ID NO: 2961803 - RNA, 18 nt, Human
gacuccugcaggcagcca

SEQ ID NO: 2961804 - RNA, 19 nt, Human
gacugagggggccuggaug

SEQ ID NO: 2961805 - RNA, 17 nt, Human
gacugagggggccugga

SEQ ID NO: 2961806 - RNA, 18 nt, Human
gacugagggggccuggau

SEQ ID NO: 2961807 - RNA, 18 nt, Human
gacugaguacguugugca

SEQ ID NO: 2961808 - RNA, 15 nt, Human
gacugagggggccug

SEQ ID NO: 2961809 - RNA, 16 nt, Human
gacugagggggccugg

SEQ ID NO: 2961810 - RNA, 16 nt, Human
gacugaggggagggga

SEQ ID NO: 2961811 - RNA, 24 nt, Human
gacugcauuauauuuauuacugua

SEQ ID NO: 2961812 - RNA, 15 nt, Human
gaauuucccaaagca

SEQ ID NO: 2961813 - RNA, 22 nt, Human
gaauuuaaauagcuuuuuucuc

SEQ ID NO: 2961814 - RNA, 22 nt, Human
gaauugauugggcacaucauuu

SEQ ID NO: 2961815 - RNA, 22 nt, Human
gaauuguaaggaaugauuaauu

SEQ ID NO: 2961816 - RNA, 19 nt, Human
gaauucucuaguuugauua

SEQ ID NO: 2961817 - RNA, 14 nt, Human
gaauugaaaaacca

SEQ ID NO: 2961818 - RNA, 16 nt, Human
gaauuccuaaaauuau

SEQ ID NO: 2961819 - RNA, 20 nt, Human
gaauuccuaaaauuauggaa

SEQ ID NO: 2961820 - RNA, 17 nt, Human
gaauucucuaguuugau

SEQ ID NO: 2961821 - RNA, 17 nt, Human
gaauucucagaaucuca

SEQ ID NO: 2961822 - RNA, 22 nt, Human
gaauucacaaaguaauuuggaa

SEQ ID NO: 2961823 - RNA, 21 nt, Human
gaaugucaguuguuauuuauu

SEQ ID NO: 2961824 - RNA, 17 nt, Human
gaaugucaguuguuauu

SEQ ID NO: 2961825 - RNA, 21 nt, Human
gaaugucagugugacugaucu

SEQ ID NO: 2961826 - RNA, 20 nt, Human
gaaugucagugugacugauc

SEQ ID NO: 2961827 - RNA, 14 nt, Human
gaaugucaguguga

SEQ ID NO: 2961828 - RNA, 22 nt, Human
gaaugguuuucaaaauaaaaau

SEQ ID NO: 2961829 - RNA, 19 nt, Human
gaaugaagauacugaaaua

SEQ ID NO: 2961830 - RNA, 11 nt, Human
gaaugcagugg

SEQ ID NO: 2961831 - RNA, 17 nt, Human
gaaugaagauacugaaa

SEQ ID NO: 2961832 - RNA, 18 nt, Human
gaaugaagauacugaaau

SEQ ID NO: 2961833 - RNA, 21 nt, Human
gaaugaagauacugaaauaaa

SEQ ID NO: 2961834 - RNA, 23 nt, Human
gaaugaaccacaucuugcucugc

SEQ ID NO: 2961835 - RNA, 22 nt, Human
gaaugaaccacaucuugcucug

SEQ ID NO: 2961836 - RNA, 18 nt, Human
gaaugaaccacaucuugc

SEQ ID NO: 2961837 - RNA, 13 nt, Human
gaaguuugaacau

SEQ ID NO: 2961838 - RNA, 20 nt, Human
gaaguuugagaucagccugg

SEQ ID NO: 2961839 - RNA, 18 nt, Human
gaauaacauguaauuaag

SEQ ID NO: 2961840 - RNA, 19 nt, Human
gaauaacauguaauuaagu

SEQ ID NO: 2961841 - RNA, 21 nt, Human
gaauacagaggcaacugcauu

SEQ ID NO: 2961842 - RNA, 17 nt, Human
gaauaauacaguaucuc

SEQ ID NO: 2961843 - RNA, 21 nt, Human
gaauaccccaagacucccaug

SEQ ID NO: 2961844 - RNA, 13 nt, Human
gaauaccuguccc

SEQ ID NO: 2961845 - RNA, 15 nt, Human
gaauaccuguccccc

SEQ ID NO: 2961846 - RNA, 23 nt, Human
gaauagcugggacuacaggugug

SEQ ID NO: 2961847 - RNA, 16 nt, Human
gaauaggcacuuuaaa

SEQ ID NO: 2961848 - RNA, 22 nt, Human
gaauagcugggacuacaggugu

SEQ ID NO: 2961849 - RNA, 20 nt, Human
gaauacucuuauaucuauau

SEQ ID NO: 2961850 - RNA, 16 nt, Human
gaauauuuuaacuucc

SEQ ID NO: 2961851 - RNA, 18 nt, Human
gaaguacuauaauuuacc

SEQ ID NO: 2961852 - RNA, 15 nt, Human
gaaguacuggagaaa

SEQ ID NO: 2961853 - RNA, 22 nt, Human
gaaguaauaugcacacauuuuu

SEQ ID NO: 2961854 - RNA, 23 nt, Human
gaaggugccucuggaugcuguga

SEQ ID NO: 2961855 - RNA, 19 nt, Human
gaagggggcugggacaugg

SEQ ID NO: 2961856 - RNA, 16 nt, Human
gaagggggcugggaca

SEQ ID NO: 2961857 - RNA, 15 nt, Human
gaagggggcugggac

SEQ ID NO: 2961858 - RNA, 14 nt, Human
gaagcggcuggcag

SEQ ID NO: 2961859 - RNA, 12 nt, Human
gaaguccaagca

SEQ ID NO: 2961860 - RNA, 22 nt, Human
gaaguccaagcauuuagaugua

SEQ ID NO: 2961861 - RNA, 20 nt, Human
gaaguuucugccgcagcccu

SEQ ID NO: 2961862 - RNA, 15 nt, Human
gaagucuuagaugua

SEQ ID NO: 2961863 - RNA, 21 nt, Human
gaaguuucugccgcagcccug

SEQ ID NO: 2961864 - RNA, 14 nt, Human
gaaguauccuucag

SEQ ID NO: 2961865 - RNA, 16 nt, Human
gaaguauccuucagcc

SEQ ID NO: 2961866 - RNA, 23 nt, Human
gaacuuugaccucugcagcaaua

SEQ ID NO: 2961867 - RNA, 17 nt, Human
gaagacugcauuauauu

SEQ ID NO: 2961868 - RNA, 13 nt, Human
gaagacuuuggaa

SEQ ID NO: 2961869 - RNA, 11 nt, Human
gaagacuuugg

SEQ ID NO: 2961870 - RNA, 12 nt, Human
gaagaacugaaa

SEQ ID NO: 2961871 - RNA, 19 nt, Human
gaagacugcauuauauuua

SEQ ID NO: 2961872 - RNA, 19 nt, Human
gaagagaaugcacaaacag

SEQ ID NO: 2961873 - RNA, 20 nt, Human
gaagacuuuucuuucagcca

SEQ ID NO: 2961874 - RNA, 17 nt, Human
gaagacuuuggaaagag

SEQ ID NO: 2961875 - RNA, 14 nt, Human
gaagacuuuggaaa

SEQ ID NO: 2961876 - RNA, 23 nt, Human
gaagcccaggaaaggcuccagga

SEQ ID NO: 2961877 - RNA, 23 nt, Human
gaagcccuucuaccuuccugcaa

SEQ ID NO: 2961878 - RNA, 19 nt, Human
gaagcccaggaaaggcucc

SEQ ID NO: 2961879 - RNA, 16 nt, Human
gaagcccaggaaaggc

SEQ ID NO: 2961880 - RNA, 15 nt, Human
gaagcccaggaaagg

SEQ ID NO: 2961881 - RNA, 13 nt, Human
gaagcccaggaaa

SEQ ID NO: 2961882 - RNA, 22 nt, Human
gaagccagcaggcucucaggcc

SEQ ID NO: 2961883 - RNA, 21 nt, Human
gaagccagcaggcucucaggc

SEQ ID NO: 2961884 - RNA, 19 nt, Human
gaagccagcaggcucucag

SEQ ID NO: 2961885 - RNA, 20 nt, Human
gaagccagcaggcucucagg

SEQ ID NO: 2961886 - RNA, 17 nt, Human
gaagauucuauguuaau

SEQ ID NO: 2961887 - RNA, 23 nt, Human
gaagauucuauguuaauauuuua

SEQ ID NO: 2961888 - RNA, 20 nt, Human
gaagauucuauguuaauauu

SEQ ID NO: 2961889 - RNA, 17 nt, Human
gaagcauuuacuuugug

SEQ ID NO: 2961890 - RNA, 20 nt, Human
gaagagguuuuaaagcuucc

SEQ ID NO: 2961891 - RNA, 20 nt, Human
gaagauaauauuaaggaaga

SEQ ID NO: 2961892 - RNA, 15 nt, Human
gaagauacugaaaua

SEQ ID NO: 2961893 - RNA, 17 nt, Human
gaagauguagaggagaa

SEQ ID NO: 2961894 - RNA, 18 nt, Human
gaagauguagaggagaaa

SEQ ID NO: 2961895 - RNA, 22 nt, Human
gaaccuuuugagugccuuacac

SEQ ID NO: 2961896 - RNA, 16 nt, Human
gaacauuucauggugu

SEQ ID NO: 2961897 - RNA, 21 nt, Human
gaacauuuggguuacuauuuc

SEQ ID NO: 2961898 - RNA, 18 nt, Human
gaaccuuuugagugccuu

SEQ ID NO: 2961899 - RNA, 21 nt, Human
gaaccuuuugagugccuuaca

SEQ ID NO: 2961900 - RNA, 19 nt, Human
gaaccuuuugagugccuua

SEQ ID NO: 2961901 - RNA, 14 nt, Human
gaacaucacagcuu

SEQ ID NO: 2961902 - RNA, 15 nt, Human
gaacauaaaauacaa

SEQ ID NO: 2961903 - RNA, 15 nt, Human
gaacacucugagacu

SEQ ID NO: 2961904 - RNA, 16 nt, Human
gaacagugauuaccag

SEQ ID NO: 2961905 - RNA, 20 nt, Human
gaacagugauuaccagggac

SEQ ID NO: 2961906 - RNA, 14 nt, Human
gaacacucugagac

SEQ ID NO: 2961907 - RNA, 13 nt, Human
gaacacucugaga

SEQ ID NO: 2961908 - RNA, 17 nt, Human
gaaaauagaauugacau

SEQ ID NO: 2961909 - RNA, 16 nt, Human
gaaauuguauuacaaa

SEQ ID NO: 2961910 - RNA, 13 nt, Human
gauaaacaguagu

SEQ ID NO: 2961911 - RNA, 12 nt, Human
gauaauacacca

SEQ ID NO: 2961912 - RNA, 23 nt, Human
gauaauacaccacuacauucugu

SEQ ID NO: 2961913 - RNA, 24 nt, Human
gauaauacaccacuacauucuguu

SEQ ID NO: 2961914 - RNA, 19 nt, Human
gaguuauugaagcagagug

SEQ ID NO: 2961915 - RNA, 20 nt, Human
gaguuauugaagcagagugg

SEQ ID NO: 2961916 - RNA, 16 nt, Human
gauacaaaagcaugug

SEQ ID NO: 2961917 - RNA, 20 nt, Human
gauagugucccacggugccu

SEQ ID NO: 2961918 - RNA, 18 nt, Human
gauauaugcucugcaugu

SEQ ID NO: 2961919 - RNA, 21 nt, Human
gauauagcuaggugacauaua

SEQ ID NO: 2961920 - RNA, 14 nt, Human
gaucacagccucug

SEQ ID NO: 2961921 - RNA, 23 nt, Human
gaucacggcucacugcagccuca

SEQ ID NO: 2961922 - RNA, 20 nt, Human
gaucacggcucacugcagcc

SEQ ID NO: 2961923 - RNA, 23 nt, Human
gaucagcuuauugucuagugaaa

SEQ ID NO: 2961924 - RNA, 22 nt, Human
gaugaaugucaguuguuauuua

SEQ ID NO: 2961925 - RNA, 22 nt, Human
gaucuucuguggguuucuaaag

SEQ ID NO: 2961926 - RNA, 19 nt, Human
gaucuucuuuauaauucua

SEQ ID NO: 2961927 - RNA, 15 nt, Human
gaugaaaugagguca

SEQ ID NO: 2961928 - RNA, 21 nt, Human
gaugaaaugaggucagagccu

SEQ ID NO: 2961929 - RNA, 19 nt, Human
gaugcagccucacaguccu

SEQ ID NO: 2961930 - RNA, 14 nt, Human
gaugccugguggca

SEQ ID NO: 2961931 - RNA, 14 nt, Human
gaugcagugcuucc

SEQ ID NO: 2961932 - RNA, 15 nt, Human
gaugccugguggcag

SEQ ID NO: 2961933 - RNA, 16 nt, Human
gaugccugguggcagc

SEQ ID NO: 2961934 - RNA, 20 nt, Human
gaugaccuugaaugaugcca

SEQ ID NO: 2961935 - RNA, 18 nt, Human
gaugaccuugaaugaugc

SEQ ID NO: 2961936 - RNA, 23 nt, Human
gaugagaaauaaaguuucuguug

SEQ ID NO: 2961937 - RNA, 14 nt, Human
gaugcaccagcccu

SEQ ID NO: 2961938 - RNA, 14 nt, Human
gaugagaggaaauc

SEQ ID NO: 2961939 - RNA, 15 nt, Human
gaugcaccagcccuu

SEQ ID NO: 2961940 - RNA, 23 nt, Human
gaugcaccagcccuuagcaggga

SEQ ID NO: 2961941 - RNA, 13 nt, Human
gaucauccacugu

SEQ ID NO: 2961942 - RNA, 16 nt, Human
gauccucccaccucag

SEQ ID NO: 2961943 - RNA, 14 nt, Human
gauccuccaggugc

SEQ ID NO: 2961944 - RNA, 17 nt, Human
gauccucccaccucagc

SEQ ID NO: 2961945 - RNA, 13 nt, Human
gaucuaggaagac

SEQ ID NO: 2961946 - RNA, 18 nt, Human
gaucuaggaagacuuugg

SEQ ID NO: 2961947 - RNA, 14 nt, Human
gaucuaggaagacu

SEQ ID NO: 2961948 - RNA, 20 nt, Human
gaucuaggaagacuuuggaa

SEQ ID NO: 2961949 - RNA, 14 nt, Human
gauccuggaaauca

SEQ ID NO: 2961950 - RNA, 13 nt, Human
gauccuggaaauc

SEQ ID NO: 2961951 - RNA, 12 nt, Human
gauccugagcca

SEQ ID NO: 2961952 - RNA, 20 nt, Human
gauuuaaacacauuaaaggu

SEQ ID NO: 2961953 - RNA, 20 nt, Human
gauugggcacaucauuucaa

SEQ ID NO: 2961954 - RNA, 19 nt, Human
gauuuguuaaugauagcua

SEQ ID NO: 2961955 - RNA, 22 nt, Human
gauuucuguuuagauaauacac

SEQ ID NO: 2961956 - RNA, 21 nt, Human
gauuucuguuuagauaauaca

SEQ ID NO: 2961957 - RNA, 15 nt, Human
gauugcaacaggcug

SEQ ID NO: 2961958 - RNA, 17 nt, Human
gauugcaacaggcuggg

SEQ ID NO: 2961959 - RNA, 18 nt, Human
gauugcaacaggcugggc

SEQ ID NO: 2961960 - RNA, 16 nt, Human
gauugcaacaggcugg

SEQ ID NO: 2961961 - RNA, 22 nt, Human
gauucuuuccugaggcugggcu

SEQ ID NO: 2961962 - RNA, 20 nt, Human
gauucuuuccugaggcuggg

SEQ ID NO: 2961963 - RNA, 16 nt, Human
gauucccaagcucugc

SEQ ID NO: 2961964 - RNA, 17 nt, Human
gauucccaagcucugcu

SEQ ID NO: 2961965 - RNA, 19 nt, Human
gauucuuuccugaggcugg

SEQ ID NO: 2961966 - RNA, 15 nt, Human
gauucccaagcucug

SEQ ID NO: 2961967 - RNA, 13 nt, Human
gauuacaagcgug

SEQ ID NO: 2961968 - RNA, 21 nt, Human
gauuacaagcgugagccacug

SEQ ID NO: 2961969 - RNA, 18 nt, Human
gauucagacagcugccug

SEQ ID NO: 2961970 - RNA, 17 nt, Human
gauucagacagcugccu

SEQ ID NO: 2961971 - RNA, 14 nt, Human
gauucagacagcug

SEQ ID NO: 2961972 - RNA, 13 nt, Human
gauucagacagcu

SEQ ID NO: 2961973 - RNA, 14 nt, Human
gauuaaguaaugau

SEQ ID NO: 2961974 - RNA, 22 nt, Human
gauuaaguaaugauaacuggaa

SEQ ID NO: 2961975 - RNA, 18 nt, Human
gauguucuagcauggcug

SEQ ID NO: 2961976 - RNA, 16 nt, Human
gaugcuagaacucccu

SEQ ID NO: 2961977 - RNA, 15 nt, Human
gcaaacuucagaguu

SEQ ID NO: 2961978 - RNA, 16 nt, Human
gcaaaccaucauugaa

SEQ ID NO: 2961979 - RNA, 21 nt, Human
gcaaaccaucauugaaaucuu

SEQ ID NO: 2961980 - RNA, 20 nt, Human
gcaaaccaucauugaaaucu

SEQ ID NO: 2961981 - RNA, 19 nt, Human
gcaaaccaucauugaaauc

SEQ ID NO: 2961982 - RNA, 17 nt, Human
gcaaaccaucauugaaa

SEQ ID NO: 2961983 - RNA, 17 nt, Human
gcaaauaaguguauuuu

SEQ ID NO: 2961984 - RNA, 23 nt, Human
gcaaauaaguguauuuugaaauu

SEQ ID NO: 2961985 - RNA, 21 nt, Human
gcaaauaaguguauuuugaaa

SEQ ID NO: 2961986 - RNA, 18 nt, Human
gcaacugcauuggcuuug

SEQ ID NO: 2961987 - RNA, 22 nt, Human
gcaagguuuaaguuauuaagag

SEQ ID NO: 2961988 - RNA, 14 nt, Human
gcaagguuuaaguu

SEQ ID NO: 2961989 - RNA, 17 nt, Human
gcaagguuuaaguuauu

SEQ ID NO: 2961990 - RNA, 19 nt, Human
gcaagguuuaaguuauuaa

SEQ ID NO: 2961991 - RNA, 17 nt, Human
gcaauccugcaagaaca

SEQ ID NO: 2961992 - RNA, 13 nt, Human
gcaaggcugucaa

SEQ ID NO: 2961993 - RNA, 14 nt, Human
gcaaggucauuuuu

SEQ ID NO: 2961994 - RNA, 18 nt, Human
gcaaggcugucaauuaca

SEQ ID NO: 2961995 - RNA, 14 nt, Human
gcaaggcugucaau

SEQ ID NO: 2961996 - RNA, 18 nt, Human
gcaagcaccuccugccuc

SEQ ID NO: 2961997 - RNA, 20 nt, Human
gcaagcaccuccugccucga

SEQ ID NO: 2961998 - RNA, 15 nt, Human
gcaagcaccuccugc

SEQ ID NO: 2961999 - RNA, 16 nt, Human
gcaagcaccuccugcc

SEQ ID NO: 2962000 - RNA, 16 nt, Human
gcaagaugugggcagu

SEQ ID NO: 2962001 - RNA, 12 nt, Human
gcaagauguggg

SEQ ID NO: 2962002 - RNA, 20 nt, Human
gcagcagggagggcuucugc

SEQ ID NO: 2962003 - RNA, 19 nt, Human
gcagccucaaccuccuggg

SEQ ID NO: 2962004 - RNA, 20 nt, Human
gcagccucaaccuccugggc

SEQ ID NO: 2962005 - RNA, 21 nt, Human
gcagccucaaccuccugggcu

SEQ ID NO: 2962006 - RNA, 22 nt, Human
gcagccucaaccuccugggcua

SEQ ID NO: 2962007 - RNA, 14 nt, Human
gcagccuggacccu

SEQ ID NO: 2962008 - RNA, 19 nt, Human
gcagagaaugaaagggccc

SEQ ID NO: 2962009 - RNA, 20 nt, Human
gcagagaaugaaagggccca

SEQ ID NO: 2962010 - RNA, 21 nt, Human
gcagagaaugaaagggcccag

SEQ ID NO: 2962011 - RNA, 21 nt, Human
gcagagaauucucuuauccaa

SEQ ID NO: 2962012 - RNA, 22 nt, Human
gcagagaaugaaagggcccaga

SEQ ID NO: 2962013 - RNA, 23 nt, Human
gcagagaaugaaagggcccagag

SEQ ID NO: 2962014 - RNA, 13 nt, Human
gcagaguggcagu

SEQ ID NO: 2962015 - RNA, 22 nt, Human
gcagaguggcagucuucaguuu

SEQ ID NO: 2962016 - RNA, 15 nt, Human
gcagaguugaagaca

SEQ ID NO: 2962017 - RNA, 17 nt, Human
gcagagaccaucccuga

SEQ ID NO: 2962018 - RNA, 15 nt, Human
gcagagaccaucccu

SEQ ID NO: 2962019 - RNA, 14 nt, Human
gcagagaccauccc

SEQ ID NO: 2962020 - RNA, 12 nt, Human
gcagcaauaaag

SEQ ID NO: 2962021 - RNA, 19 nt, Human
gcagaguugaagacagagc

SEQ ID NO: 2962022 - RNA, 17 nt, Human
gcagaguugaagacaga

SEQ ID NO: 2962023 - RNA, 16 nt, Human
gcagaguugaagacag

SEQ ID NO: 2962024 - RNA, 14 nt, Human
gcacccggccccug

SEQ ID NO: 2962025 - RNA, 23 nt, Human
gcacccauuaugcgcuguggcca

SEQ ID NO: 2962026 - RNA, 15 nt, Human
gcacccggccccugc

SEQ ID NO: 2962027 - RNA, 17 nt, Human
gcacccggccccugcug

SEQ ID NO: 2962028 - RNA, 14 nt, Human
gcaccuccugccuc

SEQ ID NO: 2962029 - RNA, 15 nt, Human
gcaccuccugccucg

SEQ ID NO: 2962030 - RNA, 19 nt, Human
gcaccacugcacuccagcc

SEQ ID NO: 2962031 - RNA, 16 nt, Human
gcacagcuucauuucc

SEQ ID NO: 2962032 - RNA, 22 nt, Human
gcacaugccucucucaggccaa

SEQ ID NO: 2962033 - RNA, 19 nt, Human
gcacagcuaacauggaagu

SEQ ID NO: 2962034 - RNA, 18 nt, Human
gcacagccucuuagaugc

SEQ ID NO: 2962035 - RNA, 20 nt, Human
gcacagccucuuagaugcag

SEQ ID NO: 2962036 - RNA, 14 nt, Human
gcaaugaccuuuca

SEQ ID NO: 2962037 - RNA, 13 nt, Human
gcaaugaccuuuc

SEQ ID NO: 2962038 - RNA, 17 nt, Human
gcacuaaggugugcucu

SEQ ID NO: 2962039 - RNA, 18 nt, Human
gcacuaaggugugcucug

SEQ ID NO: 2962040 - RNA, 14 nt, Human
gcacugggcuuggg

SEQ ID NO: 2962041 - RNA, 23 nt, Human
gcacugggcuuggggaccagagc

SEQ ID NO: 2962042 - RNA, 22 nt, Human
gcacugggcuuggggaccagag

SEQ ID NO: 2962043 - RNA, 15 nt, Human
gcacugucaagauga

SEQ ID NO: 2962044 - RNA, 12 nt, Human
gcagaaggaaga

SEQ ID NO: 2962045 - RNA, 14 nt, Human
gcagaaggaagacu

SEQ ID NO: 2962046 - RNA, 13 nt, Human
gcagaaggaagac

SEQ ID NO: 2962047 - RNA, 14 nt, Human
gcagaagacaguau

SEQ ID NO: 2962048 - RNA, 20 nt, Human
gcauauucaggaagcucagg

SEQ ID NO: 2962049 - RNA, 18 nt, Human
gcauauucaggaagcuca

SEQ ID NO: 2962050 - RNA, 17 nt, Human
gcauauucaggaagcuc

SEQ ID NO: 2962051 - RNA, 22 nt, Human
gcauauugcauacuauuaaaca

SEQ ID NO: 2962052 - RNA, 21 nt, Human
gcaucaagaugugacauguuu

SEQ ID NO: 2962053 - RNA, 15 nt, Human
gcauauucaggaagc

SEQ ID NO: 2962054 - RNA, 17 nt, Human
gcagugggagcugccug

SEQ ID NO: 2962055 - RNA, 18 nt, Human
gcagugggagcugccugu

SEQ ID NO: 2962056 - RNA, 18 nt, Human
gcauagauucccugagca

SEQ ID NO: 2962057 - RNA, 13 nt, Human
gcaguucugaaga

SEQ ID NO: 2962058 - RNA, 14 nt, Human
gcagugcucaccca

SEQ ID NO: 2962059 - RNA, 16 nt, Human
gcagugggagcugccu

SEQ ID NO: 2962060 - RNA, 17 nt, Human
gcagugcuuggcccagg

SEQ ID NO: 2962061 - RNA, 16 nt, Human
gcagugcuuggcccag

SEQ ID NO: 2962062 - RNA, 23 nt, Human
gcagugcuuccaaggauggacca

SEQ ID NO: 2962063 - RNA, 16 nt, Human
gcagggagggcuucug

SEQ ID NO: 2962064 - RNA, 12 nt, Human
gcagggcucagc

SEQ ID NO: 2962065 - RNA, 20 nt, Human
gcaggauucuuccucccucc

SEQ ID NO: 2962066 - RNA, 15 nt, Human
gcaggcuacugucag

SEQ ID NO: 2962067 - RNA, 19 nt, Human
gccaaacucaccugccccu

SEQ ID NO: 2962068 - RNA, 21 nt, Human
gccaaacucaccugccccuca

SEQ ID NO: 2962069 - RNA, 16 nt, Human
gccaaagaagcagacc

SEQ ID NO: 2962070 - RNA, 14 nt, Human
gccaaaggaagcac

SEQ ID NO: 2962071 - RNA, 20 nt, Human
gccaaaggaagcacaugccu

SEQ ID NO: 2962072 - RNA, 16 nt, Human
gccaaaggaagcacau

SEQ ID NO: 2962073 - RNA, 22 nt, Human
gcauuuugcuaaaugugaauga

SEQ ID NO: 2962074 - RNA, 12 nt, Human
gcauuccccacu

SEQ ID NO: 2962075 - RNA, 23 nt, Human
gcauuuuaaacaaaauagaaagu

SEQ ID NO: 2962076 - RNA, 23 nt, Human
gcauuugcugaauacagaggcaa

SEQ ID NO: 2962077 - RNA, 21 nt, Human
gcauuuggugguuucagaaau

SEQ ID NO: 2962078 - RNA, 17 nt, Human
gcauuugcugaauacag

SEQ ID NO: 2962079 - RNA, 17 nt, Human
gcauguuugugauugac

SEQ ID NO: 2962080 - RNA, 15 nt, Human
gcaugccuggauggg

SEQ ID NO: 2962081 - RNA, 15 nt, Human
gcaugcugucccuua

SEQ ID NO: 2962082 - RNA, 22 nt, Human
gcaugccuggauggggcugcac

SEQ ID NO: 2962083 - RNA, 17 nt, Human
gcaugccuggauggggc

SEQ ID NO: 2962084 - RNA, 23 nt, Human
gcaugaaguaauaugcacacauu

SEQ ID NO: 2962085 - RNA, 17 nt, Human
gcaucaggccaggcccu

SEQ ID NO: 2962086 - RNA, 16 nt, Human
gcaucaggccaggccc

SEQ ID NO: 2962087 - RNA, 15 nt, Human
gcaucaggccaggcc

SEQ ID NO: 2962088 - RNA, 13 nt, Human
gcaucaggccagg

SEQ ID NO: 2962089 - RNA, 22 nt, Human
gccauuuaaagcuuauuaaaac

SEQ ID NO: 2962090 - RNA, 17 nt, Human
gccauuucuuccacaag

SEQ ID NO: 2962091 - RNA, 13 nt, Human
gccauuuguccca

SEQ ID NO: 2962092 - RNA, 14 nt, Human
gccauuugucccaa

SEQ ID NO: 2962093 - RNA, 16 nt, Human
gccauuugucccaagu

SEQ ID NO: 2962094 - RNA, 18 nt, Human
gccauuugucccaagugc

SEQ ID NO: 2962095 - RNA, 20 nt, Human
gccauuugucccaagugcca

SEQ ID NO: 2962096 - RNA, 22 nt, Human
gccauuucuuccacaagagccc

SEQ ID NO: 2962097 - RNA, 20 nt, Human
gccauuucuuccacaagagc

SEQ ID NO: 2962098 - RNA, 15 nt, Human
gccaucccucccucc

SEQ ID NO: 2962099 - RNA, 14 nt, Human
gccaugggacaggg

SEQ ID NO: 2962100 - RNA, 19 nt, Human
gccaugggacagggaggac

SEQ ID NO: 2962101 - RNA, 15 nt, Human
gcccaccccucaaca

SEQ ID NO: 2962102 - RNA, 19 nt, Human
gcccacaggaucagucuga

SEQ ID NO: 2962103 - RNA, 13 nt, Human
gcccacaggauca

SEQ ID NO: 2962104 - RNA, 18 nt, Human
gcccacaggaucagucug

SEQ ID NO: 2962105 - RNA, 16 nt, Human
gcccaaagaugcagcc

SEQ ID NO: 2962106 - RNA, 15 nt, Human
gcccaaagaugcagc

SEQ ID NO: 2962107 - RNA, 16 nt, Human
gcccacagcuguauga

SEQ ID NO: 2962108 - RNA, 23 nt, Human
gccaggggaaaaucagccugcuc

SEQ ID NO: 2962109 - RNA, 17 nt, Human
gccaggggaaaaucagc

SEQ ID NO: 2962110 - RNA, 22 nt, Human
gccaggggaaaaucagccugcu

SEQ ID NO: 2962111 - RNA, 21 nt, Human
gccaggggaaaaucagccugc

SEQ ID NO: 2962112 - RNA, 19 nt, Human
gccaggaagccagcaggcu

SEQ ID NO: 2962113 - RNA, 11 nt, Human
gccaggaagcc

SEQ ID NO: 2962114 - RNA, 18 nt, Human
gccaggaagccagcaggc

SEQ ID NO: 2962115 - RNA, 17 nt, Human
gccaggaagccagcagg

SEQ ID NO: 2962116 - RNA, 19 nt, Human
gccauccagguucagcuug

SEQ ID NO: 2962117 - RNA, 20 nt, Human
gccauccagguucagcuugu

SEQ ID NO: 2962118 - RNA, 14 nt, Human
gccauccagguuca

SEQ ID NO: 2962119 - RNA, 17 nt, Human
gccaucccagccccaau

SEQ ID NO: 2962120 - RNA, 11 nt, Human
gccaucccucc

SEQ ID NO: 2962121 - RNA, 13 nt, Human
gccaucccucccu

SEQ ID NO: 2962122 - RNA, 14 nt, Human
gccaucccucccuc

SEQ ID NO: 2962123 - RNA, 16 nt, Human
gccaucccagccccaa

SEQ ID NO: 2962124 - RNA, 15 nt, Human
gccaucccagcccca

SEQ ID NO: 2962125 - RNA, 14 nt, Human
gccaucccagcccc

SEQ ID NO: 2962126 - RNA, 13 nt, Human
gccaucccagccc

SEQ ID NO: 2962127 - RNA, 15 nt, Human
gccagagacacaagc

SEQ ID NO: 2962128 - RNA, 12 nt, Human
gccagagacaca

SEQ ID NO: 2962129 - RNA, 17 nt, Human
gccagagggagugacag

SEQ ID NO: 2962130 - RNA, 18 nt, Human
gccagagggagugacaga

SEQ ID NO: 2962131 - RNA, 17 nt, Human
gccacugcaccgggcca

SEQ ID NO: 2962132 - RNA, 18 nt, Human
gccacugcaccgggccac

SEQ ID NO: 2962133 - RNA, 14 nt, Human
gccacggccaggcc

SEQ ID NO: 2962134 - RNA, 15 nt, Human
gccacggccaggcca

SEQ ID NO: 2962135 - RNA, 20 nt, Human
gccacuauuguuagucucuu

SEQ ID NO: 2962136 - RNA, 21 nt, Human
gccacuauuguuagucucuug

SEQ ID NO: 2962137 - RNA, 16 nt, Human
gccacggccaggccag

SEQ ID NO: 2962138 - RNA, 22 nt, Human
gccacguucuuacuaguuuccc

SEQ ID NO: 2962139 - RNA, 17 nt, Human
gccagauucuuuccuga

SEQ ID NO: 2962140 - RNA, 19 nt, Human
gccagagggagugacagag

SEQ ID NO: 2962141 - RNA, 20 nt, Human
gccagagggagugacagagg

SEQ ID NO: 2962142 - RNA, 16 nt, Human
gccagauucuuuccug

SEQ ID NO: 2962143 - RNA, 12 nt, Human
gccagccuugac

SEQ ID NO: 2962144 - RNA, 20 nt, Human
gccagccgagauagccaagg

SEQ ID NO: 2962145 - RNA, 21 nt, Human
gccagccgagauagccaaggc

SEQ ID NO: 2962146 - RNA, 22 nt, Human
gccagccuugaccauucuccac

SEQ ID NO: 2962147 - RNA, 21 nt, Human
gccagccuugaccauucucca

SEQ ID NO: 2962148 - RNA, 20 nt, Human
gccagccuugaccauucucc

SEQ ID NO: 2962149 - RNA, 14 nt, Human
gccagccuugacca

SEQ ID NO: 2962150 - RNA, 15 nt, Human
gccagcugcuugggc

SEQ ID NO: 2962151 - RNA, 14 nt, Human
gccagcugcuuggg

SEQ ID NO: 2962152 - RNA, 15 nt, Human
gccccaucugcgggg

SEQ ID NO: 2962153 - RNA, 23 nt, Human
gccccauccucuguacagagccc

SEQ ID NO: 2962154 - RNA, 17 nt, Human
gccccauucugccugcc

SEQ ID NO: 2962155 - RNA, 18 nt, Human
gccccauucugccugccc

SEQ ID NO: 2962156 - RNA, 20 nt, Human
gccccauucugccugcccag

SEQ ID NO: 2962157 - RNA, 21 nt, Human
gccccauucugccugcccagg

SEQ ID NO: 2962158 - RNA, 15 nt, Human
gccccagugcccaca

SEQ ID NO: 2962159 - RNA, 16 nt, Human
gccccagugcccacag

SEQ ID NO: 2962160 - RNA, 17 nt, Human
gccccagugcccacagg

SEQ ID NO: 2962161 - RNA, 21 nt, Human
gccccagugcccacaggauca

SEQ ID NO: 2962162 - RNA, 11 nt, Human
gcccaggcugg

SEQ ID NO: 2962163 - RNA, 18 nt, Human
gcccaggccuccuacagc

SEQ ID NO: 2962164 - RNA, 16 nt, Human
gcccaggaaaggcucc

SEQ ID NO: 2962165 - RNA, 15 nt, Human
gcccaggaaaggcuc

SEQ ID NO: 2962166 - RNA, 12 nt, Human
gcccaggaaagg

SEQ ID NO: 2962167 - RNA, 22 nt, Human
gcccagucuggaaugcaguggu

SEQ ID NO: 2962168 - RNA, 20 nt, Human
gcccagucuggaaugcagug

SEQ ID NO: 2962169 - RNA, 16 nt, Human
gcccaggcuggcgugc

SEQ ID NO: 2962170 - RNA, 14 nt, Human
gcccaggcuggcgu

SEQ ID NO: 2962171 - RNA, 15 nt, Human
gcccaggcuggcgug

SEQ ID NO: 2962172 - RNA, 22 nt, Human
gccccgaggccuucucugaagg

SEQ ID NO: 2962173 - RNA, 14 nt, Human
gccccgcccaggcu

SEQ ID NO: 2962174 - RNA, 23 nt, Human
gccccgaggccuucucugaagga

SEQ ID NO: 2962175 - RNA, 22 nt, Human
gccccauucugccugcccaggc

SEQ ID NO: 2962176 - RNA, 23 nt, Human
gccccauucugccugcccaggcc

SEQ ID NO: 2962177 - RNA, 17 nt, Human
gccccgugggguuccuc

SEQ ID NO: 2962178 - RNA, 21 nt, Human
gccccucagggucccuggugg

SEQ ID NO: 2962179 - RNA, 19 nt, Human
gccccucagggucccuggu

SEQ ID NO: 2962180 - RNA, 23 nt, Human
gccccucaacucuccuccagagu

SEQ ID NO: 2962181 - RNA, 23 nt, Human
gccccugcacagcaggcugccag

SEQ ID NO: 2962182 - RNA, 14 nt, Human
gccccugcacagca

SEQ ID NO: 2962183 - RNA, 17 nt, Human
gccccugcacagcaggc

SEQ ID NO: 2962184 - RNA, 22 nt, Human
gccccugcacagcaggcugcca

SEQ ID NO: 2962185 - RNA, 19 nt, Human
gccccugcacuccagccug

SEQ ID NO: 2962186 - RNA, 23 nt, Human
gccccuggcagccccuguucugg

SEQ ID NO: 2962187 - RNA, 19 nt, Human
gccccuucugacccaugcu

SEQ ID NO: 2962188 - RNA, 12 nt, Human
gcccggcuccag

SEQ ID NO: 2962189 - RNA, 13 nt, Human
gcccggcuccagg

SEQ ID NO: 2962190 - RNA, 14 nt, Human
gcccggcuccaggc

SEQ ID NO: 2962191 - RNA, 15 nt, Human
gcccggcuccaggcu

SEQ ID NO: 2962192 - RNA, 12 nt, Human
gcccgggcucug

SEQ ID NO: 2962193 - RNA, 18 nt, Human
gcccgggcucugccuccc

SEQ ID NO: 2962194 - RNA, 15 nt, Human
gcccgggcucugccu

SEQ ID NO: 2962195 - RNA, 14 nt, Human
gcccgggcucugcc

SEQ ID NO: 2962196 - RNA, 13 nt, Human
gcccgggcucugc

SEQ ID NO: 2962197 - RNA, 21 nt, Human
gcccgggcucugccucccauc

SEQ ID NO: 2962198 - RNA, 20 nt, Human
gcccgggcucugccucccau

SEQ ID NO: 2962199 - RNA, 19 nt, Human
gcccgggcucugccuccca

SEQ ID NO: 2962200 - RNA, 14 nt, Human
gcccucuccugggc

SEQ ID NO: 2962201 - RNA, 15 nt, Human
gcccucuccugggca

SEQ ID NO: 2962202 - RNA, 16 nt, Human
gcccucuccugggcag

SEQ ID NO: 2962203 - RNA, 22 nt, Human
gcccucugcccacucccugcaa

SEQ ID NO: 2962204 - RNA, 18 nt, Human
gcccucuccugggcagcu

SEQ ID NO: 2962205 - RNA, 19 nt, Human
gcccucuccugggcagcug

SEQ ID NO: 2962206 - RNA, 21 nt, Human
gcccucuccugggcagcugcc

SEQ ID NO: 2962207 - RNA, 22 nt, Human
gccucaagugauucuccugccu

SEQ ID NO: 2962208 - RNA, 24 nt, Human
gccucaagugauucuccugccuca

SEQ ID NO: 2962209 - RNA, 18 nt, Human
gccucagcauccuggcac

SEQ ID NO: 2962210 - RNA, 17 nt, Human
gccucagcauccuggca

SEQ ID NO: 2962211 - RNA, 21 nt, Human
gccucagcauccuggcacccg

SEQ ID NO: 2962212 - RNA, 23 nt, Human
gccgucuaccugaggggccucuu

SEQ ID NO: 2962213 - RNA, 22 nt, Human
gccgucuaccugaggggccucu

SEQ ID NO: 2962214 - RNA, 20 nt, Human
gccgucuaccugaggggccu

SEQ ID NO: 2962215 - RNA, 18 nt, Human
gccgucuaccugaggggc

SEQ ID NO: 2962216 - RNA, 13 nt, Human
gccgcagcccugc

SEQ ID NO: 2962217 - RNA, 17 nt, Human
gccgagauagccaaggc

SEQ ID NO: 2962218 - RNA, 15 nt, Human
gccgcagcccugcag

SEQ ID NO: 2962219 - RNA, 17 nt, Human
gccgcagcccugcagag

SEQ ID NO: 2962220 - RNA, 16 nt, Human
gccgcagcccugcaga

SEQ ID NO: 2962221 - RNA, 16 nt, Human
gccgagauagccaagg

SEQ ID NO: 2962222 - RNA, 19 nt, Human
gcccuucuuuccacagaag

SEQ ID NO: 2962223 - RNA, 23 nt, Human
gcccuucucuccagccccuggau

SEQ ID NO: 2962224 - RNA, 13 nt, Human
gcccuucucucca

SEQ ID NO: 2962225 - RNA, 11 nt, Human
gccugcccagg

SEQ ID NO: 2962226 - RNA, 12 nt, Human
gccugcccaggc

SEQ ID NO: 2962227 - RNA, 14 nt, Human
gccuggacccugug

SEQ ID NO: 2962228 - RNA, 15 nt, Human
gccucugacacacag

SEQ ID NO: 2962229 - RNA, 16 nt, Human
gccucugacacacagc

SEQ ID NO: 2962230 - RNA, 16 nt, Human
gccucugcacuccccu

SEQ ID NO: 2962231 - RNA, 20 nt, Human
gccucugcacuccccugcug

SEQ ID NO: 2962232 - RNA, 19 nt, Human
gccucugcacuccccugcu

SEQ ID NO: 2962233 - RNA, 18 nt, Human
gccucugcacuccccugc

SEQ ID NO: 2962234 - RNA, 17 nt, Human
gccucugcacuccccug

SEQ ID NO: 2962235 - RNA, 13 nt, Human
gccugagaugguc

SEQ ID NO: 2962236 - RNA, 15 nt, Human
gccucugcacucccc

SEQ ID NO: 2962237 - RNA, 21 nt, Human
gccucugcacuccccugcugg

SEQ ID NO: 2962238 - RNA, 15 nt, Human
gccucucccaucacu

SEQ ID NO: 2962239 - RNA, 22 nt, Human
gccucagccucccaaagugcug

SEQ ID NO: 2962240 - RNA, 17 nt, Human
gccucccaucacccgcu

SEQ ID NO: 2962241 - RNA, 12 nt, Human
gccucagccucc

SEQ ID NO: 2962242 - RNA, 14 nt, Human
gccucagccuccca

SEQ ID NO: 2962243 - RNA, 20 nt, Human
gccucccgaauagcugggac

SEQ ID NO: 2962244 - RNA, 21 nt, Human
gccucccgaguagcugggacu

SEQ ID NO: 2962245 - RNA, 23 nt, Human
gccucccgaguagcugggacuac

SEQ ID NO: 2962246 - RNA, 18 nt, Human
gccucccgaauagcuggg

SEQ ID NO: 2962247 - RNA, 19 nt, Human
gccucccgaauagcuggga

SEQ ID NO: 2962248 - RNA, 11 nt, Human
gccuccccucc

SEQ ID NO: 2962249 - RNA, 12 nt, Human
gccuccccuccu

SEQ ID NO: 2962250 - RNA, 13 nt, Human
gccuccccuccuc

SEQ ID NO: 2962251 - RNA, 14 nt, Human
gccuccccuccucu

SEQ ID NO: 2962252 - RNA, 17 nt, Human
gcgcugccccuggcagc

SEQ ID NO: 2962253 - RNA, 14 nt, Human
gcgcugccccuggc

SEQ ID NO: 2962254 - RNA, 20 nt, Human
gcgccuacaggagugagcac

SEQ ID NO: 2962255 - RNA, 21 nt, Human
gcgccuacaggagugagcacu

SEQ ID NO: 2962256 - RNA, 22 nt, Human
gcgccacugugcuccagccugg

SEQ ID NO: 2962257 - RNA, 23 nt, Human
gcgccacugugcuccagccuggg

SEQ ID NO: 2962258 - RNA, 18 nt, Human
gcgccuacaggagugagc

SEQ ID NO: 2962259 - RNA, 19 nt, Human
gcggaaugaaccacaucuu

SEQ ID NO: 2962260 - RNA, 16 nt, Human
gcggacagccacggcc

SEQ ID NO: 2962261 - RNA, 19 nt, Human
gcggacagccacggccagg

SEQ ID NO: 2962262 - RNA, 18 nt, Human
gcggggacagcuccuucu

SEQ ID NO: 2962263 - RNA, 19 nt, Human
gcggggacagcuccuucug

SEQ ID NO: 2962264 - RNA, 23 nt, Human
gcggacagccacggccaggccag

SEQ ID NO: 2962265 - RNA, 23 nt, Human
gcggggacagcuccuucuguccu

SEQ ID NO: 2962266 - RNA, 20 nt, Human
gcgguccacccaggagcccc

SEQ ID NO: 2962267 - RNA, 23 nt, Human
gcgguccacccaggagccccgag

SEQ ID NO: 2962268 - RNA, 19 nt, Human
gcguccugucggagcccug

SEQ ID NO: 2962269 - RNA, 14 nt, Human
gcuaacuuggguua

SEQ ID NO: 2962270 - RNA, 22 nt, Human
gcuacacaggggaaaagaggag

SEQ ID NO: 2962271 - RNA, 14 nt, Human
gcuaacauggaagu

SEQ ID NO: 2962272 - RNA, 18 nt, Human
gcuaacauggaaguacua

SEQ ID NO: 2962273 - RNA, 17 nt, Human
gcuaacauggaaguacu

SEQ ID NO: 2962274 - RNA, 15 nt, Human
gcgugagccacugca

SEQ ID NO: 2962275 - RNA, 14 nt, Human
gcgugagccacugc

SEQ ID NO: 2962276 - RNA, 22 nt, Human
gcguccugucggagcccugucu

SEQ ID NO: 2962277 - RNA, 22 nt, Human
gcuagacgagcaggcuucuucc

SEQ ID NO: 2962278 - RNA, 21 nt, Human
gcuagacgagcaggcuucuuc

SEQ ID NO: 2962279 - RNA, 23 nt, Human
gccuuauggaacacucugagacu

SEQ ID NO: 2962280 - RNA, 22 nt, Human
gccuuauggaacacucugagac

SEQ ID NO: 2962281 - RNA, 21 nt, Human
gccuuauggaacacucugaga

SEQ ID NO: 2962282 - RNA, 19 nt, Human
gccuuacccucauguucuu

SEQ ID NO: 2962283 - RNA, 20 nt, Human
gccuuagaagucacacagua

SEQ ID NO: 2962284 - RNA, 14 nt, Human
gccugguggcagcu

SEQ ID NO: 2962285 - RNA, 15 nt, Human
gccugguggcagcug

SEQ ID NO: 2962286 - RNA, 17 nt, Human
gccugucagcuaaagaa

SEQ ID NO: 2962287 - RNA, 16 nt, Human
gccugguggcagcugc

SEQ ID NO: 2962288 - RNA, 17 nt, Human
gccugguggcagcugcg

SEQ ID NO: 2962289 - RNA, 18 nt, Human
gccuguaaucacagcuac

SEQ ID NO: 2962290 - RNA, 19 nt, Human
gccuuuuuauaacuuuuua

SEQ ID NO: 2962291 - RNA, 22 nt, Human
gcgacagugagacucugucuca

SEQ ID NO: 2962292 - RNA, 19 nt, Human
gccuuccccuggcacuggc

SEQ ID NO: 2962293 - RNA, 18 nt, Human
gccuucggccuccauccu

SEQ ID NO: 2962294 - RNA, 20 nt, Human
gccuuccccuggcacuggca

SEQ ID NO: 2962295 - RNA, 19 nt, Human
gccuucggccuccauccug

SEQ ID NO: 2962296 - RNA, 21 nt, Human
ggagaccccuuggggagcagg

SEQ ID NO: 2962297 - RNA, 21 nt, Human
ggagagcuagcagcagggagg

SEQ ID NO: 2962298 - RNA, 17 nt, Human
ggagagcuagcagcagg

SEQ ID NO: 2962299 - RNA, 20 nt, Human
ggagcaaaaucgaugcagug

SEQ ID NO: 2962300 - RNA, 20 nt, Human
ggagauuuacaacuggggga

SEQ ID NO: 2962301 - RNA, 15 nt, Human
ggagaggggcacagg

SEQ ID NO: 2962302 - RNA, 20 nt, Human
ggaagccagcaggcucucag

SEQ ID NO: 2962303 - RNA, 23 nt, Human
ggaccccacuccggcccuccaga

SEQ ID NO: 2962304 - RNA, 15 nt, Human
ggagggcuccagaca

SEQ ID NO: 2962305 - RNA, 14 nt, Human
ggagggcuccagac

SEQ ID NO: 2962306 - RNA, 17 nt, Human
ggagggcuccagacaca

SEQ ID NO: 2962307 - RNA, 20 nt, Human
ggagucccaccuuggcugca

SEQ ID NO: 2962308 - RNA, 11 nt, Human
ggagugacaga

SEQ ID NO: 2962309 - RNA, 16 nt, Human
ggagugacagaggcag

SEQ ID NO: 2962310 - RNA, 16 nt, Human
ggaucacagccucuga

SEQ ID NO: 2962311 - RNA, 12 nt, Human
ggagugagcugg

SEQ ID NO: 2962312 - RNA, 14 nt, Human
ggagugagcugguu

SEQ ID NO: 2962313 - RNA, 21 nt, Human
ggagugaguugauagcacaga

SEQ ID NO: 2962314 - RNA, 17 nt, Human
ggagugacagaggcagc

SEQ ID NO: 2962315 - RNA, 18 nt, Human
ggagugacagaggcagcc

SEQ ID NO: 2962316 - RNA, 19 nt, Human
ggagugacagaggcagccc

SEQ ID NO: 2962317 - RNA, 21 nt, Human
ggagugacagaggcagcccca

SEQ ID NO: 2962318 - RNA, 12 nt, Human
ggagggagggcu

SEQ ID NO: 2962319 - RNA, 13 nt, Human
ggagggcuccaga

SEQ ID NO: 2962320 - RNA, 12 nt, Human
ggagggcuccag

SEQ ID NO: 2962321 - RNA, 21 nt, Human
ggaggaucucuugagccuggg

SEQ ID NO: 2962322 - RNA, 17 nt, Human
ggaggaucucuugagcc

SEQ ID NO: 2962323 - RNA, 23 nt, Human
ggaggaucacuugaguccagaag

SEQ ID NO: 2962324 - RNA, 15 nt, Human
ggaggauguucuggg

SEQ ID NO: 2962325 - RNA, 19 nt, Human
ggaggacuccaggcagcag

SEQ ID NO: 2962326 - RNA, 20 nt, Human
ggaggacgcucucuggccuu

SEQ ID NO: 2962327 - RNA, 21 nt, Human
ggaggacgcucucuggccuuc

SEQ ID NO: 2962328 - RNA, 19 nt, Human
ggaggacgcucucuggccu

SEQ ID NO: 2962329 - RNA, 11 nt, Human
ggccacuguga

SEQ ID NO: 2962330 - RNA, 16 nt, Human
ggccaggagccuccug

SEQ ID NO: 2962331 - RNA, 14 nt, Human
ggccaggagccucc

SEQ ID NO: 2962332 - RNA, 16 nt, Human
ggccacugugaagaga

SEQ ID NO: 2962333 - RNA, 11 nt, Human
ggccaggcugg

SEQ ID NO: 2962334 - RNA, 14 nt, Human
ggccaggccagagg

SEQ ID NO: 2962335 - RNA, 16 nt, Human
ggccaggccagaggga

SEQ ID NO: 2962336 - RNA, 15 nt, Human
ggcagguuggugggg

SEQ ID NO: 2962337 - RNA, 19 nt, Human
ggcagugcucacccacacc

SEQ ID NO: 2962338 - RNA, 23 nt, Human
ggcauguucucugaggacacuaa

SEQ ID NO: 2962339 - RNA, 16 nt, Human
ggcagugcuuggccca

SEQ ID NO: 2962340 - RNA, 22 nt, Human
ggccaccugcggugcuaucucc

SEQ ID NO: 2962341 - RNA, 16 nt, Human
ggccaccugcggugcu

SEQ ID NO: 2962342 - RNA, 17 nt, Human
ggccacaagacccuugu

SEQ ID NO: 2962343 - RNA, 16 nt, Human
ggccacaagacccuug

SEQ ID NO: 2962344 - RNA, 15 nt, Human
ggcauuccccaggag

SEQ ID NO: 2962345 - RNA, 21 nt, Human
ggccccucagggucccuggug

SEQ ID NO: 2962346 - RNA, 20 nt, Human
ggccccucagggucccuggu

SEQ ID NO: 2962347 - RNA, 19 nt, Human
ggccccucagggucccugg

SEQ ID NO: 2962348 - RNA, 16 nt, Human
ggccccucaggguccc

SEQ ID NO: 2962349 - RNA, 17 nt, Human
ggccccugccacccugg

SEQ ID NO: 2962350 - RNA, 18 nt, Human
ggccccugccacccuggg

SEQ ID NO: 2962351 - RNA, 13 nt, Human
ggccccugcccgg

SEQ ID NO: 2962352 - RNA, 13 nt, Human
ggccccugccacc

SEQ ID NO: 2962353 - RNA, 16 nt, Human
ggccccugccacccug

SEQ ID NO: 2962354 - RNA, 12 nt, Human
ggccccugccac

SEQ ID NO: 2962355 - RNA, 13 nt, Human
ggccaugggccuc

SEQ ID NO: 2962356 - RNA, 22 nt, Human
ggccaugggacagggaggacgc

SEQ ID NO: 2962357 - RNA, 16 nt, Human
ggcaaggcugucaauu

SEQ ID NO: 2962358 - RNA, 15 nt, Human
ggcacccggccccug

SEQ ID NO: 2962359 - RNA, 16 nt, Human
ggcacccggccccugc

SEQ ID NO: 2962360 - RNA, 12 nt, Human
ggcagagcagag

SEQ ID NO: 2962361 - RNA, 16 nt, Human
ggcagagcagagacca

SEQ ID NO: 2962362 - RNA, 15 nt, Human
ggcagagcagagacc

SEQ ID NO: 2962363 - RNA, 20 nt, Human
ggcagagcagagaccauccc

SEQ ID NO: 2962364 - RNA, 21 nt, Human
ggaucagucugauucccaagc

SEQ ID NO: 2962365 - RNA, 19 nt, Human
ggcaacccccagccugcua

SEQ ID NO: 2962366 - RNA, 15 nt, Human
ggcaaggcugucaau

SEQ ID NO: 2962367 - RNA, 19 nt, Human
ggcaacugcauuggcuuug

SEQ ID NO: 2962368 - RNA, 18 nt, Human
ggcaacugcauuggcuuu

SEQ ID NO: 2962369 - RNA, 14 nt, Human
ggcagcagacacau

SEQ ID NO: 2962370 - RNA, 17 nt, Human
ggcagaggaaagcaaag

SEQ ID NO: 2962371 - RNA, 23 nt, Human
ggcagauacaggaaaagcugcug

SEQ ID NO: 2962372 - RNA, 23 nt, Human
ggcagaguugaagacagagcuac

SEQ ID NO: 2962373 - RNA, 23 nt, Human
ggcaggucuugaacuccuggccu

SEQ ID NO: 2962374 - RNA, 13 nt, Human
ggcagguccaggg

SEQ ID NO: 2962375 - RNA, 19 nt, Human
ggcagcugcgguccaccca

SEQ ID NO: 2962376 - RNA, 18 nt, Human
ggcagcugccuccccucc

SEQ ID NO: 2962377 - RNA, 21 nt, Human
ggcagcugccuccccuccucu

SEQ ID NO: 2962378 - RNA, 21 nt, Human
ggcagcuugaggguugggcug

SEQ ID NO: 2962379 - RNA, 22 nt, Human
ggcagcugccuccccuccucug

SEQ ID NO: 2962380 - RNA, 16 nt, Human
ggcagcagacacaugc

SEQ ID NO: 2962381 - RNA, 16 nt, Human
ggcagcugccuccccu

SEQ ID NO: 2962382 - RNA, 16 nt, Human
ggcagcucaccucucc

SEQ ID NO: 2962383 - RNA, 22 nt, Human
ggcagcucaccucucccuugga

SEQ ID NO: 2962384 - RNA, 21 nt, Human
ggcagcucaccucucccuugg

SEQ ID NO: 2962385 - RNA, 18 nt, Human
ggcagcucaccucucccu

SEQ ID NO: 2962386 - RNA, 17 nt, Human
gcugucuccauguuuga

SEQ ID NO: 2962387 - RNA, 19 nt, Human
gcugucccuuacgugaguc

SEQ ID NO: 2962388 - RNA, 22 nt, Human
gcugucccuuacgugaguccug

SEQ ID NO: 2962389 - RNA, 21 nt, Human
gcugucccuuacgugaguccu

SEQ ID NO: 2962390 - RNA, 23 nt, Human
gcugucaauuacaggaaguacug

SEQ ID NO: 2962391 - RNA, 22 nt, Human
gcugucaauuacaggaaguacu

SEQ ID NO: 2962392 - RNA, 19 nt, Human
gcugucaauuacaggaagu

SEQ ID NO: 2962393 - RNA, 17 nt, Human
gcugucaauuacaggaa

SEQ ID NO: 2962394 - RNA, 16 nt, Human
gcuggugucaccugaa

SEQ ID NO: 2962395 - RNA, 18 nt, Human
gcuggugucaccugaaga

SEQ ID NO: 2962396 - RNA, 20 nt, Human
gcuggucccacucaguccau

SEQ ID NO: 2962397 - RNA, 14 nt, Human
gcuggucccacuca

SEQ ID NO: 2962398 - RNA, 15 nt, Human
gcugguucaggguug

SEQ ID NO: 2962399 - RNA, 21 nt, Human
gcugguuagagguucccuuug

SEQ ID NO: 2962400 - RNA, 16 nt, Human
gcugucaauuacagga

SEQ ID NO: 2962401 - RNA, 22 nt, Human
gcugguucaggguuggccccug

SEQ ID NO: 2962402 - RNA, 22 nt, Human
gcuguauuuuaaaagaaugauu

SEQ ID NO: 2962403 - RNA, 17 nt, Human
gcugggcuucaguggca

SEQ ID NO: 2962404 - RNA, 21 nt, Human
gcugggaugauuggagggggg

SEQ ID NO: 2962405 - RNA, 22 nt, Human
gcugggagagccuuccaggggu

SEQ ID NO: 2962406 - RNA, 19 nt, Human
gcugggagagccuuccagg

SEQ ID NO: 2962407 - RNA, 18 nt, Human
gcugggagagccuuccag

SEQ ID NO: 2962408 - RNA, 17 nt, Human
gcugggagagccuucca

SEQ ID NO: 2962409 - RNA, 13 nt, Human
gcugggagagccu

SEQ ID NO: 2962410 - RNA, 12 nt, Human
gcugggagagcc

SEQ ID NO: 2962411 - RNA, 19 nt, Human
gcugggggccucagugcca

SEQ ID NO: 2962412 - RNA, 20 nt, Human
gcugggggccucagugccac

SEQ ID NO: 2962413 - RNA, 15 nt, Human
gcuggucccacucag

SEQ ID NO: 2962414 - RNA, 19 nt, Human
gcuggucccacucagucca

SEQ ID NO: 2962415 - RNA, 12 nt, Human
gcuggggccagu

SEQ ID NO: 2962416 - RNA, 23 nt, Human
gcugggggaagaagcucucuccu

SEQ ID NO: 2962417 - RNA, 18 nt, Human
gcugggcuucaguggcag

SEQ ID NO: 2962418 - RNA, 19 nt, Human
gcugggcuucaguggcagc

SEQ ID NO: 2962419 - RNA, 19 nt, Human
gcugggacuacagguguga

SEQ ID NO: 2962420 - RNA, 13 nt, Human
gcugggacuacag

SEQ ID NO: 2962421 - RNA, 18 nt, Human
gcugggacuacaggcacc

SEQ ID NO: 2962422 - RNA, 19 nt, Human
gcugggacuacaggcaccc

SEQ ID NO: 2962423 - RNA, 20 nt, Human
gcugggacuacaggcaccca

SEQ ID NO: 2962424 - RNA, 20 nt, Human
gcugggacaugggaaagggg

SEQ ID NO: 2962425 - RNA, 16 nt, Human
gcuggaccuugaacug

SEQ ID NO: 2962426 - RNA, 18 nt, Human
gcuggaccuugaacuggg

SEQ ID NO: 2962427 - RNA, 22 nt, Human
gcugcuugggcuucauccuccu

SEQ ID NO: 2962428 - RNA, 17 nt, Human
gcugcuugggcuucauc

SEQ ID NO: 2962429 - RNA, 21 nt, Human
gcuggaccuugaacuggguac

SEQ ID NO: 2962430 - RNA, 22 nt, Human
gcuggaccuugaacuggguacu

SEQ ID NO: 2962431 - RNA, 11 nt, Human
gcugcucccac

SEQ ID NO: 2962432 - RNA, 23 nt, Human
gcugcuucaaggauccugagcca

SEQ ID NO: 2962433 - RNA, 22 nt, Human
gcugcuucaaggauccugagcc

SEQ ID NO: 2962434 - RNA, 21 nt, Human
gcugcuucaaggauccugagc

SEQ ID NO: 2962435 - RNA, 16 nt, Human
gcugcuugggcuucau

SEQ ID NO: 2962436 - RNA, 17 nt, Human
gcugcgguccacccagg

SEQ ID NO: 2962437 - RNA, 18 nt, Human
gcugcgguccacccagga

SEQ ID NO: 2962438 - RNA, 19 nt, Human
gcugcgguccacccaggag

SEQ ID NO: 2962439 - RNA, 10 nt, Human
gcugcuccca

SEQ ID NO: 2962440 - RNA, 13 nt, Human
gcugcuucaagga

SEQ ID NO: 2962441 - RNA, 16 nt, Human
gcugcgguccacccag

SEQ ID NO: 2962442 - RNA, 14 nt, Human
gcugcccugugagu

SEQ ID NO: 2962443 - RNA, 12 nt, Human
gcugcccuguga

SEQ ID NO: 2962444 - RNA, 11 nt, Human
gcugcccugug

SEQ ID NO: 2962445 - RNA, 16 nt, Human
gcuagauguauguacu

SEQ ID NO: 2962446 - RNA, 18 nt, Human
gcuagauguauguacuuc

SEQ ID NO: 2962447 - RNA, 12 nt, Human
ggaaauauuuau

SEQ ID NO: 2962448 - RNA, 13 nt, Human
ggaaauauuuauu

SEQ ID NO: 2962449 - RNA, 15 nt, Human
ggaaauauuuauuuu

SEQ ID NO: 2962450 - RNA, 17 nt, Human
ggaacagacuggaagca

SEQ ID NO: 2962451 - RNA, 17 nt, Human
ggaaauauuuauuuuaa

SEQ ID NO: 2962452 - RNA, 18 nt, Human
ggaaauauuuauuuuaau

SEQ ID NO: 2962453 - RNA, 15 nt, Human
ggaaaaucagccugc

SEQ ID NO: 2962454 - RNA, 10 nt, Human
ggaaaagaau

SEQ ID NO: 2962455 - RNA, 14 nt, Human
ggaaaauaaauuau

SEQ ID NO: 2962456 - RNA, 23 nt, Human
ggaaccgagggggcugcucccac

SEQ ID NO: 2962457 - RNA, 19 nt, Human
ggaacagacuggaagcaca

SEQ ID NO: 2962458 - RNA, 20 nt, Human
ggaacagacuggaagcacag

SEQ ID NO: 2962459 - RNA, 14 nt, Human
ggaagccagcaggc

SEQ ID NO: 2962460 - RNA, 13 nt, Human
ggaagccagcagg

SEQ ID NO: 2962461 - RNA, 18 nt, Human
ggaagccagcaggcucuc

SEQ ID NO: 2962462 - RNA, 17 nt, Human
ggaagccagcaggcucu

SEQ ID NO: 2962463 - RNA, 16 nt, Human
ggaagccagcaggcuc

SEQ ID NO: 2962464 - RNA, 15 nt, Human
ggaagccagcaggcu

SEQ ID NO: 2962465 - RNA, 23 nt, Human
ggaagcacaugccucucucaggc

SEQ ID NO: 2962466 - RNA, 22 nt, Human
ggaagcacaugccucucucagg

SEQ ID NO: 2962467 - RNA, 21 nt, Human
ggaagcacaugccucucucag

SEQ ID NO: 2962468 - RNA, 13 nt, Human
ggaagagccuugc

SEQ ID NO: 2962469 - RNA, 17 nt, Human
ggaagcacagcuucauu

SEQ ID NO: 2962470 - RNA, 17 nt, Human
ggaagcacaugccucuc

SEQ ID NO: 2962471 - RNA, 15 nt, Human
ggaagcacaugccuc

SEQ ID NO: 2962472 - RNA, 14 nt, Human
ggaagcacaugccu

SEQ ID NO: 2962473 - RNA, 13 nt, Human
ggaagcacaugcc

SEQ ID NO: 2962474 - RNA, 22 nt, Human
gcuuuaccaauugaaguaaaau

SEQ ID NO: 2962475 - RNA, 23 nt, Human
gcuuggcccaggaguuuggccag

SEQ ID NO: 2962476 - RNA, 13 nt, Human
gcuuggcccagga

SEQ ID NO: 2962477 - RNA, 22 nt, Human
gcuuggcccaggaguuuggcca

SEQ ID NO: 2962478 - RNA, 16 nt, Human
gcuuggcccaggaguu

SEQ ID NO: 2962479 - RNA, 15 nt, Human
gcuuggcccaggagu

SEQ ID NO: 2962480 - RNA, 14 nt, Human
gcuuggcccaggag

SEQ ID NO: 2962481 - RNA, 13 nt, Human
ggaaaaauagccu

SEQ ID NO: 2962482 - RNA, 14 nt, Human
ggaaaaacugauuu

SEQ ID NO: 2962483 - RNA, 15 nt, Human
ggaaaaauagccugc

SEQ ID NO: 2962484 - RNA, 17 nt, Human
gcuuuuaaaaaaaaaua

SEQ ID NO: 2962485 - RNA, 20 nt, Human
ggaaaaaauaacaaugaaag

SEQ ID NO: 2962486 - RNA, 14 nt, Human
gcuuuuacuuaaac

SEQ ID NO: 2962487 - RNA, 22 nt, Human
gcuugaggguugggcugguguc

SEQ ID NO: 2962488 - RNA, 16 nt, Human
gcuugccaucccuccc

SEQ ID NO: 2962489 - RNA, 18 nt, Human
gcuugccaucccucccuc

SEQ ID NO: 2962490 - RNA, 21 nt, Human
gcuugccaucccucccuccac

SEQ ID NO: 2962491 - RNA, 17 nt, Human
gcuugcccuggugccuc

SEQ ID NO: 2962492 - RNA, 19 nt, Human
gcuugcccuggugccucac

SEQ ID NO: 2962493 - RNA, 15 nt, Human
gcuuggaggaaggaa

SEQ ID NO: 2962494 - RNA, 14 nt, Human
gcuuggaggaagga

SEQ ID NO: 2962495 - RNA, 13 nt, Human
gcuuggaggaagg

SEQ ID NO: 2962496 - RNA, 21 nt, Human
gcuuccagugaggcucugccc

SEQ ID NO: 2962497 - RNA, 20 nt, Human
gcuuccagugaggcucugcc

SEQ ID NO: 2962498 - RNA, 19 nt, Human
gcuuccagugaggcucugc

SEQ ID NO: 2962499 - RNA, 23 nt, Human
gcuguucacagccagacuggcac

SEQ ID NO: 2962500 - RNA, 18 nt, Human
gcuuccagugaggcucug

SEQ ID NO: 2962501 - RNA, 16 nt, Human
gcuguucacagccaga

SEQ ID NO: 2962502 - RNA, 15 nt, Human
gcuguucacagccag

SEQ ID NO: 2962503 - RNA, 13 nt, Human
gggaaugaagaua

SEQ ID NO: 2962504 - RNA, 17 nt, Human
gggaagggggcugggac

SEQ ID NO: 2962505 - RNA, 16 nt, Human
gggaagggggcuggga

SEQ ID NO: 2962506 - RNA, 14 nt, Human
gggaagggggcugg

SEQ ID NO: 2962507 - RNA, 16 nt, Human
gggaaggauacaaaag

SEQ ID NO: 2962508 - RNA, 14 nt, Human
ggcuuuugugcauu

SEQ ID NO: 2962509 - RNA, 21 nt, Human
gggaaggauacaaaagcaugu

SEQ ID NO: 2962510 - RNA, 23 nt, Human
gggaaggauacaaaagcauguga

SEQ ID NO: 2962511 - RNA, 17 nt, Human
gggacuacaggcaccca

SEQ ID NO: 2962512 - RNA, 16 nt, Human
gggacucaaugcacug

SEQ ID NO: 2962513 - RNA, 15 nt, Human
gggaccucaggccug

SEQ ID NO: 2962514 - RNA, 13 nt, Human
gggaccucaggcc

SEQ ID NO: 2962515 - RNA, 12 nt, Human
gggaccucaggc

SEQ ID NO: 2962516 - RNA, 14 nt, Human
gggaauugaggaca

SEQ ID NO: 2962517 - RNA, 17 nt, Human
ggcugggcucccuuccc

SEQ ID NO: 2962518 - RNA, 12 nt, Human
ggcugggcuuca

SEQ ID NO: 2962519 - RNA, 15 nt, Human
ggcuuaaaacaacac

SEQ ID NO: 2962520 - RNA, 13 nt, Human
ggcugggcuucag

SEQ ID NO: 2962521 - RNA, 17 nt, Human
ggcugggcuucaguggc

SEQ ID NO: 2962522 - RNA, 21 nt, Human
ggcuuaauuauugauguuuuc

SEQ ID NO: 2962523 - RNA, 16 nt, Human
ggcuuagacccucaug

SEQ ID NO: 2962524 - RNA, 18 nt, Human
ggcuuagacccucaugcu

SEQ ID NO: 2962525 - RNA, 17 nt, Human
ggcuuagugauguaauu

SEQ ID NO: 2962526 - RNA, 21 nt, Human
ggcuuagucacugagacagcc

SEQ ID NO: 2962527 - RNA, 10 nt, Human
ggcuuuugug

SEQ ID NO: 2962528 - RNA, 22 nt, Human
ggcuugaguuuaaauuguaaua

SEQ ID NO: 2962529 - RNA, 21 nt, Human
ggcuuggggaccagagcugcc

SEQ ID NO: 2962530 - RNA, 19 nt, Human
ggcuuggggaccagagcug

SEQ ID NO: 2962531 - RNA, 22 nt, Human
ggcugcuucaaggauccugagc

SEQ ID NO: 2962532 - RNA, 14 nt, Human
ggcugcuucaagga

SEQ ID NO: 2962533 - RNA, 12 nt, Human
ggcugcuucaag

SEQ ID NO: 2962534 - RNA, 11 nt, Human
ggcugcuucaa

SEQ ID NO: 2962535 - RNA, 12 nt, Human
ggcugcagggag

SEQ ID NO: 2962536 - RNA, 13 nt, Human
ggcugcagggagu

SEQ ID NO: 2962537 - RNA, 14 nt, Human
ggcugcugaaggcu

SEQ ID NO: 2962538 - RNA, 17 nt, Human
ggcugcugaaggcucga

SEQ ID NO: 2962539 - RNA, 15 nt, Human
ggcugcugaaggcuc

SEQ ID NO: 2962540 - RNA, 18 nt, Human
ggcugcugaaggcucgag

SEQ ID NO: 2962541 - RNA, 13 nt, Human
ggcugcugaaggc

SEQ ID NO: 2962542 - RNA, 23 nt, Human
ggcugcuucaaggauccugagcc

SEQ ID NO: 2962543 - RNA, 19 nt, Human
ggcugggagagccuuccag

SEQ ID NO: 2962544 - RNA, 18 nt, Human
ggcugggagagccuucca

SEQ ID NO: 2962545 - RNA, 19 nt, Human
ggcugggcagaggaaagca

SEQ ID NO: 2962546 - RNA, 15 nt, Human
ggcugggcagaggaa

SEQ ID NO: 2962547 - RNA, 23 nt, Human
ggcugggagagccuuccaggggu

SEQ ID NO: 2962548 - RNA, 20 nt, Human
ggcugggagagccuuccagg

SEQ ID NO: 2962549 - RNA, 14 nt, Human
ggcugggcagagga

SEQ ID NO: 2962550 - RNA, 13 nt, Human
ggcugggcagagg

SEQ ID NO: 2962551 - RNA, 15 nt, Human
ggcugaggugggagg

SEQ ID NO: 2962552 - RNA, 13 nt, Human
ggcugagguggga

SEQ ID NO: 2962553 - RNA, 20 nt, Human
ggccccugcccggcugcgga

SEQ ID NO: 2962554 - RNA, 17 nt, Human
ggcucugccucccauca

SEQ ID NO: 2962555 - RNA, 16 nt, Human
ggccccugcccggcug

SEQ ID NO: 2962556 - RNA, 17 nt, Human
ggccccugcccggcugc

SEQ ID NO: 2962557 - RNA, 24 nt, Human
ggcugcaaaggguaucaggugcug

SEQ ID NO: 2962558 - RNA, 17 nt, Human
ggcugcaccggcuggcc

SEQ ID NO: 2962559 - RNA, 19 nt, Human
ggcugcaccggcuggccug

SEQ ID NO: 2962560 - RNA, 18 nt, Human
ggcugcaccggcuggccu

SEQ ID NO: 2962561 - RNA, 18 nt, Human
ggcugcaaaggguaucag

SEQ ID NO: 2962562 - RNA, 22 nt, Human
ggcugcaaaggguaucaggugc

SEQ ID NO: 2962563 - RNA, 23 nt, Human
ggcugcaaaggguaucaggugcu

SEQ ID NO: 2962564 - RNA, 23 nt, Human
gggcagugcuuggcccaggaguu

SEQ ID NO: 2962565 - RNA, 20 nt, Human
gggcagugcucacccacacc

SEQ ID NO: 2962566 - RNA, 22 nt, Human
gggcagugcuuggcccaggagu

SEQ ID NO: 2962567 - RNA, 20 nt, Human
gggcagugcuuggcccagga

SEQ ID NO: 2962568 - RNA, 19 nt, Human
gggcagugcuuggcccagg

SEQ ID NO: 2962569 - RNA, 18 nt, Human
gggcagugcuuggcccag

SEQ ID NO: 2962570 - RNA, 12 nt, Human
gggcaugacacg

SEQ ID NO: 2962571 - RNA, 17 nt, Human
gggcccagagagggugg

SEQ ID NO: 2962572 - RNA, 19 nt, Human
gggccaccgccuugcccag

SEQ ID NO: 2962573 - RNA, 23 nt, Human
gggccacagagaaaguacuucuc

SEQ ID NO: 2962574 - RNA, 16 nt, Human
gggccacagagaaagu

SEQ ID NO: 2962575 - RNA, 12 nt, Human
gggccuggccug

SEQ ID NO: 2962576 - RNA, 13 nt, Human
gggccuggccuga

SEQ ID NO: 2962577 - RNA, 13 nt, Human
gggcccugccucc

SEQ ID NO: 2962578 - RNA, 13 nt, Human
gggccuggcuccc

SEQ ID NO: 2962579 - RNA, 17 nt, Human
gggccuggcucaggugg

SEQ ID NO: 2962580 - RNA, 18 nt, Human
gggccuggccugagcugg

SEQ ID NO: 2962581 - RNA, 14 nt, Human
gggccuggccugag

SEQ ID NO: 2962582 - RNA, 13 nt, Human
gggauagagagag

SEQ ID NO: 2962583 - RNA, 21 nt, Human
gggauaugauuuaaaucagcc

SEQ ID NO: 2962584 - RNA, 18 nt, Human
gggauaucacuuccauga

SEQ ID NO: 2962585 - RNA, 16 nt, Human
gggauccuccaggugc

SEQ ID NO: 2962586 - RNA, 15 nt, Human
gggauccuccaggug

SEQ ID NO: 2962587 - RNA, 23 nt, Human
gggauccuggaguucugguuccu

SEQ ID NO: 2962588 - RNA, 20 nt, Human
gggcaacccccagccugcua

SEQ ID NO: 2962589 - RNA, 18 nt, Human
gggcaacccuggugacca

SEQ ID NO: 2962590 - RNA, 16 nt, Human
gggaggugaccccagg

SEQ ID NO: 2962591 - RNA, 17 nt, Human
gggaggugggauccucc

SEQ ID NO: 2962592 - RNA, 18 nt, Human
gggagugacagaggcagc

SEQ ID NO: 2962593 - RNA, 11 nt, Human
gggagugagcu

SEQ ID NO: 2962594 - RNA, 14 nt, Human
gggagugagcuggu

SEQ ID NO: 2962595 - RNA, 21 nt, Human
gggcacagaaaauggaagaca

SEQ ID NO: 2962596 - RNA, 20 nt, Human
gggcacagaaaauggaagac

SEQ ID NO: 2962597 - RNA, 18 nt, Human
gggcacagaaaauggaag

SEQ ID NO: 2962598 - RNA, 23 nt, Human
gggcacaccgggcacucagaaga

SEQ ID NO: 2962599 - RNA, 16 nt, Human
gggcacaucauuucaa

SEQ ID NO: 2962600 - RNA, 16 nt, Human
gggcacagggucucua

SEQ ID NO: 2962601 - RNA, 13 nt, Human
gggcacagggucu

SEQ ID NO: 2962602 - RNA, 16 nt, Human
gggcacucagaagaca

SEQ ID NO: 2962603 - RNA, 19 nt, Human
gggcacucagaagacacug

SEQ ID NO: 2962604 - RNA, 17 nt, Human
gggcagguugguggggg

SEQ ID NO: 2962605 - RNA, 11 nt, Human
gggcagagcag

SEQ ID NO: 2962606 - RNA, 20 nt, Human
gggcacucagaagacacuga

SEQ ID NO: 2962607 - RNA, 14 nt, Human
gggcagaaggaaga

SEQ ID NO: 2962608 - RNA, 18 nt, Human
gggcagaaggaagacuuc

SEQ ID NO: 2962609 - RNA, 23 nt, Human
gguuauaacuuaaugaaaacaau

SEQ ID NO: 2962610 - RNA, 13 nt, Human
gguuauggagagg

SEQ ID NO: 2962611 - RNA, 17 nt, Human
gguuaggcauuguggga

SEQ ID NO: 2962612 - RNA, 21 nt, Human
gguuacccaguuagcucucaa

SEQ ID NO: 2962613 - RNA, 13 nt, Human
gguucaaagauau

SEQ ID NO: 2962614 - RNA, 16 nt, Human
gguuauuuuacuuuuu

SEQ ID NO: 2962615 - RNA, 21 nt, Human
gguucaaagauauuuugcuuu

SEQ ID NO: 2962616 - RNA, 13 nt, Human
gguugagguuuca

SEQ ID NO: 2962617 - RNA, 16 nt, Human
gguggugaccucugcc

SEQ ID NO: 2962618 - RNA, 14 nt, Human
gguggugaccucug

SEQ ID NO: 2962619 - RNA, 15 nt, Human
gguggugaccucugc

SEQ ID NO: 2962620 - RNA, 13 nt, Human
gguguaaacacau

SEQ ID NO: 2962621 - RNA, 14 nt, Human
gguguaaacacauc

SEQ ID NO: 2962622 - RNA, 15 nt, Human
ggugguuuucuguuc

SEQ ID NO: 2962623 - RNA, 18 nt, Human
ggugguuuucuguucuuu

SEQ ID NO: 2962624 - RNA, 17 nt, Human
ggugguuucagaaaugu

SEQ ID NO: 2962625 - RNA, 18 nt, Human
ggugguuucagaaaugug

SEQ ID NO: 2962626 - RNA, 21 nt, Human
ggugguuauggagaggguguc

SEQ ID NO: 2962627 - RNA, 19 nt, Human
ggugucaccugaagacuca

SEQ ID NO: 2962628 - RNA, 19 nt, Human
ggugucaagagggucugag

SEQ ID NO: 2962629 - RNA, 17 nt, Human
ggugucaagagggucug

SEQ ID NO: 2962630 - RNA, 22 nt, Human
ggucucacucugucgcccaguc

SEQ ID NO: 2962631 - RNA, 23 nt, Human
ggucucacucugucgcccagucu

SEQ ID NO: 2962632 - RNA, 14 nt, Human
ggucccaccccaca

SEQ ID NO: 2962633 - RNA, 17 nt, Human
ggucccaccccacacac

SEQ ID NO: 2962634 - RNA, 16 nt, Human
ggugacauauacauac

SEQ ID NO: 2962635 - RNA, 21 nt, Human
ggugacagagugagacucugu

SEQ ID NO: 2962636 - RNA, 14 nt, Human
ggucugacccacug

SEQ ID NO: 2962637 - RNA, 21 nt, Human
ggugaccucugccugaaguca

SEQ ID NO: 2962638 - RNA, 22 nt, Human
ggugaccagcaccaucucuccu

SEQ ID NO: 2962639 - RNA, 18 nt, Human
ggugcugaguguacagag

SEQ ID NO: 2962640 - RNA, 15 nt, Human
ggugcugccauccag

SEQ ID NO: 2962641 - RNA, 19 nt, Human
gguggcagugggagcugcc

SEQ ID NO: 2962642 - RNA, 22 nt, Human
gguggcagugggagcugccugu

SEQ ID NO: 2962643 - RNA, 16 nt, Human
gguggcagugggagcu

SEQ ID NO: 2962644 - RNA, 22 nt, Human
gguggccucccaacucacccca

SEQ ID NO: 2962645 - RNA, 23 nt, Human
gguggccucccaacucaccccag

SEQ ID NO: 2962646 - RNA, 15 nt, Human
ggugagaagcagagg

SEQ ID NO: 2962647 - RNA, 16 nt, Human
ggugagaggggaacag

SEQ ID NO: 2962648 - RNA, 23 nt, Human
ggugcuacaaaaacacagcaagg

SEQ ID NO: 2962649 - RNA, 21 nt, Human
ggugcuacaaaaacacagcaa

SEQ ID NO: 2962650 - RNA, 20 nt, Human
ggugcuaucucccccagccc

SEQ ID NO: 2962651 - RNA, 19 nt, Human
ggugcuaucucccccagcc

SEQ ID NO: 2962652 - RNA, 17 nt, Human
ggugcuaucucccccag

SEQ ID NO: 2962653 - RNA, 16 nt, Human
ggugcuaucuccccca

SEQ ID NO: 2962654 - RNA, 18 nt, Human
gguagcauuuguguugaa

SEQ ID NO: 2962655 - RNA, 14 nt, Human
gguagcauuuuaaa

SEQ ID NO: 2962656 - RNA, 22 nt, Human
gguagaagcccuucuaccuucc

SEQ ID NO: 2962657 - RNA, 23 nt, Human
gguagaaauaucugaaaauguau

SEQ ID NO: 2962658 - RNA, 16 nt, Human
gguacuuguggacaca

SEQ ID NO: 2962659 - RNA, 17 nt, Human
gguacuuguggacacag

SEQ ID NO: 2962660 - RNA, 22 nt, Human
gguagaaauaucugaaaaugua

SEQ ID NO: 2962661 - RNA, 11 nt, Human
gguacccacug

SEQ ID NO: 2962662 - RNA, 13 nt, Human
gguacccacugcu

SEQ ID NO: 2962663 - RNA, 16 nt, Human
ggucccaccccacaca

SEQ ID NO: 2962664 - RNA, 15 nt, Human
ggucccaccccacac

SEQ ID NO: 2962665 - RNA, 11 nt, Human
ggucagagccu

SEQ ID NO: 2962666 - RNA, 19 nt, Human
gggugacagagcaagugag

SEQ ID NO: 2962667 - RNA, 17 nt, Human
gggugaagugaagacaa

SEQ ID NO: 2962668 - RNA, 12 nt, Human
ggguucuaccca

SEQ ID NO: 2962669 - RNA, 22 nt, Human
ggguucaagcgauucuucugcu

SEQ ID NO: 2962670 - RNA, 23 nt, Human
ggguucaagcgauucuucugcuu

SEQ ID NO: 2962671 - RNA, 12 nt, Human
gggguggccucc

SEQ ID NO: 2962672 - RNA, 17 nt, Human
gggguggggaccucagg

SEQ ID NO: 2962673 - RNA, 23 nt, Human
ggggcugcaccggcuggccuggc

SEQ ID NO: 2962674 - RNA, 22 nt, Human
gggggaggugggauccuccagg

SEQ ID NO: 2962675 - RNA, 22 nt, Human
ggggcugcaccggcuggccugg

SEQ ID NO: 2962676 - RNA, 21 nt, Human
ggggcugcaccggcuggccug

SEQ ID NO: 2962677 - RNA, 12 nt, Human
ggggcugcaccg

SEQ ID NO: 2962678 - RNA, 19 nt, Human
ggggcugaggugggaggau

SEQ ID NO: 2962679 - RNA, 12 nt, Human
gggucugaggaa

SEQ ID NO: 2962680 - RNA, 21 nt, Human
gggucugaggaauccagaccc

SEQ ID NO: 2962681 - RNA, 12 nt, Human
gggucucacucu

SEQ ID NO: 2962682 - RNA, 14 nt, Human
gggucucacucugu

SEQ ID NO: 2962683 - RNA, 17 nt, Human
ggguaagugagagaggg

SEQ ID NO: 2962684 - RNA, 20 nt, Human
ggggcucccagccaggcccu

SEQ ID NO: 2962685 - RNA, 13 nt, Human
ggggcucccagcc

SEQ ID NO: 2962686 - RNA, 16 nt, Human
ggggcucccagccagg

SEQ ID NO: 2962687 - RNA, 12 nt, Human
ggggcucccagc

SEQ ID NO: 2962688 - RNA, 17 nt, Human
ggggcugaggugggagg

SEQ ID NO: 2962689 - RNA, 16 nt, Human
ggggcaacccugguga

SEQ ID NO: 2962690 - RNA, 13 nt, Human
ggggcagugcuca

SEQ ID NO: 2962691 - RNA, 17 nt, Human
ggggcagugcucaccca

SEQ ID NO: 2962692 - RNA, 20 nt, Human
ggggcagugcucacccacac

SEQ ID NO: 2962693 - RNA, 23 nt, Human
ggggcagugcuuggcccaggagu

SEQ ID NO: 2962694 - RNA, 21 nt, Human
ggggcagugcuuggcccagga

SEQ ID NO: 2962695 - RNA, 22 nt, Human
gggcuuggggaccagagcugcc

SEQ ID NO: 2962696 - RNA, 16 nt, Human
ggggaaaaucagccug

SEQ ID NO: 2962697 - RNA, 19 nt, Human
ggggaaaaucagccugcuc

SEQ ID NO: 2962698 - RNA, 17 nt, Human
ggggaaaaucagccugc

SEQ ID NO: 2962699 - RNA, 21 nt, Human
ggggaaaaucagccugcucca

SEQ ID NO: 2962700 - RNA, 19 nt, Human
uaucgucacugcuuaacuu

SEQ ID NO: 2962701 - RNA, 15 nt, Human
uaucuaaauguugaa

SEQ ID NO: 2962702 - RNA, 16 nt, Human
uaucaugacaaagacu

SEQ ID NO: 2962703 - RNA, 17 nt, Human
uaucaggugcugccauc

SEQ ID NO: 2962704 - RNA, 19 nt, Human
uauauuuuuuguuaaauga

SEQ ID NO: 2962705 - RNA, 19 nt, Human
uauauuuuuuaaaauaagu

SEQ ID NO: 2962706 - RNA, 18 nt, Human
uauauuuuuuaaaauaag

SEQ ID NO: 2962707 - RNA, 14 nt, Human
uauauuugaaauau

SEQ ID NO: 2962708 - RNA, 13 nt, Human
uauauuugaaaua

SEQ ID NO: 2962709 - RNA, 15 nt, Human
uauauguagauguau

SEQ ID NO: 2962710 - RNA, 18 nt, Human
uauauguagauguaugca

SEQ ID NO: 2962711 - RNA, 20 nt, Human
uauauguagauguaugcaca

SEQ ID NO: 2962712 - RNA, 20 nt, Human
uauauuuauuacuguaagaa

SEQ ID NO: 2962713 - RNA, 23 nt, Human
uauauuuauuacuguaagaaaau

SEQ ID NO: 2962714 - RNA, 13 nt, Human
uaguuucuccaag

SEQ ID NO: 2962715 - RNA, 23 nt, Human
uaguuugauuaaauucuugcaaa

SEQ ID NO: 2962716 - RNA, 12 nt, Human
uaguuugcaguu

SEQ ID NO: 2962717 - RNA, 21 nt, Human
uaguuguaccgcaaugugacu

SEQ ID NO: 2962718 - RNA, 15 nt, Human
uaguggauguucuga

SEQ ID NO: 2962719 - RNA, 18 nt, Human
uagucaaauugugugaaa

SEQ ID NO: 2962720 - RNA, 14 nt, Human
uagucaaauugugu

SEQ ID NO: 2962721 - RNA, 21 nt, Human
uaguuugauuaaauucuugca

SEQ ID NO: 2962722 - RNA, 20 nt, Human
uauaacaaaggauacuuauu

SEQ ID NO: 2962723 - RNA, 20 nt, Human
uauaaugaaugaaacauuuu

SEQ ID NO: 2962724 - RNA, 18 nt, Human
uauaaugaaugaaacauu

SEQ ID NO: 2962725 - RNA, 22 nt, Human
uauaacaaaggauacuuauuua

SEQ ID NO: 2962726 - RNA, 23 nt, Human
uauaauuccuguuuuuauuauua

SEQ ID NO: 2962727 - RNA, 17 nt, Human
uauaauucuacuuugag

SEQ ID NO: 2962728 - RNA, 14 nt, Human
uauaauguaagcuc

SEQ ID NO: 2962729 - RNA, 19 nt, Human
uauaauguaagcucuacug

SEQ ID NO: 2962730 - RNA, 20 nt, Human
uauaauguaagcucuacuga

SEQ ID NO: 2962731 - RNA, 17 nt, Human
uaggaacacuccuucac

SEQ ID NO: 2962732 - RNA, 21 nt, Human
uaggaacuuaaauaaugugaa

SEQ ID NO: 2962733 - RNA, 14 nt, Human
uaggaacacuccuu

SEQ ID NO: 2962734 - RNA, 13 nt, Human
uaggaacacuccu

SEQ ID NO: 2962735 - RNA, 13 nt, Human
uaggaagacuuug

SEQ ID NO: 2962736 - RNA, 15 nt, Human
uaggaagacuuugga

SEQ ID NO: 2962737 - RNA, 14 nt, Human
uaggaagacuuugg

SEQ ID NO: 2962738 - RNA, 17 nt, Human
uaggaagacuuuggaaa

SEQ ID NO: 2962739 - RNA, 16 nt, Human
uaggaagacuuuggaa

SEQ ID NO: 2962740 - RNA, 13 nt, Human
uaggccuggccag

SEQ ID NO: 2962741 - RNA, 14 nt, Human
uaggccuggccaga

SEQ ID NO: 2962742 - RNA, 13 nt, Human
uaggccaugggac

SEQ ID NO: 2962743 - RNA, 15 nt, Human
uaggaagguuaaugu

SEQ ID NO: 2962744 - RNA, 23 nt, Human
uaggaauugacccacaagaaaug

SEQ ID NO: 2962745 - RNA, 20 nt, Human
uaggaauugacccacaagaa

SEQ ID NO: 2962746 - RNA, 11 nt, Human
uagcugggacu

SEQ ID NO: 2962747 - RNA, 18 nt, Human
uagcugggacuacaggug

SEQ ID NO: 2962748 - RNA, 20 nt, Human
uagcugggacuacaggcacc

SEQ ID NO: 2962749 - RNA, 22 nt, Human
uagcucauucuccuuguguuac

SEQ ID NO: 2962750 - RNA, 17 nt, Human
uagccugccucuucucu

SEQ ID NO: 2962751 - RNA, 21 nt, Human
uagcucuaggagggcuggcaa

SEQ ID NO: 2962752 - RNA, 14 nt, Human
uagcccaaaaccaa

SEQ ID NO: 2962753 - RNA, 14 nt, Human
uagcccugaacauu

SEQ ID NO: 2962754 - RNA, 16 nt, Human
uagccuaggugacaga

SEQ ID NO: 2962755 - RNA, 21 nt, Human
uagaguuuagcccugaacauu

SEQ ID NO: 2962756 - RNA, 17 nt, Human
uagaguuuagcuggaaa

SEQ ID NO: 2962757 - RNA, 18 nt, Human
uagaguuuagcuggaaaa

SEQ ID NO: 2962758 - RNA, 21 nt, Human
uagagguucaaagauauuuug

SEQ ID NO: 2962759 - RNA, 19 nt, Human
uagagguucaaagauauuu

SEQ ID NO: 2962760 - RNA, 16 nt, Human
uagagguucaaagaua

SEQ ID NO: 2962761 - RNA, 16 nt, Human
uagagagagaccacuu

SEQ ID NO: 2962762 - RNA, 11 nt, Human
uagagacaggg

SEQ ID NO: 2962763 - RNA, 16 nt, Human
uagauguaugcacaca

SEQ ID NO: 2962764 - RNA, 16 nt, Human
uagauguauguacuuc

SEQ ID NO: 2962765 - RNA, 22 nt, Human
uagauguaugcacacacauaua

SEQ ID NO: 2962766 - RNA, 19 nt, Human
uagauguaugcacacacau

SEQ ID NO: 2962767 - RNA, 20 nt, Human
uagauguaugcacacacaua

SEQ ID NO: 2962768 - RNA, 20 nt, Human
uagauguauguacuucaugc

SEQ ID NO: 2962769 - RNA, 12 nt, Human
uagauguauaua

SEQ ID NO: 2962770 - RNA, 18 nt, Human
uagauaauacaccacuac

SEQ ID NO: 2962771 - RNA, 13 nt, Human
uagauguugcuaa

SEQ ID NO: 2962772 - RNA, 11 nt, Human
uagauguugcu

SEQ ID NO: 2962773 - RNA, 16 nt, Human
uagcacuuugggaggc

SEQ ID NO: 2962774 - RNA, 19 nt, Human
uagcagagaaugaaagggc

SEQ ID NO: 2962775 - RNA, 23 nt, Human
uagcagagaaugaaagggcccag

SEQ ID NO: 2962776 - RNA, 20 nt, Human
uagcagcccucaauugugaa

SEQ ID NO: 2962777 - RNA, 21 nt, Human
uagcagcccucaauugugaaa

SEQ ID NO: 2962778 - RNA, 20 nt, Human
uagcagggcauggcugggaa

SEQ ID NO: 2962779 - RNA, 23 nt, Human
uagcaguaaaaaaugguguuuua

SEQ ID NO: 2962780 - RNA, 21 nt, Human
uacuguaucaugacaaagacu

SEQ ID NO: 2962781 - RNA, 17 nt, Human
uacugcauaugaaagga

SEQ ID NO: 2962782 - RNA, 14 nt, Human
uacuuguggacaca

SEQ ID NO: 2962783 - RNA, 19 nt, Human
uacuuguggacacagcucu

SEQ ID NO: 2962784 - RNA, 15 nt, Human
uacuuguggacacag

SEQ ID NO: 2962785 - RNA, 18 nt, Human
uacuuguggacacagcuc

SEQ ID NO: 2962786 - RNA, 15 nt, Human
uagaaauauaauuga

SEQ ID NO: 2962787 - RNA, 20 nt, Human
uagaaauaucugaaaaugua

SEQ ID NO: 2962788 - RNA, 21 nt, Human
uagaaauaucugaaaauguau

SEQ ID NO: 2962789 - RNA, 23 nt, Human
uagaaauaucugaaaauguaugu

SEQ ID NO: 2962790 - RNA, 13 nt, Human
uagaaauaacaga

SEQ ID NO: 2962791 - RNA, 16 nt, Human
uagaaauaacagaaga

SEQ ID NO: 2962792 - RNA, 18 nt, Human
uaccuuuuuuauacauaa

SEQ ID NO: 2962793 - RNA, 19 nt, Human
uaccuuuuuuauacauaaa

SEQ ID NO: 2962794 - RNA, 20 nt, Human
uaccuuuuuuauacauaaac

SEQ ID NO: 2962795 - RNA, 20 nt, Human
uaccuuuguauucucuccug

SEQ ID NO: 2962796 - RNA, 15 nt, Human
uacccaucuuaaaaa

SEQ ID NO: 2962797 - RNA, 22 nt, Human
uacccaucccauaugccugggc

SEQ ID NO: 2962798 - RNA, 19 nt, Human
uacccaucuuaaaaacaac

SEQ ID NO: 2962799 - RNA, 18 nt, Human
uacccaucuuaaaaacaa

SEQ ID NO: 2962800 - RNA, 19 nt, Human
uaccccaagacucccauga

SEQ ID NO: 2962801 - RNA, 22 nt, Human
uaccuuuuuuauacauaaacaa

SEQ ID NO: 2962802 - RNA, 19 nt, Human
uacuaaccagcagaaaugc

SEQ ID NO: 2962803 - RNA, 18 nt, Human
uacuaaccagcagaaaug

SEQ ID NO: 2962804 - RNA, 17 nt, Human
uacuaaccagcagaaau

SEQ ID NO: 2962805 - RNA, 17 nt, Human
uacuacaguccucccau

SEQ ID NO: 2962806 - RNA, 12 nt, Human
uacuacaguccu

SEQ ID NO: 2962807 - RNA, 15 nt, Human
uacuaauagacaauu

SEQ ID NO: 2962808 - RNA, 17 nt, Human
uacuaauagacaauuua

SEQ ID NO: 2962809 - RNA, 22 nt, Human
uacuaauaaaauuuaaaagucu

SEQ ID NO: 2962810 - RNA, 16 nt, Human
uacucagaauucucua

SEQ ID NO: 2962811 - RNA, 22 nt, Human
uacucagaauucucuaguuuga

SEQ ID NO: 2962812 - RNA, 20 nt, Human
uacuacaguuuguuaguaug

SEQ ID NO: 2962813 - RNA, 20 nt, Human
uacuacaguccucccaucuc

SEQ ID NO: 2962814 - RNA, 12 nt, Human
uacucaccucac

SEQ ID NO: 2962815 - RNA, 14 nt, Human
uacucaccucaccc

SEQ ID NO: 2962816 - RNA, 17 nt, Human
uacucccaucugugaaa

SEQ ID NO: 2962817 - RNA, 16 nt, Human
uacucccaucugugaa

SEQ ID NO: 2962818 - RNA, 14 nt, Human
uacucccaucugug

SEQ ID NO: 2962819 - RNA, 12 nt, Human
uacucccaucug

SEQ ID NO: 2962820 - RNA, 23 nt, Human
uacugauguuccuagugaaagag

SEQ ID NO: 2962821 - RNA, 19 nt, Human
uacugagagugaacaaauu

SEQ ID NO: 2962822 - RNA, 15 nt, Human
uacugaggugcuaug

SEQ ID NO: 2962823 - RNA, 15 nt, Human
uacccaaauuaagag

SEQ ID NO: 2962824 - RNA, 15 nt, Human
uacccacccccaccc

SEQ ID NO: 2962825 - RNA, 12 nt, Human
uacccaccccca

SEQ ID NO: 2962826 - RNA, 23 nt, Human
uacccacccccacccaagggccu

SEQ ID NO: 2962827 - RNA, 19 nt, Human
uacccacccccacccaagg

SEQ ID NO: 2962828 - RNA, 17 nt, Human
uacccacccccacccaa

SEQ ID NO: 2962829 - RNA, 11 nt, Human
uacccacugcu

SEQ ID NO: 2962830 - RNA, 12 nt, Human
uacccacugcuc

SEQ ID NO: 2962831 - RNA, 13 nt, Human
uacccacugcucu

SEQ ID NO: 2962832 - RNA, 14 nt, Human
uacccacugcucug

SEQ ID NO: 2962833 - RNA, 16 nt, Human
uacccagcgagcccug

SEQ ID NO: 2962834 - RNA, 18 nt, Human
uacccagcgagcccuggu

SEQ ID NO: 2962835 - RNA, 22 nt, Human
uacccaggugcuaggaacacuc

SEQ ID NO: 2962836 - RNA, 13 nt, Human
uaccaauauuuaa

SEQ ID NO: 2962837 - RNA, 16 nt, Human
uaccaauauuuaaucu

SEQ ID NO: 2962838 - RNA, 21 nt, Human
uaccaauauuuaaucuuuuau

SEQ ID NO: 2962839 - RNA, 23 nt, Human
uaccaauauuuaaucuuuuauga

SEQ ID NO: 2962840 - RNA, 13 nt, Human
uaccacagacaua

SEQ ID NO: 2962841 - RNA, 23 nt, Human
uaccauuuugggguacccacugc

SEQ ID NO: 2962842 - RNA, 23 nt, Human
uaccacaggaaccacaagacugc

SEQ ID NO: 2962843 - RNA, 22 nt, Human
uacauaagauaaaugugcugaa

SEQ ID NO: 2962844 - RNA, 18 nt, Human
uacauaagauaaaugugc

SEQ ID NO: 2962845 - RNA, 19 nt, Human
uacauaagauaaaugugcu

SEQ ID NO: 2962846 - RNA, 23 nt, Human
uacaguuacucagaauucucuag

SEQ ID NO: 2962847 - RNA, 19 nt, Human
uacaguuacucagaauucu

SEQ ID NO: 2962848 - RNA, 13 nt, Human
uacauuuuacaca

SEQ ID NO: 2962849 - RNA, 15 nt, Human
uacauuuuacacacu

SEQ ID NO: 2962850 - RNA, 18 nt, Human
uacauuuuacacacugua

SEQ ID NO: 2962851 - RNA, 22 nt, Human
uacauuuuacacacuguacaca

SEQ ID NO: 2962852 - RNA, 16 nt, Human
uaccaacacgagcagg

SEQ ID NO: 2962853 - RNA, 21 nt, Human
uacauuugcuccauccuccug

SEQ ID NO: 2962854 - RNA, 16 nt, Human
uacauuuguauaaaau

SEQ ID NO: 2962855 - RNA, 17 nt, Human
uacauuuguauaaaaua

SEQ ID NO: 2962856 - RNA, 11 nt, Human
uacauuugugu

SEQ ID NO: 2962857 - RNA, 21 nt, Human
uacaugagguacugagaguga

SEQ ID NO: 2962858 - RNA, 22 nt, Human
uacaugagguacugagagugaa

SEQ ID NO: 2962859 - RNA, 17 nt, Human
uacacacuguacacaua

SEQ ID NO: 2962860 - RNA, 18 nt, Human
uacacacuguacacauaa

SEQ ID NO: 2962861 - RNA, 22 nt, Human
uacacacugcauguuugugauu

SEQ ID NO: 2962862 - RNA, 16 nt, Human
uacacugugcugaguc

SEQ ID NO: 2962863 - RNA, 14 nt, Human
uacacuguuucaaa

SEQ ID NO: 2962864 - RNA, 17 nt, Human
uacacacugcauguuug

SEQ ID NO: 2962865 - RNA, 21 nt, Human
uacacacacacgcgugcacac

SEQ ID NO: 2962866 - RNA, 15 nt, Human
uacacacacauacac

SEQ ID NO: 2962867 - RNA, 17 nt, Human
uacacaaugguuuucuu

SEQ ID NO: 2962868 - RNA, 23 nt, Human
uacacaaugguuuucuugugugu

SEQ ID NO: 2962869 - RNA, 21 nt, Human
uacacaaugguuuucuugugu

SEQ ID NO: 2962870 - RNA, 13 nt, Human
uacacuuuaugca

SEQ ID NO: 2962871 - RNA, 18 nt, Human
uacagaaaaguugaauuu

SEQ ID NO: 2962872 - RNA, 22 nt, Human
uacagaaaaguugaauuuuaca

SEQ ID NO: 2962873 - RNA, 13 nt, Human
uacacuugugaau

SEQ ID NO: 2962874 - RNA, 19 nt, Human
uacacuguuucaaacuuua

SEQ ID NO: 2962875 - RNA, 17 nt, Human
uacacuguuucaaacuu

SEQ ID NO: 2962876 - RNA, 18 nt, Human
uacacuguuucaaacuuu

SEQ ID NO: 2962877 - RNA, 24 nt, Human
uacagcaaggagauuuacaacugg

SEQ ID NO: 2962878 - RNA, 23 nt, Human
uacagcuugaccgugaggccaga

SEQ ID NO: 2962879 - RNA, 17 nt, Human
uacaggaaaagcugcug

SEQ ID NO: 2962880 - RNA, 18 nt, Human
uacaggaaaagcugcuga

SEQ ID NO: 2962881 - RNA, 21 nt, Human
uacagcuugaccgugaggcca

SEQ ID NO: 2962882 - RNA, 22 nt, Human
uacagcuugaccgugaggccag

SEQ ID NO: 2962883 - RNA, 19 nt, Human
uacaggaaaagcugcugac

SEQ ID NO: 2962884 - RNA, 16 nt, Human
uacaggcacccaccau

SEQ ID NO: 2962885 - RNA, 14 nt, Human
uacaggauuugaaa

SEQ ID NO: 2962886 - RNA, 19 nt, Human
uaauaaaugaaugucacuu

SEQ ID NO: 2962887 - RNA, 20 nt, Human
uaagugguacuaacuuuccu

SEQ ID NO: 2962888 - RNA, 21 nt, Human
uaauaguucagguaacaggca

SEQ ID NO: 2962889 - RNA, 15 nt, Human
uaauaauguuucaaa

SEQ ID NO: 2962890 - RNA, 14 nt, Human
uaauaauguuucaa

SEQ ID NO: 2962891 - RNA, 23 nt, Human
uaaucucugauucccugauuuaa

SEQ ID NO: 2962892 - RNA, 11 nt, Human
uaaucuaaaug

SEQ ID NO: 2962893 - RNA, 23 nt, Human
uaaugauaacuggaaacuucagc

SEQ ID NO: 2962894 - RNA, 19 nt, Human
uaaugccacuaaauugaca

SEQ ID NO: 2962895 - RNA, 22 nt, Human
uaauuggaaaggcagcucuaaa

SEQ ID NO: 2962896 - RNA, 17 nt, Human
uaauugggcacuauuua

SEQ ID NO: 2962897 - RNA, 20 nt, Human
uaauugggcacuauuuauuu

SEQ ID NO: 2962898 - RNA, 19 nt, Human
uaauuugugauacaaugcu

SEQ ID NO: 2962899 - RNA, 22 nt, Human
uaauuugugauacaaugcugug

SEQ ID NO: 2962900 - RNA, 15 nt, Human
uaauuugguuuucac

SEQ ID NO: 2962901 - RNA, 17 nt, Human
uaauuugguuuucacau

SEQ ID NO: 2962902 - RNA, 18 nt, Human
uaauuugguuuucacauu

SEQ ID NO: 2962903 - RNA, 20 nt, Human
uaauuuguaguguuggagaa

SEQ ID NO: 2962904 - RNA, 23 nt, Human
uaauuuguaguguuggagaagaa

SEQ ID NO: 2962905 - RNA, 14 nt, Human
uaauuugugauaca

SEQ ID NO: 2962906 - RNA, 15 nt, Human
uaauuugugauacaa

SEQ ID NO: 2962907 - RNA, 18 nt, Human
uaauuugugauacaaugc

SEQ ID NO: 2962908 - RNA, 18 nt, Human
uaauucuuagcucauucu

SEQ ID NO: 2962909 - RNA, 22 nt, Human
uaauugacaggauuauuggaaa

SEQ ID NO: 2962910 - RNA, 20 nt, Human
uaauugacaggauuauugga

SEQ ID NO: 2962911 - RNA, 14 nt, Human
uaaugcgugcauac

SEQ ID NO: 2962912 - RNA, 14 nt, Human
uaauguuucaaaca

SEQ ID NO: 2962913 - RNA, 15 nt, Human
uaauguuucaaacau

SEQ ID NO: 2962914 - RNA, 20 nt, Human
uaauuaaaagaauauuuuaa

SEQ ID NO: 2962915 - RNA, 17 nt, Human
uaauuaaaacacaacau

SEQ ID NO: 2962916 - RNA, 20 nt, Human
uaacuuuuauaaacuuuacc

SEQ ID NO: 2962917 - RNA, 16 nt, Human
uaaccagcagaaaugc

SEQ ID NO: 2962918 - RNA, 19 nt, Human
uaaccagcagaaaugccuu

SEQ ID NO: 2962919 - RNA, 14 nt, Human
uaaccagcagaaau

SEQ ID NO: 2962920 - RNA, 14 nt, Human
uaacaggcuuagug

SEQ ID NO: 2962921 - RNA, 19 nt, Human
uaacaggcagauacaggaa

SEQ ID NO: 2962922 - RNA, 21 nt, Human
uaacaggcuuagugauguaau

SEQ ID NO: 2962923 - RNA, 12 nt, Human
uaacagaaaugu

SEQ ID NO: 2962924 - RNA, 14 nt, Human
uaacagaaauguac

SEQ ID NO: 2962925 - RNA, 15 nt, Human
uaacagaaauguaca

SEQ ID NO: 2962926 - RNA, 13 nt, Human
uaacagaaaugua

SEQ ID NO: 2962927 - RNA, 16 nt, Human
uaacaggacgagauga

SEQ ID NO: 2962928 - RNA, 14 nt, Human
uaacagaagaaaau

SEQ ID NO: 2962929 - RNA, 15 nt, Human
uaacagaagaaaaua

SEQ ID NO: 2962930 - RNA, 19 nt, Human
uaacagaagaaaauagaau

SEQ ID NO: 2962931 - RNA, 18 nt, Human
uaacagcaacacaaagcu

SEQ ID NO: 2962932 - RNA, 20 nt, Human
uaacagcaacacaaagcuuu

SEQ ID NO: 2962933 - RNA, 23 nt, Human
uaaauugacacuuaaaaaugguu

SEQ ID NO: 2962934 - RNA, 14 nt, Human
uaaauuuaguauuu

SEQ ID NO: 2962935 - RNA, 19 nt, Human
uaacaaugcuguauuuuaa

SEQ ID NO: 2962936 - RNA, 20 nt, Human
uaagccagacaucaacagau

SEQ ID NO: 2962937 - RNA, 21 nt, Human
uaagccagacaucaacagaua

SEQ ID NO: 2962938 - RNA, 19 nt, Human
uaaggaugcuuguacauaa

SEQ ID NO: 2962939 - RNA, 18 nt, Human
uaaggaugcuuguacaua

SEQ ID NO: 2962940 - RNA, 20 nt, Human
uaaggaugcuuguacauaau

SEQ ID NO: 2962941 - RNA, 21 nt, Human
uaaggaugcuuguacauaaug

SEQ ID NO: 2962942 - RNA, 22 nt, Human
uaaggaugcuuguacauaaugc

SEQ ID NO: 2962943 - RNA, 23 nt, Human
uaaggaugcuuguacauaaugcg

SEQ ID NO: 2962944 - RNA, 20 nt, Human
uaagcauuccaacuaucuca

SEQ ID NO: 2962945 - RNA, 16 nt, Human
uaagcauuccaacuau

SEQ ID NO: 2962946 - RNA, 18 nt, Human
uaagcauuccaacuaucu

SEQ ID NO: 2962947 - RNA, 18 nt, Human
uaagccaaaacugagcau

SEQ ID NO: 2962948 - RNA, 15 nt, Human
uaagccaaaacugag

SEQ ID NO: 2962949 - RNA, 13 nt, Human
uaagccagacauc

SEQ ID NO: 2962950 - RNA, 22 nt, Human
uaagaaccuuuugagugccuua

SEQ ID NO: 2962951 - RNA, 21 nt, Human
uaacuuuuauaaacuuuaccu

SEQ ID NO: 2962952 - RNA, 22 nt, Human
uaacuuuuauaaacuuuaccuu

SEQ ID NO: 2962953 - RNA, 19 nt, Human
uaacuuuuauaaacuuuac

SEQ ID NO: 2962954 - RNA, 24 nt, Human
uaagaaagacuaucuaaauguuga

SEQ ID NO: 2962955 - RNA, 22 nt, Human
uaagaggcagggucucacucug

SEQ ID NO: 2962956 - RNA, 16 nt, Human
uaagaacuaaaauguu

SEQ ID NO: 2962957 - RNA, 17 nt, Human
uaagagagucuauuuac

SEQ ID NO: 2962958 - RNA, 23 nt, Human
uaagagagaaugagagacacacu

SEQ ID NO: 2962959 - RNA, 16 nt, Human
uaagauaaaugugcug

SEQ ID NO: 2962960 - RNA, 17 nt, Human
uaagauaaaugugcuga

SEQ ID NO: 2962961 - RNA, 19 nt, Human
uaagagguaagacuuagua

SEQ ID NO: 2962962 - RNA, 14 nt, Human
uaagauaaaugugc

SEQ ID NO: 2962963 - RNA, 23 nt, Human
uaagagggauuagggagagaaga

SEQ ID NO: 2962964 - RNA, 23 nt, Human
uaagagggagggagggcuccaga

SEQ ID NO: 2962965 - RNA, 22 nt, Human
uaagagggagggagggcuccag

SEQ ID NO: 2962966 - RNA, 12 nt, Human
uaagagggaggg

SEQ ID NO: 2962967 - RNA, 20 nt, Human
guuucuaaagcugccagccg

SEQ ID NO: 2962968 - RNA, 16 nt, Human
guuucuaaagcugcca

SEQ ID NO: 2962969 - RNA, 15 nt, Human
guuucuaaagcugcc

SEQ ID NO: 2962970 - RNA, 14 nt, Human
guuucuaaagcugc

SEQ ID NO: 2962971 - RNA, 18 nt, Human
guuugagaucagccuggg

SEQ ID NO: 2962972 - RNA, 16 nt, Human
guuugaaccaagaacu

SEQ ID NO: 2962973 - RNA, 22 nt, Human
guuugauuaaauucuugcaaag

SEQ ID NO: 2962974 - RNA, 17 nt, Human
guuugauuaaauucuug

SEQ ID NO: 2962975 - RNA, 19 nt, Human
guuugauuaaauucuugca

SEQ ID NO: 2962976 - RNA, 17 nt, Human
guuuguaaauuaacuuu

SEQ ID NO: 2962977 - RNA, 19 nt, Human
guuuguaaauuaacuuuua

SEQ ID NO: 2962978 - RNA, 20 nt, Human
guuuccuggcacugcuucca

SEQ ID NO: 2962979 - RNA, 16 nt, Human
guuuccuggcacugcu

SEQ ID NO: 2962980 - RNA, 22 nt, Human
guuuccuggcacugcuuccagu

SEQ ID NO: 2962981 - RNA, 21 nt, Human
guuuccuggcacugcuuccag

SEQ ID NO: 2962982 - RNA, 14 nt, Human
guuucagaaaugug

SEQ ID NO: 2962983 - RNA, 18 nt, Human
guuucagaaauguguuau

SEQ ID NO: 2962984 - RNA, 18 nt, Human
gguuggcaaaaaggcagg

SEQ ID NO: 2962985 - RNA, 21 nt, Human
gguuggccccugcccggcugc

SEQ ID NO: 2962986 - RNA, 13 nt, Human
guuuagaaagcuu

SEQ ID NO: 2962987 - RNA, 18 nt, Human
guuuagaugaaugucagu

SEQ ID NO: 2962988 - RNA, 17 nt, Human
guuuagaugaaugucag

SEQ ID NO: 2962989 - RNA, 20 nt, Human
guuuaggauguugaaaaagu

SEQ ID NO: 2962990 - RNA, 23 nt, Human
uaaaaaacugcugacuguuuucu

SEQ ID NO: 2962991 - RNA, 20 nt, Human
uaaaaaacugcugacuguuu

SEQ ID NO: 2962992 - RNA, 16 nt, Human
uaaaaaagaaacauuu

SEQ ID NO: 2962993 - RNA, 20 nt, Human
uaaaaaugcaaaaaaaauua

SEQ ID NO: 2962994 - RNA, 18 nt, Human
guuuuuauuauuaacaaa

SEQ ID NO: 2962995 - RNA, 15 nt, Human
guuuuuauuauuaac

SEQ ID NO: 2962996 - RNA, 14 nt, Human
guuuuuauuaaaag

SEQ ID NO: 2962997 - RNA, 17 nt, Human
guuuuuauuaaaaggaa

SEQ ID NO: 2962998 - RNA, 13 nt, Human
guuuuuauuaaaa

SEQ ID NO: 2962999 - RNA, 17 nt, Human
guuuucaguguacaugg

SEQ ID NO: 2963000 - RNA, 18 nt, Human
guuuucaggcuagaugua

SEQ ID NO: 2963001 - RNA, 16 nt, Human
guuuucaguguacaug

SEQ ID NO: 2963002 - RNA, 13 nt, Human
guuuguucccugu

SEQ ID NO: 2963003 - RNA, 16 nt, Human
guuuucauuaucucaa

SEQ ID NO: 2963004 - RNA, 17 nt, Human
guuuuguguacuuuuaa

SEQ ID NO: 2963005 - RNA, 15 nt, Human
guuuuguguacuuuu

SEQ ID NO: 2963006 - RNA, 16 nt, Human
guuuuguguacuuuua

SEQ ID NO: 2963007 - RNA, 19 nt, Human
guuuucucuugagagggug

SEQ ID NO: 2963008 - RNA, 12 nt, Human
guuuucucuuga

SEQ ID NO: 2963009 - RNA, 19 nt, Human
guuuuuauggcuuuugugc

SEQ ID NO: 2963010 - RNA, 22 nt, Human
guuuuuauggcuuuugugcauu

SEQ ID NO: 2963011 - RNA, 23 nt, Human
guuuuuauggcuuuugugcauua

SEQ ID NO: 2963012 - RNA, 14 nt, Human
uaaaggaauuuaaa

SEQ ID NO: 2963013 - RNA, 21 nt, Human
uaaaguguauuuuuuuacuaa

SEQ ID NO: 2963014 - RNA, 22 nt, Human
uaaaguguauuuuuuuacuaau

SEQ ID NO: 2963015 - RNA, 23 nt, Human
uaaaguguauuuuuuuacuaaua

SEQ ID NO: 2963016 - RNA, 20 nt, Human
uaaaguguauuuuuuuacua

SEQ ID NO: 2963017 - RNA, 13 nt, Human
uaaaguuucuguu

SEQ ID NO: 2963018 - RNA, 17 nt, Human
uaaauaaaaauaauccu

SEQ ID NO: 2963019 - RNA, 19 nt, Human
uaaauauuuugacuuguug

SEQ ID NO: 2963020 - RNA, 19 nt, Human
uaaaucagccguguaacca

SEQ ID NO: 2963021 - RNA, 15 nt, Human
uaaauauuuugacuu

SEQ ID NO: 2963022 - RNA, 18 nt, Human
uaaauauuuugacuuguu

SEQ ID NO: 2963023 - RNA, 23 nt, Human
uaaauauugguugggaugacuug

SEQ ID NO: 2963024 - RNA, 22 nt, Human
uaaauauugguugggaugacuu

SEQ ID NO: 2963025 - RNA, 17 nt, Human
uaaauauguuucacaca

SEQ ID NO: 2963026 - RNA, 22 nt, Human
uaaauaucccuuggacauuuua

SEQ ID NO: 2963027 - RNA, 18 nt, Human
uaaauauaugcuaagucu

SEQ ID NO: 2963028 - RNA, 20 nt, Human
uaaacauauccaaguuugaa

SEQ ID NO: 2963029 - RNA, 19 nt, Human
uaaacauauccaaguuuga

SEQ ID NO: 2963030 - RNA, 16 nt, Human
uaaacuuuaccuuuuu

SEQ ID NO: 2963031 - RNA, 22 nt, Human
uaaacuuuaccuuuuuuauaca

SEQ ID NO: 2963032 - RNA, 14 nt, Human
uaaacuuaaucuaa

SEQ ID NO: 2963033 - RNA, 13 nt, Human
uaaacuuaaucua

SEQ ID NO: 2963034 - RNA, 18 nt, Human
uaaacuuaaucuaaaugg

SEQ ID NO: 2963035 - RNA, 19 nt, Human
uaaacuuaaucuaaaugga

SEQ ID NO: 2963036 - RNA, 12 nt, Human
uaaacacauuaa

SEQ ID NO: 2963037 - RNA, 23 nt, Human
uaaacaagaccacguuucuaaag

SEQ ID NO: 2963038 - RNA, 18 nt, Human
uaaacaagaccacguuuc

SEQ ID NO: 2963039 - RNA, 17 nt, Human
uaaaauggguuuuacug

SEQ ID NO: 2963040 - RNA, 19 nt, Human
uaaaauccauacauuugug

SEQ ID NO: 2963041 - RNA, 18 nt, Human
uaaaauccauacauuugu

SEQ ID NO: 2963042 - RNA, 14 nt, Human
uaaaagcauuuuuu

SEQ ID NO: 2963043 - RNA, 14 nt, Human
uaaaagaugaaaau

SEQ ID NO: 2963044 - RNA, 22 nt, Human
uauuuuagguguaaaauaauua

SEQ ID NO: 2963045 - RNA, 15 nt, Human
uauuuuacuuuuugg

SEQ ID NO: 2963046 - RNA, 14 nt, Human
uauuuuacuuuuug

SEQ ID NO: 2963047 - RNA, 13 nt, Human
uauuuuacuuuuu

SEQ ID NO: 2963048 - RNA, 23 nt, Human
uauuucugaggagccugcaacau

SEQ ID NO: 2963049 - RNA, 23 nt, Human
uauuugaguggaguuacugaaca

SEQ ID NO: 2963050 - RNA, 20 nt, Human
uaucugaaaauguaugugua

SEQ ID NO: 2963051 - RNA, 14 nt, Human
uaucugaaaaugua

SEQ ID NO: 2963052 - RNA, 15 nt, Human
uaucugaaaauguau

SEQ ID NO: 2963053 - RNA, 23 nt, Human
uauuuauuaaaugcccagccccu

SEQ ID NO: 2963054 - RNA, 12 nt, Human
uauuuauugaaa

SEQ ID NO: 2963055 - RNA, 20 nt, Human
uauuuauugaaaugauuuca

SEQ ID NO: 2963056 - RNA, 16 nt, Human
uauuuauugaaaugau

SEQ ID NO: 2963057 - RNA, 22 nt, Human
uauuucuaugaaauauuauguu

SEQ ID NO: 2963058 - RNA, 21 nt, Human
uauuucuaugaaauauuaugu

SEQ ID NO: 2963059 - RNA, 13 nt, Human
ucaaaacugcacu

SEQ ID NO: 2963060 - RNA, 22 nt, Human
ucaaaacgguuuuacugcagcu

SEQ ID NO: 2963061 - RNA, 12 nt, Human
ucaaacuaacag

SEQ ID NO: 2963062 - RNA, 13 nt, Human
ucaaacuaacagg

SEQ ID NO: 2963063 - RNA, 14 nt, Human
ucaaacucuuaaaa

SEQ ID NO: 2963064 - RNA, 15 nt, Human
uauuuuuuuacuaau

SEQ ID NO: 2963065 - RNA, 16 nt, Human
uauuuuuuucugaaau

SEQ ID NO: 2963066 - RNA, 17 nt, Human
uauuuuuuucugaaauu

SEQ ID NO: 2963067 - RNA, 20 nt, Human
uauuuuuuacauuuuacaca

SEQ ID NO: 2963068 - RNA, 14 nt, Human
uauuuugacuuguu

SEQ ID NO: 2963069 - RNA, 18 nt, Human
uauuuuuguuuuuauuaa

SEQ ID NO: 2963070 - RNA, 20 nt, Human
uauuuuuguuuuuauuaaaa

SEQ ID NO: 2963071 - RNA, 12 nt, Human
uauuuugaaauu

SEQ ID NO: 2963072 - RNA, 19 nt, Human
ucaauuacaggaaguacug

SEQ ID NO: 2963073 - RNA, 21 nt, Human
ucacacaguauuacuucugcu

SEQ ID NO: 2963074 - RNA, 22 nt, Human
ucacacaguauuacuucugcua

SEQ ID NO: 2963075 - RNA, 13 nt, Human
ucacacagugagu

SEQ ID NO: 2963076 - RNA, 21 nt, Human
ucacacaugagcaucaggcca

SEQ ID NO: 2963077 - RNA, 22 nt, Human
ucacacagugagucgaggacag

SEQ ID NO: 2963078 - RNA, 23 nt, Human
ucacacagugagucgaggacagg

SEQ ID NO: 2963079 - RNA, 11 nt, Human
ucacaggcagg

SEQ ID NO: 2963080 - RNA, 23 nt, Human
ucacaggacagcccuucuuucca

SEQ ID NO: 2963081 - RNA, 14 nt, Human
ucacaggaaguaga

SEQ ID NO: 2963082 - RNA, 19 nt, Human
ucacaggaaguagaggagg

SEQ ID NO: 2963083 - RNA, 13 nt, Human
ucaauaggaaaaa

SEQ ID NO: 2963084 - RNA, 14 nt, Human
ucaaugcacugaca

SEQ ID NO: 2963085 - RNA, 14 nt, Human
ucaauaggaaaaac

SEQ ID NO: 2963086 - RNA, 18 nt, Human
ucaaugcacugacauugu

SEQ ID NO: 2963087 - RNA, 22 nt, Human
ucaaugccccugaauuuaaaua

SEQ ID NO: 2963088 - RNA, 18 nt, Human
ucaauuacaggaaguacu

SEQ ID NO: 2963089 - RNA, 13 nt, Human
ucaauuacaggaa

SEQ ID NO: 2963090 - RNA, 15 nt, Human
ucaagcauguauuuu

SEQ ID NO: 2963091 - RNA, 16 nt, Human
ucaagcgauucuucug

SEQ ID NO: 2963092 - RNA, 22 nt, Human
ucaagugauucuccugccucag

SEQ ID NO: 2963093 - RNA, 20 nt, Human
ucaaggauccugagccagau

SEQ ID NO: 2963094 - RNA, 19 nt, Human
ucaaggauccugagccaga

SEQ ID NO: 2963095 - RNA, 18 nt, Human
ucaaggauccugagccag

SEQ ID NO: 2963096 - RNA, 18 nt, Human
ucaagcugaccuugcuga

SEQ ID NO: 2963097 - RNA, 22 nt, Human
ucaaacucuugaccucagguga

SEQ ID NO: 2963098 - RNA, 15 nt, Human
ucaaacuuuacuaug

SEQ ID NO: 2963099 - RNA, 13 nt, Human
ucaaacuuuacua

SEQ ID NO: 2963100 - RNA, 16 nt, Human
ucaaacuuuacuaugg

SEQ ID NO: 2963101 - RNA, 13 nt, Human
ucaaccuccuggg

SEQ ID NO: 2963102 - RNA, 14 nt, Human
ucaaccuccugggc

SEQ ID NO: 2963103 - RNA, 19 nt, Human
ucaacuccaaacugacucu

SEQ ID NO: 2963104 - RNA, 19 nt, Human
ucacgccuguaauccuagc

SEQ ID NO: 2963105 - RNA, 20 nt, Human
ucacgccuguaauccuagca

SEQ ID NO: 2963106 - RNA, 16 nt, Human
ucacgccacugcacua

SEQ ID NO: 2963107 - RNA, 13 nt, Human
ucacgccacugca

SEQ ID NO: 2963108 - RNA, 14 nt, Human
ucacgccacugcac

SEQ ID NO: 2963109 - RNA, 22 nt, Human
ucaccuuuguccccaccgcaga

SEQ ID NO: 2963110 - RNA, 18 nt, Human
ucaccuuuguccccaccg

SEQ ID NO: 2963111 - RNA, 17 nt, Human
ucaccuuuguccccacc

SEQ ID NO: 2963112 - RNA, 15 nt, Human
ucaccuuugucccca

SEQ ID NO: 2963113 - RNA, 14 nt, Human
ucaccuuugucccc

SEQ ID NO: 2963114 - RNA, 12 nt, Human
ucaccuuugucc

SEQ ID NO: 2963115 - RNA, 14 nt, Human
ucaccuuucccauc

SEQ ID NO: 2963116 - RNA, 19 nt, Human
ucacaggcagguccagggu

SEQ ID NO: 2963117 - RNA, 12 nt, Human
ucacaggcaggu

SEQ ID NO: 2963118 - RNA, 15 nt, Human
ucacaggcaggucca

SEQ ID NO: 2963119 - RNA, 14 nt, Human
ucacggaagagccu

SEQ ID NO: 2963120 - RNA, 17 nt, Human
ucacggaagagccuugc

SEQ ID NO: 2963121 - RNA, 16 nt, Human
ucacggaagagccuug

SEQ ID NO: 2963122 - RNA, 13 nt, Human
ucacggcucacug

SEQ ID NO: 2963123 - RNA, 15 nt, Human
ucacggcucacugca

SEQ ID NO: 2963124 - RNA, 20 nt, Human
ucacggcucacugcagccuc

SEQ ID NO: 2963125 - RNA, 13 nt, Human
ucacuccuugaaa

SEQ ID NO: 2963126 - RNA, 23 nt, Human
ucacucuccuuggugucgggcau

SEQ ID NO: 2963127 - RNA, 13 nt, Human
ucacucuggcagc

SEQ ID NO: 2963128 - RNA, 12 nt, Human
ucacucuggcag

SEQ ID NO: 2963129 - RNA, 14 nt, Human
ucacucuccuuggu

SEQ ID NO: 2963130 - RNA, 12 nt, Human
ucacucuccuug

SEQ ID NO: 2963131 - RNA, 22 nt, Human
ucacucuggcagcucagagagg

SEQ ID NO: 2963132 - RNA, 20 nt, Human
ucacucuggcagcucagaga

SEQ ID NO: 2963133 - RNA, 19 nt, Human
ucacucuggcagcucagag

SEQ ID NO: 2963134 - RNA, 18 nt, Human
ucacucuggcagcucaga

SEQ ID NO: 2963135 - RNA, 17 nt, Human
ucacucuggcagcucag

SEQ ID NO: 2963136 - RNA, 16 nt, Human
ucacucuggcagcuca

SEQ ID NO: 2963137 - RNA, 15 nt, Human
ucacucuggcagcuc

SEQ ID NO: 2963138 - RNA, 14 nt, Human
ucacucuggcagcu

SEQ ID NO: 2963139 - RNA, 19 nt, Human
ucacucugucgcccagucu

SEQ ID NO: 2963140 - RNA, 12 nt, Human
ucacucugucgc

SEQ ID NO: 2963141 - RNA, 16 nt, Human
ucacucugucgcccag

SEQ ID NO: 2963142 - RNA, 15 nt, Human
ucacugcuuaacuuc

SEQ ID NO: 2963143 - RNA, 17 nt, Human
ucacugcuuaacuucac

SEQ ID NO: 2963144 - RNA, 18 nt, Human
ucacugcuuaacuucaca

SEQ ID NO: 2963145 - RNA, 20 nt, Human
ucacugcuuaacuucacaua

SEQ ID NO: 2963146 - RNA, 17 nt, Human
ucacuugucaauaaaau

SEQ ID NO: 2963147 - RNA, 18 nt, Human
ucagcacgauuucuguuu

SEQ ID NO: 2963148 - RNA, 19 nt, Human
ucagcacgauuucuguuua

SEQ ID NO: 2963149 - RNA, 19 nt, Human
ucagacauagaauuaacac

SEQ ID NO: 2963150 - RNA, 20 nt, Human
ucagacagcugccugggauc

SEQ ID NO: 2963151 - RNA, 19 nt, Human
ucagacagcugccugggau

SEQ ID NO: 2963152 - RNA, 18 nt, Human
ucagacagcugccuggga

SEQ ID NO: 2963153 - RNA, 17 nt, Human
ucagacagcugccuggg

SEQ ID NO: 2963154 - RNA, 16 nt, Human
ucagacagcugccugg

SEQ ID NO: 2963155 - RNA, 15 nt, Human
ucagacagcugccug

SEQ ID NO: 2963156 - RNA, 22 nt, Human
ucagacauagaauuaacacaug

SEQ ID NO: 2963157 - RNA, 23 nt, Human
ucagagcugcccucuccugggca

SEQ ID NO: 2963158 - RNA, 23 nt, Human
ucagugguuggcaauuguuucaa

SEQ ID NO: 2963159 - RNA, 11 nt, Human
ucaguguacau

SEQ ID NO: 2963160 - RNA, 13 nt, Human
ucagugugacuga

SEQ ID NO: 2963161 - RNA, 17 nt, Human
ucagugugacugaucuc

SEQ ID NO: 2963162 - RNA, 21 nt, Human
ucagucugcuuagaaauaaca

SEQ ID NO: 2963163 - RNA, 19 nt, Human
ucagucugcuuagaaauaa

SEQ ID NO: 2963164 - RNA, 16 nt, Human
ucagucugcuuagaaa

SEQ ID NO: 2963165 - RNA, 15 nt, Human
ucagucuggcccuuc

SEQ ID NO: 2963166 - RNA, 24 nt, Human
ucagucugauucccaagcucugcu

SEQ ID NO: 2963167 - RNA, 16 nt, Human
ucagcagagugcuuua

SEQ ID NO: 2963168 - RNA, 22 nt, Human
ucagcagagugcuuuaccaauu

SEQ ID NO: 2963169 - RNA, 11 nt, Human
ucagcagagug

SEQ ID NO: 2963170 - RNA, 12 nt, Human
ucagcagagugc

SEQ ID NO: 2963171 - RNA, 13 nt, Human
ucaguucugauau

SEQ ID NO: 2963172 - RNA, 13 nt, Human
ucauaaugacuua

SEQ ID NO: 2963173 - RNA, 13 nt, Human
ucauacccacccc

SEQ ID NO: 2963174 - RNA, 22 nt, Human
ucauacaaggcccaggaggcuu

SEQ ID NO: 2963175 - RNA, 15 nt, Human
ucaucuguuacacaa

SEQ ID NO: 2963176 - RNA, 15 nt, Human
ucauacccaccccca

SEQ ID NO: 2963177 - RNA, 14 nt, Human
ucauacccaccccc

SEQ ID NO: 2963178 - RNA, 20 nt, Human
ucauacccacccccacccaa

SEQ ID NO: 2963179 - RNA, 16 nt, Human
ucauuaggugugacug

SEQ ID NO: 2963180 - RNA, 22 nt, Human
ucauuaggugugacugaauuuc

SEQ ID NO: 2963181 - RNA, 18 nt, Human
ucauuaggugugacugaa

SEQ ID NO: 2963182 - RNA, 21 nt, Human
ucauuaggugugacugaauuu

SEQ ID NO: 2963183 - RNA, 13 nt, Human
uccaccugccagg

SEQ ID NO: 2963184 - RNA, 12 nt, Human
uccacuuggucu

SEQ ID NO: 2963185 - RNA, 13 nt, Human
uccacuuggucug

SEQ ID NO: 2963186 - RNA, 14 nt, Human
uccagauccuggaa

SEQ ID NO: 2963187 - RNA, 16 nt, Human
uccagauccuggaaau

SEQ ID NO: 2963188 - RNA, 17 nt, Human
uccagauccuggaaauc

SEQ ID NO: 2963189 - RNA, 14 nt, Human
uccacaagagccca

SEQ ID NO: 2963190 - RNA, 22 nt, Human
uccaagcaggacauggacaagg

SEQ ID NO: 2963191 - RNA, 23 nt, Human
uccaccucccugcaauaaaaugg

SEQ ID NO: 2963192 - RNA, 12 nt, Human
uccaccugccag

SEQ ID NO: 2963193 - RNA, 14 nt, Human
uccaccuacaugag

SEQ ID NO: 2963194 - RNA, 17 nt, Human
uccaaaauaaaacuuuu

SEQ ID NO: 2963195 - RNA, 16 nt, Human
uccaaaauaaaacuuu

SEQ ID NO: 2963196 - RNA, 12 nt, Human
uccaaagaaaug

SEQ ID NO: 2963197 - RNA, 23 nt, Human
uccaaacugacucuuaagaagac

SEQ ID NO: 2963198 - RNA, 22 nt, Human
ucauucagauaugauucaaaug

SEQ ID NO: 2963199 - RNA, 14 nt, Human
ucauuucuuugagu

SEQ ID NO: 2963200 - RNA, 22 nt, Human
ucauuucugcaucagcugcuga

SEQ ID NO: 2963201 - RNA, 16 nt, Human
ucauuucugcaucagc

SEQ ID NO: 2963202 - RNA, 20 nt, Human
uccaagaagcccaggaaagg

SEQ ID NO: 2963203 - RNA, 22 nt, Human
uccaagaagcccaggaaaggcu

SEQ ID NO: 2963204 - RNA, 14 nt, Human
uccaagaauuucua

SEQ ID NO: 2963205 - RNA, 17 nt, Human
uccaagcauuuagaugu

SEQ ID NO: 2963206 - RNA, 23 nt, Human
uccaagcauaccaacacgagcag

SEQ ID NO: 2963207 - RNA, 20 nt, Human
uccccgcacugggcuugggg

SEQ ID NO: 2963208 - RNA, 21 nt, Human
ucccccuuccauggacuuugu

SEQ ID NO: 2963209 - RNA, 17 nt, Human
ucccccuggcacugguu

SEQ ID NO: 2963210 - RNA, 15 nt, Human
uccccuggcacuggc

SEQ ID NO: 2963211 - RNA, 19 nt, Human
uccccuguagagugggagc

SEQ ID NO: 2963212 - RNA, 24 nt, Human
uccccugcuggguguggcgcagca

SEQ ID NO: 2963213 - RNA, 23 nt, Human
uccccuguccccgcacugggcuu

SEQ ID NO: 2963214 - RNA, 22 nt, Human
uccccuguagagugggagcuga

SEQ ID NO: 2963215 - RNA, 21 nt, Human
uccccugcuggguguggcgca

SEQ ID NO: 2963216 - RNA, 20 nt, Human
uccccugcuggguguggcgc

SEQ ID NO: 2963217 - RNA, 15 nt, Human
uccccugcugggugu

SEQ ID NO: 2963218 - RNA, 14 nt, Human
uccccugcugggug

SEQ ID NO: 2963219 - RNA, 15 nt, Human
ucccuacuguaauuu

SEQ ID NO: 2963220 - RNA, 15 nt, Human
ucccucccucuuucc

SEQ ID NO: 2963221 - RNA, 17 nt, Human
ucccucccuccaccucc

SEQ ID NO: 2963222 - RNA, 17 nt, Human
ucccucccucuuucccu

SEQ ID NO: 2963223 - RNA, 13 nt, Human
ucccaccucagcc

SEQ ID NO: 2963224 - RNA, 14 nt, Human
ucccaccucagccu

SEQ ID NO: 2963225 - RNA, 15 nt, Human
ucccaccucagccuc

SEQ ID NO: 2963226 - RNA, 21 nt, Human
ucccaggcauuccccaggagg

SEQ ID NO: 2963227 - RNA, 20 nt, Human
ucccaggcauuccccaggag

SEQ ID NO: 2963228 - RNA, 19 nt, Human
ucccaggcauuccccagga

SEQ ID NO: 2963229 - RNA, 22 nt, Human
ucccaggcauuccccaggaggc

SEQ ID NO: 2963230 - RNA, 23 nt, Human
ucccaucucacacaugagcauca

SEQ ID NO: 2963231 - RNA, 20 nt, Human
ucccaucucacacaugagca

SEQ ID NO: 2963232 - RNA, 15 nt, Human
ucccauucuuggccc

SEQ ID NO: 2963233 - RNA, 16 nt, Human
ucccauucuuggccca

SEQ ID NO: 2963234 - RNA, 22 nt, Human
uccccacuugagaauuacccuu

SEQ ID NO: 2963235 - RNA, 23 nt, Human
uccagcucaccagccccagugcc

SEQ ID NO: 2963236 - RNA, 21 nt, Human
ucccaaagugcugggauuaca

SEQ ID NO: 2963237 - RNA, 15 nt, Human
uccauggacuuuguu

SEQ ID NO: 2963238 - RNA, 14 nt, Human
uccauggacuuugu

SEQ ID NO: 2963239 - RNA, 13 nt, Human
uccauggacuuug

SEQ ID NO: 2963240 - RNA, 17 nt, Human
ucccaagcucugcuccu

SEQ ID NO: 2963241 - RNA, 12 nt, Human
ucccaagcucug

SEQ ID NO: 2963242 - RNA, 13 nt, Human
ucccaagcucugc

SEQ ID NO: 2963243 - RNA, 14 nt, Human
ucccaagcucugcu

SEQ ID NO: 2963244 - RNA, 15 nt, Human
ucccaagcucugcuc

SEQ ID NO: 2963245 - RNA, 16 nt, Human
ucccaacucaccccag

SEQ ID NO: 2963246 - RNA, 15 nt, Human
ucccaacucacccca

SEQ ID NO: 2963247 - RNA, 14 nt, Human
ucccaacucacccc

SEQ ID NO: 2963248 - RNA, 13 nt, Human
ucccaacucaccc

SEQ ID NO: 2963249 - RNA, 16 nt, Human
ucccaaauuucauacc

SEQ ID NO: 2963250 - RNA, 17 nt, Human
ucgaguuacagacaaag

SEQ ID NO: 2963251 - RNA, 15 nt, Human
ucgaguuacagacaa

SEQ ID NO: 2963252 - RNA, 15 nt, Human
uccugguguggaaga

SEQ ID NO: 2963253 - RNA, 17 nt, Human
uccuggcccacugcauc

SEQ ID NO: 2963254 - RNA, 22 nt, Human
uccuggcaugggaaugaauguc

SEQ ID NO: 2963255 - RNA, 10 nt, Human
ucccucccuu

SEQ ID NO: 2963256 - RNA, 23 nt, Human
uccugguccccucagcucugccu

SEQ ID NO: 2963257 - RNA, 12 nt, Human
uccuucuguccu

SEQ ID NO: 2963258 - RNA, 19 nt, Human
uccuucuguccuacucugu

SEQ ID NO: 2963259 - RNA, 15 nt, Human
uccuugcaucaauuu

SEQ ID NO: 2963260 - RNA, 21 nt, Human
ucuacacuaagagagaaugag

SEQ ID NO: 2963261 - RNA, 22 nt, Human
ucuaacuucaccauauuaccac

SEQ ID NO: 2963262 - RNA, 15 nt, Human
ucuaacuucaccaua

SEQ ID NO: 2963263 - RNA, 16 nt, Human
ucuaacuucaccauau

SEQ ID NO: 2963264 - RNA, 16 nt, Human
ucuaaauucuuucauu

SEQ ID NO: 2963265 - RNA, 22 nt, Human
ucuaaaucuccaaaauaaaacu

SEQ ID NO: 2963266 - RNA, 19 nt, Human
ucuagggaaaaaccagcgu

SEQ ID NO: 2963267 - RNA, 22 nt, Human
ucuagggaaaaaccagcgugug

SEQ ID NO: 2963268 - RNA, 22 nt, Human
ucuacugaggugcuauguucuu

SEQ ID NO: 2963269 - RNA, 15 nt, Human
ucuacacugugcuga

SEQ ID NO: 2963270 - RNA, 18 nt, Human
ucuacugaggugcuaugu

SEQ ID NO: 2963271 - RNA, 19 nt, Human
ucuacugaggugcuauguu

SEQ ID NO: 2963272 - RNA, 17 nt, Human
ucuacacuaagagagaa

SEQ ID NO: 2963273 - RNA, 17 nt, Human
ucuacacuccagugaga

SEQ ID NO: 2963274 - RNA, 14 nt, Human
ucuacacugugcug

SEQ ID NO: 2963275 - RNA, 12 nt, Human
ucuacacugugc

SEQ ID NO: 2963276 - RNA, 17 nt, Human
ucucacuguugcccagg

SEQ ID NO: 2963277 - RNA, 17 nt, Human
ucucagaaucucaaaua

SEQ ID NO: 2963278 - RNA, 21 nt, Human
ucucagaaucucaaauaacua

SEQ ID NO: 2963279 - RNA, 18 nt, Human
ucucacuguugcccaggc

SEQ ID NO: 2963280 - RNA, 19 nt, Human
ucucacuguugcccaggcu

SEQ ID NO: 2963281 - RNA, 20 nt, Human
ucucacuguugcccaggcug

SEQ ID NO: 2963282 - RNA, 21 nt, Human
ucucacuguugcccaggcugg

SEQ ID NO: 2963283 - RNA, 18 nt, Human
ucucacucugucgcccag

SEQ ID NO: 2963284 - RNA, 22 nt, Human
ucucacucugucgcccagucug

SEQ ID NO: 2963285 - RNA, 16 nt, Human
ucucacucugucgccc

SEQ ID NO: 2963286 - RNA, 17 nt, Human
ucucacucugucgccca

SEQ ID NO: 2963287 - RNA, 22 nt, Human
ucucaaacucuugaccucaggu

SEQ ID NO: 2963288 - RNA, 13 nt, Human
ucucaaacucuug

SEQ ID NO: 2963289 - RNA, 21 nt, Human
ucucaaacucuugaccucagg

SEQ ID NO: 2963290 - RNA, 19 nt, Human
ucuaguaguuguucugaaa

SEQ ID NO: 2963291 - RNA, 15 nt, Human
ucucaaacuaacagg

SEQ ID NO: 2963292 - RNA, 17 nt, Human
ucucaaacuaacaggcu

SEQ ID NO: 2963293 - RNA, 22 nt, Human
ucuccugccucagccucccaaa

SEQ ID NO: 2963294 - RNA, 19 nt, Human
ucuccugccucagccuccc

SEQ ID NO: 2963295 - RNA, 14 nt, Human
ucuccugggcagcu

SEQ ID NO: 2963296 - RNA, 13 nt, Human
ucuccugggcagc

SEQ ID NO: 2963297 - RNA, 15 nt, Human
ucuccugggcagcug

SEQ ID NO: 2963298 - RNA, 16 nt, Human
ucuccugggcagcugc

SEQ ID NO: 2963299 - RNA, 17 nt, Human
ucuccugggcagcugcc

SEQ ID NO: 2963300 - RNA, 18 nt, Human
ucuccugggcagcugccu

SEQ ID NO: 2963301 - RNA, 20 nt, Human
ucucccccagccccauccuc

SEQ ID NO: 2963302 - RNA, 18 nt, Human
ucucccccagccccaucc

SEQ ID NO: 2963303 - RNA, 13 nt, Human
ucucccccagccc

SEQ ID NO: 2963304 - RNA, 22 nt, Human
ucucccccagccccauccucug

SEQ ID NO: 2963305 - RNA, 14 nt, Human
ucucccccagcccc

SEQ ID NO: 2963306 - RNA, 17 nt, Human
ucucccccagccccauc

SEQ ID NO: 2963307 - RNA, 15 nt, Human
ucucccccagcccca

SEQ ID NO: 2963308 - RNA, 21 nt, Human
ucucagugucaaugcagcccc

SEQ ID NO: 2963309 - RNA, 13 nt, Human
ucucugaggacac

SEQ ID NO: 2963310 - RNA, 18 nt, Human
ucucuacccaucuuaaaa

SEQ ID NO: 2963311 - RNA, 19 nt, Human
ucucuacccaucuuaaaaa

SEQ ID NO: 2963312 - RNA, 20 nt, Human
ucucuacccaucuuaaaaac

SEQ ID NO: 2963313 - RNA, 23 nt, Human
ucucuacccaucuuaaaaacaac

SEQ ID NO: 2963314 - RNA, 14 nt, Human
ucucuacuaaaaau

SEQ ID NO: 2963315 - RNA, 13 nt, Human
ucuccuguaccuc

SEQ ID NO: 2963316 - RNA, 15 nt, Human
ucucuacaaaaagca

SEQ ID NO: 2963317 - RNA, 21 nt, Human
ucuccugggcagcugccuccc

SEQ ID NO: 2963318 - RNA, 19 nt, Human
ucuccugggcagcugccuc

SEQ ID NO: 2963319 - RNA, 20 nt, Human
ucuccugggcagcugccucc

SEQ ID NO: 2963320 - RNA, 13 nt, Human
ucucuaggaaaua

SEQ ID NO: 2963321 - RNA, 16 nt, Human
ucucuaguuugauuaa

SEQ ID NO: 2963322 - RNA, 18 nt, Human
ucucuaguuugauuaaau

SEQ ID NO: 2963323 - RNA, 19 nt, Human
ucucuaguuugauuaaauu

SEQ ID NO: 2963324 - RNA, 14 nt, Human
ucugacccaugcug

SEQ ID NO: 2963325 - RNA, 21 nt, Human
ucugaacuuggcgcugccccu

SEQ ID NO: 2963326 - RNA, 20 nt, Human
ucugaacuuggcgcugcccc

SEQ ID NO: 2963327 - RNA, 18 nt, Human
ucugacccaugcugcccu

SEQ ID NO: 2963328 - RNA, 17 nt, Human
ucugacccaugcugccc

SEQ ID NO: 2963329 - RNA, 16 nt, Human
ucugacccaugcugcc

SEQ ID NO: 2963330 - RNA, 15 nt, Human
ucugacccaugcugc

SEQ ID NO: 2963331 - RNA, 19 nt, Human
ucugcacaagcugcacccu

SEQ ID NO: 2963332 - RNA, 14 nt, Human
ucugcacaagcugc

SEQ ID NO: 2963333 - RNA, 23 nt, Human
ucugauucccaagcucugcuccu

SEQ ID NO: 2963334 - RNA, 19 nt, Human
ucugauucccugauuuaau

SEQ ID NO: 2963335 - RNA, 16 nt, Human
ucugaggaauccagac

SEQ ID NO: 2963336 - RNA, 17 nt, Human
ucugaggaauccagacc

SEQ ID NO: 2963337 - RNA, 20 nt, Human
ucugaggacacuaaccacgc

SEQ ID NO: 2963338 - RNA, 23 nt, Human
ucugaggacacuaaccacgcugg

SEQ ID NO: 2963339 - RNA, 16 nt, Human
ucugaaaauguaugug

SEQ ID NO: 2963340 - RNA, 15 nt, Human
ucucuuuucaaaaca

SEQ ID NO: 2963341 - RNA, 16 nt, Human
ucucuuuucaaaacau

SEQ ID NO: 2963342 - RNA, 21 nt, Human
ucugaaaugucaguucugaua

SEQ ID NO: 2963343 - RNA, 14 nt, Human
ucugaaauuuccug

SEQ ID NO: 2963344 - RNA, 14 nt, Human
ucugaaaauguaug

SEQ ID NO: 2963345 - RNA, 23 nt, Human
ucugaaaauguauguguaaguau

SEQ ID NO: 2963346 - RNA, 13 nt, Human
ucugaaagggacg

SEQ ID NO: 2963347 - RNA, 18 nt, Human
ucucuucacagucacauu

SEQ ID NO: 2963348 - RNA, 20 nt, Human
ugaacugaucauguuuauga

SEQ ID NO: 2963349 - RNA, 15 nt, Human
ugaacugauaaagau

SEQ ID NO: 2963350 - RNA, 13 nt, Human
ugaacugauaaag

SEQ ID NO: 2963351 - RNA, 18 nt, Human
ugaacucuucaaucucuu

SEQ ID NO: 2963352 - RNA, 20 nt, Human
ugaaccacaucuugcucugc

SEQ ID NO: 2963353 - RNA, 21 nt, Human
ugaaccacaucuugcucugcu

SEQ ID NO: 2963354 - RNA, 22 nt, Human
ugaaccacaucuugcucugcug

SEQ ID NO: 2963355 - RNA, 15 nt, Human
ugaacucuucaaucu

SEQ ID NO: 2963356 - RNA, 19 nt, Human
ugaaccacaucuugcucug

SEQ ID NO: 2963357 - RNA, 14 nt, Human
ugaacacaucagcu

SEQ ID NO: 2963358 - RNA, 20 nt, Human
ugaaggcucgagcaugccug

SEQ ID NO: 2963359 - RNA, 21 nt, Human
ugaaguccaagcauuuagaug

SEQ ID NO: 2963360 - RNA, 22 nt, Human
ugaaguccaagcauuuagaugu

SEQ ID NO: 2963361 - RNA, 21 nt, Human
ugaaggcucgagcaugccugg

SEQ ID NO: 2963362 - RNA, 14 nt, Human
ugaagacuuuucuu

SEQ ID NO: 2963363 - RNA, 22 nt, Human
ugaagacuuuucuuucagccaa

SEQ ID NO: 2963364 - RNA, 17 nt, Human
ugaagacuuuucuuuca

SEQ ID NO: 2963365 - RNA, 19 nt, Human
ugaacuggguacuugugga

SEQ ID NO: 2963366 - RNA, 12 nt, Human
ugaacuugguuc

SEQ ID NO: 2963367 - RNA, 14 nt, Human
ugaacuuggcgcug

SEQ ID NO: 2963368 - RNA, 22 nt, Human
ugaacuuguaaaggaauuuaaa

SEQ ID NO: 2963369 - RNA, 16 nt, Human
ugaagacagagcuaca

SEQ ID NO: 2963370 - RNA, 14 nt, Human
ugaagacagagcua

SEQ ID NO: 2963371 - RNA, 16 nt, Human
ucuuuuugcuuugcuu

SEQ ID NO: 2963372 - RNA, 14 nt, Human
ucuuuuugaaaugu

SEQ ID NO: 2963373 - RNA, 19 nt, Human
ugaaaacuuuaugcuaagu

SEQ ID NO: 2963374 - RNA, 19 nt, Human
ugaaaagacuccaaagaaa

SEQ ID NO: 2963375 - RNA, 17 nt, Human
ugaaaagacuccaaaga

SEQ ID NO: 2963376 - RNA, 16 nt, Human
ugaaaagacuccaaag

SEQ ID NO: 2963377 - RNA, 15 nt, Human
ugaaaagacuccaaa

SEQ ID NO: 2963378 - RNA, 17 nt, Human
ucuuuugccguuauuaa

SEQ ID NO: 2963379 - RNA, 19 nt, Human
ucuuuugccguuauuaaaa

SEQ ID NO: 2963380 - RNA, 15 nt, Human
ugaaaucuaggaaaa

SEQ ID NO: 2963381 - RNA, 17 nt, Human
ugaaaucuaggaaaauu

SEQ ID NO: 2963382 - RNA, 18 nt, Human
ugaaaucuaggaaaauua

SEQ ID NO: 2963383 - RNA, 19 nt, Human
ugaaaucuaggaaaauuau

SEQ ID NO: 2963384 - RNA, 17 nt, Human
ugaaaucuuuuugcuuu

SEQ ID NO: 2963385 - RNA, 15 nt, Human
ugaaagggcccagag

SEQ ID NO: 2963386 - RNA, 16 nt, Human
ugaaagggcccagaga

SEQ ID NO: 2963387 - RNA, 17 nt, Human
ugaaagggcccagagag

SEQ ID NO: 2963388 - RNA, 19 nt, Human
ugaaaugaggucagagccu

SEQ ID NO: 2963389 - RNA, 20 nt, Human
ugaaaugaggucagagccug

SEQ ID NO: 2963390 - RNA, 23 nt, Human
ugaaaugaggucagagccugcag

SEQ ID NO: 2963391 - RNA, 21 nt, Human
ugaaaugaggucagagccugc

SEQ ID NO: 2963392 - RNA, 22 nt, Human
ugaaaugaggucagagccugca

SEQ ID NO: 2963393 - RNA, 18 nt, Human
ugaaacccugucucuacu

SEQ ID NO: 2963394 - RNA, 22 nt, Human
ugaaaagacuccaaagaaaugu

SEQ ID NO: 2963395 - RNA, 13 nt, Human
ugaaagauucaau

SEQ ID NO: 2963396 - RNA, 12 nt, Human
ugaaaggaaaga

SEQ ID NO: 2963397 - RNA, 17 nt, Human
ugaaaggaaagaggcuc

SEQ ID NO: 2963398 - RNA, 18 nt, Human
ugaaagcagggacuugaa

SEQ ID NO: 2963399 - RNA, 19 nt, Human
ugaaagcagggacuugaac

SEQ ID NO: 2963400 - RNA, 23 nt, Human
ugaaagcagggacuugaacccau

SEQ ID NO: 2963401 - RNA, 14 nt, Human
ucuggcuaugcauu

SEQ ID NO: 2963402 - RNA, 23 nt, Human
ucuggccuucggccuccauccug

SEQ ID NO: 2963403 - RNA, 17 nt, Human
ucuggcucuuccaggcu

SEQ ID NO: 2963404 - RNA, 16 nt, Human
ucuggcucuuccaggc

SEQ ID NO: 2963405 - RNA, 15 nt, Human
ucuggcucuuccagg

SEQ ID NO: 2963406 - RNA, 12 nt, Human
ucugggacacag

SEQ ID NO: 2963407 - RNA, 23 nt, Human
ucuguacagagcccacgccccca

SEQ ID NO: 2963408 - RNA, 24 nt, Human
ucuguaauaaacucauuucuagca

SEQ ID NO: 2963409 - RNA, 23 nt, Human
ucuguaauaaacucauuucuagc

SEQ ID NO: 2963410 - RNA, 19 nt, Human
ucuguaauaaacucauuuc

SEQ ID NO: 2963411 - RNA, 22 nt, Human
ucugugucagguggggcagcuu

SEQ ID NO: 2963412 - RNA, 23 nt, Human
ucuguggguuucuaaagcugcca

SEQ ID NO: 2963413 - RNA, 19 nt, Human
ucuguccgagcuuugaaaa

SEQ ID NO: 2963414 - RNA, 22 nt, Human
ucuguggguuucuaaagcugcc

SEQ ID NO: 2963415 - RNA, 17 nt, Human
ucuguacgucugacagg

SEQ ID NO: 2963416 - RNA, 20 nt, Human
ucuguuacacaaagaaccac

SEQ ID NO: 2963417 - RNA, 20 nt, Human
ucuguuuuauaauuuuguga

SEQ ID NO: 2963418 - RNA, 22 nt, Human
ucuguuuuauaauuuugugaag

SEQ ID NO: 2963419 - RNA, 18 nt, Human
ucuuaaaaaguggaaaaa

SEQ ID NO: 2963420 - RNA, 12 nt, Human
ucuugcucugcu

SEQ ID NO: 2963421 - RNA, 13 nt, Human
ucuugcucugcug

SEQ ID NO: 2963422 - RNA, 11 nt, Human
ucuugcucugc

SEQ ID NO: 2963423 - RNA, 21 nt, Human
ucuugaauuguaaggaaugau

SEQ ID NO: 2963424 - RNA, 15 nt, Human
ucuucuccaggcugu

SEQ ID NO: 2963425 - RNA, 16 nt, Human
ucuugaacuccuggcc

SEQ ID NO: 2963426 - RNA, 17 nt, Human
ucuugaacuccuggccu

SEQ ID NO: 2963427 - RNA, 18 nt, Human
ucuugaacuccuggccuc

SEQ ID NO: 2963428 - RNA, 13 nt, Human
ucuucuccaggcu

SEQ ID NO: 2963429 - RNA, 14 nt, Human
ucuucuccaggcug

SEQ ID NO: 2963430 - RNA, 12 nt, Human
ucuucuccaggc

SEQ ID NO: 2963431 - RNA, 22 nt, Human
ucuucuauuuauuuauuuauuc

SEQ ID NO: 2963432 - RNA, 22 nt, Human
ucuucuauauaauuccuguuuu

SEQ ID NO: 2963433 - RNA, 12 nt, Human
ucuucuauuuau

SEQ ID NO: 2963434 - RNA, 13 nt, Human
ucuucuauauaau

SEQ ID NO: 2963435 - RNA, 21 nt, Human
ucuucuccacuuucuagccag

SEQ ID NO: 2963436 - RNA, 19 nt, Human
ucuucuccacuuucuagcc

SEQ ID NO: 2963437 - RNA, 14 nt, Human
ucuuccaggcuggg

SEQ ID NO: 2963438 - RNA, 16 nt, Human
ucuucaguaagccgug

SEQ ID NO: 2963439 - RNA, 21 nt, Human
ucuuccacaagagcccaggcc

SEQ ID NO: 2963440 - RNA, 13 nt, Human
ucuuaugggcugg

SEQ ID NO: 2963441 - RNA, 15 nt, Human
ucuucaguaagccgu

SEQ ID NO: 2963442 - RNA, 13 nt, Human
ucuuaaaaagugg

SEQ ID NO: 2963443 - RNA, 14 nt, Human
ucuuagugugugca

SEQ ID NO: 2963444 - RNA, 16 nt, Human
ucuuaguggauguucu

SEQ ID NO: 2963445 - RNA, 15 nt, Human
ucuuauacauuugau

SEQ ID NO: 2963446 - RNA, 14 nt, Human
ucuuauacauuuga

SEQ ID NO: 2963447 - RNA, 16 nt, Human
uggaauaucuccguca

SEQ ID NO: 2963448 - RNA, 16 nt, Human
uggaauacucuuauau

SEQ ID NO: 2963449 - RNA, 14 nt, Human
uggaagacagcucu

SEQ ID NO: 2963450 - RNA, 15 nt, Human
uggaaaauaaauuau

SEQ ID NO: 2963451 - RNA, 16 nt, Human
uggaaaauaaauuauu

SEQ ID NO: 2963452 - RNA, 22 nt, Human
uggaaaaguauguuagugcaaa

SEQ ID NO: 2963453 - RNA, 12 nt, Human
uggaagacagcu

SEQ ID NO: 2963454 - RNA, 11 nt, Human
uggaagacagc

SEQ ID NO: 2963455 - RNA, 14 nt, Human
uggaacucucgagc

SEQ ID NO: 2963456 - RNA, 15 nt, Human
ugcuuuuuuuggccu

SEQ ID NO: 2963457 - RNA, 18 nt, Human
ugcuuccagugaggcucu

SEQ ID NO: 2963458 - RNA, 20 nt, Human
ugcuuccagugaggcucugc

SEQ ID NO: 2963459 - RNA, 19 nt, Human
ugcuuccagugaggcucug

SEQ ID NO: 2963460 - RNA, 14 nt, Human
ugcuucuguuuuau

SEQ ID NO: 2963461 - RNA, 16 nt, Human
ugcuucuucagagacu

SEQ ID NO: 2963462 - RNA, 23 nt, Human
uggauauagcuaggugacauaua

SEQ ID NO: 2963463 - RNA, 21 nt, Human
uggauauagcuaggugacaua

SEQ ID NO: 2963464 - RNA, 22 nt, Human
uggaggcaugugaugagaggaa

SEQ ID NO: 2963465 - RNA, 12 nt, Human
uggacaggcaug

SEQ ID NO: 2963466 - RNA, 16 nt, Human
uggacaggcauguucu

SEQ ID NO: 2963467 - RNA, 18 nt, Human
uggcacugcuuccaguga

SEQ ID NO: 2963468 - RNA, 16 nt, Human
uggcacugcuuccagu

SEQ ID NO: 2963469 - RNA, 14 nt, Human
uggcacugcuucca

SEQ ID NO: 2963470 - RNA, 14 nt, Human
uggaugccuggugg

SEQ ID NO: 2963471 - RNA, 19 nt, Human
uggcagcugcgguccaccc

SEQ ID NO: 2963472 - RNA, 14 nt, Human
uggcaggcaccugu

SEQ ID NO: 2963473 - RNA, 23 nt, Human
uggcagcugcgguccacccagga

SEQ ID NO: 2963474 - RNA, 21 nt, Human
uggcagcugcgguccacccag

SEQ ID NO: 2963475 - RNA, 22 nt, Human
uggcagcugcgguccacccagg

SEQ ID NO: 2963476 - RNA, 13 nt, Human
uggcagugggagc

SEQ ID NO: 2963477 - RNA, 14 nt, Human
uggcagugggagcu

SEQ ID NO: 2963478 - RNA, 15 nt, Human
uggcagugggagcug

SEQ ID NO: 2963479 - RNA, 16 nt, Human
uggcagugggagcugc

SEQ ID NO: 2963480 - RNA, 19 nt, Human
uggcagugggagcugccug

SEQ ID NO: 2963481 - RNA, 17 nt, Human
uggccagaagucaaggc

SEQ ID NO: 2963482 - RNA, 20 nt, Human
uggcagugggagcugccugu

SEQ ID NO: 2963483 - RNA, 13 nt, Human
uggguuuauuugg

SEQ ID NO: 2963484 - RNA, 14 nt, Human
uggguguggcgcag

SEQ ID NO: 2963485 - RNA, 23 nt, Human
uggguucaagcgauucuucugcu

SEQ ID NO: 2963486 - RNA, 16 nt, Human
uggguucacugcaacc

SEQ ID NO: 2963487 - RNA, 21 nt, Human
ugggugucaagagggucugag

SEQ ID NO: 2963488 - RNA, 23 nt, Human
ugggugucaagagggucugagga

SEQ ID NO: 2963489 - RNA, 18 nt, Human
uggggcagugcuuggccc

SEQ ID NO: 2963490 - RNA, 22 nt, Human
uggggcagugcuuggcccagga

SEQ ID NO: 2963491 - RNA, 20 nt, Human
uggggcagugcuuggcccag

SEQ ID NO: 2963492 - RNA, 23 nt, Human
uggggcagugcuuggcccaggag

SEQ ID NO: 2963493 - RNA, 17 nt, Human
ugggguggggaccucag

SEQ ID NO: 2963494 - RNA, 17 nt, Human
uggguagacacacauga

SEQ ID NO: 2963495 - RNA, 16 nt, Human
uggguagacacacaug

SEQ ID NO: 2963496 - RNA, 20 nt, Human
ugggcuucaguggcagcugc

SEQ ID NO: 2963497 - RNA, 19 nt, Human
ugggcuuggggaccagagc

SEQ ID NO: 2963498 - RNA, 16 nt, Human
uggggcagcuugaggg

SEQ ID NO: 2963499 - RNA, 21 nt, Human
ugggcuuggggaccagagcug

SEQ ID NO: 2963500 - RNA, 13 nt, Human
uggggcagcuuga

SEQ ID NO: 2963501 - RNA, 18 nt, Human
ugggcuucaguggcagcu

SEQ ID NO: 2963502 - RNA, 19 nt, Human
ugggcuucaguggcagcug

SEQ ID NO: 2963503 - RNA, 14 nt, Human
ugggccuccugugu

SEQ ID NO: 2963504 - RNA, 16 nt, Human
ugggccuccugugugu

SEQ ID NO: 2963505 - RNA, 22 nt, Human
ugggccuccugugugugcgccu

SEQ ID NO: 2963506 - RNA, 16 nt, Human
ugggagcuuuuguaga

SEQ ID NO: 2963507 - RNA, 16 nt, Human
ugggagcugucaagca

SEQ ID NO: 2963508 - RNA, 24 nt, Human
ugggagcugccuguucagcuccag

SEQ ID NO: 2963509 - RNA, 14 nt, Human
uggcugggggccuc

SEQ ID NO: 2963510 - RNA, 22 nt, Human
uggcugguuagagguucccuuu

SEQ ID NO: 2963511 - RNA, 22 nt, Human
ugggaaugaaugucagugugac

SEQ ID NO: 2963512 - RNA, 18 nt, Human
ugggacagucaccucaug

SEQ ID NO: 2963513 - RNA, 20 nt, Human
ugggacagucaccucaugga

SEQ ID NO: 2963514 - RNA, 21 nt, Human
ugggacagucaccucauggaa

SEQ ID NO: 2963515 - RNA, 23 nt, Human
ugggagcugccuguucagcucca

SEQ ID NO: 2963516 - RNA, 16 nt, Human
ugggacaugggaaagg

SEQ ID NO: 2963517 - RNA, 19 nt, Human
ugggacauuugcucaugga

SEQ ID NO: 2963518 - RNA, 20 nt, Human
ugggacauuugcucauggaa

SEQ ID NO: 2963519 - RNA, 22 nt, Human
uggcucagguggggucacucug

SEQ ID NO: 2963520 - RNA, 20 nt, Human
uggcucagguggggucacuc

SEQ ID NO: 2963521 - RNA, 16 nt, Human
uggcucuuccaggcug

SEQ ID NO: 2963522 - RNA, 12 nt, Human
uggcugggggcc

SEQ ID NO: 2963523 - RNA, 15 nt, Human
uggcucuuccaggcu

SEQ ID NO: 2963524 - RNA, 13 nt, Human
uggcucuuccagg

SEQ ID NO: 2963525 - RNA, 22 nt, Human
uggcgugcaguggugcgaucug

SEQ ID NO: 2963526 - RNA, 14 nt, Human
uggcgugaacccag

SEQ ID NO: 2963527 - RNA, 14 nt, Human
uggcgcugccccug

SEQ ID NO: 2963528 - RNA, 14 nt, Human
uggcgagccauuug

SEQ ID NO: 2963529 - RNA, 19 nt, Human
uggcgagccauuuguccca

SEQ ID NO: 2963530 - RNA, 15 nt, Human
uggccagaugcacca

SEQ ID NO: 2963531 - RNA, 17 nt, Human
uggccuucggccuccau

SEQ ID NO: 2963532 - RNA, 18 nt, Human
uggccuucggccuccauc

SEQ ID NO: 2963533 - RNA, 14 nt, Human
uggccuucggccuc

SEQ ID NO: 2963534 - RNA, 19 nt, Human
ugcauguuacauaagauaa

SEQ ID NO: 2963535 - RNA, 15 nt, Human
ugcauuauauuuauu

SEQ ID NO: 2963536 - RNA, 14 nt, Human
ugcauuauauuuau

SEQ ID NO: 2963537 - RNA, 20 nt, Human
ugcauuauauuuauuacugu

SEQ ID NO: 2963538 - RNA, 15 nt, Human
ugcaucguuucaucu

SEQ ID NO: 2963539 - RNA, 16 nt, Human
ugcaggcagccaggcc

SEQ ID NO: 2963540 - RNA, 22 nt, Human
ugcaucagcugcugaaacaaca

SEQ ID NO: 2963541 - RNA, 19 nt, Human
ugcaucagcugcugaaaca

SEQ ID NO: 2963542 - RNA, 19 nt, Human
ugcaggcagccaggccaca

SEQ ID NO: 2963543 - RNA, 18 nt, Human
ugcaggcagccaggccac

SEQ ID NO: 2963544 - RNA, 17 nt, Human
ugcaggcagccaggcca

SEQ ID NO: 2963545 - RNA, 15 nt, Human
ugccauccuggccca

SEQ ID NO: 2963546 - RNA, 16 nt, Human
ugccauccuggcccag

SEQ ID NO: 2963547 - RNA, 18 nt, Human
ugccauccuggcccaggg

SEQ ID NO: 2963548 - RNA, 21 nt, Human
ugccauccuggcccagggcau

SEQ ID NO: 2963549 - RNA, 10 nt, Human
ugcccagccc

SEQ ID NO: 2963550 - RNA, 14 nt, Human
ugcccaccuggccu

SEQ ID NO: 2963551 - RNA, 18 nt, Human
ugcccaccuggccucugc

SEQ ID NO: 2963552 - RNA, 17 nt, Human
ugcccaccuggccucug

SEQ ID NO: 2963553 - RNA, 15 nt, Human
ugcccaccuggccuc

SEQ ID NO: 2963554 - RNA, 22 nt, Human
ugccagggacagaggggguggc

SEQ ID NO: 2963555 - RNA, 11 nt, Human
ugccagggaca

SEQ ID NO: 2963556 - RNA, 24 nt, Human
ugccagguuuuuggucugacccac

SEQ ID NO: 2963557 - RNA, 14 nt, Human
ugccagucaccccg

SEQ ID NO: 2963558 - RNA, 13 nt, Human
ugccauccuggcc

SEQ ID NO: 2963559 - RNA, 21 nt, Human
ugccaucccucccuccaccuc

SEQ ID NO: 2963560 - RNA, 22 nt, Human
ugccaucccucccuccaccucc

SEQ ID NO: 2963561 - RNA, 15 nt, Human
ugccaucccucccuc

SEQ ID NO: 2963562 - RNA, 14 nt, Human
ugccaucccucccu

SEQ ID NO: 2963563 - RNA, 19 nt, Human
ugccaucccucccuccacc

SEQ ID NO: 2963564 - RNA, 20 nt, Human
ugccaucccucccuccaccu

SEQ ID NO: 2963565 - RNA, 21 nt, Human
ugcacagcaggcugccagugc

SEQ ID NO: 2963566 - RNA, 22 nt, Human
ugcacagcaggcugccagugcc

SEQ ID NO: 2963567 - RNA, 23 nt, Human
ugcacagcaggcugccagugccu

SEQ ID NO: 2963568 - RNA, 17 nt, Human
ugcacagcuaacaugga

SEQ ID NO: 2963569 - RNA, 18 nt, Human
ugcacagcaggcugccag

SEQ ID NO: 2963570 - RNA, 23 nt, Human
ugcacagaguuguuacauuuuua

SEQ ID NO: 2963571 - RNA, 21 nt, Human
ugcacacuuuggcccagggug

SEQ ID NO: 2963572 - RNA, 20 nt, Human
ugcacagaguuguuacauuu

SEQ ID NO: 2963573 - RNA, 21 nt, Human
ugcacagaguuguuacauuuu

SEQ ID NO: 2963574 - RNA, 22 nt, Human
ugcacagaguuguuacauuuuu

SEQ ID NO: 2963575 - RNA, 17 nt, Human
ugcacacuuuggcccag

SEQ ID NO: 2963576 - RNA, 18 nt, Human
ugcacacuuuggcccagg

SEQ ID NO: 2963577 - RNA, 19 nt, Human
ugcacacuuuggcccaggg

SEQ ID NO: 2963578 - RNA, 20 nt, Human
ugcacacuuuggcccagggu

SEQ ID NO: 2963579 - RNA, 16 nt, Human
ugcacacuuuggccca

SEQ ID NO: 2963580 - RNA, 13 nt, Human
ugcacacuuuggc

SEQ ID NO: 2963581 - RNA, 22 nt, Human
ugaagucuuuguacagacaaca

SEQ ID NO: 2963582 - RNA, 20 nt, Human
ugaagucuuuguacagacaa

SEQ ID NO: 2963583 - RNA, 17 nt, Human
ugaagucuuuguacaga

SEQ ID NO: 2963584 - RNA, 23 nt, Human
ugcacagcuaacauggaaguacu

SEQ ID NO: 2963585 - RNA, 20 nt, Human
ugcacagcuaacauggaagu

SEQ ID NO: 2963586 - RNA, 18 nt, Human
ugcacagcuaacauggaa

SEQ ID NO: 2963587 - RNA, 13 nt, Human
ugcacaucuguuu

SEQ ID NO: 2963588 - RNA, 15 nt, Human
ugcacaucaaaauau

SEQ ID NO: 2963589 - RNA, 18 nt, Human
ugcaggaccucaggugag

SEQ ID NO: 2963590 - RNA, 16 nt, Human
ugcaggaccucaggug

SEQ ID NO: 2963591 - RNA, 15 nt, Human
ugcaggaccucaggu

SEQ ID NO: 2963592 - RNA, 14 nt, Human
ugcaggaccucagg

SEQ ID NO: 2963593 - RNA, 14 nt, Human
ugcagcaauaaagc

SEQ ID NO: 2963594 - RNA, 15 nt, Human
ugcagcaauaaagca

SEQ ID NO: 2963595 - RNA, 16 nt, Human
ugcagcaauaaagcag

SEQ ID NO: 2963596 - RNA, 21 nt, Human
ugcacuugcagacucuacaga

SEQ ID NO: 2963597 - RNA, 16 nt, Human
ugcacuugcagacucu

SEQ ID NO: 2963598 - RNA, 16 nt, Human
ugcacguacacacaca

SEQ ID NO: 2963599 - RNA, 16 nt, Human
ugcagauaaacaguag

SEQ ID NO: 2963600 - RNA, 20 nt, Human
ugcacuuuguucuggcucuu

SEQ ID NO: 2963601 - RNA, 19 nt, Human
ugcacuuuguucuggcucu

SEQ ID NO: 2963602 - RNA, 18 nt, Human
ugcacuuuguucuggcuc

SEQ ID NO: 2963603 - RNA, 15 nt, Human
ugcacuuuguucugg

SEQ ID NO: 2963604 - RNA, 21 nt, Human
ugcugaaggcucgagcaugcc

SEQ ID NO: 2963605 - RNA, 23 nt, Human
ugcugaauacagaggcaacugca

SEQ ID NO: 2963606 - RNA, 18 nt, Human
ugcugaauacagaggcaa

SEQ ID NO: 2963607 - RNA, 17 nt, Human
ugcugaaugguuuucaa

SEQ ID NO: 2963608 - RNA, 18 nt, Human
ugcugaaugguuuucaaa

SEQ ID NO: 2963609 - RNA, 22 nt, Human
ugcugaaugguuuucaaaauaa

SEQ ID NO: 2963610 - RNA, 20 nt, Human
ugcuccugggcuacaaggac

SEQ ID NO: 2963611 - RNA, 19 nt, Human
ugcuccuggcccacugcau

SEQ ID NO: 2963612 - RNA, 14 nt, Human
ugcugauuuaaaca

SEQ ID NO: 2963613 - RNA, 16 nt, Human
ugcugcaguugccagu

SEQ ID NO: 2963614 - RNA, 15 nt, Human
ugcugcaguugccag

SEQ ID NO: 2963615 - RNA, 23 nt, Human
ugcugauggugcaaugaccuuuc

SEQ ID NO: 2963616 - RNA, 20 nt, Human
ugcugauggugcaaugaccu

SEQ ID NO: 2963617 - RNA, 15 nt, Human
ugcugacagacacag

SEQ ID NO: 2963618 - RNA, 16 nt, Human
ugcugacagacacagg

SEQ ID NO: 2963619 - RNA, 19 nt, Human
ugcugacagacacaggccc

SEQ ID NO: 2963620 - RNA, 23 nt, Human
ugcugaguguacagaguggaaua

SEQ ID NO: 2963621 - RNA, 18 nt, Human
ugcuccucuccccagcaa

SEQ ID NO: 2963622 - RNA, 19 nt, Human
ugcuccucuccccagcaag

SEQ ID NO: 2963623 - RNA, 16 nt, Human
ugcuaggaacacuccu

SEQ ID NO: 2963624 - RNA, 19 nt, Human
ugcuaggaacacuccuuca

SEQ ID NO: 2963625 - RNA, 17 nt, Human
ugcuaggaacacuccuu

SEQ ID NO: 2963626 - RNA, 20 nt, Human
ugcuagaacucccuuucaac

SEQ ID NO: 2963627 - RNA, 21 nt, Human
ugcuagaacucccuuucaaca

SEQ ID NO: 2963628 - RNA, 15 nt, Human
ugcgugcauaccacu

SEQ ID NO: 2963629 - RNA, 19 nt, Human
ugcuagaacucccuuucaa

SEQ ID NO: 2963630 - RNA, 18 nt, Human
ugcuagaacucccuuuca

SEQ ID NO: 2963631 - RNA, 22 nt, Human
ugccuuauggaacacucugaga

SEQ ID NO: 2963632 - RNA, 21 nt, Human
ugccuuauggaacacucugag

SEQ ID NO: 2963633 - RNA, 20 nt, Human
ugccuuauggaacacucuga

SEQ ID NO: 2963634 - RNA, 18 nt, Human
ugccuuauggaacacucu

SEQ ID NO: 2963635 - RNA, 13 nt, Human
ugcgccuacagga

SEQ ID NO: 2963636 - RNA, 23 nt, Human
ugcggugcuaucucccccagccc

SEQ ID NO: 2963637 - RNA, 17 nt, Human
ugccuucucaacuccaa

SEQ ID NO: 2963638 - RNA, 22 nt, Human
ugccuucucaacuccaaacuga

SEQ ID NO: 2963639 - RNA, 14 nt, Human
ugccucugggacug

SEQ ID NO: 2963640 - RNA, 16 nt, Human
ugccuccuuugugagg

SEQ ID NO: 2963641 - RNA, 18 nt, Human
ugccuccuuugugaggaa

SEQ ID NO: 2963642 - RNA, 17 nt, Human
ugccuccuuugugagga

SEQ ID NO: 2963643 - RNA, 22 nt, Human
ugccugaagucacacagugagu

SEQ ID NO: 2963644 - RNA, 18 nt, Human
ugccugaagucacacagu

SEQ ID NO: 2963645 - RNA, 17 nt, Human
ugccugaagucacacag

SEQ ID NO: 2963646 - RNA, 23 nt, Human
ugcccaggcuggcgugcaguggu

SEQ ID NO: 2963647 - RNA, 11 nt, Human
ugcccagcccc

SEQ ID NO: 2963648 - RNA, 23 nt, Human
ugccuaccaauauuuaaucuuuu

SEQ ID NO: 2963649 - RNA, 17 nt, Human
ugccuaccaauauuuaa

SEQ ID NO: 2963650 - RNA, 17 nt, Human
ugccuaauaugaugacu

SEQ ID NO: 2963651 - RNA, 22 nt, Human
ugccuaauaugaugacuguuuu

SEQ ID NO: 2963652 - RNA, 18 nt, Human
ugccuccccuccucugcu

SEQ ID NO: 2963653 - RNA, 19 nt, Human
ugccuccccuccucugcuu

SEQ ID NO: 2963654 - RNA, 22 nt, Human
ugccuccccuccucugcuugcc

SEQ ID NO: 2963655 - RNA, 23 nt, Human
ugccuccccuccucugcuugcca

SEQ ID NO: 2963656 - RNA, 20 nt, Human
uuaaagcuuauuaaaacuca

SEQ ID NO: 2963657 - RNA, 20 nt, Human
uuaaacuuaaucuaaaugga

SEQ ID NO: 2963658 - RNA, 16 nt, Human
uuaaacuuaaucuaaa

SEQ ID NO: 2963659 - RNA, 18 nt, Human
uuaaacuuaaucuaaaug

SEQ ID NO: 2963660 - RNA, 13 nt, Human
uuaaaagaaugau

SEQ ID NO: 2963661 - RNA, 19 nt, Human
uuaaaagaaugauuaugaa

SEQ ID NO: 2963662 - RNA, 18 nt, Human
uuaaaugcccagccccuu

SEQ ID NO: 2963663 - RNA, 17 nt, Human
uuaaaugcccagccccu

SEQ ID NO: 2963664 - RNA, 19 nt, Human
uuaaauagcuuuuuucucu

SEQ ID NO: 2963665 - RNA, 15 nt, Human
uuaaagcuuccauug

SEQ ID NO: 2963666 - RNA, 20 nt, Human
uuaaagcuuccauuguuguc

SEQ ID NO: 2963667 - RNA, 17 nt, Human
uuaaaugcaccuggaau

SEQ ID NO: 2963668 - RNA, 18 nt, Human
uuaaaugcaccuggaaua

SEQ ID NO: 2963669 - RNA, 16 nt, Human
uuaaaugcaccuggaa

SEQ ID NO: 2963670 - RNA, 11 nt, Human
uuaaaugcacc

SEQ ID NO: 2963671 - RNA, 16 nt, Human
uguuuguugucagcug

SEQ ID NO: 2963672 - RNA, 17 nt, Human
uguuuguugucagcuga

SEQ ID NO: 2963673 - RNA, 22 nt, Human
uguuuccuggcacugcuuccag

SEQ ID NO: 2963674 - RNA, 21 nt, Human
uguuuccuggcacugcuucca

SEQ ID NO: 2963675 - RNA, 20 nt, Human
uguuuccuggcacugcuucc

SEQ ID NO: 2963676 - RNA, 13 nt, Human
uguuuuugucuua

SEQ ID NO: 2963677 - RNA, 18 nt, Human
uguuuuuauuauuaacaa

SEQ ID NO: 2963678 - RNA, 15 nt, Human
uguuuuuauuauuaa

SEQ ID NO: 2963679 - RNA, 17 nt, Human
uguuuugcucaauagau

SEQ ID NO: 2963680 - RNA, 20 nt, Human
uuacagagacagaaagcaga

SEQ ID NO: 2963681 - RNA, 14 nt, Human
uuacauuuguauaa

SEQ ID NO: 2963682 - RNA, 15 nt, Human
uuacauuuguauaaa

SEQ ID NO: 2963683 - RNA, 23 nt, Human
uuacauggcuggagcuagaauuu

SEQ ID NO: 2963684 - RNA, 22 nt, Human
uuacauggcuggagcuagaauu

SEQ ID NO: 2963685 - RNA, 16 nt, Human
uuacggaacucaaaua

SEQ ID NO: 2963686 - RNA, 20 nt, Human
uuacgguuuuccagguuuaa

SEQ ID NO: 2963687 - RNA, 23 nt, Human
uuacgaaaaaaugguagcauuuu

SEQ ID NO: 2963688 - RNA, 22 nt, Human
uuaccuuuuuuauacauaaaca

SEQ ID NO: 2963689 - RNA, 19 nt, Human
uuaccuuuuuuauacauaa

SEQ ID NO: 2963690 - RNA, 20 nt, Human
uuaccuuuuuuauacauaaa

SEQ ID NO: 2963691 - RNA, 14 nt, Human
uuaccagcagagca

SEQ ID NO: 2963692 - RNA, 21 nt, Human
uuaccacuuguguuuugcaag

SEQ ID NO: 2963693 - RNA, 20 nt, Human
uuacauuuuuaagugcugca

SEQ ID NO: 2963694 - RNA, 21 nt, Human
uuacauuuuuaagugcugcau

SEQ ID NO: 2963695 - RNA, 22 nt, Human
uuacauuuuuaagugcugcauu

SEQ ID NO: 2963696 - RNA, 21 nt, Human
uuaauagguuuggacaaaaug

SEQ ID NO: 2963697 - RNA, 18 nt, Human
uuaaugucacaggcaggu

SEQ ID NO: 2963698 - RNA, 17 nt, Human
uuaaugucacaggcagg

SEQ ID NO: 2963699 - RNA, 22 nt, Human
uuaaugucaauucuugccaaau

SEQ ID NO: 2963700 - RNA, 21 nt, Human
uuaaggaagacaaugugaaaa

SEQ ID NO: 2963701 - RNA, 17 nt, Human
uuaaggaugcuuguaca

SEQ ID NO: 2963702 - RNA, 18 nt, Human
uuaaggaugcuuguacau

SEQ ID NO: 2963703 - RNA, 19 nt, Human
uuaaggaugcuuguacaua

SEQ ID NO: 2963704 - RNA, 20 nt, Human
uuaaggaugcuuguacauaa

SEQ ID NO: 2963705 - RNA, 22 nt, Human
uuaaggaugcuuguacauaaug

SEQ ID NO: 2963706 - RNA, 16 nt, Human
uuaauaauguuucaaa

SEQ ID NO: 2963707 - RNA, 16 nt, Human
uuaauagguuuggaca

SEQ ID NO: 2963708 - RNA, 18 nt, Human
uuaauaauguuucaaaca

SEQ ID NO: 2963709 - RNA, 16 nt, Human
uguguagggcgggagg

SEQ ID NO: 2963710 - RNA, 18 nt, Human
ugugugaauaccccaaga

SEQ ID NO: 2963711 - RNA, 13 nt, Human
uguguuuauuguc

SEQ ID NO: 2963712 - RNA, 19 nt, Human
ugugugcguccugucggag

SEQ ID NO: 2963713 - RNA, 16 nt, Human
uguuacugucuucagu

SEQ ID NO: 2963714 - RNA, 15 nt, Human
uguuacugucuucag

SEQ ID NO: 2963715 - RNA, 22 nt, Human
uguuacauuuuuaagugcugca

SEQ ID NO: 2963716 - RNA, 13 nt, Human
uguuacauuuuua

SEQ ID NO: 2963717 - RNA, 12 nt, Human
uguuauaaucuu

SEQ ID NO: 2963718 - RNA, 14 nt, Human
uguuagugcaaauu

SEQ ID NO: 2963719 - RNA, 15 nt, Human
uguucagcuccagcu

SEQ ID NO: 2963720 - RNA, 16 nt, Human
uguucagcuccagcuc

SEQ ID NO: 2963721 - RNA, 11 nt, Human
uguucagcugg

SEQ ID NO: 2963722 - RNA, 14 nt, Human
uguucagcuccagc

SEQ ID NO: 2963723 - RNA, 16 nt, Human
uguucacagccagacu

SEQ ID NO: 2963724 - RNA, 15 nt, Human
uguuggccaaagcca

SEQ ID NO: 2963725 - RNA, 11 nt, Human
uguuggccagg

SEQ ID NO: 2963726 - RNA, 21 nt, Human
uguuggagaagaacugaaauc

SEQ ID NO: 2963727 - RNA, 19 nt, Human
uguugaagagguuuuaaag

SEQ ID NO: 2963728 - RNA, 14 nt, Human
uguuggccaggcug

SEQ ID NO: 2963729 - RNA, 15 nt, Human
uguuuaaugguaguu

SEQ ID NO: 2963730 - RNA, 13 nt, Human
uguuuaaaaucau

SEQ ID NO: 2963731 - RNA, 21 nt, Human
uguucuccagucauuauguua

SEQ ID NO: 2963732 - RNA, 13 nt, Human
uguucucugagga

SEQ ID NO: 2963733 - RNA, 16 nt, Human
uguucucugaggacac

SEQ ID NO: 2963734 - RNA, 18 nt, Human
uguucucugaggacacua

SEQ ID NO: 2963735 - RNA, 12 nt, Human
uguucucugccc

SEQ ID NO: 2963736 - RNA, 20 nt, Human
uguucaugaaagauucaaug

SEQ ID NO: 2963737 - RNA, 14 nt, Human
uguucuuucuggcu

SEQ ID NO: 2963738 - RNA, 18 nt, Human
uguucugacccugcuuca

SEQ ID NO: 2963739 - RNA, 19 nt, Human
uguucucugcccuccaaga

SEQ ID NO: 2963740 - RNA, 15 nt, Human
uguucugacccugcu

SEQ ID NO: 2963741 - RNA, 20 nt, Human
uguucuuuccaaaguacacu

SEQ ID NO: 2963742 - RNA, 20 nt, Human
uguucuuucuggcuaugcau

SEQ ID NO: 2963743 - RNA, 22 nt, Human
uguucuuucuggcuaugcauuu

SEQ ID NO: 2963744 - RNA, 11 nt, Human
uguugaaagau

SEQ ID NO: 2963745 - RNA, 16 nt, Human
uguugaaacuuuaaga

SEQ ID NO: 2963746 - RNA, 16 nt, Human
uguaugauucccagcc

SEQ ID NO: 2963747 - RNA, 16 nt, Human
uguaugcacacacaua

SEQ ID NO: 2963748 - RNA, 17 nt, Human
uguaugcacacacauau

SEQ ID NO: 2963749 - RNA, 19 nt, Human
uguaugcacacacauauau

SEQ ID NO: 2963750 - RNA, 21 nt, Human
uguaugcacacacauauauua

SEQ ID NO: 2963751 - RNA, 15 nt, Human
uguaugcacacacau

SEQ ID NO: 2963752 - RNA, 16 nt, Human
uguaucccaugagccu

SEQ ID NO: 2963753 - RNA, 19 nt, Human
uguaucccaugagccucag

SEQ ID NO: 2963754 - RNA, 23 nt, Human
uguaucccaugagccucagcauc

SEQ ID NO: 2963755 - RNA, 18 nt, Human
ugucaguuguuauuuauu

SEQ ID NO: 2963756 - RNA, 17 nt, Human
ugucaguuguuauuuau

SEQ ID NO: 2963757 - RNA, 19 nt, Human
ugucaguucugauauggaa

SEQ ID NO: 2963758 - RNA, 22 nt, Human
ugucaguuguuauuuauugaaa

SEQ ID NO: 2963759 - RNA, 20 nt, Human
ugucagugugacugaucucu

SEQ ID NO: 2963760 - RNA, 12 nt, Human
ugucagugugac

SEQ ID NO: 2963761 - RNA, 20 nt, Human
ugucagucugcuuagaaaua

SEQ ID NO: 2963762 - RNA, 17 nt, Human
ugucagucugcuuagaa

SEQ ID NO: 2963763 - RNA, 19 nt, Human
ugucagucugcuuagaaau

SEQ ID NO: 2963764 - RNA, 21 nt, Human
uguaacuguuuagaugaaugu

SEQ ID NO: 2963765 - RNA, 14 nt, Human
uguaaucacagcua

SEQ ID NO: 2963766 - RNA, 15 nt, Human
uguaaucacagcuac

SEQ ID NO: 2963767 - RNA, 13 nt, Human
uguaaacacaucu

SEQ ID NO: 2963768 - RNA, 20 nt, Human
uguaaacacaucuaguaguu

SEQ ID NO: 2963769 - RNA, 13 nt, Human
uguaaauuaacuu

SEQ ID NO: 2963770 - RNA, 14 nt, Human
uguaaauuaacuuu

SEQ ID NO: 2963771 - RNA, 15 nt, Human
uguaaauuaacuuuu

SEQ ID NO: 2963772 - RNA, 16 nt, Human
uguaaauuaacuuuua

SEQ ID NO: 2963773 - RNA, 17 nt, Human
uguaaauuaacuuuuau

SEQ ID NO: 2963774 - RNA, 23 nt, Human
uguaccucuugagccuugaacuu

SEQ ID NO: 2963775 - RNA, 22 nt, Human
uguaccucuugagccuugaacu

SEQ ID NO: 2963776 - RNA, 14 nt, Human
uguaccucuugagc

SEQ ID NO: 2963777 - RNA, 17 nt, Human
uguacgucugacaggca

SEQ ID NO: 2963778 - RNA, 16 nt, Human
uguacgucugacaggc

SEQ ID NO: 2963779 - RNA, 17 nt, Human
uguagauaauacaguuc

SEQ ID NO: 2963780 - RNA, 14 nt, Human
uguggacacagcuc

SEQ ID NO: 2963781 - RNA, 13 nt, Human
uguggacacagcu

SEQ ID NO: 2963782 - RNA, 15 nt, Human
uguggacacagcucu

SEQ ID NO: 2963783 - RNA, 16 nt, Human
uguggacacagcucuu

SEQ ID NO: 2963784 - RNA, 21 nt, Human
uguggagaagcggcuggcagc

SEQ ID NO: 2963785 - RNA, 12 nt, Human
uguggagaagcg

SEQ ID NO: 2963786 - RNA, 12 nt, Human
uguguacuuuua

SEQ ID NO: 2963787 - RNA, 15 nt, Human
uguguacuuuuaaga

SEQ ID NO: 2963788 - RNA, 12 nt, Human
ugugggaagggg

SEQ ID NO: 2963789 - RNA, 16 nt, Human
ugugcacaugcacgug

SEQ ID NO: 2963790 - RNA, 22 nt, Human
ugugcacaugcacgugugugca

SEQ ID NO: 2963791 - RNA, 13 nt, Human
ugugccucuggga

SEQ ID NO: 2963792 - RNA, 15 nt, Human
ugugccucugggacu

SEQ ID NO: 2963793 - RNA, 16 nt, Human
ugugccucugggacug

SEQ ID NO: 2963794 - RNA, 17 nt, Human
ugugccucugggacugg

SEQ ID NO: 2963795 - RNA, 14 nt, Human
ugugcguccugucg

SEQ ID NO: 2963796 - RNA, 20 nt, Human
ugugcgugcauguguguuca

SEQ ID NO: 2963797 - RNA, 12 nt, Human
ugugaaaaaauu

SEQ ID NO: 2963798 - RNA, 17 nt, Human
ugugaaaaaauuuacuu

SEQ ID NO: 2963799 - RNA, 23 nt, Human
ugugaaaaaauuuacuuuaaacu

SEQ ID NO: 2963800 - RNA, 13 nt, Human
ugugaaaggaaag

SEQ ID NO: 2963801 - RNA, 14 nt, Human
ugugaaaggaaaga

SEQ ID NO: 2963802 - RNA, 16 nt, Human
ugucuuuuuucacuac

SEQ ID NO: 2963803 - RNA, 22 nt, Human
ugucuuuggacccugaggccca

SEQ ID NO: 2963804 - RNA, 19 nt, Human
ugucuuuggacccugaggc

SEQ ID NO: 2963805 - RNA, 18 nt, Human
ugucuuuggacccugagg

SEQ ID NO: 2963806 - RNA, 17 nt, Human
ugucuuuggacccugag

SEQ ID NO: 2963807 - RNA, 21 nt, Human
ugucucaguccaugaagaugu

SEQ ID NO: 2963808 - RNA, 18 nt, Human
ugugaguacuacaguccu

SEQ ID NO: 2963809 - RNA, 23 nt, Human
ugugaguacuacaguccucccau

SEQ ID NO: 2963810 - RNA, 20 nt, Human
ugugaguacuacaguccucc

SEQ ID NO: 2963811 - RNA, 19 nt, Human
ugugaguacuacaguccuc

SEQ ID NO: 2963812 - RNA, 21 nt, Human
ugugauacaaugcugugcccu

SEQ ID NO: 2963813 - RNA, 21 nt, Human
ugugaauaaagagggugggug

SEQ ID NO: 2963814 - RNA, 16 nt, Human
ugugaauaccccaaga

SEQ ID NO: 2963815 - RNA, 14 nt, Human
ugugaaugcagguu

SEQ ID NO: 2963816 - RNA, 20 nt, Human
ugugaaugcagguuuuauca

SEQ ID NO: 2963817 - RNA, 21 nt, Human
ugugacaaggauugcuacugu

SEQ ID NO: 2963818 - RNA, 22 nt, Human
ugugaccacugcagaagacagu

SEQ ID NO: 2963819 - RNA, 17 nt, Human
uuggguuuauuuggaaa

SEQ ID NO: 2963820 - RNA, 12 nt, Human
uuggguuuauuu

SEQ ID NO: 2963821 - RNA, 16 nt, Human
uuggguggaugccugg

SEQ ID NO: 2963822 - RNA, 22 nt, Human
uuggcuuuggguugcaggaccu

SEQ ID NO: 2963823 - RNA, 16 nt, Human
uugggaggccauuugu

SEQ ID NO: 2963824 - RNA, 12 nt, Human
uugggaggcuga

SEQ ID NO: 2963825 - RNA, 13 nt, Human
uuggcauucccca

SEQ ID NO: 2963826 - RNA, 14 nt, Human
uuggccaggcuggu

SEQ ID NO: 2963827 - RNA, 22 nt, Human
uuggccagaaaccuuccugcug

SEQ ID NO: 2963828 - RNA, 24 nt, Human
uuggccaaagccaaagcuaggccu

SEQ ID NO: 2963829 - RNA, 21 nt, Human
uuggcugggggccucagugcc

SEQ ID NO: 2963830 - RNA, 22 nt, Human
uuggcugggggccucagugcca

SEQ ID NO: 2963831 - RNA, 18 nt, Human
uuggcugggggccucagu

SEQ ID NO: 2963832 - RNA, 20 nt, Human
uuggccagaagucaaggcuu

SEQ ID NO: 2963833 - RNA, 16 nt, Human
uuggcugcugaaggcu

SEQ ID NO: 2963834 - RNA, 16 nt, Human
uuguaaaggaauuuaa

SEQ ID NO: 2963835 - RNA, 16 nt, Human
uuggucccccuuccau

SEQ ID NO: 2963836 - RNA, 22 nt, Human
uuggucccccuuccauggacuu

SEQ ID NO: 2963837 - RNA, 12 nt, Human
uugguccugcug

SEQ ID NO: 2963838 - RNA, 20 nt, Human
uuguacacucauucauuacu

SEQ ID NO: 2963839 - RNA, 13 nt, Human
uuguacagacaac

SEQ ID NO: 2963840 - RNA, 12 nt, Human
uuguacagacaa

SEQ ID NO: 2963841 - RNA, 18 nt, Human
uuguaaaugugcuuuuaa

SEQ ID NO: 2963842 - RNA, 14 nt, Human
uuguaaaugugcuu

SEQ ID NO: 2963843 - RNA, 11 nt, Human
uuguaaaugug

SEQ ID NO: 2963844 - RNA, 14 nt, Human
uuguagagccaggg

SEQ ID NO: 2963845 - RNA, 15 nt, Human
uuguagagccagggu

SEQ ID NO: 2963846 - RNA, 19 nt, Human
uuguaucacaaaucuuaac

SEQ ID NO: 2963847 - RNA, 21 nt, Human
uuguauucucuccuguaccuc

SEQ ID NO: 2963848 - RNA, 14 nt, Human
uuguauuacaaauc

SEQ ID NO: 2963849 - RNA, 20 nt, Human
uugcuaacagcaacacaaag

SEQ ID NO: 2963850 - RNA, 19 nt, Human
uugcugauggugcaaugac

SEQ ID NO: 2963851 - RNA, 20 nt, Human
uugcugauggugcaaugacc

SEQ ID NO: 2963852 - RNA, 22 nt, Human
uugcugauggugcaaugaccuu

SEQ ID NO: 2963853 - RNA, 13 nt, Human
uugcuaacagcaa

SEQ ID NO: 2963854 - RNA, 23 nt, Human
uugcccacgcuggagugcaguga

SEQ ID NO: 2963855 - RNA, 11 nt, Human
uugcccaggca

SEQ ID NO: 2963856 - RNA, 13 nt, Human
uugccagucaccc

SEQ ID NO: 2963857 - RNA, 18 nt, Human
uugccagucaccccggcc

SEQ ID NO: 2963858 - RNA, 15 nt, Human
uugcccagccuggau

SEQ ID NO: 2963859 - RNA, 11 nt, Human
uugccucugcc

SEQ ID NO: 2963860 - RNA, 14 nt, Human
uugccucugccucu

SEQ ID NO: 2963861 - RNA, 16 nt, Human
uugccucugccucuga

SEQ ID NO: 2963862 - RNA, 18 nt, Human
uugccucugccucugaca

SEQ ID NO: 2963863 - RNA, 14 nt, Human
uuggauuguccccg

SEQ ID NO: 2963864 - RNA, 17 nt, Human
uuggcaaaaaggcagga

SEQ ID NO: 2963865 - RNA, 19 nt, Human
uuggaaggaacguccccug

SEQ ID NO: 2963866 - RNA, 11 nt, Human
uuggaaggaac

SEQ ID NO: 2963867 - RNA, 20 nt, Human
uuggacauuuuaugucuuuc

SEQ ID NO: 2963868 - RNA, 18 nt, Human
uuggacauuuuaugucuu

SEQ ID NO: 2963869 - RNA, 17 nt, Human
uuggacauuuuaugucu

SEQ ID NO: 2963870 - RNA, 16 nt, Human
uuggacauuuuauguc

SEQ ID NO: 2963871 - RNA, 20 nt, Human
uugcuggggccgaaagaaca

SEQ ID NO: 2963872 - RNA, 21 nt, Human
uuggaaaggaaugcaaagaug

SEQ ID NO: 2963873 - RNA, 23 nt, Human
uuggaaagaguaggaagacuuug

SEQ ID NO: 2963874 - RNA, 21 nt, Human
uuggaaauuagguugaaacau

SEQ ID NO: 2963875 - RNA, 23 nt, Human
uuggaaauuagguugaaacauau

SEQ ID NO: 2963876 - RNA, 17 nt, Human
uucuguccuacucugug

SEQ ID NO: 2963877 - RNA, 23 nt, Human
uucuguggguuucuaaagcugcc

SEQ ID NO: 2963878 - RNA, 21 nt, Human
uucuguccgagcuuugaaaau

SEQ ID NO: 2963879 - RNA, 17 nt, Human
uucuguccgagcuuuga

SEQ ID NO: 2963880 - RNA, 15 nt, Human
uucugagaaagacua

SEQ ID NO: 2963881 - RNA, 14 nt, Human
uucugagcauuuaa

SEQ ID NO: 2963882 - RNA, 15 nt, Human
uucuuauuucauuuc

SEQ ID NO: 2963883 - RNA, 19 nt, Human
uucuuauuuaaugaaagac

SEQ ID NO: 2963884 - RNA, 23 nt, Human
uucuuauuuaaugaaagacugua

SEQ ID NO: 2963885 - RNA, 13 nt, Human
uucuugguuugua

SEQ ID NO: 2963886 - RNA, 16 nt, Human
uucuugguuuguaaau

SEQ ID NO: 2963887 - RNA, 23 nt, Human
uucuugguuuguaaauuaacuuu

SEQ ID NO: 2963888 - RNA, 17 nt, Human
uucuugguuuguaaauu

SEQ ID NO: 2963889 - RNA, 18 nt, Human
uucuugguuuguaaauua

SEQ ID NO: 2963890 - RNA, 22 nt, Human
uugaacuuugaccucugcagca

SEQ ID NO: 2963891 - RNA, 20 nt, Human
uugaacuuugaccucugcag

SEQ ID NO: 2963892 - RNA, 16 nt, Human
uugaacugauaaagau

SEQ ID NO: 2963893 - RNA, 19 nt, Human
uugaacucuucaaucucuu

SEQ ID NO: 2963894 - RNA, 19 nt, Human
uugaagacuuuucuuucag

SEQ ID NO: 2963895 - RNA, 17 nt, Human
uugaagacagagcuaca

SEQ ID NO: 2963896 - RNA, 18 nt, Human
uucuuuauaauucuacuu

SEQ ID NO: 2963897 - RNA, 21 nt, Human
uugaaaacacuguucucugcc

SEQ ID NO: 2963898 - RNA, 19 nt, Human
uugaaaacacuguucucug

SEQ ID NO: 2963899 - RNA, 23 nt, Human
uugaaacugagaugugaacacau

SEQ ID NO: 2963900 - RNA, 14 nt, Human
uugaaacuuuaaga

SEQ ID NO: 2963901 - RNA, 23 nt, Human
uugaaaagacuccaaagaaaugu

SEQ ID NO: 2963902 - RNA, 22 nt, Human
uugaaaagacuccaaagaaaug

SEQ ID NO: 2963903 - RNA, 18 nt, Human
uugaaaagacuccaaaga

SEQ ID NO: 2963904 - RNA, 16 nt, Human
uugaaaagacuccaaa

SEQ ID NO: 2963905 - RNA, 14 nt, Human
uugcaacaggcugg

SEQ ID NO: 2963906 - RNA, 17 nt, Human
uugcaacaggcugggcu

SEQ ID NO: 2963907 - RNA, 18 nt, Human
uugauuuccguuaaaaua

SEQ ID NO: 2963908 - RNA, 12 nt, Human
uugaugaagaag

SEQ ID NO: 2963909 - RNA, 21 nt, Human
uugauagcacagacccugccc

SEQ ID NO: 2963910 - RNA, 18 nt, Human
uugaggguauguuuuaua

SEQ ID NO: 2963911 - RNA, 16 nt, Human
uugcagacaggcaagc

SEQ ID NO: 2963912 - RNA, 22 nt, Human
uugcagacaggcaagcaccucc

SEQ ID NO: 2963913 - RNA, 19 nt, Human
uugcauacuauuaaacaug

SEQ ID NO: 2963914 - RNA, 18 nt, Human
uugcauacuauuaaacau

SEQ ID NO: 2963915 - RNA, 16 nt, Human
uugcauacuauuaaac

SEQ ID NO: 2963916 - RNA, 18 nt, Human
uugcauagauucccugag

SEQ ID NO: 2963917 - RNA, 22 nt, Human
uugaccugaggcccuucucucc

SEQ ID NO: 2963918 - RNA, 19 nt, Human
uugaccugaggcccuucuc

SEQ ID NO: 2963919 - RNA, 12 nt, Human
uugaccugaggc

SEQ ID NO: 2963920 - RNA, 22 nt, Human
uugacgccaucccagccccaau

SEQ ID NO: 2963921 - RNA, 14 nt, Human
uugacgccauccca

SEQ ID NO: 2963922 - RNA, 15 nt, Human
uugaccucaggugau

SEQ ID NO: 2963923 - RNA, 21 nt, Human
uugaccgugaggccagagaca

SEQ ID NO: 2963924 - RNA, 20 nt, Human
uugaccgugaggccagagac

SEQ ID NO: 2963925 - RNA, 20 nt, Human
uugacgccaucccagcccca

SEQ ID NO: 2963926 - RNA, 12 nt, Human
uugacuauuuuu

SEQ ID NO: 2963927 - RNA, 19 nt, Human
uugacuauuuuuguuuuua

SEQ ID NO: 2963928 - RNA, 20 nt, Human
uugauagcacagacccugcc

SEQ ID NO: 2963929 - RNA, 19 nt, Human
uugauagcacagacccugc

SEQ ID NO: 2963930 - RNA, 15 nt, Human
uugaggacacugaua

SEQ ID NO: 2963931 - RNA, 14 nt, Human
uugaggacacugau

SEQ ID NO: 2963932 - RNA, 13 nt, Human
uucaaagauauuu

SEQ ID NO: 2963933 - RNA, 19 nt, Human
uuacuaaaaguuuugagaa

SEQ ID NO: 2963934 - RNA, 20 nt, Human
uuacuaaaaguuuugagaaa

SEQ ID NO: 2963935 - RNA, 14 nt, Human
uuacgugaguccug

SEQ ID NO: 2963936 - RNA, 13 nt, Human
uuacgugaguccu

SEQ ID NO: 2963937 - RNA, 19 nt, Human
uucaaucuggauucauauu

SEQ ID NO: 2963938 - RNA, 23 nt, Human
uucaaucuggauucauauuuaau

SEQ ID NO: 2963939 - RNA, 20 nt, Human
uucaaucuggauucauauuu

SEQ ID NO: 2963940 - RNA, 18 nt, Human
uucaauucucauuuguca

SEQ ID NO: 2963941 - RNA, 19 nt, Human
uucaaugccccugaauuua

SEQ ID NO: 2963942 - RNA, 23 nt, Human
uucagcuccagcucaccagcccc

SEQ ID NO: 2963943 - RNA, 24 nt, Human
uucagcucugcaagaauugaagca

SEQ ID NO: 2963944 - RNA, 17 nt, Human
uucagcucugcaagaau

SEQ ID NO: 2963945 - RNA, 16 nt, Human
uucaggaagcucaggg

SEQ ID NO: 2963946 - RNA, 17 nt, Human
uucagcugacuuuucug

SEQ ID NO: 2963947 - RNA, 18 nt, Human
uucagcugcauacaguuu

SEQ ID NO: 2963948 - RNA, 19 nt, Human
uucaggaagcucagggccu

SEQ ID NO: 2963949 - RNA, 17 nt, Human
uucaggaagcucagggc

SEQ ID NO: 2963950 - RNA, 20 nt, Human
uucaggaagcucagggccug

SEQ ID NO: 2963951 - RNA, 15 nt, Human
uucaggaagcucagg

SEQ ID NO: 2963952 - RNA, 14 nt, Human
uucacucuccuugg

SEQ ID NO: 2963953 - RNA, 15 nt, Human
uucagagacuccugc

SEQ ID NO: 2963954 - RNA, 22 nt, Human
uucagcuccagcucaccagccc

SEQ ID NO: 2963955 - RNA, 21 nt, Human
uucagagcugcccucuccugg

SEQ ID NO: 2963956 - RNA, 22 nt, Human
uucagagcugcccucuccuggg

SEQ ID NO: 2963957 - RNA, 23 nt, Human
uucagagcugcccucuccugggc

SEQ ID NO: 2963958 - RNA, 19 nt, Human
uuccauuuacuuaagacuu

SEQ ID NO: 2963959 - RNA, 18 nt, Human
uuccauuuacuuaagacu

SEQ ID NO: 2963960 - RNA, 17 nt, Human
uuccaugaguccccugu

SEQ ID NO: 2963961 - RNA, 17 nt, Human
uuccacuugagugucaa

SEQ ID NO: 2963962 - RNA, 21 nt, Human
uuccacuugagugucaagcug

SEQ ID NO: 2963963 - RNA, 19 nt, Human
uuccacuuauaggaauuga

SEQ ID NO: 2963964 - RNA, 15 nt, Human
uucaguuuaucuguu

SEQ ID NO: 2963965 - RNA, 21 nt, Human
uucagugccuuauggaacacu

SEQ ID NO: 2963966 - RNA, 19 nt, Human
uucagugccuuauggaaca

SEQ ID NO: 2963967 - RNA, 18 nt, Human
uucaguuuaucuguucau

SEQ ID NO: 2963968 - RNA, 23 nt, Human
uucauaaugacuuaagcacacuu

SEQ ID NO: 2963969 - RNA, 13 nt, Human
uucauaaugacuu

SEQ ID NO: 2963970 - RNA, 19 nt, Human
uucauuuaggugaggaagc

SEQ ID NO: 2963971 - RNA, 12 nt, Human
uucaucuugaau

SEQ ID NO: 2963972 - RNA, 18 nt, Human
uucaugaaagauucaaug

SEQ ID NO: 2963973 - RNA, 11 nt, Human
uucaucuugaa

SEQ ID NO: 2963974 - RNA, 20 nt, Human
uucaucuuccaacucaaacu

SEQ ID NO: 2963975 - RNA, 15 nt, Human
uuccuucagugccuu

SEQ ID NO: 2963976 - RNA, 19 nt, Human
uuccuucagugccuuaugg

SEQ ID NO: 2963977 - RNA, 16 nt, Human
uuccuucagugccuua

SEQ ID NO: 2963978 - RNA, 23 nt, Human
uuccuucagugccuuauggaaca

SEQ ID NO: 2963979 - RNA, 19 nt, Human
uuccuucauucaacccacc

SEQ ID NO: 2963980 - RNA, 17 nt, Human
uucuaaaggcuaccuuu

SEQ ID NO: 2963981 - RNA, 18 nt, Human
uucuaaaggcuaccuuug

SEQ ID NO: 2963982 - RNA, 16 nt, Human
uucuaaaggcuaccuu

SEQ ID NO: 2963983 - RNA, 18 nt, Human
uucggccuccauccugag

SEQ ID NO: 2963984 - RNA, 19 nt, Human
uucggccuccauccugagg

SEQ ID NO: 2963985 - RNA, 22 nt, Human
uuccccacuugagaauuacccu

SEQ ID NO: 2963986 - RNA, 19 nt, Human
uucccuuugacgccauccc

SEQ ID NO: 2963987 - RNA, 18 nt, Human
uucccuugaugaagaagu

SEQ ID NO: 2963988 - RNA, 12 nt, Human
uuccucccuccc

SEQ ID NO: 2963989 - RNA, 19 nt, Human
uuccucccucccucuuucc

SEQ ID NO: 2963990 - RNA, 21 nt, Human
uuccucccucccucuuucccu

SEQ ID NO: 2963991 - RNA, 22 nt, Human
uuccucccucccucuuucccuc

SEQ ID NO: 2963992 - RNA, 23 nt, Human
uuccucauaguaugguggcuggg

SEQ ID NO: 2963993 - RNA, 12 nt, Human
uuccuagugaaa

SEQ ID NO: 2963994 - RNA, 21 nt, Human
uucuauuuauuuauuuauuca

SEQ ID NO: 2963995 - RNA, 14 nt, Human
uucuauuuauuugu

SEQ ID NO: 2963996 - RNA, 14 nt, Human
uucuauuguuucuu

SEQ ID NO: 2963997 - RNA, 16 nt, Human
uucuaugacacaugca

SEQ ID NO: 2963998 - RNA, 17 nt, Human
uucuaugacacaugcaa

SEQ ID NO: 2963999 - RNA, 17 nt, Human
uucuccagucauuaugu

SEQ ID NO: 2964000 - RNA, 19 nt, Human
uucuccagucauuauguua

SEQ ID NO: 2964001 - RNA, 11 nt, Human
uucuccaggcu

SEQ ID NO: 2964002 - RNA, 13 nt, Human
uucuccacccugc

SEQ ID NO: 2964003 - RNA, 16 nt, Human
uucuccaagcaggaca

SEQ ID NO: 2964004 - RNA, 18 nt, Human
uucucuccagccccugga

SEQ ID NO: 2964005 - RNA, 22 nt, Human
uucucuccuguaccucuugagc

SEQ ID NO: 2964006 - RNA, 15 nt, Human
uucucugauacagaa

SEQ ID NO: 2964007 - RNA, 16 nt, Human
uucucugauacagaaa

SEQ ID NO: 2964008 - RNA, 14 nt, Human
uucucugauacaga

SEQ ID NO: 2964009 - RNA, 17 nt, Human
uucucugauacagaaaa

SEQ ID NO: 2964010 - RNA, 21 nt, Human
uucugacccaugcugcccugu

SEQ ID NO: 2964011 - RNA, 20 nt, Human
uucugacccaugcugcccug

SEQ ID NO: 2964012 - RNA, 18 nt, Human
uucugacccaugcugccc

SEQ ID NO: 2964013 - RNA, 16 nt, Human
uucugacccaugcugc

SEQ ID NO: 2964014 - RNA, 17 nt, Human
uuuacauggcuggagcu

SEQ ID NO: 2964015 - RNA, 16 nt, Human
uuuacauggcuggagc

SEQ ID NO: 2964016 - RNA, 13 nt, Human
uuuaaucuuuuau

SEQ ID NO: 2964017 - RNA, 20 nt, Human
uuuagaaacacaacuauauu

SEQ ID NO: 2964018 - RNA, 15 nt, Human
uuuacuuuguguuca

SEQ ID NO: 2964019 - RNA, 22 nt, Human
uuuacauggcuggagcuagaau

SEQ ID NO: 2964020 - RNA, 15 nt, Human
uuuacuuuuuggaaa

SEQ ID NO: 2964021 - RNA, 23 nt, Human
uuuacuuuuuggaaaagaauaaa

SEQ ID NO: 2964022 - RNA, 12 nt, Human
uuuagaaacaca

SEQ ID NO: 2964023 - RNA, 19 nt, Human
uuuauuuaguuccuugagu

SEQ ID NO: 2964024 - RNA, 16 nt, Human
uuuauugucaaagugg

SEQ ID NO: 2964025 - RNA, 14 nt, Human
uuuauugucaaagu

SEQ ID NO: 2964026 - RNA, 21 nt, Human
uuuaucgucacugcuuaacuu

SEQ ID NO: 2964027 - RNA, 16 nt, Human
uuuaucgucacugcuu

SEQ ID NO: 2964028 - RNA, 16 nt, Human
uuuauaaacuuuaccu

SEQ ID NO: 2964029 - RNA, 14 nt, Human
uuuauaaacuuuac

SEQ ID NO: 2964030 - RNA, 21 nt, Human
uuuccucuuuggucuacacug

SEQ ID NO: 2964031 - RNA, 14 nt, Human
uuucuaaaggcuac

SEQ ID NO: 2964032 - RNA, 17 nt, Human
uuucuaaagcugccagc

SEQ ID NO: 2964033 - RNA, 14 nt, Human
uuucuaaagcugcc

SEQ ID NO: 2964034 - RNA, 15 nt, Human
uuucuagccagagga

SEQ ID NO: 2964035 - RNA, 16 nt, Human
uuucuaggacugaauu

SEQ ID NO: 2964036 - RNA, 22 nt, Human
uuucugagaaagacuauucaaa

SEQ ID NO: 2964037 - RNA, 15 nt, Human
uuucugagaaagacu

SEQ ID NO: 2964038 - RNA, 13 nt, Human
uuuccaggaaggc

SEQ ID NO: 2964039 - RNA, 12 nt, Human
uuuccaaaguac

SEQ ID NO: 2964040 - RNA, 15 nt, Human
uuuccaaaguacacu

SEQ ID NO: 2964041 - RNA, 15 nt, Human
uuucagccaagaauu

SEQ ID NO: 2964042 - RNA, 22 nt, Human
uuucauugcugggcuugucugu

SEQ ID NO: 2964043 - RNA, 16 nt, Human
uuuauuuauuuauuca

SEQ ID NO: 2964044 - RNA, 22 nt, Human
uuuauuuggaaaggaaugcaaa

SEQ ID NO: 2964045 - RNA, 19 nt, Human
uuucaauaggaaaaacuga

SEQ ID NO: 2964046 - RNA, 22 nt, Human
uuucaauaggaaaaacugauuu

SEQ ID NO: 2964047 - RNA, 20 nt, Human
uuucaauaggaaaaacugau

SEQ ID NO: 2964048 - RNA, 15 nt, Human
uuucagauaaucaca

SEQ ID NO: 2964049 - RNA, 15 nt, Human
uuucagcagcugcag

SEQ ID NO: 2964050 - RNA, 14 nt, Human
uuuuaaacaaaaua

SEQ ID NO: 2964051 - RNA, 22 nt, Human
uuuuacauaaauuuaguauuuu

SEQ ID NO: 2964052 - RNA, 21 nt, Human
uuuuaauuugguuuucacauu

SEQ ID NO: 2964053 - RNA, 17 nt, Human
uuuuaauuugguuuuca

SEQ ID NO: 2964054 - RNA, 20 nt, Human
uuuuauaucaauuuaaaaaa

SEQ ID NO: 2964055 - RNA, 15 nt, Human
uuuuauaugcuucug

SEQ ID NO: 2964056 - RNA, 20 nt, Human
uuuuauaugcuucuguuuua

SEQ ID NO: 2964057 - RNA, 18 nt, Human
uuuuaucgucacugcuua

SEQ ID NO: 2964058 - RNA, 22 nt, Human
uuuuaucagaacuauguuuuug

SEQ ID NO: 2964059 - RNA, 15 nt, Human
uuuuauauucucagc

SEQ ID NO: 2964060 - RNA, 10 nt, Human
uuuuauauuu

SEQ ID NO: 2964061 - RNA, 19 nt, Human
uuuuccaugaguccccugu

SEQ ID NO: 2964062 - RNA, 18 nt, Human
uuuuccaugaguccccug

SEQ ID NO: 2964063 - RNA, 15 nt, Human
uuuuccuucagugcc

SEQ ID NO: 2964064 - RNA, 16 nt, Human
uuuucuugcaugguuu

SEQ ID NO: 2964065 - RNA, 17 nt, Human
uuuucuugcaugaggcu

SEQ ID NO: 2964066 - RNA, 14 nt, Human
uuuucuucucccuc

SEQ ID NO: 2964067 - RNA, 15 nt, Human
uuuucacaguucucu

SEQ ID NO: 2964068 - RNA, 17 nt, Human
uuuucaauuuuaaacau

SEQ ID NO: 2964069 - RNA, 23 nt, Human
uuuucaauaacuggaacacucua

SEQ ID NO: 2964070 - RNA, 13 nt, Human
uuuucaauaacug

SEQ ID NO: 2964071 - RNA, 16 nt, Human
uuuucaauaacuggaa

SEQ ID NO: 2964072 - RNA, 19 nt, Human
uuuucaauaacuggaacac

SEQ ID NO: 2964073 - RNA, 17 nt, Human
uuugaggucuguucuuu

SEQ ID NO: 2964074 - RNA, 22 nt, Human
uuugaggucuguucuuuccaaa

SEQ ID NO: 2964075 - RNA, 15 nt, Human
uuugagcagggcuca

SEQ ID NO: 2964076 - RNA, 11 nt, Human
uuugcagagua

SEQ ID NO: 2964077 - RNA, 14 nt, Human
uuugcagacaggca

SEQ ID NO: 2964078 - RNA, 23 nt, Human
uuuggaaauuagguugaaacaua

SEQ ID NO: 2964079 - RNA, 18 nt, Human
uuugccauguuggccagg

SEQ ID NO: 2964080 - RNA, 21 nt, Human
uuugcauagauucccugagca

SEQ ID NO: 2964081 - RNA, 16 nt, Human
uuugucccaagugcca

SEQ ID NO: 2964082 - RNA, 21 nt, Human
uuuguccccaccgcagacagg

SEQ ID NO: 2964083 - RNA, 13 nt, Human
uuuguccccaccg

SEQ ID NO: 2964084 - RNA, 13 nt, Human
uuugguuauuuua

SEQ ID NO: 2964085 - RNA, 16 nt, Human
uuuguugucagcugaa

SEQ ID NO: 2964086 - RNA, 19 nt, Human
uuuggugguuucagaaaug

SEQ ID NO: 2964087 - RNA, 16 nt, Human
uuuguaaauuaacuuu

SEQ ID NO: 2964088 - RNA, 17 nt, Human
uuuguaaauuaacuuuu

SEQ ID NO: 2964089 - RNA, 15 nt, Human
uuuguaaauuaacuu

SEQ ID NO: 2964090 - RNA, 21 nt, Human
uuuguauaaaauaauuuuuau

SEQ ID NO: 2964091 - RNA, 22 nt, Human
uuuguaaauuaacuuuuauaaa

SEQ ID NO: 2964092 - RNA, 17 nt, Human
uuuuuuccuucagugcc

SEQ ID NO: 2964093 - RNA, 12 nt, Human
uuuuuucugaaa

SEQ ID NO: 2964094 - RNA, 12 nt, Human
uuuuuuacuaau

SEQ ID NO: 2964095 - RNA, 13 nt, Human
uuuugaaauguca

SEQ ID NO: 2964096 - RNA, 15 nt, Human
cuggcucuuccaggc

SEQ ID NO: 2964097 - RNA, 15 nt, Human
aucccauaugccugg

SEQ ID NO: 2964098 - RNA, 12 nt, Human
agccuuccaggg

SEQ ID NO: 2964099 - RNA, 15 nt, Human
cacugcuuccaguga

SEQ ID NO: 2964100 - RNA, 17 nt, Human
agcugccaccugccugu

SEQ ID NO: 2964101 - RNA, 22 nt, Human
auuuccaugauguuuuccauga

SEQ ID NO: 2964102 - RNA, 21 nt, Human
cugacacaugcugaacaucac

SEQ ID NO: 2964103 - RNA, 17 nt, Human
cucacaauccuugccac

SEQ ID NO: 2964104 - RNA, 20 nt, Human
cccagcacaaagcagauccu

SEQ ID NO: 2964105 - RNA, 21 nt, Human
ccagucauuauguuaauauuu

SEQ ID NO: 2964106 - RNA, 22 nt, Human
ccagucauuauguuaauauuuc

SEQ ID NO: 2964107 - RNA, 16 nt, Human
ccauucuuggcccagg

SEQ ID NO: 2964108 - RNA, 15 nt, Human
ccuaauaaaaaggug

SEQ ID NO: 2964109 - RNA, 16 nt, Human
ccuaauaaaaagguga

SEQ ID NO: 2964110 - RNA, 20 nt, Human
ccuaauaaaaaggugaccau

SEQ ID NO: 2964111 - RNA, 14 nt, Human
ccuaauaaaaaggu

SEQ ID NO: 2964112 - RNA, 12 nt, Human
ccuaauguguuu

SEQ ID NO: 2964113 - RNA, 23 nt, Human
caauugaaguaaaauguggcagg

SEQ ID NO: 2964114 - RNA, 13 nt, Human
cacagaagaugaa

SEQ ID NO: 2964115 - RNA, 18 nt, Human
cacccaggaacuccugac

SEQ ID NO: 2964116 - RNA, 15 nt, Human
cacaucuguuuugua

SEQ ID NO: 2964117 - RNA, 13 nt, Human
auuuuaugucuuu

SEQ ID NO: 2964118 - RNA, 17 nt, Human
caaacagucucccuucc

SEQ ID NO: 2964119 - RNA, 24 nt, Human
caaacccaguguuuuaggagcaug

SEQ ID NO: 2964120 - RNA, 13 nt, Human
auuaaaugacucu

SEQ ID NO: 2964121 - RNA, 12 nt, Human
auuaaaugacuc

SEQ ID NO: 2964122 - RNA, 14 nt, Human
auuaaaugacucuu

SEQ ID NO: 2964123 - RNA, 13 nt, Human
cauuaguuuugaa

SEQ ID NO: 2964124 - RNA, 16 nt, Human
cauuagguugugaaug

SEQ ID NO: 2964125 - RNA, 15 nt, Human
cauuagguugugaau

SEQ ID NO: 2964126 - RNA, 14 nt, Human
cauuagguugugaa

SEQ ID NO: 2964127 - RNA, 18 nt, Human
cauagcugugauuuuugg

SEQ ID NO: 2964128 - RNA, 15 nt, Human
cauagcugugauuuu

SEQ ID NO: 2964129 - RNA, 13 nt, Human
cauagcugugauu

SEQ ID NO: 2964130 - RNA, 20 nt, Human
cagaguaggggucugucuuu

SEQ ID NO: 2964131 - RNA, 23 nt, Human
cagaguaggggucugucuuuuaa

SEQ ID NO: 2964132 - RNA, 22 nt, Human
cagaguaggggucugucuuuua

SEQ ID NO: 2964133 - RNA, 16 nt, Human
gcccucaauugugaaa

SEQ ID NO: 2964134 - RNA, 19 nt, Human
gcuccaccuugcagcucuc

SEQ ID NO: 2964135 - RNA, 23 nt, Human
ggaacagaagaggaaagagagac

SEQ ID NO: 2964136 - RNA, 16 nt, Human
gcuuguacacucauuc

SEQ ID NO: 2964137 - RNA, 15 nt, Human
aaacacauuaaaggu

SEQ ID NO: 2964138 - RNA, 11 nt, Human
aaacacauuaa

SEQ ID NO: 2964139 - RNA, 21 nt, Human
aaacacauuaaagguacuuug

SEQ ID NO: 2964140 - RNA, 17 nt, Human
aaagcuuuugcauauug

SEQ ID NO: 2964141 - RNA, 14 nt, Human
aaagcuuuugcaua

SEQ ID NO: 2964142 - RNA, 13 nt, Human
aaagcuuuugcau

SEQ ID NO: 2964143 - RNA, 14 nt, Human
ggguggggcagugc

SEQ ID NO: 2964144 - RNA, 16 nt, Human
aaagguacuuugcagg

SEQ ID NO: 2964145 - RNA, 14 nt, Human
guaacucuguaauu

SEQ ID NO: 2964146 - RNA, 21 nt, Human
guacucugccacuuuauuucu

SEQ ID NO: 2964147 - RNA, 20 nt, Human
guagacgugcacgcacacug

SEQ ID NO: 2964148 - RNA, 23 nt, Human
guagacgugcacgcacacugucu

SEQ ID NO: 2964149 - RNA, 16 nt, Human
guagacaguuggguuu

SEQ ID NO: 2964150 - RNA, 14 nt, Human
guagaauguuuuca

SEQ ID NO: 2964151 - RNA, 20 nt, Human
aaaaggaagcuuacaugccu

SEQ ID NO: 2964152 - RNA, 18 nt, Human
ggcugaacuuuguggucg

SEQ ID NO: 2964153 - RNA, 19 nt, Human
ggcccuuuuucaauaacug

SEQ ID NO: 2964154 - RNA, 20 nt, Human
ggcacugguuuguucccugu

SEQ ID NO: 2964155 - RNA, 21 nt, Human
gacccucucaaacuaacaggc

SEQ ID NO: 2964156 - RNA, 22 nt, Human
gacuuugguuauuuuacuuuuu

SEQ ID NO: 2964157 - RNA, 14 nt, Human
gcaggcuggaguua

SEQ ID NO: 2964158 - RNA, 21 nt, Human
gaugcugucuucguacuggga

SEQ ID NO: 2964159 - RNA, 21 nt, Human
gauucuuguauuuauuacaac

SEQ ID NO: 2964160 - RNA, 15 nt, Human
gauucuuguauuuau

SEQ ID NO: 2964161 - RNA, 12 nt, Human
gaaagggauuuu

SEQ ID NO: 2964162 - RNA, 20 nt, Human
gaaagggauuuucagcccuc

SEQ ID NO: 2964163 - RNA, 22 nt, Human
cuugugaauaaagagggugggu

SEQ ID NO: 2964164 - RNA, 20 nt, Human
cuuuaccaauugaaguaaaa

SEQ ID NO: 2964165 - RNA, 19 nt, Human
cuuuaccaauugaaguaaa

SEQ ID NO: 2964166 - RNA, 16 nt, Human
cuuuaccaauugaagu

SEQ ID NO: 2964167 - RNA, 18 nt, Human
cuuuaccaauugaaguaa

SEQ ID NO: 2964168 - RNA, 13 nt, Human
cuuugguuauuuu

SEQ ID NO: 2964169 - RNA, 19 nt, Human
cuuugguuauuuuacuuuu

SEQ ID NO: 2964170 - RNA, 17 nt, Human
cuuugguuauuuuacuu

SEQ ID NO: 2964171 - RNA, 23 nt, Human
cuuugguuauuuuacuuuuugga

SEQ ID NO: 2964172 - RNA, 17 nt, Human
cugucggagcccugucu

SEQ ID NO: 2964173 - RNA, 18 nt, Human
cuggauaguccgucucug

SEQ ID NO: 2964174 - RNA, 19 nt, Human
cuggauaguccgucucugc

SEQ ID NO: 2964175 - RNA, 14 nt, Human
auuauguuaauauu

SEQ ID NO: 2964176 - RNA, 16 nt, Human
auuauguuaauauuuc

SEQ ID NO: 2964177 - RNA, 13 nt, Human
auuauguuaauau

SEQ ID NO: 2964178 - RNA, 17 nt, Human
auuauguuaauauuucu

SEQ ID NO: 2964179 - RNA, 16 nt, Human
auuauauucauucuuu

SEQ ID NO: 2964180 - RNA, 17 nt, Human
uuuguggaaaauaacuc

SEQ ID NO: 2964181 - RNA, 13 nt, Human
auugaagcagagu

SEQ ID NO: 2964182 - RNA, 15 nt, Human
auugaagcagagugg

SEQ ID NO: 2964183 - RNA, 14 nt, Human
auugaagcagagug

SEQ ID NO: 2964184 - RNA, 18 nt, Human
auugaagcagaguggcag

SEQ ID NO: 2964185 - RNA, 19 nt, Human
auuuuugguauuugaaaca

SEQ ID NO: 2964186 - RNA, 19 nt, Human
auuuuuguuuuuauuaaaa

SEQ ID NO: 2964187 - RNA, 21 nt, Human
auuuuuguuuuuauuaaaagg

SEQ ID NO: 2964188 - RNA, 17 nt, Human
auuugaaacacugguuu

SEQ ID NO: 2964189 - RNA, 14 nt, Human
auuugaaacacugg

SEQ ID NO: 2964190 - RNA, 16 nt, Human
auuuauuuauuuauuc

SEQ ID NO: 2964191 - RNA, 23 nt, Human
auugauugggcacaucauuucaa

SEQ ID NO: 2964192 - RNA, 19 nt, Human
auugauugggcacaucauu

SEQ ID NO: 2964193 - RNA, 14 nt, Human
uuucaaauguucuc

SEQ ID NO: 2964194 - RNA, 19 nt, Human
augauugccuuuuuauaac

SEQ ID NO: 2964195 - RNA, 17 nt, Human
uuuaaagauguagacag

SEQ ID NO: 2964196 - RNA, 18 nt, Human
uuguuuugccaauuugca

SEQ ID NO: 2964197 - RNA, 16 nt, Human
augauauaagguuuuu

SEQ ID NO: 2964198 - RNA, 22 nt, Human
uuuaauuugaagguagaauguu

SEQ ID NO: 2964199 - RNA, 15 nt, Human
uuuaaauagaugaca

SEQ ID NO: 2964200 - RNA, 18 nt, Human
auguagacaguuggguuu

SEQ ID NO: 2964201 - RNA, 20 nt, Human
auguagacaguuggguuuuu

SEQ ID NO: 2964202 - RNA, 16 nt, Human
augucaguauuucaac

SEQ ID NO: 2964203 - RNA, 13 nt, Human
augucaguauuuc

SEQ ID NO: 2964204 - RNA, 19 nt, Human
augugcacaucuguuuugu

SEQ ID NO: 2964205 - RNA, 15 nt, Human
uucccucaaaugugu

SEQ ID NO: 2964206 - RNA, 19 nt, Human
uucuagcaugaagacagag

SEQ ID NO: 2964207 - RNA, 17 nt, Human
aucugaaauaaggaaug

SEQ ID NO: 2964208 - RNA, 17 nt, Human
uugcauauugcauacua

SEQ ID NO: 2964209 - RNA, 21 nt, Human
uugaaggaugcugucuucgua

SEQ ID NO: 2964210 - RNA, 22 nt, Human
auaacuuuuuauauucucagca

SEQ ID NO: 2964211 - RNA, 15 nt, Human
aguuuuacaguguuu

SEQ ID NO: 2964212 - RNA, 15 nt, Human
aguuuaucuguucau

SEQ ID NO: 2964213 - RNA, 19 nt, Human
uuaagacuuugguuauuuu

SEQ ID NO: 2964214 - RNA, 19 nt, Human
aguuuuuuuccuucaagaa

SEQ ID NO: 2964215 - RNA, 13 nt, Human
uuauguuaauauu

SEQ ID NO: 2964216 - RNA, 18 nt, Human
uuauucauuaguuuugaa

SEQ ID NO: 2964217 - RNA, 21 nt, Human
uuauucauuaguuuugaagau

SEQ ID NO: 2964218 - RNA, 14 nt, Human
uuauuauuaacaaa

SEQ ID NO: 2964219 - RNA, 13 nt, Human
uuauuauuaacaa

SEQ ID NO: 2964220 - RNA, 18 nt, Human
auacugccuuguuuaaug

SEQ ID NO: 2964221 - RNA, 20 nt, Human
auacugccuuguuuaauggu

SEQ ID NO: 2964222 - RNA, 14 nt, Human
auagauguugcuaa

SEQ ID NO: 2964223 - RNA, 20 nt, Human
auagauguugcuaacagcaa

SEQ ID NO: 2964224 - RNA, 17 nt, Human
auacuauuaaacaugcu

SEQ ID NO: 2964225 - RNA, 19 nt, Human
auacuauuaaacaugcugu

SEQ ID NO: 2964226 - RNA, 18 nt, Human
auacuauuaaacaugcug

SEQ ID NO: 2964227 - RNA, 20 nt, Human
auacuauuaaacaugcugua

SEQ ID NO: 2964228 - RNA, 15 nt, Human
agucucccuuccuau

SEQ ID NO: 2964229 - RNA, 18 nt, Human
agugcaaacuucagaguu

SEQ ID NO: 2964230 - RNA, 17 nt, Human
ugugccuaauguguuug

SEQ ID NO: 2964231 - RNA, 18 nt, Human
ugugccuaauguguuuga

SEQ ID NO: 2964232 - RNA, 14 nt, Human
ugugccuaaugugu

SEQ ID NO: 2964233 - RNA, 15 nt, Human
ugugccuaauguguu

SEQ ID NO: 2964234 - RNA, 22 nt, Human
uguggucaacauuucucauguu

SEQ ID NO: 2964235 - RNA, 14 nt, Human
ugugucauuucaaa

SEQ ID NO: 2964236 - RNA, 13 nt, Human
ugugucauuucaa

SEQ ID NO: 2964237 - RNA, 13 nt, Human
uguuaauauuuua

SEQ ID NO: 2964238 - RNA, 22 nt, Human
uguucuaaauaucccuuggaca

SEQ ID NO: 2964239 - RNA, 19 nt, Human
aguguguggucaacauuuc

SEQ ID NO: 2964240 - RNA, 20 nt, Human
aguaaaaaaugguguuuuau

SEQ ID NO: 2964241 - RNA, 16 nt, Human
agguuuuuuuuucuca

SEQ ID NO: 2964242 - RNA, 17 nt, Human
aguaaugagcuuaagaa

SEQ ID NO: 2964243 - RNA, 15 nt, Human
uguacauacuuuuug

SEQ ID NO: 2964244 - RNA, 20 nt, Human
uguacauacuuuuuggguuu

SEQ ID NO: 2964245 - RNA, 22 nt, Human
aggugggauaucacuuccauga

SEQ ID NO: 2964246 - RNA, 20 nt, Human
uguccagccccguagacgug

SEQ ID NO: 2964247 - RNA, 16 nt, Human
aguccccucuccucca

SEQ ID NO: 2964248 - RNA, 16 nt, Human
uggcuaacuuggguua

SEQ ID NO: 2964249 - RNA, 18 nt, Human
aggcuuagugauguaauu

SEQ ID NO: 2964250 - RNA, 17 nt, Human
aggcuuagugauguaau

SEQ ID NO: 2964251 - RNA, 19 nt, Human
aggcuuagugauguaauua

SEQ ID NO: 2964252 - RNA, 12 nt, Human
uggcccaggagu

SEQ ID NO: 2964253 - RNA, 11 nt, Human
uggcccaggag

SEQ ID NO: 2964254 - RNA, 12 nt, Human
aggaguuuggcc

SEQ ID NO: 2964255 - RNA, 13 nt, Human
aggaguuuggcca

SEQ ID NO: 2964256 - RNA, 19 nt, Human
uggaacacucuauaacaaa

SEQ ID NO: 2964257 - RNA, 15 nt, Human
aggaaugcaaagaug

SEQ ID NO: 2964258 - RNA, 22 nt, Human
ugcugccaauauccuaauaaaa

SEQ ID NO: 2964259 - RNA, 23 nt, Human
ugcugccaauauccuaauaaaaa

SEQ ID NO: 2964260 - RNA, 23 nt, Human
aggaaagcaaaucaguuugguug

SEQ ID NO: 2964261 - RNA, 15 nt, Human
ugccaauauccuaau

SEQ ID NO: 2964262 - RNA, 16 nt, Human
ugccaauauccuaaua

SEQ ID NO: 2964263 - RNA, 17 nt, Human
ugccaauauccuaauaa

SEQ ID NO: 2964264 - RNA, 18 nt, Human
ugccaauauccuaauaaa

SEQ ID NO: 2964265 - RNA, 19 nt, Human
ugccaauauccuaauaaaa

SEQ ID NO: 2964266 - RNA, 21 nt, Human
ugccaauauccuaauaaaaag

SEQ ID NO: 2964267 - RNA, 23 nt, Human
ugccaauauccuaauaaaaaggu

SEQ ID NO: 2964268 - RNA, 17 nt, Human
ugcacaucuguuuugua

SEQ ID NO: 2964269 - RNA, 16 nt, Human
ugcauacuauuaaaca

SEQ ID NO: 2964270 - RNA, 15 nt, Human
ugcauacuauuaaac

SEQ ID NO: 2964271 - RNA, 12 nt, Human
ugcauacuauua

SEQ ID NO: 2964272 - RNA, 20 nt, Human
ugcauacuauuaaacaugcu

SEQ ID NO: 2964273 - RNA, 18 nt, Human
ugcauacuauuaaacaug

SEQ ID NO: 2964274 - RNA, 17 nt, Human
ugcauacuauuaaacau

SEQ ID NO: 2964275 - RNA, 16 nt, Human
ucugucuuuuaaacuc

SEQ ID NO: 2964276 - RNA, 12 nt, Human
ucugucuuuuaa

SEQ ID NO: 2964277 - RNA, 18 nt, Human
ucugucuuuuaaacucug

SEQ ID NO: 2964278 - RNA, 16 nt, Human
ucuucccucaaaugug

SEQ ID NO: 2964279 - RNA, 20 nt, Human
agacuggauaguccgucucu

SEQ ID NO: 2964280 - RNA, 21 nt, Human
agacuggauaguccgucucug

SEQ ID NO: 2964281 - RNA, 16 nt, Human
agacccucucaaacua

SEQ ID NO: 2964282 - RNA, 24 nt, Human
agacccucaugcugccaauauccu

SEQ ID NO: 2964283 - RNA, 20 nt, Human
agacccucaugcugccaaua

SEQ ID NO: 2964284 - RNA, 21 nt, Human
agacccucaugcugccaauau

SEQ ID NO: 2964285 - RNA, 18 nt, Human
agacccucaugcugccaa

SEQ ID NO: 2964286 - RNA, 19 nt, Human
agacccucaugcugccaau

SEQ ID NO: 2964287 - RNA, 15 nt, Human
ucuggauucauauuu

SEQ ID NO: 2964288 - RNA, 17 nt, Human
agaacuaaaauguucua

SEQ ID NO: 2964289 - RNA, 20 nt, Human
agaacaaaggggcuuaauua

SEQ ID NO: 2964290 - RNA, 15 nt, Human
ucuccucucucugua

SEQ ID NO: 2964291 - RNA, 20 nt, Human
acuuguugaggguauguuuu

SEQ ID NO: 2964292 - RNA, 18 nt, Human
agcaacacaaagcuuuug

SEQ ID NO: 2964293 - RNA, 16 nt, Human
agcaacacaaagcuuu

SEQ ID NO: 2964294 - RNA, 21 nt, Human
agcaacacaaagcuuuugcau

SEQ ID NO: 2964295 - RNA, 15 nt, Human
agcaacacaaagcuu

SEQ ID NO: 2964296 - RNA, 16 nt, Human
ugacauugacuauuuu

SEQ ID NO: 2964297 - RNA, 14 nt, Human
ugacauugacuauu

SEQ ID NO: 2964298 - RNA, 17 nt, Human
ugacauugcaccuggau

SEQ ID NO: 2964299 - RNA, 14 nt, Human
ugacauugcaccug

SEQ ID NO: 2964300 - RNA, 21 nt, Human
ugaagauucuauguuaauauu

SEQ ID NO: 2964301 - RNA, 17 nt, Human
ugaagcagaguggcagu

SEQ ID NO: 2964302 - RNA, 20 nt, Human
ugaaugcccagugagacugu

SEQ ID NO: 2964303 - RNA, 13 nt, Human
agcagagugcuuu

SEQ ID NO: 2964304 - RNA, 10 nt, Human
agcagagugc

SEQ ID NO: 2964305 - RNA, 23 nt, Human
ugagcaucgcuuaggagaagucu

SEQ ID NO: 2964306 - RNA, 18 nt, Human
ucagaugcacaugagcug

SEQ ID NO: 2964307 - RNA, 16 nt, Human
ucagaacuauguuuuu

SEQ ID NO: 2964308 - RNA, 19 nt, Human
ucagaacuauguuuuuguu

SEQ ID NO: 2964309 - RNA, 21 nt, Human
uccacauuuguuuugccaauu

SEQ ID NO: 2964310 - RNA, 20 nt, Human
uccuguuuuuauuauuaaca

SEQ ID NO: 2964311 - RNA, 16 nt, Human
uccuguuuuuauuauu

SEQ ID NO: 2964312 - RNA, 21 nt, Human
uccuguuuuuauuauuaacaa

SEQ ID NO: 2964313 - RNA, 15 nt, Human
uccuguuuuuauuau

SEQ ID NO: 2964314 - RNA, 14 nt, Human
acuaaaauguucua

SEQ ID NO: 2964315 - RNA, 20 nt, Human
acuacauuagguugugaaug

SEQ ID NO: 2964316 - RNA, 19 nt, Human
acuacauuagguugugaau

SEQ ID NO: 2964317 - RNA, 18 nt, Human
acuacauuagguugugaa

SEQ ID NO: 2964318 - RNA, 20 nt, Human
acuauguuuuuguucaguuu

SEQ ID NO: 2964319 - RNA, 21 nt, Human
acuauuaaacaugcuguacau

SEQ ID NO: 2964320 - RNA, 17 nt, Human
acuaucacugguuuggu

SEQ ID NO: 2964321 - RNA, 15 nt, Human
ucccuuucccuuggu

SEQ ID NO: 2964322 - RNA, 14 nt, Human
uagucauucuuccc

SEQ ID NO: 2964323 - RNA, 15 nt, Human
uagucauucuucccu

SEQ ID NO: 2964324 - RNA, 13 nt, Human
uauagcaagacau

SEQ ID NO: 2964325 - RNA, 15 nt, Human
uaugaugacuguuuu

SEQ ID NO: 2964326 - RNA, 14 nt, Human
uaugaugacuguuu

SEQ ID NO: 2964327 - RNA, 20 nt, Human
uaucagaacuauguuuuugu

SEQ ID NO: 2964328 - RNA, 14 nt, Human
uaucagaacuaugu

SEQ ID NO: 2964329 - RNA, 17 nt, Human
uauauucucagcagagu

SEQ ID NO: 2964330 - RNA, 19 nt, Human
uauauucucagcagagugc

SEQ ID NO: 2964331 - RNA, 20 nt, Human
uaucacuuccaugacauaag

SEQ ID NO: 2964332 - RNA, 21 nt, Human
acaguaacauagcugugauuu

SEQ ID NO: 2964333 - RNA, 22 nt, Human
acaguguguggucaacauuucu

SEQ ID NO: 2964334 - RNA, 15 nt, Human
uauguuuuauauagc

SEQ ID NO: 2964335 - RNA, 19 nt, Human
uauuaaacaugcuguacau

SEQ ID NO: 2964336 - RNA, 15 nt, Human
uauuaaacaugcugu

SEQ ID NO: 2964337 - RNA, 17 nt, Human
uauuaaacaugcuguac

SEQ ID NO: 2964338 - RNA, 15 nt, Human
uauucugagaugacu

SEQ ID NO: 2964339 - RNA, 20 nt, Human
uauugaagcagaguggcagu

SEQ ID NO: 2964340 - RNA, 16 nt, Human
uauugaagcagagugg

SEQ ID NO: 2964341 - RNA, 14 nt, Human
uauugaagcagagu

SEQ ID NO: 2964342 - RNA, 16 nt, Human
uauugaaaugauuuca

SEQ ID NO: 2964343 - RNA, 15 nt, Human
uauuuaaucuuuuau

SEQ ID NO: 2964344 - RNA, 13 nt, Human
uauuuaaucuuuu

SEQ ID NO: 2964345 - RNA, 16 nt, Human
uauuuaauuugaaggu

SEQ ID NO: 2964346 - RNA, 23 nt, Human
uauuuaauuugaagguagaaugu

SEQ ID NO: 2964347 - RNA, 13 nt, Human
uauuuaauuugaa

SEQ ID NO: 2964348 - RNA, 13 nt, Human
uauuuauuuguga

SEQ ID NO: 2964349 - RNA, 14 nt, Human
uauuuauuuauuua

SEQ ID NO: 2964350 - RNA, 13 nt, Human
uacuauuaaacau

SEQ ID NO: 2964351 - RNA, 16 nt, Human
uacuauuaaacaugcu

SEQ ID NO: 2964352 - RNA, 15 nt, Human
uacuauuaaacaugc

SEQ ID NO: 2964353 - RNA, 14 nt, Human
uacuauuaaacaug

SEQ ID NO: 2964354 - RNA, 18 nt, Human
uacuauuaaacaugcugu

SEQ ID NO: 2964355 - RNA, 16 nt, Human
uacauuagguugugaa

SEQ ID NO: 2964356 - RNA, 12 nt, Human
uacauacuuuuu

SEQ ID NO: 2964357 - RNA, 15 nt, Human
uacauacuuuuuggg

SEQ ID NO: 2964358 - RNA, 14 nt, Human
uacauacuuuuugg

SEQ ID NO: 2964359 - RNA, 21 nt, Human
uaauuaugguuaguagaggua

SEQ ID NO: 2964360 - RNA, 12 nt, Human
aaugcaaagaug

SEQ ID NO: 2964361 - RNA, 18 nt, Human
aaugcaaagaugaagguc

SEQ ID NO: 2964362 - RNA, 14 nt, Human
aaugcaaagaugaa

SEQ ID NO: 2964363 - RNA, 21 nt, Human
aaugcaaagaugaaggucugu

SEQ ID NO: 2964364 - RNA, 20 nt, Human
uaauuugaagguagaauguu

SEQ ID NO: 2964365 - RNA, 19 nt, Human
aaucuuuuaugauugccuu

SEQ ID NO: 2964366 - RNA, 13 nt, Human
aacucuguaauuc

SEQ ID NO: 2964367 - RNA, 18 nt, Human
aacuaacaggcuuaguga

SEQ ID NO: 2964368 - RNA, 22 nt, Human
aacuaacaggcuuagugaugua

SEQ ID NO: 2964369 - RNA, 23 nt, Human
guguguggucaacauuucucaug

SEQ ID NO: 2964370 - RNA, 12 nt, Human
guuuggccagaa

SEQ ID NO: 2964371 - RNA, 18 nt, Human
guuuggccagaagucaag

SEQ ID NO: 2964372 - RNA, 23 nt, Human
guuuggccagaagucaaggcuua

SEQ ID NO: 2964373 - RNA, 11 nt, Human
guuuggccaga

SEQ ID NO: 2964374 - RNA, 16 nt, Human
aagggcccuuuuucaa

SEQ ID NO: 2964375 - RNA, 22 nt, Human
aagggcccuuuuucaauaacug

SEQ ID NO: 2964376 - RNA, 21 nt, Human
guuucuagcaugaagacagag

SEQ ID NO: 2964377 - RNA, 13 nt, Human
aagucaaggcuua

SEQ ID NO: 2964378 - RNA, 22 nt, Human
aagucaaggcuuagacccucau

SEQ ID NO: 2964379 - RNA, 23 nt, Human
guuuuuuaagggcccuuuuucaa

SEQ ID NO: 2964380 - RNA, 23 nt, Human
guugcuaacagcaacacaaagcu

SEQ ID NO: 2964381 - RNA, 18 nt, Human
guucuccagucauuaugu

SEQ ID NO: 2964382 - RNA, 20 nt, Human
guucuccagucauuauguua

SEQ ID NO: 2964383 - RNA, 20 nt, Human
uaaacucugagugcaaacuu

SEQ ID NO: 2964384 - RNA, 12 nt, Human
uaaacucauuuc

SEQ ID NO: 2964385 - RNA, 17 nt, Human
uaaacucauuucuagca

SEQ ID NO: 2964386 - RNA, 22 nt, Human
uaaacuacauuagguugugaau

SEQ ID NO: 2964387 - RNA, 13 nt, Human
aaguuuugagaaa

SEQ ID NO: 2964388 - RNA, 16 nt, Human
uaaaugacucuucccu

SEQ ID NO: 2964389 - RNA, 14 nt, Human
augcugccaauauc

SEQ ID NO: 2964390 - RNA, 17 nt, Human
augcugccaauauccua

SEQ ID NO: 2964391 - RNA, 18 nt, Human
augcugccaauauccuaa

SEQ ID NO: 2964392 - RNA, 19 nt, Human
augcugccaauauccuaau

SEQ ID NO: 2964393 - RNA, 13 nt, Human
augcugccaauau

SEQ ID NO: 2964394 - RNA, 20 nt, Human
augcugccaauauccuaaua

SEQ ID NO: 2964395 - RNA, 21 nt, Human
augcugccaauauccuaauaa

SEQ ID NO: 2964396 - RNA, 22 nt, Human
augcugccaauauccuaauaaa

SEQ ID NO: 2964397 - RNA, 23 nt, Human
augcugccaauauccuaauaaaa

SEQ ID NO: 2964398 - RNA, 20 nt, Human
auguucuccagucauuaugu

SEQ ID NO: 2964399 - RNA, 12 nt, Human
auguuuucaaau

SEQ ID NO: 2964400 - RNA, 15 nt, Human
auguuuucaaauguu

SEQ ID NO: 2964401 - RNA, 17 nt, Human
auguuuuauauagcaag

SEQ ID NO: 2964402 - RNA, 18 nt, Human
auguuuucaaauguucuc

SEQ ID NO: 2964403 - RNA, 20 nt, Human
auaacaaaggauacuuauuu

SEQ ID NO: 2964404 - RNA, 21 nt, Human
auaacaaaggauacuuauuua

SEQ ID NO: 2964405 - RNA, 15 nt, Human
auaaugucccuucac

SEQ ID NO: 2964406 - RNA, 15 nt, Human
auagcaguaaaaaau

SEQ ID NO: 2964407 - RNA, 21 nt, Human
auagcaguaaaaaaugguguu

SEQ ID NO: 2964408 - RNA, 16 nt, Human
auauccuaauaaaaag

SEQ ID NO: 2964409 - RNA, 18 nt, Human
auauccuaauaaaaaggu

SEQ ID NO: 2964410 - RNA, 20 nt, Human
auauccuaauaaaaagguga

SEQ ID NO: 2964411 - RNA, 22 nt, Human
auaucccuuggacauuuuaugu

SEQ ID NO: 2964412 - RNA, 23 nt, Human
auaucccuuggacauuuuauguc

SEQ ID NO: 2964413 - RNA, 12 nt, Human
auauccuaauaa

SEQ ID NO: 2964414 - RNA, 13 nt, Human
auauccuaauaaa

SEQ ID NO: 2964415 - RNA, 14 nt, Human
auauccuaauaaaa

SEQ ID NO: 2964416 - RNA, 20 nt, Human
auaucccuuggacauuuuau

SEQ ID NO: 2964417 - RNA, 22 nt, Human
aggucuguuuuguguacuuuua

SEQ ID NO: 2964418 - RNA, 23 nt, Human
aggagaagucuucuauuuauuua

SEQ ID NO: 2964419 - RNA, 22 nt, Human
aggagaagucuucuauuuauuu

SEQ ID NO: 2964420 - RNA, 12 nt, Human
agcuuuugcaua

SEQ ID NO: 2964421 - RNA, 21 nt, Human
agacgugcacgcacacugucu

SEQ ID NO: 2964422 - RNA, 22 nt, Human
agacgugcacgcacacugucug

SEQ ID NO: 2964423 - RNA, 16 nt, Human
agcccucaauugugaa

SEQ ID NO: 2964424 - RNA, 17 nt, Human
agcccucaauugugaaa

SEQ ID NO: 2964425 - RNA, 19 nt, Human
agcaucgcuuaggagaagu

SEQ ID NO: 2964426 - RNA, 15 nt, Human
agcaugaagacagag

SEQ ID NO: 2964427 - RNA, 11 nt, Human
aagauucuaug

SEQ ID NO: 2964428 - RNA, 19 nt, Human
aagauucuauguuaauauu

SEQ ID NO: 2964429 - RNA, 12 nt, Human
aaggugcaucug

SEQ ID NO: 2964430 - RNA, 22 nt, Human
aacagcaacacaaagcuuuugc

SEQ ID NO: 2964431 - RNA, 15 nt, Human
aacacauuaaaggua

SEQ ID NO: 2964432 - RNA, 20 nt, Human
aacacauuaaagguacuuug

SEQ ID NO: 2964433 - RNA, 19 nt, Human
aaacacugguuuuaaauau

SEQ ID NO: 2964434 - RNA, 13 nt, Human
aaacucugagugc

SEQ ID NO: 2964435 - RNA, 15 nt, Human
aaacucugagugcaa

SEQ ID NO: 2964436 - RNA, 22 nt, Human
acccaguguuuuaggagcauga

SEQ ID NO: 2964437 - RNA, 19 nt, Human
acccaguguuuuaggagca

SEQ ID NO: 2964438 - RNA, 16 nt, Human
acuuuauuucucucau

SEQ ID NO: 2964439 - RNA, 13 nt, Human
acuuuuaagacuu

SEQ ID NO: 2964440 - RNA, 12 nt, Human
acuuuuaagacu

SEQ ID NO: 2964441 - RNA, 16 nt, Human
acuucacgcccuuggc

SEQ ID NO: 2964442 - RNA, 14 nt, Human
acugguuuuaaaua

SEQ ID NO: 2964443 - RNA, 17 nt, Human
acugguuuguucccugu

SEQ ID NO: 2964444 - RNA, 22 nt, Human
acuauuuuuguuuuuauuaaaa

SEQ ID NO: 2964445 - RNA, 21 nt, Human
acuauuuuuguuuuuauuaaa

SEQ ID NO: 2964446 - RNA, 18 nt, Human
acuauucugagaugacua

SEQ ID NO: 2964447 - RNA, 19 nt, Human
acuauucugagaugacuau

SEQ ID NO: 2964448 - RNA, 20 nt, Human
acuauuuuuguuuuuauuaa

SEQ ID NO: 2964449 - RNA, 15 nt, Human
cacaaagcagauccu

SEQ ID NO: 2964450 - RNA, 23 nt, Human
cacaaagaaccaccaggaaagca

SEQ ID NO: 2964451 - RNA, 15 nt, Human
cacauuaaaugacuc

SEQ ID NO: 2964452 - RNA, 13 nt, Human
cacauuaaaugac

SEQ ID NO: 2964453 - RNA, 17 nt, Human
cacauuaaagguacuuu

SEQ ID NO: 2964454 - RNA, 22 nt, Human
caacauuucucauguugaaacu

SEQ ID NO: 2964455 - RNA, 23 nt, Human
caacaugccagccacugugauag

SEQ ID NO: 2964456 - RNA, 17 nt, Human
caaagcuuuugcauauu

SEQ ID NO: 2964457 - RNA, 16 nt, Human
caaaggauacuuauuu

SEQ ID NO: 2964458 - RNA, 21 nt, Human
caaaggauacuuauuuaaaua

SEQ ID NO: 2964459 - RNA, 14 nt, Human
uuuguguacuuuua

SEQ ID NO: 2964460 - RNA, 13 nt, Human
uuuguguacuuuu

SEQ ID NO: 2964461 - RNA, 17 nt, Human
uuuguguacuuuuaaga

SEQ ID NO: 2964462 - RNA, 15 nt, Human
uuggacauuuuaugu

SEQ ID NO: 2964463 - RNA, 23 nt, Human
uugcuaacagcaacacaaagcuu

SEQ ID NO: 2964464 - RNA, 19 nt, Human
uugcugcugauuuaaacac

SEQ ID NO: 2964465 - RNA, 17 nt, Human
uugcugcugauuuaaac

SEQ ID NO: 2964466 - RNA, 21 nt, Human
uugcugcugauuuaaacacau

SEQ ID NO: 2964467 - RNA, 16 nt, Human
uugcugcuuguacacu

SEQ ID NO: 2964468 - RNA, 18 nt, Human
uugccuuggcugcaguuu

SEQ ID NO: 2964469 - RNA, 17 nt, Human
uugccuuuuuauaacuu

SEQ ID NO: 2964470 - RNA, 20 nt, Human
uugggcacaucauuucaaga

SEQ ID NO: 2964471 - RNA, 18 nt, Human
uugguaacucuguaauuc

SEQ ID NO: 2964472 - RNA, 23 nt, Human
uugcagcucuccccuucucugua

SEQ ID NO: 2964473 - RNA, 15 nt, Human
uugaaacacugguuu

SEQ ID NO: 2964474 - RNA, 22 nt, Human
uugaagauucuauguuaauauu

SEQ ID NO: 2964475 - RNA, 23 nt, Human
uugaagauucuauguuaauauuu

SEQ ID NO: 2964476 - RNA, 13 nt, Human
uugaagauucuau

SEQ ID NO: 2964477 - RNA, 12 nt, Human
uugaagcagagu

SEQ ID NO: 2964478 - RNA, 14 nt, Human
uugaagcagagugg

SEQ ID NO: 2964479 - RNA, 13 nt, Human
uucuuguauuuau

SEQ ID NO: 2964480 - RNA, 22 nt, Human
uuucacaguguguggucaacau

SEQ ID NO: 2964481 - RNA, 17 nt, Human
uuuggguuuauuuggaa

SEQ ID NO: 2964482 - RNA, 14 nt, Human
uuugguuauuuuac

SEQ ID NO: 2964483 - RNA, 13 nt, Human
uuugguuauuuua

SEQ ID NO: 2964484 - RNA, 22 nt, Human
uuugguugguaacucuguaauu

SEQ ID NO: 2964485 - RNA, 15 nt, Human
uuugccaauuugcac

SEQ ID NO: 2964486 - RNA, 20 nt, Human
uuugccaauuugcacauuaa

SEQ ID NO: 2964487 - RNA, 21 nt, Human
uuugaagguagaauguuuuca

SEQ ID NO: 2964488 - RNA, 15 nt, Human
uuuaaacuacauuag

SEQ ID NO: 2964489 - RNA, 15 nt, Human
uuuaaacacauuaaa

SEQ ID NO: 2964490 - RNA, 14 nt, Human
uuuaaacacauuaa

SEQ ID NO: 2964491 - RNA, 20 nt, Human
uuguuauuuauugaaaugau

SEQ ID NO: 2964492 - RNA, 15 nt, Human
uuguuauuuauugaa

SEQ ID NO: 2964493 - RNA, 12 nt, Human
uuguuuaauggu

SEQ ID NO: 2964494 - RNA, 23 nt, Human
uuguuuaaugguaguuuuacagu

SEQ ID NO: 2964495 - RNA, 22 nt, Human
uuuauccuagucauucuucccu

SEQ ID NO: 2964496 - RNA, 16 nt, Human
uuuaucuguucauaug

SEQ ID NO: 2964497 - RNA, 15 nt, Human
uuuaucuguucauau

SEQ ID NO: 2964498 - RNA, 23 nt, Human
uuuauccuagucauucuucccua

SEQ ID NO: 2964499 - RNA, 17 nt, Human
uuuacaguguuucuggc

SEQ ID NO: 2964500 - RNA, 19 nt, Human
uuuacaguguuucuggcuu

SEQ ID NO: 2964501 - RNA, 12 nt, Human
uuauugaagcag

SEQ ID NO: 2964502 - RNA, 17 nt, Human
uuauugaagcagagugg

SEQ ID NO: 2964503 - RNA, 16 nt, Human
uuauugaagcagagug

SEQ ID NO: 2964504 - RNA, 15 nt, Human
uuauugaagcagagu

SEQ ID NO: 2964505 - RNA, 13 nt, Human
uuauugaagcaga

SEQ ID NO: 2964506 - RNA, 15 nt, Human
uuauugauguuuuca

SEQ ID NO: 2964507 - RNA, 13 nt, Human
uuauuuuacuuuu

SEQ ID NO: 2964508 - RNA, 15 nt, Human
uuauuuuacuuuuug

SEQ ID NO: 2964509 - RNA, 13 nt, Human
uuacuuuaaacua

SEQ ID NO: 2964510 - RNA, 19 nt, Human
uuagacccucaugcugcca

SEQ ID NO: 2964511 - RNA, 20 nt, Human
uuagacccucaugcugccaa

SEQ ID NO: 2964512 - RNA, 20 nt, Human
uuaggagaagucuucuauuu

SEQ ID NO: 2964513 - RNA, 23 nt, Human
uuaguagagguacacuugugaau

SEQ ID NO: 2964514 - RNA, 22 nt, Human
uuaguagagguacacuugugaa

SEQ ID NO: 2964515 - RNA, 19 nt, Human
uuaaugguaguuuuacagu

SEQ ID NO: 2964516 - RNA, 21 nt, Human
uuaaacucugagugcaaacuu

SEQ ID NO: 2964517 - RNA, 15 nt, Human
ugguauuugaaacac

SEQ ID NO: 2964518 - RNA, 14 nt, Human
uggucaacauuucu

SEQ ID NO: 2964519 - RNA, 16 nt, Human
uggugauuuagcagga

SEQ ID NO: 2964520 - RNA, 22 nt, Human
uggugauuuagcaggaagcugu

SEQ ID NO: 2964521 - RNA, 14 nt, Human
uggguauagauguu

SEQ ID NO: 2964522 - RNA, 18 nt, Human
uggguauagauguugcua

SEQ ID NO: 2964523 - RNA, 19 nt, Human
uggaucuguauguguucua

SEQ ID NO: 2964524 - RNA, 16 nt, Human
ugcagggacagagcau

SEQ ID NO: 2964525 - RNA, 23 nt, Human
ugcauauugcauacuauuaaaca

SEQ ID NO: 2964526 - RNA, 15 nt, Human
ugcauauugcauacu

SEQ ID NO: 2964527 - RNA, 21 nt, Human
ugcugccaauauccuaauaaa

SEQ ID NO: 2964528 - RNA, 15 nt, Human
ugcugccaauauccu

SEQ ID NO: 2964529 - RNA, 16 nt, Human
ugcugccaauauccua

SEQ ID NO: 2964530 - RNA, 17 nt, Human
ugcugccaauauccuaa

SEQ ID NO: 2964531 - RNA, 18 nt, Human
ugcugccaauauccuaau

SEQ ID NO: 2964532 - RNA, 19 nt, Human
ugcugccaauauccuaaua

SEQ ID NO: 2964533 - RNA, 21 nt, Human
ugcuguucacuggacacuuca

SEQ ID NO: 2964534 - RNA, 17 nt, Human
ugauugggcacaucauu

SEQ ID NO: 2964535 - RNA, 21 nt, Human
ugauugggcacaucauuucaa

SEQ ID NO: 2964536 - RNA, 20 nt, Human
ugauugggcacaucauuuca

SEQ ID NO: 2964537 - RNA, 18 nt, Human
ugauugggcacaucauuu

SEQ ID NO: 2964538 - RNA, 23 nt, Human
ugauugggcacaucauuucaaga

SEQ ID NO: 2964539 - RNA, 17 nt, Human
ugauuuaaacacauuaa

SEQ ID NO: 2964540 - RNA, 16 nt, Human
ugauuuaaacacauua

SEQ ID NO: 2964541 - RNA, 18 nt, Human
ugauuuaaacacauuaaa

SEQ ID NO: 2964542 - RNA, 15 nt, Human
ugauuuaaacacauu

SEQ ID NO: 2964543 - RNA, 17 nt, Human
ugauugccuuuuuauaa

SEQ ID NO: 2964544 - RNA, 22 nt, Human
ugauugccuuuuuauaacuuuu

SEQ ID NO: 2964545 - RNA, 17 nt, Human
ugaacaguaacauagcu

SEQ ID NO: 2964546 - RNA, 13 nt, Human
ugaaaugucaacc

SEQ ID NO: 2964547 - RNA, 20 nt, Human
ucccuucacaaacccagugu

SEQ ID NO: 2964548 - RNA, 16 nt, Human
ucccuuggacauuuua

SEQ ID NO: 2964549 - RNA, 18 nt, Human
ucccuuggacauuuuaug

SEQ ID NO: 2964550 - RNA, 19 nt, Human
ucccuuggacauuuuaugu

SEQ ID NO: 2964551 - RNA, 21 nt, Human
ucccuuggacauuuuaugucu

SEQ ID NO: 2964552 - RNA, 15 nt, Human
ucccuuggacauuuu

SEQ ID NO: 2964553 - RNA, 17 nt, Human
uccuagucauucuuccc

SEQ ID NO: 2964554 - RNA, 22 nt, Human
uccucauuuuuauaaugucccu

SEQ ID NO: 2964555 - RNA, 13 nt, Human
uccuccacauuug

SEQ ID NO: 2964556 - RNA, 16 nt, Human
uccuccacauuuguuu

SEQ ID NO: 2964557 - RNA, 20 nt, Human
uaugauugccuuuuuauaac

SEQ ID NO: 2964558 - RNA, 23 nt, Human
uaugauugccuuuuuauaacuuu

SEQ ID NO: 2964559 - RNA, 18 nt, Human
uaucuguucauauggaua

SEQ ID NO: 2964560 - RNA, 13 nt, Human
uauguuaauauuu

SEQ ID NO: 2964561 - RNA, 16 nt, Human
uauguuaauauuucug

SEQ ID NO: 2964562 - RNA, 14 nt, Human
uauguuaauauuuu

SEQ ID NO: 2964563 - RNA, 13 nt, Human
uauguguucuauu

SEQ ID NO: 2964564 - RNA, 13 nt, Human
uauuauauucauu

SEQ ID NO: 2964565 - RNA, 17 nt, Human
uauuauauucauucuuu

SEQ ID NO: 2964566 - RNA, 23 nt, Human
uauuauauucauucuuuuugaaa

SEQ ID NO: 2964567 - RNA, 18 nt, Human
uauucauucuuuuugaaa

SEQ ID NO: 2964568 - RNA, 23 nt, Human
uauucauucuuuuugaaauguca

SEQ ID NO: 2964569 - RNA, 19 nt, Human
uauugcauacuauuaaaca

SEQ ID NO: 2964570 - RNA, 23 nt, Human
uauugcauacuauuaaacaugcu

SEQ ID NO: 2964571 - RNA, 18 nt, Human
uauuugaaacacugguuu

SEQ ID NO: 2964572 - RNA, 17 nt, Human
uauuuaaauagaugaca

SEQ ID NO: 2964573 - RNA, 15 nt, Human
uauuuaaauagauga

SEQ ID NO: 2964574 - RNA, 12 nt, Human
ucaaauguguac

SEQ ID NO: 2964575 - RNA, 14 nt, Human
guggaaaauaacuc

SEQ ID NO: 2964576 - RNA, 13 nt, Human
gugcuuggcccag

SEQ ID NO: 2964577 - RNA, 14 nt, Human
gugcuuggcccagg

SEQ ID NO: 2964578 - RNA, 15 nt, Human
gugcuuggcccagga

SEQ ID NO: 2964579 - RNA, 16 nt, Human
gugcuuggcccaggag

SEQ ID NO: 2964580 - RNA, 17 nt, Human
gugcuuggcccaggagu

SEQ ID NO: 2964581 - RNA, 19 nt, Human
gugcuuggcccaggaguuu

SEQ ID NO: 2964582 - RNA, 24 nt, Human
gugcuuggcccaggaguuuggcca

SEQ ID NO: 2964583 - RNA, 18 nt, Human
guccugucggagcccugu

SEQ ID NO: 2964584 - RNA, 20 nt, Human
guccugucggagcccugucu

SEQ ID NO: 2964585 - RNA, 21 nt, Human
guccugucggagcccugucuc

SEQ ID NO: 2964586 - RNA, 21 nt, Human
guccuauuauauucauucuuu

SEQ ID NO: 2964587 - RNA, 19 nt, Human
guccuauuauauucauucu

SEQ ID NO: 2964588 - RNA, 20 nt, Human
guagagguacacuugugaau

SEQ ID NO: 2964589 - RNA, 13 nt, Human
gucaaggcuuaga

SEQ ID NO: 2964590 - RNA, 14 nt, Human
gucaaggcuuagac

SEQ ID NO: 2964591 - RNA, 23 nt, Human
gguagaauguuuucaaauguucu

SEQ ID NO: 2964592 - RNA, 21 nt, Human
ggguagccacuggacugacga

SEQ ID NO: 2964593 - RNA, 14 nt, Human
guacacuugugaau

SEQ ID NO: 2964594 - RNA, 15 nt, Human
guacacuugugaaua

SEQ ID NO: 2964595 - RNA, 14 nt, Human
guacauacuuuuug

SEQ ID NO: 2964596 - RNA, 13 nt, Human
guacauacuuuuu

SEQ ID NO: 2964597 - RNA, 19 nt, Human
guacauacuuuuuggguuu

SEQ ID NO: 2964598 - RNA, 18 nt, Human
guacuaacauuuauuuga

SEQ ID NO: 2964599 - RNA, 19 nt, Human
guagagguacacuugugaa

SEQ ID NO: 2964600 - RNA, 17 nt, Human
guagagguacacuugug

SEQ ID NO: 2964601 - RNA, 15 nt, Human
guagagguacacuug

SEQ ID NO: 2964602 - RNA, 14 nt, Human
guacuuuuaagacu

SEQ ID NO: 2964603 - RNA, 16 nt, Human
guaaaaaaugguguuu

SEQ ID NO: 2964604 - RNA, 18 nt, Human
guaaaaaaugguguuuua

SEQ ID NO: 2964605 - RNA, 10 nt, Human
gguugugaau

SEQ ID NO: 2964606 - RNA, 22 nt, Human
guaacuguuuagaugaauguca

SEQ ID NO: 2964607 - RNA, 16 nt, Human
gcugccaauauccuaa

SEQ ID NO: 2964608 - RNA, 17 nt, Human
gcugccaauauccuaau

SEQ ID NO: 2964609 - RNA, 18 nt, Human
gcugccaauauccuaaua

SEQ ID NO: 2964610 - RNA, 19 nt, Human
gcugccaauauccuaauaa

SEQ ID NO: 2964611 - RNA, 14 nt, Human
gcugccaauauccu

SEQ ID NO: 2964612 - RNA, 15 nt, Human
gcugccaauauccua

SEQ ID NO: 2964613 - RNA, 13 nt, Human
gcugcaguuuuuu

SEQ ID NO: 2964614 - RNA, 19 nt, Human
gcucaccccaucaucccuu

SEQ ID NO: 2964615 - RNA, 17 nt, Human
gcucaccccaucauccc

SEQ ID NO: 2964616 - RNA, 18 nt, Human
gccuaauaugaugacugu

SEQ ID NO: 2964617 - RNA, 18 nt, Human
gcccuuuuucaauaacug

SEQ ID NO: 2964618 - RNA, 14 nt, Human
gcccuuuuucaaua

SEQ ID NO: 2964619 - RNA, 20 nt, Human
gcugccaauauccuaauaaa

SEQ ID NO: 2964620 - RNA, 21 nt, Human
gcugccaauauccuaauaaaa

SEQ ID NO: 2964621 - RNA, 23 nt, Human
gcugccaauauccuaauaaaaag

SEQ ID NO: 2964622 - RNA, 21 nt, Human
gcuuaggagaagucuucuauu

SEQ ID NO: 2964623 - RNA, 23 nt, Human
ggaaagggauuuucagcccucag

SEQ ID NO: 2964624 - RNA, 13 nt, Human
ggaaugcaaagau

SEQ ID NO: 2964625 - RNA, 13 nt, Human
ggauacuuauuua

SEQ ID NO: 2964626 - RNA, 22 nt, Human
gauugccuuuuuauaacuuuuu

SEQ ID NO: 2964627 - RNA, 21 nt, Human
gauugccuuuuuauaacuuuu

SEQ ID NO: 2964628 - RNA, 15 nt, Human
gauugccuuuuuaua

SEQ ID NO: 2964629 - RNA, 14 nt, Human
gcaaagaugaaggu

SEQ ID NO: 2964630 - RNA, 18 nt, Human
gcaaagaugaaggucugu

SEQ ID NO: 2964631 - RNA, 16 nt, Human
gauguugcuaacagca

SEQ ID NO: 2964632 - RNA, 13 nt, Human
gcacacugucugc

SEQ ID NO: 2964633 - RNA, 14 nt, Human
gcacauuaaaugac

SEQ ID NO: 2964634 - RNA, 12 nt, Human
gcacauuaaaug

SEQ ID NO: 2964635 - RNA, 21 nt, Human
gcacauuaaaugacucuuccc

SEQ ID NO: 2964636 - RNA, 16 nt, Human
gcacauuaaaugacuc

SEQ ID NO: 2964637 - RNA, 12 nt, Human
gagcccugucuc

SEQ ID NO: 2964638 - RNA, 18 nt, Human
gagguacacuugugaaua

SEQ ID NO: 2964639 - RNA, 19 nt, Human
gacagagccccacccucag

SEQ ID NO: 2964640 - RNA, 22 nt, Human
gaaugucaguuguuauuuauug

SEQ ID NO: 2964641 - RNA, 19 nt, Human
cugugaugacauucccugc

SEQ ID NO: 2964642 - RNA, 21 nt, Human
cugugcaucuagccucaagcu

SEQ ID NO: 2964643 - RNA, 22 nt, Human
cuguaauaaacucauuucuagc

SEQ ID NO: 2964644 - RNA, 21 nt, Human
cugguacucugccacuuuauu

SEQ ID NO: 2964645 - RNA, 22 nt, Human
cuggcacugguuuguucccugu

SEQ ID NO: 2964646 - RNA, 16 nt, Human
cuuagugauguaauua

SEQ ID NO: 2964647 - RNA, 15 nt, Human
cuuagugauguaauu

SEQ ID NO: 2964648 - RNA, 15 nt, Human
cuuauuuccucauuu

SEQ ID NO: 2964649 - RNA, 14 nt, Human
cuuugcaggaaauc

SEQ ID NO: 2964650 - RNA, 17 nt, Human
gaaaaggccuucuuccc

SEQ ID NO: 2964651 - RNA, 21 nt, Human
cuuuuuggguuuauuuggaaa

SEQ ID NO: 2964652 - RNA, 13 nt, Human
cuaccaauauuua

SEQ ID NO: 2964653 - RNA, 15 nt, Human
cuaccaauauuuaau

SEQ ID NO: 2964654 - RNA, 21 nt, Human
cuaccaauauuuaaucuuuua

SEQ ID NO: 2964655 - RNA, 17 nt, Human
cuacauuagguugugaa

SEQ ID NO: 2964656 - RNA, 18 nt, Human
cuacauuagguugugaau

SEQ ID NO: 2964657 - RNA, 17 nt, Human
cuacauugacagauuga

SEQ ID NO: 2964658 - RNA, 21 nt, Human
cuaauaugaugacuguuuuua

SEQ ID NO: 2964659 - RNA, 19 nt, Human
cuaauaugaugacuguuuu

SEQ ID NO: 2964660 - RNA, 20 nt, Human
cuaacagcaacacaaagcuu

SEQ ID NO: 2964661 - RNA, 12 nt, Human
cuauuuauuuau

SEQ ID NO: 2964662 - RNA, 19 nt, Human
cuauuuauuuauuuauuca

SEQ ID NO: 2964663 - RNA, 15 nt, Human
cucacagaagaugaa

SEQ ID NO: 2964664 - RNA, 16 nt, Human
cuauucugagaugacu

SEQ ID NO: 2964665 - RNA, 15 nt, Human
cuauucugagaugac

SEQ ID NO: 2964666 - RNA, 18 nt, Human
cuauucugagaugacuau

SEQ ID NO: 2964667 - RNA, 23 nt, Human
cuauucagcacaaggaaauaaaa

SEQ ID NO: 2964668 - RNA, 18 nt, Human
cuauauaauuccuguuuu

SEQ ID NO: 2964669 - RNA, 20 nt, Human
cuauauaauuccuguuuuua

SEQ ID NO: 2964670 - RNA, 23 nt, Human
cucauuuuuauaaugucccuuca

SEQ ID NO: 2964671 - RNA, 21 nt, Human
cucagaugcacaugagcuggc

SEQ ID NO: 2964672 - RNA, 18 nt, Human
ccagugacagucagggaa

SEQ ID NO: 2964673 - RNA, 13 nt, Human
ccagugagacugu

SEQ ID NO: 2964674 - RNA, 14 nt, Human
ccagcacaaagcag

SEQ ID NO: 2964675 - RNA, 19 nt, Human
aaaaauuuacuuuaaacua

SEQ ID NO: 2964676 - RNA, 18 nt, Human
aaaaauuuacuuuaaacu

SEQ ID NO: 2964677 - RNA, 13 nt, Human
aaaaauuuacuuu

SEQ ID NO: 2964678 - RNA, 19 nt, Human
agccccacccucagaugca

SEQ ID NO: 2964679 - RNA, 20 nt, Human
agauguagacaguuggguuu

SEQ ID NO: 2964680 - RNA, 20 nt, Human
agcagcccucaauugugaaa

SEQ ID NO: 2964681 - RNA, 12 nt, Human
agcaugaagaca

SEQ ID NO: 2964682 - RNA, 16 nt, Human
agagguacacuuguga

SEQ ID NO: 2964683 - RNA, 17 nt, Human
agagguacacuugugaa

SEQ ID NO: 2964684 - RNA, 18 nt, Human
agagguacacuugugaau

SEQ ID NO: 2964685 - RNA, 14 nt, Human
agguacacuuguga

SEQ ID NO: 2964686 - RNA, 16 nt, Human
agguacacuugugaau

SEQ ID NO: 2964687 - RNA, 17 nt, Human
agguacacuugugaaua

SEQ ID NO: 2964688 - RNA, 22 nt, Human
augcuugcugcugauuuaaaca

SEQ ID NO: 2964689 - RNA, 16 nt, Human
augcuugcugcugauu

SEQ ID NO: 2964690 - RNA, 23 nt, Human
augcuugcugcugauuuaaacac

SEQ ID NO: 2964691 - RNA, 21 nt, Human
auuaaaugacucuucccucaa

SEQ ID NO: 2964692 - RNA, 17 nt, Human
auuaaaugacucuuccc

SEQ ID NO: 2964693 - RNA, 18 nt, Human
augacucuucccucaaau

SEQ ID NO: 2964694 - RNA, 18 nt, Human
augacuauucaguggcua

SEQ ID NO: 2964695 - RNA, 23 nt, Human
aucuucuauauaauuccuguuuu

SEQ ID NO: 2964696 - RNA, 14 nt, Human
agucaaggcuuaga

SEQ ID NO: 2964697 - RNA, 16 nt, Human
agucaaggcuuagacc

SEQ ID NO: 2964698 - RNA, 14 nt, Human
agucauucuucccu

SEQ ID NO: 2964699 - RNA, 13 nt, Human
agucauucuuuaa

SEQ ID NO: 2964700 - RNA, 18 nt, Human
agucauuauguuaauauu

SEQ ID NO: 2964701 - RNA, 12 nt, Human
agucauuauguu

SEQ ID NO: 2964702 - RNA, 16 nt, Human
auauaauuccuguuuu

SEQ ID NO: 2964703 - RNA, 22 nt, Human
auauaauuccuguuuuuauuau

SEQ ID NO: 2964704 - RNA, 21 nt, Human
auacuuauuuaaauagaugac

SEQ ID NO: 2964705 - RNA, 15 nt, Human
auacuuauuuaaaua

SEQ ID NO: 2964706 - RNA, 22 nt, Human
auacuuauuuaaauagaugaca

SEQ ID NO: 2964707 - RNA, 17 nt, Human
auauagcaagacauuau

SEQ ID NO: 2964708 - RNA, 11 nt, Human
auaucacuucc

SEQ ID NO: 2964709 - RNA, 19 nt, Human
auaucccuuggacauuuua

SEQ ID NO: 2964710 - RNA, 23 nt, Human
auauccuaauaaaaaggugacca

SEQ ID NO: 2964711 - RNA, 13 nt, Human
auacuuauuuaaa

SEQ ID NO: 2964712 - RNA, 16 nt, Human
acgugcacgcacacug

SEQ ID NO: 2964713 - RNA, 16 nt, Human
acucuaccugcacacu

SEQ ID NO: 2964714 - RNA, 22 nt, Human
acucuauaacaaaggauacuua

SEQ ID NO: 2964715 - RNA, 13 nt, Human
acuuauuuaaaua

SEQ ID NO: 2964716 - RNA, 18 nt, Human
acuuauuuaaauagauga

SEQ ID NO: 2964717 - RNA, 14 nt, Human
acuguuuagaugaa

SEQ ID NO: 2964718 - RNA, 15 nt, Human
acauuaaaugacucu

SEQ ID NO: 2964719 - RNA, 11 nt, Human
acauuaaauga

SEQ ID NO: 2964720 - RNA, 12 nt, Human
acauuaaaugac

SEQ ID NO: 2964721 - RNA, 13 nt, Human
acauuaaagguac

SEQ ID NO: 2964722 - RNA, 18 nt, Human
acacuguccuauuauauu

SEQ ID NO: 2964723 - RNA, 18 nt, Human
acacaaagcuuuugcaua

SEQ ID NO: 2964724 - RNA, 13 nt, Human
acacaaagcuuuu

SEQ ID NO: 2964725 - RNA, 18 nt, Human
aaagaugaaggucuguuu

SEQ ID NO: 2964726 - RNA, 15 nt, Human
aacaaaggauacuua

SEQ ID NO: 2964727 - RNA, 19 nt, Human
aacaaaggauacuuauuua

SEQ ID NO: 2964728 - RNA, 16 nt, Human
aacuuuuuauauucuc

SEQ ID NO: 2964729 - RNA, 23 nt, Human
aacugacacaugcugaacaucac

SEQ ID NO: 2964730 - RNA, 19 nt, Human
aacuuauggggccaaaaua

SEQ ID NO: 2964731 - RNA, 20 nt, Human
aacucaccuggcaucuuaca

SEQ ID NO: 2964732 - RNA, 15 nt, Human
aacugaacuucagag

SEQ ID NO: 2964733 - RNA, 19 nt, Human
aaucacacugucuucugau

SEQ ID NO: 2964734 - RNA, 19 nt, Human
aaugucaguuguuauuuau

SEQ ID NO: 2964735 - RNA, 20 nt, Human
aaugucaguuguuauuuauu

SEQ ID NO: 2964736 - RNA, 22 nt, Human
aaugucaguuguuauuuauuga

SEQ ID NO: 2964737 - RNA, 14 nt, Human
aaugguaguuuuac

SEQ ID NO: 2964738 - RNA, 20 nt, Human
aaguccccucuccuccacau

SEQ ID NO: 2964739 - RNA, 21 nt, Human
aaguccccucuccuccacauu

SEQ ID NO: 2964740 - RNA, 13 nt, Human
aagaaauuugugg

SEQ ID NO: 2964741 - RNA, 15 nt, Human
auucuauguuaauau

SEQ ID NO: 2964742 - RNA, 18 nt, Human
auucuauguuaauauuuu

SEQ ID NO: 2964743 - RNA, 17 nt, Human
auuauauagcaguaaaa

SEQ ID NO: 2964744 - RNA, 16 nt, Human
uuuugccaauuugcac

SEQ ID NO: 2964745 - RNA, 19 nt, Human
uuuugccaauuugcacauu

SEQ ID NO: 2964746 - RNA, 18 nt, Human
uuuugccaauuugcacau

SEQ ID NO: 2964747 - RNA, 15 nt, Human
uuuugcauauugcau

SEQ ID NO: 2964748 - RNA, 18 nt, Human
uuuugcauauugcauacu

SEQ ID NO: 2964749 - RNA, 14 nt, Human
auguguucuauuca

SEQ ID NO: 2964750 - RNA, 13 nt, Human
auguuaauauuuc

SEQ ID NO: 2964751 - RNA, 13 nt, Human
auguuaauauuuu

SEQ ID NO: 2964752 - RNA, 22 nt, Human
auguuaauauuuuagguguaaa

SEQ ID NO: 2964753 - RNA, 16 nt, Human
auuaaacaugcuguac

SEQ ID NO: 2964754 - RNA, 14 nt, Human
auuuuacuuuuugg

SEQ ID NO: 2964755 - RNA, 17 nt, Human
auuuuacuuuuuggaaa

SEQ ID NO: 2964756 - RNA, 18 nt, Human
auuugaagguagaauguu

SEQ ID NO: 2964757 - RNA, 23 nt, Human
auuugaagguagaauguuuucaa

SEQ ID NO: 2964758 - RNA, 23 nt, Human
auuuguuuugccaauuugcacau

SEQ ID NO: 2964759 - RNA, 21 nt, Human
auuuguuuugccaauuugcac

SEQ ID NO: 2964760 - RNA, 14 nt, Human
auuugugagacugu

SEQ ID NO: 2964761 - RNA, 12 nt, Human
auuugugagacu

SEQ ID NO: 2964762 - RNA, 23 nt, Human
auugggcacaucauuucaagaag

SEQ ID NO: 2964763 - RNA, 21 nt, Human
auugggcacaucauuucaaga

SEQ ID NO: 2964764 - RNA, 19 nt, Human
auugggcacaucauuucaa

SEQ ID NO: 2964765 - RNA, 18 nt, Human
auugggcacaucauuuca

SEQ ID NO: 2964766 - RNA, 17 nt, Human
auugggcacaucauuuc

SEQ ID NO: 2964767 - RNA, 16 nt, Human
auucuuuuugaaaugu

SEQ ID NO: 2964768 - RNA, 14 nt, Human
auuuauuuauucau

SEQ ID NO: 2964769 - RNA, 14 nt, Human
auuuauucauuagu

SEQ ID NO: 2964770 - RNA, 12 nt, Human
auuucaagaagu

SEQ ID NO: 2964771 - RNA, 23 nt, Human
auuucaaacagucucccuuccua

SEQ ID NO: 2964772 - RNA, 13 nt, Human
aucuuuuaugauu

SEQ ID NO: 2964773 - RNA, 23 nt, Human
uuggccugucuuuggauuguuaa

SEQ ID NO: 2964774 - RNA, 22 nt, Human
uuguaacuguuuagaugaaugu

SEQ ID NO: 2964775 - RNA, 21 nt, Human
uuguaacuguuuagaugaaug

SEQ ID NO: 2964776 - RNA, 16 nt, Human
uuguuuuuauuaaaag

SEQ ID NO: 2964777 - RNA, 22 nt, Human
uuguucccugugucauuucaaa

SEQ ID NO: 2964778 - RNA, 19 nt, Human
uuguugaggguauguuuua

SEQ ID NO: 2964779 - RNA, 14 nt, Human
uugugaauaaagag

SEQ ID NO: 2964780 - RNA, 22 nt, Human
uugugaaggcaggggaauguau

SEQ ID NO: 2964781 - RNA, 17 nt, Human
uuuagaugaaugucagu

SEQ ID NO: 2964782 - RNA, 22 nt, Human
uuuauauagcaagacauuauau

SEQ ID NO: 2964783 - RNA, 18 nt, Human
uuuauauagcaagacauu

SEQ ID NO: 2964784 - RNA, 16 nt, Human
augccuaccaauauuu

SEQ ID NO: 2964785 - RNA, 17 nt, Human
augccuaccaauauuua

SEQ ID NO: 2964786 - RNA, 23 nt, Human
augccuaccaauauuuaaucuuu

SEQ ID NO: 2964787 - RNA, 23 nt, Human
uuugaaacacugguuuuaaauau

SEQ ID NO: 2964788 - RNA, 13 nt, Human
uuucucauguuga

SEQ ID NO: 2964789 - RNA, 15 nt, Human
uuucucauguugaaa

SEQ ID NO: 2964790 - RNA, 22 nt, Human
uuucucacagaagaugaagcac

SEQ ID NO: 2964791 - RNA, 18 nt, Human
uuucucacagaagaugaa

SEQ ID NO: 2964792 - RNA, 20 nt, Human
uuuccuucaagaaugcagua

SEQ ID NO: 2964793 - RNA, 19 nt, Human
uucauuaguuuugaagauu

SEQ ID NO: 2964794 - RNA, 14 nt, Human
uucauuaguuuuga

SEQ ID NO: 2964795 - RNA, 19 nt, Human
uucauucuuuuugaaaugu

SEQ ID NO: 2964796 - RNA, 16 nt, Human
uuccaguaaugagcuu

SEQ ID NO: 2964797 - RNA, 22 nt, Human
uuccuguuuuuauuauuaacaa

SEQ ID NO: 2964798 - RNA, 19 nt, Human
auauugguugggaugacuu

SEQ ID NO: 2964799 - RNA, 20 nt, Human
auauugguugggaugacuug

SEQ ID NO: 2964800 - RNA, 13 nt, Human
auauuuaaucuuu

SEQ ID NO: 2964801 - RNA, 14 nt, Human
uucucucaucuguu

SEQ ID NO: 2964802 - RNA, 14 nt, Human
aucacuuccaugac

SEQ ID NO: 2964803 - RNA, 16 nt, Human
auccaauugcugcuug

SEQ ID NO: 2964804 - RNA, 14 nt, Human
uugaaggaugcugu

SEQ ID NO: 2964805 - RNA, 16 nt, Human
uugaaggaugcugucu

SEQ ID NO: 2964806 - RNA, 14 nt, Human
uugaaguaaaaugu

SEQ ID NO: 2964807 - RNA, 16 nt, Human
uugaagguagaauguu

SEQ ID NO: 2964808 - RNA, 19 nt, Human
uugaagguagaauguuuuc

SEQ ID NO: 2964809 - RNA, 15 nt, Human
uugaagguagaaugu

SEQ ID NO: 2964810 - RNA, 22 nt, Human
uggaguuauugaagcagagugg

SEQ ID NO: 2964811 - RNA, 20 nt, Human
ugggaaagggauuuucagcc

SEQ ID NO: 2964812 - RNA, 17 nt, Human
aggaagcuuacaugccu

SEQ ID NO: 2964813 - RNA, 18 nt, Human
aggaagcugugagagcag

SEQ ID NO: 2964814 - RNA, 11 nt, Human
ugcuguacaua

SEQ ID NO: 2964815 - RNA, 22 nt, Human
ugcuguacauacuuuuuggguu

SEQ ID NO: 2964816 - RNA, 17 nt, Human
ugcuguacauacuuuuu

SEQ ID NO: 2964817 - RNA, 15 nt, Human
ugcuguacauacuuu

SEQ ID NO: 2964818 - RNA, 18 nt, Human
ugcuuggcccaggaguuu

SEQ ID NO: 2964819 - RNA, 23 nt, Human
ugcuuggcccaggaguuuggcca

SEQ ID NO: 2964820 - RNA, 15 nt, Human
ugcuuggcccaggag

SEQ ID NO: 2964821 - RNA, 16 nt, Human
ugcuuggcccaggagu

SEQ ID NO: 2964822 - RNA, 12 nt, Human
ugcuuggcccag

SEQ ID NO: 2964823 - RNA, 22 nt, Human
uggaaaggaaugcaaagaugaa

SEQ ID NO: 2964824 - RNA, 21 nt, Human
uggaaaggaaugcaaagauga

SEQ ID NO: 2964825 - RNA, 15 nt, Human
uggaaaggaaugcaa

SEQ ID NO: 2964826 - RNA, 12 nt, Human
uggaaaggaaug

SEQ ID NO: 2964827 - RNA, 15 nt, Human
aggaguuuggccaga

SEQ ID NO: 2964828 - RNA, 16 nt, Human
aggaguuuggccagaa

SEQ ID NO: 2964829 - RNA, 17 nt, Human
aggaguuuggccagaag

SEQ ID NO: 2964830 - RNA, 18 nt, Human
aggaguuuggccagaagu

SEQ ID NO: 2964831 - RNA, 14 nt, Human
aggaguuuggccag

SEQ ID NO: 2964832 - RNA, 13 nt, Human
ugaugacuguuuu

SEQ ID NO: 2964833 - RNA, 15 nt, Human
ugaugacauucccug

SEQ ID NO: 2964834 - RNA, 18 nt, Human
ugaugacauucccugcua

SEQ ID NO: 2964835 - RNA, 20 nt, Human
ugauuuagcaggaagcugug

SEQ ID NO: 2964836 - RNA, 17 nt, Human
ugauuuagcaggaagcu

SEQ ID NO: 2964837 - RNA, 11 nt, Human
agcccugucuc

SEQ ID NO: 2964838 - RNA, 18 nt, Human
agcccugucuccucucuc

SEQ ID NO: 2964839 - RNA, 22 nt, Human
ugcagcucuccccuucucugua

SEQ ID NO: 2964840 - RNA, 20 nt, Human
ugcagcucuccccuucucug

SEQ ID NO: 2964841 - RNA, 17 nt, Human
ugccagccacugugaua

SEQ ID NO: 2964842 - RNA, 13 nt, Human
aguuuggccagaa

SEQ ID NO: 2964843 - RNA, 14 nt, Human
aguuuggccagaag

SEQ ID NO: 2964844 - RNA, 16 nt, Human
aguuugguuucuagca

SEQ ID NO: 2964845 - RNA, 12 nt, Human
aguuuggccaga

SEQ ID NO: 2964846 - RNA, 13 nt, Human
uguuuucaaaugu

SEQ ID NO: 2964847 - RNA, 14 nt, Human
uguuuucaaauguu

SEQ ID NO: 2964848 - RNA, 17 nt, Human
uguuuuauauagcaaga

SEQ ID NO: 2964849 - RNA, 21 nt, Human
uguuuuauauagcaagacauu

SEQ ID NO: 2964850 - RNA, 14 nt, Human
uguuuuaggagcau

SEQ ID NO: 2964851 - RNA, 22 nt, Human
aguucuugccuuggcugcaguu

SEQ ID NO: 2964852 - RNA, 23 nt, Human
aguggcagucuucaguuugcaga

SEQ ID NO: 2964853 - RNA, 14 nt, Human
aguuauugaagcag

SEQ ID NO: 2964854 - RNA, 18 nt, Human
aguuauugaagcagagug

SEQ ID NO: 2964855 - RNA, 17 nt, Human
aguuauugaagcagagu

SEQ ID NO: 2964856 - RNA, 16 nt, Human
aguuauugaagcagag

SEQ ID NO: 2964857 - RNA, 23 nt, Human
aguuauugaagcagaguggcagu

SEQ ID NO: 2964858 - RNA, 19 nt, Human
aguuauugaagcagagugg

SEQ ID NO: 2964859 - RNA, 15 nt, Human
uuaucagaacuaugu

SEQ ID NO: 2964860 - RNA, 13 nt, Human
uuauauagcaaga

SEQ ID NO: 2964861 - RNA, 19 nt, Human
uuauauagcaagacauuau

SEQ ID NO: 2964862 - RNA, 16 nt, Human
uuauaacuuuuuauau

SEQ ID NO: 2964863 - RNA, 14 nt, Human
uuauaacuuuuuau

SEQ ID NO: 2964864 - RNA, 21 nt, Human
uuagccguggugauuuagcag

SEQ ID NO: 2964865 - RNA, 15 nt, Human
auaaacucauuucua

SEQ ID NO: 2964866 - RNA, 23 nt, Human
auaacuggaacacucuauaacaa

SEQ ID NO: 2964867 - RNA, 21 nt, Human
auaacuggaacacucuauaac

SEQ ID NO: 2964868 - RNA, 18 nt, Human
auaacuggaacacucuau

SEQ ID NO: 2964869 - RNA, 16 nt, Human
auaacuggaacacucu

SEQ ID NO: 2964870 - RNA, 18 nt, Human
uuagcaggaagcugugag

SEQ ID NO: 2964871 - RNA, 21 nt, Human
aguccccucuccuccacauuu

SEQ ID NO: 2964872 - RNA, 20 nt, Human
ugucaaccccaaguuaguuc

SEQ ID NO: 2964873 - RNA, 22 nt, Human
aguccccucuccuccacauuug

SEQ ID NO: 2964874 - RNA, 15 nt, Human
ugucuccucucucug

SEQ ID NO: 2964875 - RNA, 20 nt, Human
ugugauuuuugguauuugaa

SEQ ID NO: 2964876 - RNA, 21 nt, Human
ugugauuuuugguauuugaaa

SEQ ID NO: 2964877 - RNA, 19 nt, Human
ugugauuuuugguauuuga

SEQ ID NO: 2964878 - RNA, 14 nt, Human
agucuucuauuuau

SEQ ID NO: 2964879 - RNA, 14 nt, Human
aggguuuaaagaug

SEQ ID NO: 2964880 - RNA, 21 nt, Human
aggggcuuaauuauugauguu

SEQ ID NO: 2964881 - RNA, 18 nt, Human
ugguuauuuuacuuuuug

SEQ ID NO: 2964882 - RNA, 15 nt, Human
ugguuauuuuacuuu

SEQ ID NO: 2964883 - RNA, 16 nt, Human
ugguuauuuuacuuuu

SEQ ID NO: 2964884 - RNA, 15 nt, Human
ugguuucuagcauga

SEQ ID NO: 2964885 - RNA, 15 nt, Human
ugguuuguucccugu

SEQ ID NO: 2964886 - RNA, 12 nt, Human
agguugugaaug

SEQ ID NO: 2964887 - RNA, 17 nt, Human
uguagacaguuggguuu

SEQ ID NO: 2964888 - RNA, 18 nt, Human
ugaaguaaaauguggcag

SEQ ID NO: 2964889 - RNA, 19 nt, Human
ugaaguaaaauguggcagg

SEQ ID NO: 2964890 - RNA, 23 nt, Human
agacuuugguuauuuuacuuuuu

SEQ ID NO: 2964891 - RNA, 17 nt, Human
agacuuugguuauuuua

SEQ ID NO: 2964892 - RNA, 21 nt, Human
ugagagcaguuugguuucuag

SEQ ID NO: 2964893 - RNA, 23 nt, Human
ugagagcaguuugguuucuagca

SEQ ID NO: 2964894 - RNA, 16 nt, Human
agaugcacaugagcug

SEQ ID NO: 2964895 - RNA, 13 nt, Human
agaugcacaugag

SEQ ID NO: 2964896 - RNA, 14 nt, Human
ugacagauugaauu

SEQ ID NO: 2964897 - RNA, 13 nt, Human
ugacauucccugc

SEQ ID NO: 2964898 - RNA, 22 nt, Human
ugacuauucugagaugacuauu

SEQ ID NO: 2964899 - RNA, 21 nt, Human
ugacuauucugagaugacuau

SEQ ID NO: 2964900 - RNA, 19 nt, Human
ugacuauucugagaugacu

SEQ ID NO: 2964901 - RNA, 16 nt, Human
ugacuauaaccuuguu

SEQ ID NO: 2964902 - RNA, 11 nt, Human
ugacuguuuuu

SEQ ID NO: 2964903 - RNA, 22 nt, Human
ugacuauuuuuguuuuuauuaa

SEQ ID NO: 2964904 - RNA, 18 nt, Human
ugacuauuuuuguuuuua

SEQ ID NO: 2964905 - RNA, 23 nt, Human
ugacuauuuuuguuuuuauuaaa

SEQ ID NO: 2964906 - RNA, 14 nt, Human
ucugagugcaaacu

SEQ ID NO: 2964907 - RNA, 23 nt, Human
ucugagugcaaacuucagaguuc

SEQ ID NO: 2964908 - RNA, 22 nt, Human
ucugagugcaaacuucagaguu

SEQ ID NO: 2964909 - RNA, 24 nt, Human
agaauugauugggcacaucauuuc

SEQ ID NO: 2964910 - RNA, 23 nt, Human
agaauugauugggcacaucauuu

SEQ ID NO: 2964911 - RNA, 22 nt, Human
agaauugauugggcacaucauu

SEQ ID NO: 2964912 - RNA, 16 nt, Human
agaauugauugggcac

SEQ ID NO: 2964913 - RNA, 22 nt, Human
agacagagccccacccucagau

SEQ ID NO: 2964914 - RNA, 24 nt, Human
agacagagccccacccucagaugc

SEQ ID NO: 2964915 - RNA, 17 nt, Human
ucugugaugacauuccc

SEQ ID NO: 2964916 - RNA, 15 nt, Human
agaauguuuucaaau

SEQ ID NO: 2964917 - RNA, 21 nt, Human
agaauguuuucaaauguucuc

SEQ ID NO: 2964918 - RNA, 23 nt, Human
ucuauaacaaaggauacuuauuu

SEQ ID NO: 2964919 - RNA, 22 nt, Human
ucuauaacaaaggauacuuauu

SEQ ID NO: 2964920 - RNA, 14 nt, Human
ucuauguuaauauu

SEQ ID NO: 2964921 - RNA, 16 nt, Human
ucuauguuaauauuuu

SEQ ID NO: 2964922 - RNA, 13 nt, Human
ucuauuuauuuau

SEQ ID NO: 2964923 - RNA, 14 nt, Human
ucuauuuauuuauu

SEQ ID NO: 2964924 - RNA, 15 nt, Human
ucuauuuauuuguga

SEQ ID NO: 2964925 - RNA, 14 nt, Human
ucucagcagagugc

SEQ ID NO: 2964926 - RNA, 13 nt, Human
ucucagcagagug

SEQ ID NO: 2964927 - RNA, 12 nt, Human
ucucagcagagu

SEQ ID NO: 2964928 - RNA, 15 nt, Human
acuugugaauaaaga

SEQ ID NO: 2964929 - RNA, 21 nt, Human
acuuugguuauuuuacuuuuu

SEQ ID NO: 2964930 - RNA, 13 nt, Human
acuuugguuauuu

SEQ ID NO: 2964931 - RNA, 10 nt, Human
acuuugguua

SEQ ID NO: 2964932 - RNA, 23 nt, Human
acuuugguuauuuuacuuuuugg

SEQ ID NO: 2964933 - RNA, 22 nt, Human
acuuugguuauuuuacuuuuug

SEQ ID NO: 2964934 - RNA, 16 nt, Human
acuuuuuauauucuca

SEQ ID NO: 2964935 - RNA, 15 nt, Human
acuuuuuauauucuc

SEQ ID NO: 2964936 - RNA, 12 nt, Human
acuuuuuauauu

SEQ ID NO: 2964937 - RNA, 22 nt, Human
acuuuuuauauucucagcagag

SEQ ID NO: 2964938 - RNA, 14 nt, Human
uccagucauuaugu

SEQ ID NO: 2964939 - RNA, 15 nt, Human
uccagucauuauguu

SEQ ID NO: 2964940 - RNA, 21 nt, Human
uccagucauuauguuaauauu

SEQ ID NO: 2964941 - RNA, 23 nt, Human
uccagucauuauguuaauauuuc

SEQ ID NO: 2964942 - RNA, 15 nt, Human
acugaacaguaacau

SEQ ID NO: 2964943 - RNA, 21 nt, Human
acugaacaguaacauagcugu

SEQ ID NO: 2964944 - RNA, 22 nt, Human
acucugagugcaaacuucagag

SEQ ID NO: 2964945 - RNA, 17 nt, Human
acucugccacuuuauuu

SEQ ID NO: 2964946 - RNA, 16 nt, Human
acucugccacuuuauu

SEQ ID NO: 2964947 - RNA, 14 nt, Human
ucagcccucagaau

SEQ ID NO: 2964948 - RNA, 15 nt, Human
accccaucaucccuu

SEQ ID NO: 2964949 - RNA, 14 nt, Human
acccucucaaacua

SEQ ID NO: 2964950 - RNA, 15 nt, Human
ucauauggauaaaua

SEQ ID NO: 2964951 - RNA, 19 nt, Human
ucaaucuggauucauauuu

SEQ ID NO: 2964952 - RNA, 14 nt, Human
acauugacuauuuu

SEQ ID NO: 2964953 - RNA, 17 nt, Human
acauugacuauuuuugu

SEQ ID NO: 2964954 - RNA, 11 nt, Human
acauucccugc

SEQ ID NO: 2964955 - RNA, 17 nt, Human
ucaacauuucucauguu

SEQ ID NO: 2964956 - RNA, 21 nt, Human
acaugcuguacauacuuuuug

SEQ ID NO: 2964957 - RNA, 20 nt, Human
acaugcuguacauacuuuuu

SEQ ID NO: 2964958 - RNA, 16 nt, Human
ucacacugucuucuga

SEQ ID NO: 2964959 - RNA, 12 nt, Human
ucaauugugaaa

SEQ ID NO: 2964960 - RNA, 16 nt, Human
aaucuggauucauauu

SEQ ID NO: 2964961 - RNA, 17 nt, Human
aaucuggauucauauuu

SEQ ID NO: 2964962 - RNA, 18 nt, Human
aaucuggauucauauuua

SEQ ID NO: 2964963 - RNA, 19 nt, Human
aaucuggauucauauuuaa

SEQ ID NO: 2964964 - RNA, 23 nt, Human
aaucgcuccaccuugcagcucuc

SEQ ID NO: 2964965 - RNA, 12 nt, Human
uaauaaacucau

SEQ ID NO: 2964966 - RNA, 11 nt, Human
uaaucuuuuau

SEQ ID NO: 2964967 - RNA, 17 nt, Human
uaaugucaguauuucaa

SEQ ID NO: 2964968 - RNA, 13 nt, Human
aauauuuaaucuu

SEQ ID NO: 2964969 - RNA, 21 nt, Human
aauuaaugucaguauuucaac

SEQ ID NO: 2964970 - RNA, 17 nt, Human
aauuauugauguuuuca

SEQ ID NO: 2964971 - RNA, 20 nt, Human
uacucugccacuuuauuucu

SEQ ID NO: 2964972 - RNA, 23 nt, Human
uauguuuuuguucaguuuaucug

SEQ ID NO: 2964973 - RNA, 18 nt, Human
uauucaguggcuaacuug

SEQ ID NO: 2964974 - RNA, 14 nt, Human
acaggcuuagugau

SEQ ID NO: 2964975 - RNA, 20 nt, Human
acaggcuuagugauguaauu

SEQ ID NO: 2964976 - RNA, 19 nt, Human
acaggcuuagugauguaau

SEQ ID NO: 2964977 - RNA, 12 nt, Human
acagauugaauu

SEQ ID NO: 2964978 - RNA, 18 nt, Human
acagauugaauuugccua

SEQ ID NO: 2964979 - RNA, 22 nt, Human
uauccuaauaaaaaggugacca

SEQ ID NO: 2964980 - RNA, 19 nt, Human
uauccuaauaaaaagguga

SEQ ID NO: 2964981 - RNA, 15 nt, Human
uauccuaauaaaaag

SEQ ID NO: 2964982 - RNA, 18 nt, Human
uauccuaauaaaaaggug

SEQ ID NO: 2964983 - RNA, 12 nt, Human
uauccuaauaaa

SEQ ID NO: 2964984 - RNA, 18 nt, Human
uaucccuuggacauuuua

SEQ ID NO: 2964985 - RNA, 19 nt, Human
uaucccuuggacauuuuau

SEQ ID NO: 2964986 - RNA, 17 nt, Human
uaucccuuggacauuuu

SEQ ID NO: 2964987 - RNA, 17 nt, Human
uauaacuuuuuauauuc

SEQ ID NO: 2964988 - RNA, 12 nt, Human
uauaacuuuuua

SEQ ID NO: 2964989 - RNA, 20 nt, Human
uauaacuuuuuauauucuca

SEQ ID NO: 2964990 - RNA, 12 nt, Human
uaggagcaugag

SEQ ID NO: 2964991 - RNA, 20 nt, Human
uaggagaagucuucuauuua

SEQ ID NO: 2964992 - RNA, 18 nt, Human
uagcauguccuaaugcuu

SEQ ID NO: 2964993 - RNA, 19 nt, Human
uagaugacauugacuauuu

SEQ ID NO: 2964994 - RNA, 18 nt, Human
uagaugacauugacuauu

SEQ ID NO: 2964995 - RNA, 24 nt, Human
acaaaggauacuuauuuaaauaga

SEQ ID NO: 2964996 - RNA, 17 nt, Human
acaaaggggcuuaauua

SEQ ID NO: 2964997 - RNA, 14 nt, Human
aacuucagaguucu

SEQ ID NO: 2964998 - RNA, 18 nt, Human
gugcacgcacacugucug

SEQ ID NO: 2964999 - RNA, 15 nt, Human
aacuaaaauguucua

SEQ ID NO: 2965000 - RNA, 20 nt, Human
aacacaaagcuuuugcauau

SEQ ID NO: 2965001 - RNA, 19 nt, Human
aacacaaagcuuuugcaua

SEQ ID NO: 2965002 - RNA, 18 nt, Human
aacacaaagcuuuugcau

SEQ ID NO: 2965003 - RNA, 12 nt, Human
aacacaaagcuu

SEQ ID NO: 2965004 - RNA, 16 nt, Human
aacacugguuuuaaau

SEQ ID NO: 2965005 - RNA, 18 nt, Human
aacacugguuuuaaauau

SEQ ID NO: 2965006 - RNA, 15 nt, Human
aacauagcugugauu

SEQ ID NO: 2965007 - RNA, 19 nt, Human
aagcuuuugcauauugcau

SEQ ID NO: 2965008 - RNA, 15 nt, Human
aagcuuuugcauauu

SEQ ID NO: 2965009 - RNA, 22 nt, Human
aagcuuuugcauauugcauacu

SEQ ID NO: 2965010 - RNA, 13 nt, Human
aagcuuuugcaua

SEQ ID NO: 2965011 - RNA, 15 nt, Human
guuauuuuacuuuuu

SEQ ID NO: 2965012 - RNA, 16 nt, Human
guuauuuuacuuuuug

SEQ ID NO: 2965013 - RNA, 17 nt, Human
aagagggugggugggua

SEQ ID NO: 2965014 - RNA, 13 nt, Human
uaaaaaggugacc

SEQ ID NO: 2965015 - RNA, 15 nt, Human
uaaaaaggugaccau

SEQ ID NO: 2965016 - RNA, 14 nt, Human
aagguagaauguuu

SEQ ID NO: 2965017 - RNA, 13 nt, Human
aagguagaauguu

SEQ ID NO: 2965018 - RNA, 22 nt, Human
cuucucuguauuccuagaaacu

SEQ ID NO: 2965019 - RNA, 16 nt, Human
cuucuauuuauuuauu

SEQ ID NO: 2965020 - RNA, 22 nt, Human
cuucuauuuauuuauuuauuca

SEQ ID NO: 2965021 - RNA, 14 nt, Human
cuucuauauaauuc

SEQ ID NO: 2965022 - RNA, 15 nt, Human
cuuuaagaacuaaaa

SEQ ID NO: 2965023 - RNA, 16 nt, Human
cuuggcccaggaguuu

SEQ ID NO: 2965024 - RNA, 20 nt, Human
cuuggcccaggaguuuggcc

SEQ ID NO: 2965025 - RNA, 22 nt, Human
cuuggcccaggaguuuggccag

SEQ ID NO: 2965026 - RNA, 23 nt, Human
cuuggcccaggaguuuggccaga

SEQ ID NO: 2965027 - RNA, 15 nt, Human
cuuggcccaggaguu

SEQ ID NO: 2965028 - RNA, 24 nt, Human
cuggaguuauugaagcagaguggc

SEQ ID NO: 2965029 - RNA, 23 nt, Human
cuggaguuauugaagcagagugg

SEQ ID NO: 2965030 - RNA, 21 nt, Human
cuggaguuauugaagcagagu

SEQ ID NO: 2965031 - RNA, 22 nt, Human
cuggaguuauugaagcagagug

SEQ ID NO: 2965032 - RNA, 23 nt, Human
cugucggagcccugucuccucuc

SEQ ID NO: 2965033 - RNA, 19 nt, Human
gacacuucacgcccuuggc

SEQ ID NO: 2965034 - RNA, 16 nt, Human
gacauuuuaugucuuu

SEQ ID NO: 2965035 - RNA, 20 nt, Human
gacauuuuaugucuuucuug

SEQ ID NO: 2965036 - RNA, 18 nt, Human
gacccucaugcugccaau

SEQ ID NO: 2965037 - RNA, 21 nt, Human
gacccucaugcugccaauauc

SEQ ID NO: 2965038 - RNA, 22 nt, Human
gacccucaugcugccaauaucc

SEQ ID NO: 2965039 - RNA, 23 nt, Human
gacccucaugcugccaauauccu

SEQ ID NO: 2965040 - RNA, 12 nt, Human
gacccucaugcu

SEQ ID NO: 2965041 - RNA, 14 nt, Human
gacccucaugcugc

SEQ ID NO: 2965042 - RNA, 16 nt, Human
gacccucaugcugcca

SEQ ID NO: 2965043 - RNA, 17 nt, Human
gacccucaugcugccaa

SEQ ID NO: 2965044 - RNA, 17 nt, Human
gaauguuuucaaauguu

SEQ ID NO: 2965045 - RNA, 16 nt, Human
gagccccacccucaga

SEQ ID NO: 2965046 - RNA, 17 nt, Human
gagccccacccucagau

SEQ ID NO: 2965047 - RNA, 15 nt, Human
gcagcucuccccuuc

SEQ ID NO: 2965048 - RNA, 14 nt, Human
gcagucuucaguuu

SEQ ID NO: 2965049 - RNA, 20 nt, Human
ggaaugauauaagguuuuuu

SEQ ID NO: 2965050 - RNA, 13 nt, Human
ggaaaggaaugca

SEQ ID NO: 2965051 - RNA, 17 nt, Human
ggaaaggaaugcaaaga

SEQ ID NO: 2965052 - RNA, 13 nt, Human
gcuuuugcauauu

SEQ ID NO: 2965053 - RNA, 19 nt, Human
gcccaggaguuuggccaga

SEQ ID NO: 2965054 - RNA, 20 nt, Human
gcccaggaguuuggccagaa

SEQ ID NO: 2965055 - RNA, 19 nt, Human
aaaauaauuagguauuuuc

SEQ ID NO: 2965056 - RNA, 21 nt, Human
aaaaggaagcuuacaugccua

SEQ ID NO: 2965057 - RNA, 20 nt, Human
aaaaugguguuuuaucuucu

SEQ ID NO: 2965058 - RNA, 16 nt, Human
gggguaaggugcaucu

SEQ ID NO: 2965059 - RNA, 15 nt, Human
aaacauuucauuucc

SEQ ID NO: 2965060 - RNA, 16 nt, Human
gguauagauguugcua

SEQ ID NO: 2965061 - RNA, 22 nt, Human
aaauaucccuuggacauuuuau

SEQ ID NO: 2965062 - RNA, 23 nt, Human
aaauaucccuuggacauuuuaug

SEQ ID NO: 2965063 - RNA, 21 nt, Human
aaauauugguugggaugacuu

SEQ ID NO: 2965064 - RNA, 17 nt, Human
guaacauagcugugauu

SEQ ID NO: 2965065 - RNA, 17 nt, Human
aaauaauuagguauuuu

SEQ ID NO: 2965066 - RNA, 13 nt, Human
guaauaaacucau

SEQ ID NO: 2965067 - RNA, 21 nt, Human
aaagggguaggguuuaaagau

SEQ ID NO: 2965068 - RNA, 15 nt, Human
ggcacaucauuucaa

SEQ ID NO: 2965069 - RNA, 14 nt, Human
ggcacaucauuuca

SEQ ID NO: 2965070 - RNA, 23 nt, Human
ggauugugccuaauguguuugag

SEQ ID NO: 2965071 - RNA, 19 nt, Human
ggaguuauugaagcagagu

SEQ ID NO: 2965072 - RNA, 15 nt, Human
ggcuaacuuggguua

SEQ ID NO: 2965073 - RNA, 19 nt, Human
caauaaacauuucauuucc

SEQ ID NO: 2965074 - RNA, 13 nt, Human
caccuugcagcuc

SEQ ID NO: 2965075 - RNA, 15 nt, Human
caccuugcagcucuc

SEQ ID NO: 2965076 - RNA, 22 nt, Human
caccuugcagcucuccccuucu

SEQ ID NO: 2965077 - RNA, 12 nt, Human
cacuugugaaua

SEQ ID NO: 2965078 - RNA, 11 nt, Human
cacuugugaau

SEQ ID NO: 2965079 - RNA, 20 nt, Human
caagaaguccccucuccucc

SEQ ID NO: 2965080 - RNA, 19 nt, Human
auucugagaugacuauuca

SEQ ID NO: 2965081 - RNA, 15 nt, Human
auuucucauguugaa

SEQ ID NO: 2965082 - RNA, 23 nt, Human
auuucaagaaguccccucuccuc

SEQ ID NO: 2965083 - RNA, 14 nt, Human
auuuaaucuuuuau

SEQ ID NO: 2965084 - RNA, 17 nt, Human
auuuaaucuuuuaugau

SEQ ID NO: 2965085 - RNA, 20 nt, Human
cauuauauagcaguaaaaaa

SEQ ID NO: 2965086 - RNA, 16 nt, Human
cauuaguuuugaagau

SEQ ID NO: 2965087 - RNA, 17 nt, Human
cauuauauagcaguaaa

SEQ ID NO: 2965088 - RNA, 14 nt, Human
cauuaguuuugaag

SEQ ID NO: 2965089 - RNA, 15 nt, Human
cauuaguuuugaaga

SEQ ID NO: 2965090 - RNA, 18 nt, Human
caucuguuacacaaagaa

SEQ ID NO: 2965091 - RNA, 14 nt, Human
cauauggauaaaua

SEQ ID NO: 2965092 - RNA, 20 nt, Human
ccaggauuauugucaaagaa

SEQ ID NO: 2965093 - RNA, 20 nt, Human
ccucaugcugccaauauccu

SEQ ID NO: 2965094 - RNA, 21 nt, Human
ccucaugcugccaauauccua

SEQ ID NO: 2965095 - RNA, 21 nt, Human
ccucauuuuuauaaugucccu

SEQ ID NO: 2965096 - RNA, 19 nt, Human
cccugucuccucucucugu

SEQ ID NO: 2965097 - RNA, 17 nt, Human
ccugucggagcccuguc

SEQ ID NO: 2965098 - RNA, 21 nt, Human
ccugucggagcccugucuccu

SEQ ID NO: 2965099 - RNA, 16 nt, Human
ccugucggagcccugu

SEQ ID NO: 2965100 - RNA, 22 nt, Human
ccugucggagcccugucuccuc

SEQ ID NO: 2965101 - RNA, 21 nt, Human
cuauuaaacaugcuguacaua

SEQ ID NO: 2965102 - RNA, 21 nt, Human
cuauuuuuguuuuuauuaaaa

SEQ ID NO: 2965103 - RNA, 15 nt, Human
cuauuuuuguuuuua

SEQ ID NO: 2965104 - RNA, 21 nt, Human
cucaaacuaacaggcuuagug

SEQ ID NO: 2965105 - RNA, 21 nt, Human
cucaauaaacauuucauuucc

SEQ ID NO: 2965106 - RNA, 17 nt, Human
cucaauaaacauuucau

SEQ ID NO: 2965107 - RNA, 13 nt, Human
cucaauugugaaa

SEQ ID NO: 2965108 - RNA, 12 nt, Human
cucaauugugaa

SEQ ID NO: 2965109 - RNA, 20 nt, Human
cgugugugugcguccugucg

SEQ ID NO: 2965110 - RNA, 15 nt, Human
cuaauaaaaagguga

SEQ ID NO: 2965111 - RNA, 14 nt, Human
cuaauaaaaaggug

SEQ ID NO: 2965112 - RNA, 13 nt, Human
cuaauaaaaaggu

SEQ ID NO: 2965113 - RNA, 11 nt, Human
cuaauaaaaag

SEQ ID NO: 2965114 - RNA, 16 nt, Human
ccuuuuucaauaacug

SEQ ID NO: 2965115 - RNA, 21 nt, Human
ccuuuuuauaacuuuuuauau

SEQ ID NO: 2965116 - RNA, 15 nt, Human
ccuuuuuauaacuuu

SEQ ID NO: 2965117 - RNA, 12 nt, Human
ccuuuuuauaac

SEQ ID NO: 2965118 - RNA, 22 nt, Human
cguggugauuuagcaggaagcu

SEQ ID NO: 2965119 - RNA, 15 nt, Human
cguggugauuuagca

SEQ ID NO: 2965120 - RNA, 16 nt, Human
cucuccccuucucugu

SEQ ID NO: 2965121 - RNA, 21 nt, Human
cacaguguguggucaacauuu

SEQ ID NO: 2965122 - RNA, 23 nt, Human
cacaguguguggucaacauuucu

SEQ ID NO: 2965123 - RNA, 20 nt, Human
caaacuaacaggcuuaguga

SEQ ID NO: 2965124 - RNA, 16 nt, Human
caaacuaacaggcuua

SEQ ID NO: 2965125 - RNA, 14 nt, Human
caaacuaacaggcu

SEQ ID NO: 2965126 - RNA, 18 nt, Human
caaggcuuagacccucau

SEQ ID NO: 2965127 - RNA, 15 nt, Human
caaggcugugcaucu

SEQ ID NO: 2965128 - RNA, 15 nt, Human
caaggcuuagacccu

SEQ ID NO: 2965129 - RNA, 14 nt, Human
caaggcuuagaccc

SEQ ID NO: 2965130 - RNA, 19 nt, Human
caaugagaucauugugaag

SEQ ID NO: 2965131 - RNA, 22 nt, Human
caauuugcacauuaaaugacuc

SEQ ID NO: 2965132 - RNA, 15 nt, Human
caauuugcacauuaa

SEQ ID NO: 2965133 - RNA, 14 nt, Human
caauuugcacauua

SEQ ID NO: 2965134 - RNA, 16 nt, Human
caaguuaguucaaucu

SEQ ID NO: 2965135 - RNA, 23 nt, Human
caaucugugaugacauucccugc

SEQ ID NO: 2965136 - RNA, 20 nt, Human
caaucuggauucauauuuaa

SEQ ID NO: 2965137 - RNA, 16 nt, Human
caaucuggauucauau

SEQ ID NO: 2965138 - RNA, 20 nt, Human
uucuucccaauagcaaggcu

SEQ ID NO: 2965139 - RNA, 15 nt, Human
uucuggacuaaaacu

SEQ ID NO: 2965140 - RNA, 22 nt, Human
uugauugggcacaucauuucaa

SEQ ID NO: 2965141 - RNA, 17 nt, Human
uugauugggcacaucau

SEQ ID NO: 2965142 - RNA, 16 nt, Human
uugauugggcacauca

SEQ ID NO: 2965143 - RNA, 21 nt, Human
uugacuauuuuuguuuuuauu

SEQ ID NO: 2965144 - RNA, 22 nt, Human
uucucauguugaaacuuuaaga

SEQ ID NO: 2965145 - RNA, 21 nt, Human
uucuauauaauuccuguuuuu

SEQ ID NO: 2965146 - RNA, 14 nt, Human
uucacgcccuuggc

SEQ ID NO: 2965147 - RNA, 16 nt, Human
uuauuuggaaaggaau

SEQ ID NO: 2965148 - RNA, 22 nt, Human
uuauuugaguggaguuacugaa

SEQ ID NO: 2965149 - RNA, 20 nt, Human
uuauuuggaaaggaaugcaa

SEQ ID NO: 2965150 - RNA, 22 nt, Human
uucaauaacuggaacacucuau

SEQ ID NO: 2965151 - RNA, 16 nt, Human
uucaauaacuggaaca

SEQ ID NO: 2965152 - RNA, 12 nt, Human
uucaauaacugg

SEQ ID NO: 2965153 - RNA, 14 nt, Human
uuagugauguaauu

SEQ ID NO: 2965154 - RNA, 17 nt, Human
uuauaacuuuuuauauu

SEQ ID NO: 2965155 - RNA, 21 nt, Human
uuauauucucagcagagugcu

SEQ ID NO: 2965156 - RNA, 20 nt, Human
uuauauucucagcagagugc

SEQ ID NO: 2965157 - RNA, 19 nt, Human
uuauauucucagcagagug

SEQ ID NO: 2965158 - RNA, 18 nt, Human
uuauauucucagcagagu

SEQ ID NO: 2965159 - RNA, 16 nt, Human
uuauauucucagcaga

SEQ ID NO: 2965160 - RNA, 15 nt, Human
uuaugauugccuuuu

SEQ ID NO: 2965161 - RNA, 21 nt, Human
uuaugauugccuuuuuauaac

SEQ ID NO: 2965162 - RNA, 16 nt, Human
uuauuaacaaaacagu

SEQ ID NO: 2965163 - RNA, 20 nt, Human
uugugaaaaaauuuacuuua

SEQ ID NO: 2965164 - RNA, 15 nt, Human
uugguauuugaaaca

SEQ ID NO: 2965165 - RNA, 15 nt, Human
uugugccuaaugugu

SEQ ID NO: 2965166 - RNA, 18 nt, Human
uugugccuaauguguuug

SEQ ID NO: 2965167 - RNA, 13 nt, Human
uuuauaacuuuuu

SEQ ID NO: 2965168 - RNA, 16 nt, Human
uuuauaacuuuuuaua

SEQ ID NO: 2965169 - RNA, 14 nt, Human
uuuacuuuaaacua

SEQ ID NO: 2965170 - RNA, 17 nt, Human
uuuaagaacuaaaaugu

SEQ ID NO: 2965171 - RNA, 16 nt, Human
uuuaagacccucucaa

SEQ ID NO: 2965172 - RNA, 21 nt, Human
uuuugaagauucuauguuaau

SEQ ID NO: 2965173 - RNA, 13 nt, Human
uuugguauuugaa

SEQ ID NO: 2965174 - RNA, 18 nt, Human
uuuggaaaggaaugcaaa

SEQ ID NO: 2965175 - RNA, 17 nt, Human
uuuggaaaggaaugcaa

SEQ ID NO: 2965176 - RNA, 16 nt, Human
uuuggaaaggaaugca

SEQ ID NO: 2965177 - RNA, 19 nt, Human
uuuggaaaggaaugcaaag

SEQ ID NO: 2965178 - RNA, 15 nt, Human
uuugcaggaaauccu

SEQ ID NO: 2965179 - RNA, 22 nt, Human
uuugaguggaguuacugaacag

SEQ ID NO: 2965180 - RNA, 15 nt, Human
uuuucaaauguucuc

SEQ ID NO: 2965181 - RNA, 13 nt, Human
uuuuauauagcaa

SEQ ID NO: 2965182 - RNA, 13 nt, Human
uuuuaucuucuau

SEQ ID NO: 2965183 - RNA, 17 nt, Human
ugcacgcacacugucug

SEQ ID NO: 2965184 - RNA, 16 nt, Human
ugcacgcacacugucu

SEQ ID NO: 2965185 - RNA, 22 nt, Human
ugcagaguaggggucugucuuu

SEQ ID NO: 2965186 - RNA, 16 nt, Human
ugauguaauuaugguu

SEQ ID NO: 2965187 - RNA, 16 nt, Human
uggacauuuuaugucu

SEQ ID NO: 2965188 - RNA, 17 nt, Human
uggacauuuuaugucuu

SEQ ID NO: 2965189 - RNA, 11 nt, Human
uggacauuuua

SEQ ID NO: 2965190 - RNA, 13 nt, Human
uggacauuuuaug

SEQ ID NO: 2965191 - RNA, 20 nt, Human
uggauugugccuaauguguu

SEQ ID NO: 2965192 - RNA, 23 nt, Human
uggauugugccuaauguguuuga

SEQ ID NO: 2965193 - RNA, 19 nt, Human
uggauugugccuaaugugu

SEQ ID NO: 2965194 - RNA, 14 nt, Human
uggaaaagaauaaa

SEQ ID NO: 2965195 - RNA, 14 nt, Human
ugucuuuuaaacuc

SEQ ID NO: 2965196 - RNA, 15 nt, Human
uguccuauuauauuc

SEQ ID NO: 2965197 - RNA, 19 nt, Human
ucuguuuuguguacuuuua

SEQ ID NO: 2965198 - RNA, 13 nt, Human
ucuguuuugugua

SEQ ID NO: 2965199 - RNA, 22 nt, Human
ucucuguaauaaacucauuucu

SEQ ID NO: 2965200 - RNA, 18 nt, Human
ucucuguaauaaacucau

SEQ ID NO: 2965201 - RNA, 18 nt, Human
uccuaauaaaaaggugac

SEQ ID NO: 2965202 - RNA, 16 nt, Human
uccuaauaaaaaggug

SEQ ID NO: 2965203 - RNA, 17 nt, Human
uccuaauaaaaagguga

SEQ ID NO: 2965204 - RNA, 12 nt, Human
uccuaauaaaaa

SEQ ID NO: 2965205 - RNA, 13 nt, Human
uccuaauaaaaag

SEQ ID NO: 2965206 - RNA, 14 nt, Human
uccuaauaaaaagg

SEQ ID NO: 2965207 - RNA, 15 nt, Human
uccuaauaaaaaggu

SEQ ID NO: 2965208 - RNA, 12 nt, Human
uccuauuauauu

SEQ ID NO: 2965209 - RNA, 22 nt, Human
ucuaaauaucccuuggacauuu

SEQ ID NO: 2965210 - RNA, 22 nt, Human
uccugucggagcccugucuccu

SEQ ID NO: 2965211 - RNA, 19 nt, Human
uccugucggagcccugucu

SEQ ID NO: 2965212 - RNA, 17 nt, Human
uauuuucuccaaauguu

SEQ ID NO: 2965213 - RNA, 15 nt, Human
uauucucagcagagu

SEQ ID NO: 2965214 - RNA, 21 nt, Human
uauucucagcagagugcuuua

SEQ ID NO: 2965215 - RNA, 17 nt, Human
uauucucagcagagugc

SEQ ID NO: 2965216 - RNA, 13 nt, Human
uauugauguuuuc

SEQ ID NO: 2965217 - RNA, 14 nt, Human
uauugauguuuuca

SEQ ID NO: 2965218 - RNA, 13 nt, Human
uauuaacaaaaca

SEQ ID NO: 2965219 - RNA, 14 nt, Human
ucauuaguuuugaa

SEQ ID NO: 2965220 - RNA, 23 nt, Human
ucauuaguuuugaagauucuaug

SEQ ID NO: 2965221 - RNA, 21 nt, Human
ucaugcugccaauauccuaau

SEQ ID NO: 2965222 - RNA, 23 nt, Human
ucaugcugccaauauccuaauaa

SEQ ID NO: 2965223 - RNA, 16 nt, Human
ucauuauguuaauauu

SEQ ID NO: 2965224 - RNA, 17 nt, Human
ucauuauguuaauauuu

SEQ ID NO: 2965225 - RNA, 13 nt, Human
ucaugcugccaau

SEQ ID NO: 2965226 - RNA, 17 nt, Human
ucaugcugccaauaucc

SEQ ID NO: 2965227 - RNA, 19 nt, Human
ucaugcugccaauauccua

SEQ ID NO: 2965228 - RNA, 20 nt, Human
ucaugcugccaauauccuaa

SEQ ID NO: 2965229 - RNA, 17 nt, Human
ucacugguacucugcca

SEQ ID NO: 2965230 - RNA, 22 nt, Human
ggcuuagacccucaugcugcca

SEQ ID NO: 2965231 - RNA, 23 nt, Human
ggcuuagacccucaugcugccaa

SEQ ID NO: 2965232 - RNA, 20 nt, Human
ggcuuagacccucaugcugc

SEQ ID NO: 2965233 - RNA, 18 nt, Human
ggcuuagacccucaugcu

SEQ ID NO: 2965234 - RNA, 15 nt, Human
ggcuggaguuauuga

SEQ ID NO: 2965235 - RNA, 23 nt, Human
ggcuggaguuauugaagcagagu

SEQ ID NO: 2965236 - RNA, 19 nt, Human
ggauugaaggaugcugucu

SEQ ID NO: 2965237 - RNA, 17 nt, Human
ggcagugcuuggcccag

SEQ ID NO: 2965238 - RNA, 18 nt, Human
ggcagugcuuggcccagg

SEQ ID NO: 2965239 - RNA, 19 nt, Human
ggcagugcuuggcccagga

SEQ ID NO: 2965240 - RNA, 20 nt, Human
ggcagugcuuggcccaggag

SEQ ID NO: 2965241 - RNA, 21 nt, Human
ggcagugcuuggcccaggagu

SEQ ID NO: 2965242 - RNA, 22 nt, Human
ggcagugcuuggcccaggaguu

SEQ ID NO: 2965243 - RNA, 23 nt, Human
ggcagugcuuggcccaggaguuu

SEQ ID NO: 2965244 - RNA, 16 nt, Human
ggcagugcuuggccca

SEQ ID NO: 2965245 - RNA, 15 nt, Human
ggacauuuuaugucu

SEQ ID NO: 2965246 - RNA, 19 nt, Human
ggagaagucuucuauuuau

SEQ ID NO: 2965247 - RNA, 20 nt, Human
ggagaagucuucuauuuauu

SEQ ID NO: 2965248 - RNA, 18 nt, Human
ggagcccugucuccucuc

SEQ ID NO: 2965249 - RNA, 23 nt, Human
ggagcccugucuccucucucugu

SEQ ID NO: 2965250 - RNA, 23 nt, Human
gccuuguuuaaugguaguuuuac

SEQ ID NO: 2965251 - RNA, 15 nt, Human
gccuuguuuaauggu

SEQ ID NO: 2965252 - RNA, 14 nt, Human
gcugaccuugcuga

SEQ ID NO: 2965253 - RNA, 19 nt, Human
gcugauuuaaacacauuaa

SEQ ID NO: 2965254 - RNA, 22 nt, Human
gcuuacaugccuaccaauauuu

SEQ ID NO: 2965255 - RNA, 16 nt, Human
gcuuagacccucaugc

SEQ ID NO: 2965256 - RNA, 21 nt, Human
gcuuagacccucaugcugcca

SEQ ID NO: 2965257 - RNA, 22 nt, Human
gcagaguaggggucugucuuuu

SEQ ID NO: 2965258 - RNA, 16 nt, Human
gcaggaagcugugaga

SEQ ID NO: 2965259 - RNA, 15 nt, Human
gcacgcacacugucu

SEQ ID NO: 2965260 - RNA, 16 nt, Human
gcacgcacacugucug

SEQ ID NO: 2965261 - RNA, 21 nt, Human
gcauacuauuaaacaugcugu

SEQ ID NO: 2965262 - RNA, 17 nt, Human
gcauacuauuaaacaug

SEQ ID NO: 2965263 - RNA, 14 nt, Human
gcauacuauuaaac

SEQ ID NO: 2965264 - RNA, 13 nt, Human
gcauacuauuaaa

SEQ ID NO: 2965265 - RNA, 22 nt, Human
gcauacugccuuguuuaauggu

SEQ ID NO: 2965266 - RNA, 12 nt, Human
gccaauuugcac

SEQ ID NO: 2965267 - RNA, 14 nt, Human
gccaauauccuaau

SEQ ID NO: 2965268 - RNA, 15 nt, Human
gccaauauccuaaua

SEQ ID NO: 2965269 - RNA, 16 nt, Human
gccaauauccuaauaa

SEQ ID NO: 2965270 - RNA, 17 nt, Human
gccaauauccuaauaaa

SEQ ID NO: 2965271 - RNA, 13 nt, Human
gccaauauccuaa

SEQ ID NO: 2965272 - RNA, 18 nt, Human
gccaauauccuaauaaaa

SEQ ID NO: 2965273 - RNA, 19 nt, Human
gccaauauccuaauaaaaa

SEQ ID NO: 2965274 - RNA, 20 nt, Human
gccaauauccuaauaaaaag

SEQ ID NO: 2965275 - RNA, 22 nt, Human
gccaauauccuaauaaaaaggu

SEQ ID NO: 2965276 - RNA, 23 nt, Human
gccaauauccuaauaaaaaggug

SEQ ID NO: 2965277 - RNA, 17 nt, Human
gaguuauugaagcagag

SEQ ID NO: 2965278 - RNA, 18 nt, Human
gauugugccuaauguguu

SEQ ID NO: 2965279 - RNA, 20 nt, Human
gauucuauguuaauauuuua

SEQ ID NO: 2965280 - RNA, 17 nt, Human
gauucuauguuaauauu

SEQ ID NO: 2965281 - RNA, 15 nt, Human
gaugacuguuuuuaa

SEQ ID NO: 2965282 - RNA, 23 nt, Human
cugacgacuugagugcucaguag

SEQ ID NO: 2965283 - RNA, 17 nt, Human
cugaacaucacagcuua

SEQ ID NO: 2965284 - RNA, 22 nt, Human
cugauuuaaacacauuaaaggu

SEQ ID NO: 2965285 - RNA, 13 nt, Human
cucagcagagugc

SEQ ID NO: 2965286 - RNA, 12 nt, Human
cucagcagagug

SEQ ID NO: 2965287 - RNA, 11 nt, Human
cucagcagagu

SEQ ID NO: 2965288 - RNA, 16 nt, Human
cucagcagagugcuuu

SEQ ID NO: 2965289 - RNA, 15 nt, Human
cucaagucuggcaga

SEQ ID NO: 2965290 - RNA, 22 nt, Human
cuaugcuguucacuggacacuu

SEQ ID NO: 2965291 - RNA, 22 nt, Human
cuaugggguaaaagggguaggg

SEQ ID NO: 2965292 - RNA, 17 nt, Human
cuccaccuugcagcucu

SEQ ID NO: 2965293 - RNA, 13 nt, Human
cuccacauuuguu

SEQ ID NO: 2965294 - RNA, 15 nt, Human
cuccacauuuguuuu

SEQ ID NO: 2965295 - RNA, 14 nt, Human
cucauuucuagcag

SEQ ID NO: 2965296 - RNA, 17 nt, Human
cucauguugaaacuuua

SEQ ID NO: 2965297 - RNA, 16 nt, Human
cuuguuuaaugguagu

SEQ ID NO: 2965298 - RNA, 19 nt, Human
cuuuaaacuacauuagguu

SEQ ID NO: 2965299 - RNA, 13 nt, Human
gaaacacugguuu

SEQ ID NO: 2965300 - RNA, 22 nt, Human
gaaacacugguuuuaaauauuu

SEQ ID NO: 2965301 - RNA, 18 nt, Human
gaaguaaaauguggcagg

SEQ ID NO: 2965302 - RNA, 17 nt, Human
gaaguaaaauguggcag

SEQ ID NO: 2965303 - RNA, 20 nt, Human
gaagguagaauguuuucaaa

SEQ ID NO: 2965304 - RNA, 16 nt, Human
gaagguagaauguuuu

SEQ ID NO: 2965305 - RNA, 17 nt, Human
gaagguagaauguuuuc

SEQ ID NO: 2965306 - RNA, 15 nt, Human
gaagguagaauguuu

SEQ ID NO: 2965307 - RNA, 14 nt, Human
gaagaaaauaauua

SEQ ID NO: 2965308 - RNA, 23 nt, Human
cugggguggguggggcagugcuu

SEQ ID NO: 2965309 - RNA, 15 nt, Human
cugucuuuuaaacuc

SEQ ID NO: 2965310 - RNA, 14 nt, Human
cugucuuuuaaacu

SEQ ID NO: 2965311 - RNA, 22 nt, Human
cugugauuuuugguauuugaaa

SEQ ID NO: 2965312 - RNA, 15 nt, Human
cuguguuguacagcu

SEQ ID NO: 2965313 - RNA, 23 nt, Human
cuuagacccucaugcugccaaua

SEQ ID NO: 2965314 - RNA, 19 nt, Human
cuuagacccucaugcugcc

SEQ ID NO: 2965315 - RNA, 20 nt, Human
cuuagacccucaugcugcca

SEQ ID NO: 2965316 - RNA, 21 nt, Human
cuuagacccucaugcugccaa

SEQ ID NO: 2965317 - RNA, 22 nt, Human
cuuagacccucaugcugccaau

SEQ ID NO: 2965318 - RNA, 10 nt, Human
cuuaauuauu

SEQ ID NO: 2965319 - RNA, 16 nt, Human
cuuaauuauugauguu

SEQ ID NO: 2965320 - RNA, 20 nt, Human
cuguuuuuauuauuaacaaa

SEQ ID NO: 2965321 - RNA, 18 nt, Human
cuguuuuuauuauuaaca

SEQ ID NO: 2965322 - RNA, 14 nt, Human
cuucaagaaugcag

SEQ ID NO: 2965323 - RNA, 16 nt, Human
cuuccacuugaguguc

SEQ ID NO: 2965324 - RNA, 12 nt, Human
cccuaaucuucc

SEQ ID NO: 2965325 - RNA, 15 nt, Human
ccuccacauuuguuu

SEQ ID NO: 2965326 - RNA, 15 nt, Human
ccuguuuuuauuauu

SEQ ID NO: 2965327 - RNA, 14 nt, Human
ccuguuuuuauuau

SEQ ID NO: 2965328 - RNA, 13 nt, Human
ccuuguuuaaugg

SEQ ID NO: 2965329 - RNA, 23 nt, Human
ccuucuucccaauagcaaggcug

SEQ ID NO: 2965330 - RNA, 19 nt, Human
ccaguguuuuaggagcaug

SEQ ID NO: 2965331 - RNA, 12 nt, Human
cagugcuuggcc

SEQ ID NO: 2965332 - RNA, 21 nt, Human
cauauugcauacuauuaaaca

SEQ ID NO: 2965333 - RNA, 19 nt, Human
cauauugcauacuauuaaa

SEQ ID NO: 2965334 - RNA, 22 nt, Human
cauauugcauacuauuaaacau

SEQ ID NO: 2965335 - RNA, 17 nt, Human
cauauuuaauuugaagg

SEQ ID NO: 2965336 - RNA, 14 nt, Human
caucccuuucccuu

SEQ ID NO: 2965337 - RNA, 17 nt, Human
caucccuuucccuuggu

SEQ ID NO: 2965338 - RNA, 11 nt, Human
caucaucccuu

SEQ ID NO: 2965339 - RNA, 13 nt, Human
caugcuguacaua

SEQ ID NO: 2965340 - RNA, 21 nt, Human
caugcuguacauacuuuuugg

SEQ ID NO: 2965341 - RNA, 19 nt, Human
caugcuguacauacuuuuu

SEQ ID NO: 2965342 - RNA, 16 nt, Human
caugcuguacauacuu

SEQ ID NO: 2965343 - RNA, 14 nt, Human
cauucuuuuugaaa

SEQ ID NO: 2965344 - RNA, 16 nt, Human
cauucuuuuugaaaug

SEQ ID NO: 2965345 - RNA, 13 nt, Human
cauucuuuuugaa

SEQ ID NO: 2965346 - RNA, 13 nt, Human
cauucuuggccca

SEQ ID NO: 2965347 - RNA, 16 nt, Human
cauucuuggcccagga

SEQ ID NO: 2965348 - RNA, 18 nt, Human
caguacuaacauuuauuu

SEQ ID NO: 2965349 - RNA, 21 nt, Human
caguaaugagcuuaagaaauu

SEQ ID NO: 2965350 - RNA, 13 nt, Human
caguaacauagcu

SEQ ID NO: 2965351 - RNA, 23 nt, Human
cagucagggaaggugccucugga

SEQ ID NO: 2965352 - RNA, 19 nt, Human
cagucauuauguuaauauu

SEQ ID NO: 2965353 - RNA, 15 nt, Human
caggaguuuggccag

SEQ ID NO: 2965354 - RNA, 16 nt, Human
caggaguuuggccaga

SEQ ID NO: 2965355 - RNA, 17 nt, Human
caggaguuuggccagaa

SEQ ID NO: 2965356 - RNA, 13 nt, Human
caggaguuuggcc

SEQ ID NO: 2965357 - RNA, 14 nt, Human
caggaguuuggcca

SEQ ID NO: 2965358 - RNA, 13 nt, Human
caggcuggaguua

SEQ ID NO: 2965359 - RNA, 16 nt, Human
caggcuggaguuauug

SEQ ID NO: 2965360 - RNA, 19 nt, Human
cagcacaaggaaauaaaau

SEQ ID NO: 2965361 - RNA, 10 nt, Human
cagcagagug

SEQ ID NO: 2965362 - RNA, 9 nt, Human
cagcagagu

SEQ ID NO: 2965363 - RNA, 15 nt, Human
cagcagagugcuuua

SEQ ID NO: 2965364 - RNA, 11 nt, Human
cagcagagugc

SEQ ID NO: 2965365 - RNA, 15 nt, Human
cagcaacacaaagcu

SEQ ID NO: 2965366 - RNA, 23 nt, Human
cagcaacacaaagcuuuugcaua

SEQ ID NO: 2965367 - RNA, 13 nt, Human
cagcccucagaau

SEQ ID NO: 2965368 - RNA, 18 nt, Human
cagcccucaauugugaaa

SEQ ID NO: 2965369 - RNA, 16 nt, Human
cagcucuccccuucuc

SEQ ID NO: 2965370 - RNA, 22 nt, Human
caggaagcugugagagcaguuu

SEQ ID NO: 2965371 - RNA, 13 nt, Human
caggaagcuguga

SEQ ID NO: 2965372 - RNA, 14 nt, Human
caggaagcugugag

SEQ ID NO: 2965373 - RNA, 20 nt, Human
cagagccccacccucagaug

SEQ ID NO: 2965374 - RNA, 21 nt, Human
cagagaagauucuuguauuua

SEQ ID NO: 2965375 - RNA, 21 nt, Human
cagagugcuuuaccaauugaa

SEQ ID NO: 2965376 - RNA, 12 nt, Human
cagaguggcagu

SEQ ID NO: 2965377 - RNA, 17 nt, Human
cagaugcacaugagcug

SEQ ID NO: 2965378 - RNA, 17 nt, Human
cagaacuauguuuuugu

SEQ ID NO: 2965379 - RNA, 18 nt, Human
cagaagucaaggcuuaga

SEQ ID NO: 2965380 - RNA, 16 nt, Human
cagaagucaaggcuua

SEQ ID NO: 2965381 - RNA, 17 nt, Human
cagaagucaaggcuuag

SEQ ID NO: 2965382 - RNA, 23 nt, Human
cagaaucgcuccaccuugcagcu

SEQ ID NO: 2965383 - RNA, 21 nt, Human
cagaaucgcuccaccuugcag

SEQ ID NO: 2965384 - RNA, 20 nt, Human
cacccucagaugcacaugag

SEQ ID NO: 2965385 - RNA, 15 nt, Human
cacgcacacugucug

SEQ ID NO: 2965386 - RNA, 13 nt, Human
cacucuauaacaa

SEQ ID NO: 2965387 - RNA, 19 nt, Human
cacuucacgcccuuggcca

SEQ ID NO: 2965388 - RNA, 17 nt, Human
cacuucacgcccuuggc

SEQ ID NO: 2965389 - RNA, 21 nt, Human
cacuucacgcccuuggccaug

SEQ ID NO: 2965390 - RNA, 20 nt, Human
cacuucacgcccuuggccau

SEQ ID NO: 2965391 - RNA, 18 nt, Human
cacugguuuguucccugu

SEQ ID NO: 2965392 - RNA, 16 nt, Human
cacugguuuuaaauau

SEQ ID NO: 2965393 - RNA, 15 nt, Human
cacugguuuuaaaua

SEQ ID NO: 2965394 - RNA, 13 nt, Human
cacugguuuuaaa

SEQ ID NO: 2965395 - RNA, 12 nt, Human
cacugguuuuaa

SEQ ID NO: 2965396 - RNA, 16 nt, Human
cacuguccuauuauau

SEQ ID NO: 2965397 - RNA, 18 nt, Human
cugccaauauccuaauaa

SEQ ID NO: 2965398 - RNA, 19 nt, Human
cugccaauauccuaauaaa

SEQ ID NO: 2965399 - RNA, 20 nt, Human
cugccaauauccuaauaaaa

SEQ ID NO: 2965400 - RNA, 22 nt, Human
cugccaauauccuaauaaaaag

SEQ ID NO: 2965401 - RNA, 13 nt, Human
cugccaauauccu

SEQ ID NO: 2965402 - RNA, 14 nt, Human
cugccaauauccua

SEQ ID NO: 2965403 - RNA, 16 nt, Human
cugccaauauccuaau

SEQ ID NO: 2965404 - RNA, 17 nt, Human
cugccaauauccuaaua

SEQ ID NO: 2965405 - RNA, 22 nt, Human
cugguuuuaaauauuuugacuu

SEQ ID NO: 2965406 - RNA, 16 nt, Human
cugguuuguucccugu

SEQ ID NO: 2965407 - RNA, 15 nt, Human
cuucacgcccuuggc

SEQ ID NO: 2965408 - RNA, 17 nt, Human
cuucacgcccuuggcca

SEQ ID NO: 2965409 - RNA, 16 nt, Human
cuucaguuugcagagu

SEQ ID NO: 2965410 - RNA, 17 nt, Human
cuucaguuugcagagua

SEQ ID NO: 2965411 - RNA, 20 nt, Human
gaaaaaauuuacuuuaaacu

SEQ ID NO: 2965412 - RNA, 22 nt, Human
cuuuuaugauugccuuuuuaua

SEQ ID NO: 2965413 - RNA, 20 nt, Human
gagaagucuucuauuuauuu

SEQ ID NO: 2965414 - RNA, 21 nt, Human
gagaagucuucuauuuauuua

SEQ ID NO: 2965415 - RNA, 22 nt, Human
gacuauuuuuguuuuuauuaaa

SEQ ID NO: 2965416 - RNA, 21 nt, Human
gacuauuuuuguuuuuauuaa

SEQ ID NO: 2965417 - RNA, 18 nt, Human
gacuauuuuuguuuuuau

SEQ ID NO: 2965418 - RNA, 17 nt, Human
gacuauuuuuguuuuua

SEQ ID NO: 2965419 - RNA, 13 nt, Human
gacuauuuuuguu

SEQ ID NO: 2965420 - RNA, 15 nt, Human
gcacaucuguuuugu

SEQ ID NO: 2965421 - RNA, 21 nt, Human
gcacaugagcuggcgggauug

SEQ ID NO: 2965422 - RNA, 19 nt, Human
gcaguaaaaaaugguguuu

SEQ ID NO: 2965423 - RNA, 22 nt, Human
gcaguaaaaaaugguguuuuau

SEQ ID NO: 2965424 - RNA, 21 nt, Human
gcaguacuaacauuuauuuga

SEQ ID NO: 2965425 - RNA, 15 nt, Human
gcaguacuaacauuu

SEQ ID NO: 2965426 - RNA, 21 nt, Human
gagugcucaguagucagacug

SEQ ID NO: 2965427 - RNA, 12 nt, Human
gaguuuggccag

SEQ ID NO: 2965428 - RNA, 13 nt, Human
gaguuuggccaga

SEQ ID NO: 2965429 - RNA, 14 nt, Human
gaguuuggccagaa

SEQ ID NO: 2965430 - RNA, 16 nt, Human
gauacuuauuuaaaua

SEQ ID NO: 2965431 - RNA, 19 nt, Human
gauacuuauuuaaauagau

SEQ ID NO: 2965432 - RNA, 13 nt, Human
gauacuuauuuaa

SEQ ID NO: 2965433 - RNA, 12 nt, Human
gcugaacaucac

SEQ ID NO: 2965434 - RNA, 17 nt, Human
gcuuauuuccucauuuu

SEQ ID NO: 2965435 - RNA, 22 nt, Human
gcuuaauuauugauguuuucau

SEQ ID NO: 2965436 - RNA, 22 nt, Human
gcuguacauacuuuuuggguuu

SEQ ID NO: 2965437 - RNA, 22 nt, Human
gcuggaguuauugaagcagagu

SEQ ID NO: 2965438 - RNA, 15 nt, Human
gcccaggaguuuggc

SEQ ID NO: 2965439 - RNA, 16 nt, Human
gcccaggaguuuggcc

SEQ ID NO: 2965440 - RNA, 13 nt, Human
gcccaggaguuug

SEQ ID NO: 2965441 - RNA, 17 nt, Human
gcccaggaguuuggcca

SEQ ID NO: 2965442 - RNA, 18 nt, Human
gcccaggaguuuggccag

SEQ ID NO: 2965443 - RNA, 15 nt, Human
gccccacccucagau

SEQ ID NO: 2965444 - RNA, 18 nt, Human
gccccacccucagaugca

SEQ ID NO: 2965445 - RNA, 15 nt, Human
gguacacuugugaau

SEQ ID NO: 2965446 - RNA, 21 nt, Human
ggucuguuuuguguacuuuua

SEQ ID NO: 2965447 - RNA, 11 nt, Human
gguuuauuugg

SEQ ID NO: 2965448 - RNA, 12 nt, Human
gguuucuagcau

SEQ ID NO: 2965449 - RNA, 18 nt, Human
gguggggcagugcuuggc

SEQ ID NO: 2965450 - RNA, 22 nt, Human
aaauaaggaaugauauaagguu

SEQ ID NO: 2965451 - RNA, 16 nt, Human
aaacagucucccuucc

SEQ ID NO: 2965452 - RNA, 19 nt, Human
gggcccuuuuucaauaacu

SEQ ID NO: 2965453 - RNA, 22 nt, Human
aaaagggguaggguuuaaagau

SEQ ID NO: 2965454 - RNA, 14 nt, Human
ggaguuuggccaga

SEQ ID NO: 2965455 - RNA, 15 nt, Human
ggaguuuggccagaa

SEQ ID NO: 2965456 - RNA, 13 nt, Human
ggaguuuggccag

SEQ ID NO: 2965457 - RNA, 19 nt, Human
ggaucuguauguguucuau

SEQ ID NO: 2965458 - RNA, 18 nt, Human
ggaucuguauguguucua

SEQ ID NO: 2965459 - RNA, 11 nt, Human
ggcccaggagu

SEQ ID NO: 2965460 - RNA, 13 nt, Human
ggcccaggaguuu

SEQ ID NO: 2965461 - RNA, 18 nt, Human
ggcccaggaguuuggcca

SEQ ID NO: 2965462 - RNA, 19 nt, Human
ggcccaggaguuuggccag

SEQ ID NO: 2965463 - RNA, 20 nt, Human
ggcccaggaguuuggccaga

SEQ ID NO: 2965464 - RNA, 21 nt, Human
caguaaaaaaugguguuuuau

SEQ ID NO: 2965465 - RNA, 20 nt, Human
caguaaaaaaugguguuuua

SEQ ID NO: 2965466 - RNA, 14 nt, Human
cauuucaagaaguc

SEQ ID NO: 2965467 - RNA, 14 nt, Human
caguuugcagagua

SEQ ID NO: 2965468 - RNA, 21 nt, Human
caguuugguugguaacucugu

SEQ ID NO: 2965469 - RNA, 11 nt, Human
caguuugguug

SEQ ID NO: 2965470 - RNA, 15 nt, Human
caugcugccaauauc

SEQ ID NO: 2965471 - RNA, 17 nt, Human
caugcugccaauauccu

SEQ ID NO: 2965472 - RNA, 19 nt, Human
caugcugccaauauccuaa

SEQ ID NO: 2965473 - RNA, 21 nt, Human
caugcugccaauauccuaaua

SEQ ID NO: 2965474 - RNA, 22 nt, Human
caugcugccaauauccuaauaa

SEQ ID NO: 2965475 - RNA, 14 nt, Human
cacugguuugguuc

SEQ ID NO: 2965476 - RNA, 17 nt, Human
auugcugcuuguacacu

SEQ ID NO: 2965477 - RNA, 17 nt, Human
auuacaacucuauuuaa

SEQ ID NO: 2965478 - RNA, 13 nt, Human
auuagguugugaa

SEQ ID NO: 2965479 - RNA, 15 nt, Human
auuagguugugaaug

SEQ ID NO: 2965480 - RNA, 14 nt, Human
auuagguugugaau

SEQ ID NO: 2965481 - RNA, 15 nt, Human
auuuggaaaggaaug

SEQ ID NO: 2965482 - RNA, 18 nt, Human
auuuggaaaggaaugcaa

SEQ ID NO: 2965483 - RNA, 18 nt, Human
auuuguggaaaauaacuc

SEQ ID NO: 2965484 - RNA, 21 nt, Human
auuugccuaauaugaugacug

SEQ ID NO: 2965485 - RNA, 13 nt, Human
caaacccaguguu

SEQ ID NO: 2965486 - RNA, 24 nt, Human
ccguagacgugcacgcacacuguc

SEQ ID NO: 2965487 - RNA, 13 nt, Human
cccuucucuguau

SEQ ID NO: 2965488 - RNA, 16 nt, Human
cuagcaugaagacaga

SEQ ID NO: 2965489 - RNA, 18 nt, Human
cuauaacaaaggauacuu

SEQ ID NO: 2965490 - RNA, 22 nt, Human
cuauaacaaaggauacuuauuu

SEQ ID NO: 2965491 - RNA, 16 nt, Human
ccuuggacauuuuaug

SEQ ID NO: 2965492 - RNA, 18 nt, Human
ccuuggacauuuuauguc

SEQ ID NO: 2965493 - RNA, 21 nt, Human
ccuuggacauuuuaugucuuu

SEQ ID NO: 2965494 - RNA, 13 nt, Human
cucuauuucugga

SEQ ID NO: 2965495 - RNA, 14 nt, Human
cucaugcugccaau

SEQ ID NO: 2965496 - RNA, 22 nt, Human
cucaugcugccaauauccuaau

SEQ ID NO: 2965497 - RNA, 12 nt, Human
cucaugcugcca

SEQ ID NO: 2965498 - RNA, 22 nt, Human
cuccagucauuauguuaauauu

SEQ ID NO: 2965499 - RNA, 13 nt, Human
augaaugcccagu

SEQ ID NO: 2965500 - RNA, 21 nt, Human
augaaugcccagugagacugu

SEQ ID NO: 2965501 - RNA, 21 nt, Human
uugguugguaacucuguaauu

SEQ ID NO: 2965502 - RNA, 17 nt, Human
uugguugggaugacuug

SEQ ID NO: 2965503 - RNA, 20 nt, Human
uugguucuggacuaaaacua

SEQ ID NO: 2965504 - RNA, 18 nt, Human
uugguucuggacuaaaac

SEQ ID NO: 2965505 - RNA, 23 nt, Human
augacuuggugucuaauguguag

SEQ ID NO: 2965506 - RNA, 18 nt, Human
augacuuggugucuaaug

SEQ ID NO: 2965507 - RNA, 19 nt, Human
augacauugacuauuuuug

SEQ ID NO: 2965508 - RNA, 16 nt, Human
augacauugacuauuu

SEQ ID NO: 2965509 - RNA, 14 nt, Human
augacauucccugc

SEQ ID NO: 2965510 - RNA, 11 nt, Human
uugcacauuaa

SEQ ID NO: 2965511 - RNA, 23 nt, Human
uugcacauuaaaugacucuuccc

SEQ ID NO: 2965512 - RNA, 20 nt, Human
uugccuaauaugaugacugu

SEQ ID NO: 2965513 - RNA, 12 nt, Human
aucuguuacaca

SEQ ID NO: 2965514 - RNA, 22 nt, Human
uuuagaugaaugucaguuguua

SEQ ID NO: 2965515 - RNA, 18 nt, Human
uuuagaugaaugucaguu

SEQ ID NO: 2965516 - RNA, 18 nt, Human
augcuguacauacuuuuu

SEQ ID NO: 2965517 - RNA, 16 nt, Human
augcuguacauacuuu

SEQ ID NO: 2965518 - RNA, 15 nt, Human
augcuguacauacuu

SEQ ID NO: 2965519 - RNA, 12 nt, Human
augcuguacaua

SEQ ID NO: 2965520 - RNA, 18 nt, Human
augcaguacuaacauuua

SEQ ID NO: 2965521 - RNA, 13 nt, Human
augcagguuuuau

SEQ ID NO: 2965522 - RNA, 13 nt, Human
augauuucacagu

SEQ ID NO: 2965523 - RNA, 13 nt, Human
aucauuucaagaa

SEQ ID NO: 2965524 - RNA, 14 nt, Human
uugaaaugauuuca

SEQ ID NO: 2965525 - RNA, 14 nt, Human
uucuuuuugaaaug

SEQ ID NO: 2965526 - RNA, 15 nt, Human
uucuuuuugaaaugu

SEQ ID NO: 2965527 - RNA, 20 nt, Human
auccuagucauucuucccua

SEQ ID NO: 2965528 - RNA, 18 nt, Human
auccuaauaaaaagguga

SEQ ID NO: 2965529 - RNA, 22 nt, Human
auccuaauaaaaaggugaccau

SEQ ID NO: 2965530 - RNA, 14 nt, Human
auccuaauaaaaag

SEQ ID NO: 2965531 - RNA, 15 nt, Human
auccuaauaaaaagg

SEQ ID NO: 2965532 - RNA, 16 nt, Human
auccuaauaaaaaggu

SEQ ID NO: 2965533 - RNA, 17 nt, Human
auccuaauaaaaaggug

SEQ ID NO: 2965534 - RNA, 12 nt, Human
auccuaauaaaa

SEQ ID NO: 2965535 - RNA, 15 nt, Human
uucuuggcccaggau

SEQ ID NO: 2965536 - RNA, 13 nt, Human
uucucagcagagu

SEQ ID NO: 2965537 - RNA, 22 nt, Human
uucuaaauaucccuuggacauu

SEQ ID NO: 2965538 - RNA, 21 nt, Human
uuccuucaagaaugcaguacu

SEQ ID NO: 2965539 - RNA, 14 nt, Human
uuccuucaagaaug

SEQ ID NO: 2965540 - RNA, 16 nt, Human
auaugaugacuguuuu

SEQ ID NO: 2965541 - RNA, 13 nt, Human
uucauauuuaauu

SEQ ID NO: 2965542 - RNA, 23 nt, Human
uucaagaaguccccucuccucca

SEQ ID NO: 2965543 - RNA, 23 nt, Human
uucaagaaugcaguacuaacauu

SEQ ID NO: 2965544 - RNA, 14 nt, Human
auucucagcagagu

SEQ ID NO: 2965545 - RNA, 15 nt, Human
auucucagcagagug

SEQ ID NO: 2965546 - RNA, 16 nt, Human
auugacagauugaauu

SEQ ID NO: 2965547 - RNA, 16 nt, Human
auucucagcagagugc

SEQ ID NO: 2965548 - RNA, 18 nt, Human
auuuaaacacauuaaagg

SEQ ID NO: 2965549 - RNA, 17 nt, Human
auuuaaacacauuaaag

SEQ ID NO: 2965550 - RNA, 17 nt, Human
auucucagcagagugcu

SEQ ID NO: 2965551 - RNA, 11 nt, Human
auuauuaacaa

SEQ ID NO: 2965552 - RNA, 12 nt, Human
uuugcacauuaa

SEQ ID NO: 2965553 - RNA, 16 nt, Human
uuugcacauuaaauga

SEQ ID NO: 2965554 - RNA, 13 nt, Human
uuugcacauuaaa

SEQ ID NO: 2965555 - RNA, 10 nt, Human
uuuggccaga

SEQ ID NO: 2965556 - RNA, 12 nt, Human
uuuggccagaag

SEQ ID NO: 2965557 - RNA, 14 nt, Human
uuuggccagaaguc

SEQ ID NO: 2965558 - RNA, 23 nt, Human
augucuagaccaggaccucccuc

SEQ ID NO: 2965559 - RNA, 15 nt, Human
augucaguuguuauu

SEQ ID NO: 2965560 - RNA, 17 nt, Human
augucaguuguuauuua

SEQ ID NO: 2965561 - RNA, 17 nt, Human
uuuuaagacuuugguua

SEQ ID NO: 2965562 - RNA, 22 nt, Human
uuuuaagggcccuuuuucaaua

SEQ ID NO: 2965563 - RNA, 22 nt, Human
uuuguaacuguuuagaugaaug

SEQ ID NO: 2965564 - RNA, 23 nt, Human
uuuguaacuguuuagaugaaugu

SEQ ID NO: 2965565 - RNA, 15 nt, Human
uuuuauuauuaacaa

SEQ ID NO: 2965566 - RNA, 23 nt, Human
uuuuccaguaaugagcuuaagaa

SEQ ID NO: 2965567 - RNA, 13 nt, Human
auuaaagugccca

SEQ ID NO: 2965568 - RNA, 19 nt, Human
uuuucucacagaagaugaa

SEQ ID NO: 2965569 - RNA, 17 nt, Human
aguuuugaagauucuau

SEQ ID NO: 2965570 - RNA, 18 nt, Human
aguuuugaagauucuaug

SEQ ID NO: 2965571 - RNA, 20 nt, Human
uuaagaacuaaaauguucua

SEQ ID NO: 2965572 - RNA, 16 nt, Human
uuaagaacuaaaaugu

SEQ ID NO: 2965573 - RNA, 19 nt, Human
uuaagaacuaaaauguucu

SEQ ID NO: 2965574 - RNA, 13 nt, Human
uuaaggguaugau

SEQ ID NO: 2965575 - RNA, 14 nt, Human
uuaaacacauuaaa

SEQ ID NO: 2965576 - RNA, 19 nt, Human
uuaaacaugcuguacauac

SEQ ID NO: 2965577 - RNA, 23 nt, Human
uuaaacaugcuguacauacuuuu

SEQ ID NO: 2965578 - RNA, 22 nt, Human
uuaaacaugcuguacauacuuu

SEQ ID NO: 2965579 - RNA, 21 nt, Human
uuaaacaugcuguacauacuu

SEQ ID NO: 2965580 - RNA, 13 nt, Human
uuaaauagaugac

SEQ ID NO: 2965581 - RNA, 14 nt, Human
uuaaauagaugaca

SEQ ID NO: 2965582 - RNA, 16 nt, Human
uuaaauagaugacauu

SEQ ID NO: 2965583 - RNA, 15 nt, Human
uuacugaacaguaac

SEQ ID NO: 2965584 - RNA, 23 nt, Human
uuacugaacaguaacauagcugu

SEQ ID NO: 2965585 - RNA, 17 nt, Human
uuagguugugaaugcag

SEQ ID NO: 2965586 - RNA, 13 nt, Human
uuagguugugaau

SEQ ID NO: 2965587 - RNA, 12 nt, Human
uuagguugugaa

SEQ ID NO: 2965588 - RNA, 15 nt, Human
uguuuagaugaaugu

SEQ ID NO: 2965589 - RNA, 20 nt, Human
uguuuagaugaaugucaguu

SEQ ID NO: 2965590 - RNA, 23 nt, Human
aguucuauuuauuugugagacug

SEQ ID NO: 2965591 - RNA, 24 nt, Human
aguucaaucuggauucauauuuaa

SEQ ID NO: 2965592 - RNA, 13 nt, Human
uguuauuuauuga

SEQ ID NO: 2965593 - RNA, 15 nt, Human
uguuauuuauugaaa

SEQ ID NO: 2965594 - RNA, 17 nt, Human
uguuauuuauugaaaug

SEQ ID NO: 2965595 - RNA, 18 nt, Human
uguuauuuauugaaauga

SEQ ID NO: 2965596 - RNA, 19 nt, Human
uguuauuuauugaaaugau

SEQ ID NO: 2965597 - RNA, 15 nt, Human
aguggaguuacugaa

SEQ ID NO: 2965598 - RNA, 16 nt, Human
aguuacugaacaguaa

SEQ ID NO: 2965599 - RNA, 12 nt, Human
agugcuuggccc

SEQ ID NO: 2965600 - RNA, 14 nt, Human
agugcuuggcccag

SEQ ID NO: 2965601 - RNA, 15 nt, Human
agugcuuggcccagg

SEQ ID NO: 2965602 - RNA, 16 nt, Human
agugcuuggcccagga

SEQ ID NO: 2965603 - RNA, 18 nt, Human
agugcuuggcccaggagu

SEQ ID NO: 2965604 - RNA, 19 nt, Human
agugcuuggcccaggaguu

SEQ ID NO: 2965605 - RNA, 20 nt, Human
agugcuuggcccaggaguuu

SEQ ID NO: 2965606 - RNA, 22 nt, Human
agugcuuuaccaauugaaguaa

SEQ ID NO: 2965607 - RNA, 17 nt, Human
agguagaauguuuucaa

SEQ ID NO: 2965608 - RNA, 15 nt, Human
ugggcacaucauuuc

SEQ ID NO: 2965609 - RNA, 20 nt, Human
ugggcacaucauuucaagaa

SEQ ID NO: 2965610 - RNA, 15 nt, Human
ugucaguauuucaac

SEQ ID NO: 2965611 - RNA, 23 nt, Human
agucagacuggauaguccgucuc

SEQ ID NO: 2965612 - RNA, 22 nt, Human
uguccuaaugcuugcugcugau

SEQ ID NO: 2965613 - RNA, 23 nt, Human
uguaauuaugguuaguagaggua

SEQ ID NO: 2965614 - RNA, 21 nt, Human
aguagagguacacuugugaau

SEQ ID NO: 2965615 - RNA, 20 nt, Human
aguagagguacacuugugaa

SEQ ID NO: 2965616 - RNA, 22 nt, Human
aguagagguacacuugugaaua

SEQ ID NO: 2965617 - RNA, 14 nt, Human
aguagagguacacu

SEQ ID NO: 2965618 - RNA, 15 nt, Human
uguacuuuuaagacu

SEQ ID NO: 2965619 - RNA, 18 nt, Human
uguacuuuuaagacuuug

SEQ ID NO: 2965620 - RNA, 17 nt, Human
aggaaugcaaagaugaa

SEQ ID NO: 2965621 - RNA, 16 nt, Human
uggcaucuuacaucug

SEQ ID NO: 2965622 - RNA, 13 nt, Human
aggauacuuauuu

SEQ ID NO: 2965623 - RNA, 16 nt, Human
aggauacuuauuuaaa

SEQ ID NO: 2965624 - RNA, 15 nt, Human
aggauacuuauuuaa

SEQ ID NO: 2965625 - RNA, 18 nt, Human
ugcuugcugcugauuuaa

SEQ ID NO: 2965626 - RNA, 16 nt, Human
ugcuuguacacucauu

SEQ ID NO: 2965627 - RNA, 22 nt, Human
ugcuuguacacucauucauuac

SEQ ID NO: 2965628 - RNA, 19 nt, Human
ugcuuguacacucauucau

SEQ ID NO: 2965629 - RNA, 14 nt, Human
ugccaauauccuaa

SEQ ID NO: 2965630 - RNA, 13 nt, Human
ugccaauuugcac

SEQ ID NO: 2965631 - RNA, 15 nt, Human
ugccaauuugcacau

SEQ ID NO: 2965632 - RNA, 21 nt, Human
ugccaauuugcacauuaaaug

SEQ ID NO: 2965633 - RNA, 17 nt, Human
ugccaauuugcacauua

SEQ ID NO: 2965634 - RNA, 14 nt, Human
ugcaguacuaacau

SEQ ID NO: 2965635 - RNA, 14 nt, Human
ugcacacuguccua

SEQ ID NO: 2965636 - RNA, 21 nt, Human
ugcacacuguccuauuauauu

SEQ ID NO: 2965637 - RNA, 23 nt, Human
agcauguccuaaugcuugcugcu

SEQ ID NO: 2965638 - RNA, 21 nt, Human
ugaaaaaauuuacuuuaaacu

SEQ ID NO: 2965639 - RNA, 12 nt, Human
ucuuuuaaacuc

SEQ ID NO: 2965640 - RNA, 11 nt, Human
ucuuuuaaacu

SEQ ID NO: 2965641 - RNA, 21 nt, Human
agagcaguuugguuucuagca

SEQ ID NO: 2965642 - RNA, 23 nt, Human
agagcaguuugguuucuagcaug

SEQ ID NO: 2965643 - RNA, 12 nt, Human
agauguugcuaa

SEQ ID NO: 2965644 - RNA, 14 nt, Human
agcaagacauuaua

SEQ ID NO: 2965645 - RNA, 14 nt, Human
ugaauuugccuaau

SEQ ID NO: 2965646 - RNA, 18 nt, Human
ugaagguagaauguuuuc

SEQ ID NO: 2965647 - RNA, 19 nt, Human
ugaagguagaauguuuuca

SEQ ID NO: 2965648 - RNA, 19 nt, Human
ucuggauucauauuuaauu

SEQ ID NO: 2965649 - RNA, 16 nt, Human
ucuggauucauauuua

SEQ ID NO: 2965650 - RNA, 16 nt, Human
agaauaaaccaagaau

SEQ ID NO: 2965651 - RNA, 17 nt, Human
agaacuauguuuuuguu

SEQ ID NO: 2965652 - RNA, 12 nt, Human
ucuagcaugaag

SEQ ID NO: 2965653 - RNA, 15 nt, Human
acuguccuauuauau

SEQ ID NO: 2965654 - RNA, 16 nt, Human
acuguccuauuauauu

SEQ ID NO: 2965655 - RNA, 18 nt, Human
acuguccuauuauauuca

SEQ ID NO: 2965656 - RNA, 13 nt, Human
ucaguagucagac

SEQ ID NO: 2965657 - RNA, 15 nt, Human
ucaguuguuauuuau

SEQ ID NO: 2965658 - RNA, 20 nt, Human
ucaguuguuauuuauugaaa

SEQ ID NO: 2965659 - RNA, 14 nt, Human
ucaguuuaucuguu

SEQ ID NO: 2965660 - RNA, 16 nt, Human
ucaguuuaucuguuca

SEQ ID NO: 2965661 - RNA, 12 nt, Human
ucaguuugguug

SEQ ID NO: 2965662 - RNA, 16 nt, Human
ucaguuugcagaguag

SEQ ID NO: 2965663 - RNA, 15 nt, Human
ucaguuugcagagua

SEQ ID NO: 2965664 - RNA, 12 nt, Human
ucagcccucaga

SEQ ID NO: 2965665 - RNA, 13 nt, Human
ucagcccucagaa

SEQ ID NO: 2965666 - RNA, 13 nt, Human
acauuuuaugucu

SEQ ID NO: 2965667 - RNA, 15 nt, Human
acauuuuaugucuuu

SEQ ID NO: 2965668 - RNA, 14 nt, Human
ucacagaagaugaa

SEQ ID NO: 2965669 - RNA, 20 nt, Human
ucaauugugaaaaaauuuac

SEQ ID NO: 2965670 - RNA, 16 nt, Human
ucaauugugaaaaaau

SEQ ID NO: 2965671 - RNA, 22 nt, Human
ucacagcuuauuuccucauuuu

SEQ ID NO: 2965672 - RNA, 20 nt, Human
uauuuugacuuguugagggu

SEQ ID NO: 2965673 - RNA, 12 nt, Human
uauuuuacuuuu

SEQ ID NO: 2965674 - RNA, 14 nt, Human
uauuuugacuuguu

SEQ ID NO: 2965675 - RNA, 17 nt, Human
acgcccuuggccauggg

SEQ ID NO: 2965676 - RNA, 20 nt, Human
accugcacacuguccuauua

SEQ ID NO: 2965677 - RNA, 15 nt, Human
acucuucccucaaau

SEQ ID NO: 2965678 - RNA, 19 nt, Human
acacaaagcuuuugcauau

SEQ ID NO: 2965679 - RNA, 20 nt, Human
acacaaagcuuuugcauauu

SEQ ID NO: 2965680 - RNA, 17 nt, Human
uaguagagguacacuug

SEQ ID NO: 2965681 - RNA, 22 nt, Human
uaggggucugucuuuuaaacuc

SEQ ID NO: 2965682 - RNA, 13 nt, Human
uagagguacacuu

SEQ ID NO: 2965683 - RNA, 18 nt, Human
uagagguacacuugugaa

SEQ ID NO: 2965684 - RNA, 19 nt, Human
uagagguacacuugugaau

SEQ ID NO: 2965685 - RNA, 20 nt, Human
uaugugcacaucuguuuugu

SEQ ID NO: 2965686 - RNA, 16 nt, Human
acacucauucauuacu

SEQ ID NO: 2965687 - RNA, 14 nt, Human
uauccaaucuguga

SEQ ID NO: 2965688 - RNA, 23 nt, Human
uauccaauugcugcuuguacacu

SEQ ID NO: 2965689 - RNA, 15 nt, Human
uauccaauugcugcu

SEQ ID NO: 2965690 - RNA, 18 nt, Human
uauauagcaagacauuau

SEQ ID NO: 2965691 - RNA, 16 nt, Human
uauauagcaguaaaaa

SEQ ID NO: 2965692 - RNA, 20 nt, Human
uauauagcaagacauuauau

SEQ ID NO: 2965693 - RNA, 15 nt, Human
uauauagcaguaaaa

SEQ ID NO: 2965694 - RNA, 18 nt, Human
uauagcaguaaaaaaugg

SEQ ID NO: 2965695 - RNA, 20 nt, Human
uauagauguugcuaacagca

SEQ ID NO: 2965696 - RNA, 15 nt, Human
uauagauguugcuaa

SEQ ID NO: 2965697 - RNA, 21 nt, Human
uauagauguugcuaacagcaa

SEQ ID NO: 2965698 - RNA, 10 nt, Human
uauagauguu

SEQ ID NO: 2965699 - RNA, 23 nt, Human
uauauagcaguaaaaaauggugu

SEQ ID NO: 2965700 - RNA, 17 nt, Human
uacauuagguugugaau

SEQ ID NO: 2965701 - RNA, 22 nt, Human
aauguucacugguacucugcca

SEQ ID NO: 2965702 - RNA, 16 nt, Human
uaauuauugauguuuu

SEQ ID NO: 2965703 - RNA, 20 nt, Human
aaugcuugcugcugauuuaa

SEQ ID NO: 2965704 - RNA, 18 nt, Human
aaugcuugcugcugauuu

SEQ ID NO: 2965705 - RNA, 23 nt, Human
aaugcuugcugcugauuuaaaca

SEQ ID NO: 2965706 - RNA, 22 nt, Human
aaugcuugcugcugauuuaaac

SEQ ID NO: 2965707 - RNA, 23 nt, Human
aauauuuugacuuguugagggua

SEQ ID NO: 2965708 - RNA, 14 nt, Human
uaauaaaaagguga

SEQ ID NO: 2965709 - RNA, 15 nt, Human
uaauaaaaaggugac

SEQ ID NO: 2965710 - RNA, 12 nt, Human
uaauaaaaaggu

SEQ ID NO: 2965711 - RNA, 16 nt, Human
uaacuaucacugguuu

SEQ ID NO: 2965712 - RNA, 21 nt, Human
uaacuaucacugguuugguuc

SEQ ID NO: 2965713 - RNA, 18 nt, Human
uaacaaaggauacuuauu

SEQ ID NO: 2965714 - RNA, 17 nt, Human
uaacaaaggauacuuau

SEQ ID NO: 2965715 - RNA, 16 nt, Human
uaacaaaggauacuua

SEQ ID NO: 2965716 - RNA, 15 nt, Human
uaacaaaggauacuu

SEQ ID NO: 2965717 - RNA, 20 nt, Human
uaacaaaggauacuuauuua

SEQ ID NO: 2965718 - RNA, 19 nt, Human
uaacaaaggauacuuauuu

SEQ ID NO: 2965719 - RNA, 21 nt, Human
uaacaaaggauacuuauuuaa

SEQ ID NO: 2965720 - RNA, 21 nt, Human
aauagcaaggcugugcaucua

SEQ ID NO: 2965721 - RNA, 22 nt, Human
aauagcagcccucaauugugaa

SEQ ID NO: 2965722 - RNA, 23 nt, Human
aauagcagcccucaauugugaaa

SEQ ID NO: 2965723 - RNA, 13 nt, Human
gugucauuucaaa

SEQ ID NO: 2965724 - RNA, 18 nt, Human
aagaugaaggucuguuuu

SEQ ID NO: 2965725 - RNA, 18 nt, Human
guuauugaagcagagugg

SEQ ID NO: 2965726 - RNA, 17 nt, Human
guuauugaagcagagug

SEQ ID NO: 2965727 - RNA, 16 nt, Human
guuauugaagcagagu

SEQ ID NO: 2965728 - RNA, 13 nt, Human
aagucuucuauuu

SEQ ID NO: 2965729 - RNA, 17 nt, Human
aagucuucuauuuauuu

SEQ ID NO: 2965730 - RNA, 14 nt, Human
guugcuaacagcaa

SEQ ID NO: 2965731 - RNA, 13 nt, Human
aaggauacuuauu

SEQ ID NO: 2965732 - RNA, 16 nt, Human
aaggauacuuauuuaa

SEQ ID NO: 2965733 - RNA, 12 nt, Human
guuuaaugguag

SEQ ID NO: 2965734 - RNA, 17 nt, Human
guuuaaugguaguuuua

SEQ ID NO: 2965735 - RNA, 20 nt, Human
guuuaaugguaguuuuacag

SEQ ID NO: 2965736 - RNA, 22 nt, Human
guuuauuuggaaaggaaugcaa

SEQ ID NO: 2965737 - RNA, 18 nt, Human
aaaugguguuuuaucuuc

SEQ ID NO: 2965738 - RNA, 17 nt, Human
aaaugguguuuuaucuu

SEQ ID NO: 2965739 - RNA, 12 nt, Human
aaauuuguggaa

SEQ ID NO: 2965740 - RNA, 16 nt, Human
gucaguuguuauuuau

SEQ ID NO: 2965741 - RNA, 17 nt, Human
gucaguuguuauuuauu

SEQ ID NO: 2965742 - RNA, 18 nt, Human
gucaguuguuauuuauug

SEQ ID NO: 2965743 - RNA, 21 nt, Human
gucaguuguuauuuauugaaa

SEQ ID NO: 2965744 - RNA, 21 nt, Human
aacacaaagcuuuugcauauu

SEQ ID NO: 2965745 - RNA, 22 nt, Human
aacucugagugcaaacuucaga

SEQ ID NO: 2965746 - RNA, 20 nt, Human
aacucugagugcaaacuuca

SEQ ID NO: 2965747 - RNA, 18 nt, Human
aacucugagugcaaacuu

SEQ ID NO: 2965748 - RNA, 19 nt, Human
aacucugagugcaaacuuc

SEQ ID NO: 2965749 - RNA, 20 nt, Human
aacugggaugaggugacuau

SEQ ID NO: 2965750 - RNA, 17 nt, Human
gugcacaucuguuuugu

SEQ ID NO: 2965751 - RNA, 17 nt, Human
gucuucuauuuauuuau

SEQ ID NO: 2965752 - RNA, 12 nt, Human
gucuucuauuua

SEQ ID NO: 2965753 - RNA, 14 nt, Human
gucuucuauuuauu

SEQ ID NO: 2965754 - RNA, 12 nt, Human
aacucauuucua

SEQ ID NO: 2965755 - RNA, 20 nt, Human
aacuacauuagguugugaau

SEQ ID NO: 2965756 - RNA, 17 nt, Human
accaagaauugauuggg

SEQ ID NO: 2965757 - RNA, 17 nt, Human
acauuucucauguugaa

SEQ ID NO: 2965758 - RNA, 19 nt, Human
acaugccuaccaauauuua

SEQ ID NO: 2965759 - RNA, 18 nt, Human
acaugccuaccaauauuu

SEQ ID NO: 2965760 - RNA, 14 nt, Human
acaugccuaccaau

SEQ ID NO: 2965761 - RNA, 12 nt, Human
aaagugcccagc

SEQ ID NO: 2965762 - RNA, 18 nt, Human
aacagcaacacaaagcuu

SEQ ID NO: 2965763 - RNA, 17 nt, Human
aacagcaacacaaagcu

SEQ ID NO: 2965764 - RNA, 20 nt, Human
aacaugcuguacauacuuuu

SEQ ID NO: 2965765 - RNA, 19 nt, Human
aacaugcuguacauacuuu

SEQ ID NO: 2965766 - RNA, 18 nt, Human
aacaugcuguacauacuu

SEQ ID NO: 2965767 - RNA, 21 nt, Human
aacaugcuguacauacuuuuu

SEQ ID NO: 2965768 - RNA, 18 nt, Human
aacugaaguucuauuuau

SEQ ID NO: 2965769 - RNA, 13 nt, Human
aauauaaaaauaa

SEQ ID NO: 2965770 - RNA, 17 nt, Human
aauaaaauuuuaguuga

SEQ ID NO: 2965771 - RNA, 10 nt, Human
aagcagagug

SEQ ID NO: 2965772 - RNA, 14 nt, Human
aagcagaguggcag

SEQ ID NO: 2965773 - RNA, 11 nt, Human
aagcagagugg

SEQ ID NO: 2965774 - RNA, 20 nt, Human
aagcagaguggcagucuuca

SEQ ID NO: 2965775 - RNA, 21 nt, Human
aagauucuauguuaauauuuu

SEQ ID NO: 2965776 - RNA, 22 nt, Human
aagauucuauguuaauauuuua

SEQ ID NO: 2965777 - RNA, 15 nt, Human
aagacuuugguuauu

SEQ ID NO: 2965778 - RNA, 13 nt, Human
aagacuuugguua

SEQ ID NO: 2965779 - RNA, 23 nt, Human
aagacuuugguuauuuuacuuuu

SEQ ID NO: 2965780 - RNA, 17 nt, Human
aagacuuugguuauuuu

SEQ ID NO: 2965781 - RNA, 13 nt, Human
aacuguuuagaug

SEQ ID NO: 2965782 - RNA, 16 nt, Human
aaggaaugcaaagaug

SEQ ID NO: 2965783 - RNA, 15 nt, Human
aaggaaugcaaagau

SEQ ID NO: 2965784 - RNA, 23 nt, Human
aaggucuguuuuguguacuuuua

SEQ ID NO: 2965785 - RNA, 20 nt, Human
aaggucuguuuuguguacuu

SEQ ID NO: 2965786 - RNA, 19 nt, Human
aaggucuguuuuguguacu

SEQ ID NO: 2965787 - RNA, 21 nt, Human
aagggauuuucagcccucaga

SEQ ID NO: 2965788 - RNA, 23 nt, Human
aagggauuuucagcccucagaau

SEQ ID NO: 2965789 - RNA, 15 nt, Human
aagggauuuucagcc

SEQ ID NO: 2965790 - RNA, 17 nt, Human
agaugaaggucuguuuu

SEQ ID NO: 2965791 - RNA, 14 nt, Human
agaugaaggucugu

SEQ ID NO: 2965792 - RNA, 22 nt, Human
agauucuuguauuuauuacaac

SEQ ID NO: 2965793 - RNA, 21 nt, Human
agauucuauguuaauauuuua

SEQ ID NO: 2965794 - RNA, 16 nt, Human
agacuggauaguccgu

SEQ ID NO: 2965795 - RNA, 21 nt, Human
agaagucuucuauuuauuuau

SEQ ID NO: 2965796 - RNA, 24 nt, Human
aggcuuagacccucaugcugccaa

SEQ ID NO: 2965797 - RNA, 23 nt, Human
aggcuuagacccucaugcugcca

SEQ ID NO: 2965798 - RNA, 17 nt, Human
agggauuuucagcccuc

SEQ ID NO: 2965799 - RNA, 22 nt, Human
agggauuuucagcccucagaau

SEQ ID NO: 2965800 - RNA, 20 nt, Human
agcuuauuuccucauuuuua

SEQ ID NO: 2965801 - RNA, 14 nt, Human
augacuguuuuuaa

SEQ ID NO: 2965802 - RNA, 17 nt, Human
aucgcuccaccuugcag

SEQ ID NO: 2965803 - RNA, 21 nt, Human
aucgcuccaccuugcagcucu

SEQ ID NO: 2965804 - RNA, 21 nt, Human
augguaguuuuacaguguuuc

SEQ ID NO: 2965805 - RNA, 22 nt, Human
augguaguuuuacaguguuucu

SEQ ID NO: 2965806 - RNA, 15 nt, Human
augguaguuuuacag

SEQ ID NO: 2965807 - RNA, 16 nt, Human
aguacuaacauuuauu

SEQ ID NO: 2965808 - RNA, 17 nt, Human
auauucauucuuuuuga

SEQ ID NO: 2965809 - RNA, 21 nt, Human
auagcagcccucaauugugaa

SEQ ID NO: 2965810 - RNA, 22 nt, Human
auagcagcccucaauugugaaa

SEQ ID NO: 2965811 - RNA, 16 nt, Human
auagcauguccuaaug

SEQ ID NO: 2965812 - RNA, 19 nt, Human
auagcauguccuaaugcuu

SEQ ID NO: 2965813 - RNA, 11 nt, Human
aguuuggccag

SEQ ID NO: 2965814 - RNA, 19 nt, Human
caaggcuuagacccucaug

SEQ ID NO: 2965815 - RNA, 22 nt, Human
caaggcuuagacccucaugcug

SEQ ID NO: 2965816 - RNA, 21 nt, Human
caauauccuaauaaaaaggug

SEQ ID NO: 2965817 - RNA, 18 nt, Human
caauaacuggaacacucu

SEQ ID NO: 2965818 - RNA, 13 nt, Human
cacaaagcuuuug

SEQ ID NO: 2965819 - RNA, 16 nt, Human
cacaaagcuuuugcau

SEQ ID NO: 2965820 - RNA, 22 nt, Human
caauauccuaauaaaaagguga

SEQ ID NO: 2965821 - RNA, 18 nt, Human
uguucacuggacacuuca

SEQ ID NO: 2965822 - RNA, 14 nt, Human
uguguggucaacau

SEQ ID NO: 2965823 - RNA, 23 nt, Human
uguguggucaacauuucucaugu

SEQ ID NO: 2965824 - RNA, 22 nt, Human
uuaaacuacauuagguugugaa

SEQ ID NO: 2965825 - RNA, 23 nt, Human
uuaaacuacauuagguugugaau

SEQ ID NO: 2965826 - RNA, 20 nt, Human
uuaaauauuuugacuuguug

SEQ ID NO: 2965827 - RNA, 11 nt, Human
uuaaaugacuc

SEQ ID NO: 2965828 - RNA, 18 nt, Human
uuaaaugacucuucccuc

SEQ ID NO: 2965829 - RNA, 18 nt, Human
uguuucuggcuuagaaca

SEQ ID NO: 2965830 - RNA, 20 nt, Human
uguaauaaacucauuucuag

SEQ ID NO: 2965831 - RNA, 23 nt, Human
ugugaaggcaggggaauguaugu

SEQ ID NO: 2965832 - RNA, 17 nt, Human
ugugcacaucuguuuug

SEQ ID NO: 2965833 - RNA, 15 nt, Human
ugugcacaucuguuu

SEQ ID NO: 2965834 - RNA, 21 nt, Human
ugcuuuaccaauugaaguaaa

SEQ ID NO: 2965835 - RNA, 22 nt, Human
uggcccaggaguuuggccagaa

SEQ ID NO: 2965836 - RNA, 20 nt, Human
uggcccaggaguuuggccag

SEQ ID NO: 2965837 - RNA, 21 nt, Human
uggcccaggaguuuggccaga

SEQ ID NO: 2965838 - RNA, 14 nt, Human
uggcccaggaguuu

SEQ ID NO: 2965839 - RNA, 19 nt, Human
uggcccaggaguuuggcca

SEQ ID NO: 2965840 - RNA, 13 nt, Human
uggcccaggaguu

SEQ ID NO: 2965841 - RNA, 15 nt, Human
ugguaguuuuacagu

SEQ ID NO: 2965842 - RNA, 19 nt, Human
ugcacgcacacugucugcc

SEQ ID NO: 2965843 - RNA, 16 nt, Human
ugcucaguagucagac

SEQ ID NO: 2965844 - RNA, 14 nt, Human
ugcugauuuaaaca

SEQ ID NO: 2965845 - RNA, 17 nt, Human
ugcugauuuaaacacau

SEQ ID NO: 2965846 - RNA, 15 nt, Human
ugcugauuuaaacac

SEQ ID NO: 2965847 - RNA, 23 nt, Human
ugcuaacagcaacacaaagcuuu

SEQ ID NO: 2965848 - RNA, 22 nt, Human
ugcuaacagcaacacaaagcuu

SEQ ID NO: 2965849 - RNA, 21 nt, Human
ugcuaacagcaacacaaagcu

SEQ ID NO: 2965850 - RNA, 14 nt, Human
ucggagcccugucu

SEQ ID NO: 2965851 - RNA, 15 nt, Human
ucggagcccugucuc

SEQ ID NO: 2965852 - RNA, 14 nt, Human
ucuggacuaaaacu

SEQ ID NO: 2965853 - RNA, 20 nt, Human
ugaaacacugguuuuaaaua

SEQ ID NO: 2965854 - RNA, 15 nt, Human
ugaaacacugguuuu

SEQ ID NO: 2965855 - RNA, 18 nt, Human
ucuucaguuugcagagua

SEQ ID NO: 2965856 - RNA, 17 nt, Human
ucuucaguuugcagagu

SEQ ID NO: 2965857 - RNA, 15 nt, Human
ugacucuucccucaa

SEQ ID NO: 2965858 - RNA, 20 nt, Human
ugaaugcagguuuuaucaga

SEQ ID NO: 2965859 - RNA, 18 nt, Human
ugaaugcagguuuuauca

SEQ ID NO: 2965860 - RNA, 21 nt, Human
ugaaacacugguuuuaaauau

SEQ ID NO: 2965861 - RNA, 18 nt, Human
uacuaacauuuauuugag

SEQ ID NO: 2965862 - RNA, 17 nt, Human
uacuaacauuuauuuga

SEQ ID NO: 2965863 - RNA, 19 nt, Human
uacaugccuaccaauauuu

SEQ ID NO: 2965864 - RNA, 16 nt, Human
uacaugccuaccaaua

SEQ ID NO: 2965865 - RNA, 18 nt, Human
uaauuccuguuuuuauua

SEQ ID NO: 2965866 - RNA, 19 nt, Human
uagaauguuuucaaauguu

SEQ ID NO: 2965867 - RNA, 18 nt, Human
uagaauguuuucaaaugu

SEQ ID NO: 2965868 - RNA, 12 nt, Human
uacuuuaaacua

SEQ ID NO: 2965869 - RNA, 23 nt, Human
uagacccucaugcugccaauauc

SEQ ID NO: 2965870 - RNA, 19 nt, Human
uagacccucaugcugccaa

SEQ ID NO: 2965871 - RNA, 17 nt, Human
uagacccucaugcugcc

SEQ ID NO: 2965872 - RNA, 18 nt, Human
uagacccucaugcugcca

SEQ ID NO: 2965873 - RNA, 16 nt, Human
uagcaugaagacagag

SEQ ID NO: 2965874 - RNA, 21 nt, Human
uagcagcccucaauugugaaa

SEQ ID NO: 2965875 - RNA, 21 nt, Human
uaguagagguacacuugugaa

SEQ ID NO: 2965876 - RNA, 20 nt, Human
uaguagagguacacuuguga

SEQ ID NO: 2965877 - RNA, 22 nt, Human
uaguagagguacacuugugaau

SEQ ID NO: 2965878 - RNA, 10 nt, Human
uaacuggaac

SEQ ID NO: 2965879 - RNA, 14 nt, Human
uaacuuuuuauauu

SEQ ID NO: 2965880 - RNA, 13 nt, Human
uaacuuuuuauau

SEQ ID NO: 2965881 - RNA, 16 nt, Human
uaacuuuuuauauucu

SEQ ID NO: 2965882 - RNA, 15 nt, Human
uaacuuuuuauauuc

SEQ ID NO: 2965883 - RNA, 18 nt, Human
uaacucaccuggcaucuu

SEQ ID NO: 2965884 - RNA, 15 nt, Human
uaauauggaucugua

SEQ ID NO: 2965885 - RNA, 15 nt, Human
uaauaugaugacugu

SEQ ID NO: 2965886 - RNA, 19 nt, Human
uaaugcuugcugcugauuu

SEQ ID NO: 2965887 - RNA, 16 nt, Human
uaaugguaguuuuaca

SEQ ID NO: 2965888 - RNA, 22 nt, Human
uaaacaugcuguacauacuuuu

SEQ ID NO: 2965889 - RNA, 21 nt, Human
uaaacaugcuguacauacuuu

SEQ ID NO: 2965890 - RNA, 23 nt, Human
uaaacaugcuguacauacuuuuu

SEQ ID NO: 2965891 - RNA, 22 nt, Human
uaaacacauuaaagguacuuug

SEQ ID NO: 2965892 - RNA, 19 nt, Human
uaaacaugcuguacauacu

SEQ ID NO: 2965893 - RNA, 20 nt, Human
uaaacaugcuguacauacuu

SEQ ID NO: 2965894 - RNA, 18 nt, Human
uaaaaggaagcuuacaug

SEQ ID NO: 2965895 - RNA, 21 nt, Human
uaaaaggaagcuuacaugccu

SEQ ID NO: 2965896 - RNA, 14 nt, Human
guggggcagugcuu

SEQ ID NO: 2965897 - RNA, 23 nt, Human
guggggcagugcuuggcccagga

SEQ ID NO: 2965898 - RNA, 14 nt, Human
gugugcguccuguc

SEQ ID NO: 2965899 - RNA, 16 nt, Human
gugugcguccugucgg

SEQ ID NO: 2965900 - RNA, 24 nt, Human
guucacuggacacuucacgcccuu

SEQ ID NO: 2965901 - RNA, 23 nt, Human
guucaaucuggauucauauuuaa

SEQ ID NO: 2965902 - RNA, 24 nt, Human
guuaguucaaucuggauucauauu

SEQ ID NO: 2965903 - RNA, 17 nt, Human
gucugucuuuuaaacuc

SEQ ID NO: 2965904 - RNA, 14 nt, Human
gucuguuuugugua

SEQ ID NO: 2965905 - RNA, 15 nt, Human
gucuguuuuguguac

SEQ ID NO: 2965906 - RNA, 20 nt, Human
gucuguuuuguguacuuuua

SEQ ID NO: 2965907 - RNA, 12 nt, Human
gucggagcccug

SEQ ID NO: 2965908 - RNA, 16 nt, Human
gucggagcccugucuc

SEQ ID NO: 2965909 - RNA, 13 nt, Human
gugcguccugucg

SEQ ID NO: 2965910 - RNA, 15 nt, Human
guauagauguugcua

SEQ ID NO: 2965911 - RNA, 16 nt, Human
guauagauguugcuaa

SEQ ID NO: 2965912 - RNA, 20 nt, Human
guauguuuuauauagcaaga

SEQ ID NO: 2965913 - RNA, 16 nt, Human
gucaaggcuuagaccc

SEQ ID NO: 2965914 - RNA, 18 nt, Human
gucaaggcuuagacccuc

SEQ ID NO: 2965915 - RNA, 20 nt, Human
gucaaggcuuagacccucau

SEQ ID NO: 2965916 - RNA, 22 nt, Human
guauuuucuccaaauguucacu

SEQ ID NO: 2965917 - RNA, 14 nt, Human
gucauucuucccua

SEQ ID NO: 2965918 - RNA, 17 nt, Human
gucauuauguuaauauu

SEQ ID NO: 2965919 - RNA, 19 nt, Human
gucauuauguuaauauuuc

SEQ ID NO: 2965920 - RNA, 13 nt, Human
uuuuccuucaaga

SEQ ID NO: 2965921 - RNA, 21 nt, Human
uuuuccuucaagaaugcagua

SEQ ID NO: 2965922 - RNA, 14 nt, Human
uuuuccuucaagaa

SEQ ID NO: 2965923 - RNA, 16 nt, Human
uuuugguauuugaaac

SEQ ID NO: 2965924 - RNA, 14 nt, Human
uuuugguauuugaa

SEQ ID NO: 2965925 - RNA, 18 nt, Human
uuuuggguuuauuuggaa

SEQ ID NO: 2965926 - RNA, 17 nt, Human
uuuuggguuuauuugga

SEQ ID NO: 2965927 - RNA, 20 nt, Human
uuuuuaagggcccuuuuuca

SEQ ID NO: 2965928 - RNA, 21 nt, Human
uuuuuccuucaagaaugcagu

SEQ ID NO: 2965929 - RNA, 23 nt, Human
uuaccaauugaaguaaaaugugg

SEQ ID NO: 2965930 - RNA, 18 nt, Human
uuuccucauuuuuauaau

SEQ ID NO: 2965931 - RNA, 22 nt, Human
uuaccaauugaaguaaaaugug

SEQ ID NO: 2965932 - RNA, 16 nt, Human
uuugaagauucuaugu

SEQ ID NO: 2965933 - RNA, 14 nt, Human
uuuggaaaagaaua

SEQ ID NO: 2965934 - RNA, 20 nt, Human
uuugcauauugcauacuauu

SEQ ID NO: 2965935 - RNA, 15 nt, Human
uuugcauauugcaua

SEQ ID NO: 2965936 - RNA, 13 nt, Human
uuugguuucuagc

SEQ ID NO: 2965937 - RNA, 12 nt, Human
uuuguucccugu

SEQ ID NO: 2965938 - RNA, 19 nt, Human
uuuuaauauggaucuguau

SEQ ID NO: 2965939 - RNA, 22 nt, Human
gccgugugugugcguccugucg

SEQ ID NO: 2965940 - RNA, 23 nt, Human
gccguggugauuuagcaggaagc

SEQ ID NO: 2965941 - RNA, 16 nt, Human
gcccuuggccaugggu

SEQ ID NO: 2965942 - RNA, 13 nt, Human
gcuacacaccuaa

SEQ ID NO: 2965943 - RNA, 19 nt, Human
gcagcccucaauugugaaa

SEQ ID NO: 2965944 - RNA, 17 nt, Human
gcacugguuuguucccu

SEQ ID NO: 2965945 - RNA, 19 nt, Human
gcacugguuuguucccugu

SEQ ID NO: 2965946 - RNA, 18 nt, Human
gcagugcuuggcccagga

SEQ ID NO: 2965947 - RNA, 19 nt, Human
gcagugcuuggcccaggag

SEQ ID NO: 2965948 - RNA, 20 nt, Human
gcagugcuuggcccaggagu

SEQ ID NO: 2965949 - RNA, 12 nt, Human
gauucauauuua

SEQ ID NO: 2965950 - RNA, 11 nt, Human
gauuuucagcc

SEQ ID NO: 2965951 - RNA, 15 nt, Human
gauuuucagcccuca

SEQ ID NO: 2965952 - RNA, 19 nt, Human
gauuuucagcccucagaau

SEQ ID NO: 2965953 - RNA, 15 nt, Human
gaugacauucccugc

SEQ ID NO: 2965954 - RNA, 23 nt, Human
gaugacauugacuauuuuuguuu

SEQ ID NO: 2965955 - RNA, 21 nt, Human
gaugacauugacuauuuuugu

SEQ ID NO: 2965956 - RNA, 17 nt, Human
gaugacauugacuauuu

SEQ ID NO: 2965957 - RNA, 17 nt, Human
gaugacauucccugcua

SEQ ID NO: 2965958 - RNA, 15 nt, Human
gaugaaggucuguuu

SEQ ID NO: 2965959 - RNA, 18 nt, Human
gaugaaggucuguuuugu

SEQ ID NO: 2965960 - RNA, 13 nt, Human
gaagucuucuauu

SEQ ID NO: 2965961 - RNA, 17 nt, Human
gaagucuucuauuuauu

SEQ ID NO: 2965962 - RNA, 17 nt, Human
cuugcugcugauuuaaa

SEQ ID NO: 2965963 - RNA, 19 nt, Human
cuugcugcugauuuaaaca

SEQ ID NO: 2965964 - RNA, 17 nt, Human
cuuggacauuuuauguc

SEQ ID NO: 2965965 - RNA, 18 nt, Human
cuuggacauuuuaugucu

SEQ ID NO: 2965966 - RNA, 16 nt, Human
cuuggacauuuuaugu

SEQ ID NO: 2965967 - RNA, 19 nt, Human
cuuggacauuuuaugucuu

SEQ ID NO: 2965968 - RNA, 16 nt, Human
cuugagugcucaguag

SEQ ID NO: 2965969 - RNA, 22 nt, Human
cuugagugucaagcugaccuug

SEQ ID NO: 2965970 - RNA, 17 nt, Human
cuuucccuuggugcccu

SEQ ID NO: 2965971 - RNA, 12 nt, Human
cuuucccuuggu

SEQ ID NO: 2965972 - RNA, 11 nt, Human
cuuuuaaacuc

SEQ ID NO: 2965973 - RNA, 17 nt, Human
cuuuuaagacuuugguu

SEQ ID NO: 2965974 - RNA, 23 nt, Human
cuuuugcauauugcauacuauua

SEQ ID NO: 2965975 - RNA, 15 nt, Human
cuuuugcauauugca

SEQ ID NO: 2965976 - RNA, 22 nt, Human
cuuuuuauauucucagcagagu

SEQ ID NO: 2965977 - RNA, 16 nt, Human
cuuuuuauaacuuuuu

SEQ ID NO: 2965978 - RNA, 18 nt, Human
cuuuuuauauucucagca

SEQ ID NO: 2965979 - RNA, 12 nt, Human
cuuuuuauaacu

SEQ ID NO: 2965980 - RNA, 20 nt, Human
gaaaggaaugcaaagaugaa

SEQ ID NO: 2965981 - RNA, 16 nt, Human
gaaacugacacaugcu

SEQ ID NO: 2965982 - RNA, 22 nt, Human
gaacaguaacauagcugugauu

SEQ ID NO: 2965983 - RNA, 21 nt, Human
gaacacucuauaacaaaggau

SEQ ID NO: 2965984 - RNA, 15 nt, Human
gaacacucuauaaca

SEQ ID NO: 2965985 - RNA, 18 nt, Human
gaaguccccucuccucca

SEQ ID NO: 2965986 - RNA, 23 nt, Human
gaaguccccucuccuccacauuu

SEQ ID NO: 2965987 - RNA, 18 nt, Human
gaagucaaggcuuagacc

SEQ ID NO: 2965988 - RNA, 19 nt, Human
gaaggucuguuuuguguac

SEQ ID NO: 2965989 - RNA, 14 nt, Human
gaaggaugcugucu

SEQ ID NO: 2965990 - RNA, 20 nt, Human
gaagauucuuguauuuauua

SEQ ID NO: 2965991 - RNA, 21 nt, Human
cuguaaguuacaugaaggcag

SEQ ID NO: 2965992 - RNA, 16 nt, Human
cuguacauacuuuuug

SEQ ID NO: 2965993 - RNA, 15 nt, Human
cuguacauacuuuuu

SEQ ID NO: 2965994 - RNA, 17 nt, Human
cugucuccucucucugu

SEQ ID NO: 2965995 - RNA, 20 nt, Human
cugucuccucucucuguaau

SEQ ID NO: 2965996 - RNA, 15 nt, Human
cuguccuauuauauu

SEQ ID NO: 2965997 - RNA, 21 nt, Human
cuguccuauuauauucauucu

SEQ ID NO: 2965998 - RNA, 20 nt, Human
cugggaaagggauuuucagc

SEQ ID NO: 2965999 - RNA, 20 nt, Human
cugcaguuuuuuuccuucaa

SEQ ID NO: 2966000 - RNA, 22 nt, Human
cugcaguuuuuuuccuucaaga

SEQ ID NO: 2966001 - RNA, 23 nt, Human
cugcaguuuuuuuccuucaagaa

SEQ ID NO: 2966002 - RNA, 16 nt, Human
cugaaauaaggaauga

SEQ ID NO: 2966003 - RNA, 13 nt, Human
cuccuccacauuu

SEQ ID NO: 2966004 - RNA, 22 nt, Human
cgccagcucaccccaucauccc

SEQ ID NO: 2966005 - RNA, 18 nt, Human
cgugcacgcacacugucu

SEQ ID NO: 2966006 - RNA, 13 nt, Human
cuaaaauguucua

SEQ ID NO: 2966007 - RNA, 18 nt, Human
cuacacaccuaacuuaug

SEQ ID NO: 2966008 - RNA, 14 nt, Human
cccucaugcugcca

SEQ ID NO: 2966009 - RNA, 17 nt, Human
cccucaugcugccaaua

SEQ ID NO: 2966010 - RNA, 16 nt, Human
ccucccccuggcacug

SEQ ID NO: 2966011 - RNA, 14 nt, Human
ccucuccuccacau

SEQ ID NO: 2966012 - RNA, 20 nt, Human
ccucagaugcacaugagcug

SEQ ID NO: 2966013 - RNA, 15 nt, Human
cccuuggacauuuua

SEQ ID NO: 2966014 - RNA, 14 nt, Human
cccuuggacauuuu

SEQ ID NO: 2966015 - RNA, 16 nt, Human
cccaguguuuuaggag

SEQ ID NO: 2966016 - RNA, 17 nt, Human
cccaguguuuuaggagc

SEQ ID NO: 2966017 - RNA, 22 nt, Human
cauugacuauuuuuguuuuuau

SEQ ID NO: 2966018 - RNA, 14 nt, Human
cauugacagauuga

SEQ ID NO: 2966019 - RNA, 16 nt, Human
cauuucucauguugaa

SEQ ID NO: 2966020 - RNA, 17 nt, Human
cauuucucauguugaaa

SEQ ID NO: 2966021 - RNA, 20 nt, Human
ccaauuugcacauuaaauga

SEQ ID NO: 2966022 - RNA, 19 nt, Human
ccaauuugcacauuaaaug

SEQ ID NO: 2966023 - RNA, 21 nt, Human
ccaauauuuaaucuuuuauga

SEQ ID NO: 2966024 - RNA, 17 nt, Human
cauuaaagguacuuugc

SEQ ID NO: 2966025 - RNA, 18 nt, Human
cauuaaaugacucuuccc

SEQ ID NO: 2966026 - RNA, 14 nt, Human
cauuaaaugacucu

SEQ ID NO: 2966027 - RNA, 13 nt, Human
cauuaaaugacuc

SEQ ID NO: 2966028 - RNA, 17 nt, Human
caugccuaccaauauuu

SEQ ID NO: 2966029 - RNA, 18 nt, Human
cauacuuuuuggguuuau

SEQ ID NO: 2966030 - RNA, 16 nt, Human
cauacuuuuuggguuu

SEQ ID NO: 2966031 - RNA, 12 nt, Human
cauacuuuuugg

SEQ ID NO: 2966032 - RNA, 18 nt, Human
cauacuauuaaacaugcu

SEQ ID NO: 2966033 - RNA, 14 nt, Human
caucauuucaagaa

SEQ ID NO: 2966034 - RNA, 12 nt, Human
caucauuucaag

SEQ ID NO: 2966035 - RNA, 14 nt, Human
cauacuauuaaaca

SEQ ID NO: 2966036 - RNA, 18 nt, Human
caguuggguuuuuuaagg

SEQ ID NO: 2966037 - RNA, 16 nt, Human
caguuggguuuuuuaa

SEQ ID NO: 2966038 - RNA, 11 nt, Human
caguuggguuu

SEQ ID NO: 2966039 - RNA, 19 nt, Human
caguuuuuuuccuucaaga

SEQ ID NO: 2966040 - RNA, 22 nt, Human
cauaagugcuauugcagagccg

SEQ ID NO: 2966041 - RNA, 18 nt, Human
cauaagugcuauugcaga

SEQ ID NO: 2966042 - RNA, 20 nt, Human
caguguuuuaggagcaugag

SEQ ID NO: 2966043 - RNA, 16 nt, Human
caguguuuuaggagca

SEQ ID NO: 2966044 - RNA, 13 nt, Human
cagugcuuggccc

SEQ ID NO: 2966045 - RNA, 14 nt, Human
cagugcuuggccca

SEQ ID NO: 2966046 - RNA, 15 nt, Human
cagugcuuggcccag

SEQ ID NO: 2966047 - RNA, 16 nt, Human
cagugcuuggcccagg

SEQ ID NO: 2966048 - RNA, 17 nt, Human
cagugcuuggcccagga

SEQ ID NO: 2966049 - RNA, 18 nt, Human
cagugcuuggcccaggag

SEQ ID NO: 2966050 - RNA, 19 nt, Human
cagugcuuggcccaggagu

SEQ ID NO: 2966051 - RNA, 20 nt, Human
cagugcuuggcccaggaguu

SEQ ID NO: 2966052 - RNA, 17 nt, Human
caguguguggucaacau

SEQ ID NO: 2966053 - RNA, 21 nt, Human
caguguguggucaacauuucu

SEQ ID NO: 2966054 - RNA, 16 nt, Human
caccaugggauuaaua

SEQ ID NO: 2966055 - RNA, 12 nt, Human
caauauccuaau

SEQ ID NO: 2966056 - RNA, 13 nt, Human
caauauccuaaua

SEQ ID NO: 2966057 - RNA, 14 nt, Human
caauauccuaauaa

SEQ ID NO: 2966058 - RNA, 15 nt, Human
caauauccuaauaaa

SEQ ID NO: 2966059 - RNA, 16 nt, Human
caauauccuaauaaaa

SEQ ID NO: 2966060 - RNA, 18 nt, Human
caauauccuaauaaaaag

SEQ ID NO: 2966061 - RNA, 19 nt, Human
caauauccuaauaaaaagg

SEQ ID NO: 2966062 - RNA, 20 nt, Human
caauauccuaauaaaaaggu

SEQ ID NO: 2966063 - RNA, 23 nt, Human
caacugggguggguggggcagug

SEQ ID NO: 2966064 - RNA, 17 nt, Human
caacauaacucaagucu

SEQ ID NO: 2966065 - RNA, 18 nt, Human
agauucuauguuaauauu

SEQ ID NO: 2966066 - RNA, 11 nt, Human
agaugaauguc

SEQ ID NO: 2966067 - RNA, 15 nt, Human
agaugaaugucaguu

SEQ ID NO: 2966068 - RNA, 18 nt, Human
agaugacauugacuauuu

SEQ ID NO: 2966069 - RNA, 23 nt, Human
agaugacauugacuauuuuuguu

SEQ ID NO: 2966070 - RNA, 13 nt, Human
agcaaaucaguuu

SEQ ID NO: 2966071 - RNA, 23 nt, Human
agaaugcaguacuaacauuuauu

SEQ ID NO: 2966072 - RNA, 16 nt, Human
agaagucaaggcuuag

SEQ ID NO: 2966073 - RNA, 17 nt, Human
agaagucaaggcuuaga

SEQ ID NO: 2966074 - RNA, 18 nt, Human
agaagucaaggcuuagac

SEQ ID NO: 2966075 - RNA, 19 nt, Human
agaagucaaggcuuagacc

SEQ ID NO: 2966076 - RNA, 18 nt, Human
agaagucuucuauuuauu

SEQ ID NO: 2966077 - RNA, 22 nt, Human
aggcuuagacccucaugcugcc

SEQ ID NO: 2966078 - RNA, 14 nt, Human
aggcuuagacccuc

SEQ ID NO: 2966079 - RNA, 21 nt, Human
aggcuuagacccucaugcugc

SEQ ID NO: 2966080 - RNA, 12 nt, Human
aggcuuagaccc

SEQ ID NO: 2966081 - RNA, 18 nt, Human
auggauaaauauugguug

SEQ ID NO: 2966082 - RNA, 14 nt, Human
augagcuuaagaaa

SEQ ID NO: 2966083 - RNA, 23 nt, Human
augagcuuaagaaauuuguggaa

SEQ ID NO: 2966084 - RNA, 16 nt, Human
auagcaagacauuaua

SEQ ID NO: 2966085 - RNA, 19 nt, Human
aucaucccuuucccuuggu

SEQ ID NO: 2966086 - RNA, 15 nt, Human
aucaucccuuucccu

SEQ ID NO: 2966087 - RNA, 18 nt, Human
agugauguaauuaugguu

SEQ ID NO: 2966088 - RNA, 22 nt, Human
agugcuacacaccuaacuuaug

SEQ ID NO: 2966089 - RNA, 22 nt, Human
agucuggcagacuuucuucucu

SEQ ID NO: 2966090 - RNA, 21 nt, Human
auaagugcuauugcagagccg

SEQ ID NO: 2966091 - RNA, 14 nt, Human
agugcuauugcaga

SEQ ID NO: 2966092 - RNA, 17 nt, Human
aguuguuauuuauugaa

SEQ ID NO: 2966093 - RNA, 13 nt, Human
aguuugcagagua

SEQ ID NO: 2966094 - RNA, 14 nt, Human
acgcacacugucug

SEQ ID NO: 2966095 - RNA, 20 nt, Human
acccucagaugcacaugagc

SEQ ID NO: 2966096 - RNA, 14 nt, Human
acccucaugcugcc

SEQ ID NO: 2966097 - RNA, 16 nt, Human
acccucaugcugccaa

SEQ ID NO: 2966098 - RNA, 22 nt, Human
acccucaugcugccaauauccu

SEQ ID NO: 2966099 - RNA, 13 nt, Human
acugacacaugcu

SEQ ID NO: 2966100 - RNA, 19 nt, Human
acuggaacacucuauaaca

SEQ ID NO: 2966101 - RNA, 14 nt, Human
acaucauuucaaga

SEQ ID NO: 2966102 - RNA, 20 nt, Human
aauuaugguuaguagaggua

SEQ ID NO: 2966103 - RNA, 13 nt, Human
aauuccuguuuuu

SEQ ID NO: 2966104 - RNA, 22 nt, Human
aauuccuguuuuuauuauuaac

SEQ ID NO: 2966105 - RNA, 21 nt, Human
aauuccuguuuuuauuauuaa

SEQ ID NO: 2966106 - RNA, 19 nt, Human
aauuccuguuuuuauuauu

SEQ ID NO: 2966107 - RNA, 18 nt, Human
aaggcaggggaauguaug

SEQ ID NO: 2966108 - RNA, 20 nt, Human
aaggcaggggaauguaugug

SEQ ID NO: 2966109 - RNA, 22 nt, Human
aagacagagccccacccucaga

SEQ ID NO: 2966110 - RNA, 14 nt, Human
aaauagaugacauu

SEQ ID NO: 2966111 - RNA, 21 nt, Human
aaauagaugacauugacuauu

SEQ ID NO: 2966112 - RNA, 22 nt, Human
aaauagcagcccucaauuguga

SEQ ID NO: 2966113 - RNA, 15 nt, Human
auuuaaauagaugac

SEQ ID NO: 2966114 - RNA, 14 nt, Human
auuuaaauagauga

SEQ ID NO: 2966115 - RNA, 15 nt, Human
auuuacuuuaaacua

SEQ ID NO: 2966116 - RNA, 12 nt, Human
auuuauuacaac

SEQ ID NO: 2966117 - RNA, 13 nt, Human
auuuauugaaaug

SEQ ID NO: 2966118 - RNA, 15 nt, Human
auuuauugaaaugau

SEQ ID NO: 2966119 - RNA, 22 nt, Human
auuuauugaaaugauuucacag

SEQ ID NO: 2966120 - RNA, 17 nt, Human
auugcaccuggauguac

SEQ ID NO: 2966121 - RNA, 17 nt, Human
auugcauacuauuaaac

SEQ ID NO: 2966122 - RNA, 18 nt, Human
auugcauacuauuaaaca

SEQ ID NO: 2966123 - RNA, 13 nt, Human
auugauguuuuca

SEQ ID NO: 2966124 - RNA, 16 nt, Human
auugauguuuucauag

SEQ ID NO: 2966125 - RNA, 17 nt, Human
auugauguuuucauaga

SEQ ID NO: 2966126 - RNA, 14 nt, Human
auugaaguaaaaug

SEQ ID NO: 2966127 - RNA, 17 nt, Human
auugaaggaugcugucu

SEQ ID NO: 2966128 - RNA, 24 nt, Human
auuccuagaaacugacacaugcug

SEQ ID NO: 2966129 - RNA, 15 nt, Human
auugaaguaaaaugu

SEQ ID NO: 2966130 - RNA, 21 nt, Human
auugccuuuuuauaacuuuuu

SEQ ID NO: 2966131 - RNA, 20 nt, Human
auugccuuuuuauaacuuuu

SEQ ID NO: 2966132 - RNA, 19 nt, Human
auugccuuuuuauaacuuu

SEQ ID NO: 2966133 - RNA, 20 nt, Human
auugcauacuauuaaacaug

SEQ ID NO: 2966134 - RNA, 19 nt, Human
auugcauacuauuaaacau

SEQ ID NO: 2966135 - RNA, 22 nt, Human
auugcauacuauuaaacaugcu

SEQ ID NO: 2966136 - RNA, 14 nt, Human
auguugcuaacagc

SEQ ID NO: 2966137 - RNA, 17 nt, Human
uuuguuuuuauuaaaag

SEQ ID NO: 2966138 - RNA, 23 nt, Human
uuugagaaauuuuuuuuuccagu

SEQ ID NO: 2966139 - RNA, 21 nt, Human
auuccuaacuaucacugguuu

SEQ ID NO: 2966140 - RNA, 21 nt, Human
auuaguuuugaagauucuaug

SEQ ID NO: 2966141 - RNA, 17 nt, Human
auuauugauguuuucau

SEQ ID NO: 2966142 - RNA, 15 nt, Human
uuuuugguauuugaa

SEQ ID NO: 2966143 - RNA, 18 nt, Human
uuuuuggaaaagaauaaa

SEQ ID NO: 2966144 - RNA, 12 nt, Human
uuuuguguacuu

SEQ ID NO: 2966145 - RNA, 14 nt, Human
uuuuggaaaagaau

SEQ ID NO: 2966146 - RNA, 22 nt, Human
uuuuuauauucucagcagagug

SEQ ID NO: 2966147 - RNA, 21 nt, Human
uuuuuauauucucagcagagu

SEQ ID NO: 2966148 - RNA, 20 nt, Human
uuuuguuuuuauuaaaagga

SEQ ID NO: 2966149 - RNA, 16 nt, Human
uuuaagacuuugguua

SEQ ID NO: 2966150 - RNA, 15 nt, Human
uuuaaucuuuuauga

SEQ ID NO: 2966151 - RNA, 21 nt, Human
uuuaagggcccuuuuucaaua

SEQ ID NO: 2966152 - RNA, 20 nt, Human
uuuaagggcccuuuuucaau

SEQ ID NO: 2966153 - RNA, 18 nt, Human
uuuaagggcccuuuuuca

SEQ ID NO: 2966154 - RNA, 20 nt, Human
augcaaagaugaaggucugu

SEQ ID NO: 2966155 - RNA, 16 nt, Human
uuguguacuuuuaaga

SEQ ID NO: 2966156 - RNA, 22 nt, Human
uugugaaugcagguuuuaucag

SEQ ID NO: 2966157 - RNA, 18 nt, Human
uuuaucagaacuauguuu

SEQ ID NO: 2966158 - RNA, 15 nt, Human
augcccagugagacu

SEQ ID NO: 2966159 - RNA, 16 nt, Human
augcccagugagacug

SEQ ID NO: 2966160 - RNA, 18 nt, Human
uuuaaucuuuuaugauug

SEQ ID NO: 2966161 - RNA, 17 nt, Human
uuuaucagaacuauguu

SEQ ID NO: 2966162 - RNA, 16 nt, Human
uuuaucagaacuaugu

SEQ ID NO: 2966163 - RNA, 23 nt, Human
uugccaauuugcacauuaaauga

SEQ ID NO: 2966164 - RNA, 22 nt, Human
uugccaauuugcacauuaaaug

SEQ ID NO: 2966165 - RNA, 19 nt, Human
uugccaauuugcacauuaa

SEQ ID NO: 2966166 - RNA, 16 nt, Human
aucccuuucccuuggu

SEQ ID NO: 2966167 - RNA, 20 nt, Human
aucccuuggacauuuuaugu

SEQ ID NO: 2966168 - RNA, 21 nt, Human
aucccuuggacauuuuauguc

SEQ ID NO: 2966169 - RNA, 17 nt, Human
aucccuuggacauuuua

SEQ ID NO: 2966170 - RNA, 19 nt, Human
aucccuuggacauuuuaug

SEQ ID NO: 2966171 - RNA, 14 nt, Human
uugagugucaagcu

SEQ ID NO: 2966172 - RNA, 19 nt, Human
aucugugaugacauucccu

SEQ ID NO: 2966173 - RNA, 21 nt, Human
aucugugaugacauucccugc

SEQ ID NO: 2966174 - RNA, 13 nt, Human
uuggcccaggagu

SEQ ID NO: 2966175 - RNA, 14 nt, Human
uuggcccaggaguu

SEQ ID NO: 2966176 - RNA, 15 nt, Human
uuggcccaggaguuu

SEQ ID NO: 2966177 - RNA, 20 nt, Human
uuggcccaggaguuuggcca

SEQ ID NO: 2966178 - RNA, 21 nt, Human
uuggcccaggaguuuggccag

SEQ ID NO: 2966179 - RNA, 22 nt, Human
uuggcccaggaguuuggccaga

SEQ ID NO: 2966180 - RNA, 20 nt, Human
uuggcccaggauuauuguca

SEQ ID NO: 2966181 - RNA, 13 nt, Human
auauaagguuuuu

SEQ ID NO: 2966182 - RNA, 15 nt, Human
uucagcccucagaau

SEQ ID NO: 2966183 - RNA, 18 nt, Human
uucacugguacucugcca

SEQ ID NO: 2966184 - RNA, 11 nt, Human
uucauagagaa

SEQ ID NO: 2966185 - RNA, 18 nt, Human
uucauagagaauauaaaa

SEQ ID NO: 2966186 - RNA, 20 nt, Human
uucauauuuaauuugaaggu

SEQ ID NO: 2966187 - RNA, 21 nt, Human
uuauuucucucaucuguuaca

SEQ ID NO: 2966188 - RNA, 22 nt, Human
auagcugugauuuuugguauuu

SEQ ID NO: 2966189 - RNA, 12 nt, Human
auaacuuuuuau

SEQ ID NO: 2966190 - RNA, 18 nt, Human
auaacuuuuuauauucuc

SEQ ID NO: 2966191 - RNA, 19 nt, Human
auagcugugauuuuuggua

SEQ ID NO: 2966192 - RNA, 13 nt, Human
uuauuuaaauaga

SEQ ID NO: 2966193 - RNA, 11 nt, Human
uuauuuauuga

SEQ ID NO: 2966194 - RNA, 13 nt, Human
uucucacagaaga

SEQ ID NO: 2966195 - RNA, 23 nt, Human
auauuucugaggagccugcaaca

SEQ ID NO: 2966196 - RNA, 20 nt, Human
auauugcauacuauuaaaca

SEQ ID NO: 2966197 - RNA, 22 nt, Human
auauugcauacuauuaaacaug

SEQ ID NO: 2966198 - RNA, 18 nt, Human
auauucucagcagagugc

SEQ ID NO: 2966199 - RNA, 17 nt, Human
auauucucagcagagug

SEQ ID NO: 2966200 - RNA, 15 nt, Human
auauucucagcagag

SEQ ID NO: 2966201 - RNA, 16 nt, Human
auauucucagcagagu

SEQ ID NO: 2966202 - RNA, 18 nt, Human
ugugaugacauucccugc

SEQ ID NO: 2966203 - RNA, 21 nt, Human
agucuucaguuugcagaguag

SEQ ID NO: 2966204 - RNA, 20 nt, Human
agucuucaguuugcagagua

SEQ ID NO: 2966205 - RNA, 18 nt, Human
agucuucaguuugcagag

SEQ ID NO: 2966206 - RNA, 23 nt, Human
auaaauauugguugggaugacuu

SEQ ID NO: 2966207 - RNA, 15 nt, Human
aguuggguuuuuuaa

SEQ ID NO: 2966208 - RNA, 14 nt, Human
uguugcuaacagca

SEQ ID NO: 2966209 - RNA, 22 nt, Human
uguuugagcaucgcuuaggaga

SEQ ID NO: 2966210 - RNA, 23 nt, Human
uguuuugccaauuugcacauuaa

SEQ ID NO: 2966211 - RNA, 22 nt, Human
uguuuugccaauuugcacauua

SEQ ID NO: 2966212 - RNA, 21 nt, Human
uguuuugccaauuugcacauu

SEQ ID NO: 2966213 - RNA, 17 nt, Human
uguuuugccaauuugca

SEQ ID NO: 2966214 - RNA, 19 nt, Human
uguuuugccaauuugcaca

SEQ ID NO: 2966215 - RNA, 16 nt, Human
uguuuuaucuucuaua

SEQ ID NO: 2966216 - RNA, 17 nt, Human
agggcccuuuuucaaua

SEQ ID NO: 2966217 - RNA, 19 nt, Human
ugucaagcugaccuugcug

SEQ ID NO: 2966218 - RNA, 13 nt, Human
aguagucagacug

SEQ ID NO: 2966219 - RNA, 20 nt, Human
aguaggggucugucuuuuaa

SEQ ID NO: 2966220 - RNA, 18 nt, Human
aguaggggucugucuuuu

SEQ ID NO: 2966221 - RNA, 16 nt, Human
aguaaaauguggcagg

SEQ ID NO: 2966222 - RNA, 21 nt, Human
ugguuaguagagguacacuug

SEQ ID NO: 2966223 - RNA, 20 nt, Human
ugccuuuuuauaacuuuuua

SEQ ID NO: 2966224 - RNA, 20 nt, Human
agcuuaagaaauuuguggaa

SEQ ID NO: 2966225 - RNA, 16 nt, Human
aggcaggggaauguau

SEQ ID NO: 2966226 - RNA, 19 nt, Human
aggcaggggaauguaugug

SEQ ID NO: 2966227 - RNA, 14 nt, Human
aggcaggggaaugu

SEQ ID NO: 2966228 - RNA, 20 nt, Human
uggaguuauugaagcagagu

SEQ ID NO: 2966229 - RNA, 14 nt, Human
uggauucauauuua

SEQ ID NO: 2966230 - RNA, 17 nt, Human
uggauucauauuuaauu

SEQ ID NO: 2966231 - RNA, 13 nt, Human
ugcacauuaaaug

SEQ ID NO: 2966232 - RNA, 18 nt, Human
ugcacauuaaaugacucu

SEQ ID NO: 2966233 - RNA, 15 nt, Human
ugcacauuaaaugac

SEQ ID NO: 2966234 - RNA, 12 nt, Human
ugcaaagaugaa

SEQ ID NO: 2966235 - RNA, 23 nt, Human
ugcaaagaugaaggucuguuuug

SEQ ID NO: 2966236 - RNA, 16 nt, Human
ugcaaacuucagaguu

SEQ ID NO: 2966237 - RNA, 14 nt, Human
ugauuucacagugu

SEQ ID NO: 2966238 - RNA, 16 nt, Human
ugauuucacagugugu

SEQ ID NO: 2966239 - RNA, 18 nt, Human
ugcaucuagccucaagcu

SEQ ID NO: 2966240 - RNA, 22 nt, Human
ugagugcaaacuucagaguucu

SEQ ID NO: 2966241 - RNA, 20 nt, Human
ugagugcaaacuucagaguu

SEQ ID NO: 2966242 - RNA, 18 nt, Human
ugagugcaaacuucagag

SEQ ID NO: 2966243 - RNA, 14 nt, Human
ugaguggaguuacu

SEQ ID NO: 2966244 - RNA, 22 nt, Human
agcaguuugguuucuagcauga

SEQ ID NO: 2966245 - RNA, 23 nt, Human
agcaguuugguuucuagcaugaa

SEQ ID NO: 2966246 - RNA, 20 nt, Human
agcaguuugguuucuagcau

SEQ ID NO: 2966247 - RNA, 20 nt, Human
agcaggaagcugugagagca

SEQ ID NO: 2966248 - RNA, 18 nt, Human
ugaaauaaggaaugauau

SEQ ID NO: 2966249 - RNA, 14 nt, Human
ugaaauaaggaaug

SEQ ID NO: 2966250 - RNA, 15 nt, Human
ugaaugucaguuguu

SEQ ID NO: 2966251 - RNA, 16 nt, Human
ugaagcagaguggcag

SEQ ID NO: 2966252 - RNA, 13 nt, Human
ugaagcagagugg

SEQ ID NO: 2966253 - RNA, 12 nt, Human
ugaagcagagug

SEQ ID NO: 2966254 - RNA, 17 nt, Human
agacccucaugcugcca

SEQ ID NO: 2966255 - RNA, 12 nt, Human
agaauguuuuca

SEQ ID NO: 2966256 - RNA, 15 nt, Human
ucuguauguguucua

SEQ ID NO: 2966257 - RNA, 12 nt, Human
ucuguauguguu

SEQ ID NO: 2966258 - RNA, 20 nt, Human
ucugugaugacauucccugc

SEQ ID NO: 2966259 - RNA, 14 nt, Human
agacaguuggguuu

SEQ ID NO: 2966260 - RNA, 15 nt, Human
ucuuacaucugaaau

SEQ ID NO: 2966261 - RNA, 21 nt, Human
ucuauuucuggaugaaugccc

SEQ ID NO: 2966262 - RNA, 11 nt, Human
acuuuaaacua

SEQ ID NO: 2966263 - RNA, 18 nt, Human
ucucucaucuguuacaca

SEQ ID NO: 2966264 - RNA, 12 nt, Human
ucugacuauaac

SEQ ID NO: 2966265 - RNA, 18 nt, Human
ucgcuccaccuugcagcu

SEQ ID NO: 2966266 - RNA, 22 nt, Human
uccaaucugugaugacauuccc

SEQ ID NO: 2966267 - RNA, 22 nt, Human
accuggauugugccuaaugugu

SEQ ID NO: 2966268 - RNA, 21 nt, Human
ucauucuuuuugaaaugucaa

SEQ ID NO: 2966269 - RNA, 12 nt, Human
ucauuacuaaaa

SEQ ID NO: 2966270 - RNA, 18 nt, Human
acuaacaggcuuagugau

SEQ ID NO: 2966271 - RNA, 17 nt, Human
acuaacaggcuuaguga

SEQ ID NO: 2966272 - RNA, 12 nt, Human
acuaacaggcuu

SEQ ID NO: 2966273 - RNA, 18 nt, Human
acuaacauuuauuugagu

SEQ ID NO: 2966274 - RNA, 16 nt, Human
ucccugugucauuuca

SEQ ID NO: 2966275 - RNA, 17 nt, Human
ucccugugucauuucaa

SEQ ID NO: 2966276 - RNA, 11 nt, Human
uccuaaauagc

SEQ ID NO: 2966277 - RNA, 14 nt, Human
uccccucuccucca

SEQ ID NO: 2966278 - RNA, 23 nt, Human
accaauauuuaaucuuuuaugau

SEQ ID NO: 2966279 - RNA, 20 nt, Human
accaauauuuaaucuuuuau

SEQ ID NO: 2966280 - RNA, 16 nt, Human
accaauauuuaaucuu

SEQ ID NO: 2966281 - RNA, 17 nt, Human
accaauauuuaaucuuu

SEQ ID NO: 2966282 - RNA, 14 nt, Human
acauagcugugauu

SEQ ID NO: 2966283 - RNA, 13 nt, Human
acaucuguuuugu

SEQ ID NO: 2966284 - RNA, 16 nt, Human
acaguuggguuuuuua

SEQ ID NO: 2966285 - RNA, 18 nt, Human
acaguuggguuuuuuaag

SEQ ID NO: 2966286 - RNA, 20 nt, Human
acauacuuuuuggguuuauu

SEQ ID NO: 2966287 - RNA, 17 nt, Human
acauacuuuuuggguuu

SEQ ID NO: 2966288 - RNA, 13 nt, Human
acauacuuuuugg

SEQ ID NO: 2966289 - RNA, 11 nt, Human
acauacuuuuu

SEQ ID NO: 2966290 - RNA, 14 nt, Human
ucaaggcuuagacc

SEQ ID NO: 2966291 - RNA, 16 nt, Human
ucaagaaugcaguacu

SEQ ID NO: 2966292 - RNA, 21 nt, Human
acauuaaaugacucuucccuc

SEQ ID NO: 2966293 - RNA, 19 nt, Human
acauuaaaugacucuuccc

SEQ ID NO: 2966294 - RNA, 19 nt, Human
acaugcuguacauacuuuu

SEQ ID NO: 2966295 - RNA, 17 nt, Human
acaugcuguacauacuu

SEQ ID NO: 2966296 - RNA, 14 nt, Human
acaugcugaacauc

SEQ ID NO: 2966297 - RNA, 21 nt, Human
acaugcugaacaucacagcuu

SEQ ID NO: 2966298 - RNA, 17 nt, Human
acauuagguugugaaug

SEQ ID NO: 2966299 - RNA, 16 nt, Human
acauuagguugugaau

SEQ ID NO: 2966300 - RNA, 15 nt, Human
acauuagguugugaa

SEQ ID NO: 2966301 - RNA, 15 nt, Human
uauuugugagacugu

SEQ ID NO: 2966302 - RNA, 20 nt, Human
uauccuagucauucuucccu

SEQ ID NO: 2966303 - RNA, 17 nt, Human
acagcaacacaaagcuu

SEQ ID NO: 2966304 - RNA, 20 nt, Human
acagcaacacaaagcuuuug

SEQ ID NO: 2966305 - RNA, 15 nt, Human
acacucuauaacaaa

SEQ ID NO: 2966306 - RNA, 13 nt, Human
acacuugugaaua

SEQ ID NO: 2966307 - RNA, 12 nt, Human
acacuugugaau

SEQ ID NO: 2966308 - RNA, 18 nt, Human
acacuugugaauaaagag

SEQ ID NO: 2966309 - RNA, 20 nt, Human
uauauucauucuuuuugaaa

SEQ ID NO: 2966310 - RNA, 19 nt, Human
uauauucauucuuuuugaa

SEQ ID NO: 2966311 - RNA, 18 nt, Human
acacaugcugaacaucac

SEQ ID NO: 2966312 - RNA, 23 nt, Human
uaguucaaucuggauucauauuu

SEQ ID NO: 2966313 - RNA, 14 nt, Human
acacaccuaacuua

SEQ ID NO: 2966314 - RNA, 12 nt, Human
uagguugugaau

SEQ ID NO: 2966315 - RNA, 19 nt, Human
aauugauugggcacaucau

SEQ ID NO: 2966316 - RNA, 23 nt, Human
aauugauugggcacaucauuuca

SEQ ID NO: 2966317 - RNA, 20 nt, Human
aauugauugggcacaucauu

SEQ ID NO: 2966318 - RNA, 14 nt, Human
uacugaacaguaac

SEQ ID NO: 2966319 - RNA, 23 nt, Human
uacugggaaagggauuuucagcc

SEQ ID NO: 2966320 - RNA, 21 nt, Human
uacuaaaaguuuugagaaauu

SEQ ID NO: 2966321 - RNA, 18 nt, Human
aauuuacuuuaaacuaca

SEQ ID NO: 2966322 - RNA, 15 nt, Human
aauuuacuuuaaacu

SEQ ID NO: 2966323 - RNA, 16 nt, Human
aauuuacuuuaaacua

SEQ ID NO: 2966324 - RNA, 14 nt, Human
aauuugcacauuaa

SEQ ID NO: 2966325 - RNA, 16 nt, Human
aauuugcacauuaaau

SEQ ID NO: 2966326 - RNA, 21 nt, Human
uacuuauuuaaauagaugaca

SEQ ID NO: 2966327 - RNA, 14 nt, Human
uacuuauuuaaaua

SEQ ID NO: 2966328 - RNA, 12 nt, Human
uacuuauuuaaa

SEQ ID NO: 2966329 - RNA, 12 nt, Human
aauuugcacauu

SEQ ID NO: 2966330 - RNA, 10 nt, Human
uacuuuuugg

SEQ ID NO: 2966331 - RNA, 23 nt, Human
aauuugccuaauaugaugacugu

SEQ ID NO: 2966332 - RNA, 20 nt, Human
uagaugaaugucaguuguua

SEQ ID NO: 2966333 - RNA, 23 nt, Human
acaaaggauacuuauuuaaauag

SEQ ID NO: 2966334 - RNA, 21 nt, Human
acaaaggauacuuauuuaaau

SEQ ID NO: 2966335 - RNA, 23 nt, Human
acaaagcuuuugcauauugcaua

SEQ ID NO: 2966336 - RNA, 22 nt, Human
acaaagcuuuugcauauugcau

SEQ ID NO: 2966337 - RNA, 15 nt, Human
acaaagcuuuugcau

SEQ ID NO: 2966338 - RNA, 21 nt, Human
aauaucccuuggacauuuuau

SEQ ID NO: 2966339 - RNA, 20 nt, Human
aauaucccuuggacauuuua

SEQ ID NO: 2966340 - RNA, 22 nt, Human
aauaucccuuggacauuuuaug

SEQ ID NO: 2966341 - RNA, 12 nt, Human
aauauccuaaua

SEQ ID NO: 2966342 - RNA, 13 nt, Human
aauauccuaauaa

SEQ ID NO: 2966343 - RNA, 14 nt, Human
aauauccuaauaaa

SEQ ID NO: 2966344 - RNA, 20 nt, Human
aauauccaauugcugcuugu

SEQ ID NO: 2966345 - RNA, 15 nt, Human
aauauccuaauaaaa

SEQ ID NO: 2966346 - RNA, 19 nt, Human
aauauccuaauaaaaaggu

SEQ ID NO: 2966347 - RNA, 21 nt, Human
aauauccuaauaaaaagguga

SEQ ID NO: 2966348 - RNA, 22 nt, Human
aauagaugacauugacuauuuu

SEQ ID NO: 2966349 - RNA, 21 nt, Human
aauagaugacauugacuauuu

SEQ ID NO: 2966350 - RNA, 19 nt, Human
aauagaugacauugacuau

SEQ ID NO: 2966351 - RNA, 20 nt, Human
aauagcauguccuaaugcuu

SEQ ID NO: 2966352 - RNA, 17 nt, Human
aauaugaugacuguuuu

SEQ ID NO: 2966353 - RNA, 16 nt, Human
aauaugaugacuguuu

SEQ ID NO: 2966354 - RNA, 21 nt, Human
aauauuuuagguguaaaauaa

SEQ ID NO: 2966355 - RNA, 21 nt, Human
aauauugguugggaugacuug

SEQ ID NO: 2966356 - RNA, 15 nt, Human
aauauugguugggau

SEQ ID NO: 2966357 - RNA, 21 nt, Human
uaaauagaugacauugacuau

SEQ ID NO: 2966358 - RNA, 19 nt, Human
uaaauagaugacauugacu

SEQ ID NO: 2966359 - RNA, 14 nt, Human
uaaauagaugacau

SEQ ID NO: 2966360 - RNA, 16 nt, Human
aauaaaaaggugacca

SEQ ID NO: 2966361 - RNA, 12 nt, Human
aauaaaaaggug

SEQ ID NO: 2966362 - RNA, 13 nt, Human
aauaaaaagguga

SEQ ID NO: 2966363 - RNA, 16 nt, Human
guuuugaagauucuau

SEQ ID NO: 2966364 - RNA, 17 nt, Human
guuuugaagauucuaug

SEQ ID NO: 2966365 - RNA, 20 nt, Human
guuuugaagauucuauguua

SEQ ID NO: 2966366 - RNA, 17 nt, Human
aauaacuggaacacucu

SEQ ID NO: 2966367 - RNA, 18 nt, Human
aaugcaguacuaacauuu

SEQ ID NO: 2966368 - RNA, 14 nt, Human
aaugagcuuaagaa

SEQ ID NO: 2966369 - RNA, 18 nt, Human
uaauuauugauguuuuca

SEQ ID NO: 2966370 - RNA, 13 nt, Human
aaugacucuuccc

SEQ ID NO: 2966371 - RNA, 18 nt, Human
uaaugguaguuuuacagu

SEQ ID NO: 2966372 - RNA, 18 nt, Human
uaaugagcuuaagaaauu

SEQ ID NO: 2966373 - RNA, 21 nt, Human
aacuuuaagaacuaaaauguu

SEQ ID NO: 2966374 - RNA, 15 nt, Human
gugccuaauguguuu

SEQ ID NO: 2966375 - RNA, 24 nt, Human
aagaaugcaguacuaacauuuauu

SEQ ID NO: 2966376 - RNA, 23 nt, Human
aagaauugauugggcacaucauu

SEQ ID NO: 2966377 - RNA, 17 nt, Human
aagacccucucaaacua

SEQ ID NO: 2966378 - RNA, 17 nt, Human
guggcuaacuuggguua

SEQ ID NO: 2966379 - RNA, 15 nt, Human
guggguggggcagug

SEQ ID NO: 2966380 - RNA, 14 nt, Human
guuacacaaagaac

SEQ ID NO: 2966381 - RNA, 14 nt, Human
guuuuacaguguuu

SEQ ID NO: 2966382 - RNA, 16 nt, Human
aaccccaaguuaguuc

SEQ ID NO: 2966383 - RNA, 22 nt, Human
aacacugguuuuaaauauuuug

SEQ ID NO: 2966384 - RNA, 21 nt, Human
aacacucuauaacaaaggaua

SEQ ID NO: 2966385 - RNA, 22 nt, Human
aacauuuauuugaguggaguua

SEQ ID NO: 2966386 - RNA, 15 nt, Human
aacaguaacauagcu

SEQ ID NO: 2966387 - RNA, 18 nt, Human
aacaggcuuagugaugua

SEQ ID NO: 2966388 - RNA, 22 nt, Human
aacaguaacauagcugugauuu

SEQ ID NO: 2966389 - RNA, 15 nt, Human
aaaugauuucacagu

SEQ ID NO: 2966390 - RNA, 15 nt, Human
aaaggauacuuauuu

SEQ ID NO: 2966391 - RNA, 17 nt, Human
aaaggauacuuauuuaa

SEQ ID NO: 2966392 - RNA, 13 nt, Human
gucaacauuucuc

SEQ ID NO: 2966393 - RNA, 17 nt, Human
gucaacauuucucaugu

SEQ ID NO: 2966394 - RNA, 20 nt, Human
aaauuuacuuuaaacuacau

SEQ ID NO: 2966395 - RNA, 17 nt, Human
aaauuuacuuuaaacua

SEQ ID NO: 2966396 - RNA, 22 nt, Human
cugcugauuuaaacacauuaaa

SEQ ID NO: 2966397 - RNA, 16 nt, Human
cugcugauuuaaacac

SEQ ID NO: 2966398 - RNA, 20 nt, Human
cugcuuauccguuagccgug

SEQ ID NO: 2966399 - RNA, 14 nt, Human
cuuggcccaggagu

SEQ ID NO: 2966400 - RNA, 13 nt, Human
cuuggcccaggag

SEQ ID NO: 2966401 - RNA, 13 nt, Human
gacucuucccuca

SEQ ID NO: 2966402 - RNA, 12 nt, Human
gacauucccugc

SEQ ID NO: 2966403 - RNA, 14 nt, Human
gacauugacuauuu

SEQ ID NO: 2966404 - RNA, 22 nt, Human
gacauugacuauuuuuguuuuu

SEQ ID NO: 2966405 - RNA, 16 nt, Human
gaaguucuauuuauuu

SEQ ID NO: 2966406 - RNA, 12 nt, Human
gaagcagagugg

SEQ ID NO: 2966407 - RNA, 11 nt, Human
gaagcagagug

SEQ ID NO: 2966408 - RNA, 13 nt, Human
gcacaucauuuca

SEQ ID NO: 2966409 - RNA, 11 nt, Human
gaguggaguua

SEQ ID NO: 2966410 - RNA, 17 nt, Human
gaguggaguuacugaac

SEQ ID NO: 2966411 - RNA, 16 nt, Human
gcuguacauacuuuuu

SEQ ID NO: 2966412 - RNA, 15 nt, Human
gcuguacauacuuuu

SEQ ID NO: 2966413 - RNA, 14 nt, Human
gcuguacauacuuu

SEQ ID NO: 2966414 - RNA, 13 nt, Human
gcuguacauacuu

SEQ ID NO: 2966415 - RNA, 17 nt, Human
gcuguacauacuuuuug

SEQ ID NO: 2966416 - RNA, 16 nt, Human
gcugcugauuuaaaca

SEQ ID NO: 2966417 - RNA, 23 nt, Human
gccagaagucaaggcuuagaccc

SEQ ID NO: 2966418 - RNA, 16 nt, Human
gccagaagucaaggcu

SEQ ID NO: 2966419 - RNA, 20 nt, Human
gccagaagucaaggcuuaga

SEQ ID NO: 2966420 - RNA, 22 nt, Human
gccagaagucaaggcuuagacc

SEQ ID NO: 2966421 - RNA, 14 nt, Human
gccacuuuauuucu

SEQ ID NO: 2966422 - RNA, 15 nt, Human
gccuaccaauauuua

SEQ ID NO: 2966423 - RNA, 22 nt, Human
ggcccaggaguuuggccagaag

SEQ ID NO: 2966424 - RNA, 23 nt, Human
ggcccaggaguuuggccagaagu

SEQ ID NO: 2966425 - RNA, 21 nt, Human
ggcccaggaguuuggccagaa

SEQ ID NO: 2966426 - RNA, 12 nt, Human
ggauuuucagcc

SEQ ID NO: 2966427 - RNA, 19 nt, Human
aaagaugaaggucuguuuu

SEQ ID NO: 2966428 - RNA, 22 nt, Human
aaaggaaugcaaagaugaaggu

SEQ ID NO: 2966429 - RNA, 19 nt, Human
aaaggaaugcaaagaugaa

SEQ ID NO: 2966430 - RNA, 13 nt, Human
ggucugucuuuua

SEQ ID NO: 2966431 - RNA, 14 nt, Human
ggucugucuuuuaa

SEQ ID NO: 2966432 - RNA, 20 nt, Human
ggugauuuagcaggaagcug

SEQ ID NO: 2966433 - RNA, 18 nt, Human
aaacaugcuguacauacu

SEQ ID NO: 2966434 - RNA, 16 nt, Human
aaacaugcuguacaua

SEQ ID NO: 2966435 - RNA, 15 nt, Human
aaacaugcuguacau

SEQ ID NO: 2966436 - RNA, 21 nt, Human
aaacaugcuguacauacuuuu

SEQ ID NO: 2966437 - RNA, 20 nt, Human
aaacaugcuguacauacuuu

SEQ ID NO: 2966438 - RNA, 22 nt, Human
aaacaugcuguacauacuuuuu

SEQ ID NO: 2966439 - RNA, 23 nt, Human
aaacaugcuguacauacuuuuug

SEQ ID NO: 2966440 - RNA, 20 nt, Human
aaacuacauuagguugugaa

SEQ ID NO: 2966441 - RNA, 22 nt, Human
aaacuacauuagguugugaaug

SEQ ID NO: 2966442 - RNA, 21 nt, Human
aaacuacauuagguugugaau

SEQ ID NO: 2966443 - RNA, 16 nt, Human
aaacucauuucuagca

SEQ ID NO: 2966444 - RNA, 18 nt, Human
aaacuacauugacagauu

SEQ ID NO: 2966445 - RNA, 17 nt, Human
gggauugaaggaugcug

SEQ ID NO: 2966446 - RNA, 21 nt, Human
gggauuuucagcccucagaau

SEQ ID NO: 2966447 - RNA, 20 nt, Human
auuaaugucaguauuucaac

SEQ ID NO: 2966448 - RNA, 16 nt, Human
auucauucuuuuugaa

SEQ ID NO: 2966449 - RNA, 21 nt, Human
auucauucuuuuugaaauguc

SEQ ID NO: 2966450 - RNA, 15 nt, Human
auucauucuuuuuga

SEQ ID NO: 2966451 - RNA, 14 nt, Human
auucauuaguuuug

SEQ ID NO: 2966452 - RNA, 15 nt, Human
auucauuaguuuuga

SEQ ID NO: 2966453 - RNA, 17 nt, Human
auuucucucaucuguua

SEQ ID NO: 2966454 - RNA, 19 nt, Human
auuugcacauuaaaugacu

SEQ ID NO: 2966455 - RNA, 17 nt, Human
auuugcacauuaaauga

SEQ ID NO: 2966456 - RNA, 15 nt, Human
auuugcacauuaaau

SEQ ID NO: 2966457 - RNA, 14 nt, Human
auuugcacauuaaa

SEQ ID NO: 2966458 - RNA, 13 nt, Human
auuuaauuugaag

SEQ ID NO: 2966459 - RNA, 15 nt, Human
auuuaauuugaaggu

SEQ ID NO: 2966460 - RNA, 22 nt, Human
auuuaauuugaagguagaaugu

SEQ ID NO: 2966461 - RNA, 17 nt, Human
auuucacaguguguggu

SEQ ID NO: 2966462 - RNA, 21 nt, Human
auuugcacauuaaaugacucu

SEQ ID NO: 2966463 - RNA, 20 nt, Human
auuugcacauuaaaugacuc

SEQ ID NO: 2966464 - RNA, 17 nt, Human
auuuucuccaaauguuc

SEQ ID NO: 2966465 - RNA, 23 nt, Human
caauugugaaaaaauuuacuuua

SEQ ID NO: 2966466 - RNA, 17 nt, Human
cacaaggaaauaaaauu

SEQ ID NO: 2966467 - RNA, 22 nt, Human
caauugugaaaaaauuuacuuu

SEQ ID NO: 2966468 - RNA, 18 nt, Human
caauauuuaaucuuuuau

SEQ ID NO: 2966469 - RNA, 19 nt, Human
cagacuggauaguccgucu

SEQ ID NO: 2966470 - RNA, 14 nt, Human
caguuguuauuuau

SEQ ID NO: 2966471 - RNA, 19 nt, Human
caguuguuauuuauugaaa

SEQ ID NO: 2966472 - RNA, 21 nt, Human
caguuguuauuuauugaaaug

SEQ ID NO: 2966473 - RNA, 17 nt, Human
cauuauguuaauauuuc

SEQ ID NO: 2966474 - RNA, 14 nt, Human
cauuauguuaauau

SEQ ID NO: 2966475 - RNA, 15 nt, Human
cauuauguuaauauu

SEQ ID NO: 2966476 - RNA, 16 nt, Human
cauuauguuaauauuu

SEQ ID NO: 2966477 - RNA, 14 nt, Human
ccaggaguuuggcc

SEQ ID NO: 2966478 - RNA, 15 nt, Human
ccaggaguuuggcca

SEQ ID NO: 2966479 - RNA, 16 nt, Human
ccaggaguuuggccag

SEQ ID NO: 2966480 - RNA, 17 nt, Human
ccaggaguuuggccaga

SEQ ID NO: 2966481 - RNA, 18 nt, Human
ccaggaguuuggccagaa

SEQ ID NO: 2966482 - RNA, 18 nt, Human
ccacuugagugucaagcu

SEQ ID NO: 2966483 - RNA, 14 nt, Human
cccauucuuggccc

SEQ ID NO: 2966484 - RNA, 13 nt, Human
ccucaugcugcca

SEQ ID NO: 2966485 - RNA, 15 nt, Human
ccucaugcugccaau

SEQ ID NO: 2966486 - RNA, 16 nt, Human
ccucaugcugccaaua

SEQ ID NO: 2966487 - RNA, 13 nt, Human
ccuuucccuuggu

SEQ ID NO: 2966488 - RNA, 13 nt, Human
cuaacuuggguua

SEQ ID NO: 2966489 - RNA, 19 nt, Human
cuaauaaaaaggugaccau

SEQ ID NO: 2966490 - RNA, 13 nt, Human
cuauguuaauauu

SEQ ID NO: 2966491 - RNA, 15 nt, Human
cuauguuaauauuuu

SEQ ID NO: 2966492 - RNA, 17 nt, Human
cuauguuaauauuuuag

SEQ ID NO: 2966493 - RNA, 14 nt, Human
cuauguuaauauuu

SEQ ID NO: 2966494 - RNA, 21 nt, Human
cuauguuaauauuuuaggugu

SEQ ID NO: 2966495 - RNA, 17 nt, Human
cuaucacugguuugguu

SEQ ID NO: 2966496 - RNA, 12 nt, Human
cuauguuuuugu

SEQ ID NO: 2966497 - RNA, 18 nt, Human
cucaguagucagacugga

SEQ ID NO: 2966498 - RNA, 16 nt, Human
cucucuguaauaaacu

SEQ ID NO: 2966499 - RNA, 21 nt, Human
cucucuguaauaaacucauuu

SEQ ID NO: 2966500 - RNA, 13 nt, Human
uuuugaaauguca

SEQ ID NO: 2966501 - RNA, 11 nt, Human
uuugcagagua

SEQ ID NO: 2966502 - RNA, 19 nt, Human
uuuucaauaacuggaacac

SEQ ID NO: 2966503 - RNA, 16 nt, Human
uuuucaauaacuggaa

SEQ ID NO: 2966504 - RNA, 13 nt, Human
uuuucaauaacug

SEQ ID NO: 2966505 - RNA, 23 nt, Human
uuuucaauaacuggaacacucua

SEQ ID NO: 2966506 - RNA, 15 nt, Human
uuuuauauucucagc

SEQ ID NO: 2966507 - RNA, 22 nt, Human
uuuuaucagaacuauguuuuug

SEQ ID NO: 2966508 - RNA, 22 nt, Human
uuuauuuggaaaggaaugcaaa

SEQ ID NO: 2966509 - RNA, 16 nt, Human
uuuauuuauuuauuca

SEQ ID NO: 2966510 - RNA, 23 nt, Human
uuuacuuuuuggaaaagaauaaa

SEQ ID NO: 2966511 - RNA, 15 nt, Human
uuuacuuuuuggaaa

SEQ ID NO: 2966512 - RNA, 13 nt, Human
uuuaaucuuuuau

SEQ ID NO: 2966513 - RNA, 19 nt, Human
uucuccagucauuauguua

SEQ ID NO: 2966514 - RNA, 17 nt, Human
uucuccagucauuaugu

SEQ ID NO: 2966515 - RNA, 14 nt, Human
uucuauuuauuugu

SEQ ID NO: 2966516 - RNA, 21 nt, Human
uucuauuuauuuauuuauuca

SEQ ID NO: 2966517 - RNA, 18 nt, Human
uucaguuuaucuguucau

SEQ ID NO: 2966518 - RNA, 15 nt, Human
uucaguuuaucuguu

SEQ ID NO: 2966519 - RNA, 21 nt, Human
uuccacuugagugucaagcug

SEQ ID NO: 2966520 - RNA, 17 nt, Human
uuccacuugagugucaa

SEQ ID NO: 2966521 - RNA, 20 nt, Human
uucaaucuggauucauauuu

SEQ ID NO: 2966522 - RNA, 23 nt, Human
uucaaucuggauucauauuuaau

SEQ ID NO: 2966523 - RNA, 19 nt, Human
uucaaucuggauucauauu

SEQ ID NO: 2966524 - RNA, 20 nt, Human
uuacuaaaaguuuugagaaa

SEQ ID NO: 2966525 - RNA, 19 nt, Human
uuacuaaaaguuuugagaa

SEQ ID NO: 2966526 - RNA, 19 nt, Human
uugacuauuuuuguuuuua

SEQ ID NO: 2966527 - RNA, 12 nt, Human
uugacuauuuuu

SEQ ID NO: 2966528 - RNA, 16 nt, Human
uugcauacuauuaaac

SEQ ID NO: 2966529 - RNA, 18 nt, Human
uugcauacuauuaaacau

SEQ ID NO: 2966530 - RNA, 19 nt, Human
uugcauacuauuaaacaug

SEQ ID NO: 2966531 - RNA, 18 nt, Human
uugaggguauguuuuaua

SEQ ID NO: 2966532 - RNA, 14 nt, Human
uugaaacuuuaaga

SEQ ID NO: 2966533 - RNA, 21 nt, Human
uuggaaaggaaugcaaagaug

SEQ ID NO: 2966534 - RNA, 16 nt, Human
uuggacauuuuauguc

SEQ ID NO: 2966535 - RNA, 17 nt, Human
uuggacauuuuaugucu

SEQ ID NO: 2966536 - RNA, 18 nt, Human
uuggacauuuuaugucuu

SEQ ID NO: 2966537 - RNA, 20 nt, Human
uuggacauuuuaugucuuuc

SEQ ID NO: 2966538 - RNA, 13 nt, Human
uugcuaacagcaa

SEQ ID NO: 2966539 - RNA, 20 nt, Human
uugcuaacagcaacacaaag

SEQ ID NO: 2966540 - RNA, 20 nt, Human
uuguacacucauucauuacu

SEQ ID NO: 2966541 - RNA, 20 nt, Human
uuggccagaagucaaggcuu

SEQ ID NO: 2966542 - RNA, 12 nt, Human
uuggguuuauuu

SEQ ID NO: 2966543 - RNA, 17 nt, Human
uuggguuuauuuggaaa

SEQ ID NO: 2966544 - RNA, 20 nt, Human
ugugaaugcagguuuuauca

SEQ ID NO: 2966545 - RNA, 14 nt, Human
ugugaaugcagguu

SEQ ID NO: 2966546 - RNA, 21 nt, Human
ugugaauaaagagggugggug

SEQ ID NO: 2966547 - RNA, 23 nt, Human
ugugaaaaaauuuacuuuaaacu

SEQ ID NO: 2966548 - RNA, 17 nt, Human
ugugaaaaaauuuacuu

SEQ ID NO: 2966549 - RNA, 12 nt, Human
ugugaaaaaauu

SEQ ID NO: 2966550 - RNA, 14 nt, Human
ugugcguccugucg

SEQ ID NO: 2966551 - RNA, 15 nt, Human
uguguacuuuuaaga

SEQ ID NO: 2966552 - RNA, 12 nt, Human
uguguacuuuua

SEQ ID NO: 2966553 - RNA, 21 nt, Human
uguaacuguuuagaugaaugu

SEQ ID NO: 2966554 - RNA, 22 nt, Human
ugucaguuguuauuuauugaaa

SEQ ID NO: 2966555 - RNA, 17 nt, Human
ugucaguuguuauuuau

SEQ ID NO: 2966556 - RNA, 18 nt, Human
ugucaguuguuauuuauu

SEQ ID NO: 2966557 - RNA, 16 nt, Human
uguugaaacuuuaaga

SEQ ID NO: 2966558 - RNA, 21 nt, Human
uguucuccagucauuauguua

SEQ ID NO: 2966559 - RNA, 15 nt, Human
uguuuaaugguaguu

SEQ ID NO: 2966560 - RNA, 19 nt, Human
ugugugcguccugucggag

SEQ ID NO: 2966561 - RNA, 15 nt, Human
uguuuuuauuauuaa

SEQ ID NO: 2966562 - RNA, 18 nt, Human
uguuuuuauuauuaacaa

SEQ ID NO: 2966563 - RNA, 22 nt, Human
ugccuaauaugaugacuguuuu

SEQ ID NO: 2966564 - RNA, 17 nt, Human
ugccuaauaugaugacu

SEQ ID NO: 2966565 - RNA, 17 nt, Human
ugccuaccaauauuuaa

SEQ ID NO: 2966566 - RNA, 23 nt, Human
ugccuaccaauauuuaaucuuuu

SEQ ID NO: 2966567 - RNA, 13 nt, Human
ugcacaucuguuu

SEQ ID NO: 2966568 - RNA, 23 nt, Human
uggggcagugcuuggcccaggag

SEQ ID NO: 2966569 - RNA, 20 nt, Human
uggggcagugcuuggcccag

SEQ ID NO: 2966570 - RNA, 22 nt, Human
uggggcagugcuuggcccagga

SEQ ID NO: 2966571 - RNA, 18 nt, Human
uggggcagugcuuggccc

SEQ ID NO: 2966572 - RNA, 13 nt, Human
uggguuuauuugg

SEQ ID NO: 2966573 - RNA, 17 nt, Human
uggccagaagucaaggc

SEQ ID NO: 2966574 - RNA, 15 nt, Human
ugcuuuuuuuggccu

SEQ ID NO: 2966575 - RNA, 13 nt, Human
ucuucuauauaau

SEQ ID NO: 2966576 - RNA, 12 nt, Human
ucuucuauuuau

SEQ ID NO: 2966577 - RNA, 22 nt, Human
ucuucuauauaauuccuguuuu

SEQ ID NO: 2966578 - RNA, 22 nt, Human
ucuucuauuuauuuauuuauuc

SEQ ID NO: 2966579 - RNA, 20 nt, Human
ucuguuacacaaagaaccac

SEQ ID NO: 2966580 - RNA, 19 nt, Human
ucuguaauaaacucauuuc

SEQ ID NO: 2966581 - RNA, 23 nt, Human
ucuguaauaaacucauuucuagc

SEQ ID NO: 2966582 - RNA, 24 nt, Human
ucuguaauaaacucauuucuagca

SEQ ID NO: 2966583 - RNA, 14 nt, Human
ucuuuuugaaaugu

SEQ ID NO: 2966584 - RNA, 17 nt, Human
ucucaaacuaacaggcu

SEQ ID NO: 2966585 - RNA, 15 nt, Human
ucucaaacuaacagg

SEQ ID NO: 2966586 - RNA, 16 nt, Human
ucccauucuuggccca

SEQ ID NO: 2966587 - RNA, 15 nt, Human
ucccauucuuggccc

SEQ ID NO: 2966588 - RNA, 17 nt, Human
ucccccuggcacugguu

SEQ ID NO: 2966589 - RNA, 15 nt, Human
ucaucuguuacacaa

SEQ ID NO: 2966590 - RNA, 12 nt, Human
ucagcagagugc

SEQ ID NO: 2966591 - RNA, 11 nt, Human
ucagcagagug

SEQ ID NO: 2966592 - RNA, 22 nt, Human
ucagcagagugcuuuaccaauu

SEQ ID NO: 2966593 - RNA, 16 nt, Human
ucagcagagugcuuua

SEQ ID NO: 2966594 - RNA, 18 nt, Human
ucaagcugaccuugcuga

SEQ ID NO: 2966595 - RNA, 20 nt, Human
uauuuuuguuuuuauuaaaa

SEQ ID NO: 2966596 - RNA, 18 nt, Human
uauuuuuguuuuuauuaa

SEQ ID NO: 2966597 - RNA, 13 nt, Human
ucaaacuaacagg

SEQ ID NO: 2966598 - RNA, 12 nt, Human
ucaaacuaacag

SEQ ID NO: 2966599 - RNA, 16 nt, Human
uauuuauugaaaugau

SEQ ID NO: 2966600 - RNA, 20 nt, Human
uauuuauugaaaugauuuca

SEQ ID NO: 2966601 - RNA, 12 nt, Human
uauuuauugaaa

SEQ ID NO: 2966602 - RNA, 23 nt, Human
uauuugaguggaguuacugaaca

SEQ ID NO: 2966603 - RNA, 23 nt, Human
uauuucugaggagccugcaacau

SEQ ID NO: 2966604 - RNA, 13 nt, Human
uauuuuacuuuuu

SEQ ID NO: 2966605 - RNA, 14 nt, Human
uauuuuacuuuuug

SEQ ID NO: 2966606 - RNA, 15 nt, Human
uauuuuacuuuuugg

SEQ ID NO: 2966607 - RNA, 22 nt, Human
uauuuuagguguaaaauaauua

SEQ ID NO: 2966608 - RNA, 12 nt, Human
uaaacacauuaa

SEQ ID NO: 2966609 - RNA, 22 nt, Human
uaaauaucccuuggacauuuua

SEQ ID NO: 2966610 - RNA, 22 nt, Human
uaaauauugguugggaugacuu

SEQ ID NO: 2966611 - RNA, 23 nt, Human
uaaauauugguugggaugacuug

SEQ ID NO: 2966612 - RNA, 18 nt, Human
uaaauauuuugacuuguu

SEQ ID NO: 2966613 - RNA, 15 nt, Human
uaaauauuuugacuu

SEQ ID NO: 2966614 - RNA, 19 nt, Human
uaaauauuuugacuuguug

SEQ ID NO: 2966615 - RNA, 16 nt, Human
guuuuguguacuuuua

SEQ ID NO: 2966616 - RNA, 15 nt, Human
guuuuguguacuuuu

SEQ ID NO: 2966617 - RNA, 17 nt, Human
guuuuguguacuuuuaa

SEQ ID NO: 2966618 - RNA, 13 nt, Human
guuuguucccugu

SEQ ID NO: 2966619 - RNA, 13 nt, Human
guuuuuauuaaaa

SEQ ID NO: 2966620 - RNA, 17 nt, Human
guuuuuauuaaaaggaa

SEQ ID NO: 2966621 - RNA, 14 nt, Human
guuuuuauuaaaag

SEQ ID NO: 2966622 - RNA, 15 nt, Human
guuuuuauuauuaac

SEQ ID NO: 2966623 - RNA, 18 nt, Human
guuuuuauuauuaacaaa

SEQ ID NO: 2966624 - RNA, 17 nt, Human
guuuagaugaaugucag

SEQ ID NO: 2966625 - RNA, 18 nt, Human
guuuagaugaaugucagu

SEQ ID NO: 2966626 - RNA, 16 nt, Human
uaagaacuaaaauguu

SEQ ID NO: 2966627 - RNA, 20 nt, Human
uaacagcaacacaaagcuuu

SEQ ID NO: 2966628 - RNA, 18 nt, Human
uaacagcaacacaaagcu

SEQ ID NO: 2966629 - RNA, 21 nt, Human
uaacaggcuuagugauguaau

SEQ ID NO: 2966630 - RNA, 14 nt, Human
uaacaggcuuagug

SEQ ID NO: 2966631 - RNA, 13 nt, Human
uacacuugugaau

SEQ ID NO: 2966632 - RNA, 23 nt, Human
uaccaauauuuaaucuuuuauga

SEQ ID NO: 2966633 - RNA, 21 nt, Human
uaccaauauuuaaucuuuuau

SEQ ID NO: 2966634 - RNA, 16 nt, Human
uaccaauauuuaaucu

SEQ ID NO: 2966635 - RNA, 13 nt, Human
uaccaauauuuaa

SEQ ID NO: 2966636 - RNA, 23 nt, Human
uagcaguaaaaaaugguguuuua

SEQ ID NO: 2966637 - RNA, 20 nt, Human
uagcagcccucaauugugaa

SEQ ID NO: 2966638 - RNA, 11 nt, Human
uagauguugcu

SEQ ID NO: 2966639 - RNA, 13 nt, Human
uagauguugcuaa

SEQ ID NO: 2966640 - RNA, 23 nt, Human
uauaauuccuguuuuuauuauua

SEQ ID NO: 2966641 - RNA, 22 nt, Human
uauaacaaaggauacuuauuua

SEQ ID NO: 2966642 - RNA, 20 nt, Human
uauaacaaaggauacuuauu

SEQ ID NO: 2966643 - RNA, 21 nt, Human
ggggcagugcuuggcccagga

SEQ ID NO: 2966644 - RNA, 23 nt, Human
ggggcagugcuuggcccaggagu

SEQ ID NO: 2966645 - RNA, 16 nt, Human
gguuauuuuacuuuuu

SEQ ID NO: 2966646 - RNA, 16 nt, Human
gggcacaucauuucaa

SEQ ID NO: 2966647 - RNA, 18 nt, Human
gggauaucacuuccauga

SEQ ID NO: 2966648 - RNA, 18 nt, Human
gggcagugcuuggcccag

SEQ ID NO: 2966649 - RNA, 19 nt, Human
gggcagugcuuggcccagg

SEQ ID NO: 2966650 - RNA, 20 nt, Human
gggcagugcuuggcccagga

SEQ ID NO: 2966651 - RNA, 22 nt, Human
gggcagugcuuggcccaggagu

SEQ ID NO: 2966652 - RNA, 23 nt, Human
gggcagugcuuggcccaggaguu

SEQ ID NO: 2966653 - RNA, 17 nt, Human
ggcuuagugauguaauu

SEQ ID NO: 2966654 - RNA, 16 nt, Human
ggcuuagacccucaug

SEQ ID NO: 2966655 - RNA, 21 nt, Human
ggcuuaauuauugauguuuuc

SEQ ID NO: 2966656 - RNA, 14 nt, Human
gcuuggcccaggag

SEQ ID NO: 2966657 - RNA, 15 nt, Human
gcuuggcccaggagu

SEQ ID NO: 2966658 - RNA, 16 nt, Human
gcuuggcccaggaguu

SEQ ID NO: 2966659 - RNA, 22 nt, Human
gcuuggcccaggaguuuggcca

SEQ ID NO: 2966660 - RNA, 13 nt, Human
gcuuggcccagga

SEQ ID NO: 2966661 - RNA, 23 nt, Human
gcuuggcccaggaguuuggccag

SEQ ID NO: 2966662 - RNA, 22 nt, Human
gcuuuaccaauugaaguaaaau

SEQ ID NO: 2966663 - RNA, 10 nt, Human
ggaaaagaau

SEQ ID NO: 2966664 - RNA, 19 nt, Human
gccuuuuuauaacuuuuua

SEQ ID NO: 2966665 - RNA, 22 nt, Human
gcguccugucggagcccugucu

SEQ ID NO: 2966666 - RNA, 14 nt, Human
gcuaacuuggguua

SEQ ID NO: 2966667 - RNA, 19 nt, Human
gcguccugucggagcccug

SEQ ID NO: 2966668 - RNA, 16 nt, Human
gcagugcuuggcccag

SEQ ID NO: 2966669 - RNA, 17 nt, Human
gcagugcuuggcccagg

SEQ ID NO: 2966670 - RNA, 22 nt, Human
gcauauugcauacuauuaaaca

SEQ ID NO: 2966671 - RNA, 22 nt, Human
gcagaguggcagucuucaguuu

SEQ ID NO: 2966672 - RNA, 13 nt, Human
gcagaguggcagu

SEQ ID NO: 2966673 - RNA, 15 nt, Human
gcaaacuucagaguu

SEQ ID NO: 2966674 - RNA, 20 nt, Human
gauugggcacaucauuucaa

SEQ ID NO: 2966675 - RNA, 20 nt, Human
gauuuaaacacauuaaaggu

SEQ ID NO: 2966676 - RNA, 22 nt, Human
gaugaaugucaguuguuauuua

SEQ ID NO: 2966677 - RNA, 20 nt, Human
gaguuauugaagcagagugg

SEQ ID NO: 2966678 - RNA, 19 nt, Human
gaguuauugaagcagagug

SEQ ID NO: 2966679 - RNA, 18 nt, Human
gaguuauugaagcagagu

SEQ ID NO: 2966680 - RNA, 14 nt, Human
gaacaucacagcuu

SEQ ID NO: 2966681 - RNA, 20 nt, Human
gaagauucuauguuaauauu

SEQ ID NO: 2966682 - RNA, 23 nt, Human
gaagauucuauguuaauauuuua

SEQ ID NO: 2966683 - RNA, 17 nt, Human
gaagauucuauguuaau

SEQ ID NO: 2966684 - RNA, 23 nt, Human
gaaggugccucuggaugcuguga

SEQ ID NO: 2966685 - RNA, 17 nt, Human
gaaugucaguuguuauu

SEQ ID NO: 2966686 - RNA, 21 nt, Human
gaaugucaguuguuauuuauu

SEQ ID NO: 2966687 - RNA, 22 nt, Human
gaauugauugggcacaucauuu

SEQ ID NO: 2966688 - RNA, 17 nt, Human
gacuggauaguccgucu

SEQ ID NO: 2966689 - RNA, 16 nt, Human
gacuggauaguccguc

SEQ ID NO: 2966690 - RNA, 22 nt, Human
gacuggauaguccgucucugcu

SEQ ID NO: 2966691 - RNA, 21 nt, Human
gacagagccccacccucagau

SEQ ID NO: 2966692 - RNA, 13 nt, Human
gacaguuggguuu

SEQ ID NO: 2966693 - RNA, 17 nt, Human
gacaguuggguuuuuua

SEQ ID NO: 2966694 - RNA, 14 nt, Human
cuuuuugaaauguc

SEQ ID NO: 2966695 - RNA, 15 nt, Human
cuuuuucaauaacug

SEQ ID NO: 2966696 - RNA, 16 nt, Human
cuuguacacucauuca

SEQ ID NO: 2966697 - RNA, 16 nt, Human
cuuguugaggguaugu

SEQ ID NO: 2966698 - RNA, 22 nt, Human
cuuguugaggguauguuuuaua

SEQ ID NO: 2966699 - RNA, 21 nt, Human
cuuguugaggguauguuuuau

SEQ ID NO: 2966700 - RNA, 20 nt, Human
cuuguugaggguauguuuua

SEQ ID NO: 2966701 - RNA, 22 nt, Human
cuugcagcucuccccuucucug

SEQ ID NO: 2966702 - RNA, 14 nt, Human
cuuauuuaaauaga

SEQ ID NO: 2966703 - RNA, 13 nt, Human
cuuauuuaaauag

SEQ ID NO: 2966704 - RNA, 19 nt, Human
cuuauuuaaauagaugaca

SEQ ID NO: 2966705 - RNA, 18 nt, Human
cuuauuuaaauagaugac

SEQ ID NO: 2966706 - RNA, 14 nt, Human
cuuagacccucaug

SEQ ID NO: 2966707 - RNA, 18 nt, Human
cuuagacccucaugcugc

SEQ ID NO: 2966708 - RNA, 19 nt, Human
cuuaauaaacuguggugcu

SEQ ID NO: 2966709 - RNA, 18 nt, Human
cuuaagaaauuuguggaa

SEQ ID NO: 2966710 - RNA, 22 nt, Human
cucccuuccuaugcuguucacu

SEQ ID NO: 2966711 - RNA, 13 nt, Human
cucauucauuacu

SEQ ID NO: 2966712 - RNA, 17 nt, Human
cucauucauuacuaaaa

SEQ ID NO: 2966713 - RNA, 16 nt, Human
cugaacuucagagcau

SEQ ID NO: 2966714 - RNA, 20 nt, Human
cuggacacuucacgcccuug

SEQ ID NO: 2966715 - RNA, 22 nt, Human
cuggacacuucacgcccuuggc

SEQ ID NO: 2966716 - RNA, 17 nt, Human
cugcagggacagagcau

SEQ ID NO: 2966717 - RNA, 14 nt, Human
ccucaauugugaaa

SEQ ID NO: 2966718 - RNA, 18 nt, Human
ccucaauaaacauuucau

SEQ ID NO: 2966719 - RNA, 22 nt, Human
cccuuuuucaauaacuggaaca

SEQ ID NO: 2966720 - RNA, 17 nt, Human
cccuuuuucaauaacug

SEQ ID NO: 2966721 - RNA, 16 nt, Human
cccugugucauuucaa

SEQ ID NO: 2966722 - RNA, 18 nt, Human
ccagaagucaaggcuuag

SEQ ID NO: 2966723 - RNA, 12 nt, Human
ccaauauccuaa

SEQ ID NO: 2966724 - RNA, 13 nt, Human
ccaauauccuaau

SEQ ID NO: 2966725 - RNA, 14 nt, Human
ccaauauccuaaua

SEQ ID NO: 2966726 - RNA, 15 nt, Human
ccaauauccuaauaa

SEQ ID NO: 2966727 - RNA, 16 nt, Human
ccaauauccuaauaaa

SEQ ID NO: 2966728 - RNA, 17 nt, Human
ccaauauccuaauaaaa

SEQ ID NO: 2966729 - RNA, 18 nt, Human
ccaauauccuaauaaaaa

SEQ ID NO: 2966730 - RNA, 19 nt, Human
ccaauauccuaauaaaaag

SEQ ID NO: 2966731 - RNA, 17 nt, Human
cccaggaguuuggccag

SEQ ID NO: 2966732 - RNA, 18 nt, Human
cccaggaguuuggccaga

SEQ ID NO: 2966733 - RNA, 19 nt, Human
cccaggaguuuggccagaa

SEQ ID NO: 2966734 - RNA, 20 nt, Human
cccaggaguuuggccagaag

SEQ ID NO: 2966735 - RNA, 15 nt, Human
cccaggaguuuggcc

SEQ ID NO: 2966736 - RNA, 16 nt, Human
cccaggaguuuggcca

SEQ ID NO: 2966737 - RNA, 21 nt, Human
cucucuguaauaaacucauuu

SEQ ID NO: 2966738 - RNA, 16 nt, Human
cucucuguaauaaacu

SEQ ID NO: 2966739 - RNA, 18 nt, Human
cucaguagucagacugga

SEQ ID NO: 2966740 - RNA, 12 nt, Human
cuauguuuuugu

SEQ ID NO: 2966741 - RNA, 17 nt, Human
cuaucacugguuugguu

SEQ ID NO: 2966742 - RNA, 21 nt, Human
cuauguuaauauuuuaggugu

SEQ ID NO: 2966743 - RNA, 14 nt, Human
cuauguuaauauuu

SEQ ID NO: 2966744 - RNA, 17 nt, Human
cuauguuaauauuuuag

SEQ ID NO: 2966745 - RNA, 15 nt, Human
cuauguuaauauuuu

SEQ ID NO: 2966746 - RNA, 13 nt, Human
cuauguuaauauu

SEQ ID NO: 2966747 - RNA, 19 nt, Human
cuaauaaaaaggugaccau

SEQ ID NO: 2966748 - RNA, 13 nt, Human
cuaacuuggguua

SEQ ID NO: 2966749 - RNA, 13 nt, Human
ccuuucccuuggu

SEQ ID NO: 2966750 - RNA, 16 nt, Human
ccucaugcugccaaua

SEQ ID NO: 2966751 - RNA, 15 nt, Human
ccucaugcugccaau

SEQ ID NO: 2966752 - RNA, 13 nt, Human
ccucaugcugcca

SEQ ID NO: 2966753 - RNA, 14 nt, Human
cccauucuuggccc

SEQ ID NO: 2966754 - RNA, 18 nt, Human
ccacuugagugucaagcu

SEQ ID NO: 2966755 - RNA, 18 nt, Human
ccaggaguuuggccagaa

SEQ ID NO: 2966756 - RNA, 17 nt, Human
ccaggaguuuggccaga

SEQ ID NO: 2966757 - RNA, 16 nt, Human
ccaggaguuuggccag

SEQ ID NO: 2966758 - RNA, 15 nt, Human
ccaggaguuuggcca

SEQ ID NO: 2966759 - RNA, 14 nt, Human
ccaggaguuuggcc

SEQ ID NO: 2966760 - RNA, 16 nt, Human
cauuauguuaauauuu

SEQ ID NO: 2966761 - RNA, 15 nt, Human
cauuauguuaauauu

SEQ ID NO: 2966762 - RNA, 14 nt, Human
cauuauguuaauau

SEQ ID NO: 2966763 - RNA, 17 nt, Human
cauuauguuaauauuuc

SEQ ID NO: 2966764 - RNA, 21 nt, Human
caguuguuauuuauugaaaug

SEQ ID NO: 2966765 - RNA, 19 nt, Human
caguuguuauuuauugaaa

SEQ ID NO: 2966766 - RNA, 14 nt, Human
caguuguuauuuau

SEQ ID NO: 2966767 - RNA, 19 nt, Human
cagacuggauaguccgucu

SEQ ID NO: 2966768 - RNA, 18 nt, Human
caauauuuaaucuuuuau

SEQ ID NO: 2966769 - RNA, 22 nt, Human
caauugugaaaaaauuuacuuu

SEQ ID NO: 2966770 - RNA, 17 nt, Human
cacaaggaaauaaaauu

SEQ ID NO: 2966771 - RNA, 23 nt, Human
caauugugaaaaaauuuacuuua

SEQ ID NO: 2966772 - RNA, 17 nt, Human
auuuucuccaaauguuc

SEQ ID NO: 2966773 - RNA, 20 nt, Human
auuugcacauuaaaugacuc

SEQ ID NO: 2966774 - RNA, 21 nt, Human
auuugcacauuaaaugacucu

SEQ ID NO: 2966775 - RNA, 17 nt, Human
auuucacaguguguggu

SEQ ID NO: 2966776 - RNA, 22 nt, Human
auuuaauuugaagguagaaugu

SEQ ID NO: 2966777 - RNA, 15 nt, Human
auuuaauuugaaggu

SEQ ID NO: 2966778 - RNA, 13 nt, Human
auuuaauuugaag

SEQ ID NO: 2966779 - RNA, 14 nt, Human
auuugcacauuaaa

SEQ ID NO: 2966780 - RNA, 15 nt, Human
auuugcacauuaaau

SEQ ID NO: 2966781 - RNA, 17 nt, Human
auuugcacauuaaauga

SEQ ID NO: 2966782 - RNA, 19 nt, Human
auuugcacauuaaaugacu

SEQ ID NO: 2966783 - RNA, 17 nt, Human
auuucucucaucuguua

SEQ ID NO: 2966784 - RNA, 15 nt, Human
auucauuaguuuuga

SEQ ID NO: 2966785 - RNA, 14 nt, Human
auucauuaguuuug

SEQ ID NO: 2966786 - RNA, 15 nt, Human
auucauucuuuuuga

SEQ ID NO: 2966787 - RNA, 21 nt, Human
auucauucuuuuugaaauguc

SEQ ID NO: 2966788 - RNA, 16 nt, Human
auucauucuuuuugaa

SEQ ID NO: 2966789 - RNA, 21 nt, Human
gggauuuucagcccucagaau

SEQ ID NO: 2966790 - RNA, 17 nt, Human
gggauugaaggaugcug

SEQ ID NO: 2966791 - RNA, 18 nt, Human
aaacuacauugacagauu

SEQ ID NO: 2966792 - RNA, 16 nt, Human
aaacucauuucuagca

SEQ ID NO: 2966793 - RNA, 21 nt, Human
aaacuacauuagguugugaau

SEQ ID NO: 2966794 - RNA, 22 nt, Human
aaacuacauuagguugugaaug

SEQ ID NO: 2966795 - RNA, 20 nt, Human
aaacuacauuagguugugaa

SEQ ID NO: 2966796 - RNA, 22 nt, Human
aaacaugcuguacauacuuuuu

SEQ ID NO: 2966797 - RNA, 20 nt, Human
aaacaugcuguacauacuuu

SEQ ID NO: 2966798 - RNA, 21 nt, Human
aaacaugcuguacauacuuuu

SEQ ID NO: 2966799 - RNA, 15 nt, Human
aaacaugcuguacau

SEQ ID NO: 2966800 - RNA, 16 nt, Human
aaacaugcuguacaua

SEQ ID NO: 2966801 - RNA, 18 nt, Human
aaacaugcuguacauacu

SEQ ID NO: 2966802 - RNA, 20 nt, Human
ggugauuuagcaggaagcug

SEQ ID NO: 2966803 - RNA, 14 nt, Human
ggucugucuuuuaa

SEQ ID NO: 2966804 - RNA, 13 nt, Human
ggucugucuuuua

SEQ ID NO: 2966805 - RNA, 19 nt, Human
aaaggaaugcaaagaugaa

SEQ ID NO: 2966806 - RNA, 22 nt, Human
aaaggaaugcaaagaugaaggu

SEQ ID NO: 2966807 - RNA, 19 nt, Human
aaagaugaaggucuguuuu

SEQ ID NO: 2966808 - RNA, 12 nt, Human
ggauuuucagcc

SEQ ID NO: 2966809 - RNA, 21 nt, Human
ggcccaggaguuuggccagaa

SEQ ID NO: 2966810 - RNA, 23 nt, Human
ggcccaggaguuuggccagaagu

SEQ ID NO: 2966811 - RNA, 22 nt, Human
ggcccaggaguuuggccagaag

SEQ ID NO: 2966812 - RNA, 15 nt, Human
gccuaccaauauuua

SEQ ID NO: 2966813 - RNA, 14 nt, Human
gccacuuuauuucu

SEQ ID NO: 2966814 - RNA, 22 nt, Human
gccagaagucaaggcuuagacc

SEQ ID NO: 2966815 - RNA, 20 nt, Human
gccagaagucaaggcuuaga

SEQ ID NO: 2966816 - RNA, 16 nt, Human
gccagaagucaaggcu

SEQ ID NO: 2966817 - RNA, 23 nt, Human
gccagaagucaaggcuuagaccc

SEQ ID NO: 2966818 - RNA, 16 nt, Human
gcugcugauuuaaaca

SEQ ID NO: 2966819 - RNA, 17 nt, Human
gcuguacauacuuuuug

SEQ ID NO: 2966820 - RNA, 13 nt, Human
gcuguacauacuu

SEQ ID NO: 2966821 - RNA, 14 nt, Human
gcuguacauacuuu

SEQ ID NO: 2966822 - RNA, 15 nt, Human
gcuguacauacuuuu

SEQ ID NO: 2966823 - RNA, 16 nt, Human
gcuguacauacuuuuu

SEQ ID NO: 2966824 - RNA, 17 nt, Human
gaguggaguuacugaac

SEQ ID NO: 2966825 - RNA, 11 nt, Human
gaguggaguua

SEQ ID NO: 2966826 - RNA, 13 nt, Human
gcacaucauuuca

SEQ ID NO: 2966827 - RNA, 11 nt, Human
gaagcagagug

SEQ ID NO: 2966828 - RNA, 12 nt, Human
gaagcagagugg

SEQ ID NO: 2966829 - RNA, 16 nt, Human
gaaguucuauuuauuu

SEQ ID NO: 2966830 - RNA, 22 nt, Human
gacauugacuauuuuuguuuuu

SEQ ID NO: 2966831 - RNA, 14 nt, Human
gacauugacuauuu

SEQ ID NO: 2966832 - RNA, 12 nt, Human
gacauucccugc

SEQ ID NO: 2966833 - RNA, 13 nt, Human
gacucuucccuca

SEQ ID NO: 2966834 - RNA, 13 nt, Human
cuuggcccaggag

SEQ ID NO: 2966835 - RNA, 20 nt, Human
cugcuuauccguuagccgug

SEQ ID NO: 2966836 - RNA, 16 nt, Human
cugcugauuuaaacac

SEQ ID NO: 2966837 - RNA, 22 nt, Human
cugcugauuuaaacacauuaaa

SEQ ID NO: 2966838 - RNA, 17 nt, Human
aaauuuacuuuaaacua

SEQ ID NO: 2966839 - RNA, 20 nt, Human
aaauuuacuuuaaacuacau

SEQ ID NO: 2966840 - RNA, 17 nt, Human
gucaacauuucucaugu

SEQ ID NO: 2966841 - RNA, 13 nt, Human
gucaacauuucuc

SEQ ID NO: 2966842 - RNA, 17 nt, Human
aaaggauacuuauuuaa

SEQ ID NO: 2966843 - RNA, 15 nt, Human
aaaggauacuuauuu

SEQ ID NO: 2966844 - RNA, 15 nt, Human
aaaugauuucacagu

SEQ ID NO: 2966845 - RNA, 22 nt, Human
aacaguaacauagcugugauuu

SEQ ID NO: 2966846 - RNA, 18 nt, Human
aacaggcuuagugaugua

SEQ ID NO: 2966847 - RNA, 15 nt, Human
aacaguaacauagcu

SEQ ID NO: 2966848 - RNA, 22 nt, Human
aacauuuauuugaguggaguua

SEQ ID NO: 2966849 - RNA, 21 nt, Human
aacacucuauaacaaaggaua

SEQ ID NO: 2966850 - RNA, 22 nt, Human
aacacugguuuuaaauauuuug

SEQ ID NO: 2966851 - RNA, 18 nt, Human
aacacugguuuuaaauau

SEQ ID NO: 2966852 - RNA, 16 nt, Human
aaccccaaguuaguuc

SEQ ID NO: 2966853 - RNA, 14 nt, Human
guuuuacaguguuu

SEQ ID NO: 2966854 - RNA, 20 nt, Human
guuuaaugguaguuuuacag

SEQ ID NO: 2966855 - RNA, 14 nt, Human
guuacacaaagaac

SEQ ID NO: 2966856 - RNA, 17 nt, Human
guggcuaacuuggguua

SEQ ID NO: 2966857 - RNA, 17 nt, Human
aagacccucucaaacua

SEQ ID NO: 2966858 - RNA, 23 nt, Human
aagaauugauugggcacaucauu

SEQ ID NO: 2966859 - RNA, 24 nt, Human
aagaaugcaguacuaacauuuauu

SEQ ID NO: 2966860 - RNA, 15 nt, Human
gugccuaauguguuu

SEQ ID NO: 2966861 - RNA, 21 nt, Human
aacuuuaagaacuaaaauguu

SEQ ID NO: 2966862 - RNA, 18 nt, Human
uaaugagcuuaagaaauu

SEQ ID NO: 2966863 - RNA, 18 nt, Human
uaaugguaguuuuacagu

SEQ ID NO: 2966864 - RNA, 13 nt, Human
aaugacucuuccc

SEQ ID NO: 2966865 - RNA, 18 nt, Human
uaauuauugauguuuuca

SEQ ID NO: 2966866 - RNA, 14 nt, Human
aaugagcuuaagaa

SEQ ID NO: 2966867 - RNA, 18 nt, Human
aaugcaguacuaacauuu

SEQ ID NO: 2966868 - RNA, 17 nt, Human
aauaacuggaacacucu

SEQ ID NO: 2966869 - RNA, 20 nt, Human
guuuugaagauucuauguua

SEQ ID NO: 2966870 - RNA, 17 nt, Human
guuuugaagauucuaug

SEQ ID NO: 2966871 - RNA, 16 nt, Human
guuuugaagauucuau

SEQ ID NO: 2966872 - RNA, 13 nt, Human
aauaaaaagguga

SEQ ID NO: 2966873 - RNA, 12 nt, Human
aauaaaaaggug

SEQ ID NO: 2966874 - RNA, 16 nt, Human
aauaaaaaggugacca

SEQ ID NO: 2966875 - RNA, 14 nt, Human
uaaauagaugacau

SEQ ID NO: 2966876 - RNA, 19 nt, Human
uaaauagaugacauugacu

SEQ ID NO: 2966877 - RNA, 21 nt, Human
uaaauagaugacauugacuau

SEQ ID NO: 2966878 - RNA, 15 nt, Human
aauauugguugggau

SEQ ID NO: 2966879 - RNA, 21 nt, Human
aauauugguugggaugacuug

SEQ ID NO: 2966880 - RNA, 21 nt, Human
aauauuuuagguguaaaauaa

SEQ ID NO: 2966881 - RNA, 16 nt, Human
aauaugaugacuguuu

SEQ ID NO: 2966882 - RNA, 17 nt, Human
aauaugaugacuguuuu

SEQ ID NO: 2966883 - RNA, 21 nt, Human
aauauccuaauaaaaagguga

SEQ ID NO: 2966884 - RNA, 20 nt, Human
aauagcauguccuaaugcuu

SEQ ID NO: 2966885 - RNA, 19 nt, Human
aauagaugacauugacuau

SEQ ID NO: 2966886 - RNA, 21 nt, Human
aauagaugacauugacuauuu

SEQ ID NO: 2966887 - RNA, 22 nt, Human
aauagaugacauugacuauuuu

SEQ ID NO: 2966888 - RNA, 19 nt, Human
aauauccuaauaaaaaggu

SEQ ID NO: 2966889 - RNA, 15 nt, Human
aauauccuaauaaaa

SEQ ID NO: 2966890 - RNA, 20 nt, Human
aauauccaauugcugcuugu

SEQ ID NO: 2966891 - RNA, 14 nt, Human
aauauccuaauaaa

SEQ ID NO: 2966892 - RNA, 13 nt, Human
aauauccuaauaa

SEQ ID NO: 2966893 - RNA, 12 nt, Human
aauauccuaaua

SEQ ID NO: 2966894 - RNA, 22 nt, Human
aauaucccuuggacauuuuaug

SEQ ID NO: 2966895 - RNA, 20 nt, Human
aauaucccuuggacauuuua

SEQ ID NO: 2966896 - RNA, 21 nt, Human
aauaucccuuggacauuuuau

SEQ ID NO: 2966897 - RNA, 15 nt, Human
acaaagcuuuugcau

SEQ ID NO: 2966898 - RNA, 22 nt, Human
acaaagcuuuugcauauugcau

SEQ ID NO: 2966899 - RNA, 23 nt, Human
acaaagcuuuugcauauugcaua

SEQ ID NO: 2966900 - RNA, 21 nt, Human
acaaaggauacuuauuuaaau

SEQ ID NO: 2966901 - RNA, 23 nt, Human
acaaaggauacuuauuuaaauag

SEQ ID NO: 2966902 - RNA, 20 nt, Human
uagaugaaugucaguuguua

SEQ ID NO: 2966903 - RNA, 23 nt, Human
aauuugccuaauaugaugacugu

SEQ ID NO: 2966904 - RNA, 10 nt, Human
uacuuuuugg

SEQ ID NO: 2966905 - RNA, 12 nt, Human
aauuugcacauu

SEQ ID NO: 2966906 - RNA, 12 nt, Human
uacuuauuuaaa

SEQ ID NO: 2966907 - RNA, 14 nt, Human
uacuuauuuaaaua

SEQ ID NO: 2966908 - RNA, 21 nt, Human
uacuuauuuaaauagaugaca

SEQ ID NO: 2966909 - RNA, 16 nt, Human
aauuugcacauuaaau

SEQ ID NO: 2966910 - RNA, 14 nt, Human
aauuugcacauuaa

SEQ ID NO: 2966911 - RNA, 16 nt, Human
aauuuacuuuaaacua

SEQ ID NO: 2966912 - RNA, 15 nt, Human
aauuuacuuuaaacu

SEQ ID NO: 2966913 - RNA, 18 nt, Human
aauuuacuuuaaacuaca

SEQ ID NO: 2966914 - RNA, 21 nt, Human
uacuaaaaguuuugagaaauu

SEQ ID NO: 2966915 - RNA, 23 nt, Human
uacugggaaagggauuuucagcc

SEQ ID NO: 2966916 - RNA, 14 nt, Human
uacugaacaguaac

SEQ ID NO: 2966917 - RNA, 20 nt, Human
aauugauugggcacaucauu

SEQ ID NO: 2966918 - RNA, 23 nt, Human
aauugauugggcacaucauuuca

SEQ ID NO: 2966919 - RNA, 19 nt, Human
aauugauugggcacaucau

SEQ ID NO: 2966920 - RNA, 12 nt, Human
uagguugugaau

SEQ ID NO: 2966921 - RNA, 14 nt, Human
acacaccuaacuua

SEQ ID NO: 2966922 - RNA, 23 nt, Human
uaguucaaucuggauucauauuu

SEQ ID NO: 2966923 - RNA, 18 nt, Human
acacaugcugaacaucac

SEQ ID NO: 2966924 - RNA, 19 nt, Human
uauauucauucuuuuugaa

SEQ ID NO: 2966925 - RNA, 20 nt, Human
uauauucauucuuuuugaaa

SEQ ID NO: 2966926 - RNA, 18 nt, Human
acacuugugaauaaagag

SEQ ID NO: 2966927 - RNA, 12 nt, Human
acacuugugaau

SEQ ID NO: 2966928 - RNA, 13 nt, Human
acacuugugaaua

SEQ ID NO: 2966929 - RNA, 15 nt, Human
acacucuauaacaaa

SEQ ID NO: 2966930 - RNA, 20 nt, Human
acagcaacacaaagcuuuug

SEQ ID NO: 2966931 - RNA, 17 nt, Human
acagcaacacaaagcuu

SEQ ID NO: 2966932 - RNA, 20 nt, Human
uauccuagucauucuucccu

SEQ ID NO: 2966933 - RNA, 15 nt, Human
uauuugugagacugu

SEQ ID NO: 2966934 - RNA, 15 nt, Human
acauuagguugugaa

SEQ ID NO: 2966935 - RNA, 16 nt, Human
acauuagguugugaau

SEQ ID NO: 2966936 - RNA, 17 nt, Human
acauuagguugugaaug

SEQ ID NO: 2966937 - RNA, 21 nt, Human
acaugcugaacaucacagcuu

SEQ ID NO: 2966938 - RNA, 14 nt, Human
acaugcugaacauc

SEQ ID NO: 2966939 - RNA, 17 nt, Human
acaugcuguacauacuu

SEQ ID NO: 2966940 - RNA, 19 nt, Human
acaugcuguacauacuuuu

SEQ ID NO: 2966941 - RNA, 19 nt, Human
acauuaaaugacucuuccc

SEQ ID NO: 2966942 - RNA, 21 nt, Human
acauuaaaugacucuucccuc

SEQ ID NO: 2966943 - RNA, 16 nt, Human
ucaagaaugcaguacu

SEQ ID NO: 2966944 - RNA, 14 nt, Human
ucaaggcuuagacc

SEQ ID NO: 2966945 - RNA, 11 nt, Human
acauacuuuuu

SEQ ID NO: 2966946 - RNA, 13 nt, Human
acauacuuuuugg

SEQ ID NO: 2966947 - RNA, 17 nt, Human
acauacuuuuuggguuu

SEQ ID NO: 2966948 - RNA, 20 nt, Human
acauacuuuuuggguuuauu

SEQ ID NO: 2966949 - RNA, 18 nt, Human
acaguuggguuuuuuaag

SEQ ID NO: 2966950 - RNA, 16 nt, Human
acaguuggguuuuuua

SEQ ID NO: 2966951 - RNA, 13 nt, Human
acaucuguuuugu

SEQ ID NO: 2966952 - RNA, 14 nt, Human
acauagcugugauu

SEQ ID NO: 2966953 - RNA, 17 nt, Human
accaauauuuaaucuuu

SEQ ID NO: 2966954 - RNA, 16 nt, Human
accaauauuuaaucuu

SEQ ID NO: 2966955 - RNA, 20 nt, Human
accaauauuuaaucuuuuau

SEQ ID NO: 2966956 - RNA, 23 nt, Human
accaauauuuaaucuuuuaugau

SEQ ID NO: 2966957 - RNA, 14 nt, Human
uccccucuccucca

SEQ ID NO: 2966958 - RNA, 11 nt, Human
uccuaaauagc

SEQ ID NO: 2966959 - RNA, 17 nt, Human
ucccugugucauuucaa

SEQ ID NO: 2966960 - RNA, 16 nt, Human
ucccugugucauuuca

SEQ ID NO: 2966961 - RNA, 18 nt, Human
acuaacauuuauuugagu

SEQ ID NO: 2966962 - RNA, 12 nt, Human
acuaacaggcuu

SEQ ID NO: 2966963 - RNA, 17 nt, Human
acuaacaggcuuaguga

SEQ ID NO: 2966964 - RNA, 18 nt, Human
acuaacaggcuuagugau

SEQ ID NO: 2966965 - RNA, 12 nt, Human
ucauuacuaaaa

SEQ ID NO: 2966966 - RNA, 21 nt, Human
ucauucuuuuugaaaugucaa

SEQ ID NO: 2966967 - RNA, 22 nt, Human
accuggauugugccuaaugugu

SEQ ID NO: 2966968 - RNA, 22 nt, Human
uccaaucugugaugacauuccc

SEQ ID NO: 2966969 - RNA, 18 nt, Human
ucgcuccaccuugcagcu

SEQ ID NO: 2966970 - RNA, 12 nt, Human
ucugacuauaac

SEQ ID NO: 2966971 - RNA, 18 nt, Human
ucucucaucuguuacaca

SEQ ID NO: 2966972 - RNA, 11 nt, Human
acuuuaaacua

SEQ ID NO: 2966973 - RNA, 21 nt, Human
ucuauuucuggaugaaugccc

SEQ ID NO: 2966974 - RNA, 15 nt, Human
ucuuacaucugaaau

SEQ ID NO: 2966975 - RNA, 14 nt, Human
agacaguuggguuu

SEQ ID NO: 2966976 - RNA, 20 nt, Human
ucugugaugacauucccugc

SEQ ID NO: 2966977 - RNA, 17 nt, Human
ucugugaugacauuccc

SEQ ID NO: 2966978 - RNA, 12 nt, Human
ucuguauguguu

SEQ ID NO: 2966979 - RNA, 15 nt, Human
ucuguauguguucua

SEQ ID NO: 2966980 - RNA, 12 nt, Human
agaauguuuuca

SEQ ID NO: 2966981 - RNA, 17 nt, Human
agacccucaugcugcca

SEQ ID NO: 2966982 - RNA, 12 nt, Human
ugaagcagagug

SEQ ID NO: 2966983 - RNA, 13 nt, Human
ugaagcagagugg

SEQ ID NO: 2966984 - RNA, 16 nt, Human
ugaagcagaguggcag

SEQ ID NO: 2966985 - RNA, 15 nt, Human
ugaaugucaguuguu

SEQ ID NO: 2966986 - RNA, 14 nt, Human
ugaaauaaggaaug

SEQ ID NO: 2966987 - RNA, 18 nt, Human
ugaaauaaggaaugauau

SEQ ID NO: 2966988 - RNA, 20 nt, Human
agcaggaagcugugagagca

SEQ ID NO: 2966989 - RNA, 20 nt, Human
agcaguuugguuucuagcau

SEQ ID NO: 2966990 - RNA, 23 nt, Human
agcaguuugguuucuagcaugaa

SEQ ID NO: 2966991 - RNA, 22 nt, Human
agcaguuugguuucuagcauga

SEQ ID NO: 2966992 - RNA, 14 nt, Human
ugaguggaguuacu

SEQ ID NO: 2966993 - RNA, 18 nt, Human
ugagugcaaacuucagag

SEQ ID NO: 2966994 - RNA, 20 nt, Human
ugagugcaaacuucagaguu

SEQ ID NO: 2966995 - RNA, 22 nt, Human
ugagugcaaacuucagaguucu

SEQ ID NO: 2966996 - RNA, 18 nt, Human
ugcaucuagccucaagcu

SEQ ID NO: 2966997 - RNA, 16 nt, Human
ugauuucacagugugu

SEQ ID NO: 2966998 - RNA, 14 nt, Human
ugauuucacagugu

SEQ ID NO: 2966999 - RNA, 16 nt, Human
ugcaaacuucagaguu

SEQ ID NO: 2967000 - RNA, 23 nt, Human
ugcaaagaugaaggucuguuuug

SEQ ID NO: 2967001 - RNA, 12 nt, Human
ugcaaagaugaa

SEQ ID NO: 2967002 - RNA, 15 nt, Human
ugcacauuaaaugac

SEQ ID NO: 2967003 - RNA, 18 nt, Human
ugcacauuaaaugacucu

SEQ ID NO: 2967004 - RNA, 13 nt, Human
ugcacauuaaaug

SEQ ID NO: 2967005 - RNA, 17 nt, Human
uggauucauauuuaauu

SEQ ID NO: 2967006 - RNA, 14 nt, Human
uggauucauauuua

SEQ ID NO: 2967007 - RNA, 20 nt, Human
uggaguuauugaagcagagu

SEQ ID NO: 2967008 - RNA, 14 nt, Human
aggcaggggaaugu

SEQ ID NO: 2967009 - RNA, 19 nt, Human
aggcaggggaauguaugug

SEQ ID NO: 2967010 - RNA, 16 nt, Human
aggcaggggaauguau

SEQ ID NO: 2967011 - RNA, 20 nt, Human
agcuuaagaaauuuguggaa

SEQ ID NO: 2967012 - RNA, 21 nt, Human
ugguuaguagagguacacuug

SEQ ID NO: 2967013 - RNA, 16 nt, Human
aguaaaauguggcagg

SEQ ID NO: 2967014 - RNA, 18 nt, Human
aguaggggucugucuuuu

SEQ ID NO: 2967015 - RNA, 20 nt, Human
aguaggggucugucuuuuaa

SEQ ID NO: 2967016 - RNA, 13 nt, Human
aguagucagacug

SEQ ID NO: 2967017 - RNA, 19 nt, Human
ugucaagcugaccuugcug

SEQ ID NO: 2967018 - RNA, 17 nt, Human
agggcccuuuuucaaua

SEQ ID NO: 2967019 - RNA, 16 nt, Human
uguuuuaucuucuaua

SEQ ID NO: 2967020 - RNA, 21 nt, Human
uguuuuauauagcaagacauu

SEQ ID NO: 2967021 - RNA, 19 nt, Human
uguuuugccaauuugcaca

SEQ ID NO: 2967022 - RNA, 17 nt, Human
uguuuugccaauuugca

SEQ ID NO: 2967023 - RNA, 21 nt, Human
uguuuugccaauuugcacauu

SEQ ID NO: 2967024 - RNA, 22 nt, Human
uguuuugccaauuugcacauua

SEQ ID NO: 2967025 - RNA, 23 nt, Human
uguuuugccaauuugcacauuaa

SEQ ID NO: 2967026 - RNA, 22 nt, Human
uguuugagcaucgcuuaggaga

SEQ ID NO: 2967027 - RNA, 14 nt, Human
uguugcuaacagca

SEQ ID NO: 2967028 - RNA, 15 nt, Human
aguuggguuuuuuaa

SEQ ID NO: 2967029 - RNA, 18 nt, Human
agucuucaguuugcagag

SEQ ID NO: 2967030 - RNA, 20 nt, Human
agucuucaguuugcagagua

SEQ ID NO: 2967031 - RNA, 21 nt, Human
agucuucaguuugcagaguag

SEQ ID NO: 2967032 - RNA, 18 nt, Human
ugugaugacauucccugc

SEQ ID NO: 2967033 - RNA, 16 nt, Human
auauucucagcagagu

SEQ ID NO: 2967034 - RNA, 15 nt, Human
auauucucagcagag

SEQ ID NO: 2967035 - RNA, 17 nt, Human
auauucucagcagagug

SEQ ID NO: 2967036 - RNA, 18 nt, Human
auauucucagcagagugc

SEQ ID NO: 2967037 - RNA, 22 nt, Human
auauugcauacuauuaaacaug

SEQ ID NO: 2967038 - RNA, 20 nt, Human
auauugcauacuauuaaaca

SEQ ID NO: 2967039 - RNA, 23 nt, Human
auauuucugaggagccugcaaca

SEQ ID NO: 2967040 - RNA, 13 nt, Human
uucucacagaaga

SEQ ID NO: 2967041 - RNA, 11 nt, Human
uuauuuauuga

SEQ ID NO: 2967042 - RNA, 13 nt, Human
uuauuuaaauaga

SEQ ID NO: 2967043 - RNA, 19 nt, Human
auagcugugauuuuuggua

SEQ ID NO: 2967044 - RNA, 12 nt, Human
auaacuuuuuau

SEQ ID NO: 2967045 - RNA, 22 nt, Human
auagcugugauuuuugguauuu

SEQ ID NO: 2967046 - RNA, 21 nt, Human
uuauuucucucaucuguuaca

SEQ ID NO: 2967047 - RNA, 20 nt, Human
uucauauuuaauuugaaggu

SEQ ID NO: 2967048 - RNA, 18 nt, Human
uucauagagaauauaaaa

SEQ ID NO: 2967049 - RNA, 11 nt, Human
uucauagagaa

SEQ ID NO: 2967050 - RNA, 18 nt, Human
uucacugguacucugcca

SEQ ID NO: 2967051 - RNA, 15 nt, Human
uucagcccucagaau

SEQ ID NO: 2967052 - RNA, 13 nt, Human
auauaagguuuuu

SEQ ID NO: 2967053 - RNA, 20 nt, Human
uuggcccaggauuauuguca

SEQ ID NO: 2967054 - RNA, 22 nt, Human
uuggcccaggaguuuggccaga

SEQ ID NO: 2967055 - RNA, 21 nt, Human
uuggcccaggaguuuggccag

SEQ ID NO: 2967056 - RNA, 20 nt, Human
uuggcccaggaguuuggcca

SEQ ID NO: 2967057 - RNA, 15 nt, Human
uuggcccaggaguuu

SEQ ID NO: 2967058 - RNA, 14 nt, Human
uuggcccaggaguu

SEQ ID NO: 2967059 - RNA, 13 nt, Human
uuggcccaggagu

SEQ ID NO: 2967060 - RNA, 21 nt, Human
aucugugaugacauucccugc

SEQ ID NO: 2967061 - RNA, 19 nt, Human
aucugugaugacauucccu

SEQ ID NO: 2967062 - RNA, 14 nt, Human
uugagugucaagcu

SEQ ID NO: 2967063 - RNA, 19 nt, Human
aucccuuggacauuuuaug

SEQ ID NO: 2967064 - RNA, 17 nt, Human
aucccuuggacauuuua

SEQ ID NO: 2967065 - RNA, 21 nt, Human
aucccuuggacauuuuauguc

SEQ ID NO: 2967066 - RNA, 20 nt, Human
aucccuuggacauuuuaugu

SEQ ID NO: 2967067 - RNA, 16 nt, Human
aucccuuucccuuggu

SEQ ID NO: 2967068 - RNA, 19 nt, Human
uugccaauuugcacauuaa

SEQ ID NO: 2967069 - RNA, 22 nt, Human
uugccaauuugcacauuaaaug

SEQ ID NO: 2967070 - RNA, 23 nt, Human
uugccaauuugcacauuaaauga

SEQ ID NO: 2967071 - RNA, 16 nt, Human
uuuaucagaacuaugu

SEQ ID NO: 2967072 - RNA, 17 nt, Human
uuuaucagaacuauguu

SEQ ID NO: 2967073 - RNA, 18 nt, Human
uuuaaucuuuuaugauug

SEQ ID NO: 2967074 - RNA, 16 nt, Human
augcccagugagacug

SEQ ID NO: 2967075 - RNA, 15 nt, Human
augcccagugagacu

SEQ ID NO: 2967076 - RNA, 18 nt, Human
uuuaucagaacuauguuu

SEQ ID NO: 2967077 - RNA, 22 nt, Human
uugugaaugcagguuuuaucag

SEQ ID NO: 2967078 - RNA, 16 nt, Human
uuguguacuuuuaaga

SEQ ID NO: 2967079 - RNA, 20 nt, Human
augcaaagaugaaggucugu

SEQ ID NO: 2967080 - RNA, 18 nt, Human
uuuaagggcccuuuuuca

SEQ ID NO: 2967081 - RNA, 20 nt, Human
uuuaagggcccuuuuucaau

SEQ ID NO: 2967082 - RNA, 21 nt, Human
uuuaagggcccuuuuucaaua

SEQ ID NO: 2967083 - RNA, 15 nt, Human
uuuaaucuuuuauga

SEQ ID NO: 2967084 - RNA, 16 nt, Human
uuuaagacuuugguua

SEQ ID NO: 2967085 - RNA, 20 nt, Human
uuuuguuuuuauuaaaagga

SEQ ID NO: 2967086 - RNA, 21 nt, Human
uuuuuauauucucagcagagu

SEQ ID NO: 2967087 - RNA, 22 nt, Human
uuuuuauauucucagcagagug

SEQ ID NO: 2967088 - RNA, 14 nt, Human
uuuuggaaaagaau

SEQ ID NO: 2967089 - RNA, 12 nt, Human
uuuuguguacuu

SEQ ID NO: 2967090 - RNA, 18 nt, Human
uuuuuggaaaagaauaaa

SEQ ID NO: 2967091 - RNA, 15 nt, Human
uuuuugguauuugaa

SEQ ID NO: 2967092 - RNA, 17 nt, Human
auuauugauguuuucau

SEQ ID NO: 2967093 - RNA, 21 nt, Human
auuaguuuugaagauucuaug

SEQ ID NO: 2967094 - RNA, 21 nt, Human
auuccuaacuaucacugguuu

SEQ ID NO: 2967095 - RNA, 23 nt, Human
uuugagaaauuuuuuuuuccagu

SEQ ID NO: 2967096 - RNA, 17 nt, Human
uuuguuuuuauuaaaag

SEQ ID NO: 2967097 - RNA, 14 nt, Human
auguugcuaacagc

SEQ ID NO: 2967098 - RNA, 22 nt, Human
auugcauacuauuaaacaugcu

SEQ ID NO: 2967099 - RNA, 19 nt, Human
auugcauacuauuaaacau

SEQ ID NO: 2967100 - RNA, 20 nt, Human
auugcauacuauuaaacaug

SEQ ID NO: 2967101 - RNA, 19 nt, Human
auugccuuuuuauaacuuu

SEQ ID NO: 2967102 - RNA, 20 nt, Human
auugccuuuuuauaacuuuu

SEQ ID NO: 2967103 - RNA, 21 nt, Human
auugccuuuuuauaacuuuuu

SEQ ID NO: 2967104 - RNA, 15 nt, Human
auugaaguaaaaugu

SEQ ID NO: 2967105 - RNA, 24 nt, Human
auuccuagaaacugacacaugcug

SEQ ID NO: 2967106 - RNA, 17 nt, Human
auugaaggaugcugucu

SEQ ID NO: 2967107 - RNA, 14 nt, Human
auugaaguaaaaug

SEQ ID NO: 2967108 - RNA, 17 nt, Human
auugauguuuucauaga

SEQ ID NO: 2967109 - RNA, 16 nt, Human
auugauguuuucauag

SEQ ID NO: 2967110 - RNA, 13 nt, Human
auugauguuuuca

SEQ ID NO: 2967111 - RNA, 18 nt, Human
auugcauacuauuaaaca

SEQ ID NO: 2967112 - RNA, 17 nt, Human
auugcauacuauuaaac

SEQ ID NO: 2967113 - RNA, 17 nt, Human
auugcaccuggauguac

SEQ ID NO: 2967114 - RNA, 22 nt, Human
auuuauugaaaugauuucacag

SEQ ID NO: 2967115 - RNA, 15 nt, Human
auuuauugaaaugau

SEQ ID NO: 2967116 - RNA, 13 nt, Human
auuuauugaaaug

SEQ ID NO: 2967117 - RNA, 12 nt, Human
auuuauuacaac

SEQ ID NO: 2967118 - RNA, 15 nt, Human
auuuacuuuaaacua

SEQ ID NO: 2967119 - RNA, 14 nt, Human
auuuaaauagauga

SEQ ID NO: 2967120 - RNA, 15 nt, Human
auuuaaauagaugac

SEQ ID NO: 2967121 - RNA, 22 nt, Human
aaauagcagcccucaauuguga

SEQ ID NO: 2967122 - RNA, 21 nt, Human
aaauagaugacauugacuauu

SEQ ID NO: 2967123 - RNA, 14 nt, Human
aaauagaugacauu

SEQ ID NO: 2967124 - RNA, 22 nt, Human
aagacagagccccacccucaga

SEQ ID NO: 2967125 - RNA, 20 nt, Human
aaggcaggggaauguaugug

SEQ ID NO: 2967126 - RNA, 18 nt, Human
aaggcaggggaauguaug

SEQ ID NO: 2967127 - RNA, 19 nt, Human
aauuccuguuuuuauuauu

SEQ ID NO: 2967128 - RNA, 21 nt, Human
aauuccuguuuuuauuauuaa

SEQ ID NO: 2967129 - RNA, 22 nt, Human
aauuccuguuuuuauuauuaac

SEQ ID NO: 2967130 - RNA, 13 nt, Human
aauuccuguuuuu

SEQ ID NO: 2967131 - RNA, 20 nt, Human
aauuaugguuaguagaggua

SEQ ID NO: 2967132 - RNA, 14 nt, Human
acaucauuucaaga

SEQ ID NO: 2967133 - RNA, 19 nt, Human
acuggaacacucuauaaca

SEQ ID NO: 2967134 - RNA, 13 nt, Human
acugacacaugcu

SEQ ID NO: 2967135 - RNA, 22 nt, Human
acccucaugcugccaauauccu

SEQ ID NO: 2967136 - RNA, 16 nt, Human
acccucaugcugccaa

SEQ ID NO: 2967137 - RNA, 14 nt, Human
acccucaugcugcc

SEQ ID NO: 2967138 - RNA, 20 nt, Human
acccucagaugcacaugagc

SEQ ID NO: 2967139 - RNA, 14 nt, Human
acgcacacugucug

SEQ ID NO: 2967140 - RNA, 13 nt, Human
aguuugcagagua

SEQ ID NO: 2967141 - RNA, 17 nt, Human
aguuguuauuuauugaa

SEQ ID NO: 2967142 - RNA, 14 nt, Human
agugcuauugcaga

SEQ ID NO: 2967143 - RNA, 21 nt, Human
auaagugcuauugcagagccg

SEQ ID NO: 2967144 - RNA, 22 nt, Human
agucuggcagacuuucuucucu

SEQ ID NO: 2967145 - RNA, 22 nt, Human
agugcuacacaccuaacuuaug

SEQ ID NO: 2967146 - RNA, 18 nt, Human
agugauguaauuaugguu

SEQ ID NO: 2967147 - RNA, 15 nt, Human
aucaucccuuucccu

SEQ ID NO: 2967148 - RNA, 19 nt, Human
aucaucccuuucccuuggu

SEQ ID NO: 2967149 - RNA, 16 nt, Human
auagcaagacauuaua

SEQ ID NO: 2967150 - RNA, 23 nt, Human
augagcuuaagaaauuuguggaa

SEQ ID NO: 2967151 - RNA, 14 nt, Human
augagcuuaagaaa

SEQ ID NO: 2967152 - RNA, 12 nt, Human
aggcuuagaccc

SEQ ID NO: 2967153 - RNA, 21 nt, Human
aggcuuagacccucaugcugc

SEQ ID NO: 2967154 - RNA, 14 nt, Human
aggcuuagacccuc

SEQ ID NO: 2967155 - RNA, 22 nt, Human
aggcuuagacccucaugcugcc

SEQ ID NO: 2967156 - RNA, 18 nt, Human
agaagucuucuauuuauu

SEQ ID NO: 2967157 - RNA, 19 nt, Human
agaagucaaggcuuagacc

SEQ ID NO: 2967158 - RNA, 18 nt, Human
agaagucaaggcuuagac

SEQ ID NO: 2967159 - RNA, 17 nt, Human
agaagucaaggcuuaga

SEQ ID NO: 2967160 - RNA, 16 nt, Human
agaagucaaggcuuag

SEQ ID NO: 2967161 - RNA, 23 nt, Human
agaaugcaguacuaacauuuauu

SEQ ID NO: 2967162 - RNA, 13 nt, Human
agcaaaucaguuu

SEQ ID NO: 2967163 - RNA, 23 nt, Human
agaugacauugacuauuuuuguu

SEQ ID NO: 2967164 - RNA, 18 nt, Human
agaugacauugacuauuu

SEQ ID NO: 2967165 - RNA, 15 nt, Human
agaugaaugucaguu

SEQ ID NO: 2967166 - RNA, 11 nt, Human
agaugaauguc

SEQ ID NO: 2967167 - RNA, 18 nt, Human
agauucuauguuaauauu

SEQ ID NO: 2967168 - RNA, 19 nt, Human
agcaucgcuuaggagaagu

SEQ ID NO: 2967169 - RNA, 17 nt, Human
caacauaacucaagucu

SEQ ID NO: 2967170 - RNA, 23 nt, Human
caacugggguggguggggcagug

SEQ ID NO: 2967171 - RNA, 20 nt, Human
caauauccuaauaaaaaggu

SEQ ID NO: 2967172 - RNA, 19 nt, Human
caauauccuaauaaaaagg

SEQ ID NO: 2967173 - RNA, 18 nt, Human
caauauccuaauaaaaag

SEQ ID NO: 2967174 - RNA, 16 nt, Human
caauauccuaauaaaa

SEQ ID NO: 2967175 - RNA, 15 nt, Human
caauauccuaauaaa

SEQ ID NO: 2967176 - RNA, 14 nt, Human
caauauccuaauaa

SEQ ID NO: 2967177 - RNA, 13 nt, Human
caauauccuaaua

SEQ ID NO: 2967178 - RNA, 12 nt, Human
caauauccuaau

SEQ ID NO: 2967179 - RNA, 16 nt, Human
caccaugggauuaaua

SEQ ID NO: 2967180 - RNA, 16 nt, Human
cccaggaguuuggcca

SEQ ID NO: 2967181 - RNA, 15 nt, Human
cccaggaguuuggcc

SEQ ID NO: 2967182 - RNA, 20 nt, Human
cccaggaguuuggccagaag

SEQ ID NO: 2967183 - RNA, 19 nt, Human
cccaggaguuuggccagaa

SEQ ID NO: 2967184 - RNA, 18 nt, Human
cccaggaguuuggccaga

SEQ ID NO: 2967185 - RNA, 17 nt, Human
cccaggaguuuggccag

SEQ ID NO: 2967186 - RNA, 19 nt, Human
ccaauauccuaauaaaaag

SEQ ID NO: 2967187 - RNA, 18 nt, Human
ccaauauccuaauaaaaa

SEQ ID NO: 2967188 - RNA, 17 nt, Human
ccaauauccuaauaaaa

SEQ ID NO: 2967189 - RNA, 16 nt, Human
ccaauauccuaauaaa

SEQ ID NO: 2967190 - RNA, 15 nt, Human
ccaauauccuaauaa

SEQ ID NO: 2967191 - RNA, 14 nt, Human
ccaauauccuaaua

SEQ ID NO: 2967192 - RNA, 13 nt, Human
ccaauauccuaau

SEQ ID NO: 2967193 - RNA, 12 nt, Human
ccaauauccuaa

SEQ ID NO: 2967194 - RNA, 18 nt, Human
ccagaagucaaggcuuag

SEQ ID NO: 2967195 - RNA, 16 nt, Human
cccugugucauuucaa

SEQ ID NO: 2967196 - RNA, 17 nt, Human
cccuuuuucaauaacug

SEQ ID NO: 2967197 - RNA, 22 nt, Human
cccuuuuucaauaacuggaaca

SEQ ID NO: 2967198 - RNA, 18 nt, Human
ccucaauaaacauuucau

SEQ ID NO: 2967199 - RNA, 14 nt, Human
ccucaauugugaaa

SEQ ID NO: 2967200 - RNA, 17 nt, Human
cugcagggacagagcau

SEQ ID NO: 2967201 - RNA, 22 nt, Human
cuggacacuucacgcccuuggc

SEQ ID NO: 2967202 - RNA, 20 nt, Human
cuggacacuucacgcccuug

SEQ ID NO: 2967203 - RNA, 16 nt, Human
cugaacuucagagcau

SEQ ID NO: 2967204 - RNA, 17 nt, Human
cucauucauuacuaaaa

SEQ ID NO: 2967205 - RNA, 13 nt, Human
cucauucauuacu

SEQ ID NO: 2967206 - RNA, 22 nt, Human
cucccuuccuaugcuguucacu

SEQ ID NO: 2967207 - RNA, 18 nt, Human
cuuaagaaauuuguggaa

SEQ ID NO: 2967208 - RNA, 19 nt, Human
cuuaauaaacuguggugcu

SEQ ID NO: 2967209 - RNA, 18 nt, Human
cuuagacccucaugcugc

SEQ ID NO: 2967210 - RNA, 14 nt, Human
cuuagacccucaug

SEQ ID NO: 2967211 - RNA, 18 nt, Human
cuuauuuaaauagaugac

SEQ ID NO: 2967212 - RNA, 19 nt, Human
cuuauuuaaauagaugaca

SEQ ID NO: 2967213 - RNA, 13 nt, Human
cuuauuuaaauag

SEQ ID NO: 2967214 - RNA, 14 nt, Human
cuuauuuaaauaga

SEQ ID NO: 2967215 - RNA, 22 nt, Human
cuugcagcucuccccuucucug

SEQ ID NO: 2967216 - RNA, 20 nt, Human
cuuguugaggguauguuuua

SEQ ID NO: 2967217 - RNA, 21 nt, Human
cuuguugaggguauguuuuau

SEQ ID NO: 2967218 - RNA, 22 nt, Human
cuuguugaggguauguuuuaua

SEQ ID NO: 2967219 - RNA, 16 nt, Human
cuuguugaggguaugu

SEQ ID NO: 2967220 - RNA, 16 nt, Human
cuuguacacucauuca

SEQ ID NO: 2967221 - RNA, 15 nt, Human
cuuuuucaauaacug

SEQ ID NO: 2967222 - RNA, 14 nt, Human
cuuuuugaaauguc

SEQ ID NO: 2967223 - RNA, 17 nt, Human
gacaguuggguuuuuua

SEQ ID NO: 2967224 - RNA, 13 nt, Human
gacaguuggguuu

SEQ ID NO: 2967225 - RNA, 21 nt, Human
gacagagccccacccucagau

SEQ ID NO: 2967226 - RNA, 22 nt, Human
gacuggauaguccgucucugcu

SEQ ID NO: 2967227 - RNA, 16 nt, Human
gacuggauaguccguc

SEQ ID NO: 2967228 - RNA, 17 nt, Human
gacuggauaguccgucu

SEQ ID NO: 2967229 - RNA, 22 nt, Human
gaauugauugggcacaucauuu

SEQ ID NO: 2967230 - RNA, 21 nt, Human
gaaugucaguuguuauuuauu

SEQ ID NO: 2967231 - RNA, 17 nt, Human
gaaugucaguuguuauu

SEQ ID NO: 2967232 - RNA, 23 nt, Human
gaaggugccucuggaugcuguga

SEQ ID NO: 2967233 - RNA, 17 nt, Human
gaagauucuauguuaau

SEQ ID NO: 2967234 - RNA, 23 nt, Human
gaagauucuauguuaauauuuua

SEQ ID NO: 2967235 - RNA, 20 nt, Human
gaagauucuauguuaauauu

SEQ ID NO: 2967236 - RNA, 14 nt, Human
gaacaucacagcuu

SEQ ID NO: 2967237 - RNA, 18 nt, Human
gaguuauugaagcagagu

SEQ ID NO: 2967238 - RNA, 19 nt, Human
gaguuauugaagcagagug

SEQ ID NO: 2967239 - RNA, 20 nt, Human
gaguuauugaagcagagugg

SEQ ID NO: 2967240 - RNA, 22 nt, Human
gaugaaugucaguuguuauuua

SEQ ID NO: 2967241 - RNA, 20 nt, Human
gauuuaaacacauuaaaggu

SEQ ID NO: 2967242 - RNA, 20 nt, Human
gauugggcacaucauuucaa

SEQ ID NO: 2967243 - RNA, 15 nt, Human
gcaaacuucagaguu

SEQ ID NO: 2967244 - RNA, 13 nt, Human
gcagaguggcagu

SEQ ID NO: 2967245 - RNA, 22 nt, Human
gcagaguggcagucuucaguuu

SEQ ID NO: 2967246 - RNA, 22 nt, Human
gcauauugcauacuauuaaaca

SEQ ID NO: 2967247 - RNA, 17 nt, Human
gcagugcuuggcccagg

SEQ ID NO: 2967248 - RNA, 16 nt, Human
gcagugcuuggcccag

SEQ ID NO: 2967249 - RNA, 19 nt, Human
gcguccugucggagcccug

SEQ ID NO: 2967250 - RNA, 14 nt, Human
gcuaacuuggguua

SEQ ID NO: 2967251 - RNA, 22 nt, Human
gcguccugucggagcccugucu

SEQ ID NO: 2967252 - RNA, 19 nt, Human
gccuuuuuauaacuuuuua

SEQ ID NO: 2967253 - RNA, 10 nt, Human
ggaaaagaau

SEQ ID NO: 2967254 - RNA, 22 nt, Human
gcuuuaccaauugaaguaaaau

SEQ ID NO: 2967255 - RNA, 23 nt, Human
gcuuggcccaggaguuuggccag

SEQ ID NO: 2967256 - RNA, 13 nt, Human
gcuuggcccagga

SEQ ID NO: 2967257 - RNA, 22 nt, Human
gcuuggcccaggaguuuggcca

SEQ ID NO: 2967258 - RNA, 16 nt, Human
gcuuggcccaggaguu

SEQ ID NO: 2967259 - RNA, 15 nt, Human
gcuuggcccaggagu

SEQ ID NO: 2967260 - RNA, 14 nt, Human
gcuuggcccaggag

SEQ ID NO: 2967261 - RNA, 23 nt, Human
ggagcccugucuccucucucugu

SEQ ID NO: 2967262 - RNA, 21 nt, Human
ggcuuaauuauugauguuuuc

SEQ ID NO: 2967263 - RNA, 16 nt, Human
ggcuuagacccucaug

SEQ ID NO: 2967264 - RNA, 17 nt, Human
ggcuuagugauguaauu

SEQ ID NO: 2967265 - RNA, 23 nt, Human
gggcagugcuuggcccaggaguu

SEQ ID NO: 2967266 - RNA, 22 nt, Human
gggcagugcuuggcccaggagu

SEQ ID NO: 2967267 - RNA, 20 nt, Human
gggcagugcuuggcccagga

SEQ ID NO: 2967268 - RNA, 19 nt, Human
gggcagugcuuggcccagg

SEQ ID NO: 2967269 - RNA, 18 nt, Human
gggcagugcuuggcccag

SEQ ID NO: 2967270 - RNA, 18 nt, Human
gggauaucacuuccauga

SEQ ID NO: 2967271 - RNA, 16 nt, Human
gggcacaucauuucaa

SEQ ID NO: 2967272 - RNA, 16 nt, Human
gguuauuuuacuuuuu

SEQ ID NO: 2967273 - RNA, 23 nt, Human
ggggcagugcuuggcccaggagu

SEQ ID NO: 2967274 - RNA, 21 nt, Human
ggggcagugcuuggcccagga

SEQ ID NO: 2967275 - RNA, 20 nt, Human
uauaacaaaggauacuuauu

SEQ ID NO: 2967276 - RNA, 22 nt, Human
uauaacaaaggauacuuauuua

SEQ ID NO: 2967277 - RNA, 23 nt, Human
uauaauuccuguuuuuauuauua

SEQ ID NO: 2967278 - RNA, 13 nt, Human
uagauguugcuaa

SEQ ID NO: 2967279 - RNA, 11 nt, Human
uagauguugcu

SEQ ID NO: 2967280 - RNA, 20 nt, Human
uagcagcccucaauugugaa

SEQ ID NO: 2967281 - RNA, 23 nt, Human
uagcaguaaaaaaugguguuuua

SEQ ID NO: 2967282 - RNA, 13 nt, Human
uaccaauauuuaa

SEQ ID NO: 2967283 - RNA, 16 nt, Human
uaccaauauuuaaucu

SEQ ID NO: 2967284 - RNA, 21 nt, Human
uaccaauauuuaaucuuuuau

SEQ ID NO: 2967285 - RNA, 23 nt, Human
uaccaauauuuaaucuuuuauga

SEQ ID NO: 2967286 - RNA, 13 nt, Human
uacacuugugaau

SEQ ID NO: 2967287 - RNA, 14 nt, Human
uaacaggcuuagug

SEQ ID NO: 2967288 - RNA, 21 nt, Human
uaacaggcuuagugauguaau

SEQ ID NO: 2967289 - RNA, 18 nt, Human
uaacagcaacacaaagcu

SEQ ID NO: 2967290 - RNA, 20 nt, Human
uaacagcaacacaaagcuuu

SEQ ID NO: 2967291 - RNA, 16 nt, Human
uaagaacuaaaauguu

SEQ ID NO: 2967292 - RNA, 18 nt, Human
guuuagaugaaugucagu

SEQ ID NO: 2967293 - RNA, 17 nt, Human
guuuagaugaaugucag

SEQ ID NO: 2967294 - RNA, 18 nt, Human
guuuuuauuauuaacaaa

SEQ ID NO: 2967295 - RNA, 15 nt, Human
guuuuuauuauuaac

SEQ ID NO: 2967296 - RNA, 14 nt, Human
guuuuuauuaaaag

SEQ ID NO: 2967297 - RNA, 17 nt, Human
guuuuuauuaaaaggaa

SEQ ID NO: 2967298 - RNA, 13 nt, Human
guuuuuauuaaaa

SEQ ID NO: 2967299 - RNA, 13 nt, Human
guuuguucccugu

SEQ ID NO: 2967300 - RNA, 17 nt, Human
guuuuguguacuuuuaa

SEQ ID NO: 2967301 - RNA, 15 nt, Human
guuuuguguacuuuu

SEQ ID NO: 2967302 - RNA, 16 nt, Human
guuuuguguacuuuua

SEQ ID NO: 2967303 - RNA, 19 nt, Human
uaaauauuuugacuuguug

SEQ ID NO: 2967304 - RNA, 15 nt, Human
uaaauauuuugacuu

SEQ ID NO: 2967305 - RNA, 18 nt, Human
uaaauauuuugacuuguu

SEQ ID NO: 2967306 - RNA, 23 nt, Human
uaaauauugguugggaugacuug

SEQ ID NO: 2967307 - RNA, 22 nt, Human
uaaauauugguugggaugacuu

SEQ ID NO: 2967308 - RNA, 22 nt, Human
uaaauaucccuuggacauuuua

SEQ ID NO: 2967309 - RNA, 12 nt, Human
uaaacacauuaa

SEQ ID NO: 2967310 - RNA, 22 nt, Human
uauuuuagguguaaaauaauua

SEQ ID NO: 2967311 - RNA, 15 nt, Human
uauuuuacuuuuugg

SEQ ID NO: 2967312 - RNA, 14 nt, Human
uauuuuacuuuuug

SEQ ID NO: 2967313 - RNA, 13 nt, Human
uauuuuacuuuuu

SEQ ID NO: 2967314 - RNA, 12 nt, Human
uauuuuacuuuu

SEQ ID NO: 2967315 - RNA, 23 nt, Human
uauuucugaggagccugcaacau

SEQ ID NO: 2967316 - RNA, 23 nt, Human
uauuugaguggaguuacugaaca

SEQ ID NO: 2967317 - RNA, 12 nt, Human
uauuuauugaaa

SEQ ID NO: 2967318 - RNA, 20 nt, Human
uauuuauugaaaugauuuca

SEQ ID NO: 2967319 - RNA, 16 nt, Human
uauuuauugaaaugau

SEQ ID NO: 2967320 - RNA, 12 nt, Human
ucaaacuaacag

SEQ ID NO: 2967321 - RNA, 13 nt, Human
ucaaacuaacagg

SEQ ID NO: 2967322 - RNA, 18 nt, Human
uauuuuuguuuuuauuaa

SEQ ID NO: 2967323 - RNA, 20 nt, Human
uauuuuuguuuuuauuaaaa

SEQ ID NO: 2967324 - RNA, 18 nt, Human
ucaagcugaccuugcuga

SEQ ID NO: 2967325 - RNA, 16 nt, Human
ucagcagagugcuuua

SEQ ID NO: 2967326 - RNA, 22 nt, Human
ucagcagagugcuuuaccaauu

SEQ ID NO: 2967327 - RNA, 11 nt, Human
ucagcagagug

SEQ ID NO: 2967328 - RNA, 12 nt, Human
ucagcagagugc

SEQ ID NO: 2967329 - RNA, 15 nt, Human
ucaucuguuacacaa

SEQ ID NO: 2967330 - RNA, 17 nt, Human
ucccccuggcacugguu

SEQ ID NO: 2967331 - RNA, 15 nt, Human
ucccauucuuggccc

SEQ ID NO: 2967332 - RNA, 16 nt, Human
ucccauucuuggccca

SEQ ID NO: 2967333 - RNA, 15 nt, Human
ucucaaacuaacagg

SEQ ID NO: 2967334 - RNA, 17 nt, Human
ucucaaacuaacaggcu

SEQ ID NO: 2967335 - RNA, 14 nt, Human
ucuuuuugaaaugu

SEQ ID NO: 2967336 - RNA, 24 nt, Human
ucuguaauaaacucauuucuagca

SEQ ID NO: 2967337 - RNA, 23 nt, Human
ucuguaauaaacucauuucuagc

SEQ ID NO: 2967338 - RNA, 19 nt, Human
ucuguaauaaacucauuuc

SEQ ID NO: 2967339 - RNA, 20 nt, Human
ucuguuacacaaagaaccac

SEQ ID NO: 2967340 - RNA, 22 nt, Human
ucuucuauuuauuuauuuauuc

SEQ ID NO: 2967341 - RNA, 22 nt, Human
ucuucuauauaauuccuguuuu

SEQ ID NO: 2967342 - RNA, 12 nt, Human
ucuucuauuuau

SEQ ID NO: 2967343 - RNA, 13 nt, Human
ucuucuauauaau

SEQ ID NO: 2967344 - RNA, 15 nt, Human
ugcuuuuuuuggccu

SEQ ID NO: 2967345 - RNA, 17 nt, Human
uggccagaagucaaggc

SEQ ID NO: 2967346 - RNA, 13 nt, Human
uggguuuauuugg

SEQ ID NO: 2967347 - RNA, 18 nt, Human
uggggcagugcuuggccc

SEQ ID NO: 2967348 - RNA, 22 nt, Human
uggggcagugcuuggcccagga

SEQ ID NO: 2967349 - RNA, 20 nt, Human
uggggcagugcuuggcccag

SEQ ID NO: 2967350 - RNA, 23 nt, Human
uggggcagugcuuggcccaggag

SEQ ID NO: 2967351 - RNA, 13 nt, Human
ugcacaucuguuu

SEQ ID NO: 2967352 - RNA, 21 nt, Human
ugcacacuguccuauuauauu

SEQ ID NO: 2967353 - RNA, 23 nt, Human
ugccuaccaauauuuaaucuuuu

SEQ ID NO: 2967354 - RNA, 17 nt, Human
ugccuaccaauauuuaa

SEQ ID NO: 2967355 - RNA, 17 nt, Human
ugccuaauaugaugacu

SEQ ID NO: 2967356 - RNA, 22 nt, Human
ugccuaauaugaugacuguuuu

SEQ ID NO: 2967357 - RNA, 18 nt, Human
uguuuuuauuauuaacaa

SEQ ID NO: 2967358 - RNA, 15 nt, Human
uguuuuuauuauuaa

SEQ ID NO: 2967359 - RNA, 19 nt, Human
ugugugcguccugucggag

SEQ ID NO: 2967360 - RNA, 15 nt, Human
uguuuaaugguaguu

SEQ ID NO: 2967361 - RNA, 21 nt, Human
uguucuccagucauuauguua

SEQ ID NO: 2967362 - RNA, 16 nt, Human
uguugaaacuuuaaga

SEQ ID NO: 2967363 - RNA, 18 nt, Human
ugucaguuguuauuuauu

SEQ ID NO: 2967364 - RNA, 17 nt, Human
ugucaguuguuauuuau

SEQ ID NO: 2967365 - RNA, 22 nt, Human
ugucaguuguuauuuauugaaa

SEQ ID NO: 2967366 - RNA, 21 nt, Human
uguaacuguuuagaugaaugu

SEQ ID NO: 2967367 - RNA, 12 nt, Human
uguguacuuuua

SEQ ID NO: 2967368 - RNA, 15 nt, Human
uguguacuuuuaaga

SEQ ID NO: 2967369 - RNA, 14 nt, Human
ugugcguccugucg

SEQ ID NO: 2967370 - RNA, 12 nt, Human
ugugaaaaaauu

SEQ ID NO: 2967371 - RNA, 17 nt, Human
ugugaaaaaauuuacuu

SEQ ID NO: 2967372 - RNA, 23 nt, Human
ugugaaaaaauuuacuuuaaacu

SEQ ID NO: 2967373 - RNA, 21 nt, Human
ugugaauaaagagggugggug

SEQ ID NO: 2967374 - RNA, 14 nt, Human
ugugaaugcagguu

SEQ ID NO: 2967375 - RNA, 20 nt, Human
ugugaaugcagguuuuauca

SEQ ID NO: 2967376 - RNA, 17 nt, Human
uuggguuuauuuggaaa

SEQ ID NO: 2967377 - RNA, 12 nt, Human
uuggguuuauuu

SEQ ID NO: 2967378 - RNA, 20 nt, Human
uuggccagaagucaaggcuu

SEQ ID NO: 2967379 - RNA, 20 nt, Human
uuguacacucauucauuacu

SEQ ID NO: 2967380 - RNA, 20 nt, Human
uugcuaacagcaacacaaag

SEQ ID NO: 2967381 - RNA, 13 nt, Human
uugcuaacagcaa

SEQ ID NO: 2967382 - RNA, 20 nt, Human
uuggacauuuuaugucuuuc

SEQ ID NO: 2967383 - RNA, 18 nt, Human
uuggacauuuuaugucuu

SEQ ID NO: 2967384 - RNA, 17 nt, Human
uuggacauuuuaugucu

SEQ ID NO: 2967385 - RNA, 16 nt, Human
uuggacauuuuauguc

SEQ ID NO: 2967386 - RNA, 15 nt, Human
uuggacauuuuaugu

SEQ ID NO: 2967387 - RNA, 21 nt, Human
uuggaaaggaaugcaaagaug

SEQ ID NO: 2967388 - RNA, 14 nt, Human
uugaaacuuuaaga

SEQ ID NO: 2967389 - RNA, 18 nt, Human
uugaggguauguuuuaua

SEQ ID NO: 2967390 - RNA, 19 nt, Human
uugcauacuauuaaacaug

SEQ ID NO: 2967391 - RNA, 18 nt, Human
uugcauacuauuaaacau

SEQ ID NO: 2967392 - RNA, 16 nt, Human
uugcauacuauuaaac

SEQ ID NO: 2967393 - RNA, 12 nt, Human
uugacuauuuuu

SEQ ID NO: 2967394 - RNA, 19 nt, Human
uuacuaaaaguuuugagaa

SEQ ID NO: 2967395 - RNA, 20 nt, Human
uuacuaaaaguuuugagaaa

SEQ ID NO: 2967396 - RNA, 19 nt, Human
uucaaucuggauucauauu

SEQ ID NO: 2967397 - RNA, 23 nt, Human
uucaaucuggauucauauuuaau

SEQ ID NO: 2967398 - RNA, 20 nt, Human
uucaaucuggauucauauuu

SEQ ID NO: 2967399 - RNA, 17 nt, Human
uuccacuugagugucaa

SEQ ID NO: 2967400 - RNA, 21 nt, Human
uuccacuugagugucaagcug

SEQ ID NO: 2967401 - RNA, 15 nt, Human
uucaguuuaucuguu

SEQ ID NO: 2967402 - RNA, 18 nt, Human
uucaguuuaucuguucau

SEQ ID NO: 2967403 - RNA, 21 nt, Human
uucuauuuauuuauuuauuca

SEQ ID NO: 2967404 - RNA, 14 nt, Human
uucuauuuauuugu

SEQ ID NO: 2967405 - RNA, 17 nt, Human
uucuccagucauuaugu

SEQ ID NO: 2967406 - RNA, 19 nt, Human
uucuccagucauuauguua

SEQ ID NO: 2967407 - RNA, 13 nt, Human
uuuaaucuuuuau

SEQ ID NO: 2967408 - RNA, 15 nt, Human
uuuacuuuuuggaaa

SEQ ID NO: 2967409 - RNA, 23 nt, Human
uuuacuuuuuggaaaagaauaaa

SEQ ID NO: 2967410 - RNA, 16 nt, Human
uuuauuuauuuauuca

SEQ ID NO: 2967411 - RNA, 22 nt, Human
uuuauuuggaaaggaaugcaaa

SEQ ID NO: 2967412 - RNA, 22 nt, Human
uuuuaucagaacuauguuuuug

SEQ ID NO: 2967413 - RNA, 15 nt, Human
uuuuauauucucagc

SEQ ID NO: 2967414 - RNA, 13 nt, Human
uuuuauauagcaa

SEQ ID NO: 2967415 - RNA, 23 nt, Human
uuuucaauaacuggaacacucua

SEQ ID NO: 2967416 - RNA, 13 nt, Human
uuuucaauaacug

SEQ ID NO: 2967417 - RNA, 16 nt, Human
uuuucaauaacuggaa

SEQ ID NO: 2967418 - RNA, 19 nt, Human
uuuucaauaacuggaacac

SEQ ID NO: 2967419 - RNA, 11 nt, Human
uuugcagagua

SEQ ID NO: 2967420 - RNA, 22 nt, Human
caauauccuaauaaaaagguga

SEQ ID NO: 2967421 - RNA, 16 nt, Human
cacaaagcuuuugcau

SEQ ID NO: 2967422 - RNA, 13 nt, Human
cacaaagcuuuug

SEQ ID NO: 2967423 - RNA, 18 nt, Human
caauaacuggaacacucu

SEQ ID NO: 2967424 - RNA, 21 nt, Human
caauauccuaauaaaaaggug

SEQ ID NO: 2967425 - RNA, 22 nt, Human
caaggcuuagacccucaugcug

SEQ ID NO: 2967426 - RNA, 19 nt, Human
caaggcuuagacccucaug

SEQ ID NO: 2967427 - RNA, 23 nt, Human
cacaguguguggucaacauuucu

SEQ ID NO: 2967428 - RNA, 11 nt, Human
aguuuggccag

SEQ ID NO: 2967429 - RNA, 19 nt, Human
auagcauguccuaaugcuu

SEQ ID NO: 2967430 - RNA, 16 nt, Human
auagcauguccuaaug

SEQ ID NO: 2967431 - RNA, 22 nt, Human
auagcagcccucaauugugaaa

SEQ ID NO: 2967432 - RNA, 21 nt, Human
auagcagcccucaauugugaa

SEQ ID NO: 2967433 - RNA, 17 nt, Human
auauucauucuuuuuga

SEQ ID NO: 2967434 - RNA, 16 nt, Human
aguacuaacauuuauu

SEQ ID NO: 2967435 - RNA, 15 nt, Human
augguaguuuuacag

SEQ ID NO: 2967436 - RNA, 22 nt, Human
augguaguuuuacaguguuucu

SEQ ID NO: 2967437 - RNA, 21 nt, Human
augguaguuuuacaguguuuc

SEQ ID NO: 2967438 - RNA, 18 nt, Human
auggauaaauauugguug

SEQ ID NO: 2967439 - RNA, 21 nt, Human
aucgcuccaccuugcagcucu

SEQ ID NO: 2967440 - RNA, 17 nt, Human
aucgcuccaccuugcag

SEQ ID NO: 2967441 - RNA, 14 nt, Human
augacuguuuuuaa

SEQ ID NO: 2967442 - RNA, 20 nt, Human
agcuuauuuccucauuuuua

SEQ ID NO: 2967443 - RNA, 22 nt, Human
agggauuuucagcccucagaau

SEQ ID NO: 2967444 - RNA, 17 nt, Human
agggauuuucagcccuc

SEQ ID NO: 2967445 - RNA, 23 nt, Human
aggcuuagacccucaugcugcca

SEQ ID NO: 2967446 - RNA, 24 nt, Human
aggcuuagacccucaugcugccaa

SEQ ID NO: 2967447 - RNA, 21 nt, Human
agaagucuucuauuuauuuau

SEQ ID NO: 2967448 - RNA, 16 nt, Human
agacuggauaguccgu

SEQ ID NO: 2967449 - RNA, 21 nt, Human
agauucuauguuaauauuuua

SEQ ID NO: 2967450 - RNA, 22 nt, Human
agauucuuguauuuauuacaac

SEQ ID NO: 2967451 - RNA, 14 nt, Human
agaugaaggucugu

SEQ ID NO: 2967452 - RNA, 17 nt, Human
agaugaaggucuguuuu

SEQ ID NO: 2967453 - RNA, 15 nt, Human
aagggauuuucagcc

SEQ ID NO: 2967454 - RNA, 23 nt, Human
aagggauuuucagcccucagaau

SEQ ID NO: 2967455 - RNA, 21 nt, Human
aagggauuuucagcccucaga

SEQ ID NO: 2967456 - RNA, 19 nt, Human
aaggucuguuuuguguacu

SEQ ID NO: 2967457 - RNA, 20 nt, Human
aaggucuguuuuguguacuu

SEQ ID NO: 2967458 - RNA, 23 nt, Human
aaggucuguuuuguguacuuuua

SEQ ID NO: 2967459 - RNA, 15 nt, Human
aaggaaugcaaagau

SEQ ID NO: 2967460 - RNA, 16 nt, Human
aaggaaugcaaagaug

SEQ ID NO: 2967461 - RNA, 13 nt, Human
aacuguuuagaug

SEQ ID NO: 2967462 - RNA, 17 nt, Human
aagacuuugguuauuuu

SEQ ID NO: 2967463 - RNA, 23 nt, Human
aagacuuugguuauuuuacuuuu

SEQ ID NO: 2967464 - RNA, 13 nt, Human
aagacuuugguua

SEQ ID NO: 2967465 - RNA, 15 nt, Human
aagacuuugguuauu

SEQ ID NO: 2967466 - RNA, 22 nt, Human
aagauucuauguuaauauuuua

SEQ ID NO: 2967467 - RNA, 21 nt, Human
aagauucuauguuaauauuuu

SEQ ID NO: 2967468 - RNA, 19 nt, Human
aagauucuauguuaauauu

SEQ ID NO: 2967469 - RNA, 20 nt, Human
aagcagaguggcagucuuca

SEQ ID NO: 2967470 - RNA, 11 nt, Human
aagcagagugg

SEQ ID NO: 2967471 - RNA, 14 nt, Human
aagcagaguggcag

SEQ ID NO: 2967472 - RNA, 10 nt, Human
aagcagagug

SEQ ID NO: 2967473 - RNA, 17 nt, Human
aauaaaauuuuaguuga

SEQ ID NO: 2967474 - RNA, 13 nt, Human
aauauaaaaauaa

SEQ ID NO: 2967475 - RNA, 18 nt, Human
aacugaaguucuauuuau

SEQ ID NO: 2967476 - RNA, 21 nt, Human
aacaugcuguacauacuuuuu

SEQ ID NO: 2967477 - RNA, 18 nt, Human
aacaugcuguacauacuu

SEQ ID NO: 2967478 - RNA, 19 nt, Human
aacaugcuguacauacuuu

SEQ ID NO: 2967479 - RNA, 20 nt, Human
aacaugcuguacauacuuuu

SEQ ID NO: 2967480 - RNA, 17 nt, Human
aacagcaacacaaagcu

SEQ ID NO: 2967481 - RNA, 18 nt, Human
aacagcaacacaaagcuu

SEQ ID NO: 2967482 - RNA, 12 nt, Human
aaagugcccagc

SEQ ID NO: 2967483 - RNA, 14 nt, Human
acaugccuaccaau

SEQ ID NO: 2967484 - RNA, 18 nt, Human
acaugccuaccaauauuu

SEQ ID NO: 2967485 - RNA, 19 nt, Human
acaugccuaccaauauuua

SEQ ID NO: 2967486 - RNA, 17 nt, Human
acauuucucauguugaa

SEQ ID NO: 2967487 - RNA, 17 nt, Human
accaagaauugauuggg

SEQ ID NO: 2967488 - RNA, 20 nt, Human
aacuacauuagguugugaau

SEQ ID NO: 2967489 - RNA, 12 nt, Human
aacucauuucua

SEQ ID NO: 2967490 - RNA, 14 nt, Human
gucuucuauuuauu

SEQ ID NO: 2967491 - RNA, 12 nt, Human
gucuucuauuua

SEQ ID NO: 2967492 - RNA, 17 nt, Human
gucuucuauuuauuuau

SEQ ID NO: 2967493 - RNA, 17 nt, Human
gugcacaucuguuuugu

SEQ ID NO: 2967494 - RNA, 20 nt, Human
aacugggaugaggugacuau

SEQ ID NO: 2967495 - RNA, 19 nt, Human
aacucugagugcaaacuuc

SEQ ID NO: 2967496 - RNA, 18 nt, Human
aacucugagugcaaacuu

SEQ ID NO: 2967497 - RNA, 20 nt, Human
aacucugagugcaaacuuca

SEQ ID NO: 2967498 - RNA, 22 nt, Human
aacucugagugcaaacuucaga

SEQ ID NO: 2967499 - RNA, 21 nt, Human
aacacaaagcuuuugcauauu

SEQ ID NO: 2967500 - RNA, 21 nt, Human
gucaguuguuauuuauugaaa

SEQ ID NO: 2967501 - RNA, 18 nt, Human
gucaguuguuauuuauug

SEQ ID NO: 2967502 - RNA, 17 nt, Human
gucaguuguuauuuauu

SEQ ID NO: 2967503 - RNA, 16 nt, Human
gucaguuguuauuuau

SEQ ID NO: 2967504 - RNA, 12 nt, Human
aaauuuguggaa

SEQ ID NO: 2967505 - RNA, 17 nt, Human
aaaugguguuuuaucuu

SEQ ID NO: 2967506 - RNA, 18 nt, Human
aaaugguguuuuaucuuc

SEQ ID NO: 2967507 - RNA, 22 nt, Human
guuuauuuggaaaggaaugcaa

SEQ ID NO: 2967508 - RNA, 17 nt, Human
guuuaaugguaguuuua

SEQ ID NO: 2967509 - RNA, 12 nt, Human
guuuaaugguag

SEQ ID NO: 2967510 - RNA, 16 nt, Human
aaggauacuuauuuaa

SEQ ID NO: 2967511 - RNA, 13 nt, Human
aaggauacuuauu

SEQ ID NO: 2967512 - RNA, 14 nt, Human
guugcuaacagcaa

SEQ ID NO: 2967513 - RNA, 17 nt, Human
aagucuucuauuuauuu

SEQ ID NO: 2967514 - RNA, 13 nt, Human
aagucuucuauuu

SEQ ID NO: 2967515 - RNA, 16 nt, Human
guuauugaagcagagu

SEQ ID NO: 2967516 - RNA, 17 nt, Human
guuauugaagcagagug

SEQ ID NO: 2967517 - RNA, 18 nt, Human
guuauugaagcagagugg

SEQ ID NO: 2967518 - RNA, 18 nt, Human
aagaugaaggucuguuuu

SEQ ID NO: 2967519 - RNA, 13 nt, Human
gugucauuucaaa

SEQ ID NO: 2967520 - RNA, 23 nt, Human
aauagcagcccucaauugugaaa

SEQ ID NO: 2967521 - RNA, 22 nt, Human
aauagcagcccucaauugugaa

SEQ ID NO: 2967522 - RNA, 21 nt, Human
aauagcaaggcugugcaucua

SEQ ID NO: 2967523 - RNA, 21 nt, Human
uaacaaaggauacuuauuuaa

SEQ ID NO: 2967524 - RNA, 19 nt, Human
uaacaaaggauacuuauuu

SEQ ID NO: 2967525 - RNA, 20 nt, Human
uaacaaaggauacuuauuua

SEQ ID NO: 2967526 - RNA, 15 nt, Human
uaacaaaggauacuu

SEQ ID NO: 2967527 - RNA, 16 nt, Human
uaacaaaggauacuua

SEQ ID NO: 2967528 - RNA, 17 nt, Human
uaacaaaggauacuuau

SEQ ID NO: 2967529 - RNA, 18 nt, Human
uaacaaaggauacuuauu

SEQ ID NO: 2967530 - RNA, 21 nt, Human
uaacuaucacugguuugguuc

SEQ ID NO: 2967531 - RNA, 16 nt, Human
uaacuaucacugguuu

SEQ ID NO: 2967532 - RNA, 12 nt, Human
uaauaaaaaggu

SEQ ID NO: 2967533 - RNA, 15 nt, Human
uaauaaaaaggugac

SEQ ID NO: 2967534 - RNA, 14 nt, Human
uaauaaaaagguga

SEQ ID NO: 2967535 - RNA, 23 nt, Human
aauauuuugacuuguugagggua

SEQ ID NO: 2967536 - RNA, 22 nt, Human
aaugcuugcugcugauuuaaac

SEQ ID NO: 2967537 - RNA, 23 nt, Human
aaugcuugcugcugauuuaaaca

SEQ ID NO: 2967538 - RNA, 18 nt, Human
aaugcuugcugcugauuu

SEQ ID NO: 2967539 - RNA, 20 nt, Human
aaugcuugcugcugauuuaa

SEQ ID NO: 2967540 - RNA, 16 nt, Human
uaauuauugauguuuu

SEQ ID NO: 2967541 - RNA, 22 nt, Human
aauguucacugguacucugcca

SEQ ID NO: 2967542 - RNA, 17 nt, Human
uacauuagguugugaau

SEQ ID NO: 2967543 - RNA, 23 nt, Human
uauauagcaguaaaaaauggugu

SEQ ID NO: 2967544 - RNA, 10 nt, Human
uauagauguu

SEQ ID NO: 2967545 - RNA, 21 nt, Human
uauagauguugcuaacagcaa

SEQ ID NO: 2967546 - RNA, 15 nt, Human
uauagauguugcuaa

SEQ ID NO: 2967547 - RNA, 20 nt, Human
uauagauguugcuaacagca

SEQ ID NO: 2967548 - RNA, 18 nt, Human
uauagcaguaaaaaaugg

SEQ ID NO: 2967549 - RNA, 15 nt, Human
uauauagcaguaaaa

SEQ ID NO: 2967550 - RNA, 20 nt, Human
uauauagcaagacauuauau

SEQ ID NO: 2967551 - RNA, 16 nt, Human
uauauagcaguaaaaa

SEQ ID NO: 2967552 - RNA, 18 nt, Human
uauauagcaagacauuau

SEQ ID NO: 2967553 - RNA, 15 nt, Human
uauccaauugcugcu

SEQ ID NO: 2967554 - RNA, 23 nt, Human
uauccaauugcugcuuguacacu

SEQ ID NO: 2967555 - RNA, 14 nt, Human
uauccaaucuguga

SEQ ID NO: 2967556 - RNA, 16 nt, Human
acacucauucauuacu

SEQ ID NO: 2967557 - RNA, 20 nt, Human
uaugugcacaucuguuuugu

SEQ ID NO: 2967558 - RNA, 19 nt, Human
uagagguacacuugugaau

SEQ ID NO: 2967559 - RNA, 18 nt, Human
uagagguacacuugugaa

SEQ ID NO: 2967560 - RNA, 13 nt, Human
uagagguacacuu

SEQ ID NO: 2967561 - RNA, 22 nt, Human
uaggggucugucuuuuaaacuc

SEQ ID NO: 2967562 - RNA, 20 nt, Human
acacaaagcuuuugcauauu

SEQ ID NO: 2967563 - RNA, 19 nt, Human
acacaaagcuuuugcauau

SEQ ID NO: 2967564 - RNA, 15 nt, Human
acucuucccucaaau

SEQ ID NO: 2967565 - RNA, 20 nt, Human
accugcacacuguccuauua

SEQ ID NO: 2967566 - RNA, 17 nt, Human
acgcccuuggccauggg

SEQ ID NO: 2967567 - RNA, 14 nt, Human
uauuuugacuuguu

SEQ ID NO: 2967568 - RNA, 20 nt, Human
uauuuugacuuguugagggu

SEQ ID NO: 2967569 - RNA, 22 nt, Human
ucacagcuuauuuccucauuuu

SEQ ID NO: 2967570 - RNA, 16 nt, Human
ucaauugugaaaaaau

SEQ ID NO: 2967571 - RNA, 20 nt, Human
ucaauugugaaaaaauuuac

SEQ ID NO: 2967572 - RNA, 14 nt, Human
ucacagaagaugaa

SEQ ID NO: 2967573 - RNA, 15 nt, Human
acauuuuaugucuuu

SEQ ID NO: 2967574 - RNA, 13 nt, Human
acauuuuaugucu

SEQ ID NO: 2967575 - RNA, 13 nt, Human
ucagcccucagaa

SEQ ID NO: 2967576 - RNA, 12 nt, Human
ucagcccucaga

SEQ ID NO: 2967577 - RNA, 15 nt, Human
ucaguuugcagagua

SEQ ID NO: 2967578 - RNA, 16 nt, Human
ucaguuugcagaguag

SEQ ID NO: 2967579 - RNA, 12 nt, Human
ucaguuugguug

SEQ ID NO: 2967580 - RNA, 16 nt, Human
ucaguuuaucuguuca

SEQ ID NO: 2967581 - RNA, 14 nt, Human
ucaguuuaucuguu

SEQ ID NO: 2967582 - RNA, 20 nt, Human
ucaguuguuauuuauugaaa

SEQ ID NO: 2967583 - RNA, 15 nt, Human
ucaguuguuauuuau

SEQ ID NO: 2967584 - RNA, 13 nt, Human
ucaguagucagac

SEQ ID NO: 2967585 - RNA, 18 nt, Human
acuguccuauuauauuca

SEQ ID NO: 2967586 - RNA, 16 nt, Human
acuguccuauuauauu

SEQ ID NO: 2967587 - RNA, 15 nt, Human
acuguccuauuauau

SEQ ID NO: 2967588 - RNA, 12 nt, Human
ucuagcaugaag

SEQ ID NO: 2967589 - RNA, 17 nt, Human
agaacuauguuuuuguu

SEQ ID NO: 2967590 - RNA, 16 nt, Human
agaauaaaccaagaau

SEQ ID NO: 2967591 - RNA, 16 nt, Human
ucuggauucauauuua

SEQ ID NO: 2967592 - RNA, 19 nt, Human
ucuggauucauauuuaauu

SEQ ID NO: 2967593 - RNA, 19 nt, Human
ugaagguagaauguuuuca

SEQ ID NO: 2967594 - RNA, 18 nt, Human
ugaagguagaauguuuuc

SEQ ID NO: 2967595 - RNA, 14 nt, Human
ugaauuugccuaau

SEQ ID NO: 2967596 - RNA, 14 nt, Human
agcaagacauuaua

SEQ ID NO: 2967597 - RNA, 12 nt, Human
agauguugcuaa

SEQ ID NO: 2967598 - RNA, 23 nt, Human
ugacuauuuuuguuuuuauuaaa

SEQ ID NO: 2967599 - RNA, 23 nt, Human
agagcaguuugguuucuagcaug

SEQ ID NO: 2967600 - RNA, 21 nt, Human
agagcaguuugguuucuagca

SEQ ID NO: 2967601 - RNA, 11 nt, Human
ucuuuuaaacu

SEQ ID NO: 2967602 - RNA, 12 nt, Human
ucuuuuaaacuc

SEQ ID NO: 2967603 - RNA, 21 nt, Human
ugaaaaaauuuacuuuaaacu

SEQ ID NO: 2967604 - RNA, 23 nt, Human
agcauguccuaaugcuugcugcu

SEQ ID NO: 2967605 - RNA, 14 nt, Human
ugcacacuguccua

SEQ ID NO: 2967606 - RNA, 14 nt, Human
ugcaguacuaacau

SEQ ID NO: 2967607 - RNA, 17 nt, Human
ugccaauuugcacauua

SEQ ID NO: 2967608 - RNA, 21 nt, Human
ugccaauuugcacauuaaaug

SEQ ID NO: 2967609 - RNA, 15 nt, Human
ugccaauuugcacau

SEQ ID NO: 2967610 - RNA, 13 nt, Human
ugccaauuugcac

SEQ ID NO: 2967611 - RNA, 14 nt, Human
ugccaauauccuaa

SEQ ID NO: 2967612 - RNA, 19 nt, Human
ugcuuguacacucauucau

SEQ ID NO: 2967613 - RNA, 22 nt, Human
ugcuuguacacucauucauuac

SEQ ID NO: 2967614 - RNA, 16 nt, Human
ugcuuguacacucauu

SEQ ID NO: 2967615 - RNA, 18 nt, Human
ugcuugcugcugauuuaa

SEQ ID NO: 2967616 - RNA, 15 nt, Human
aggauacuuauuuaa

SEQ ID NO: 2967617 - RNA, 16 nt, Human
aggauacuuauuuaaa

SEQ ID NO: 2967618 - RNA, 13 nt, Human
aggauacuuauuu

SEQ ID NO: 2967619 - RNA, 16 nt, Human
uggcaucuuacaucug

SEQ ID NO: 2967620 - RNA, 17 nt, Human
aggaaugcaaagaugaa

SEQ ID NO: 2967621 - RNA, 18 nt, Human
uguacuuuuaagacuuug

SEQ ID NO: 2967622 - RNA, 15 nt, Human
uguacuuuuaagacu

SEQ ID NO: 2967623 - RNA, 14 nt, Human
aguagagguacacu

SEQ ID NO: 2967624 - RNA, 22 nt, Human
aguagagguacacuugugaaua

SEQ ID NO: 2967625 - RNA, 20 nt, Human
aguagagguacacuugugaa

SEQ ID NO: 2967626 - RNA, 21 nt, Human
aguagagguacacuugugaau

SEQ ID NO: 2967627 - RNA, 23 nt, Human
uguaauuaugguuaguagaggua

SEQ ID NO: 2967628 - RNA, 22 nt, Human
uguccuaaugcuugcugcugau

SEQ ID NO: 2967629 - RNA, 23 nt, Human
agucagacuggauaguccgucuc

SEQ ID NO: 2967630 - RNA, 15 nt, Human
ugucaguauuucaac

SEQ ID NO: 2967631 - RNA, 20 nt, Human
ugggcacaucauuucaagaa

SEQ ID NO: 2967632 - RNA, 15 nt, Human
ugggcacaucauuuc

SEQ ID NO: 2967633 - RNA, 17 nt, Human
agguagaauguuuucaa

SEQ ID NO: 2967634 - RNA, 22 nt, Human
agugcuuuaccaauugaaguaa

SEQ ID NO: 2967635 - RNA, 13 nt, Human
uguuaauauuuua

SEQ ID NO: 2967636 - RNA, 20 nt, Human
agugcuuggcccaggaguuu

SEQ ID NO: 2967637 - RNA, 19 nt, Human
agugcuuggcccaggaguu

SEQ ID NO: 2967638 - RNA, 18 nt, Human
agugcuuggcccaggagu

SEQ ID NO: 2967639 - RNA, 16 nt, Human
agugcuuggcccagga

SEQ ID NO: 2967640 - RNA, 15 nt, Human
agugcuuggcccagg

SEQ ID NO: 2967641 - RNA, 14 nt, Human
agugcuuggcccag

SEQ ID NO: 2967642 - RNA, 12 nt, Human
agugcuuggccc

SEQ ID NO: 2967643 - RNA, 16 nt, Human
aguuacugaacaguaa

SEQ ID NO: 2967644 - RNA, 15 nt, Human
aguggaguuacugaa

SEQ ID NO: 2967645 - RNA, 19 nt, Human
uguuauuuauugaaaugau

SEQ ID NO: 2967646 - RNA, 18 nt, Human
uguuauuuauugaaauga

SEQ ID NO: 2967647 - RNA, 17 nt, Human
uguuauuuauugaaaug

SEQ ID NO: 2967648 - RNA, 15 nt, Human
uguuauuuauugaaa

SEQ ID NO: 2967649 - RNA, 13 nt, Human
uguuauuuauuga

SEQ ID NO: 2967650 - RNA, 24 nt, Human
aguucaaucuggauucauauuuaa

SEQ ID NO: 2967651 - RNA, 23 nt, Human
aguucuauuuauuugugagacug

SEQ ID NO: 2967652 - RNA, 20 nt, Human
uguuuagaugaaugucaguu

SEQ ID NO: 2967653 - RNA, 15 nt, Human
uguuuagaugaaugu

SEQ ID NO: 2967654 - RNA, 12 nt, Human
uuagguugugaa

SEQ ID NO: 2967655 - RNA, 13 nt, Human
uuagguugugaau

SEQ ID NO: 2967656 - RNA, 17 nt, Human
uuagguugugaaugcag

SEQ ID NO: 2967657 - RNA, 23 nt, Human
uuacugaacaguaacauagcugu

SEQ ID NO: 2967658 - RNA, 15 nt, Human
uuacugaacaguaac

SEQ ID NO: 2967659 - RNA, 23 nt, Human
auaaauauugguugggaugacuu

SEQ ID NO: 2967660 - RNA, 16 nt, Human
uuaaauagaugacauu

SEQ ID NO: 2967661 - RNA, 14 nt, Human
uuaaauagaugaca

SEQ ID NO: 2967662 - RNA, 13 nt, Human
uuaaauagaugac

SEQ ID NO: 2967663 - RNA, 21 nt, Human
uuaaacaugcuguacauacuu

SEQ ID NO: 2967664 - RNA, 22 nt, Human
uuaaacaugcuguacauacuuu

SEQ ID NO: 2967665 - RNA, 23 nt, Human
uuaaacaugcuguacauacuuuu

SEQ ID NO: 2967666 - RNA, 19 nt, Human
uuaaacaugcuguacauac

SEQ ID NO: 2967667 - RNA, 14 nt, Human
uuaaacacauuaaa

SEQ ID NO: 2967668 - RNA, 13 nt, Human
uuaaggguaugau

SEQ ID NO: 2967669 - RNA, 19 nt, Human
uuaagaacuaaaauguucu

SEQ ID NO: 2967670 - RNA, 16 nt, Human
uuaagaacuaaaaugu

SEQ ID NO: 2967671 - RNA, 20 nt, Human
uuaagaacuaaaauguucua

SEQ ID NO: 2967672 - RNA, 18 nt, Human
aguuuugaagauucuaug

SEQ ID NO: 2967673 - RNA, 17 nt, Human
aguuuugaagauucuau

SEQ ID NO: 2967674 - RNA, 19 nt, Human
uuuucucacagaagaugaa

SEQ ID NO: 2967675 - RNA, 13 nt, Human
auuaaagugccca

SEQ ID NO: 2967676 - RNA, 23 nt, Human
uuuuccaguaaugagcuuaagaa

SEQ ID NO: 2967677 - RNA, 15 nt, Human
uuuuauuauuaacaa

SEQ ID NO: 2967678 - RNA, 23 nt, Human
uuuguaacuguuuagaugaaugu

SEQ ID NO: 2967679 - RNA, 22 nt, Human
uuuguaacuguuuagaugaaug

SEQ ID NO: 2967680 - RNA, 22 nt, Human
uuuuaagggcccuuuuucaaua

SEQ ID NO: 2967681 - RNA, 17 nt, Human
uuuuaagacuuugguua

SEQ ID NO: 2967682 - RNA, 17 nt, Human
augucaguuguuauuua

SEQ ID NO: 2967683 - RNA, 15 nt, Human
augucaguuguuauu

SEQ ID NO: 2967684 - RNA, 23 nt, Human
augucuagaccaggaccucccuc

SEQ ID NO: 2967685 - RNA, 14 nt, Human
uuuggccagaaguc

SEQ ID NO: 2967686 - RNA, 12 nt, Human
uuuggccagaag

SEQ ID NO: 2967687 - RNA, 10 nt, Human
uuuggccaga

SEQ ID NO: 2967688 - RNA, 13 nt, Human
uuugcacauuaaa

SEQ ID NO: 2967689 - RNA, 16 nt, Human
uuugcacauuaaauga

SEQ ID NO: 2967690 - RNA, 12 nt, Human
uuugcacauuaa

SEQ ID NO: 2967691 - RNA, 11 nt, Human
auuauuaacaa

SEQ ID NO: 2967692 - RNA, 17 nt, Human
auuuaaacacauuaaag

SEQ ID NO: 2967693 - RNA, 18 nt, Human
auuuaaacacauuaaagg

SEQ ID NO: 2967694 - RNA, 16 nt, Human
auucucagcagagugc

SEQ ID NO: 2967695 - RNA, 16 nt, Human
auugacagauugaauu

SEQ ID NO: 2967696 - RNA, 15 nt, Human
auucucagcagagug

SEQ ID NO: 2967697 - RNA, 14 nt, Human
auucucagcagagu

SEQ ID NO: 2967698 - RNA, 23 nt, Human
uucaagaaugcaguacuaacauu

SEQ ID NO: 2967699 - RNA, 23 nt, Human
uucaagaaguccccucuccucca

SEQ ID NO: 2967700 - RNA, 13 nt, Human
uucauauuuaauu

SEQ ID NO: 2967701 - RNA, 16 nt, Human
auaugaugacuguuuu

SEQ ID NO: 2967702 - RNA, 14 nt, Human
uuccuucaagaaug

SEQ ID NO: 2967703 - RNA, 21 nt, Human
uuccuucaagaaugcaguacu

SEQ ID NO: 2967704 - RNA, 22 nt, Human
uucuaaauaucccuuggacauu

SEQ ID NO: 2967705 - RNA, 13 nt, Human
uucucagcagagu

SEQ ID NO: 2967706 - RNA, 15 nt, Human
uucuuggcccaggau

SEQ ID NO: 2967707 - RNA, 12 nt, Human
auccuaauaaaa

SEQ ID NO: 2967708 - RNA, 17 nt, Human
auccuaauaaaaaggug

SEQ ID NO: 2967709 - RNA, 16 nt, Human
auccuaauaaaaaggu

SEQ ID NO: 2967710 - RNA, 15 nt, Human
auccuaauaaaaagg

SEQ ID NO: 2967711 - RNA, 14 nt, Human
auccuaauaaaaag

SEQ ID NO: 2967712 - RNA, 22 nt, Human
auccuaauaaaaaggugaccau

SEQ ID NO: 2967713 - RNA, 18 nt, Human
auccuaauaaaaagguga

SEQ ID NO: 2967714 - RNA, 20 nt, Human
auccuagucauucuucccua

SEQ ID NO: 2967715 - RNA, 15 nt, Human
uucuuuuugaaaugu

SEQ ID NO: 2967716 - RNA, 14 nt, Human
uucuuuuugaaaug

SEQ ID NO: 2967717 - RNA, 14 nt, Human
uugaaaugauuuca

SEQ ID NO: 2967718 - RNA, 13 nt, Human
aucauuucaagaa

SEQ ID NO: 2967719 - RNA, 13 nt, Human
augauuucacagu

SEQ ID NO: 2967720 - RNA, 13 nt, Human
augcagguuuuau

SEQ ID NO: 2967721 - RNA, 18 nt, Human
augcaguacuaacauuua

SEQ ID NO: 2967722 - RNA, 12 nt, Human
augcuguacaua

SEQ ID NO: 2967723 - RNA, 15 nt, Human
augcuguacauacuu

SEQ ID NO: 2967724 - RNA, 16 nt, Human
augcuguacauacuuu

SEQ ID NO: 2967725 - RNA, 18 nt, Human
augcuguacauacuuuuu

SEQ ID NO: 2967726 - RNA, 18 nt, Human
uuuagaugaaugucaguu

SEQ ID NO: 2967727 - RNA, 17 nt, Human
uuuagaugaaugucagu

SEQ ID NO: 2967728 - RNA, 22 nt, Human
uuuagaugaaugucaguuguua

SEQ ID NO: 2967729 - RNA, 12 nt, Human
aucuguuacaca

SEQ ID NO: 2967730 - RNA, 20 nt, Human
uugccuaauaugaugacugu

SEQ ID NO: 2967731 - RNA, 23 nt, Human
uugcacauuaaaugacucuuccc

SEQ ID NO: 2967732 - RNA, 11 nt, Human
uugcacauuaa

SEQ ID NO: 2967733 - RNA, 14 nt, Human
augacauucccugc

SEQ ID NO: 2967734 - RNA, 16 nt, Human
augacauugacuauuu

SEQ ID NO: 2967735 - RNA, 19 nt, Human
augacauugacuauuuuug

SEQ ID NO: 2967736 - RNA, 18 nt, Human
augacuuggugucuaaug

SEQ ID NO: 2967737 - RNA, 23 nt, Human
augacuuggugucuaauguguag

SEQ ID NO: 2967738 - RNA, 18 nt, Human
uugguucuggacuaaaac

SEQ ID NO: 2967739 - RNA, 20 nt, Human
uugguucuggacuaaaacua

SEQ ID NO: 2967740 - RNA, 17 nt, Human
uugguugggaugacuug

SEQ ID NO: 2967741 - RNA, 21 nt, Human
uugguugguaacucuguaauu

SEQ ID NO: 2967742 - RNA, 21 nt, Human
augaaugcccagugagacugu

SEQ ID NO: 2967743 - RNA, 13 nt, Human
augaaugcccagu

SEQ ID NO: 2967744 - RNA, 22 nt, Human
cuccagucauuauguuaauauu

SEQ ID NO: 2967745 - RNA, 12 nt, Human
cucaugcugcca

SEQ ID NO: 2967746 - RNA, 22 nt, Human
cucaugcugccaauauccuaau

SEQ ID NO: 2967747 - RNA, 14 nt, Human
cucaugcugccaau

SEQ ID NO: 2967748 - RNA, 13 nt, Human
cucuauuucugga

SEQ ID NO: 2967749 - RNA, 21 nt, Human
ccuuggacauuuuaugucuuu

SEQ ID NO: 2967750 - RNA, 18 nt, Human
ccuuggacauuuuauguc

SEQ ID NO: 2967751 - RNA, 16 nt, Human
ccuuggacauuuuaug

SEQ ID NO: 2967752 - RNA, 22 nt, Human
cuauaacaaaggauacuuauuu

SEQ ID NO: 2967753 - RNA, 18 nt, Human
cuauaacaaaggauacuu

SEQ ID NO: 2967754 - RNA, 16 nt, Human
cuagcaugaagacaga

SEQ ID NO: 2967755 - RNA, 13 nt, Human
cccuucucuguau

SEQ ID NO: 2967756 - RNA, 24 nt, Human
ccguagacgugcacgcacacuguc

SEQ ID NO: 2967757 - RNA, 13 nt, Human
caaacccaguguu

SEQ ID NO: 2967758 - RNA, 21 nt, Human
auuugccuaauaugaugacug

SEQ ID NO: 2967759 - RNA, 18 nt, Human
auuuguggaaaauaacuc

SEQ ID NO: 2967760 - RNA, 18 nt, Human
auuuggaaaggaaugcaa

SEQ ID NO: 2967761 - RNA, 15 nt, Human
auuuggaaaggaaug

SEQ ID NO: 2967762 - RNA, 14 nt, Human
auuagguugugaau

SEQ ID NO: 2967763 - RNA, 15 nt, Human
auuagguugugaaug

SEQ ID NO: 2967764 - RNA, 13 nt, Human
auuagguugugaa

SEQ ID NO: 2967765 - RNA, 17 nt, Human
auuacaacucuauuuaa

SEQ ID NO: 2967766 - RNA, 20 nt, Human
auuaaugucaguauuucaac

SEQ ID NO: 2967767 - RNA, 17 nt, Human
auugcugcuuguacacu

SEQ ID NO: 2967768 - RNA, 14 nt, Human
cacugguuugguuc

SEQ ID NO: 2967769 - RNA, 22 nt, Human
caugcugccaauauccuaauaa

SEQ ID NO: 2967770 - RNA, 21 nt, Human
caugcugccaauauccuaaua

SEQ ID NO: 2967771 - RNA, 19 nt, Human
caugcugccaauauccuaa

SEQ ID NO: 2967772 - RNA, 17 nt, Human
caugcugccaauauccu

SEQ ID NO: 2967773 - RNA, 15 nt, Human
caugcugccaauauc

SEQ ID NO: 2967774 - RNA, 11 nt, Human
caguuugguug

SEQ ID NO: 2967775 - RNA, 21 nt, Human
caguuugguugguaacucugu

SEQ ID NO: 2967776 - RNA, 14 nt, Human
caguuugcagagua

SEQ ID NO: 2967777 - RNA, 14 nt, Human
cauuucaagaaguc

SEQ ID NO: 2967778 - RNA, 20 nt, Human
caguaaaaaaugguguuuua

SEQ ID NO: 2967779 - RNA, 21 nt, Human
caguaaaaaaugguguuuuau

SEQ ID NO: 2967780 - RNA, 20 nt, Human
ggcccaggaguuuggccaga

SEQ ID NO: 2967781 - RNA, 19 nt, Human
ggcccaggaguuuggccag

SEQ ID NO: 2967782 - RNA, 18 nt, Human
ggcccaggaguuuggcca

SEQ ID NO: 2967783 - RNA, 13 nt, Human
ggcccaggaguuu

SEQ ID NO: 2967784 - RNA, 11 nt, Human
ggcccaggagu

SEQ ID NO: 2967785 - RNA, 18 nt, Human
ggaucuguauguguucua

SEQ ID NO: 2967786 - RNA, 19 nt, Human
ggaucuguauguguucuau

SEQ ID NO: 2967787 - RNA, 13 nt, Human
ggaguuuggccag

SEQ ID NO: 2967788 - RNA, 15 nt, Human
ggaguuuggccagaa

SEQ ID NO: 2967789 - RNA, 14 nt, Human
ggaguuuggccaga

SEQ ID NO: 2967790 - RNA, 22 nt, Human
aaaagggguaggguuuaaagau

SEQ ID NO: 2967791 - RNA, 19 nt, Human
gggcccuuuuucaauaacu

SEQ ID NO: 2967792 - RNA, 16 nt, Human
aaacagucucccuucc

SEQ ID NO: 2967793 - RNA, 22 nt, Human
aaauaaggaaugauauaagguu

SEQ ID NO: 2967794 - RNA, 18 nt, Human
gguggggcagugcuuggc

SEQ ID NO: 2967795 - RNA, 12 nt, Human
gguuucuagcau

SEQ ID NO: 2967796 - RNA, 11 nt, Human
gguuuauuugg

SEQ ID NO: 2967797 - RNA, 21 nt, Human
ggucuguuuuguguacuuuua

SEQ ID NO: 2967798 - RNA, 15 nt, Human
gguacacuugugaau

SEQ ID NO: 2967799 - RNA, 18 nt, Human
gccccacccucagaugca

SEQ ID NO: 2967800 - RNA, 15 nt, Human
gccccacccucagau

SEQ ID NO: 2967801 - RNA, 18 nt, Human
gcccaggaguuuggccag

SEQ ID NO: 2967802 - RNA, 17 nt, Human
gcccaggaguuuggcca

SEQ ID NO: 2967803 - RNA, 13 nt, Human
gcccaggaguuug

SEQ ID NO: 2967804 - RNA, 16 nt, Human
gcccaggaguuuggcc

SEQ ID NO: 2967805 - RNA, 15 nt, Human
gcccaggaguuuggc

SEQ ID NO: 2967806 - RNA, 22 nt, Human
gcuggaguuauugaagcagagu

SEQ ID NO: 2967807 - RNA, 22 nt, Human
gcuguacauacuuuuuggguuu

SEQ ID NO: 2967808 - RNA, 22 nt, Human
gcuuaauuauugauguuuucau

SEQ ID NO: 2967809 - RNA, 17 nt, Human
gcuuauuuccucauuuu

SEQ ID NO: 2967810 - RNA, 12 nt, Human
gcugaacaucac

SEQ ID NO: 2967811 - RNA, 13 nt, Human
gauacuuauuuaa

SEQ ID NO: 2967812 - RNA, 19 nt, Human
gauacuuauuuaaauagau

SEQ ID NO: 2967813 - RNA, 16 nt, Human
gauacuuauuuaaaua

SEQ ID NO: 2967814 - RNA, 14 nt, Human
gaguuuggccagaa

SEQ ID NO: 2967815 - RNA, 13 nt, Human
gaguuuggccaga

SEQ ID NO: 2967816 - RNA, 12 nt, Human
gaguuuggccag

SEQ ID NO: 2967817 - RNA, 21 nt, Human
gagugcucaguagucagacug

SEQ ID NO: 2967818 - RNA, 15 nt, Human
gcaguacuaacauuu

SEQ ID NO: 2967819 - RNA, 21 nt, Human
gcaguacuaacauuuauuuga

SEQ ID NO: 2967820 - RNA, 22 nt, Human
gcaguaaaaaaugguguuuuau

SEQ ID NO: 2967821 - RNA, 19 nt, Human
gcaguaaaaaaugguguuu

SEQ ID NO: 2967822 - RNA, 21 nt, Human
gcacaugagcuggcgggauug

SEQ ID NO: 2967823 - RNA, 15 nt, Human
gcacaucuguuuugu

SEQ ID NO: 2967824 - RNA, 13 nt, Human
gacuauuuuuguu

SEQ ID NO: 2967825 - RNA, 17 nt, Human
gacuauuuuuguuuuua

SEQ ID NO: 2967826 - RNA, 18 nt, Human
gacuauuuuuguuuuuau

SEQ ID NO: 2967827 - RNA, 21 nt, Human
gacuauuuuuguuuuuauuaa

SEQ ID NO: 2967828 - RNA, 22 nt, Human
gacuauuuuuguuuuuauuaaa

SEQ ID NO: 2967829 - RNA, 21 nt, Human
gagaagucuucuauuuauuua

SEQ ID NO: 2967830 - RNA, 20 nt, Human
gagaagucuucuauuuauuu

SEQ ID NO: 2967831 - RNA, 22 nt, Human
cuuuuaugauugccuuuuuaua

SEQ ID NO: 2967832 - RNA, 20 nt, Human
gaaaaaauuuacuuuaaacu

SEQ ID NO: 2967833 - RNA, 17 nt, Human
cuucaguuugcagagua

SEQ ID NO: 2967834 - RNA, 16 nt, Human
cuucaguuugcagagu

SEQ ID NO: 2967835 - RNA, 17 nt, Human
cuucacgcccuuggcca

SEQ ID NO: 2967836 - RNA, 15 nt, Human
cuucacgcccuuggc

SEQ ID NO: 2967837 - RNA, 16 nt, Human
cugguuuguucccugu

SEQ ID NO: 2967838 - RNA, 22 nt, Human
cugguuuuaaauauuuugacuu

SEQ ID NO: 2967839 - RNA, 17 nt, Human
cugccaauauccuaaua

SEQ ID NO: 2967840 - RNA, 16 nt, Human
cugccaauauccuaau

SEQ ID NO: 2967841 - RNA, 14 nt, Human
cugccaauauccua

SEQ ID NO: 2967842 - RNA, 13 nt, Human
cugccaauauccu

SEQ ID NO: 2967843 - RNA, 22 nt, Human
cugccaauauccuaauaaaaag

SEQ ID NO: 2967844 - RNA, 20 nt, Human
cugccaauauccuaauaaaa

SEQ ID NO: 2967845 - RNA, 19 nt, Human
cugccaauauccuaauaaa

SEQ ID NO: 2967846 - RNA, 18 nt, Human
cugccaauauccuaauaa

SEQ ID NO: 2967847 - RNA, 21 nt, Human
caguguguggucaacauuucu

SEQ ID NO: 2967848 - RNA, 17 nt, Human
caguguguggucaacau

SEQ ID NO: 2967849 - RNA, 20 nt, Human
cagugcuuggcccaggaguu

SEQ ID NO: 2967850 - RNA, 19 nt, Human
cagugcuuggcccaggagu

SEQ ID NO: 2967851 - RNA, 18 nt, Human
cagugcuuggcccaggag

SEQ ID NO: 2967852 - RNA, 17 nt, Human
cagugcuuggcccagga

SEQ ID NO: 2967853 - RNA, 12 nt, Human
cagugcuuggcc

SEQ ID NO: 2967854 - RNA, 16 nt, Human
cagugcuuggcccagg

SEQ ID NO: 2967855 - RNA, 15 nt, Human
cagugcuuggcccag

SEQ ID NO: 2967856 - RNA, 14 nt, Human
cagugcuuggccca

SEQ ID NO: 2967857 - RNA, 13 nt, Human
cagugcuuggccc

SEQ ID NO: 2967858 - RNA, 16 nt, Human
caguguuuuaggagca

SEQ ID NO: 2967859 - RNA, 20 nt, Human
caguguuuuaggagcaugag

SEQ ID NO: 2967860 - RNA, 18 nt, Human
cauaagugcuauugcaga

SEQ ID NO: 2967861 - RNA, 22 nt, Human
cauaagugcuauugcagagccg

SEQ ID NO: 2967862 - RNA, 19 nt, Human
caguuuuuuuccuucaaga

SEQ ID NO: 2967863 - RNA, 11 nt, Human
caguuggguuu

SEQ ID NO: 2967864 - RNA, 16 nt, Human
caguuggguuuuuuaa

SEQ ID NO: 2967865 - RNA, 18 nt, Human
caguuggguuuuuuaagg

SEQ ID NO: 2967866 - RNA, 14 nt, Human
cauacuauuaaaca

SEQ ID NO: 2967867 - RNA, 12 nt, Human
caucauuucaag

SEQ ID NO: 2967868 - RNA, 14 nt, Human
caucauuucaagaa

SEQ ID NO: 2967869 - RNA, 18 nt, Human
cauacuauuaaacaugcu

SEQ ID NO: 2967870 - RNA, 12 nt, Human
cauacuuuuugg

SEQ ID NO: 2967871 - RNA, 16 nt, Human
cauacuuuuuggguuu

SEQ ID NO: 2967872 - RNA, 18 nt, Human
cauacuuuuuggguuuau

SEQ ID NO: 2967873 - RNA, 17 nt, Human
caugccuaccaauauuu

SEQ ID NO: 2967874 - RNA, 13 nt, Human
cauuaaaugacuc

SEQ ID NO: 2967875 - RNA, 14 nt, Human
cauuaaaugacucu

SEQ ID NO: 2967876 - RNA, 18 nt, Human
cauuaaaugacucuuccc

SEQ ID NO: 2967877 - RNA, 17 nt, Human
cauuaaagguacuuugc

SEQ ID NO: 2967878 - RNA, 21 nt, Human
ccaauauuuaaucuuuuauga

SEQ ID NO: 2967879 - RNA, 19 nt, Human
ccaauuugcacauuaaaug

SEQ ID NO: 2967880 - RNA, 20 nt, Human
ccaauuugcacauuaaauga

SEQ ID NO: 2967881 - RNA, 17 nt, Human
cauuucucauguugaaa

SEQ ID NO: 2967882 - RNA, 16 nt, Human
cauuucucauguugaa

SEQ ID NO: 2967883 - RNA, 14 nt, Human
cauugacagauuga

SEQ ID NO: 2967884 - RNA, 22 nt, Human
cauugacuauuuuuguuuuuau

SEQ ID NO: 2967885 - RNA, 17 nt, Human
cccaguguuuuaggagc

SEQ ID NO: 2967886 - RNA, 16 nt, Human
cccaguguuuuaggag

SEQ ID NO: 2967887 - RNA, 14 nt, Human
cccuuggacauuuu

SEQ ID NO: 2967888 - RNA, 15 nt, Human
cccuuggacauuuua

SEQ ID NO: 2967889 - RNA, 20 nt, Human
ccucagaugcacaugagcug

SEQ ID NO: 2967890 - RNA, 14 nt, Human
ccucuccuccacau

SEQ ID NO: 2967891 - RNA, 16 nt, Human
ccucccccuggcacug

SEQ ID NO: 2967892 - RNA, 17 nt, Human
cccucaugcugccaaua

SEQ ID NO: 2967893 - RNA, 14 nt, Human
cccucaugcugcca

SEQ ID NO: 2967894 - RNA, 18 nt, Human
cuacacaccuaacuuaug

SEQ ID NO: 2967895 - RNA, 13 nt, Human
cuaaaauguucua

SEQ ID NO: 2967896 - RNA, 18 nt, Human
cgugcacgcacacugucu

SEQ ID NO: 2967897 - RNA, 22 nt, Human
cgccagcucaccccaucauccc

SEQ ID NO: 2967898 - RNA, 13 nt, Human
cuccuccacauuu

SEQ ID NO: 2967899 - RNA, 16 nt, Human
cugaaauaaggaauga

SEQ ID NO: 2967900 - RNA, 23 nt, Human
cugcaguuuuuuuccuucaagaa

SEQ ID NO: 2967901 - RNA, 22 nt, Human
cugcaguuuuuuuccuucaaga

SEQ ID NO: 2967902 - RNA, 20 nt, Human
cugcaguuuuuuuccuucaa

SEQ ID NO: 2967903 - RNA, 20 nt, Human
cugggaaagggauuuucagc

SEQ ID NO: 2967904 - RNA, 21 nt, Human
cuguccuauuauauucauucu

SEQ ID NO: 2967905 - RNA, 15 nt, Human
cuguccuauuauauu

SEQ ID NO: 2967906 - RNA, 20 nt, Human
cugucuccucucucuguaau

SEQ ID NO: 2967907 - RNA, 17 nt, Human
cugucuccucucucugu

SEQ ID NO: 2967908 - RNA, 15 nt, Human
cuguacauacuuuuu

SEQ ID NO: 2967909 - RNA, 16 nt, Human
cuguacauacuuuuug

SEQ ID NO: 2967910 - RNA, 21 nt, Human
cuguaaguuacaugaaggcag

SEQ ID NO: 2967911 - RNA, 21 nt, Human
cugguacucugccacuuuauu

SEQ ID NO: 2967912 - RNA, 20 nt, Human
gaagauucuuguauuuauua

SEQ ID NO: 2967913 - RNA, 14 nt, Human
gaaggaugcugucu

SEQ ID NO: 2967914 - RNA, 19 nt, Human
gaaggucuguuuuguguac

SEQ ID NO: 2967915 - RNA, 18 nt, Human
gaagucaaggcuuagacc

SEQ ID NO: 2967916 - RNA, 23 nt, Human
gaaguccccucuccuccacauuu

SEQ ID NO: 2967917 - RNA, 18 nt, Human
gaaguccccucuccucca

SEQ ID NO: 2967918 - RNA, 15 nt, Human
gaacacucuauaaca

SEQ ID NO: 2967919 - RNA, 21 nt, Human
gaacacucuauaacaaaggau

SEQ ID NO: 2967920 - RNA, 22 nt, Human
gaacaguaacauagcugugauu

SEQ ID NO: 2967921 - RNA, 16 nt, Human
gaaacugacacaugcu

SEQ ID NO: 2967922 - RNA, 20 nt, Human
gaaaggaaugcaaagaugaa

SEQ ID NO: 2967923 - RNA, 12 nt, Human
cuuuuuauaacu

SEQ ID NO: 2967924 - RNA, 18 nt, Human
cuuuuuauauucucagca

SEQ ID NO: 2967925 - RNA, 16 nt, Human
cuuuuuauaacuuuuu

SEQ ID NO: 2967926 - RNA, 22 nt, Human
cuuuuuauauucucagcagagu

SEQ ID NO: 2967927 - RNA, 15 nt, Human
cuuuugcauauugca

SEQ ID NO: 2967928 - RNA, 23 nt, Human
cuuuugcauauugcauacuauua

SEQ ID NO: 2967929 - RNA, 17 nt, Human
cuuuuaagacuuugguu

SEQ ID NO: 2967930 - RNA, 11 nt, Human
cuuuuaaacuc

SEQ ID NO: 2967931 - RNA, 12 nt, Human
cuuucccuuggu

SEQ ID NO: 2967932 - RNA, 17 nt, Human
cuuucccuuggugcccu

SEQ ID NO: 2967933 - RNA, 22 nt, Human
cuugagugucaagcugaccuug

SEQ ID NO: 2967934 - RNA, 16 nt, Human
cuugagugcucaguag

SEQ ID NO: 2967935 - RNA, 19 nt, Human
cuuggacauuuuaugucuu

SEQ ID NO: 2967936 - RNA, 16 nt, Human
cuuggacauuuuaugu

SEQ ID NO: 2967937 - RNA, 18 nt, Human
cuuggacauuuuaugucu

SEQ ID NO: 2967938 - RNA, 17 nt, Human
cuuggacauuuuauguc

SEQ ID NO: 2967939 - RNA, 19 nt, Human
cuugcugcugauuuaaaca

SEQ ID NO: 2967940 - RNA, 17 nt, Human
cuugcugcugauuuaaa

SEQ ID NO: 2967941 - RNA, 17 nt, Human
gaagucuucuauuuauu

SEQ ID NO: 2967942 - RNA, 13 nt, Human
gaagucuucuauu

SEQ ID NO: 2967943 - RNA, 18 nt, Human
gaugaaggucuguuuugu

SEQ ID NO: 2967944 - RNA, 15 nt, Human
gaugaaggucuguuu

SEQ ID NO: 2967945 - RNA, 17 nt, Human
gaugacauucccugcua

SEQ ID NO: 2967946 - RNA, 17 nt, Human
gaugacauugacuauuu

SEQ ID NO: 2967947 - RNA, 21 nt, Human
gaugacauugacuauuuuugu

SEQ ID NO: 2967948 - RNA, 23 nt, Human
gaugacauugacuauuuuuguuu

SEQ ID NO: 2967949 - RNA, 15 nt, Human
gaugacauucccugc

SEQ ID NO: 2967950 - RNA, 19 nt, Human
gauuuucagcccucagaau

SEQ ID NO: 2967951 - RNA, 15 nt, Human
gauuuucagcccuca

SEQ ID NO: 2967952 - RNA, 11 nt, Human
gauuuucagcc

SEQ ID NO: 2967953 - RNA, 12 nt, Human
gauucauauuua

SEQ ID NO: 2967954 - RNA, 20 nt, Human
gcagugcuuggcccaggagu

SEQ ID NO: 2967955 - RNA, 19 nt, Human
gcagugcuuggcccaggag

SEQ ID NO: 2967956 - RNA, 18 nt, Human
gcagugcuuggcccagga

SEQ ID NO: 2967957 - RNA, 19 nt, Human
gcacugguuuguucccugu

SEQ ID NO: 2967958 - RNA, 17 nt, Human
gcacugguuuguucccu

SEQ ID NO: 2967959 - RNA, 19 nt, Human
gcagcccucaauugugaaa

SEQ ID NO: 2967960 - RNA, 13 nt, Human
gcuacacaccuaa

SEQ ID NO: 2967961 - RNA, 16 nt, Human
gcccuuggccaugggu

SEQ ID NO: 2967962 - RNA, 18 nt, Human
gcccuuuuucaauaacug

SEQ ID NO: 2967963 - RNA, 23 nt, Human
gccguggugauuuagcaggaagc

SEQ ID NO: 2967964 - RNA, 22 nt, Human
gccgugugugugcguccugucg

SEQ ID NO: 2967965 - RNA, 19 nt, Human
uuuuaauauggaucuguau

SEQ ID NO: 2967966 - RNA, 12 nt, Human
uuuguucccugu

SEQ ID NO: 2967967 - RNA, 13 nt, Human
uuugguuucuagc

SEQ ID NO: 2967968 - RNA, 15 nt, Human
uuugcauauugcaua

SEQ ID NO: 2967969 - RNA, 20 nt, Human
uuugcauauugcauacuauu

SEQ ID NO: 2967970 - RNA, 14 nt, Human
uuuggaaaagaaua

SEQ ID NO: 2967971 - RNA, 16 nt, Human
uuugaagauucuaugu

SEQ ID NO: 2967972 - RNA, 22 nt, Human
uuaccaauugaaguaaaaugug

SEQ ID NO: 2967973 - RNA, 18 nt, Human
uuuccucauuuuuauaau

SEQ ID NO: 2967974 - RNA, 23 nt, Human
uuaccaauugaaguaaaaugugg

SEQ ID NO: 2967975 - RNA, 21 nt, Human
uuuuuccuucaagaaugcagu

SEQ ID NO: 2967976 - RNA, 20 nt, Human
uuuuuaagggcccuuuuuca

SEQ ID NO: 2967977 - RNA, 17 nt, Human
uuuuggguuuauuugga

SEQ ID NO: 2967978 - RNA, 18 nt, Human
uuuuggguuuauuuggaa

SEQ ID NO: 2967979 - RNA, 14 nt, Human
uuuugguauuugaa

SEQ ID NO: 2967980 - RNA, 16 nt, Human
uuuugguauuugaaac

SEQ ID NO: 2967981 - RNA, 14 nt, Human
uuuuccuucaagaa

SEQ ID NO: 2967982 - RNA, 21 nt, Human
uuuuccuucaagaaugcagua

SEQ ID NO: 2967983 - RNA, 13 nt, Human
uuuuccuucaaga

SEQ ID NO: 2967984 - RNA, 19 nt, Human
gucauuauguuaauauuuc

SEQ ID NO: 2967985 - RNA, 17 nt, Human
gucauuauguuaauauu

SEQ ID NO: 2967986 - RNA, 14 nt, Human
gucauucuucccua

SEQ ID NO: 2967987 - RNA, 22 nt, Human
guauuuucuccaaauguucacu

SEQ ID NO: 2967988 - RNA, 20 nt, Human
gucaaggcuuagacccucau

SEQ ID NO: 2967989 - RNA, 18 nt, Human
gucaaggcuuagacccuc

SEQ ID NO: 2967990 - RNA, 16 nt, Human
gucaaggcuuagaccc

SEQ ID NO: 2967991 - RNA, 20 nt, Human
guauguuuuauauagcaaga

SEQ ID NO: 2967992 - RNA, 16 nt, Human
guauagauguugcuaa

SEQ ID NO: 2967993 - RNA, 15 nt, Human
guauagauguugcua

SEQ ID NO: 2967994 - RNA, 13 nt, Human
gugcguccugucg

SEQ ID NO: 2967995 - RNA, 16 nt, Human
gucggagcccugucuc

SEQ ID NO: 2967996 - RNA, 12 nt, Human
gucggagcccug

SEQ ID NO: 2967997 - RNA, 20 nt, Human
gucuguuuuguguacuuuua

SEQ ID NO: 2967998 - RNA, 15 nt, Human
gucuguuuuguguac

SEQ ID NO: 2967999 - RNA, 14 nt, Human
gucuguuuugugua

SEQ ID NO: 2968000 - RNA, 17 nt, Human
gucugucuuuuaaacuc

SEQ ID NO: 2968001 - RNA, 24 nt, Human
guuaguucaaucuggauucauauu

SEQ ID NO: 2968002 - RNA, 23 nt, Human
guucaaucuggauucauauuuaa

SEQ ID NO: 2968003 - RNA, 24 nt, Human
guucacuggacacuucacgcccuu

SEQ ID NO: 2968004 - RNA, 16 nt, Human
gugugcguccugucgg

SEQ ID NO: 2968005 - RNA, 14 nt, Human
gugugcguccuguc

SEQ ID NO: 2968006 - RNA, 23 nt, Human
guggggcagugcuuggcccagga

SEQ ID NO: 2968007 - RNA, 14 nt, Human
guggggcagugcuu

SEQ ID NO: 2968008 - RNA, 15 nt, Human
guggguggggcagug

SEQ ID NO: 2968009 - RNA, 21 nt, Human
uaaaaggaagcuuacaugccu

SEQ ID NO: 2968010 - RNA, 18 nt, Human
uaaaaggaagcuuacaug

SEQ ID NO: 2968011 - RNA, 20 nt, Human
uaaacaugcuguacauacuu

SEQ ID NO: 2968012 - RNA, 19 nt, Human
uaaacaugcuguacauacu

SEQ ID NO: 2968013 - RNA, 22 nt, Human
uaaacacauuaaagguacuuug

SEQ ID NO: 2968014 - RNA, 23 nt, Human
uaaacaugcuguacauacuuuuu

SEQ ID NO: 2968015 - RNA, 21 nt, Human
uaaacaugcuguacauacuuu

SEQ ID NO: 2968016 - RNA, 22 nt, Human
uaaacaugcuguacauacuuuu

SEQ ID NO: 2968017 - RNA, 16 nt, Human
uaaugguaguuuuaca

SEQ ID NO: 2968018 - RNA, 19 nt, Human
uaaugcuugcugcugauuu

SEQ ID NO: 2968019 - RNA, 15 nt, Human
uaauaugaugacugu

SEQ ID NO: 2968020 - RNA, 15 nt, Human
uaauauggaucugua

SEQ ID NO: 2968021 - RNA, 18 nt, Human
uaacucaccuggcaucuu

SEQ ID NO: 2968022 - RNA, 15 nt, Human
uaacuuuuuauauuc

SEQ ID NO: 2968023 - RNA, 16 nt, Human
uaacuuuuuauauucu

SEQ ID NO: 2968024 - RNA, 13 nt, Human
uaacuuuuuauau

SEQ ID NO: 2968025 - RNA, 14 nt, Human
uaacuuuuuauauu

SEQ ID NO: 2968026 - RNA, 10 nt, Human
uaacuggaac

SEQ ID NO: 2968027 - RNA, 22 nt, Human
uaguagagguacacuugugaau

SEQ ID NO: 2968028 - RNA, 20 nt, Human
uaguagagguacacuuguga

SEQ ID NO: 2968029 - RNA, 21 nt, Human
uaguagagguacacuugugaa

SEQ ID NO: 2968030 - RNA, 17 nt, Human
uaguagagguacacuug

SEQ ID NO: 2968031 - RNA, 21 nt, Human
uagcagcccucaauugugaaa

SEQ ID NO: 2968032 - RNA, 16 nt, Human
uagcaugaagacagag

SEQ ID NO: 2968033 - RNA, 18 nt, Human
uagacccucaugcugcca

SEQ ID NO: 2968034 - RNA, 17 nt, Human
uagacccucaugcugcc

SEQ ID NO: 2968035 - RNA, 19 nt, Human
uagacccucaugcugccaa

SEQ ID NO: 2968036 - RNA, 23 nt, Human
uagacccucaugcugccaauauc

SEQ ID NO: 2968037 - RNA, 12 nt, Human
uacuuuaaacua

SEQ ID NO: 2968038 - RNA, 18 nt, Human
uagaauguuuucaaaugu

SEQ ID NO: 2968039 - RNA, 19 nt, Human
uagaauguuuucaaauguu

SEQ ID NO: 2968040 - RNA, 18 nt, Human
uaauuccuguuuuuauua

SEQ ID NO: 2968041 - RNA, 16 nt, Human
uacaugccuaccaaua

SEQ ID NO: 2968042 - RNA, 19 nt, Human
uacaugccuaccaauauuu

SEQ ID NO: 2968043 - RNA, 17 nt, Human
uacuaacauuuauuuga

SEQ ID NO: 2968044 - RNA, 18 nt, Human
uacuaacauuuauuugag

SEQ ID NO: 2968045 - RNA, 21 nt, Human
ugaaacacugguuuuaaauau

SEQ ID NO: 2968046 - RNA, 18 nt, Human
ugaaugcagguuuuauca

SEQ ID NO: 2968047 - RNA, 20 nt, Human
ugaaugcagguuuuaucaga

SEQ ID NO: 2968048 - RNA, 15 nt, Human
ugacucuucccucaa

SEQ ID NO: 2968049 - RNA, 17 nt, Human
ucuucaguuugcagagu

SEQ ID NO: 2968050 - RNA, 18 nt, Human
ucuucaguuugcagagua

SEQ ID NO: 2968051 - RNA, 15 nt, Human
ugaaacacugguuuu

SEQ ID NO: 2968052 - RNA, 20 nt, Human
ugaaacacugguuuuaaaua

SEQ ID NO: 2968053 - RNA, 14 nt, Human
ucuggacuaaaacu

SEQ ID NO: 2968054 - RNA, 15 nt, Human
ucggagcccugucuc

SEQ ID NO: 2968055 - RNA, 14 nt, Human
ucggagcccugucu

SEQ ID NO: 2968056 - RNA, 21 nt, Human
ugcuaacagcaacacaaagcu

SEQ ID NO: 2968057 - RNA, 22 nt, Human
ugcuaacagcaacacaaagcuu

SEQ ID NO: 2968058 - RNA, 23 nt, Human
ugcuaacagcaacacaaagcuuu

SEQ ID NO: 2968059 - RNA, 15 nt, Human
ugcugauuuaaacac

SEQ ID NO: 2968060 - RNA, 17 nt, Human
ugcugauuuaaacacau

SEQ ID NO: 2968061 - RNA, 14 nt, Human
ugcugauuuaaaca

SEQ ID NO: 2968062 - RNA, 16 nt, Human
ugcucaguagucagac

SEQ ID NO: 2968063 - RNA, 19 nt, Human
ugcacgcacacugucugcc

SEQ ID NO: 2968064 - RNA, 15 nt, Human
ugguaguuuuacagu

SEQ ID NO: 2968065 - RNA, 13 nt, Human
uggcccaggaguu

SEQ ID NO: 2968066 - RNA, 19 nt, Human
uggcccaggaguuuggcca

SEQ ID NO: 2968067 - RNA, 14 nt, Human
uggcccaggaguuu

SEQ ID NO: 2968068 - RNA, 21 nt, Human
uggcccaggaguuuggccaga

SEQ ID NO: 2968069 - RNA, 20 nt, Human
uggcccaggaguuuggccag

SEQ ID NO: 2968070 - RNA, 22 nt, Human
uggcccaggaguuuggccagaa

SEQ ID NO: 2968071 - RNA, 12 nt, Human
uggcccaggagu

SEQ ID NO: 2968072 - RNA, 21 nt, Human
ugcuuuaccaauugaaguaaa

SEQ ID NO: 2968073 - RNA, 15 nt, Human
ugugcacaucuguuu

SEQ ID NO: 2968074 - RNA, 17 nt, Human
ugugcacaucuguuuug

SEQ ID NO: 2968075 - RNA, 23 nt, Human
ugugaaggcaggggaauguaugu

SEQ ID NO: 2968076 - RNA, 20 nt, Human
uguaauaaacucauuucuag

SEQ ID NO: 2968077 - RNA, 18 nt, Human
uguuucuggcuuagaaca

SEQ ID NO: 2968078 - RNA, 18 nt, Human
uuaaaugacucuucccuc

SEQ ID NO: 2968079 - RNA, 11 nt, Human
uuaaaugacuc

SEQ ID NO: 2968080 - RNA, 20 nt, Human
uuaaauauuuugacuuguug

SEQ ID NO: 2968081 - RNA, 23 nt, Human
uuaaacuacauuagguugugaau

SEQ ID NO: 2968082 - RNA, 22 nt, Human
uuaaacuacauuagguugugaa

SEQ ID NO: 2968083 - RNA, 23 nt, Human
uguguggucaacauuucucaugu

SEQ ID NO: 2968084 - RNA, 14 nt, Human
uguguggucaacau

SEQ ID NO: 2968085 - RNA, 18 nt, Human
uguucacuggacacuuca

SEQ ID NO: 2968086 - RNA, 16 nt, Human
caaucuggauucauau

SEQ ID NO: 2968087 - RNA, 20 nt, Human
caaucuggauucauauuuaa

SEQ ID NO: 2968088 - RNA, 23 nt, Human
caaucugugaugacauucccugc

SEQ ID NO: 2968089 - RNA, 16 nt, Human
caaguuaguucaaucu

SEQ ID NO: 2968090 - RNA, 14 nt, Human
caauuugcacauua

SEQ ID NO: 2968091 - RNA, 15 nt, Human
caauuugcacauuaa

SEQ ID NO: 2968092 - RNA, 22 nt, Human
caauuugcacauuaaaugacuc

SEQ ID NO: 2968093 - RNA, 19 nt, Human
caaugagaucauugugaag

SEQ ID NO: 2968094 - RNA, 14 nt, Human
caaggcuuagaccc

SEQ ID NO: 2968095 - RNA, 15 nt, Human
caaggcuuagacccu

SEQ ID NO: 2968096 - RNA, 15 nt, Human
caaggcugugcaucu

SEQ ID NO: 2968097 - RNA, 18 nt, Human
caaggcuuagacccucau

SEQ ID NO: 2968098 - RNA, 14 nt, Human
caaacuaacaggcu

SEQ ID NO: 2968099 - RNA, 16 nt, Human
caaacuaacaggcuua

SEQ ID NO: 2968100 - RNA, 20 nt, Human
caaacuaacaggcuuaguga

SEQ ID NO: 2968101 - RNA, 21 nt, Human
cacaguguguggucaacauuu

SEQ ID NO: 2968102 - RNA, 16 nt, Human
cucuccccuucucugu

SEQ ID NO: 2968103 - RNA, 15 nt, Human
cguggugauuuagca

SEQ ID NO: 2968104 - RNA, 22 nt, Human
cguggugauuuagcaggaagcu

SEQ ID NO: 2968105 - RNA, 12 nt, Human
ccuuuuuauaac

SEQ ID NO: 2968106 - RNA, 15 nt, Human
ccuuuuuauaacuuu

SEQ ID NO: 2968107 - RNA, 21 nt, Human
ccuuuuuauaacuuuuuauau

SEQ ID NO: 2968108 - RNA, 16 nt, Human
ccuuuuucaauaacug

SEQ ID NO: 2968109 - RNA, 11 nt, Human
cuaauaaaaag

SEQ ID NO: 2968110 - RNA, 13 nt, Human
cuaauaaaaaggu

SEQ ID NO: 2968111 - RNA, 14 nt, Human
cuaauaaaaaggug

SEQ ID NO: 2968112 - RNA, 15 nt, Human
cuaauaaaaagguga

SEQ ID NO: 2968113 - RNA, 20 nt, Human
cgugugugugcguccugucg

SEQ ID NO: 2968114 - RNA, 12 nt, Human
cucaauugugaa

SEQ ID NO: 2968115 - RNA, 13 nt, Human
cucaauugugaaa

SEQ ID NO: 2968116 - RNA, 17 nt, Human
cucaauaaacauuucau

SEQ ID NO: 2968117 - RNA, 21 nt, Human
cucaauaaacauuucauuucc

SEQ ID NO: 2968118 - RNA, 21 nt, Human
cucaaacuaacaggcuuagug

SEQ ID NO: 2968119 - RNA, 15 nt, Human
cuauuuuuguuuuua

SEQ ID NO: 2968120 - RNA, 21 nt, Human
cuauuuuuguuuuuauuaaaa

SEQ ID NO: 2968121 - RNA, 21 nt, Human
cuauuaaacaugcuguacaua

SEQ ID NO: 2968122 - RNA, 22 nt, Human
ccugucggagcccugucuccuc

SEQ ID NO: 2968123 - RNA, 16 nt, Human
ccugucggagcccugu

SEQ ID NO: 2968124 - RNA, 21 nt, Human
ccugucggagcccugucuccu

SEQ ID NO: 2968125 - RNA, 17 nt, Human
ccugucggagcccuguc

SEQ ID NO: 2968126 - RNA, 19 nt, Human
cccugucuccucucucugu

SEQ ID NO: 2968127 - RNA, 21 nt, Human
ccucauuuuuauaaugucccu

SEQ ID NO: 2968128 - RNA, 21 nt, Human
ccucaugcugccaauauccua

SEQ ID NO: 2968129 - RNA, 20 nt, Human
ccucaugcugccaauauccu

SEQ ID NO: 2968130 - RNA, 20 nt, Human
ccaggauuauugucaaagaa

SEQ ID NO: 2968131 - RNA, 14 nt, Human
cauauggauaaaua

SEQ ID NO: 2968132 - RNA, 18 nt, Human
caucuguuacacaaagaa

SEQ ID NO: 2968133 - RNA, 15 nt, Human
cauuaguuuugaaga

SEQ ID NO: 2968134 - RNA, 14 nt, Human
cauuaguuuugaag

SEQ ID NO: 2968135 - RNA, 17 nt, Human
cauuauauagcaguaaa

SEQ ID NO: 2968136 - RNA, 16 nt, Human
cauuaguuuugaagau

SEQ ID NO: 2968137 - RNA, 20 nt, Human
cauuauauagcaguaaaaaa

SEQ ID NO: 2968138 - RNA, 17 nt, Human
auuuaaucuuuuaugau

SEQ ID NO: 2968139 - RNA, 14 nt, Human
auuuaaucuuuuau

SEQ ID NO: 2968140 - RNA, 23 nt, Human
auuucaagaaguccccucuccuc

SEQ ID NO: 2968141 - RNA, 12 nt, Human
auuucaagaagu

SEQ ID NO: 2968142 - RNA, 15 nt, Human
auuucucauguugaa

SEQ ID NO: 2968143 - RNA, 19 nt, Human
auucugagaugacuauuca

SEQ ID NO: 2968144 - RNA, 20 nt, Human
caagaaguccccucuccucc

SEQ ID NO: 2968145 - RNA, 11 nt, Human
cacuugugaau

SEQ ID NO: 2968146 - RNA, 12 nt, Human
cacuugugaaua

SEQ ID NO: 2968147 - RNA, 22 nt, Human
caccuugcagcucuccccuucu

SEQ ID NO: 2968148 - RNA, 15 nt, Human
caccuugcagcucuc

SEQ ID NO: 2968149 - RNA, 13 nt, Human
caccuugcagcuc

SEQ ID NO: 2968150 - RNA, 19 nt, Human
caauaaacauuucauuucc

SEQ ID NO: 2968151 - RNA, 15 nt, Human
ggcuaacuuggguua

SEQ ID NO: 2968152 - RNA, 19 nt, Human
ggaguuauugaagcagagu

SEQ ID NO: 2968153 - RNA, 23 nt, Human
ggauugugccuaauguguuugag

SEQ ID NO: 2968154 - RNA, 14 nt, Human
ggcacaucauuuca

SEQ ID NO: 2968155 - RNA, 15 nt, Human
ggcacaucauuucaa

SEQ ID NO: 2968156 - RNA, 21 nt, Human
aaagggguaggguuuaaagau

SEQ ID NO: 2968157 - RNA, 13 nt, Human
guaauaaacucau

SEQ ID NO: 2968158 - RNA, 17 nt, Human
aaauaauuagguauuuu

SEQ ID NO: 2968159 - RNA, 17 nt, Human
guaacauagcugugauu

SEQ ID NO: 2968160 - RNA, 21 nt, Human
aaauauugguugggaugacuu

SEQ ID NO: 2968161 - RNA, 23 nt, Human
aaauaucccuuggacauuuuaug

SEQ ID NO: 2968162 - RNA, 22 nt, Human
aaauaucccuuggacauuuuau

SEQ ID NO: 2968163 - RNA, 16 nt, Human
gguauagauguugcua

SEQ ID NO: 2968164 - RNA, 15 nt, Human
aaacauuucauuucc

SEQ ID NO: 2968165 - RNA, 16 nt, Human
gggguaaggugcaucu

SEQ ID NO: 2968166 - RNA, 20 nt, Human
aaaaugguguuuuaucuucu

SEQ ID NO: 2968167 - RNA, 21 nt, Human
aaaaggaagcuuacaugccua

SEQ ID NO: 2968168 - RNA, 19 nt, Human
aaaauaauuagguauuuuc

SEQ ID NO: 2968169 - RNA, 20 nt, Human
gcccaggaguuuggccagaa

SEQ ID NO: 2968170 - RNA, 19 nt, Human
gcccaggaguuuggccaga

SEQ ID NO: 2968171 - RNA, 13 nt, Human
gcuuuugcauauu

SEQ ID NO: 2968172 - RNA, 17 nt, Human
ggaaaggaaugcaaaga

SEQ ID NO: 2968173 - RNA, 13 nt, Human
ggaaaggaaugca

SEQ ID NO: 2968174 - RNA, 20 nt, Human
ggaaugauauaagguuuuuu

SEQ ID NO: 2968175 - RNA, 14 nt, Human
gcagucuucaguuu

SEQ ID NO: 2968176 - RNA, 15 nt, Human
gcagcucuccccuuc

SEQ ID NO: 2968177 - RNA, 17 nt, Human
gagccccacccucagau

SEQ ID NO: 2968178 - RNA, 16 nt, Human
gagccccacccucaga

SEQ ID NO: 2968179 - RNA, 17 nt, Human
gaauguuuucaaauguu

SEQ ID NO: 2968180 - RNA, 17 nt, Human
gacccucaugcugccaa

SEQ ID NO: 2968181 - RNA, 16 nt, Human
gacccucaugcugcca

SEQ ID NO: 2968182 - RNA, 14 nt, Human
gacccucaugcugc

SEQ ID NO: 2968183 - RNA, 12 nt, Human
gacccucaugcu

SEQ ID NO: 2968184 - RNA, 23 nt, Human
gacccucaugcugccaauauccu

SEQ ID NO: 2968185 - RNA, 22 nt, Human
gacccucaugcugccaauaucc

SEQ ID NO: 2968186 - RNA, 21 nt, Human
gacccucaugcugccaauauc

SEQ ID NO: 2968187 - RNA, 18 nt, Human
gacccucaugcugccaau

SEQ ID NO: 2968188 - RNA, 20 nt, Human
gacauuuuaugucuuucuug

SEQ ID NO: 2968189 - RNA, 16 nt, Human
gacauuuuaugucuuu

SEQ ID NO: 2968190 - RNA, 19 nt, Human
gacacuucacgcccuuggc

SEQ ID NO: 2968191 - RNA, 23 nt, Human
cugucggagcccugucuccucuc

SEQ ID NO: 2968192 - RNA, 22 nt, Human
cuggaguuauugaagcagagug

SEQ ID NO: 2968193 - RNA, 21 nt, Human
cuggaguuauugaagcagagu

SEQ ID NO: 2968194 - RNA, 23 nt, Human
cuggaguuauugaagcagagugg

SEQ ID NO: 2968195 - RNA, 24 nt, Human
cuggaguuauugaagcagaguggc

SEQ ID NO: 2968196 - RNA, 15 nt, Human
cuuggcccaggaguu

SEQ ID NO: 2968197 - RNA, 14 nt, Human
cuuggcccaggagu

SEQ ID NO: 2968198 - RNA, 23 nt, Human
cuuggcccaggaguuuggccaga

SEQ ID NO: 2968199 - RNA, 22 nt, Human
cuuggcccaggaguuuggccag

SEQ ID NO: 2968200 - RNA, 20 nt, Human
cuuggcccaggaguuuggcc

SEQ ID NO: 2968201 - RNA, 16 nt, Human
cuuggcccaggaguuu

SEQ ID NO: 2968202 - RNA, 15 nt, Human
cuuuaagaacuaaaa

SEQ ID NO: 2968203 - RNA, 14 nt, Human
cuucuauauaauuc

SEQ ID NO: 2968204 - RNA, 22 nt, Human
cuucuauuuauuuauuuauuca

SEQ ID NO: 2968205 - RNA, 16 nt, Human
cuucuauuuauuuauu

SEQ ID NO: 2968206 - RNA, 22 nt, Human
cuucucuguauuccuagaaacu

SEQ ID NO: 2968207 - RNA, 13 nt, Human
aagguagaauguu

SEQ ID NO: 2968208 - RNA, 14 nt, Human
aagguagaauguuu

SEQ ID NO: 2968209 - RNA, 15 nt, Human
uaaaaaggugaccau

SEQ ID NO: 2968210 - RNA, 13 nt, Human
uaaaaaggugacc

SEQ ID NO: 2968211 - RNA, 17 nt, Human
aagagggugggugggua

SEQ ID NO: 2968212 - RNA, 16 nt, Human
guuauuuuacuuuuug

SEQ ID NO: 2968213 - RNA, 15 nt, Human
guuauuuuacuuuuu

SEQ ID NO: 2968214 - RNA, 13 nt, Human
aagcuuuugcaua

SEQ ID NO: 2968215 - RNA, 22 nt, Human
aagcuuuugcauauugcauacu

SEQ ID NO: 2968216 - RNA, 15 nt, Human
aagcuuuugcauauu

SEQ ID NO: 2968217 - RNA, 19 nt, Human
aagcuuuugcauauugcau

SEQ ID NO: 2968218 - RNA, 15 nt, Human
aacauagcugugauu

SEQ ID NO: 2968219 - RNA, 16 nt, Human
aacacugguuuuaaau

SEQ ID NO: 2968220 - RNA, 12 nt, Human
aacacaaagcuu

SEQ ID NO: 2968221 - RNA, 18 nt, Human
aacacaaagcuuuugcau

SEQ ID NO: 2968222 - RNA, 19 nt, Human
aacacaaagcuuuugcaua

SEQ ID NO: 2968223 - RNA, 20 nt, Human
aacacaaagcuuuugcauau

SEQ ID NO: 2968224 - RNA, 15 nt, Human
aacuaaaauguucua

SEQ ID NO: 2968225 - RNA, 18 nt, Human
gugcacgcacacugucug

SEQ ID NO: 2968226 - RNA, 14 nt, Human
aacuucagaguucu

SEQ ID NO: 2968227 - RNA, 17 nt, Human
acaaaggggcuuaauua

SEQ ID NO: 2968228 - RNA, 24 nt, Human
acaaaggauacuuauuuaaauaga

SEQ ID NO: 2968229 - RNA, 18 nt, Human
uagaugacauugacuauu

SEQ ID NO: 2968230 - RNA, 19 nt, Human
uagaugacauugacuauuu

SEQ ID NO: 2968231 - RNA, 18 nt, Human
uagcauguccuaaugcuu

SEQ ID NO: 2968232 - RNA, 20 nt, Human
uaggagaagucuucuauuua

SEQ ID NO: 2968233 - RNA, 12 nt, Human
uaggagcaugag

SEQ ID NO: 2968234 - RNA, 20 nt, Human
uauaacuuuuuauauucuca

SEQ ID NO: 2968235 - RNA, 12 nt, Human
uauaacuuuuua

SEQ ID NO: 2968236 - RNA, 17 nt, Human
uauaacuuuuuauauuc

SEQ ID NO: 2968237 - RNA, 17 nt, Human
uaucccuuggacauuuu

SEQ ID NO: 2968238 - RNA, 19 nt, Human
uaucccuuggacauuuuau

SEQ ID NO: 2968239 - RNA, 18 nt, Human
uaucccuuggacauuuua

SEQ ID NO: 2968240 - RNA, 12 nt, Human
uauccuaauaaa

SEQ ID NO: 2968241 - RNA, 18 nt, Human
uauccuaauaaaaaggug

SEQ ID NO: 2968242 - RNA, 15 nt, Human
uauccuaauaaaaag

SEQ ID NO: 2968243 - RNA, 19 nt, Human
uauccuaauaaaaagguga

SEQ ID NO: 2968244 - RNA, 22 nt, Human
uauccuaauaaaaaggugacca

SEQ ID NO: 2968245 - RNA, 18 nt, Human
acagauugaauuugccua

SEQ ID NO: 2968246 - RNA, 12 nt, Human
acagauugaauu

SEQ ID NO: 2968247 - RNA, 19 nt, Human
acaggcuuagugauguaau

SEQ ID NO: 2968248 - RNA, 20 nt, Human
acaggcuuagugauguaauu

SEQ ID NO: 2968249 - RNA, 14 nt, Human
acaggcuuagugau

SEQ ID NO: 2968250 - RNA, 18 nt, Human
uauucaguggcuaacuug

SEQ ID NO: 2968251 - RNA, 23 nt, Human
uauguuuuuguucaguuuaucug

SEQ ID NO: 2968252 - RNA, 20 nt, Human
uacucugccacuuuauuucu

SEQ ID NO: 2968253 - RNA, 17 nt, Human
aauuauugauguuuuca

SEQ ID NO: 2968254 - RNA, 21 nt, Human
aauuaaugucaguauuucaac

SEQ ID NO: 2968255 - RNA, 13 nt, Human
aauauuuaaucuu

SEQ ID NO: 2968256 - RNA, 17 nt, Human
uaaugucaguauuucaa

SEQ ID NO: 2968257 - RNA, 11 nt, Human
uaaucuuuuau

SEQ ID NO: 2968258 - RNA, 12 nt, Human
uaauaaacucau

SEQ ID NO: 2968259 - RNA, 23 nt, Human
aaucgcuccaccuugcagcucuc

SEQ ID NO: 2968260 - RNA, 19 nt, Human
aaucuggauucauauuuaa

SEQ ID NO: 2968261 - RNA, 18 nt, Human
aaucuggauucauauuua

SEQ ID NO: 2968262 - RNA, 17 nt, Human
aaucuggauucauauuu

SEQ ID NO: 2968263 - RNA, 16 nt, Human
aaucuggauucauauu

SEQ ID NO: 2968264 - RNA, 12 nt, Human
ucaauugugaaa

SEQ ID NO: 2968265 - RNA, 16 nt, Human
ucacacugucuucuga

SEQ ID NO: 2968266 - RNA, 20 nt, Human
acaugcuguacauacuuuuu

SEQ ID NO: 2968267 - RNA, 21 nt, Human
acaugcuguacauacuuuuug

SEQ ID NO: 2968268 - RNA, 17 nt, Human
ucaacauuucucauguu

SEQ ID NO: 2968269 - RNA, 11 nt, Human
acauucccugc

SEQ ID NO: 2968270 - RNA, 17 nt, Human
acauugacuauuuuugu

SEQ ID NO: 2968271 - RNA, 14 nt, Human
acauugacuauuuu

SEQ ID NO: 2968272 - RNA, 19 nt, Human
ucaaucuggauucauauuu

SEQ ID NO: 2968273 - RNA, 15 nt, Human
ucauauggauaaaua

SEQ ID NO: 2968274 - RNA, 14 nt, Human
acccucucaaacua

SEQ ID NO: 2968275 - RNA, 15 nt, Human
accccaucaucccuu

SEQ ID NO: 2968276 - RNA, 14 nt, Human
ucagcccucagaau

SEQ ID NO: 2968277 - RNA, 16 nt, Human
acucugccacuuuauu

SEQ ID NO: 2968278 - RNA, 17 nt, Human
acucugccacuuuauuu

SEQ ID NO: 2968279 - RNA, 22 nt, Human
acucugagugcaaacuucagag

SEQ ID NO: 2968280 - RNA, 21 nt, Human
acugaacaguaacauagcugu

SEQ ID NO: 2968281 - RNA, 15 nt, Human
acugaacaguaacau

SEQ ID NO: 2968282 - RNA, 23 nt, Human
uccagucauuauguuaauauuuc

SEQ ID NO: 2968283 - RNA, 21 nt, Human
uccagucauuauguuaauauu

SEQ ID NO: 2968284 - RNA, 15 nt, Human
uccagucauuauguu

SEQ ID NO: 2968285 - RNA, 14 nt, Human
uccagucauuaugu

SEQ ID NO: 2968286 - RNA, 22 nt, Human
acuuuuuauauucucagcagag

SEQ ID NO: 2968287 - RNA, 12 nt, Human
acuuuuuauauu

SEQ ID NO: 2968288 - RNA, 15 nt, Human
acuuuuuauauucuc

SEQ ID NO: 2968289 - RNA, 16 nt, Human
acuuuuuauauucuca

SEQ ID NO: 2968290 - RNA, 22 nt, Human
acuuugguuauuuuacuuuuug

SEQ ID NO: 2968291 - RNA, 23 nt, Human
acuuugguuauuuuacuuuuugg

SEQ ID NO: 2968292 - RNA, 10 nt, Human
acuuugguua

SEQ ID NO: 2968293 - RNA, 13 nt, Human
acuuugguuauuu

SEQ ID NO: 2968294 - RNA, 21 nt, Human
acuuugguuauuuuacuuuuu

SEQ ID NO: 2968295 - RNA, 15 nt, Human
acuugugaauaaaga

SEQ ID NO: 2968296 - RNA, 12 nt, Human
ucucagcagagu

SEQ ID NO: 2968297 - RNA, 13 nt, Human
ucucagcagagug

SEQ ID NO: 2968298 - RNA, 14 nt, Human
ucucagcagagugc

SEQ ID NO: 2968299 - RNA, 15 nt, Human
ucuauuuauuuguga

SEQ ID NO: 2968300 - RNA, 14 nt, Human
ucuauuuauuuauu

SEQ ID NO: 2968301 - RNA, 13 nt, Human
ucuauuuauuuau

SEQ ID NO: 2968302 - RNA, 16 nt, Human
ucuauguuaauauuuu

SEQ ID NO: 2968303 - RNA, 14 nt, Human
ucuauguuaauauu

SEQ ID NO: 2968304 - RNA, 22 nt, Human
ucuauaacaaaggauacuuauu

SEQ ID NO: 2968305 - RNA, 23 nt, Human
ucuauaacaaaggauacuuauuu

SEQ ID NO: 2968306 - RNA, 21 nt, Human
agaauguuuucaaauguucuc

SEQ ID NO: 2968307 - RNA, 15 nt, Human
agaauguuuucaaau

SEQ ID NO: 2968308 - RNA, 24 nt, Human
agacagagccccacccucagaugc

SEQ ID NO: 2968309 - RNA, 22 nt, Human
agacagagccccacccucagau

SEQ ID NO: 2968310 - RNA, 16 nt, Human
agaauugauugggcac

SEQ ID NO: 2968311 - RNA, 22 nt, Human
agaauugauugggcacaucauu

SEQ ID NO: 2968312 - RNA, 23 nt, Human
agaauugauugggcacaucauuu

SEQ ID NO: 2968313 - RNA, 24 nt, Human
agaauugauugggcacaucauuuc

SEQ ID NO: 2968314 - RNA, 22 nt, Human
ucugagugcaaacuucagaguu

SEQ ID NO: 2968315 - RNA, 23 nt, Human
ucugagugcaaacuucagaguuc

SEQ ID NO: 2968316 - RNA, 14 nt, Human
ucugagugcaaacu

SEQ ID NO: 2968317 - RNA, 18 nt, Human
ugacuauuuuuguuuuua

SEQ ID NO: 2968318 - RNA, 22 nt, Human
ugacuauuuuuguuuuuauuaa

SEQ ID NO: 2968319 - RNA, 11 nt, Human
ugacuguuuuu

SEQ ID NO: 2968320 - RNA, 16 nt, Human
ugacuauaaccuuguu

SEQ ID NO: 2968321 - RNA, 19 nt, Human
ugacuauucugagaugacu

SEQ ID NO: 2968322 - RNA, 21 nt, Human
ugacuauucugagaugacuau

SEQ ID NO: 2968323 - RNA, 22 nt, Human
ugacuauucugagaugacuauu

SEQ ID NO: 2968324 - RNA, 13 nt, Human
ugacauucccugc

SEQ ID NO: 2968325 - RNA, 14 nt, Human
ugacagauugaauu

SEQ ID NO: 2968326 - RNA, 13 nt, Human
agaugcacaugag

SEQ ID NO: 2968327 - RNA, 16 nt, Human
agaugcacaugagcug

SEQ ID NO: 2968328 - RNA, 23 nt, Human
ugagagcaguuugguuucuagca

SEQ ID NO: 2968329 - RNA, 21 nt, Human
ugagagcaguuugguuucuag

SEQ ID NO: 2968330 - RNA, 17 nt, Human
agacuuugguuauuuua

SEQ ID NO: 2968331 - RNA, 23 nt, Human
agacuuugguuauuuuacuuuuu

SEQ ID NO: 2968332 - RNA, 19 nt, Human
ugaaguaaaauguggcagg

SEQ ID NO: 2968333 - RNA, 18 nt, Human
ugaaguaaaauguggcag

SEQ ID NO: 2968334 - RNA, 17 nt, Human
uguagacaguuggguuu

SEQ ID NO: 2968335 - RNA, 12 nt, Human
agguugugaaug

SEQ ID NO: 2968336 - RNA, 15 nt, Human
ugguuuguucccugu

SEQ ID NO: 2968337 - RNA, 15 nt, Human
ugguuucuagcauga

SEQ ID NO: 2968338 - RNA, 16 nt, Human
ugguuauuuuacuuuu

SEQ ID NO: 2968339 - RNA, 15 nt, Human
ugguuauuuuacuuu

SEQ ID NO: 2968340 - RNA, 18 nt, Human
ugguuauuuuacuuuuug

SEQ ID NO: 2968341 - RNA, 21 nt, Human
aggggcuuaauuauugauguu

SEQ ID NO: 2968342 - RNA, 14 nt, Human
aggguuuaaagaug

SEQ ID NO: 2968343 - RNA, 14 nt, Human
agucuucuauuuau

SEQ ID NO: 2968344 - RNA, 19 nt, Human
ugugauuuuugguauuuga

SEQ ID NO: 2968345 - RNA, 21 nt, Human
ugugauuuuugguauuugaaa

SEQ ID NO: 2968346 - RNA, 20 nt, Human
ugugauuuuugguauuugaa

SEQ ID NO: 2968347 - RNA, 15 nt, Human
ugucuccucucucug

SEQ ID NO: 2968348 - RNA, 22 nt, Human
aguccccucuccuccacauuug

SEQ ID NO: 2968349 - RNA, 20 nt, Human
ugucaaccccaaguuaguuc

SEQ ID NO: 2968350 - RNA, 21 nt, Human
aguccccucuccuccacauuu

SEQ ID NO: 2968351 - RNA, 18 nt, Human
uuagcaggaagcugugag

SEQ ID NO: 2968352 - RNA, 16 nt, Human
auaacuggaacacucu

SEQ ID NO: 2968353 - RNA, 18 nt, Human
auaacuggaacacucuau

SEQ ID NO: 2968354 - RNA, 21 nt, Human
auaacuggaacacucuauaac

SEQ ID NO: 2968355 - RNA, 23 nt, Human
auaacuggaacacucuauaacaa

SEQ ID NO: 2968356 - RNA, 15 nt, Human
auaaacucauuucua

SEQ ID NO: 2968357 - RNA, 21 nt, Human
uuagccguggugauuuagcag

SEQ ID NO: 2968358 - RNA, 14 nt, Human
uuauaacuuuuuau

SEQ ID NO: 2968359 - RNA, 16 nt, Human
uuauaacuuuuuauau

SEQ ID NO: 2968360 - RNA, 19 nt, Human
uuauauagcaagacauuau

SEQ ID NO: 2968361 - RNA, 13 nt, Human
uuauauagcaaga

SEQ ID NO: 2968362 - RNA, 15 nt, Human
uuaucagaacuaugu

SEQ ID NO: 2968363 - RNA, 20 nt, Human
auacuauuaaacaugcugua

SEQ ID NO: 2968364 - RNA, 19 nt, Human
aguuauugaagcagagugg

SEQ ID NO: 2968365 - RNA, 23 nt, Human
aguuauugaagcagaguggcagu

SEQ ID NO: 2968366 - RNA, 16 nt, Human
aguuauugaagcagag

SEQ ID NO: 2968367 - RNA, 17 nt, Human
aguuauugaagcagagu

SEQ ID NO: 2968368 - RNA, 18 nt, Human
aguuauugaagcagagug

SEQ ID NO: 2968369 - RNA, 14 nt, Human
aguuauugaagcag

SEQ ID NO: 2968370 - RNA, 23 nt, Human
aguggcagucuucaguuugcaga

SEQ ID NO: 2968371 - RNA, 22 nt, Human
aguucuugccuuggcugcaguu

SEQ ID NO: 2968372 - RNA, 14 nt, Human
uguuuuaggagcau

SEQ ID NO: 2968373 - RNA, 17 nt, Human
uguuuuauauagcaaga

SEQ ID NO: 2968374 - RNA, 14 nt, Human
uguuuucaaauguu

SEQ ID NO: 2968375 - RNA, 13 nt, Human
uguuuucaaaugu

SEQ ID NO: 2968376 - RNA, 12 nt, Human
aguuuggccaga

SEQ ID NO: 2968377 - RNA, 16 nt, Human
aguuugguuucuagca

SEQ ID NO: 2968378 - RNA, 14 nt, Human
aguuuggccagaag

SEQ ID NO: 2968379 - RNA, 13 nt, Human
aguuuggccagaa

SEQ ID NO: 2968380 - RNA, 17 nt, Human
ugccagccacugugaua

SEQ ID NO: 2968381 - RNA, 20 nt, Human
ugcagcucuccccuucucug

SEQ ID NO: 2968382 - RNA, 22 nt, Human
ugcagcucuccccuucucugua

SEQ ID NO: 2968383 - RNA, 18 nt, Human
agcccugucuccucucuc

SEQ ID NO: 2968384 - RNA, 11 nt, Human
agcccugucuc

SEQ ID NO: 2968385 - RNA, 17 nt, Human
ugauuuagcaggaagcu

SEQ ID NO: 2968386 - RNA, 20 nt, Human
ugauuuagcaggaagcugug

SEQ ID NO: 2968387 - RNA, 18 nt, Human
ugaugacauucccugcua

SEQ ID NO: 2968388 - RNA, 15 nt, Human
ugaugacauucccug

SEQ ID NO: 2968389 - RNA, 13 nt, Human
ugaugacuguuuu

SEQ ID NO: 2968390 - RNA, 14 nt, Human
aggaguuuggccag

SEQ ID NO: 2968391 - RNA, 18 nt, Human
aggaguuuggccagaagu

SEQ ID NO: 2968392 - RNA, 17 nt, Human
aggaguuuggccagaag

SEQ ID NO: 2968393 - RNA, 16 nt, Human
aggaguuuggccagaa

SEQ ID NO: 2968394 - RNA, 15 nt, Human
aggaguuuggccaga

SEQ ID NO: 2968395 - RNA, 12 nt, Human
uggaaaggaaug

SEQ ID NO: 2968396 - RNA, 15 nt, Human
uggaaaggaaugcaa

SEQ ID NO: 2968397 - RNA, 21 nt, Human
uggaaaggaaugcaaagauga

SEQ ID NO: 2968398 - RNA, 22 nt, Human
uggaaaggaaugcaaagaugaa

SEQ ID NO: 2968399 - RNA, 12 nt, Human
ugcuuggcccag

SEQ ID NO: 2968400 - RNA, 16 nt, Human
ugcuuggcccaggagu

SEQ ID NO: 2968401 - RNA, 15 nt, Human
ugcuuggcccaggag

SEQ ID NO: 2968402 - RNA, 23 nt, Human
ugcuuggcccaggaguuuggcca

SEQ ID NO: 2968403 - RNA, 18 nt, Human
ugcuuggcccaggaguuu

SEQ ID NO: 2968404 - RNA, 15 nt, Human
ugcuguacauacuuu

SEQ ID NO: 2968405 - RNA, 17 nt, Human
ugcuguacauacuuuuu

SEQ ID NO: 2968406 - RNA, 22 nt, Human
ugcuguacauacuuuuuggguu

SEQ ID NO: 2968407 - RNA, 11 nt, Human
ugcuguacaua

SEQ ID NO: 2968408 - RNA, 18 nt, Human
aggaagcugugagagcag

SEQ ID NO: 2968409 - RNA, 17 nt, Human
aggaagcuuacaugccu

SEQ ID NO: 2968410 - RNA, 20 nt, Human
ugggaaagggauuuucagcc

SEQ ID NO: 2968411 - RNA, 22 nt, Human
uggaguuauugaagcagagugg

SEQ ID NO: 2968412 - RNA, 15 nt, Human
uugaagguagaaugu

SEQ ID NO: 2968413 - RNA, 19 nt, Human
uugaagguagaauguuuuc

SEQ ID NO: 2968414 - RNA, 16 nt, Human
uugaagguagaauguu

SEQ ID NO: 2968415 - RNA, 14 nt, Human
uugaaguaaaaugu

SEQ ID NO: 2968416 - RNA, 16 nt, Human
uugaaggaugcugucu

SEQ ID NO: 2968417 - RNA, 14 nt, Human
uugaaggaugcugu

SEQ ID NO: 2968418 - RNA, 16 nt, Human
auccaauugcugcuug

SEQ ID NO: 2968419 - RNA, 14 nt, Human
aucacuuccaugac

SEQ ID NO: 2968420 - RNA, 14 nt, Human
uucucucaucuguu

SEQ ID NO: 2968421 - RNA, 13 nt, Human
auauuuaaucuuu

SEQ ID NO: 2968422 - RNA, 20 nt, Human
auauugguugggaugacuug

SEQ ID NO: 2968423 - RNA, 19 nt, Human
auauugguugggaugacuu

SEQ ID NO: 2968424 - RNA, 22 nt, Human
uuccuguuuuuauuauuaacaa

SEQ ID NO: 2968425 - RNA, 16 nt, Human
uuccaguaaugagcuu

SEQ ID NO: 2968426 - RNA, 19 nt, Human
uucauucuuuuugaaaugu

SEQ ID NO: 2968427 - RNA, 14 nt, Human
uucauuaguuuuga

SEQ ID NO: 2968428 - RNA, 19 nt, Human
uucauuaguuuugaagauu

SEQ ID NO: 2968429 - RNA, 20 nt, Human
uuuccuucaagaaugcagua

SEQ ID NO: 2968430 - RNA, 18 nt, Human
uuucucacagaagaugaa

SEQ ID NO: 2968431 - RNA, 22 nt, Human
uuucucacagaagaugaagcac

SEQ ID NO: 2968432 - RNA, 15 nt, Human
uuucucauguugaaa

SEQ ID NO: 2968433 - RNA, 13 nt, Human
uuucucauguuga

SEQ ID NO: 2968434 - RNA, 23 nt, Human
uuugaaacacugguuuuaaauau

SEQ ID NO: 2968435 - RNA, 23 nt, Human
augccuaccaauauuuaaucuuu

SEQ ID NO: 2968436 - RNA, 17 nt, Human
augccuaccaauauuua

SEQ ID NO: 2968437 - RNA, 16 nt, Human
augccuaccaauauuu

SEQ ID NO: 2968438 - RNA, 18 nt, Human
uuuauauagcaagacauu

SEQ ID NO: 2968439 - RNA, 22 nt, Human
uuuauauagcaagacauuauau

SEQ ID NO: 2968440 - RNA, 22 nt, Human
uugugaaggcaggggaauguau

SEQ ID NO: 2968441 - RNA, 14 nt, Human
uugugaauaaagag

SEQ ID NO: 2968442 - RNA, 19 nt, Human
uuguugaggguauguuuua

SEQ ID NO: 2968443 - RNA, 22 nt, Human
uuguucccugugucauuucaaa

SEQ ID NO: 2968444 - RNA, 16 nt, Human
uuguuuuuauuaaaag

SEQ ID NO: 2968445 - RNA, 21 nt, Human
uuguaacuguuuagaugaaug

SEQ ID NO: 2968446 - RNA, 22 nt, Human
uuguaacuguuuagaugaaugu

SEQ ID NO: 2968447 - RNA, 23 nt, Human
uuggccugucuuuggauuguuaa

SEQ ID NO: 2968448 - RNA, 13 nt, Human
aucuuuuaugauu

SEQ ID NO: 2968449 - RNA, 23 nt, Human
auuucaaacagucucccuuccua

SEQ ID NO: 2968450 - RNA, 14 nt, Human
auuuauucauuagu

SEQ ID NO: 2968451 - RNA, 14 nt, Human
auuuauuuauucau

SEQ ID NO: 2968452 - RNA, 16 nt, Human
auucuuuuugaaaugu

SEQ ID NO: 2968453 - RNA, 17 nt, Human
auugggcacaucauuuc

SEQ ID NO: 2968454 - RNA, 18 nt, Human
auugggcacaucauuuca

SEQ ID NO: 2968455 - RNA, 19 nt, Human
auugggcacaucauuucaa

SEQ ID NO: 2968456 - RNA, 21 nt, Human
auugggcacaucauuucaaga

SEQ ID NO: 2968457 - RNA, 23 nt, Human
auugggcacaucauuucaagaag

SEQ ID NO: 2968458 - RNA, 12 nt, Human
auuugugagacu

SEQ ID NO: 2968459 - RNA, 14 nt, Human
auuugugagacugu

SEQ ID NO: 2968460 - RNA, 21 nt, Human
auuuguuuugccaauuugcac

SEQ ID NO: 2968461 - RNA, 23 nt, Human
auuuguuuugccaauuugcacau

SEQ ID NO: 2968462 - RNA, 23 nt, Human
auuugaagguagaauguuuucaa

SEQ ID NO: 2968463 - RNA, 18 nt, Human
auuugaagguagaauguu

SEQ ID NO: 2968464 - RNA, 17 nt, Human
auuuuacuuuuuggaaa

SEQ ID NO: 2968465 - RNA, 14 nt, Human
auuuuacuuuuugg

SEQ ID NO: 2968466 - RNA, 16 nt, Human
auuaaacaugcuguac

SEQ ID NO: 2968467 - RNA, 22 nt, Human
auguuaauauuuuagguguaaa

SEQ ID NO: 2968468 - RNA, 13 nt, Human
auguuaauauuuu

SEQ ID NO: 2968469 - RNA, 13 nt, Human
auguuaauauuuc

SEQ ID NO: 2968470 - RNA, 14 nt, Human
auguguucuauuca

SEQ ID NO: 2968471 - RNA, 18 nt, Human
uuuugcauauugcauacu

SEQ ID NO: 2968472 - RNA, 15 nt, Human
uuuugcauauugcau

SEQ ID NO: 2968473 - RNA, 18 nt, Human
uuuugccaauuugcacau

SEQ ID NO: 2968474 - RNA, 19 nt, Human
uuuugccaauuugcacauu

SEQ ID NO: 2968475 - RNA, 16 nt, Human
uuuugccaauuugcac

SEQ ID NO: 2968476 - RNA, 17 nt, Human
auuauauagcaguaaaa

SEQ ID NO: 2968477 - RNA, 18 nt, Human
auucuauguuaauauuuu

SEQ ID NO: 2968478 - RNA, 15 nt, Human
auucuauguuaauau

SEQ ID NO: 2968479 - RNA, 17 nt, Human
auucucagcagagugcu

SEQ ID NO: 2968480 - RNA, 13 nt, Human
aagaaauuugugg

SEQ ID NO: 2968481 - RNA, 21 nt, Human
aaguccccucuccuccacauu

SEQ ID NO: 2968482 - RNA, 20 nt, Human
aaguccccucuccuccacau

SEQ ID NO: 2968483 - RNA, 14 nt, Human
aaugguaguuuuac

SEQ ID NO: 2968484 - RNA, 22 nt, Human
aaugucaguuguuauuuauuga

SEQ ID NO: 2968485 - RNA, 20 nt, Human
aaugucaguuguuauuuauu

SEQ ID NO: 2968486 - RNA, 19 nt, Human
aaugucaguuguuauuuau

SEQ ID NO: 2968487 - RNA, 19 nt, Human
aaucacacugucuucugau

SEQ ID NO: 2968488 - RNA, 15 nt, Human
aacugaacuucagag

SEQ ID NO: 2968489 - RNA, 20 nt, Human
aacucaccuggcaucuuaca

SEQ ID NO: 2968490 - RNA, 19 nt, Human
aacuuauggggccaaaaua

SEQ ID NO: 2968491 - RNA, 23 nt, Human
aacugacacaugcugaacaucac

SEQ ID NO: 2968492 - RNA, 16 nt, Human
aacuuuuuauauucuc

SEQ ID NO: 2968493 - RNA, 19 nt, Human
aacaaaggauacuuauuua

SEQ ID NO: 2968494 - RNA, 15 nt, Human
aacaaaggauacuua

SEQ ID NO: 2968495 - RNA, 18 nt, Human
aaagaugaaggucuguuu

SEQ ID NO: 2968496 - RNA, 13 nt, Human
acacaaagcuuuu

SEQ ID NO: 2968497 - RNA, 18 nt, Human
acacaaagcuuuugcaua

SEQ ID NO: 2968498 - RNA, 18 nt, Human
acacuguccuauuauauu

SEQ ID NO: 2968499 - RNA, 13 nt, Human
acauuaaagguac

SEQ ID NO: 2968500 - RNA, 12 nt, Human
acauuaaaugac

SEQ ID NO: 2968501 - RNA, 11 nt, Human
acauuaaauga

SEQ ID NO: 2968502 - RNA, 15 nt, Human
acauuaaaugacucu

SEQ ID NO: 2968503 - RNA, 14 nt, Human
acuguuuagaugaa

SEQ ID NO: 2968504 - RNA, 18 nt, Human
acuuauuuaaauagauga

SEQ ID NO: 2968505 - RNA, 13 nt, Human
acuuauuuaaaua

SEQ ID NO: 2968506 - RNA, 22 nt, Human
acucuauaacaaaggauacuua

SEQ ID NO: 2968507 - RNA, 16 nt, Human
acucuaccugcacacu

SEQ ID NO: 2968508 - RNA, 16 nt, Human
acgugcacgcacacug

SEQ ID NO: 2968509 - RNA, 13 nt, Human
auacuuauuuaaa

SEQ ID NO: 2968510 - RNA, 23 nt, Human
auauccuaauaaaaaggugacca

SEQ ID NO: 2968511 - RNA, 19 nt, Human
auaucccuuggacauuuua

SEQ ID NO: 2968512 - RNA, 11 nt, Human
auaucacuucc

SEQ ID NO: 2968513 - RNA, 17 nt, Human
auauagcaagacauuau

SEQ ID NO: 2968514 - RNA, 22 nt, Human
auacuuauuuaaauagaugaca

SEQ ID NO: 2968515 - RNA, 15 nt, Human
auacuuauuuaaaua

SEQ ID NO: 2968516 - RNA, 21 nt, Human
auacuuauuuaaauagaugac

SEQ ID NO: 2968517 - RNA, 22 nt, Human
auauaauuccuguuuuuauuau

SEQ ID NO: 2968518 - RNA, 16 nt, Human
auauaauuccuguuuu

SEQ ID NO: 2968519 - RNA, 12 nt, Human
agucauuauguu

SEQ ID NO: 2968520 - RNA, 18 nt, Human
agucauuauguuaauauu

SEQ ID NO: 2968521 - RNA, 13 nt, Human
agucauucuuuaa

SEQ ID NO: 2968522 - RNA, 14 nt, Human
agucauucuucccu

SEQ ID NO: 2968523 - RNA, 16 nt, Human
agucaaggcuuagacc

SEQ ID NO: 2968524 - RNA, 14 nt, Human
agucaaggcuuaga

SEQ ID NO: 2968525 - RNA, 23 nt, Human
aucuucuauauaauuccuguuuu

SEQ ID NO: 2968526 - RNA, 18 nt, Human
augacuauucaguggcua

SEQ ID NO: 2968527 - RNA, 18 nt, Human
augacucuucccucaaau

SEQ ID NO: 2968528 - RNA, 17 nt, Human
auuaaaugacucuuccc

SEQ ID NO: 2968529 - RNA, 14 nt, Human
auuaaaugacucuu

SEQ ID NO: 2968530 - RNA, 21 nt, Human
auuaaaugacucuucccucaa

SEQ ID NO: 2968531 - RNA, 23 nt, Human
augcuugcugcugauuuaaacac

SEQ ID NO: 2968532 - RNA, 16 nt, Human
augcuugcugcugauu

SEQ ID NO: 2968533 - RNA, 22 nt, Human
augcuugcugcugauuuaaaca

SEQ ID NO: 2968534 - RNA, 17 nt, Human
agguacacuugugaaua

SEQ ID NO: 2968535 - RNA, 16 nt, Human
agguacacuugugaau

SEQ ID NO: 2968536 - RNA, 14 nt, Human
agguacacuuguga

SEQ ID NO: 2968537 - RNA, 18 nt, Human
agagguacacuugugaau

SEQ ID NO: 2968538 - RNA, 17 nt, Human
agagguacacuugugaa

SEQ ID NO: 2968539 - RNA, 16 nt, Human
agagguacacuuguga

SEQ ID NO: 2968540 - RNA, 12 nt, Human
agcaugaagaca

SEQ ID NO: 2968541 - RNA, 20 nt, Human
agcagcccucaauugugaaa

SEQ ID NO: 2968542 - RNA, 20 nt, Human
agauguagacaguuggguuu

SEQ ID NO: 2968543 - RNA, 19 nt, Human
agccccacccucagaugca

SEQ ID NO: 2968544 - RNA, 13 nt, Human
aaaaauuuacuuu

SEQ ID NO: 2968545 - RNA, 18 nt, Human
aaaaauuuacuuuaaacu

SEQ ID NO: 2968546 - RNA, 19 nt, Human
aaaaauuuacuuuaaacua

SEQ ID NO: 2968547 - RNA, 16 nt, Human
cacuguccuauuauau

SEQ ID NO: 2968548 - RNA, 12 nt, Human
cacugguuuuaa

SEQ ID NO: 2968549 - RNA, 13 nt, Human
cacugguuuuaaa

SEQ ID NO: 2968550 - RNA, 15 nt, Human
cacugguuuuaaaua

SEQ ID NO: 2968551 - RNA, 16 nt, Human
cacugguuuuaaauau

SEQ ID NO: 2968552 - RNA, 18 nt, Human
cacugguuuguucccugu

SEQ ID NO: 2968553 - RNA, 20 nt, Human
cacuucacgcccuuggccau

SEQ ID NO: 2968554 - RNA, 21 nt, Human
cacuucacgcccuuggccaug

SEQ ID NO: 2968555 - RNA, 17 nt, Human
cacuucacgcccuuggc

SEQ ID NO: 2968556 - RNA, 19 nt, Human
cacuucacgcccuuggcca

SEQ ID NO: 2968557 - RNA, 13 nt, Human
cacucuauaacaa

SEQ ID NO: 2968558 - RNA, 15 nt, Human
cacgcacacugucug

SEQ ID NO: 2968559 - RNA, 20 nt, Human
cacccucagaugcacaugag

SEQ ID NO: 2968560 - RNA, 21 nt, Human
cagaaucgcuccaccuugcag

SEQ ID NO: 2968561 - RNA, 23 nt, Human
cagaaucgcuccaccuugcagcu

SEQ ID NO: 2968562 - RNA, 17 nt, Human
cagaagucaaggcuuag

SEQ ID NO: 2968563 - RNA, 16 nt, Human
cagaagucaaggcuua

SEQ ID NO: 2968564 - RNA, 18 nt, Human
cagaagucaaggcuuaga

SEQ ID NO: 2968565 - RNA, 17 nt, Human
cagaacuauguuuuugu

SEQ ID NO: 2968566 - RNA, 17 nt, Human
cagaugcacaugagcug

SEQ ID NO: 2968567 - RNA, 12 nt, Human
cagaguggcagu

SEQ ID NO: 2968568 - RNA, 21 nt, Human
cagagugcuuuaccaauugaa

SEQ ID NO: 2968569 - RNA, 21 nt, Human
cagagaagauucuuguauuua

SEQ ID NO: 2968570 - RNA, 20 nt, Human
cagagccccacccucagaug

SEQ ID NO: 2968571 - RNA, 14 nt, Human
caggaagcugugag

SEQ ID NO: 2968572 - RNA, 13 nt, Human
caggaagcuguga

SEQ ID NO: 2968573 - RNA, 22 nt, Human
caggaagcugugagagcaguuu

SEQ ID NO: 2968574 - RNA, 16 nt, Human
cagcucuccccuucuc

SEQ ID NO: 2968575 - RNA, 18 nt, Human
cagcccucaauugugaaa

SEQ ID NO: 2968576 - RNA, 13 nt, Human
cagcccucagaau

SEQ ID NO: 2968577 - RNA, 23 nt, Human
cagcaacacaaagcuuuugcaua

SEQ ID NO: 2968578 - RNA, 15 nt, Human
cagcaacacaaagcu

SEQ ID NO: 2968579 - RNA, 11 nt, Human
cagcagagugc

SEQ ID NO: 2968580 - RNA, 15 nt, Human
cagcagagugcuuua

SEQ ID NO: 2968581 - RNA, 9 nt, Human
cagcagagu

SEQ ID NO: 2968582 - RNA, 10 nt, Human
cagcagagug

SEQ ID NO: 2968583 - RNA, 19 nt, Human
cagcacaaggaaauaaaau

SEQ ID NO: 2968584 - RNA, 16 nt, Human
caggcuggaguuauug

SEQ ID NO: 2968585 - RNA, 13 nt, Human
caggcuggaguua

SEQ ID NO: 2968586 - RNA, 14 nt, Human
caggaguuuggcca

SEQ ID NO: 2968587 - RNA, 13 nt, Human
caggaguuuggcc

SEQ ID NO: 2968588 - RNA, 17 nt, Human
caggaguuuggccagaa

SEQ ID NO: 2968589 - RNA, 16 nt, Human
caggaguuuggccaga

SEQ ID NO: 2968590 - RNA, 15 nt, Human
caggaguuuggccag

SEQ ID NO: 2968591 - RNA, 19 nt, Human
cagucauuauguuaauauu

SEQ ID NO: 2968592 - RNA, 23 nt, Human
cagucagggaaggugccucugga

SEQ ID NO: 2968593 - RNA, 13 nt, Human
caguaacauagcu

SEQ ID NO: 2968594 - RNA, 21 nt, Human
caguaaugagcuuaagaaauu

SEQ ID NO: 2968595 - RNA, 18 nt, Human
caguacuaacauuuauuu

SEQ ID NO: 2968596 - RNA, 16 nt, Human
cauucuuggcccagga

SEQ ID NO: 2968597 - RNA, 13 nt, Human
cauucuuggccca

SEQ ID NO: 2968598 - RNA, 13 nt, Human
cauucuuuuugaa

SEQ ID NO: 2968599 - RNA, 16 nt, Human
cauucuuuuugaaaug

SEQ ID NO: 2968600 - RNA, 14 nt, Human
cauucuuuuugaaa

SEQ ID NO: 2968601 - RNA, 16 nt, Human
caugcuguacauacuu

SEQ ID NO: 2968602 - RNA, 19 nt, Human
caugcuguacauacuuuuu

SEQ ID NO: 2968603 - RNA, 21 nt, Human
caugcuguacauacuuuuugg

SEQ ID NO: 2968604 - RNA, 13 nt, Human
caugcuguacaua

SEQ ID NO: 2968605 - RNA, 11 nt, Human
caucaucccuu

SEQ ID NO: 2968606 - RNA, 17 nt, Human
caucccuuucccuuggu

SEQ ID NO: 2968607 - RNA, 14 nt, Human
caucccuuucccuu

SEQ ID NO: 2968608 - RNA, 17 nt, Human
cauauuuaauuugaagg

SEQ ID NO: 2968609 - RNA, 22 nt, Human
cauauugcauacuauuaaacau

SEQ ID NO: 2968610 - RNA, 19 nt, Human
cauauugcauacuauuaaa

SEQ ID NO: 2968611 - RNA, 21 nt, Human
cauauugcauacuauuaaaca

SEQ ID NO: 2968612 - RNA, 19 nt, Human
ccaguguuuuaggagcaug

SEQ ID NO: 2968613 - RNA, 23 nt, Human
ccuucuucccaauagcaaggcug

SEQ ID NO: 2968614 - RNA, 13 nt, Human
ccuuguuuaaugg

SEQ ID NO: 2968615 - RNA, 14 nt, Human
ccuguuuuuauuau

SEQ ID NO: 2968616 - RNA, 15 nt, Human
ccuguuuuuauuauu

SEQ ID NO: 2968617 - RNA, 15 nt, Human
ccuccacauuuguuu

SEQ ID NO: 2968618 - RNA, 12 nt, Human
cccuaaucuucc

SEQ ID NO: 2968619 - RNA, 16 nt, Human
cuuccacuugaguguc

SEQ ID NO: 2968620 - RNA, 14 nt, Human
cuucaagaaugcag

SEQ ID NO: 2968621 - RNA, 18 nt, Human
cuguuuuuauuauuaaca

SEQ ID NO: 2968622 - RNA, 20 nt, Human
cuguuuuuauuauuaacaaa

SEQ ID NO: 2968623 - RNA, 16 nt, Human
cuuaauuauugauguu

SEQ ID NO: 2968624 - RNA, 10 nt, Human
cuuaauuauu

SEQ ID NO: 2968625 - RNA, 22 nt, Human
cuuagacccucaugcugccaau

SEQ ID NO: 2968626 - RNA, 21 nt, Human
cuuagacccucaugcugccaa

SEQ ID NO: 2968627 - RNA, 20 nt, Human
cuuagacccucaugcugcca

SEQ ID NO: 2968628 - RNA, 19 nt, Human
cuuagacccucaugcugcc

SEQ ID NO: 2968629 - RNA, 23 nt, Human
cuuagacccucaugcugccaaua

SEQ ID NO: 2968630 - RNA, 15 nt, Human
cuguguuguacagcu

SEQ ID NO: 2968631 - RNA, 22 nt, Human
cugugauuuuugguauuugaaa

SEQ ID NO: 2968632 - RNA, 14 nt, Human
cugucuuuuaaacu

SEQ ID NO: 2968633 - RNA, 15 nt, Human
cugucuuuuaaacuc

SEQ ID NO: 2968634 - RNA, 23 nt, Human
cugggguggguggggcagugcuu

SEQ ID NO: 2968635 - RNA, 14 nt, Human
gaagaaaauaauua

SEQ ID NO: 2968636 - RNA, 15 nt, Human
gaagguagaauguuu

SEQ ID NO: 2968637 - RNA, 17 nt, Human
gaagguagaauguuuuc

SEQ ID NO: 2968638 - RNA, 16 nt, Human
gaagguagaauguuuu

SEQ ID NO: 2968639 - RNA, 20 nt, Human
gaagguagaauguuuucaaa

SEQ ID NO: 2968640 - RNA, 17 nt, Human
gaaguaaaauguggcag

SEQ ID NO: 2968641 - RNA, 18 nt, Human
gaaguaaaauguggcagg

SEQ ID NO: 2968642 - RNA, 22 nt, Human
gaaacacugguuuuaaauauuu

SEQ ID NO: 2968643 - RNA, 13 nt, Human
gaaacacugguuu

SEQ ID NO: 2968644 - RNA, 19 nt, Human
cuuuaaacuacauuagguu

SEQ ID NO: 2968645 - RNA, 16 nt, Human
cuuguuuaaugguagu

SEQ ID NO: 2968646 - RNA, 17 nt, Human
cucauguugaaacuuua

SEQ ID NO: 2968647 - RNA, 14 nt, Human
cucauuucuagcag

SEQ ID NO: 2968648 - RNA, 15 nt, Human
cuccacauuuguuuu

SEQ ID NO: 2968649 - RNA, 13 nt, Human
cuccacauuuguu

SEQ ID NO: 2968650 - RNA, 17 nt, Human
cuccaccuugcagcucu

SEQ ID NO: 2968651 - RNA, 22 nt, Human
cuaugggguaaaagggguaggg

SEQ ID NO: 2968652 - RNA, 22 nt, Human
cuaugcuguucacuggacacuu

SEQ ID NO: 2968653 - RNA, 15 nt, Human
cucaagucuggcaga

SEQ ID NO: 2968654 - RNA, 16 nt, Human
cucagcagagugcuuu

SEQ ID NO: 2968655 - RNA, 11 nt, Human
cucagcagagu

SEQ ID NO: 2968656 - RNA, 12 nt, Human
cucagcagagug

SEQ ID NO: 2968657 - RNA, 13 nt, Human
cucagcagagugc

SEQ ID NO: 2968658 - RNA, 22 nt, Human
cugauuuaaacacauuaaaggu

SEQ ID NO: 2968659 - RNA, 17 nt, Human
cugaacaucacagcuua

SEQ ID NO: 2968660 - RNA, 23 nt, Human
cugacgacuugagugcucaguag

SEQ ID NO: 2968661 - RNA, 15 nt, Human
gaugacuguuuuuaa

SEQ ID NO: 2968662 - RNA, 17 nt, Human
gauucuauguuaauauu

SEQ ID NO: 2968663 - RNA, 20 nt, Human
gauucuauguuaauauuuua

SEQ ID NO: 2968664 - RNA, 18 nt, Human
gauugugccuaauguguu

SEQ ID NO: 2968665 - RNA, 17 nt, Human
gaguuauugaagcagag

SEQ ID NO: 2968666 - RNA, 23 nt, Human
gccaauauccuaauaaaaaggug

SEQ ID NO: 2968667 - RNA, 22 nt, Human
gccaauauccuaauaaaaaggu

SEQ ID NO: 2968668 - RNA, 20 nt, Human
gccaauauccuaauaaaaag

SEQ ID NO: 2968669 - RNA, 19 nt, Human
gccaauauccuaauaaaaa

SEQ ID NO: 2968670 - RNA, 18 nt, Human
gccaauauccuaauaaaa

SEQ ID NO: 2968671 - RNA, 13 nt, Human
gccaauauccuaa

SEQ ID NO: 2968672 - RNA, 17 nt, Human
gccaauauccuaauaaa

SEQ ID NO: 2968673 - RNA, 16 nt, Human
gccaauauccuaauaa

SEQ ID NO: 2968674 - RNA, 15 nt, Human
gccaauauccuaaua

SEQ ID NO: 2968675 - RNA, 14 nt, Human
gccaauauccuaau

SEQ ID NO: 2968676 - RNA, 12 nt, Human
gccaauuugcac

SEQ ID NO: 2968677 - RNA, 22 nt, Human
gcauacugccuuguuuaauggu

SEQ ID NO: 2968678 - RNA, 13 nt, Human
gcauacuauuaaa

SEQ ID NO: 2968679 - RNA, 14 nt, Human
gcauacuauuaaac

SEQ ID NO: 2968680 - RNA, 17 nt, Human
gcauacuauuaaacaug

SEQ ID NO: 2968681 - RNA, 21 nt, Human
gcauacuauuaaacaugcugu

SEQ ID NO: 2968682 - RNA, 16 nt, Human
gcacgcacacugucug

SEQ ID NO: 2968683 - RNA, 15 nt, Human
gcacgcacacugucu

SEQ ID NO: 2968684 - RNA, 16 nt, Human
gcaggaagcugugaga

SEQ ID NO: 2968685 - RNA, 22 nt, Human
gcagaguaggggucugucuuuu

SEQ ID NO: 2968686 - RNA, 21 nt, Human
gcuuagacccucaugcugcca

SEQ ID NO: 2968687 - RNA, 16 nt, Human
gcuuagacccucaugc

SEQ ID NO: 2968688 - RNA, 22 nt, Human
gcuuacaugccuaccaauauuu

SEQ ID NO: 2968689 - RNA, 19 nt, Human
gcugauuuaaacacauuaa

SEQ ID NO: 2968690 - RNA, 14 nt, Human
gcugaccuugcuga

SEQ ID NO: 2968691 - RNA, 15 nt, Human
gccuuguuuaauggu

SEQ ID NO: 2968692 - RNA, 23 nt, Human
gccuuguuuaaugguaguuuuac

SEQ ID NO: 2968693 - RNA, 18 nt, Human
ggagcccugucuccucuc

SEQ ID NO: 2968694 - RNA, 20 nt, Human
ggagaagucuucuauuuauu

SEQ ID NO: 2968695 - RNA, 19 nt, Human
ggagaagucuucuauuuau

SEQ ID NO: 2968696 - RNA, 15 nt, Human
ggacauuuuaugucu

SEQ ID NO: 2968697 - RNA, 16 nt, Human
ggcagugcuuggccca

SEQ ID NO: 2968698 - RNA, 23 nt, Human
ggcagugcuuggcccaggaguuu

SEQ ID NO: 2968699 - RNA, 22 nt, Human
ggcagugcuuggcccaggaguu

SEQ ID NO: 2968700 - RNA, 21 nt, Human
ggcagugcuuggcccaggagu

SEQ ID NO: 2968701 - RNA, 20 nt, Human
ggcagugcuuggcccaggag

SEQ ID NO: 2968702 - RNA, 19 nt, Human
ggcagugcuuggcccagga

SEQ ID NO: 2968703 - RNA, 18 nt, Human
ggcagugcuuggcccagg

SEQ ID NO: 2968704 - RNA, 17 nt, Human
ggcagugcuuggcccag

SEQ ID NO: 2968705 - RNA, 19 nt, Human
ggauugaaggaugcugucu

SEQ ID NO: 2968706 - RNA, 23 nt, Human
ggcuggaguuauugaagcagagu

SEQ ID NO: 2968707 - RNA, 15 nt, Human
ggcuggaguuauuga

SEQ ID NO: 2968708 - RNA, 18 nt, Human
ggcuuagacccucaugcu

SEQ ID NO: 2968709 - RNA, 20 nt, Human
ggcuuagacccucaugcugc

SEQ ID NO: 2968710 - RNA, 23 nt, Human
ggcuuagacccucaugcugccaa

SEQ ID NO: 2968711 - RNA, 22 nt, Human
ggcuuagacccucaugcugcca

SEQ ID NO: 2968712 - RNA, 17 nt, Human
ucacugguacucugcca

SEQ ID NO: 2968713 - RNA, 20 nt, Human
ucaugcugccaauauccuaa

SEQ ID NO: 2968714 - RNA, 19 nt, Human
ucaugcugccaauauccua

SEQ ID NO: 2968715 - RNA, 17 nt, Human
ucaugcugccaauaucc

SEQ ID NO: 2968716 - RNA, 13 nt, Human
ucaugcugccaau

SEQ ID NO: 2968717 - RNA, 17 nt, Human
ucauuauguuaauauuu

SEQ ID NO: 2968718 - RNA, 16 nt, Human
ucauuauguuaauauu

SEQ ID NO: 2968719 - RNA, 23 nt, Human
ucaugcugccaauauccuaauaa

SEQ ID NO: 2968720 - RNA, 21 nt, Human
ucaugcugccaauauccuaau

SEQ ID NO: 2968721 - RNA, 23 nt, Human
ucauuaguuuugaagauucuaug

SEQ ID NO: 2968722 - RNA, 14 nt, Human
ucauuaguuuugaa

SEQ ID NO: 2968723 - RNA, 13 nt, Human
uauuaacaaaaca

SEQ ID NO: 2968724 - RNA, 14 nt, Human
uauugauguuuuca

SEQ ID NO: 2968725 - RNA, 13 nt, Human
uauugauguuuuc

SEQ ID NO: 2968726 - RNA, 17 nt, Human
uauucucagcagagugc

SEQ ID NO: 2968727 - RNA, 21 nt, Human
uauucucagcagagugcuuua

SEQ ID NO: 2968728 - RNA, 15 nt, Human
uauucucagcagagu

SEQ ID NO: 2968729 - RNA, 17 nt, Human
uauuuucuccaaauguu

SEQ ID NO: 2968730 - RNA, 19 nt, Human
uccugucggagcccugucu

SEQ ID NO: 2968731 - RNA, 22 nt, Human
ucuaaauaucccuuggacauuu

SEQ ID NO: 2968732 - RNA, 12 nt, Human
uccuauuauauu

SEQ ID NO: 2968733 - RNA, 15 nt, Human
uccuaauaaaaaggu

SEQ ID NO: 2968734 - RNA, 14 nt, Human
uccuaauaaaaagg

SEQ ID NO: 2968735 - RNA, 13 nt, Human
uccuaauaaaaag

SEQ ID NO: 2968736 - RNA, 12 nt, Human
uccuaauaaaaa

SEQ ID NO: 2968737 - RNA, 17 nt, Human
uccuaauaaaaagguga

SEQ ID NO: 2968738 - RNA, 16 nt, Human
uccuaauaaaaaggug

SEQ ID NO: 2968739 - RNA, 18 nt, Human
uccuaauaaaaaggugac

SEQ ID NO: 2968740 - RNA, 18 nt, Human
ucucuguaauaaacucau

SEQ ID NO: 2968741 - RNA, 22 nt, Human
ucucuguaauaaacucauuucu

SEQ ID NO: 2968742 - RNA, 13 nt, Human
ucuguuuugugua

SEQ ID NO: 2968743 - RNA, 19 nt, Human
ucuguuuuguguacuuuua

SEQ ID NO: 2968744 - RNA, 15 nt, Human
uguccuauuauauuc

SEQ ID NO: 2968745 - RNA, 14 nt, Human
ugucuuuuaaacuc

SEQ ID NO: 2968746 - RNA, 14 nt, Human
uggaaaagaauaaa

SEQ ID NO: 2968747 - RNA, 19 nt, Human
uggauugugccuaaugugu

SEQ ID NO: 2968748 - RNA, 23 nt, Human
uggauugugccuaauguguuuga

SEQ ID NO: 2968749 - RNA, 20 nt, Human
uggauugugccuaauguguu

SEQ ID NO: 2968750 - RNA, 13 nt, Human
uggacauuuuaug

SEQ ID NO: 2968751 - RNA, 11 nt, Human
uggacauuuua

SEQ ID NO: 2968752 - RNA, 17 nt, Human
uggacauuuuaugucuu

SEQ ID NO: 2968753 - RNA, 16 nt, Human
uggacauuuuaugucu

SEQ ID NO: 2968754 - RNA, 16 nt, Human
ugauguaauuaugguu

SEQ ID NO: 2968755 - RNA, 22 nt, Human
ugcagaguaggggucugucuuu

SEQ ID NO: 2968756 - RNA, 16 nt, Human
ugcacgcacacugucu

SEQ ID NO: 2968757 - RNA, 17 nt, Human
ugcacgcacacugucug

SEQ ID NO: 2968758 - RNA, 13 nt, Human
uuuuaucuucuau

SEQ ID NO: 2968759 - RNA, 15 nt, Human
uuuucaaauguucuc

SEQ ID NO: 2968760 - RNA, 13 nt, Human
uuuugaaauguca

SEQ ID NO: 2968761 - RNA, 22 nt, Human
uuugaguggaguuacugaacag

SEQ ID NO: 2968762 - RNA, 15 nt, Human
uuugcaggaaauccu

SEQ ID NO: 2968763 - RNA, 19 nt, Human
uuuggaaaggaaugcaaag

SEQ ID NO: 2968764 - RNA, 16 nt, Human
uuuggaaaggaaugca

SEQ ID NO: 2968765 - RNA, 17 nt, Human
uuuggaaaggaaugcaa

SEQ ID NO: 2968766 - RNA, 18 nt, Human
uuuggaaaggaaugcaaa

SEQ ID NO: 2968767 - RNA, 13 nt, Human
uuugguauuugaa

SEQ ID NO: 2968768 - RNA, 21 nt, Human
uuuugaagauucuauguuaau

SEQ ID NO: 2968769 - RNA, 16 nt, Human
uuuaagacccucucaa

SEQ ID NO: 2968770 - RNA, 17 nt, Human
uuuaagaacuaaaaugu

SEQ ID NO: 2968771 - RNA, 14 nt, Human
uuuacuuuaaacua

SEQ ID NO: 2968772 - RNA, 16 nt, Human
uuuauaacuuuuuaua

SEQ ID NO: 2968773 - RNA, 13 nt, Human
uuuauaacuuuuu

SEQ ID NO: 2968774 - RNA, 18 nt, Human
uugugccuaauguguuug

SEQ ID NO: 2968775 - RNA, 15 nt, Human
uugugccuaaugugu

SEQ ID NO: 2968776 - RNA, 15 nt, Human
uugguauuugaaaca

SEQ ID NO: 2968777 - RNA, 20 nt, Human
uugugaaaaaauuuacuuua

SEQ ID NO: 2968778 - RNA, 16 nt, Human
uuauuaacaaaacagu

SEQ ID NO: 2968779 - RNA, 21 nt, Human
uuaugauugccuuuuuauaac

SEQ ID NO: 2968780 - RNA, 15 nt, Human
uuaugauugccuuuu

SEQ ID NO: 2968781 - RNA, 16 nt, Human
uuauauucucagcaga

SEQ ID NO: 2968782 - RNA, 18 nt, Human
uuauauucucagcagagu

SEQ ID NO: 2968783 - RNA, 19 nt, Human
uuauauucucagcagagug

SEQ ID NO: 2968784 - RNA, 20 nt, Human
uuauauucucagcagagugc

SEQ ID NO: 2968785 - RNA, 21 nt, Human
uuauauucucagcagagugcu

SEQ ID NO: 2968786 - RNA, 17 nt, Human
uuauaacuuuuuauauu

SEQ ID NO: 2968787 - RNA, 14 nt, Human
uuagugauguaauu

SEQ ID NO: 2968788 - RNA, 12 nt, Human
uucaauaacugg

SEQ ID NO: 2968789 - RNA, 16 nt, Human
uucaauaacuggaaca

SEQ ID NO: 2968790 - RNA, 22 nt, Human
uucaauaacuggaacacucuau

SEQ ID NO: 2968791 - RNA, 20 nt, Human
uuauuuggaaaggaaugcaa

SEQ ID NO: 2968792 - RNA, 22 nt, Human
uuauuugaguggaguuacugaa

SEQ ID NO: 2968793 - RNA, 16 nt, Human
uuauuuggaaaggaau

SEQ ID NO: 2968794 - RNA, 14 nt, Human
uucacgcccuuggc

SEQ ID NO: 2968795 - RNA, 21 nt, Human
uucuauauaauuccuguuuuu

SEQ ID NO: 2968796 - RNA, 22 nt, Human
uucucauguugaaacuuuaaga

SEQ ID NO: 2968797 - RNA, 21 nt, Human
uugacuauuuuuguuuuuauu

SEQ ID NO: 2968798 - RNA, 19 nt, Human
uugacuauuuuuguuuuua

SEQ ID NO: 2968799 - RNA, 16 nt, Human
uugauugggcacauca

SEQ ID NO: 2968800 - RNA, 17 nt, Human
uugauugggcacaucau

SEQ ID NO: 2968801 - RNA, 22 nt, Human
uugauugggcacaucauuucaa

SEQ ID NO: 2968802 - RNA, 15 nt, Human
uucuggacuaaaacu

SEQ ID NO: 2968803 - RNA, 20 nt, Human
uucuucccaauagcaaggcu

SEQ ID NO: 2968804 - RNA, 21 nt, Human
caaaggauacuuauuuaaaua

SEQ ID NO: 2968805 - RNA, 16 nt, Human
caaaggauacuuauuu

SEQ ID NO: 2968806 - RNA, 17 nt, Human
caaagcuuuugcauauu

SEQ ID NO: 2968807 - RNA, 23 nt, Human
caacaugccagccacugugauag

SEQ ID NO: 2968808 - RNA, 22 nt, Human
caacauuucucauguugaaacu

SEQ ID NO: 2968809 - RNA, 17 nt, Human
cacauuaaagguacuuu

SEQ ID NO: 2968810 - RNA, 13 nt, Human
cacauuaaaugac

SEQ ID NO: 2968811 - RNA, 15 nt, Human
cacauuaaaugacuc

SEQ ID NO: 2968812 - RNA, 23 nt, Human
cacaaagaaccaccaggaaagca

SEQ ID NO: 2968813 - RNA, 15 nt, Human
cacaaagcagauccu

SEQ ID NO: 2968814 - RNA, 20 nt, Human
acuauuuuuguuuuuauuaa

SEQ ID NO: 2968815 - RNA, 19 nt, Human
acuauucugagaugacuau

SEQ ID NO: 2968816 - RNA, 18 nt, Human
acuauucugagaugacua

SEQ ID NO: 2968817 - RNA, 21 nt, Human
acuauuuuuguuuuuauuaaa

SEQ ID NO: 2968818 - RNA, 22 nt, Human
acuauuuuuguuuuuauuaaaa

SEQ ID NO: 2968819 - RNA, 17 nt, Human
acugguuuguucccugu

SEQ ID NO: 2968820 - RNA, 14 nt, Human
acugguuuuaaaua

SEQ ID NO: 2968821 - RNA, 16 nt, Human
acuucacgcccuuggc

SEQ ID NO: 2968822 - RNA, 12 nt, Human
acuuuuaagacu

SEQ ID NO: 2968823 - RNA, 13 nt, Human
acuuuuaagacuu

SEQ ID NO: 2968824 - RNA, 16 nt, Human
acuuuauuucucucau

SEQ ID NO: 2968825 - RNA, 19 nt, Human
acccaguguuuuaggagca

SEQ ID NO: 2968826 - RNA, 22 nt, Human
acccaguguuuuaggagcauga

SEQ ID NO: 2968827 - RNA, 15 nt, Human
aaacucugagugcaa

SEQ ID NO: 2968828 - RNA, 13 nt, Human
aaacucugagugc

SEQ ID NO: 2968829 - RNA, 19 nt, Human
aaacacugguuuuaaauau

SEQ ID NO: 2968830 - RNA, 20 nt, Human
aacacauuaaagguacuuug

SEQ ID NO: 2968831 - RNA, 15 nt, Human
aacacauuaaaggua

SEQ ID NO: 2968832 - RNA, 22 nt, Human
aacagcaacacaaagcuuuugc

SEQ ID NO: 2968833 - RNA, 12 nt, Human
aaggugcaucug

SEQ ID NO: 2968834 - RNA, 11 nt, Human
aagauucuaug

SEQ ID NO: 2968835 - RNA, 15 nt, Human
agcaugaagacagag

SEQ ID NO: 2968836 - RNA, 17 nt, Human
agcccucaauugugaaa

SEQ ID NO: 2968837 - RNA, 16 nt, Human
agcccucaauugugaa

SEQ ID NO: 2968838 - RNA, 22 nt, Human
agacgugcacgcacacugucug

SEQ ID NO: 2968839 - RNA, 21 nt, Human
agacgugcacgcacacugucu

SEQ ID NO: 2968840 - RNA, 12 nt, Human
agcuuuugcaua

SEQ ID NO: 2968841 - RNA, 22 nt, Human
aggagaagucuucuauuuauuu

SEQ ID NO: 2968842 - RNA, 23 nt, Human
aggagaagucuucuauuuauuua

SEQ ID NO: 2968843 - RNA, 22 nt, Human
aggucuguuuuguguacuuuua

SEQ ID NO: 2968844 - RNA, 20 nt, Human
auaucccuuggacauuuuau

SEQ ID NO: 2968845 - RNA, 14 nt, Human
auauccuaauaaaa

SEQ ID NO: 2968846 - RNA, 13 nt, Human
auauccuaauaaa

SEQ ID NO: 2968847 - RNA, 12 nt, Human
auauccuaauaa

SEQ ID NO: 2968848 - RNA, 23 nt, Human
auaucccuuggacauuuuauguc

SEQ ID NO: 2968849 - RNA, 22 nt, Human
auaucccuuggacauuuuaugu

SEQ ID NO: 2968850 - RNA, 20 nt, Human
auauccuaauaaaaagguga

SEQ ID NO: 2968851 - RNA, 18 nt, Human
auauccuaauaaaaaggu

SEQ ID NO: 2968852 - RNA, 16 nt, Human
auauccuaauaaaaag

SEQ ID NO: 2968853 - RNA, 21 nt, Human
auagcaguaaaaaaugguguu

SEQ ID NO: 2968854 - RNA, 15 nt, Human
auagcaguaaaaaau

SEQ ID NO: 2968855 - RNA, 15 nt, Human
auaaugucccuucac

SEQ ID NO: 2968856 - RNA, 21 nt, Human
auaacaaaggauacuuauuua

SEQ ID NO: 2968857 - RNA, 20 nt, Human
auaacaaaggauacuuauuu

SEQ ID NO: 2968858 - RNA, 18 nt, Human
auguuuucaaauguucuc

SEQ ID NO: 2968859 - RNA, 17 nt, Human
auguuuuauauagcaag

SEQ ID NO: 2968860 - RNA, 15 nt, Human
auguuuucaaauguu

SEQ ID NO: 2968861 - RNA, 12 nt, Human
auguuuucaaau

SEQ ID NO: 2968862 - RNA, 20 nt, Human
auguucuccagucauuaugu

SEQ ID NO: 2968863 - RNA, 23 nt, Human
augcugccaauauccuaauaaaa

SEQ ID NO: 2968864 - RNA, 22 nt, Human
augcugccaauauccuaauaaa

SEQ ID NO: 2968865 - RNA, 21 nt, Human
augcugccaauauccuaauaa

SEQ ID NO: 2968866 - RNA, 20 nt, Human
augcugccaauauccuaaua

SEQ ID NO: 2968867 - RNA, 13 nt, Human
augcugccaauau

SEQ ID NO: 2968868 - RNA, 19 nt, Human
augcugccaauauccuaau

SEQ ID NO: 2968869 - RNA, 18 nt, Human
augcugccaauauccuaa

SEQ ID NO: 2968870 - RNA, 17 nt, Human
augcugccaauauccua

SEQ ID NO: 2968871 - RNA, 14 nt, Human
augcugccaauauc

SEQ ID NO: 2968872 - RNA, 16 nt, Human
uaaaugacucuucccu

SEQ ID NO: 2968873 - RNA, 13 nt, Human
aaguuuugagaaa

SEQ ID NO: 2968874 - RNA, 22 nt, Human
uaaacuacauuagguugugaau

SEQ ID NO: 2968875 - RNA, 17 nt, Human
uaaacucauuucuagca

SEQ ID NO: 2968876 - RNA, 12 nt, Human
uaaacucauuuc

SEQ ID NO: 2968877 - RNA, 20 nt, Human
uaaacucugagugcaaacuu

SEQ ID NO: 2968878 - RNA, 20 nt, Human
guucuccagucauuauguua

SEQ ID NO: 2968879 - RNA, 18 nt, Human
guucuccagucauuaugu

SEQ ID NO: 2968880 - RNA, 23 nt, Human
guugcuaacagcaacacaaagcu

SEQ ID NO: 2968881 - RNA, 23 nt, Human
guuuuuuaagggcccuuuuucaa

SEQ ID NO: 2968882 - RNA, 22 nt, Human
aagucaaggcuuagacccucau

SEQ ID NO: 2968883 - RNA, 13 nt, Human
aagucaaggcuua

SEQ ID NO: 2968884 - RNA, 21 nt, Human
guuucuagcaugaagacagag

SEQ ID NO: 2968885 - RNA, 22 nt, Human
aagggcccuuuuucaauaacug

SEQ ID NO: 2968886 - RNA, 16 nt, Human
aagggcccuuuuucaa

SEQ ID NO: 2968887 - RNA, 11 nt, Human
guuuggccaga

SEQ ID NO: 2968888 - RNA, 23 nt, Human
guuuggccagaagucaaggcuua

SEQ ID NO: 2968889 - RNA, 18 nt, Human
guuuggccagaagucaag

SEQ ID NO: 2968890 - RNA, 12 nt, Human
guuuggccagaa

SEQ ID NO: 2968891 - RNA, 23 nt, Human
guguguggucaacauuucucaug

SEQ ID NO: 2968892 - RNA, 22 nt, Human
aacuaacaggcuuagugaugua

SEQ ID NO: 2968893 - RNA, 18 nt, Human
aacuaacaggcuuaguga

SEQ ID NO: 2968894 - RNA, 13 nt, Human
aacucuguaauuc

SEQ ID NO: 2968895 - RNA, 19 nt, Human
aaucuuuuaugauugccuu

SEQ ID NO: 2968896 - RNA, 20 nt, Human
uaauuugaagguagaauguu

SEQ ID NO: 2968897 - RNA, 21 nt, Human
aaugcaaagaugaaggucugu

SEQ ID NO: 2968898 - RNA, 14 nt, Human
aaugcaaagaugaa

SEQ ID NO: 2968899 - RNA, 18 nt, Human
aaugcaaagaugaagguc

SEQ ID NO: 2968900 - RNA, 12 nt, Human
aaugcaaagaug

SEQ ID NO: 2968901 - RNA, 21 nt, Human
uaauuaugguuaguagaggua

SEQ ID NO: 2968902 - RNA, 14 nt, Human
uacauacuuuuugg

SEQ ID NO: 2968903 - RNA, 15 nt, Human
uacauacuuuuuggg

SEQ ID NO: 2968904 - RNA, 12 nt, Human
uacauacuuuuu

SEQ ID NO: 2968905 - RNA, 16 nt, Human
uacauuagguugugaa

SEQ ID NO: 2968906 - RNA, 18 nt, Human
uacuauuaaacaugcugu

SEQ ID NO: 2968907 - RNA, 14 nt, Human
uacuauuaaacaug

SEQ ID NO: 2968908 - RNA, 15 nt, Human
uacuauuaaacaugc

SEQ ID NO: 2968909 - RNA, 16 nt, Human
uacuauuaaacaugcu

SEQ ID NO: 2968910 - RNA, 13 nt, Human
uacuauuaaacau

SEQ ID NO: 2968911 - RNA, 14 nt, Human
uauuuauuuauuua

SEQ ID NO: 2968912 - RNA, 13 nt, Human
uauuuauuuguga

SEQ ID NO: 2968913 - RNA, 13 nt, Human
uauuuaauuugaa

SEQ ID NO: 2968914 - RNA, 23 nt, Human
uauuuaauuugaagguagaaugu

SEQ ID NO: 2968915 - RNA, 16 nt, Human
uauuuaauuugaaggu

SEQ ID NO: 2968916 - RNA, 13 nt, Human
uauuuaaucuuuu

SEQ ID NO: 2968917 - RNA, 15 nt, Human
uauuuaaucuuuuau

SEQ ID NO: 2968918 - RNA, 16 nt, Human
uauugaaaugauuuca

SEQ ID NO: 2968919 - RNA, 14 nt, Human
uauugaagcagagu

SEQ ID NO: 2968920 - RNA, 16 nt, Human
uauugaagcagagugg

SEQ ID NO: 2968921 - RNA, 20 nt, Human
uauugaagcagaguggcagu

SEQ ID NO: 2968922 - RNA, 15 nt, Human
uauucugagaugacu

SEQ ID NO: 2968923 - RNA, 17 nt, Human
uauuaaacaugcuguac

SEQ ID NO: 2968924 - RNA, 15 nt, Human
uauuaaacaugcugu

SEQ ID NO: 2968925 - RNA, 19 nt, Human
uauuaaacaugcuguacau

SEQ ID NO: 2968926 - RNA, 15 nt, Human
uauguuuuauauagc

SEQ ID NO: 2968927 - RNA, 22 nt, Human
acaguguguggucaacauuucu

SEQ ID NO: 2968928 - RNA, 21 nt, Human
acaguaacauagcugugauuu

SEQ ID NO: 2968929 - RNA, 20 nt, Human
uaucacuuccaugacauaag

SEQ ID NO: 2968930 - RNA, 19 nt, Human
uauauucucagcagagugc

SEQ ID NO: 2968931 - RNA, 17 nt, Human
uauauucucagcagagu

SEQ ID NO: 2968932 - RNA, 14 nt, Human
uaucagaacuaugu

SEQ ID NO: 2968933 - RNA, 20 nt, Human
uaucagaacuauguuuuugu

SEQ ID NO: 2968934 - RNA, 14 nt, Human
uaugaugacuguuu

SEQ ID NO: 2968935 - RNA, 15 nt, Human
uaugaugacuguuuu

SEQ ID NO: 2968936 - RNA, 13 nt, Human
uauagcaagacau

SEQ ID NO: 2968937 - RNA, 15 nt, Human
uagucauucuucccu

SEQ ID NO: 2968938 - RNA, 14 nt, Human
uagucauucuuccc

SEQ ID NO: 2968939 - RNA, 15 nt, Human
ucccuuucccuuggu

SEQ ID NO: 2968940 - RNA, 17 nt, Human
acuaucacugguuuggu

SEQ ID NO: 2968941 - RNA, 21 nt, Human
acuauuaaacaugcuguacau

SEQ ID NO: 2968942 - RNA, 20 nt, Human
acuauguuuuuguucaguuu

SEQ ID NO: 2968943 - RNA, 18 nt, Human
acuacauuagguugugaa

SEQ ID NO: 2968944 - RNA, 19 nt, Human
acuacauuagguugugaau

SEQ ID NO: 2968945 - RNA, 20 nt, Human
acuacauuagguugugaaug

SEQ ID NO: 2968946 - RNA, 14 nt, Human
acuaaaauguucua

SEQ ID NO: 2968947 - RNA, 15 nt, Human
uccuguuuuuauuau

SEQ ID NO: 2968948 - RNA, 21 nt, Human
uccuguuuuuauuauuaacaa

SEQ ID NO: 2968949 - RNA, 16 nt, Human
uccuguuuuuauuauu

SEQ ID NO: 2968950 - RNA, 20 nt, Human
uccuguuuuuauuauuaaca

SEQ ID NO: 2968951 - RNA, 21 nt, Human
uccacauuuguuuugccaauu

SEQ ID NO: 2968952 - RNA, 19 nt, Human
ucagaacuauguuuuuguu

SEQ ID NO: 2968953 - RNA, 16 nt, Human
ucagaacuauguuuuu

SEQ ID NO: 2968954 - RNA, 18 nt, Human
ucagaugcacaugagcug

SEQ ID NO: 2968955 - RNA, 23 nt, Human
ugagcaucgcuuaggagaagucu

SEQ ID NO: 2968956 - RNA, 10 nt, Human
agcagagugc

SEQ ID NO: 2968957 - RNA, 13 nt, Human
agcagagugcuuu

SEQ ID NO: 2968958 - RNA, 20 nt, Human
ugaaugcccagugagacugu

SEQ ID NO: 2968959 - RNA, 17 nt, Human
ugaagcagaguggcagu

SEQ ID NO: 2968960 - RNA, 21 nt, Human
ugaagauucuauguuaauauu

SEQ ID NO: 2968961 - RNA, 14 nt, Human
ugacauugcaccug

SEQ ID NO: 2968962 - RNA, 17 nt, Human
ugacauugcaccuggau

SEQ ID NO: 2968963 - RNA, 14 nt, Human
ugacauugacuauu

SEQ ID NO: 2968964 - RNA, 16 nt, Human
ugacauugacuauuuu

SEQ ID NO: 2968965 - RNA, 15 nt, Human
agcaacacaaagcuu

SEQ ID NO: 2968966 - RNA, 21 nt, Human
agcaacacaaagcuuuugcau

SEQ ID NO: 2968967 - RNA, 16 nt, Human
agcaacacaaagcuuu

SEQ ID NO: 2968968 - RNA, 18 nt, Human
agcaacacaaagcuuuug

SEQ ID NO: 2968969 - RNA, 20 nt, Human
acuuguugaggguauguuuu

SEQ ID NO: 2968970 - RNA, 15 nt, Human
ucuccucucucugua

SEQ ID NO: 2968971 - RNA, 20 nt, Human
agaacaaaggggcuuaauua

SEQ ID NO: 2968972 - RNA, 17 nt, Human
agaacuaaaauguucua

SEQ ID NO: 2968973 - RNA, 15 nt, Human
ucuggauucauauuu

SEQ ID NO: 2968974 - RNA, 19 nt, Human
agacccucaugcugccaau

SEQ ID NO: 2968975 - RNA, 18 nt, Human
agacccucaugcugccaa

SEQ ID NO: 2968976 - RNA, 21 nt, Human
agacccucaugcugccaauau

SEQ ID NO: 2968977 - RNA, 20 nt, Human
agacccucaugcugccaaua

SEQ ID NO: 2968978 - RNA, 24 nt, Human
agacccucaugcugccaauauccu

SEQ ID NO: 2968979 - RNA, 16 nt, Human
agacccucucaaacua

SEQ ID NO: 2968980 - RNA, 21 nt, Human
agacuggauaguccgucucug

SEQ ID NO: 2968981 - RNA, 20 nt, Human
agacuggauaguccgucucu

SEQ ID NO: 2968982 - RNA, 16 nt, Human
ucuucccucaaaugug

SEQ ID NO: 2968983 - RNA, 18 nt, Human
ucugucuuuuaaacucug

SEQ ID NO: 2968984 - RNA, 12 nt, Human
ucugucuuuuaa

SEQ ID NO: 2968985 - RNA, 16 nt, Human
ucugucuuuuaaacuc

SEQ ID NO: 2968986 - RNA, 17 nt, Human
ugcauacuauuaaacau

SEQ ID NO: 2968987 - RNA, 18 nt, Human
ugcauacuauuaaacaug

SEQ ID NO: 2968988 - RNA, 20 nt, Human
ugcauacuauuaaacaugcu

SEQ ID NO: 2968989 - RNA, 12 nt, Human
ugcauacuauua

SEQ ID NO: 2968990 - RNA, 15 nt, Human
ugcauacuauuaaac

SEQ ID NO: 2968991 - RNA, 16 nt, Human
ugcauacuauuaaaca

SEQ ID NO: 2968992 - RNA, 17 nt, Human
ugcacaucuguuuugua

SEQ ID NO: 2968993 - RNA, 23 nt, Human
ugccaauauccuaauaaaaaggu

SEQ ID NO: 2968994 - RNA, 21 nt, Human
ugccaauauccuaauaaaaag

SEQ ID NO: 2968995 - RNA, 19 nt, Human
ugccaauauccuaauaaaa

SEQ ID NO: 2968996 - RNA, 18 nt, Human
ugccaauauccuaauaaa

SEQ ID NO: 2968997 - RNA, 17 nt, Human
ugccaauauccuaauaa

SEQ ID NO: 2968998 - RNA, 16 nt, Human
ugccaauauccuaaua

SEQ ID NO: 2968999 - RNA, 15 nt, Human
ugccaauauccuaau

SEQ ID NO: 2969000 - RNA, 23 nt, Human
aggaaagcaaaucaguuugguug

SEQ ID NO: 2969001 - RNA, 23 nt, Human
ugcugccaauauccuaauaaaaa

SEQ ID NO: 2969002 - RNA, 22 nt, Human
ugcugccaauauccuaauaaaa

SEQ ID NO: 2969003 - RNA, 15 nt, Human
aggaaugcaaagaug

SEQ ID NO: 2969004 - RNA, 20 nt, Human
ugccuuuuuauaacuuuuua

SEQ ID NO: 2969005 - RNA, 19 nt, Human
uggaacacucuauaacaaa

SEQ ID NO: 2969006 - RNA, 13 nt, Human
aggaguuuggcca

SEQ ID NO: 2969007 - RNA, 12 nt, Human
aggaguuuggcc

SEQ ID NO: 2969008 - RNA, 11 nt, Human
uggcccaggag

SEQ ID NO: 2969009 - RNA, 19 nt, Human
aggcuuagugauguaauua

SEQ ID NO: 2969010 - RNA, 17 nt, Human
aggcuuagugauguaau

SEQ ID NO: 2969011 - RNA, 18 nt, Human
aggcuuagugauguaauu

SEQ ID NO: 2969012 - RNA, 16 nt, Human
uggcuaacuuggguua

SEQ ID NO: 2969013 - RNA, 16 nt, Human
aguccccucuccucca

SEQ ID NO: 2969014 - RNA, 20 nt, Human
uguccagccccguagacgug

SEQ ID NO: 2969015 - RNA, 22 nt, Human
aggugggauaucacuuccauga

SEQ ID NO: 2969016 - RNA, 20 nt, Human
uguacauacuuuuuggguuu

SEQ ID NO: 2969017 - RNA, 15 nt, Human
uguacauacuuuuug

SEQ ID NO: 2969018 - RNA, 17 nt, Human
aguaaugagcuuaagaa

SEQ ID NO: 2969019 - RNA, 16 nt, Human
agguuuuuuuuucuca

SEQ ID NO: 2969020 - RNA, 20 nt, Human
aguaaaaaaugguguuuuau

SEQ ID NO: 2969021 - RNA, 19 nt, Human
aguguguggucaacauuuc

SEQ ID NO: 2969022 - RNA, 22 nt, Human
uguucuaaauaucccuuggaca

SEQ ID NO: 2969023 - RNA, 13 nt, Human
ugugucauuucaa

SEQ ID NO: 2969024 - RNA, 14 nt, Human
ugugucauuucaaa

SEQ ID NO: 2969025 - RNA, 22 nt, Human
uguggucaacauuucucauguu

SEQ ID NO: 2969026 - RNA, 15 nt, Human
ugugccuaauguguu

SEQ ID NO: 2969027 - RNA, 14 nt, Human
ugugccuaaugugu

SEQ ID NO: 2969028 - RNA, 18 nt, Human
ugugccuaauguguuuga

SEQ ID NO: 2969029 - RNA, 17 nt, Human
ugugccuaauguguuug

SEQ ID NO: 2969030 - RNA, 18 nt, Human
agugcaaacuucagaguu

SEQ ID NO: 2969031 - RNA, 15 nt, Human
agucucccuuccuau

SEQ ID NO: 2969032 - RNA, 18 nt, Human
auacuauuaaacaugcug

SEQ ID NO: 2969033 - RNA, 19 nt, Human
auacuauuaaacaugcugu

SEQ ID NO: 2969034 - RNA, 17 nt, Human
auacuauuaaacaugcu

SEQ ID NO: 2969035 - RNA, 20 nt, Human
auagauguugcuaacagcaa

SEQ ID NO: 2969036 - RNA, 14 nt, Human
auagauguugcuaa

SEQ ID NO: 2969037 - RNA, 20 nt, Human
auacugccuuguuuaauggu

SEQ ID NO: 2969038 - RNA, 18 nt, Human
auacugccuuguuuaaug

SEQ ID NO: 2969039 - RNA, 13 nt, Human
uuauuauuaacaa

SEQ ID NO: 2969040 - RNA, 14 nt, Human
uuauuauuaacaaa

SEQ ID NO: 2969041 - RNA, 21 nt, Human
uuauucauuaguuuugaagau

SEQ ID NO: 2969042 - RNA, 18 nt, Human
uuauucauuaguuuugaa

SEQ ID NO: 2969043 - RNA, 13 nt, Human
uuauguuaauauu

SEQ ID NO: 2969044 - RNA, 19 nt, Human
aguuuuuuuccuucaagaa

SEQ ID NO: 2969045 - RNA, 19 nt, Human
uuaagacuuugguuauuuu

SEQ ID NO: 2969046 - RNA, 15 nt, Human
aguuuaucuguucau

SEQ ID NO: 2969047 - RNA, 15 nt, Human
aguuuuacaguguuu

SEQ ID NO: 2969048 - RNA, 22 nt, Human
auaacuuuuuauauucucagca

SEQ ID NO: 2969049 - RNA, 18 nt, Human
auaacuuuuuauauucuc

SEQ ID NO: 2969050 - RNA, 21 nt, Human
uugaaggaugcugucuucgua

SEQ ID NO: 2969051 - RNA, 17 nt, Human
uugcauauugcauacua

SEQ ID NO: 2969052 - RNA, 17 nt, Human
aucugaaauaaggaaug

SEQ ID NO: 2969053 - RNA, 19 nt, Human
uucuagcaugaagacagag

SEQ ID NO: 2969054 - RNA, 15 nt, Human
uucccucaaaugugu

SEQ ID NO: 2969055 - RNA, 19 nt, Human
augugcacaucuguuuugu

SEQ ID NO: 2969056 - RNA, 13 nt, Human
augucaguauuuc

SEQ ID NO: 2969057 - RNA, 16 nt, Human
augucaguauuucaac

SEQ ID NO: 2969058 - RNA, 20 nt, Human
auguagacaguuggguuuuu

SEQ ID NO: 2969059 - RNA, 18 nt, Human
auguagacaguuggguuu

SEQ ID NO: 2969060 - RNA, 15 nt, Human
uuuaaauagaugaca

SEQ ID NO: 2969061 - RNA, 22 nt, Human
uuuaauuugaagguagaauguu

SEQ ID NO: 2969062 - RNA, 16 nt, Human
augauauaagguuuuu

SEQ ID NO: 2969063 - RNA, 18 nt, Human
uuguuuugccaauuugca

SEQ ID NO: 2969064 - RNA, 17 nt, Human
uuuaaagauguagacag

SEQ ID NO: 2969065 - RNA, 19 nt, Human
augauugccuuuuuauaac

SEQ ID NO: 2969066 - RNA, 14 nt, Human
uuucaaauguucuc

SEQ ID NO: 2969067 - RNA, 19 nt, Human
auugauugggcacaucauu

SEQ ID NO: 2969068 - RNA, 23 nt, Human
auugauugggcacaucauuucaa

SEQ ID NO: 2969069 - RNA, 16 nt, Human
auuuauuuauuuauuc

SEQ ID NO: 2969070 - RNA, 14 nt, Human
auuugaaacacugg

SEQ ID NO: 2969071 - RNA, 17 nt, Human
auuugaaacacugguuu

SEQ ID NO: 2969072 - RNA, 21 nt, Human
auuuuuguuuuuauuaaaagg

SEQ ID NO: 2969073 - RNA, 19 nt, Human
auuuuuguuuuuauuaaaa

SEQ ID NO: 2969074 - RNA, 19 nt, Human
auuuuugguauuugaaaca

SEQ ID NO: 2969075 - RNA, 18 nt, Human
auugaagcagaguggcag

SEQ ID NO: 2969076 - RNA, 14 nt, Human
auugaagcagagug

SEQ ID NO: 2969077 - RNA, 15 nt, Human
auugaagcagagugg

SEQ ID NO: 2969078 - RNA, 13 nt, Human
auugaagcagagu

SEQ ID NO: 2969079 - RNA, 17 nt, Human
uuuguggaaaauaacuc

SEQ ID NO: 2969080 - RNA, 16 nt, Human
auuauauucauucuuu

SEQ ID NO: 2969081 - RNA, 17 nt, Human
auuauguuaauauuucu

SEQ ID NO: 2969082 - RNA, 13 nt, Human
auuauguuaauau

SEQ ID NO: 2969083 - RNA, 16 nt, Human
auuauguuaauauuuc

SEQ ID NO: 2969084 - RNA, 14 nt, Human
auuauguuaauauu

SEQ ID NO: 2969085 - RNA, 19 nt, Human
cuggauaguccgucucugc

SEQ ID NO: 2969086 - RNA, 18 nt, Human
cuggauaguccgucucug

SEQ ID NO: 2969087 - RNA, 17 nt, Human
cugucggagcccugucu

SEQ ID NO: 2969088 - RNA, 23 nt, Human
cuuugguuauuuuacuuuuugga

SEQ ID NO: 2969089 - RNA, 17 nt, Human
cuuugguuauuuuacuu

SEQ ID NO: 2969090 - RNA, 19 nt, Human
cuuugguuauuuuacuuuu

SEQ ID NO: 2969091 - RNA, 13 nt, Human
cuuugguuauuuu

SEQ ID NO: 2969092 - RNA, 18 nt, Human
cuuuaccaauugaaguaa

SEQ ID NO: 2969093 - RNA, 16 nt, Human
cuuuaccaauugaagu

SEQ ID NO: 2969094 - RNA, 19 nt, Human
cuuuaccaauugaaguaaa

SEQ ID NO: 2969095 - RNA, 20 nt, Human
cuuuaccaauugaaguaaaa

SEQ ID NO: 2969096 - RNA, 22 nt, Human
cuugugaauaaagagggugggu

SEQ ID NO: 2969097 - RNA, 20 nt, Human
gaaagggauuuucagcccuc

SEQ ID NO: 2969098 - RNA, 12 nt, Human
gaaagggauuuu

SEQ ID NO: 2969099 - RNA, 15 nt, Human
gauucuuguauuuau

SEQ ID NO: 2969100 - RNA, 21 nt, Human
gauucuuguauuuauuacaac

SEQ ID NO: 2969101 - RNA, 21 nt, Human
gaugcugucuucguacuggga

SEQ ID NO: 2969102 - RNA, 14 nt, Human
gcaggcuggaguua

SEQ ID NO: 2969103 - RNA, 22 nt, Human
gacuuugguuauuuuacuuuuu

SEQ ID NO: 2969104 - RNA, 21 nt, Human
gacccucucaaacuaacaggc

SEQ ID NO: 2969105 - RNA, 20 nt, Human
ggcacugguuuguucccugu

SEQ ID NO: 2969106 - RNA, 19 nt, Human
ggcccuuuuucaauaacug

SEQ ID NO: 2969107 - RNA, 18 nt, Human
ggcugaacuuuguggucg

SEQ ID NO: 2969108 - RNA, 20 nt, Human
aaaaggaagcuuacaugccu

SEQ ID NO: 2969109 - RNA, 14 nt, Human
guagaauguuuuca

SEQ ID NO: 2969110 - RNA, 16 nt, Human
guagacaguuggguuu

SEQ ID NO: 2969111 - RNA, 23 nt, Human
guagacgugcacgcacacugucu

SEQ ID NO: 2969112 - RNA, 20 nt, Human
guagacgugcacgcacacug

SEQ ID NO: 2969113 - RNA, 21 nt, Human
guacucugccacuuuauuucu

SEQ ID NO: 2969114 - RNA, 14 nt, Human
guaacucuguaauu

SEQ ID NO: 2969115 - RNA, 16 nt, Human
aaagguacuuugcagg

SEQ ID NO: 2969116 - RNA, 14 nt, Human
ggguggggcagugc

SEQ ID NO: 2969117 - RNA, 13 nt, Human
aaagcuuuugcau

SEQ ID NO: 2969118 - RNA, 14 nt, Human
aaagcuuuugcaua

SEQ ID NO: 2969119 - RNA, 17 nt, Human
aaagcuuuugcauauug

SEQ ID NO: 2969120 - RNA, 21 nt, Human
aaacacauuaaagguacuuug

SEQ ID NO: 2969121 - RNA, 11 nt, Human
aaacacauuaa

SEQ ID NO: 2969122 - RNA, 15 nt, Human
aaacacauuaaaggu

SEQ ID NO: 2969123 - RNA, 23 nt, Human
aaacaugcuguacauacuuuuug

SEQ ID NO: 2969124 - RNA, 16 nt, Human
gcuuguacacucauuc

SEQ ID NO: 2969125 - RNA, 23 nt, Human
ggaacagaagaggaaagagagac

SEQ ID NO: 2969126 - RNA, 19 nt, Human
gcuccaccuugcagcucuc

SEQ ID NO: 2969127 - RNA, 16 nt, Human
gcccucaauugugaaa

SEQ ID NO: 2969128 - RNA, 22 nt, Human
cagaguaggggucugucuuuua

SEQ ID NO: 2969129 - RNA, 23 nt, Human
cagaguaggggucugucuuuuaa

SEQ ID NO: 2969130 - RNA, 20 nt, Human
cagaguaggggucugucuuu

SEQ ID NO: 2969131 - RNA, 13 nt, Human
cauagcugugauu

SEQ ID NO: 2969132 - RNA, 15 nt, Human
cauagcugugauuuu

SEQ ID NO: 2969133 - RNA, 18 nt, Human
cauagcugugauuuuugg

SEQ ID NO: 2969134 - RNA, 14 nt, Human
cauuagguugugaa

SEQ ID NO: 2969135 - RNA, 15 nt, Human
cauuagguugugaau

SEQ ID NO: 2969136 - RNA, 16 nt, Human
cauuagguugugaaug

SEQ ID NO: 2969137 - RNA, 13 nt, Human
cauuaguuuugaa

SEQ ID NO: 2969138 - RNA, 12 nt, Human
auuaaaugacuc

SEQ ID NO: 2969139 - RNA, 13 nt, Human
auuaaaugacucu

SEQ ID NO: 2969140 - RNA, 24 nt, Human
caaacccaguguuuuaggagcaug

SEQ ID NO: 2969141 - RNA, 17 nt, Human
caaacagucucccuucc

SEQ ID NO: 2969142 - RNA, 13 nt, Human
auuuuaugucuuu

SEQ ID NO: 2969143 - RNA, 15 nt, Human
cacaucuguuuugua

SEQ ID NO: 2969144 - RNA, 18 nt, Human
cacccaggaacuccugac

SEQ ID NO: 2969145 - RNA, 13 nt, Human
cacagaagaugaa

SEQ ID NO: 2969146 - RNA, 23 nt, Human
caauugaaguaaaauguggcagg

SEQ ID NO: 2969147 - RNA, 12 nt, Human
ccuaauguguuu

SEQ ID NO: 2969148 - RNA, 14 nt, Human
ccuaauaaaaaggu

SEQ ID NO: 2969149 - RNA, 20 nt, Human
ccuaauaaaaaggugaccau

SEQ ID NO: 2969150 - RNA, 16 nt, Human
ccuaauaaaaagguga

SEQ ID NO: 2969151 - RNA, 15 nt, Human
ccuaauaaaaaggug

SEQ ID NO: 2969152 - RNA, 16 nt, Human
ccauucuuggcccagg

SEQ ID NO: 2969153 - RNA, 22 nt, Human
ccagucauuauguuaauauuuc

SEQ ID NO: 2969154 - RNA, 21 nt, Human
ccagucauuauguuaauauuu

SEQ ID NO: 2969155 - RNA, 20 nt, Human
cccagcacaaagcagauccu

SEQ ID NO: 2969156 - RNA, 17 nt, Human
cucacaauccuugccac

SEQ ID NO: 2969157 - RNA, 21 nt, Human
cugacacaugcugaacaucac

SEQ ID NO: 2969158 - RNA, 14 nt, Human
ccagcacaaagcag

SEQ ID NO: 2969159 - RNA, 13 nt, Human
ccagugagacugu

SEQ ID NO: 2969160 - RNA, 18 nt, Human
ccagugacagucagggaa

SEQ ID NO: 2969161 - RNA, 21 nt, Human
cucagaugcacaugagcuggc

SEQ ID NO: 2969162 - RNA, 23 nt, Human
cucauuuuuauaaugucccuuca

SEQ ID NO: 2969163 - RNA, 20 nt, Human
cuauauaauuccuguuuuua

SEQ ID NO: 2969164 - RNA, 18 nt, Human
cuauauaauuccuguuuu

SEQ ID NO: 2969165 - RNA, 23 nt, Human
cuauucagcacaaggaaauaaaa

SEQ ID NO: 2969166 - RNA, 18 nt, Human
cuauucugagaugacuau

SEQ ID NO: 2969167 - RNA, 15 nt, Human
cuauucugagaugac

SEQ ID NO: 2969168 - RNA, 16 nt, Human
cuauucugagaugacu

SEQ ID NO: 2969169 - RNA, 15 nt, Human
cucacagaagaugaa

SEQ ID NO: 2969170 - RNA, 19 nt, Human
cuauuuauuuauuuauuca

SEQ ID NO: 2969171 - RNA, 12 nt, Human
cuauuuauuuau

SEQ ID NO: 2969172 - RNA, 20 nt, Human
cuaacagcaacacaaagcuu

SEQ ID NO: 2969173 - RNA, 19 nt, Human
cuaauaugaugacuguuuu

SEQ ID NO: 2969174 - RNA, 21 nt, Human
cuaauaugaugacuguuuuua

SEQ ID NO: 2969175 - RNA, 17 nt, Human
cuacauugacagauuga

SEQ ID NO: 2969176 - RNA, 18 nt, Human
cuacauuagguugugaau

SEQ ID NO: 2969177 - RNA, 17 nt, Human
cuacauuagguugugaa

SEQ ID NO: 2969178 - RNA, 21 nt, Human
cuaccaauauuuaaucuuuua

SEQ ID NO: 2969179 - RNA, 15 nt, Human
cuaccaauauuuaau

SEQ ID NO: 2969180 - RNA, 13 nt, Human
cuaccaauauuua

SEQ ID NO: 2969181 - RNA, 21 nt, Human
cuuuuuggguuuauuuggaaa

SEQ ID NO: 2969182 - RNA, 17 nt, Human
gaaaaggccuucuuccc

SEQ ID NO: 2969183 - RNA, 14 nt, Human
cuuugcaggaaauc

SEQ ID NO: 2969184 - RNA, 15 nt, Human
cuuauuuccucauuu

SEQ ID NO: 2969185 - RNA, 15 nt, Human
cuuagugauguaauu

SEQ ID NO: 2969186 - RNA, 16 nt, Human
cuuagugauguaauua

SEQ ID NO: 2969187 - RNA, 22 nt, Human
cuggcacugguuuguucccugu

SEQ ID NO: 2969188 - RNA, 22 nt, Human
cuguaauaaacucauuucuagc

SEQ ID NO: 2969189 - RNA, 21 nt, Human
cugugcaucuagccucaagcu

SEQ ID NO: 2969190 - RNA, 19 nt, Human
cugugaugacauucccugc

SEQ ID NO: 2969191 - RNA, 22 nt, Human
gaaugucaguuguuauuuauug

SEQ ID NO: 2969192 - RNA, 19 nt, Human
gacagagccccacccucag

SEQ ID NO: 2969193 - RNA, 18 nt, Human
gagguacacuugugaaua

SEQ ID NO: 2969194 - RNA, 12 nt, Human
gagcccugucuc

SEQ ID NO: 2969195 - RNA, 16 nt, Human
gcacauuaaaugacuc

SEQ ID NO: 2969196 - RNA, 21 nt, Human
gcacauuaaaugacucuuccc

SEQ ID NO: 2969197 - RNA, 12 nt, Human
gcacauuaaaug

SEQ ID NO: 2969198 - RNA, 14 nt, Human
gcacauuaaaugac

SEQ ID NO: 2969199 - RNA, 13 nt, Human
gcacacugucugc

SEQ ID NO: 2969200 - RNA, 16 nt, Human
gauguugcuaacagca

SEQ ID NO: 2969201 - RNA, 18 nt, Human
gcaaagaugaaggucugu

SEQ ID NO: 2969202 - RNA, 14 nt, Human
gcaaagaugaaggu

SEQ ID NO: 2969203 - RNA, 15 nt, Human
gauugccuuuuuaua

SEQ ID NO: 2969204 - RNA, 21 nt, Human
gauugccuuuuuauaacuuuu

SEQ ID NO: 2969205 - RNA, 22 nt, Human
gauugccuuuuuauaacuuuuu

SEQ ID NO: 2969206 - RNA, 13 nt, Human
ggauacuuauuua

SEQ ID NO: 2969207 - RNA, 13 nt, Human
ggaaugcaaagau

SEQ ID NO: 2969208 - RNA, 23 nt, Human
ggaaagggauuuucagcccucag

SEQ ID NO: 2969209 - RNA, 21 nt, Human
gcuuaggagaagucuucuauu

SEQ ID NO: 2969210 - RNA, 23 nt, Human
gcugccaauauccuaauaaaaag

SEQ ID NO: 2969211 - RNA, 21 nt, Human
gcugccaauauccuaauaaaa

SEQ ID NO: 2969212 - RNA, 20 nt, Human
gcugccaauauccuaauaaa

SEQ ID NO: 2969213 - RNA, 14 nt, Human
gcccuuuuucaaua

SEQ ID NO: 2969214 - RNA, 18 nt, Human
gccuaauaugaugacugu

SEQ ID NO: 2969215 - RNA, 17 nt, Human
gcucaccccaucauccc

SEQ ID NO: 2969216 - RNA, 19 nt, Human
gcucaccccaucaucccuu

SEQ ID NO: 2969217 - RNA, 13 nt, Human
gcugcaguuuuuu

SEQ ID NO: 2969218 - RNA, 15 nt, Human
gcugccaauauccua

SEQ ID NO: 2969219 - RNA, 14 nt, Human
gcugccaauauccu

SEQ ID NO: 2969220 - RNA, 19 nt, Human
gcugccaauauccuaauaa

SEQ ID NO: 2969221 - RNA, 18 nt, Human
gcugccaauauccuaaua

SEQ ID NO: 2969222 - RNA, 17 nt, Human
gcugccaauauccuaau

SEQ ID NO: 2969223 - RNA, 16 nt, Human
gcugccaauauccuaa

SEQ ID NO: 2969224 - RNA, 22 nt, Human
guaacuguuuagaugaauguca

SEQ ID NO: 2969225 - RNA, 10 nt, Human
gguugugaau

SEQ ID NO: 2969226 - RNA, 18 nt, Human
guaaaaaaugguguuuua

SEQ ID NO: 2969227 - RNA, 16 nt, Human
guaaaaaaugguguuu

SEQ ID NO: 2969228 - RNA, 14 nt, Human
guacuuuuaagacu

SEQ ID NO: 2969229 - RNA, 15 nt, Human
guagagguacacuug

SEQ ID NO: 2969230 - RNA, 17 nt, Human
guagagguacacuugug

SEQ ID NO: 2969231 - RNA, 19 nt, Human
guagagguacacuugugaa

SEQ ID NO: 2969232 - RNA, 18 nt, Human
guacuaacauuuauuuga

SEQ ID NO: 2969233 - RNA, 19 nt, Human
guacauacuuuuuggguuu

SEQ ID NO: 2969234 - RNA, 13 nt, Human
guacauacuuuuu

SEQ ID NO: 2969235 - RNA, 14 nt, Human
guacauacuuuuug

SEQ ID NO: 2969236 - RNA, 15 nt, Human
guacacuugugaaua

SEQ ID NO: 2969237 - RNA, 14 nt, Human
guacacuugugaau

SEQ ID NO: 2969238 - RNA, 21 nt, Human
ggguagccacuggacugacga

SEQ ID NO: 2969239 - RNA, 23 nt, Human
gguagaauguuuucaaauguucu

SEQ ID NO: 2969240 - RNA, 14 nt, Human
gucaaggcuuagac

SEQ ID NO: 2969241 - RNA, 13 nt, Human
gucaaggcuuaga

SEQ ID NO: 2969242 - RNA, 20 nt, Human
guagagguacacuugugaau

SEQ ID NO: 2969243 - RNA, 19 nt, Human
guccuauuauauucauucu

SEQ ID NO: 2969244 - RNA, 21 nt, Human
guccuauuauauucauucuuu

SEQ ID NO: 2969245 - RNA, 21 nt, Human
guccugucggagcccugucuc

SEQ ID NO: 2969246 - RNA, 20 nt, Human
guccugucggagcccugucu

SEQ ID NO: 2969247 - RNA, 18 nt, Human
guccugucggagcccugu

SEQ ID NO: 2969248 - RNA, 24 nt, Human
gugcuuggcccaggaguuuggcca

SEQ ID NO: 2969249 - RNA, 19 nt, Human
gugcuuggcccaggaguuu

SEQ ID NO: 2969250 - RNA, 17 nt, Human
gugcuuggcccaggagu

SEQ ID NO: 2969251 - RNA, 16 nt, Human
gugcuuggcccaggag

SEQ ID NO: 2969252 - RNA, 15 nt, Human
gugcuuggcccagga

SEQ ID NO: 2969253 - RNA, 14 nt, Human
gugcuuggcccagg

SEQ ID NO: 2969254 - RNA, 13 nt, Human
gugcuuggcccag

SEQ ID NO: 2969255 - RNA, 14 nt, Human
guggaaaauaacuc

SEQ ID NO: 2969256 - RNA, 12 nt, Human
ucaaauguguac

SEQ ID NO: 2969257 - RNA, 15 nt, Human
uauuuaaauagauga

SEQ ID NO: 2969258 - RNA, 17 nt, Human
uauuuaaauagaugaca

SEQ ID NO: 2969259 - RNA, 18 nt, Human
uauuugaaacacugguuu

SEQ ID NO: 2969260 - RNA, 23 nt, Human
uauugcauacuauuaaacaugcu

SEQ ID NO: 2969261 - RNA, 19 nt, Human
uauugcauacuauuaaaca

SEQ ID NO: 2969262 - RNA, 23 nt, Human
uauucauucuuuuugaaauguca

SEQ ID NO: 2969263 - RNA, 18 nt, Human
uauucauucuuuuugaaa

SEQ ID NO: 2969264 - RNA, 23 nt, Human
uauuauauucauucuuuuugaaa

SEQ ID NO: 2969265 - RNA, 17 nt, Human
uauuauauucauucuuu

SEQ ID NO: 2969266 - RNA, 13 nt, Human
uauuauauucauu

SEQ ID NO: 2969267 - RNA, 13 nt, Human
uauguguucuauu

SEQ ID NO: 2969268 - RNA, 14 nt, Human
uauguuaauauuuu

SEQ ID NO: 2969269 - RNA, 16 nt, Human
uauguuaauauuucug

SEQ ID NO: 2969270 - RNA, 13 nt, Human
uauguuaauauuu

SEQ ID NO: 2969271 - RNA, 18 nt, Human
uaucuguucauauggaua

SEQ ID NO: 2969272 - RNA, 23 nt, Human
uaugauugccuuuuuauaacuuu

SEQ ID NO: 2969273 - RNA, 20 nt, Human
uaugauugccuuuuuauaac

SEQ ID NO: 2969274 - RNA, 16 nt, Human
uccuccacauuuguuu

SEQ ID NO: 2969275 - RNA, 13 nt, Human
uccuccacauuug

SEQ ID NO: 2969276 - RNA, 22 nt, Human
uccucauuuuuauaaugucccu

SEQ ID NO: 2969277 - RNA, 17 nt, Human
uccuagucauucuuccc

SEQ ID NO: 2969278 - RNA, 15 nt, Human
ucccuuggacauuuu

SEQ ID NO: 2969279 - RNA, 21 nt, Human
ucccuuggacauuuuaugucu

SEQ ID NO: 2969280 - RNA, 19 nt, Human
ucccuuggacauuuuaugu

SEQ ID NO: 2969281 - RNA, 18 nt, Human
ucccuuggacauuuuaug

SEQ ID NO: 2969282 - RNA, 16 nt, Human
ucccuuggacauuuua

SEQ ID NO: 2969283 - RNA, 20 nt, Human
ucccuucacaaacccagugu

SEQ ID NO: 2969284 - RNA, 22 nt, Human
uccugucggagcccugucuccu

SEQ ID NO: 2969285 - RNA, 13 nt, Human
ugaaaugucaacc

SEQ ID NO: 2969286 - RNA, 17 nt, Human
ugaacaguaacauagcu

SEQ ID NO: 2969287 - RNA, 22 nt, Human
ugauugccuuuuuauaacuuuu

SEQ ID NO: 2969288 - RNA, 17 nt, Human
ugauugccuuuuuauaa

SEQ ID NO: 2969289 - RNA, 15 nt, Human
ugauuuaaacacauu

SEQ ID NO: 2969290 - RNA, 18 nt, Human
ugauuuaaacacauuaaa

SEQ ID NO: 2969291 - RNA, 16 nt, Human
ugauuuaaacacauua

SEQ ID NO: 2969292 - RNA, 17 nt, Human
ugauuuaaacacauuaa

SEQ ID NO: 2969293 - RNA, 23 nt, Human
ugauugggcacaucauuucaaga

SEQ ID NO: 2969294 - RNA, 18 nt, Human
ugauugggcacaucauuu

SEQ ID NO: 2969295 - RNA, 20 nt, Human
ugauugggcacaucauuuca

SEQ ID NO: 2969296 - RNA, 21 nt, Human
ugauugggcacaucauuucaa

SEQ ID NO: 2969297 - RNA, 17 nt, Human
ugauugggcacaucauu

SEQ ID NO: 2969298 - RNA, 21 nt, Human
ugcuguucacuggacacuuca

SEQ ID NO: 2969299 - RNA, 19 nt, Human
ugcugccaauauccuaaua

SEQ ID NO: 2969300 - RNA, 18 nt, Human
ugcugccaauauccuaau

SEQ ID NO: 2969301 - RNA, 17 nt, Human
ugcugccaauauccuaa

SEQ ID NO: 2969302 - RNA, 16 nt, Human
ugcugccaauauccua

SEQ ID NO: 2969303 - RNA, 15 nt, Human
ugcugccaauauccu

SEQ ID NO: 2969304 - RNA, 21 nt, Human
ugcugccaauauccuaauaaa

SEQ ID NO: 2969305 - RNA, 15 nt, Human
ugcauauugcauacu

SEQ ID NO: 2969306 - RNA, 23 nt, Human
ugcauauugcauacuauuaaaca

SEQ ID NO: 2969307 - RNA, 16 nt, Human
ugcagggacagagcau

SEQ ID NO: 2969308 - RNA, 19 nt, Human
uggaucuguauguguucua

SEQ ID NO: 2969309 - RNA, 18 nt, Human
uggguauagauguugcua

SEQ ID NO: 2969310 - RNA, 14 nt, Human
uggguauagauguu

SEQ ID NO: 2969311 - RNA, 22 nt, Human
uggugauuuagcaggaagcugu

SEQ ID NO: 2969312 - RNA, 16 nt, Human
uggugauuuagcagga

SEQ ID NO: 2969313 - RNA, 14 nt, Human
uggucaacauuucu

SEQ ID NO: 2969314 - RNA, 15 nt, Human
ugguauuugaaacac

SEQ ID NO: 2969315 - RNA, 21 nt, Human
uuaaacucugagugcaaacuu

SEQ ID NO: 2969316 - RNA, 19 nt, Human
uuaaugguaguuuuacagu

SEQ ID NO: 2969317 - RNA, 22 nt, Human
uuaguagagguacacuugugaa

SEQ ID NO: 2969318 - RNA, 23 nt, Human
uuaguagagguacacuugugaau

SEQ ID NO: 2969319 - RNA, 20 nt, Human
uuaggagaagucuucuauuu

SEQ ID NO: 2969320 - RNA, 20 nt, Human
uuagacccucaugcugccaa

SEQ ID NO: 2969321 - RNA, 19 nt, Human
uuagacccucaugcugcca

SEQ ID NO: 2969322 - RNA, 13 nt, Human
uuacuuuaaacua

SEQ ID NO: 2969323 - RNA, 15 nt, Human
uuauuuuacuuuuug

SEQ ID NO: 2969324 - RNA, 13 nt, Human
uuauuuuacuuuu

SEQ ID NO: 2969325 - RNA, 15 nt, Human
uuauugauguuuuca

SEQ ID NO: 2969326 - RNA, 13 nt, Human
uuauugaagcaga

SEQ ID NO: 2969327 - RNA, 15 nt, Human
uuauugaagcagagu

SEQ ID NO: 2969328 - RNA, 16 nt, Human
uuauugaagcagagug

SEQ ID NO: 2969329 - RNA, 17 nt, Human
uuauugaagcagagugg

SEQ ID NO: 2969330 - RNA, 12 nt, Human
uuauugaagcag

SEQ ID NO: 2969331 - RNA, 19 nt, Human
uuuacaguguuucuggcuu

SEQ ID NO: 2969332 - RNA, 17 nt, Human
uuuacaguguuucuggc

SEQ ID NO: 2969333 - RNA, 23 nt, Human
uuuauccuagucauucuucccua

SEQ ID NO: 2969334 - RNA, 15 nt, Human
uuuaucuguucauau

SEQ ID NO: 2969335 - RNA, 16 nt, Human
uuuaucuguucauaug

SEQ ID NO: 2969336 - RNA, 22 nt, Human
uuuauccuagucauucuucccu

SEQ ID NO: 2969337 - RNA, 23 nt, Human
uuguuuaaugguaguuuuacagu

SEQ ID NO: 2969338 - RNA, 12 nt, Human
uuguuuaauggu

SEQ ID NO: 2969339 - RNA, 15 nt, Human
uuguuauuuauugaa

SEQ ID NO: 2969340 - RNA, 20 nt, Human
uuguuauuuauugaaaugau

SEQ ID NO: 2969341 - RNA, 14 nt, Human
uuuaaacacauuaa

SEQ ID NO: 2969342 - RNA, 15 nt, Human
uuuaaacacauuaaa

SEQ ID NO: 2969343 - RNA, 15 nt, Human
uuuaaacuacauuag

SEQ ID NO: 2969344 - RNA, 21 nt, Human
uuugaagguagaauguuuuca

SEQ ID NO: 2969345 - RNA, 20 nt, Human
uuugccaauuugcacauuaa

SEQ ID NO: 2969346 - RNA, 15 nt, Human
uuugccaauuugcac

SEQ ID NO: 2969347 - RNA, 22 nt, Human
uuugguugguaacucuguaauu

SEQ ID NO: 2969348 - RNA, 13 nt, Human
uuugguuauuuua

SEQ ID NO: 2969349 - RNA, 14 nt, Human
uuugguuauuuuac

SEQ ID NO: 2969350 - RNA, 17 nt, Human
uuuggguuuauuuggaa

SEQ ID NO: 2969351 - RNA, 22 nt, Human
uuucacaguguguggucaacau

SEQ ID NO: 2969352 - RNA, 13 nt, Human
uucuuguauuuau

SEQ ID NO: 2969353 - RNA, 14 nt, Human
uugaagcagagugg

SEQ ID NO: 2969354 - RNA, 12 nt, Human
uugaagcagagu

SEQ ID NO: 2969355 - RNA, 13 nt, Human
uugaagauucuau

SEQ ID NO: 2969356 - RNA, 23 nt, Human
uugaagauucuauguuaauauuu

SEQ ID NO: 2969357 - RNA, 22 nt, Human
uugaagauucuauguuaauauu

SEQ ID NO: 2969358 - RNA, 15 nt, Human
uugaaacacugguuu

SEQ ID NO: 2969359 - RNA, 23 nt, Human
uugcagcucuccccuucucugua

SEQ ID NO: 2969360 - RNA, 18 nt, Human
uugguaacucuguaauuc

SEQ ID NO: 2969361 - RNA, 20 nt, Human
uugggcacaucauuucaaga

SEQ ID NO: 2969362 - RNA, 17 nt, Human
uugccuuuuuauaacuu

SEQ ID NO: 2969363 - RNA, 18 nt, Human
uugccuuggcugcaguuu

SEQ ID NO: 2969364 - RNA, 16 nt, Human
uugcugcuuguacacu

SEQ ID NO: 2969365 - RNA, 21 nt, Human
uugcugcugauuuaaacacau

SEQ ID NO: 2969366 - RNA, 17 nt, Human
uugcugcugauuuaaac

SEQ ID NO: 2969367 - RNA, 19 nt, Human
uugcugcugauuuaaacac

SEQ ID NO: 2969368 - RNA, 23 nt, Human
uugcuaacagcaacacaaagcuu

SEQ ID NO: 2969369 - RNA, 17 nt, Human
uuuguguacuuuuaaga

SEQ ID NO: 2969370 - RNA, 13 nt, Human
uuuguguacuuuu

SEQ ID NO: 2969371 - RNA, 14 nt, Human
uuuguguacuuuua

SEQ ID NO: 2969372 - RNA, 21 nt, Human
cugacacaugcugaacaucac

SEQ ID NO: 2969373 - RNA, 23 nt, Human
cugacacacagcucuguccuggg

SEQ ID NO: 2969374 - RNA, 22 nt, Human
cugacacacagcucuguccugg

SEQ ID NO: 2969375 - RNA, 21 nt, Human
cugacacacagcucuguccug

SEQ ID NO: 2969376 - RNA, 20 nt, Human
cugacacacagcucuguccu

SEQ ID NO: 2969377 - RNA, 19 nt, Human
cugacacacagcucugucc

SEQ ID NO: 2969378 - RNA, 18 nt, Human
cugacacacagcucuguc

SEQ ID NO: 2969379 - RNA, 17 nt, Human
cugacacacagcucugu

SEQ ID NO: 2969380 - RNA, 16 nt, Human
cugacacacagcucug

SEQ ID NO: 2969381 - RNA, 15 nt, Human
cugacacacagcucu

SEQ ID NO: 2969382 - RNA, 13 nt, Human
cugacacacagcu

SEQ ID NO: 2969383 - RNA, 17 nt, Human
cugaaagaggaaugaag

SEQ ID NO: 2969384 - RNA, 13 nt, Human
cugaaagaggaau

SEQ ID NO: 2969385 - RNA, 24 nt, Human
cucuugauucauaaugacuuaagc

SEQ ID NO: 2969386 - RNA, 13 nt, Human
cucuugagccugg

SEQ ID NO: 2969387 - RNA, 14 nt, Human
cucuugagccuggg

SEQ ID NO: 2969388 - RNA, 22 nt, Human
cucuugauucauaaugacuuaa

SEQ ID NO: 2969389 - RNA, 15 nt, Human
cucuugagccuggga

SEQ ID NO: 2969390 - RNA, 16 nt, Human
cucuugagccugggag

SEQ ID NO: 2969391 - RNA, 23 nt, Human
cucuugagccuugaacuuugacc

SEQ ID NO: 2969392 - RNA, 17 nt, Human
cucugcacaagcugcac

SEQ ID NO: 2969393 - RNA, 18 nt, Human
cucugcacaagcugcacc

SEQ ID NO: 2969394 - RNA, 17 nt, Human
cugaucucucgugauug

SEQ ID NO: 2969395 - RNA, 18 nt, Human
cugaucucucgugauuga

SEQ ID NO: 2969396 - RNA, 14 nt, Human
cugaucucucguga

SEQ ID NO: 2969397 - RNA, 23 nt, Human
cugaggaauccagacccggcugc

SEQ ID NO: 2969398 - RNA, 14 nt, Human
cugaggggccucuu

SEQ ID NO: 2969399 - RNA, 13 nt, Human
cugaggugggagg

SEQ ID NO: 2969400 - RNA, 12 nt, Human
cugaggugggag

SEQ ID NO: 2969401 - RNA, 22 nt, Human
cugaggugggaggaucucuuga

SEQ ID NO: 2969402 - RNA, 18 nt, Human
cugagggggccuggaugc

SEQ ID NO: 2969403 - RNA, 12 nt, Human
cugagcugggau

SEQ ID NO: 2969404 - RNA, 22 nt, Human
cugagcugggaugauuggaggg

SEQ ID NO: 2969405 - RNA, 19 nt, Human
cugacccugcuucaaauau

SEQ ID NO: 2969406 - RNA, 22 nt, Human
cuccgcuuucuacccagcgagc

SEQ ID NO: 2969407 - RNA, 14 nt, Human
cuccgucaacucau

SEQ ID NO: 2969408 - RNA, 20 nt, Human
cuccgcuuucuacccagcga

SEQ ID NO: 2969409 - RNA, 21 nt, Human
cuccgcuuucuacccagcgag

SEQ ID NO: 2969410 - RNA, 19 nt, Human
cucccucuuucccucccuu

SEQ ID NO: 2969411 - RNA, 16 nt, Human
cucccucccucuuucc

SEQ ID NO: 2969412 - RNA, 15 nt, Human
cucccucuuucccuc

SEQ ID NO: 2969413 - RNA, 22 nt, Human
cuccagaauuucccaaagcagu

SEQ ID NO: 2969414 - RNA, 11 nt, Human
cuccagacaca

SEQ ID NO: 2969415 - RNA, 16 nt, Human
cuccagacacaugucc

SEQ ID NO: 2969416 - RNA, 17 nt, Human
cucagaaucucaaauaa

SEQ ID NO: 2969417 - RNA, 16 nt, Human
cucagaaucucaaaua

SEQ ID NO: 2969418 - RNA, 21 nt, Human
cuccagaauuucccaaagcag

SEQ ID NO: 2969419 - RNA, 22 nt, Human
cuccaggcuguaucccaugagc

SEQ ID NO: 2969420 - RNA, 23 nt, Human
cuccaggcuguaucccaugagcc

SEQ ID NO: 2969421 - RNA, 22 nt, Human
cuccaggugcacaagcuccaag

SEQ ID NO: 2969422 - RNA, 21 nt, Human
cuccagugagacagcucugca

SEQ ID NO: 2969423 - RNA, 19 nt, Human
cuccaggugcacaagcucc

SEQ ID NO: 2969424 - RNA, 20 nt, Human
cuccaggugcacaagcucca

SEQ ID NO: 2969425 - RNA, 18 nt, Human
cuccaggugcacaagcuc

SEQ ID NO: 2969426 - RNA, 16 nt, Human
cucccagccaggcccu

SEQ ID NO: 2969427 - RNA, 14 nt, Human
cucccagccaggcc

SEQ ID NO: 2969428 - RNA, 13 nt, Human
cucccagccaggc

SEQ ID NO: 2969429 - RNA, 11 nt, Human
cucccagccag

SEQ ID NO: 2969430 - RNA, 13 nt, Human
cucccaccucagc

SEQ ID NO: 2969431 - RNA, 17 nt, Human
cucccaccucagccucc

SEQ ID NO: 2969432 - RNA, 16 nt, Human
cucccaccucagccuc

SEQ ID NO: 2969433 - RNA, 14 nt, Human
cucccaccucagcc

SEQ ID NO: 2969434 - RNA, 22 nt, Human
cuccuuuagcgcccaguugggu

SEQ ID NO: 2969435 - RNA, 22 nt, Human
cuccuagccugugccucuggga

SEQ ID NO: 2969436 - RNA, 17 nt, Human
cuccuuuagcgcccagu

SEQ ID NO: 2969437 - RNA, 16 nt, Human
cuccuuuagcgcccag

SEQ ID NO: 2969438 - RNA, 23 nt, Human
cuccuuugugaggaagccgcugg

SEQ ID NO: 2969439 - RNA, 24 nt, Human
cuccuuuucacaguucucuccuuc

SEQ ID NO: 2969440 - RNA, 11 nt, Human
cucggugccuu

SEQ ID NO: 2969441 - RNA, 23 nt, Human
cucgguguggagaagcggcuggc

SEQ ID NO: 2969442 - RNA, 16 nt, Human
cucugcacaagcugca

SEQ ID NO: 2969443 - RNA, 10 nt, Human
cucuccucug

SEQ ID NO: 2969444 - RNA, 17 nt, Human
cucucuggccuucggcc

SEQ ID NO: 2969445 - RNA, 19 nt, Human
cucucuggccuucggccuc

SEQ ID NO: 2969446 - RNA, 13 nt, Human
cucucccuuggau

SEQ ID NO: 2969447 - RNA, 13 nt, Human
cucuccuccuuuu

SEQ ID NO: 2969448 - RNA, 20 nt, Human
cucuccuccuuuucacaguu

SEQ ID NO: 2969449 - RNA, 16 nt, Human
cucuccgaccagacac

SEQ ID NO: 2969450 - RNA, 17 nt, Human
cucacaauccuugccac

SEQ ID NO: 2969451 - RNA, 14 nt, Human
cucacaaaggaugc

SEQ ID NO: 2969452 - RNA, 12 nt, Human
cucaaauaacua

SEQ ID NO: 2969453 - RNA, 14 nt, Human
cucacacaugagca

SEQ ID NO: 2969454 - RNA, 21 nt, Human
cucacacaugagcaucaggcc

SEQ ID NO: 2969455 - RNA, 13 nt, Human
cucaaaacugcac

SEQ ID NO: 2969456 - RNA, 18 nt, Human
cucaaaaaaagaaaaaga

SEQ ID NO: 2969457 - RNA, 17 nt, Human
cucaaaaaaagaaaaag

SEQ ID NO: 2969458 - RNA, 17 nt, Human
cuauguugcccaggcag

SEQ ID NO: 2969459 - RNA, 16 nt, Human
cuauguugcccaggca

SEQ ID NO: 2969460 - RNA, 20 nt, Human
cuaucucccccagccccauc

SEQ ID NO: 2969461 - RNA, 19 nt, Human
cuauguaucaaugaguaac

SEQ ID NO: 2969462 - RNA, 18 nt, Human
cuaucucccccagcccca

SEQ ID NO: 2969463 - RNA, 17 nt, Human
cuaugugagcacaaagg

SEQ ID NO: 2969464 - RNA, 16 nt, Human
cuauguaucaaugagu

SEQ ID NO: 2969465 - RNA, 22 nt, Human
cuauguguagggcgggaggaug

SEQ ID NO: 2969466 - RNA, 15 nt, Human
cuauguugcccaggc

SEQ ID NO: 2969467 - RNA, 14 nt, Human
cuauguugcccagg

SEQ ID NO: 2969468 - RNA, 23 nt, Human
cucagaaaacaaggaugaauuaa

SEQ ID NO: 2969469 - RNA, 19 nt, Human
cucagaaaacaaggaugaa

SEQ ID NO: 2969470 - RNA, 18 nt, Human
cucacuuguuuuauuuaa

SEQ ID NO: 2969471 - RNA, 14 nt, Human
cucaccugccccuc

SEQ ID NO: 2969472 - RNA, 16 nt, Human
cucaccugccccucaa

SEQ ID NO: 2969473 - RNA, 18 nt, Human
cucaccugccccucaacu

SEQ ID NO: 2969474 - RNA, 13 nt, Human
cucaccugccccu

SEQ ID NO: 2969475 - RNA, 14 nt, Human
cucaccucucccuu

SEQ ID NO: 2969476 - RNA, 15 nt, Human
cucaccucucccuug

SEQ ID NO: 2969477 - RNA, 16 nt, Human
cucaccucucccuugg

SEQ ID NO: 2969478 - RNA, 17 nt, Human
cucaccucucccuugga

SEQ ID NO: 2969479 - RNA, 13 nt, Human
cucaccucucccu

SEQ ID NO: 2969480 - RNA, 15 nt, Human
cuaccugaggggccu

SEQ ID NO: 2969481 - RNA, 16 nt, Human
cuaccugaggggccuc

SEQ ID NO: 2969482 - RNA, 19 nt, Human
cuaccugaggggccucuua

SEQ ID NO: 2969483 - RNA, 23 nt, Human
cuaccugaggggccucuuauggg

SEQ ID NO: 2969484 - RNA, 20 nt, Human
cuacuaaaaaugcaaaaaaa

SEQ ID NO: 2969485 - RNA, 20 nt, Human
cuagcauacguacacauuuu

SEQ ID NO: 2969486 - RNA, 19 nt, Human
cuagcauacguacacauuu

SEQ ID NO: 2969487 - RNA, 18 nt, Human
cuagcauacguacacauu

SEQ ID NO: 2969488 - RNA, 16 nt, Human
cuagcauacguacaca

SEQ ID NO: 2969489 - RNA, 19 nt, Human
cuaggccuggccagaugca

SEQ ID NO: 2969490 - RNA, 18 nt, Human
cuaggccuggccagaugc

SEQ ID NO: 2969491 - RNA, 15 nt, Human
cuaggccuggccaga

SEQ ID NO: 2969492 - RNA, 14 nt, Human
cuaggccuggccag

SEQ ID NO: 2969493 - RNA, 12 nt, Human
cuaggccugggg

SEQ ID NO: 2969494 - RNA, 13 nt, Human
cuaggccugggga

SEQ ID NO: 2969495 - RNA, 13 nt, Human
cuaggccuggcca

SEQ ID NO: 2969496 - RNA, 19 nt, Human
cuagccagaggagagagga

SEQ ID NO: 2969497 - RNA, 17 nt, Human
cuagccagaggagagag

SEQ ID NO: 2969498 - RNA, 14 nt, Human
cuagggaagauaau

SEQ ID NO: 2969499 - RNA, 19 nt, Human
cuaguuugauuaaauucuu

SEQ ID NO: 2969500 - RNA, 17 nt, Human
cuaguuugauuaaauuc

SEQ ID NO: 2969501 - RNA, 20 nt, Human
cuaguuugauuaaauucuug

SEQ ID NO: 2969502 - RNA, 15 nt, Human
cuaguuugauuaaau

SEQ ID NO: 2969503 - RNA, 20 nt, Human
cgcuggggccaguugguccc

SEQ ID NO: 2969504 - RNA, 17 nt, Human
cgcuggggccaguuggu

SEQ ID NO: 2969505 - RNA, 16 nt, Human
cgcugccccuggcagc

SEQ ID NO: 2969506 - RNA, 17 nt, Human
cgcugccccuggcagcc

SEQ ID NO: 2969507 - RNA, 13 nt, Human
cgcugccccuggc

SEQ ID NO: 2969508 - RNA, 23 nt, Human
cgcuggaccuugaacuggguacu

SEQ ID NO: 2969509 - RNA, 19 nt, Human
cgcuggaccuugaacuggg

SEQ ID NO: 2969510 - RNA, 18 nt, Human
cgcugccccuggcagccc

SEQ ID NO: 2969511 - RNA, 16 nt, Human
cgccuuaaggauguuc

SEQ ID NO: 2969512 - RNA, 23 nt, Human
cggagaagagcuguucacagcca

SEQ ID NO: 2969513 - RNA, 24 nt, Human
cggagaagagcuguucacagccag

SEQ ID NO: 2969514 - RNA, 15 nt, Human
cggagacggaguccc

SEQ ID NO: 2969515 - RNA, 15 nt, Human
cgguuuauauaagcu

SEQ ID NO: 2969516 - RNA, 16 nt, Human
cguacacauuuuauuu

SEQ ID NO: 2969517 - RNA, 13 nt, Human
cguacacauuuua

SEQ ID NO: 2969518 - RNA, 13 nt, Human
cguuaaaauacca

SEQ ID NO: 2969519 - RNA, 15 nt, Human
cuaaagcugccagcc

SEQ ID NO: 2969520 - RNA, 16 nt, Human
cuaaaggcuaccuuug

SEQ ID NO: 2969521 - RNA, 15 nt, Human
cuaaaggcuaccuuu

SEQ ID NO: 2969522 - RNA, 14 nt, Human
cuaaagcugccagc

SEQ ID NO: 2969523 - RNA, 17 nt, Human
cuaaagaaguuugaaca

SEQ ID NO: 2969524 - RNA, 19 nt, Human
cuaaaguguauuuuuuuac

SEQ ID NO: 2969525 - RNA, 19 nt, Human
cuaaaggcuaccuuuguau

SEQ ID NO: 2969526 - RNA, 17 nt, Human
cuaaaggcuaccuuugu

SEQ ID NO: 2969527 - RNA, 22 nt, Human
cuaaaguguauuuuuuuacuaa

SEQ ID NO: 2969528 - RNA, 20 nt, Human
cccagcacaaagcagauccu

SEQ ID NO: 2969529 - RNA, 18 nt, Human
cccagcaauuaugaaaau

SEQ ID NO: 2969530 - RNA, 23 nt, Human
cccagcaagugagagcugggugu

SEQ ID NO: 2969531 - RNA, 16 nt, Human
cccagcaauuaugaaa

SEQ ID NO: 2969532 - RNA, 12 nt, Human
cccagccaggcc

SEQ ID NO: 2969533 - RNA, 14 nt, Human
cccagccaggcccu

SEQ ID NO: 2969534 - RNA, 24 nt, Human
cccagccagcaguucagagcugcc

SEQ ID NO: 2969535 - RNA, 15 nt, Human
cccaggaaaggcucc

SEQ ID NO: 2969536 - RNA, 16 nt, Human
cccaggaaaggcucca

SEQ ID NO: 2969537 - RNA, 20 nt, Human
cccauauuuguacaccaaua

SEQ ID NO: 2969538 - RNA, 17 nt, Human
cccaggaaaggcuccag

SEQ ID NO: 2969539 - RNA, 18 nt, Human
cccaggaaaggcuccagg

SEQ ID NO: 2969540 - RNA, 22 nt, Human
cccaggcuuagucacugagaca

SEQ ID NO: 2969541 - RNA, 21 nt, Human
cccauccucuguacagagccc

SEQ ID NO: 2969542 - RNA, 22 nt, Human
cccauccucuguacagagccca

SEQ ID NO: 2969543 - RNA, 14 nt, Human
ccccgcacugggcu

SEQ ID NO: 2969544 - RNA, 23 nt, Human
ccccgaggccuucucugaaggac

SEQ ID NO: 2969545 - RNA, 15 nt, Human
cccauucugccugcc

SEQ ID NO: 2969546 - RNA, 14 nt, Human
cccauucugccugc

SEQ ID NO: 2969547 - RNA, 19 nt, Human
cccauucugccugcccagg

SEQ ID NO: 2969548 - RNA, 15 nt, Human
cccauuugcuccuuu

SEQ ID NO: 2969549 - RNA, 20 nt, Human
ccccagauugcaacaggcug

SEQ ID NO: 2969550 - RNA, 15 nt, Human
ccccagauugcaaca

SEQ ID NO: 2969551 - RNA, 22 nt, Human
cccuccucugcuugccaucccu

SEQ ID NO: 2969552 - RNA, 13 nt, Human
cccuccucugcuu

SEQ ID NO: 2969553 - RNA, 13 nt, Human
ccccugcacucca

SEQ ID NO: 2969554 - RNA, 21 nt, Human
ccccugcacagcaggcugcca

SEQ ID NO: 2969555 - RNA, 16 nt, Human
ccccugcacagcaggc

SEQ ID NO: 2969556 - RNA, 15 nt, Human
ccccugcacagcagg

SEQ ID NO: 2969557 - RNA, 17 nt, Human
ccccugaauuuaaauag

SEQ ID NO: 2969558 - RNA, 15 nt, Human
ccccugacaacacuc

SEQ ID NO: 2969559 - RNA, 13 nt, Human
ccccugaauuuaa

SEQ ID NO: 2969560 - RNA, 16 nt, Human
ccccugccacccuggg

SEQ ID NO: 2969561 - RNA, 14 nt, Human
ccccugccacccug

SEQ ID NO: 2969562 - RNA, 23 nt, Human
ccccugcacagcaggcugccagu

SEQ ID NO: 2969563 - RNA, 22 nt, Human
ccccugcacagcaggcugccag

SEQ ID NO: 2969564 - RNA, 18 nt, Human
cccgggaagggggcuggg

SEQ ID NO: 2969565 - RNA, 21 nt, Human
cccgggaagggggcugggaca

SEQ ID NO: 2969566 - RNA, 16 nt, Human
cccucaacaccucugc

SEQ ID NO: 2969567 - RNA, 16 nt, Human
cccucaacucuccucc

SEQ ID NO: 2969568 - RNA, 18 nt, Human
cccgaauagcugggacua

SEQ ID NO: 2969569 - RNA, 17 nt, Human
cccgaauagcugggacu

SEQ ID NO: 2969570 - RNA, 16 nt, Human
cccgaauagcugggac

SEQ ID NO: 2969571 - RNA, 14 nt, Human
ccccuucugaccca

SEQ ID NO: 2969572 - RNA, 13 nt, Human
ccccuucugaccc

SEQ ID NO: 2969573 - RNA, 15 nt, Human
cccgggaagggggcu

SEQ ID NO: 2969574 - RNA, 12 nt, Human
cccgggaagggg

SEQ ID NO: 2969575 - RNA, 15 nt, Human
cccggccccugcugg

SEQ ID NO: 2969576 - RNA, 16 nt, Human
cccggccccugcuggu

SEQ ID NO: 2969577 - RNA, 21 nt, Human
ccagucauuauguuaauauuu

SEQ ID NO: 2969578 - RNA, 22 nt, Human
ccagucauuauguuaauauuuc

SEQ ID NO: 2969579 - RNA, 15 nt, Human
ccaguccugcccgcc

SEQ ID NO: 2969580 - RNA, 13 nt, Human
ccaguccugcccg

SEQ ID NO: 2969581 - RNA, 12 nt, Human
ccaguccugccc

SEQ ID NO: 2969582 - RNA, 14 nt, Human
ccaggcaggucuug

SEQ ID NO: 2969583 - RNA, 12 nt, Human
ccaggcaggucu

SEQ ID NO: 2969584 - RNA, 23 nt, Human
ccaggcaggucuugaacuccugg

SEQ ID NO: 2969585 - RNA, 12 nt, Human
ccaggcuggcgu

SEQ ID NO: 2969586 - RNA, 21 nt, Human
ccaggggaaaaucagccugcu

SEQ ID NO: 2969587 - RNA, 23 nt, Human
ccagccccuucugacccaugcug

SEQ ID NO: 2969588 - RNA, 24 nt, Human
ccagccccuucugacccaugcugc

SEQ ID NO: 2969589 - RNA, 23 nt, Human
ccagcuacucgggaggcugaggc

SEQ ID NO: 2969590 - RNA, 21 nt, Human
ccagcuacucgggaggcugag

SEQ ID NO: 2969591 - RNA, 12 nt, Human
ccagcagagcac

SEQ ID NO: 2969592 - RNA, 13 nt, Human
ccagcagagcacc

SEQ ID NO: 2969593 - RNA, 14 nt, Human
ccagcagagcaccu

SEQ ID NO: 2969594 - RNA, 17 nt, Human
ccagccccagugcccac

SEQ ID NO: 2969595 - RNA, 15 nt, Human
ccagccccauccucu

SEQ ID NO: 2969596 - RNA, 17 nt, Human
ccagccccauccucugu

SEQ ID NO: 2969597 - RNA, 23 nt, Human
ccagcacuuugggaggcugaggc

SEQ ID NO: 2969598 - RNA, 21 nt, Human
ccagcacuuugggaggcugag

SEQ ID NO: 2969599 - RNA, 16 nt, Human
ccauucuuggcccagg

SEQ ID NO: 2969600 - RNA, 15 nt, Human
cccaacucaccccag

SEQ ID NO: 2969601 - RNA, 16 nt, Human
cccaacucaccccagc

SEQ ID NO: 2969602 - RNA, 17 nt, Human
ccauuggggcucccagc

SEQ ID NO: 2969603 - RNA, 16 nt, Human
ccauuggggcucccag

SEQ ID NO: 2969604 - RNA, 15 nt, Human
ccauuggggcuccca

SEQ ID NO: 2969605 - RNA, 22 nt, Human
cccacugcuuuuggucugugug

SEQ ID NO: 2969606 - RNA, 23 nt, Human
cccacugcuuuuggucuguguga

SEQ ID NO: 2969607 - RNA, 21 nt, Human
cccacuccggcccuccagagc

SEQ ID NO: 2969608 - RNA, 19 nt, Human
cccacuccggcccuccaga

SEQ ID NO: 2969609 - RNA, 13 nt, Human
cccacucccugca

SEQ ID NO: 2969610 - RNA, 12 nt, Human
cccacucccugc

SEQ ID NO: 2969611 - RNA, 14 nt, Human
cccacuccggcccu

SEQ ID NO: 2969612 - RNA, 17 nt, Human
cccaacucaccccagcc

SEQ ID NO: 2969613 - RNA, 20 nt, Human
cccaacucaccccagcccca

SEQ ID NO: 2969614 - RNA, 13 nt, Human
cccaacuccagaa

SEQ ID NO: 2969615 - RNA, 20 nt, Human
cccaagacucccaugaggga

SEQ ID NO: 2969616 - RNA, 16 nt, Human
cccaagacucccauga

SEQ ID NO: 2969617 - RNA, 12 nt, Human
cccaagcucugc

SEQ ID NO: 2969618 - RNA, 14 nt, Human
cccaagcucugcuc

SEQ ID NO: 2969619 - RNA, 13 nt, Human
cccaagcucugcu

SEQ ID NO: 2969620 - RNA, 22 nt, Human
ccauccccuguagagugggagc

SEQ ID NO: 2969621 - RNA, 21 nt, Human
ccaucccauaugccugggcag

SEQ ID NO: 2969622 - RNA, 13 nt, Human
ccaucccucccuc

SEQ ID NO: 2969623 - RNA, 19 nt, Human
ccaucccauaugccugggc

SEQ ID NO: 2969624 - RNA, 20 nt, Human
ccaucccauaugccugggca

SEQ ID NO: 2969625 - RNA, 20 nt, Human
ccaucccaaacccuucagug

SEQ ID NO: 2969626 - RNA, 19 nt, Human
ccauccagguucagcuugu

SEQ ID NO: 2969627 - RNA, 18 nt, Human
ccauccagguucagcuug

SEQ ID NO: 2969628 - RNA, 18 nt, Human
ccaguuggucccccuucc

SEQ ID NO: 2969629 - RNA, 20 nt, Human
ccaguuggucccccuuccau

SEQ ID NO: 2969630 - RNA, 16 nt, Human
ccauaagcuacugcca

SEQ ID NO: 2969631 - RNA, 21 nt, Human
ccauaagcuacugccauccug

SEQ ID NO: 2969632 - RNA, 18 nt, Human
ccauaagcuacugccauc

SEQ ID NO: 2969633 - RNA, 17 nt, Human
ccauaagcuacugccau

SEQ ID NO: 2969634 - RNA, 13 nt, Human
ccaguuggucccc

SEQ ID NO: 2969635 - RNA, 23 nt, Human
ccaguuggguggaugccuggugg

SEQ ID NO: 2969636 - RNA, 22 nt, Human
ccaguuggagcagaugccuccc

SEQ ID NO: 2969637 - RNA, 20 nt, Human
ccaugaggaacaaggcaagg

SEQ ID NO: 2969638 - RNA, 15 nt, Human
ccaucccucccucca

SEQ ID NO: 2969639 - RNA, 14 nt, Human
ccaucccucccucc

SEQ ID NO: 2969640 - RNA, 23 nt, Human
ccaugaggaacaaggcaaggcug

SEQ ID NO: 2969641 - RNA, 17 nt, Human
ccaugagggagaugcca

SEQ ID NO: 2969642 - RNA, 18 nt, Human
ccaugaguccccuguuug

SEQ ID NO: 2969643 - RNA, 21 nt, Human
ccaugagggagaugccaugag

SEQ ID NO: 2969644 - RNA, 20 nt, Human
ccaugagggagaugccauga

SEQ ID NO: 2969645 - RNA, 19 nt, Human
ccaugagggagaugccaug

SEQ ID NO: 2969646 - RNA, 18 nt, Human
ccaugagggagaugccau

SEQ ID NO: 2969647 - RNA, 23 nt, Human
ccaugagggagaugccaugagcc

SEQ ID NO: 2969648 - RNA, 15 nt, Human
ccuaauaaaaaggug

SEQ ID NO: 2969649 - RNA, 16 nt, Human
ccuaauaaaaagguga

SEQ ID NO: 2969650 - RNA, 20 nt, Human
ccuaauaaaaaggugaccau

SEQ ID NO: 2969651 - RNA, 14 nt, Human
ccuaauaaaaaggu

SEQ ID NO: 2969652 - RNA, 12 nt, Human
ccuaauguguuu

SEQ ID NO: 2969653 - RNA, 21 nt, Human
ccuagcauacguacacauuuu

SEQ ID NO: 2969654 - RNA, 23 nt, Human
ccuagccugugccucugggacug

SEQ ID NO: 2969655 - RNA, 19 nt, Human
ccuagccuuagaagucaca

SEQ ID NO: 2969656 - RNA, 22 nt, Human
ccuagccuuagaagucacacag

SEQ ID NO: 2969657 - RNA, 18 nt, Human
ccggccaccugcggugcu

SEQ ID NO: 2969658 - RNA, 17 nt, Human
ccggccaccugcggugc

SEQ ID NO: 2969659 - RNA, 14 nt, Human
cccuucucuccagc

SEQ ID NO: 2969660 - RNA, 19 nt, Human
cccuucucuccagccccug

SEQ ID NO: 2969661 - RNA, 21 nt, Human
cccuuuuuuggcugcugaagg

SEQ ID NO: 2969662 - RNA, 22 nt, Human
cccuuuuuuggcugcugaaggc

SEQ ID NO: 2969663 - RNA, 23 nt, Human
cccuuuuuuggcugcugaaggcu

SEQ ID NO: 2969664 - RNA, 23 nt, Human
cccugugaguacuacaguccucc

SEQ ID NO: 2969665 - RNA, 15 nt, Human
cccugugauggggcc

SEQ ID NO: 2969666 - RNA, 21 nt, Human
cccugugaguacuacaguccu

SEQ ID NO: 2969667 - RNA, 14 nt, Human
cccuccuuucacca

SEQ ID NO: 2969668 - RNA, 19 nt, Human
cccuguggaugcugcugcc

SEQ ID NO: 2969669 - RNA, 14 nt, Human
ccgcagcccugcag

SEQ ID NO: 2969670 - RNA, 18 nt, Human
ccgcagcccugcagaggg

SEQ ID NO: 2969671 - RNA, 23 nt, Human
ccgcagcccugcagagggcacag

SEQ ID NO: 2969672 - RNA, 12 nt, Human
ccucggagaaga

SEQ ID NO: 2969673 - RNA, 14 nt, Human
ccucggagaagagc

SEQ ID NO: 2969674 - RNA, 22 nt, Human
ccucggaccccacuccggcccu

SEQ ID NO: 2969675 - RNA, 20 nt, Human
ccucggaccccacuccggcc

SEQ ID NO: 2969676 - RNA, 18 nt, Human
ccuccuuuucacaguucu

SEQ ID NO: 2969677 - RNA, 23 nt, Human
ccuccuuugugaggaagccgcug

SEQ ID NO: 2969678 - RNA, 16 nt, Human
ccucccuucucuucac

SEQ ID NO: 2969679 - RNA, 14 nt, Human
ccuccgccucuugg

SEQ ID NO: 2969680 - RNA, 13 nt, Human
ccuccgccucuug

SEQ ID NO: 2969681 - RNA, 16 nt, Human
ccucaacaccucugca

SEQ ID NO: 2969682 - RNA, 21 nt, Human
ccucaacucuccuccagaguc

SEQ ID NO: 2969683 - RNA, 23 nt, Human
ccucaacucuccuccagagucag

SEQ ID NO: 2969684 - RNA, 19 nt, Human
ccucaacucuccuccagag

SEQ ID NO: 2969685 - RNA, 15 nt, Human
ccucaaccuccuggg

SEQ ID NO: 2969686 - RNA, 18 nt, Human
ccucauuagcauuuugcu

SEQ ID NO: 2969687 - RNA, 10 nt, Human
ccucaggccu

SEQ ID NO: 2969688 - RNA, 12 nt, Human
ccucaggcaggu

SEQ ID NO: 2969689 - RNA, 18 nt, Human
ccucaggcaggugggaug

SEQ ID NO: 2969690 - RNA, 20 nt, Human
ccucaagugauucuccugcc

SEQ ID NO: 2969691 - RNA, 23 nt, Human
ccucaagugauucuccugccuca

SEQ ID NO: 2969692 - RNA, 17 nt, Human
ccucccaucacccgcua

SEQ ID NO: 2969693 - RNA, 17 nt, Human
ccuccaagaccuucucc

SEQ ID NO: 2969694 - RNA, 19 nt, Human
ccuccaagaccuucuccuu

SEQ ID NO: 2969695 - RNA, 16 nt, Human
ccuccaagaccuucuc

SEQ ID NO: 2969696 - RNA, 12 nt, Human
ccucccaucacc

SEQ ID NO: 2969697 - RNA, 17 nt, Human
ccugucucuacuaaaaa

SEQ ID NO: 2969698 - RNA, 14 nt, Human
ccuggaugcccccu

SEQ ID NO: 2969699 - RNA, 18 nt, Human
ccuggaugccauccaagu

SEQ ID NO: 2969700 - RNA, 14 nt, Human
ccuggaugccaucc

SEQ ID NO: 2969701 - RNA, 13 nt, Human
ccuggaugccauc

SEQ ID NO: 2969702 - RNA, 15 nt, Human
ccuggauggggcugc

SEQ ID NO: 2969703 - RNA, 17 nt, Human
ccuggauggggcugcac

SEQ ID NO: 2969704 - RNA, 18 nt, Human
ccuggauggggcugcacc

SEQ ID NO: 2969705 - RNA, 18 nt, Human
ccuggaugcccccugugg

SEQ ID NO: 2969706 - RNA, 16 nt, Human
ccuggaugcccccugu

SEQ ID NO: 2969707 - RNA, 19 nt, Human
ccuggaugcccccugugga

SEQ ID NO: 2969708 - RNA, 16 nt, Human
ccuggccccucagggu

SEQ ID NO: 2969709 - RNA, 18 nt, Human
ccuggccccucagggucc

SEQ ID NO: 2969710 - RNA, 20 nt, Human
ccuggccccucagggucccu

SEQ ID NO: 2969711 - RNA, 21 nt, Human
ccuggccccucagggucccug

SEQ ID NO: 2969712 - RNA, 22 nt, Human
ccuggccucaagugauucuccu

SEQ ID NO: 2969713 - RNA, 20 nt, Human
ccuggccugagcugggauga

SEQ ID NO: 2969714 - RNA, 19 nt, Human
ccugguggcagugggagcu

SEQ ID NO: 2969715 - RNA, 18 nt, Human
ccugguggcagugggagc

SEQ ID NO: 2969716 - RNA, 15 nt, Human
ccugguggcaguggg

SEQ ID NO: 2969717 - RNA, 20 nt, Human
ccugguggcagugggagcug

SEQ ID NO: 2969718 - RNA, 13 nt, Human
ccugguguggaag

SEQ ID NO: 2969719 - RNA, 15 nt, Human
ccuggggagaaagua

SEQ ID NO: 2969720 - RNA, 15 nt, Human
ccugggcuacaagga

SEQ ID NO: 2969721 - RNA, 15 nt, Human
ccucuuugagugaag

SEQ ID NO: 2969722 - RNA, 19 nt, Human
ccucuuucccucccuuccu

SEQ ID NO: 2969723 - RNA, 16 nt, Human
ccucuuucccucccuu

SEQ ID NO: 2969724 - RNA, 12 nt, Human
ccugcaggcagc

SEQ ID NO: 2969725 - RNA, 13 nt, Human
ccugcaggcagcc

SEQ ID NO: 2969726 - RNA, 14 nt, Human
ccugcaggcagcca

SEQ ID NO: 2969727 - RNA, 15 nt, Human
ccugcccaccuggcc

SEQ ID NO: 2969728 - RNA, 17 nt, Human
ccugcccaccuggccuc

SEQ ID NO: 2969729 - RNA, 18 nt, Human
ccugcccaccuggccucu

SEQ ID NO: 2969730 - RNA, 19 nt, Human
ccugcccaccuggccucug

SEQ ID NO: 2969731 - RNA, 19 nt, Human
ccugcccaggccccugcca

SEQ ID NO: 2969732 - RNA, 18 nt, Human
ccugcccaggccccugcc

SEQ ID NO: 2969733 - RNA, 21 nt, Human
ccugcccaggccccugccacc

SEQ ID NO: 2969734 - RNA, 15 nt, Human
ccugccucagccucc

SEQ ID NO: 2969735 - RNA, 16 nt, Human
ccugccucagccuccc

SEQ ID NO: 2969736 - RNA, 23 nt, Human
caauugaaguaaaauguggcagg

SEQ ID NO: 2969737 - RNA, 15 nt, Human
caaugggagcucaug

SEQ ID NO: 2969738 - RNA, 17 nt, Human
cacaagagcccaggccu

SEQ ID NO: 2969739 - RNA, 20 nt, Human
cacaagagcccaggccuccu

SEQ ID NO: 2969740 - RNA, 18 nt, Human
cacaagcuccaagcuccc

SEQ ID NO: 2969741 - RNA, 19 nt, Human
cacaagcuccaagcuccca

SEQ ID NO: 2969742 - RNA, 18 nt, Human
cacaagagcccaggccuc

SEQ ID NO: 2969743 - RNA, 19 nt, Human
cacaagagcccaggccucc

SEQ ID NO: 2969744 - RNA, 13 nt, Human
caaugcuggcugu

SEQ ID NO: 2969745 - RNA, 21 nt, Human
caaugcuggcuguuggcuggg

SEQ ID NO: 2969746 - RNA, 20 nt, Human
caaugcuggcuguuggcugg

SEQ ID NO: 2969747 - RNA, 12 nt, Human
caaugcuggcug

SEQ ID NO: 2969748 - RNA, 16 nt, Human
caauggcagccuuggc

SEQ ID NO: 2969749 - RNA, 13 nt, Human
caaucaugucagu

SEQ ID NO: 2969750 - RNA, 20 nt, Human
cacaagcuccaagcucccag

SEQ ID NO: 2969751 - RNA, 21 nt, Human
cacaagcuccaagcucccagg

SEQ ID NO: 2969752 - RNA, 15 nt, Human
caauaaaauggguuu

SEQ ID NO: 2969753 - RNA, 23 nt, Human
caauaaaauccauacauuugugu

SEQ ID NO: 2969754 - RNA, 20 nt, Human
caauaaaauccauacauuug

SEQ ID NO: 2969755 - RNA, 12 nt, Human
caaguuugaauu

SEQ ID NO: 2969756 - RNA, 21 nt, Human
caagucagucauucagauaug

SEQ ID NO: 2969757 - RNA, 21 nt, Human
caaggccugucagcuaaagaa

SEQ ID NO: 2969758 - RNA, 18 nt, Human
caaggccuuccccuggca

SEQ ID NO: 2969759 - RNA, 21 nt, Human
caaggccuuccccuggcacug

SEQ ID NO: 2969760 - RNA, 18 nt, Human
caaggcaaggcugucaau

SEQ ID NO: 2969761 - RNA, 17 nt, Human
caaggcaaggcugucaa

SEQ ID NO: 2969762 - RNA, 16 nt, Human
caaggcaaggcuguca

SEQ ID NO: 2969763 - RNA, 19 nt, Human
caaggccaaaggaagcaca

SEQ ID NO: 2969764 - RNA, 20 nt, Human
caaggccaaaggaagcacau

SEQ ID NO: 2969765 - RNA, 21 nt, Human
caaggccaaaggaagcacaug

SEQ ID NO: 2969766 - RNA, 13 nt, Human
cacagaagaugaa

SEQ ID NO: 2969767 - RNA, 14 nt, Human
cacagacccugccc

SEQ ID NO: 2969768 - RNA, 16 nt, Human
cacagacccugcccug

SEQ ID NO: 2969769 - RNA, 17 nt, Human
cacagacccugcccugu

SEQ ID NO: 2969770 - RNA, 18 nt, Human
cacagacccugcccugug

SEQ ID NO: 2969771 - RNA, 14 nt, Human
cacagcucuguccu

SEQ ID NO: 2969772 - RNA, 11 nt, Human
cacagcucugu

SEQ ID NO: 2969773 - RNA, 18 nt, Human
cacagcucuguccuggga

SEQ ID NO: 2969774 - RNA, 16 nt, Human
cacagcucuguccugg

SEQ ID NO: 2969775 - RNA, 15 nt, Human
cacagcucuguccug

SEQ ID NO: 2969776 - RNA, 15 nt, Human
cacagcucuucucca

SEQ ID NO: 2969777 - RNA, 14 nt, Human
cacagcucuucucc

SEQ ID NO: 2969778 - RNA, 17 nt, Human
cacagcucuucuccagg

SEQ ID NO: 2969779 - RNA, 20 nt, Human
cacacauuuuuuaaaugcac

SEQ ID NO: 2969780 - RNA, 19 nt, Human
cacacauuuuuuaaaugca

SEQ ID NO: 2969781 - RNA, 16 nt, Human
cacacauuuuuuaaau

SEQ ID NO: 2969782 - RNA, 12 nt, Human
cacacauuuuuu

SEQ ID NO: 2969783 - RNA, 11 nt, Human
cacacauuuuu

SEQ ID NO: 2969784 - RNA, 10 nt, Human
cacacauuuu

SEQ ID NO: 2969785 - RNA, 19 nt, Human
cacacuuuggcccagggug

SEQ ID NO: 2969786 - RNA, 18 nt, Human
cacacuuuggcccagggu

SEQ ID NO: 2969787 - RNA, 15 nt, Human
cacacuuuggcccag

SEQ ID NO: 2969788 - RNA, 18 nt, Human
cacccaggaacuccugac

SEQ ID NO: 2969789 - RNA, 16 nt, Human
cacccaggagccccga

SEQ ID NO: 2969790 - RNA, 18 nt, Human
cacccaccucagccuccc

SEQ ID NO: 2969791 - RNA, 17 nt, Human
cacccaccucagccucc

SEQ ID NO: 2969792 - RNA, 13 nt, Human
caccagccccagu

SEQ ID NO: 2969793 - RNA, 16 nt, Human
caccagccccagugcc

SEQ ID NO: 2969794 - RNA, 15 nt, Human
cacaucuguuuugua

SEQ ID NO: 2969795 - RNA, 21 nt, Human
cacauuuuauuuuauuaugca

SEQ ID NO: 2969796 - RNA, 20 nt, Human
cacauuuuauuuuauuaugc

SEQ ID NO: 2969797 - RNA, 19 nt, Human
cacauuuuauuuuauuaug

SEQ ID NO: 2969798 - RNA, 17 nt, Human
cacauuuuauuuuauua

SEQ ID NO: 2969799 - RNA, 16 nt, Human
caccaacgucugugcc

SEQ ID NO: 2969800 - RNA, 14 nt, Human
caccaacgucugug

SEQ ID NO: 2969801 - RNA, 23 nt, Human
cacaucuaguaguuguucugaaa

SEQ ID NO: 2969802 - RNA, 22 nt, Human
cacaucuaguaguuguucugaa

SEQ ID NO: 2969803 - RNA, 15 nt, Human
cacuuaaaaaugguu

SEQ ID NO: 2969804 - RNA, 19 nt, Human
cacuguugcccaggcuggc

SEQ ID NO: 2969805 - RNA, 18 nt, Human
cacuguugcccaggcugg

SEQ ID NO: 2969806 - RNA, 23 nt, Human
cacuguugcccaggcuggcgugc

SEQ ID NO: 2969807 - RNA, 18 nt, Human
cacuggguguaaacacau

SEQ ID NO: 2969808 - RNA, 14 nt, Human
cacugcagccucaa

SEQ ID NO: 2969809 - RNA, 19 nt, Human
cacugcagccucaaccucc

SEQ ID NO: 2969810 - RNA, 23 nt, Human
cacugcagccucaaccuccuggg

SEQ ID NO: 2969811 - RNA, 22 nt, Human
cacugcagccucaaccuccugg

SEQ ID NO: 2969812 - RNA, 21 nt, Human
cacugcagccucaaccuccug

SEQ ID NO: 2969813 - RNA, 20 nt, Human
cacugcagccucaaccuccu

SEQ ID NO: 2969814 - RNA, 17 nt, Human
cacugccaugccagcuu

SEQ ID NO: 2969815 - RNA, 18 nt, Human
cacuuguguuaugaagca

SEQ ID NO: 2969816 - RNA, 13 nt, Human
cacuuuaaaacac

SEQ ID NO: 2969817 - RNA, 16 nt, Human
cacuuucuagccagag

SEQ ID NO: 2969818 - RNA, 17 nt, Human
cacuuucuagccagagg

SEQ ID NO: 2969819 - RNA, 13 nt, Human
cacuuucuagcca

SEQ ID NO: 2969820 - RNA, 17 nt, Human
cagaacagugauuacca

SEQ ID NO: 2969821 - RNA, 12 nt, Human
cagaacagugau

SEQ ID NO: 2969822 - RNA, 11 nt, Human
cagaacaguga

SEQ ID NO: 2969823 - RNA, 14 nt, Human
cagaaguuucugcc

SEQ ID NO: 2969824 - RNA, 16 nt, Human
cagaaguuucugccgc

SEQ ID NO: 2969825 - RNA, 16 nt, Human
cagaaauguacagcaa

SEQ ID NO: 2969826 - RNA, 12 nt, Human
cacuccagccug

SEQ ID NO: 2969827 - RNA, 13 nt, Human
cacuccagccuga

SEQ ID NO: 2969828 - RNA, 21 nt, Human
cacuacauucuguuaaucauu

SEQ ID NO: 2969829 - RNA, 17 nt, Human
cacuacauucuguuaau

SEQ ID NO: 2969830 - RNA, 16 nt, Human
cacuacauucuguuaa

SEQ ID NO: 2969831 - RNA, 23 nt, Human
cacuccagccugagcgacaguga

SEQ ID NO: 2969832 - RNA, 14 nt, Human
cacuccagccuggg

SEQ ID NO: 2969833 - RNA, 13 nt, Human
cacuccagccugg

SEQ ID NO: 2969834 - RNA, 20 nt, Human
cacucugucgcccagucugg

SEQ ID NO: 2969835 - RNA, 13 nt, Human
cacggccaggcca

SEQ ID NO: 2969836 - RNA, 12 nt, Human
cacggccaggcc

SEQ ID NO: 2969837 - RNA, 17 nt, Human
cacggccaggccagagg

SEQ ID NO: 2969838 - RNA, 14 nt, Human
cacggcucacugca

SEQ ID NO: 2969839 - RNA, 22 nt, Human
cacucuuauugcccacgcugga

SEQ ID NO: 2969840 - RNA, 21 nt, Human
cacucuuauugcccacgcugg

SEQ ID NO: 2969841 - RNA, 20 nt, Human
cacucuuauugcccacgcug

SEQ ID NO: 2969842 - RNA, 16 nt, Human
caccuuggcugcaggg

SEQ ID NO: 2969843 - RNA, 15 nt, Human
caccuuggcugcagg

SEQ ID NO: 2969844 - RNA, 18 nt, Human
caccuuggcugcagggag

SEQ ID NO: 2969845 - RNA, 14 nt, Human
caccuuucccaucu

SEQ ID NO: 2969846 - RNA, 19 nt, Human
caccuuuuucauacaaggc

SEQ ID NO: 2969847 - RNA, 21 nt, Human
caccuuuuucauacaaggccc

SEQ ID NO: 2969848 - RNA, 13 nt, Human
auuuuaugucuuu

SEQ ID NO: 2969849 - RNA, 21 nt, Human
auuuuauaucaauuuaaaaaa

SEQ ID NO: 2969850 - RNA, 19 nt, Human
auuuuagggguagcauuug

SEQ ID NO: 2969851 - RNA, 15 nt, Human
auuuugaaauuguuu

SEQ ID NO: 2969852 - RNA, 13 nt, Human
auuuugaaauugu

SEQ ID NO: 2969853 - RNA, 19 nt, Human
auuuuuaagugcugcauuu

SEQ ID NO: 2969854 - RNA, 18 nt, Human
auuuuuaagugcugcauu

SEQ ID NO: 2969855 - RNA, 16 nt, Human
auuuuuaagugcugca

SEQ ID NO: 2969856 - RNA, 14 nt, Human
auuuuuagacagag

SEQ ID NO: 2969857 - RNA, 17 nt, Human
caaacagucucccuucc

SEQ ID NO: 2969858 - RNA, 16 nt, Human
caaacagucucaggaa

SEQ ID NO: 2969859 - RNA, 17 nt, Human
caaacagucucaggaaa

SEQ ID NO: 2969860 - RNA, 21 nt, Human
caaaaggauaaugaauacuuu

SEQ ID NO: 2969861 - RNA, 15 nt, Human
caaacagucucagga

SEQ ID NO: 2969862 - RNA, 24 nt, Human
caaacccaguguuuuaggagcaug

SEQ ID NO: 2969863 - RNA, 15 nt, Human
auuuuuauauuugaa

SEQ ID NO: 2969864 - RNA, 18 nt, Human
auuuuuuuuuccuucagu

SEQ ID NO: 2969865 - RNA, 16 nt, Human
auuuuuuugagacaga

SEQ ID NO: 2969866 - RNA, 20 nt, Human
auuuuuuuuuccuucagugc

SEQ ID NO: 2969867 - RNA, 22 nt, Human
auuuuuuuuuccuucagugccu

SEQ ID NO: 2969868 - RNA, 19 nt, Human
caaaagcugggcagguugg

SEQ ID NO: 2969869 - RNA, 18 nt, Human
caagaccacguuucuaaa

SEQ ID NO: 2969870 - RNA, 17 nt, Human
caagaccacguuucuaa

SEQ ID NO: 2969871 - RNA, 19 nt, Human
caagacccaaaaggcagaa

SEQ ID NO: 2969872 - RNA, 14 nt, Human
caacucuccuccag

SEQ ID NO: 2969873 - RNA, 22 nt, Human
caagaauugaagcaggacuaaa

SEQ ID NO: 2969874 - RNA, 17 nt, Human
caacucauauuuucaug

SEQ ID NO: 2969875 - RNA, 17 nt, Human
caacucaccccagcccc

SEQ ID NO: 2969876 - RNA, 18 nt, Human
caacucaccccagcccca

SEQ ID NO: 2969877 - RNA, 16 nt, Human
caaagauauuuugcuu

SEQ ID NO: 2969878 - RNA, 14 nt, Human
caaagauauuuugc

SEQ ID NO: 2969879 - RNA, 18 nt, Human
caaagcagugcaugcugu

SEQ ID NO: 2969880 - RNA, 21 nt, Human
caaagcagugcaugcuguccc

SEQ ID NO: 2969881 - RNA, 22 nt, Human
caaagcagugcaugcugucccu

SEQ ID NO: 2969882 - RNA, 21 nt, Human
caaaguaucccuacuguaauu

SEQ ID NO: 2969883 - RNA, 19 nt, Human
caaaguaucccuacuguaa

SEQ ID NO: 2969884 - RNA, 17 nt, Human
caaaguagaucaugcau

SEQ ID NO: 2969885 - RNA, 22 nt, Human
caaaguagaagucuuagaugua

SEQ ID NO: 2969886 - RNA, 20 nt, Human
caaaguagaucaugcauaga

SEQ ID NO: 2969887 - RNA, 21 nt, Human
caaaucuuaacuugaaggagu

SEQ ID NO: 2969888 - RNA, 21 nt, Human
caaaucugcuuuuuaaagaau

SEQ ID NO: 2969889 - RNA, 23 nt, Human
caaaugcuguaacuuucugaaau

SEQ ID NO: 2969890 - RNA, 13 nt, Human
auuaaaugacucu

SEQ ID NO: 2969891 - RNA, 12 nt, Human
auuaaaugacuc

SEQ ID NO: 2969892 - RNA, 17 nt, Human
auuaaaugcccagcccc

SEQ ID NO: 2969893 - RNA, 19 nt, Human
auuaaaugcccagccccuu

SEQ ID NO: 2969894 - RNA, 20 nt, Human
auuaugaauuacauuuguau

SEQ ID NO: 2969895 - RNA, 19 nt, Human
auuaugaauuacauuugua

SEQ ID NO: 2969896 - RNA, 22 nt, Human
auuaugaauuacauuuguauaa

SEQ ID NO: 2969897 - RNA, 18 nt, Human
auucaacagguuuuccug

SEQ ID NO: 2969898 - RNA, 16 nt, Human
auucaaaugucuauaa

SEQ ID NO: 2969899 - RNA, 18 nt, Human
auucaaauguauuacagu

SEQ ID NO: 2969900 - RNA, 14 nt, Human
auuauggaaacaga

SEQ ID NO: 2969901 - RNA, 16 nt, Human
auucuugcaaaguauc

SEQ ID NO: 2969902 - RNA, 15 nt, Human
auucuugcaaaguau

SEQ ID NO: 2969903 - RNA, 14 nt, Human
auucuugcaaagua

SEQ ID NO: 2969904 - RNA, 14 nt, Human
auucuucugcuuca

SEQ ID NO: 2969905 - RNA, 22 nt, Human
auucuucuguacgucugacagg

SEQ ID NO: 2969906 - RNA, 20 nt, Human
auucuucugcuucagccucc

SEQ ID NO: 2969907 - RNA, 19 nt, Human
auucuucugcuucagccuc

SEQ ID NO: 2969908 - RNA, 18 nt, Human
auucucuaguuugauuaa

SEQ ID NO: 2969909 - RNA, 17 nt, Human
auucucuaguuugauua

SEQ ID NO: 2969910 - RNA, 22 nt, Human
auucuccuuguguuacuaaguu

SEQ ID NO: 2969911 - RNA, 21 nt, Human
auucuccuuguguuacuaagu

SEQ ID NO: 2969912 - RNA, 19 nt, Human
auucuccuuguguuacuaa

SEQ ID NO: 2969913 - RNA, 18 nt, Human
auucuccuuguguuacua

SEQ ID NO: 2969914 - RNA, 17 nt, Human
auucuccuuguguuacu

SEQ ID NO: 2969915 - RNA, 15 nt, Human
auuguuuaaaaucau

SEQ ID NO: 2969916 - RNA, 16 nt, Human
auuguugucugcaacu

SEQ ID NO: 2969917 - RNA, 18 nt, Human
auugcuugagcucaggag

SEQ ID NO: 2969918 - RNA, 16 nt, Human
auuuaauaaaugugcc

SEQ ID NO: 2969919 - RNA, 21 nt, Human
auuuaaugaaagacuguacaa

SEQ ID NO: 2969920 - RNA, 20 nt, Human
auuuaaugaaagacuguaca

SEQ ID NO: 2969921 - RNA, 15 nt, Human
auuuaaugaaagacu

SEQ ID NO: 2969922 - RNA, 16 nt, Human
auuuaaugaaagacug

SEQ ID NO: 2969923 - RNA, 14 nt, Human
auuucuaugaaaua

SEQ ID NO: 2969924 - RNA, 20 nt, Human
auuucauaccuaucaucuua

SEQ ID NO: 2969925 - RNA, 13 nt, Human
cauuaguuuugaa

SEQ ID NO: 2969926 - RNA, 13 nt, Human
cauuaucucaaaa

SEQ ID NO: 2969927 - RNA, 23 nt, Human
cauuaucuagauacuguaucaug

SEQ ID NO: 2969928 - RNA, 12 nt, Human
cauuaucucaaa

SEQ ID NO: 2969929 - RNA, 16 nt, Human
cauuagguugugaaug

SEQ ID NO: 2969930 - RNA, 15 nt, Human
cauuagguugugaau

SEQ ID NO: 2969931 - RNA, 14 nt, Human
cauuagguugugaa

SEQ ID NO: 2969932 - RNA, 22 nt, Human
cauuaggugugacugaauuucu

SEQ ID NO: 2969933 - RNA, 19 nt, Human
cauguccaagaagcccagg

SEQ ID NO: 2969934 - RNA, 20 nt, Human
cauguccaagaagcccagga

SEQ ID NO: 2969935 - RNA, 18 nt, Human
cauguccaagaagcccag

SEQ ID NO: 2969936 - RNA, 13 nt, Human
cauguuggccagg

SEQ ID NO: 2969937 - RNA, 12 nt, Human
cauguuggccag

SEQ ID NO: 2969938 - RNA, 12 nt, Human
cauuccuguucc

SEQ ID NO: 2969939 - RNA, 14 nt, Human
caugucagacacag

SEQ ID NO: 2969940 - RNA, 13 nt, Human
caugucagacaca

SEQ ID NO: 2969941 - RNA, 22 nt, Human
caugauuaaccacuucagcuga

SEQ ID NO: 2969942 - RNA, 23 nt, Human
caugauuaaccacuucagcugac

SEQ ID NO: 2969943 - RNA, 24 nt, Human
caugauuaaccacuucagcugacu

SEQ ID NO: 2969944 - RNA, 12 nt, Human
caugcugcccug

SEQ ID NO: 2969945 - RNA, 13 nt, Human
caugcugcccugu

SEQ ID NO: 2969946 - RNA, 13 nt, Human
caugcuccuggcc

SEQ ID NO: 2969947 - RNA, 16 nt, Human
caugcacgugugugca

SEQ ID NO: 2969948 - RNA, 23 nt, Human
caugaaguaauaugcacacauuu

SEQ ID NO: 2969949 - RNA, 22 nt, Human
caugaaguaauaugcacacauu

SEQ ID NO: 2969950 - RNA, 19 nt, Human
caugaaguaauaugcacac

SEQ ID NO: 2969951 - RNA, 15 nt, Human
caugaaguaauaugc

SEQ ID NO: 2969952 - RNA, 21 nt, Human
caugacacgaauauugcugau

SEQ ID NO: 2969953 - RNA, 23 nt, Human
caugacacgaauauugcugaugg

SEQ ID NO: 2969954 - RNA, 14 nt, Human
caugcugcccugug

SEQ ID NO: 2969955 - RNA, 15 nt, Human
caugcugcccuguga

SEQ ID NO: 2969956 - RNA, 18 nt, Human
cauagcugugauuuuugg

SEQ ID NO: 2969957 - RNA, 15 nt, Human
cauagcugugauuuu

SEQ ID NO: 2969958 - RNA, 13 nt, Human
cauagcugugauu

SEQ ID NO: 2969959 - RNA, 22 nt, Human
cauagcagagaaugaaagggcc

SEQ ID NO: 2969960 - RNA, 19 nt, Human
cauagcagagaaugaaagg

SEQ ID NO: 2969961 - RNA, 22 nt, Human
cauaugccugggcagaaggaag

SEQ ID NO: 2969962 - RNA, 13 nt, Human
cauaugccugggc

SEQ ID NO: 2969963 - RNA, 15 nt, Human
cauaugccugggcag

SEQ ID NO: 2969964 - RNA, 20 nt, Human
cauaugccugggcagaagga

SEQ ID NO: 2969965 - RNA, 20 nt, Human
cauauucaggaagcucaggg

SEQ ID NO: 2969966 - RNA, 14 nt, Human
cauauucaggaagc

SEQ ID NO: 2969967 - RNA, 15 nt, Human
cauauucaggaagcu

SEQ ID NO: 2969968 - RNA, 15 nt, Human
caucaggccaggccc

SEQ ID NO: 2969969 - RNA, 14 nt, Human
caucaggccaggcc

SEQ ID NO: 2969970 - RNA, 16 nt, Human
caucaggccaggcccu

SEQ ID NO: 2969971 - RNA, 19 nt, Human
caucaggccaggcccucug

SEQ ID NO: 2969972 - RNA, 17 nt, Human
caucccagccccaauga

SEQ ID NO: 2969973 - RNA, 17 nt, Human
caucugcgggggcagug

SEQ ID NO: 2969974 - RNA, 20 nt, Human
caucugcgggggcagugcuc

SEQ ID NO: 2969975 - RNA, 19 nt, Human
caucugcgggggcagugcu

SEQ ID NO: 2969976 - RNA, 21 nt, Human
caucugcgggggcagugcuca

SEQ ID NO: 2969977 - RNA, 19 nt, Human
caucccauaugccugggca

SEQ ID NO: 2969978 - RNA, 14 nt, Human
cauccccuguagag

SEQ ID NO: 2969979 - RNA, 16 nt, Human
ccacagaagcuccagg

SEQ ID NO: 2969980 - RNA, 18 nt, Human
ccaccagucugacuguuu

SEQ ID NO: 2969981 - RNA, 18 nt, Human
ccacagaagcuccaggua

SEQ ID NO: 2969982 - RNA, 22 nt, Human
ccacagagaaaguacuucucca

SEQ ID NO: 2969983 - RNA, 17 nt, Human
ccaccagugccucuccc

SEQ ID NO: 2969984 - RNA, 15 nt, Human
ccaccagugccucuc

SEQ ID NO: 2969985 - RNA, 14 nt, Human
ccaccagugccucu

SEQ ID NO: 2969986 - RNA, 13 nt, Human
ccaccagugccuc

SEQ ID NO: 2969987 - RNA, 12 nt, Human
ccaccagugccu

SEQ ID NO: 2969988 - RNA, 18 nt, Human
ccaccaucaugucuggcu

SEQ ID NO: 2969989 - RNA, 19 nt, Human
ccaccagugccucucccug

SEQ ID NO: 2969990 - RNA, 18 nt, Human
ccaccaucaccagacagg

SEQ ID NO: 2969991 - RNA, 19 nt, Human
ccaccaucaugucuggcua

SEQ ID NO: 2969992 - RNA, 17 nt, Human
ccaccgccuugcccagc

SEQ ID NO: 2969993 - RNA, 16 nt, Human
ccaccgccuugcccag

SEQ ID NO: 2969994 - RNA, 19 nt, Human
ccaccgccuugcccagccu

SEQ ID NO: 2969995 - RNA, 16 nt, Human
ccaccuuggcugcagg

SEQ ID NO: 2969996 - RNA, 15 nt, Human
ccaccuuggcugcag

SEQ ID NO: 2969997 - RNA, 14 nt, Human
ccaccuuggcugca

SEQ ID NO: 2969998 - RNA, 12 nt, Human
ccaccuuggcug

SEQ ID NO: 2969999 - RNA, 19 nt, Human
ccaccuuggcugcagggag

SEQ ID NO: 2970000 - RNA, 18 nt, Human
ccaccuuggcugcaggga

SEQ ID NO: 2970001 - RNA, 18 nt, Human
ccacgcuggaccuugaac

SEQ ID NO: 2970002 - RNA, 15 nt, Human
cauuuggauuggaug

SEQ ID NO: 2970003 - RNA, 13 nt, Human
cauuugucccaag

SEQ ID NO: 2970004 - RNA, 12 nt, Human
cauuugucccaa

SEQ ID NO: 2970005 - RNA, 17 nt, Human
cauuugucacacacuuu

SEQ ID NO: 2970006 - RNA, 19 nt, Human
cauuugucccaagugccaa

SEQ ID NO: 2970007 - RNA, 18 nt, Human
cauuugucccaagugcca

SEQ ID NO: 2970008 - RNA, 16 nt, Human
cauuugucccaagugc

SEQ ID NO: 2970009 - RNA, 14 nt, Human
cauuugucccaagu

SEQ ID NO: 2970010 - RNA, 15 nt, Human
cauuuauucugcuca

SEQ ID NO: 2970011 - RNA, 14 nt, Human
cauuuauucugcuc

SEQ ID NO: 2970012 - RNA, 16 nt, Human
cauuuuuuaaaugcac

SEQ ID NO: 2970013 - RNA, 15 nt, Human
cauuuuuuaaaugca

SEQ ID NO: 2970014 - RNA, 19 nt, Human
cauuuuuuaaaugcaccug

SEQ ID NO: 2970015 - RNA, 16 nt, Human
ccaaggccaaaggaag

SEQ ID NO: 2970016 - RNA, 13 nt, Human
ccaagaagcccag

SEQ ID NO: 2970017 - RNA, 13 nt, Human
ccaacgucugugc

SEQ ID NO: 2970018 - RNA, 15 nt, Human
ccaacgucugugcca

SEQ ID NO: 2970019 - RNA, 22 nt, Human
ccaaauggaaaugggcagagca

SEQ ID NO: 2970020 - RNA, 15 nt, Human
ccaaggccaaaggaa

SEQ ID NO: 2970021 - RNA, 14 nt, Human
ccaagaagcccagg

SEQ ID NO: 2970022 - RNA, 19 nt, Human
ccaagcuggucccacucag

SEQ ID NO: 2970023 - RNA, 12 nt, Human
ccaagcuggucc

SEQ ID NO: 2970024 - RNA, 20 nt, Human
cagaguaggggucugucuuu

SEQ ID NO: 2970025 - RNA, 21 nt, Human
cagaguaggcuauuccugaga

SEQ ID NO: 2970026 - RNA, 23 nt, Human
cagaguaggggucugucuuuuaa

SEQ ID NO: 2970027 - RNA, 22 nt, Human
cagaguaggggucugucuuuua

SEQ ID NO: 2970028 - RNA, 22 nt, Human
cagaguaggcuauuccugagag

SEQ ID NO: 2970029 - RNA, 20 nt, Human
cagagucagaaguuucugcc

SEQ ID NO: 2970030 - RNA, 18 nt, Human
cagaggggguggccuccc

SEQ ID NO: 2970031 - RNA, 17 nt, Human
cagaggggguggccucc

SEQ ID NO: 2970032 - RNA, 19 nt, Human
cagaggggguggccuccca

SEQ ID NO: 2970033 - RNA, 20 nt, Human
cagaggggguggccucccaa

SEQ ID NO: 2970034 - RNA, 19 nt, Human
cagauaugauucaaauguc

SEQ ID NO: 2970035 - RNA, 17 nt, Human
cagauaugauucaaaug

SEQ ID NO: 2970036 - RNA, 16 nt, Human
cagauaugauucaaau

SEQ ID NO: 2970037 - RNA, 15 nt, Human
cagauaugauucaaa

SEQ ID NO: 2970038 - RNA, 20 nt, Human
cagaaguuugagaucagccu

SEQ ID NO: 2970039 - RNA, 23 nt, Human
cagaaguuucugccgcagcccug

SEQ ID NO: 2970040 - RNA, 22 nt, Human
cagaaguuugagaucagccugg

SEQ ID NO: 2970041 - RNA, 23 nt, Human
cagaaguuugagaucagccuggg

SEQ ID NO: 2970042 - RNA, 16 nt, Human
cagagcugccaccugc

SEQ ID NO: 2970043 - RNA, 18 nt, Human
cagagcugccaccugccu

SEQ ID NO: 2970044 - RNA, 15 nt, Human
cagagcugcccucuc

SEQ ID NO: 2970045 - RNA, 13 nt, Human
cagagcugcccuc

SEQ ID NO: 2970046 - RNA, 22 nt, Human
cagagggccugcaagggaguga

SEQ ID NO: 2970047 - RNA, 20 nt, Human
cagcaguugaaaagacucca

SEQ ID NO: 2970048 - RNA, 21 nt, Human
cagcaguugaaaagacuccaa

SEQ ID NO: 2970049 - RNA, 14 nt, Human
cagcagugagacug

SEQ ID NO: 2970050 - RNA, 17 nt, Human
cagcaguugaaaagacu

SEQ ID NO: 2970051 - RNA, 19 nt, Human
cagcauauucaggaagcuc

SEQ ID NO: 2970052 - RNA, 22 nt, Human
cagcauauucaggaagcucagg

SEQ ID NO: 2970053 - RNA, 23 nt, Human
cagcauauucaggaagcucaggg

SEQ ID NO: 2970054 - RNA, 21 nt, Human
cagccagcaguucagagcugc

SEQ ID NO: 2970055 - RNA, 15 nt, Human
cagccagcaguucag

SEQ ID NO: 2970056 - RNA, 14 nt, Human
cagccagcaguuca

SEQ ID NO: 2970057 - RNA, 12 nt, Human
cagccaggccac

SEQ ID NO: 2970058 - RNA, 13 nt, Human
cagccaggccaca

SEQ ID NO: 2970059 - RNA, 22 nt, Human
cagccaggccacaagacccuug

SEQ ID NO: 2970060 - RNA, 22 nt, Human
cagcacagccucuuagaugcag

SEQ ID NO: 2970061 - RNA, 22 nt, Human
caggaaaucaaauaugcaaagc

SEQ ID NO: 2970062 - RNA, 23 nt, Human
caggaaaucaaauaugcaaagca

SEQ ID NO: 2970063 - RNA, 14 nt, Human
caggaaaggcucca

SEQ ID NO: 2970064 - RNA, 15 nt, Human
caggaaaggcuccag

SEQ ID NO: 2970065 - RNA, 20 nt, Human
caggaaagagaacuuccaga

SEQ ID NO: 2970066 - RNA, 18 nt, Human
cagcuucauuuccugugu

SEQ ID NO: 2970067 - RNA, 15 nt, Human
cagcuucauuuccug

SEQ ID NO: 2970068 - RNA, 18 nt, Human
cagcugugcucuggacag

SEQ ID NO: 2970069 - RNA, 17 nt, Human
cagcuccccucggagaa

SEQ ID NO: 2970070 - RNA, 18 nt, Human
cagcuccccucggagaag

SEQ ID NO: 2970071 - RNA, 16 nt, Human
cagcuccccucggaga

SEQ ID NO: 2970072 - RNA, 22 nt, Human
cagcugccuccccuccucugcu

SEQ ID NO: 2970073 - RNA, 21 nt, Human
cagcugccuccccuccucugc

SEQ ID NO: 2970074 - RNA, 24 nt, Human
cagcugccuccccuccucugcuug

SEQ ID NO: 2970075 - RNA, 23 nt, Human
cagcugccuccccuccucugcuu

SEQ ID NO: 2970076 - RNA, 20 nt, Human
cagcugccuccccuccucug

SEQ ID NO: 2970077 - RNA, 16 nt, Human
cagcuccaagaauuuc

SEQ ID NO: 2970078 - RNA, 15 nt, Human
cagcuccagcucacc

SEQ ID NO: 2970079 - RNA, 14 nt, Human
cagcuccagcucac

SEQ ID NO: 2970080 - RNA, 19 nt, Human
cagcuccaagaauuucuag

SEQ ID NO: 2970081 - RNA, 13 nt, Human
cagcuccagcuca

SEQ ID NO: 2970082 - RNA, 20 nt, Human
cagcuccagcucaccagccc

SEQ ID NO: 2970083 - RNA, 18 nt, Human
cagcuccagcucaccagc

SEQ ID NO: 2970084 - RNA, 17 nt, Human
cagcuccagcucaccag

SEQ ID NO: 2970085 - RNA, 16 nt, Human
cagcuccagcucacca

SEQ ID NO: 2970086 - RNA, 22 nt, Human
cagcuccagcucaccagcccca

SEQ ID NO: 2970087 - RNA, 20 nt, Human
cagcccuucuuuccacagaa

SEQ ID NO: 2970088 - RNA, 19 nt, Human
cagcccuucuuuccacaga

SEQ ID NO: 2970089 - RNA, 15 nt, Human
cagcccuucuuucca

SEQ ID NO: 2970090 - RNA, 20 nt, Human
cagccgagauagccaaggcc

SEQ ID NO: 2970091 - RNA, 21 nt, Human
cagccgagauagccaaggcca

SEQ ID NO: 2970092 - RNA, 12 nt, Human
cagccccuggau

SEQ ID NO: 2970093 - RNA, 13 nt, Human
cagccccuggaug

SEQ ID NO: 2970094 - RNA, 14 nt, Human
cagccccuggaugc

SEQ ID NO: 2970095 - RNA, 17 nt, Human
cagccccuggaugcagc

SEQ ID NO: 2970096 - RNA, 18 nt, Human
cagccccuggaugcagcc

SEQ ID NO: 2970097 - RNA, 19 nt, Human
cagccccuggaugcagccu

SEQ ID NO: 2970098 - RNA, 21 nt, Human
cagccccuggaugcagccuca

SEQ ID NO: 2970099 - RNA, 21 nt, Human
cagcccuuagcagggaaacag

SEQ ID NO: 2970100 - RNA, 16 nt, Human
cagcccuuagcaggga

SEQ ID NO: 2970101 - RNA, 15 nt, Human
cagcccuuagcaggg

SEQ ID NO: 2970102 - RNA, 19 nt, Human
cagccugagcgacagugag

SEQ ID NO: 2970103 - RNA, 18 nt, Human
cagccugagcgacaguga

SEQ ID NO: 2970104 - RNA, 17 nt, Human
cagcggggacagcuccu

SEQ ID NO: 2970105 - RNA, 16 nt, Human
cagcggggacagcucc

SEQ ID NO: 2970106 - RNA, 14 nt, Human
cagcggggacagcu

SEQ ID NO: 2970107 - RNA, 15 nt, Human
cagcggggacagcuc

SEQ ID NO: 2970108 - RNA, 18 nt, Human
cagggaggacgcucucug

SEQ ID NO: 2970109 - RNA, 17 nt, Human
cagggaggacgcucucu

SEQ ID NO: 2970110 - RNA, 19 nt, Human
caggcugggcuucaguggc

SEQ ID NO: 2970111 - RNA, 17 nt, Human
caggcugggcuucagug

SEQ ID NO: 2970112 - RNA, 15 nt, Human
caggcugggcuucag

SEQ ID NO: 2970113 - RNA, 16 nt, Human
caggcugggcuucagu

SEQ ID NO: 2970114 - RNA, 18 nt, Human
cagggaggugaccccagg

SEQ ID NO: 2970115 - RNA, 22 nt, Human
cagggaguccgaaagggacuug

SEQ ID NO: 2970116 - RNA, 21 nt, Human
caggccagagggagugacaga

SEQ ID NO: 2970117 - RNA, 19 nt, Human
caggccagagggagugaca

SEQ ID NO: 2970118 - RNA, 17 nt, Human
caggcagcagacacaug

SEQ ID NO: 2970119 - RNA, 15 nt, Human
caggcagcagacaca

SEQ ID NO: 2970120 - RNA, 16 nt, Human
caggcagcagacacau

SEQ ID NO: 2970121 - RNA, 16 nt, Human
caggccagagggagug

SEQ ID NO: 2970122 - RNA, 23 nt, Human
caggccagagggagugacagagg

SEQ ID NO: 2970123 - RNA, 14 nt, Human
caggaggccagccu

SEQ ID NO: 2970124 - RNA, 15 nt, Human
caggaggccagccuu

SEQ ID NO: 2970125 - RNA, 16 nt, Human
caggaggccagccuug

SEQ ID NO: 2970126 - RNA, 23 nt, Human
caggcacccaccaucaugucugg

SEQ ID NO: 2970127 - RNA, 22 nt, Human
caggcacccaccaucaugucug

SEQ ID NO: 2970128 - RNA, 18 nt, Human
caggcacccaccaucaug

SEQ ID NO: 2970129 - RNA, 17 nt, Human
caggaggccagccuuga

SEQ ID NO: 2970130 - RNA, 16 nt, Human
cagguuuaagcuguua

SEQ ID NO: 2970131 - RNA, 18 nt, Human
cagguuuaagcuguuacu

SEQ ID NO: 2970132 - RNA, 22 nt, Human
cagucaccccggccaccugcgg

SEQ ID NO: 2970133 - RNA, 20 nt, Human
cagucaccccggccaccugc

SEQ ID NO: 2970134 - RNA, 19 nt, Human
cagucaccccggccaccug

SEQ ID NO: 2970135 - RNA, 14 nt, Human
cagguugguggggg

SEQ ID NO: 2970136 - RNA, 18 nt, Human
caggugcuaggaacacuc

SEQ ID NO: 2970137 - RNA, 20 nt, Human
caggugcuaggaacacuccu

SEQ ID NO: 2970138 - RNA, 14 nt, Human
caggugcgaaagga

SEQ ID NO: 2970139 - RNA, 17 nt, Human
caggugauccacccacc

SEQ ID NO: 2970140 - RNA, 16 nt, Human
caggugauccacccac

SEQ ID NO: 2970141 - RNA, 12 nt, Human
caggguuggccc

SEQ ID NO: 2970142 - RNA, 22 nt, Human
caggugcacaagcuccaagcuc

SEQ ID NO: 2970143 - RNA, 18 nt, Human
cagggucucacucugucg

SEQ ID NO: 2970144 - RNA, 17 nt, Human
cagggucucacucuguc

SEQ ID NO: 2970145 - RNA, 21 nt, Human
cagggucucacucugucgccc

SEQ ID NO: 2970146 - RNA, 22 nt, Human
cagugcaugcugucccuuacgu

SEQ ID NO: 2970147 - RNA, 23 nt, Human
cagugcaugcugucccuuacgug

SEQ ID NO: 2970148 - RNA, 19 nt, Human
cagugcaugcugucccuua

SEQ ID NO: 2970149 - RNA, 20 nt, Human
cagucugauucccaagcucu

SEQ ID NO: 2970150 - RNA, 19 nt, Human
cagucugauucccaagcuc

SEQ ID NO: 2970151 - RNA, 22 nt, Human
cagugcacuaauguguaagaca

SEQ ID NO: 2970152 - RNA, 12 nt, Human
cagugcccacag

SEQ ID NO: 2970153 - RNA, 11 nt, Human
cagugggagcu

SEQ ID NO: 2970154 - RNA, 15 nt, Human
cagugccaaaaacaa

SEQ ID NO: 2970155 - RNA, 14 nt, Human
cagugcaguauaga

SEQ ID NO: 2970156 - RNA, 15 nt, Human
cagucucaggaaauc

SEQ ID NO: 2970157 - RNA, 16 nt, Human
gcccucaauugugaaa

SEQ ID NO: 2970158 - RNA, 23 nt, Human
gcccgggcucugccucccaucac

SEQ ID NO: 2970159 - RNA, 16 nt, Human
gccccugccacccugg

SEQ ID NO: 2970160 - RNA, 17 nt, Human
gccccugccacccuggg

SEQ ID NO: 2970161 - RNA, 12 nt, Human
gcccccacuggu

SEQ ID NO: 2970162 - RNA, 15 nt, Human
gccuaggugacagag

SEQ ID NO: 2970163 - RNA, 14 nt, Human
gccuaggugacaga

SEQ ID NO: 2970164 - RNA, 13 nt, Human
gccuaggugacag

SEQ ID NO: 2970165 - RNA, 20 nt, Human
gccuagcauacguacacauu

SEQ ID NO: 2970166 - RNA, 22 nt, Human
gccuagcauacguacacauuuu

SEQ ID NO: 2970167 - RNA, 21 nt, Human
gccuagcauacguacacauuu

SEQ ID NO: 2970168 - RNA, 23 nt, Human
gccuagcauacguacacauuuua

SEQ ID NO: 2970169 - RNA, 20 nt, Human
gccuaggugacagagugaga

SEQ ID NO: 2970170 - RNA, 20 nt, Human
gcccuuagcagggaaacagc

SEQ ID NO: 2970171 - RNA, 19 nt, Human
gcccuuagcagggaaacag

SEQ ID NO: 2970172 - RNA, 12 nt, Human
gcccugccuccu

SEQ ID NO: 2970173 - RNA, 13 nt, Human
gcccugccuccuu

SEQ ID NO: 2970174 - RNA, 22 nt, Human
gcccuuagcagggaaacagcua

SEQ ID NO: 2970175 - RNA, 20 nt, Human
gccgcagcccugcagagggc

SEQ ID NO: 2970176 - RNA, 19 nt, Human
gccgcagcccugcagaggg

SEQ ID NO: 2970177 - RNA, 14 nt, Human
gccgcccaaggccu

SEQ ID NO: 2970178 - RNA, 23 nt, Human
gccgcccaaggccuuccccuggc

SEQ ID NO: 2970179 - RNA, 17 nt, Human
gcccugcccaccuggcc

SEQ ID NO: 2970180 - RNA, 20 nt, Human
gcccugcccaccuggccucu

SEQ ID NO: 2970181 - RNA, 21 nt, Human
gcccugcccaccuggccucug

SEQ ID NO: 2970182 - RNA, 22 nt, Human
gcccugcccaccuggccucugc

SEQ ID NO: 2970183 - RNA, 11 nt, Human
gcccugccucc

SEQ ID NO: 2970184 - RNA, 18 nt, Human
gcccugcagagggcacag

SEQ ID NO: 2970185 - RNA, 16 nt, Human
gcccugcagagggcac

SEQ ID NO: 2970186 - RNA, 20 nt, Human
gccuucggccuccauccuga

SEQ ID NO: 2970187 - RNA, 21 nt, Human
gccuucggccuccauccugag

SEQ ID NO: 2970188 - RNA, 17 nt, Human
gccuugaccauucucca

SEQ ID NO: 2970189 - RNA, 19 nt, Human
gccuugaccauucuccacc

SEQ ID NO: 2970190 - RNA, 20 nt, Human
gccuugaccauucuccaccu

SEQ ID NO: 2970191 - RNA, 15 nt, Human
gcgagcccugguggc

SEQ ID NO: 2970192 - RNA, 17 nt, Human
gcgagcccugguggcag

SEQ ID NO: 2970193 - RNA, 13 nt, Human
gccuugcccagcc

SEQ ID NO: 2970194 - RNA, 17 nt, Human
gccuugcccagccugga

SEQ ID NO: 2970195 - RNA, 15 nt, Human
gccuugcccagccug

SEQ ID NO: 2970196 - RNA, 14 nt, Human
gccuugcccagccu

SEQ ID NO: 2970197 - RNA, 19 nt, Human
gccuugcccagccuggaug

SEQ ID NO: 2970198 - RNA, 18 nt, Human
gccuugcccagccuggau

SEQ ID NO: 2970199 - RNA, 22 nt, Human
gcgaucuggguucacugcaacc

SEQ ID NO: 2970200 - RNA, 15 nt, Human
gccuguugggccagg

SEQ ID NO: 2970201 - RNA, 16 nt, Human
gccuguugggccagga

SEQ ID NO: 2970202 - RNA, 18 nt, Human
gccuguugggccaggagc

SEQ ID NO: 2970203 - RNA, 20 nt, Human
gccuguugggccaggagccu

SEQ ID NO: 2970204 - RNA, 14 nt, Human
gccuguugggccag

SEQ ID NO: 2970205 - RNA, 17 nt, Human
gccugugccucugggac

SEQ ID NO: 2970206 - RNA, 16 nt, Human
gccugugccucuggga

SEQ ID NO: 2970207 - RNA, 13 nt, Human
gccuggcucaggu

SEQ ID NO: 2970208 - RNA, 18 nt, Human
gccugugccucugggacu

SEQ ID NO: 2970209 - RNA, 13 nt, Human
gccuggccugagc

SEQ ID NO: 2970210 - RNA, 14 nt, Human
gccuggccugagcu

SEQ ID NO: 2970211 - RNA, 18 nt, Human
gccuggccugagcuggga

SEQ ID NO: 2970212 - RNA, 20 nt, Human
gccuggccugagcugggaug

SEQ ID NO: 2970213 - RNA, 17 nt, Human
gccucuuaugggcuggg

SEQ ID NO: 2970214 - RNA, 18 nt, Human
gccucuuaugggcugggu

SEQ ID NO: 2970215 - RNA, 16 nt, Human
gccucuuaugggcugg

SEQ ID NO: 2970216 - RNA, 15 nt, Human
gccucuuagaugcag

SEQ ID NO: 2970217 - RNA, 22 nt, Human
gccucgaacuggcugcaaaggg

SEQ ID NO: 2970218 - RNA, 20 nt, Human
gccucgaacuggcugcaaag

SEQ ID NO: 2970219 - RNA, 21 nt, Human
gccucuuaugggcuggguucu

SEQ ID NO: 2970220 - RNA, 14 nt, Human
gccucuuggguuca

SEQ ID NO: 2970221 - RNA, 14 nt, Human
gccugcccaggccc

SEQ ID NO: 2970222 - RNA, 13 nt, Human
gccugcccaggcc

SEQ ID NO: 2970223 - RNA, 17 nt, Human
gccucccaaagugcugg

SEQ ID NO: 2970224 - RNA, 13 nt, Human
gccuccugugugu

SEQ ID NO: 2970225 - RNA, 16 nt, Human
gccucccaaagugcug

SEQ ID NO: 2970226 - RNA, 23 nt, Human
gccuccugugugugcgccuacag

SEQ ID NO: 2970227 - RNA, 19 nt, Human
gccuccugugugugcgccu

SEQ ID NO: 2970228 - RNA, 17 nt, Human
gccucgaacuggcugca

SEQ ID NO: 2970229 - RNA, 20 nt, Human
gccugcccaggccccugcca

SEQ ID NO: 2970230 - RNA, 15 nt, Human
gccugcccaggcccc

SEQ ID NO: 2970231 - RNA, 22 nt, Human
gccugcccaggccccugccacc

SEQ ID NO: 2970232 - RNA, 19 nt, Human
gcuccaccuugcagcucuc

SEQ ID NO: 2970233 - RNA, 15 nt, Human
gcuccacuuggucug

SEQ ID NO: 2970234 - RNA, 21 nt, Human
gcuccccucggagaagagcug

SEQ ID NO: 2970235 - RNA, 18 nt, Human
gcuccccucggagaagag

SEQ ID NO: 2970236 - RNA, 18 nt, Human
gcuccuggcccacugcau

SEQ ID NO: 2970237 - RNA, 19 nt, Human
gcuccuggcccacugcauc

SEQ ID NO: 2970238 - RNA, 20 nt, Human
gcuccuggcccacugcaucg

SEQ ID NO: 2970239 - RNA, 14 nt, Human
gcuccuggcccacu

SEQ ID NO: 2970240 - RNA, 15 nt, Human
gcuccuggcccacug

SEQ ID NO: 2970241 - RNA, 19 nt, Human
gcuccacuuggucugugag

SEQ ID NO: 2970242 - RNA, 18 nt, Human
gcuccacuuggucuguga

SEQ ID NO: 2970243 - RNA, 18 nt, Human
gcuccagcucaccagccc

SEQ ID NO: 2970244 - RNA, 17 nt, Human
gcuccagcucaccagcc

SEQ ID NO: 2970245 - RNA, 21 nt, Human
gcuccagcucaccagccccag

SEQ ID NO: 2970246 - RNA, 20 nt, Human
gcuccagcucaccagcccca

SEQ ID NO: 2970247 - RNA, 15 nt, Human
gcucccagccaggcc

SEQ ID NO: 2970248 - RNA, 14 nt, Human
gcucccagccaggc

SEQ ID NO: 2970249 - RNA, 17 nt, Human
gcucccagccaggcccu

SEQ ID NO: 2970250 - RNA, 16 nt, Human
gcucccagccaggccc

SEQ ID NO: 2970251 - RNA, 18 nt, Human
gcucccagccaggcccuu

SEQ ID NO: 2970252 - RNA, 16 nt, Human
gcucccaccuggcucu

SEQ ID NO: 2970253 - RNA, 14 nt, Human
gcucccaccuggcu

SEQ ID NO: 2970254 - RNA, 18 nt, Human
gcucccaccuggcucugu

SEQ ID NO: 2970255 - RNA, 11 nt, Human
gcucugcccuu

SEQ ID NO: 2970256 - RNA, 23 nt, Human
gcucugcaagaauugaagcagga

SEQ ID NO: 2970257 - RNA, 17 nt, Human
gcucugaucauccacug

SEQ ID NO: 2970258 - RNA, 23 nt, Human
gcucugaucauccacugugccau

SEQ ID NO: 2970259 - RNA, 15 nt, Human
gcuaaugggacacua

SEQ ID NO: 2970260 - RNA, 13 nt, Human
gcuaaugggacac

SEQ ID NO: 2970261 - RNA, 23 nt, Human
gcuaagugauccucccaccucag

SEQ ID NO: 2970262 - RNA, 18 nt, Human
gcguuucuaugacacaug

SEQ ID NO: 2970263 - RNA, 23 nt, Human
gcgugcacacaccagagcccacc

SEQ ID NO: 2970264 - RNA, 19 nt, Human
gcgugcacacaccagagcc

SEQ ID NO: 2970265 - RNA, 20 nt, Human
gcgggaggauguucugggac

SEQ ID NO: 2970266 - RNA, 22 nt, Human
gcgggaggauguucugggacac

SEQ ID NO: 2970267 - RNA, 21 nt, Human
gcgggaggauguucugggaca

SEQ ID NO: 2970268 - RNA, 20 nt, Human
gcgugcacacaccagagccc

SEQ ID NO: 2970269 - RNA, 15 nt, Human
gcuagaacucccuuu

SEQ ID NO: 2970270 - RNA, 14 nt, Human
gcuagaacucccuu

SEQ ID NO: 2970271 - RNA, 13 nt, Human
gcuagaacucccu

SEQ ID NO: 2970272 - RNA, 12 nt, Human
gcuagaacuccc

SEQ ID NO: 2970273 - RNA, 18 nt, Human
gcuacucgggaggcugag

SEQ ID NO: 2970274 - RNA, 17 nt, Human
gcuacucgggaggcuga

SEQ ID NO: 2970275 - RNA, 23 nt, Human
gcuacucgggaggcugaggcagg

SEQ ID NO: 2970276 - RNA, 16 nt, Human
gcuagaacucccuuuc

SEQ ID NO: 2970277 - RNA, 13 nt, Human
gcuacugccaucc

SEQ ID NO: 2970278 - RNA, 11 nt, Human
gcuacugccau

SEQ ID NO: 2970279 - RNA, 20 nt, Human
gcuauucaguaauaacucua

SEQ ID NO: 2970280 - RNA, 18 nt, Human
gcuauucaguaauaacuc

SEQ ID NO: 2970281 - RNA, 14 nt, Human
gcucacugcagccu

SEQ ID NO: 2970282 - RNA, 13 nt, Human
gcucacugcagcc

SEQ ID NO: 2970283 - RNA, 12 nt, Human
gcucacugcagc

SEQ ID NO: 2970284 - RNA, 11 nt, Human
gcucacugcag

SEQ ID NO: 2970285 - RNA, 16 nt, Human
gcucacugcagccuca

SEQ ID NO: 2970286 - RNA, 15 nt, Human
gcucacugcagccuc

SEQ ID NO: 2970287 - RNA, 17 nt, Human
gcucacugcagccucaa

SEQ ID NO: 2970288 - RNA, 23 nt, Human
gcucagguggggucacucuggca

SEQ ID NO: 2970289 - RNA, 14 nt, Human
gcucaggugucccu

SEQ ID NO: 2970290 - RNA, 16 nt, Human
gcucaggugucccugc

SEQ ID NO: 2970291 - RNA, 14 nt, Human
gcucagagagggug

SEQ ID NO: 2970292 - RNA, 13 nt, Human
gcucagagagggu

SEQ ID NO: 2970293 - RNA, 21 nt, Human
gcuagugugguguuuccuggc

SEQ ID NO: 2970294 - RNA, 22 nt, Human
gcuagugugguguuuccuggca

SEQ ID NO: 2970295 - RNA, 12 nt, Human
gcuaugcauuug

SEQ ID NO: 2970296 - RNA, 13 nt, Human
gcuaugcauuuga

SEQ ID NO: 2970297 - RNA, 19 nt, Human
gcuauucaguaauaacucu

SEQ ID NO: 2970298 - RNA, 16 nt, Human
gcuaggccuggccaga

SEQ ID NO: 2970299 - RNA, 23 nt, Human
gcuaggccuggccagaugcacca

SEQ ID NO: 2970300 - RNA, 17 nt, Human
gcuaggccuggccagau

SEQ ID NO: 2970301 - RNA, 23 nt, Human
ggaacagaagaggaaagagagac

SEQ ID NO: 2970302 - RNA, 15 nt, Human
ggaacacucugagac

SEQ ID NO: 2970303 - RNA, 16 nt, Human
ggaacacucugagacu

SEQ ID NO: 2970304 - RNA, 12 nt, Human
ggaacacucuga

SEQ ID NO: 2970305 - RNA, 14 nt, Human
ggaacacucugaga

SEQ ID NO: 2970306 - RNA, 19 nt, Human
ggaacacuccuucacagau

SEQ ID NO: 2970307 - RNA, 13 nt, Human
ggaagacuuugga

SEQ ID NO: 2970308 - RNA, 17 nt, Human
ggaagacuuuggaaaga

SEQ ID NO: 2970309 - RNA, 12 nt, Human
ggaagacuuugg

SEQ ID NO: 2970310 - RNA, 13 nt, Human
ggaagacagcucu

SEQ ID NO: 2970311 - RNA, 14 nt, Human
ggaagacagcucuu

SEQ ID NO: 2970312 - RNA, 22 nt, Human
ggaagacaaugugaaaagaaaa

SEQ ID NO: 2970313 - RNA, 13 nt, Human
ggaagagaaaaaa

SEQ ID NO: 2970314 - RNA, 18 nt, Human
ggaagacuuuggaaagag

SEQ ID NO: 2970315 - RNA, 15 nt, Human
ggaagagaaaaaaua

SEQ ID NO: 2970316 - RNA, 18 nt, Human
ggaauaacauguaauuaa

SEQ ID NO: 2970317 - RNA, 13 nt, Human
ggaauaagacaga

SEQ ID NO: 2970318 - RNA, 17 nt, Human
ggaauaagacagagacc

SEQ ID NO: 2970319 - RNA, 16 nt, Human
ggaauccagacccggc

SEQ ID NO: 2970320 - RNA, 22 nt, Human
ggacaaggaugaucuaggaaga

SEQ ID NO: 2970321 - RNA, 23 nt, Human
ggacaaggaugaucuaggaagac

SEQ ID NO: 2970322 - RNA, 13 nt, Human
ggacaagagcagg

SEQ ID NO: 2970323 - RNA, 19 nt, Human
ggaaugaagauacugaaau

SEQ ID NO: 2970324 - RNA, 18 nt, Human
ggacacagcucuucucca

SEQ ID NO: 2970325 - RNA, 15 nt, Human
ggacacagcucuucu

SEQ ID NO: 2970326 - RNA, 21 nt, Human
ggacacagcucuucuccaggc

SEQ ID NO: 2970327 - RNA, 14 nt, Human
ggacacagcucuuc

SEQ ID NO: 2970328 - RNA, 17 nt, Human
ggacagcuccuucuguc

SEQ ID NO: 2970329 - RNA, 20 nt, Human
ggacagcuccuucuguccua

SEQ ID NO: 2970330 - RNA, 19 nt, Human
ggacagcuccuucuguccu

SEQ ID NO: 2970331 - RNA, 22 nt, Human
ggacacuaaccacgcuggaccu

SEQ ID NO: 2970332 - RNA, 17 nt, Human
ggacacuaaccacgcug

SEQ ID NO: 2970333 - RNA, 16 nt, Human
ggaaggaaacccagcu

SEQ ID NO: 2970334 - RNA, 15 nt, Human
ggaagcucagggccu

SEQ ID NO: 2970335 - RNA, 23 nt, Human
ggaagcucagggccuggcucagg

SEQ ID NO: 2970336 - RNA, 11 nt, Human
ggaagcuccgc

SEQ ID NO: 2970337 - RNA, 22 nt, Human
ggaagcucagggccuggcucag

SEQ ID NO: 2970338 - RNA, 19 nt, Human
ggaaggaaacccagcucug

SEQ ID NO: 2970339 - RNA, 20 nt, Human
ggaaggaaacccagcucugg

SEQ ID NO: 2970340 - RNA, 15 nt, Human
ggaagccgcuggggc

SEQ ID NO: 2970341 - RNA, 22 nt, Human
ggacucauuuuaaaaaauggaa

SEQ ID NO: 2970342 - RNA, 22 nt, Human
ggacuccaggcagcagacacau

SEQ ID NO: 2970343 - RNA, 21 nt, Human
ggacuccaggcagcagacaca

SEQ ID NO: 2970344 - RNA, 16 nt, Human
ggacucaaugcacuga

SEQ ID NO: 2970345 - RNA, 24 nt, Human
ggacuaacuugucuuuggacccug

SEQ ID NO: 2970346 - RNA, 14 nt, Human
ggacuacaggugug

SEQ ID NO: 2970347 - RNA, 15 nt, Human
ggacucaaugcacug

SEQ ID NO: 2970348 - RNA, 20 nt, Human
ggacuaacuugucuuuggac

SEQ ID NO: 2970349 - RNA, 16 nt, Human
ggagaaaggaagggcu

SEQ ID NO: 2970350 - RNA, 13 nt, Human
ggagaaacuggaa

SEQ ID NO: 2970351 - RNA, 14 nt, Human
ggacuuugcacacu

SEQ ID NO: 2970352 - RNA, 23 nt, Human
ggacuuugcacacuuuggcccag

SEQ ID NO: 2970353 - RNA, 14 nt, Human
ggacuuggaagcuc

SEQ ID NO: 2970354 - RNA, 14 nt, Human
ggaccucaggccug

SEQ ID NO: 2970355 - RNA, 15 nt, Human
ggaccucaggccugg

SEQ ID NO: 2970356 - RNA, 20 nt, Human
ggacguguuaugacuccaga

SEQ ID NO: 2970357 - RNA, 13 nt, Human
ggaccucaggccu

SEQ ID NO: 2970358 - RNA, 12 nt, Human
ggaccucaggcc

SEQ ID NO: 2970359 - RNA, 12 nt, Human
ggacccugaggc

SEQ ID NO: 2970360 - RNA, 13 nt, Human
ggacccugaggcc

SEQ ID NO: 2970361 - RNA, 11 nt, Human
ggacccugagg

SEQ ID NO: 2970362 - RNA, 12 nt, Human
ggacccccugaa

SEQ ID NO: 2970363 - RNA, 16 nt, Human
gcuuguacacucauuc

SEQ ID NO: 2970364 - RNA, 14 nt, Human
gcuugagcucagga

SEQ ID NO: 2970365 - RNA, 20 nt, Human
gcuuguaaauagcucaggug

SEQ ID NO: 2970366 - RNA, 12 nt, Human
gcuuguacauaa

SEQ ID NO: 2970367 - RNA, 22 nt, Human
gcuuccucauaguaugguggcu

SEQ ID NO: 2970368 - RNA, 23 nt, Human
gcuucuucagagacuccugcagg

SEQ ID NO: 2970369 - RNA, 18 nt, Human
gcuucacggaagagccuu

SEQ ID NO: 2970370 - RNA, 12 nt, Human
gcuucagccucc

SEQ ID NO: 2970371 - RNA, 17 nt, Human
gcuucacggaagagccu

SEQ ID NO: 2970372 - RNA, 15 nt, Human
gcuucacggaagagc

SEQ ID NO: 2970373 - RNA, 20 nt, Human
gcuucaaggauccugagcca

SEQ ID NO: 2970374 - RNA, 21 nt, Human
gcuucaaggauccugagccag

SEQ ID NO: 2970375 - RNA, 19 nt, Human
gcuucaaggauccugagcc

SEQ ID NO: 2970376 - RNA, 18 nt, Human
gcuucaaggauccugagc

SEQ ID NO: 2970377 - RNA, 16 nt, Human
gcuggcuguuggcugg

SEQ ID NO: 2970378 - RNA, 15 nt, Human
gcuggcuguuggcug

SEQ ID NO: 2970379 - RNA, 21 nt, Human
gcuggguggcaccagcagccu

SEQ ID NO: 2970380 - RNA, 22 nt, Human
gcuggguggcaccagcagccug

SEQ ID NO: 2970381 - RNA, 23 nt, Human
gcuggguggcaccagcagccugg

SEQ ID NO: 2970382 - RNA, 20 nt, Human
gcuggccuggccccucaggg

SEQ ID NO: 2970383 - RNA, 22 nt, Human
gcuggagugcagugagccgaga

SEQ ID NO: 2970384 - RNA, 17 nt, Human
gcuggagugcagugagc

SEQ ID NO: 2970385 - RNA, 18 nt, Human
gcuggagugcagugagcc

SEQ ID NO: 2970386 - RNA, 20 nt, Human
gcuggcgugcaguggugcga

SEQ ID NO: 2970387 - RNA, 13 nt, Human
gcugcugaaggcu

SEQ ID NO: 2970388 - RNA, 14 nt, Human
gcugcugaaggcuc

SEQ ID NO: 2970389 - RNA, 15 nt, Human
gcugcugaaggcucg

SEQ ID NO: 2970390 - RNA, 15 nt, Human
gcucugguccauaga

SEQ ID NO: 2970391 - RNA, 16 nt, Human
gcucugguccauagag

SEQ ID NO: 2970392 - RNA, 13 nt, Human
gcucugcccuugg

SEQ ID NO: 2970393 - RNA, 13 nt, Human
gcugcuggcuggu

SEQ ID NO: 2970394 - RNA, 23 nt, Human
aaacaugcuguacauacuuuuug

SEQ ID NO: 2970395 - RNA, 17 nt, Human
aaacauggccuuugcuu

SEQ ID NO: 2970396 - RNA, 16 nt, Human
aaacauggccuuugcu

SEQ ID NO: 2970397 - RNA, 15 nt, Human
aaacagucucaggaa

SEQ ID NO: 2970398 - RNA, 14 nt, Human
aaacaguagugaua

SEQ ID NO: 2970399 - RNA, 19 nt, Human
ggggaauugaggacacuga

SEQ ID NO: 2970400 - RNA, 16 nt, Human
ggggaccagagcugcc

SEQ ID NO: 2970401 - RNA, 15 nt, Human
ggggaccagagcugc

SEQ ID NO: 2970402 - RNA, 22 nt, Human
ggggaauguuugccucugccuc

SEQ ID NO: 2970403 - RNA, 18 nt, Human
ggggaauguuugccucug

SEQ ID NO: 2970404 - RNA, 18 nt, Human
gggggccucagugccacu

SEQ ID NO: 2970405 - RNA, 17 nt, Human
gggggccucagugccac

SEQ ID NO: 2970406 - RNA, 15 nt, Human
gggggccucagugcc

SEQ ID NO: 2970407 - RNA, 12 nt, Human
gggggccucagu

SEQ ID NO: 2970408 - RNA, 15 nt, Human
aaacacauuaaaggu

SEQ ID NO: 2970409 - RNA, 11 nt, Human
aaacacauuaa

SEQ ID NO: 2970410 - RNA, 11 nt, Human
aaacacauuuu

SEQ ID NO: 2970411 - RNA, 21 nt, Human
aaacacauuaaagguacuuug

SEQ ID NO: 2970412 - RNA, 12 nt, Human
aaacacagcaag

SEQ ID NO: 2970413 - RNA, 14 nt, Human
aaacacagcaaggg

SEQ ID NO: 2970414 - RNA, 18 nt, Human
aaacacaucuaguaguug

SEQ ID NO: 2970415 - RNA, 19 nt, Human
aaacacaaacgggcucagc

SEQ ID NO: 2970416 - RNA, 11 nt, Human
aaacacagcaa

SEQ ID NO: 2970417 - RNA, 13 nt, Human
gggaugagaaagg

SEQ ID NO: 2970418 - RNA, 19 nt, Human
aaaauuuagaaauauaauu

SEQ ID NO: 2970419 - RNA, 20 nt, Human
aaaauuuugauguuuuaagg

SEQ ID NO: 2970420 - RNA, 12 nt, Human
aaaccacagcag

SEQ ID NO: 2970421 - RNA, 23 nt, Human
aaaccaagucaagugaaaaagga

SEQ ID NO: 2970422 - RNA, 15 nt, Human
aaacgggcucagcaa

SEQ ID NO: 2970423 - RNA, 15 nt, Human
gggggccuggaugcc

SEQ ID NO: 2970424 - RNA, 14 nt, Human
aaacuuaaucuaaa

SEQ ID NO: 2970425 - RNA, 16 nt, Human
aaacuuaaucuaaaug

SEQ ID NO: 2970426 - RNA, 18 nt, Human
aaacuuaaucuaaaugga

SEQ ID NO: 2970427 - RNA, 17 nt, Human
aaacuuaaucuaaaugg

SEQ ID NO: 2970428 - RNA, 19 nt, Human
ggguggcaccagcagccug

SEQ ID NO: 2970429 - RNA, 14 nt, Human
aaacgucuuaaaua

SEQ ID NO: 2970430 - RNA, 13 nt, Human
aaacgucuuaaau

SEQ ID NO: 2970431 - RNA, 15 nt, Human
aaacucguuaauuug

SEQ ID NO: 2970432 - RNA, 17 nt, Human
aaagcuuuugcauauug

SEQ ID NO: 2970433 - RNA, 14 nt, Human
aaagcuuuugcaua

SEQ ID NO: 2970434 - RNA, 22 nt, Human
aaaggaaagagggagguaagga

SEQ ID NO: 2970435 - RNA, 21 nt, Human
aaaggagagcuagcagcaggg

SEQ ID NO: 2970436 - RNA, 17 nt, Human
aaaggagagcuagcagc

SEQ ID NO: 2970437 - RNA, 17 nt, Human
aaaggagauuggaagga

SEQ ID NO: 2970438 - RNA, 14 nt, Human
aaagguacuucaaa

SEQ ID NO: 2970439 - RNA, 22 nt, Human
aaagggacuuggaagcuccgcu

SEQ ID NO: 2970440 - RNA, 13 nt, Human
aaagcuuuugcau

SEQ ID NO: 2970441 - RNA, 15 nt, Human
aaagcuuguuaagau

SEQ ID NO: 2970442 - RNA, 13 nt, Human
aaagcugcugaca

SEQ ID NO: 2970443 - RNA, 17 nt, Human
aaagcacugacuucuaa

SEQ ID NO: 2970444 - RNA, 21 nt, Human
aaagcacugacuucuaaguaa

SEQ ID NO: 2970445 - RNA, 15 nt, Human
aaagcucacuuuacu

SEQ ID NO: 2970446 - RNA, 13 nt, Human
ggucgaggcagga

SEQ ID NO: 2970447 - RNA, 13 nt, Human
ggugaacagaaca

SEQ ID NO: 2970448 - RNA, 24 nt, Human
ggugauccacccaccucagccucc

SEQ ID NO: 2970449 - RNA, 23 nt, Human
ggugauccacccaccucagccuc

SEQ ID NO: 2970450 - RNA, 18 nt, Human
ggugauccacccaccuca

SEQ ID NO: 2970451 - RNA, 13 nt, Human
ggugcaaugaccu

SEQ ID NO: 2970452 - RNA, 12 nt, Human
ggugcaaugacc

SEQ ID NO: 2970453 - RNA, 13 nt, Human
gguggaugccugg

SEQ ID NO: 2970454 - RNA, 14 nt, Human
ggguggggcagugc

SEQ ID NO: 2970455 - RNA, 14 nt, Human
ggguggccucccaa

SEQ ID NO: 2970456 - RNA, 19 nt, Human
aaacuucagacauagaauu

SEQ ID NO: 2970457 - RNA, 23 nt, Human
aaacuucagcgguuuauauaagc

SEQ ID NO: 2970458 - RNA, 21 nt, Human
aaagacuauucaaacagucuc

SEQ ID NO: 2970459 - RNA, 15 nt, Human
aaagacuccaaagaa

SEQ ID NO: 2970460 - RNA, 21 nt, Human
aaagacuccaaagaaauguaa

SEQ ID NO: 2970461 - RNA, 14 nt, Human
aaagacuccaaaga

SEQ ID NO: 2970462 - RNA, 18 nt, Human
aaagacuauucaaacagu

SEQ ID NO: 2970463 - RNA, 19 nt, Human
aaagacuauucaaacaguc

SEQ ID NO: 2970464 - RNA, 17 nt, Human
aaagacuauucaaacag

SEQ ID NO: 2970465 - RNA, 13 nt, Human
aaagacagugaaa

SEQ ID NO: 2970466 - RNA, 15 nt, Human
aaagaggcagcuuga

SEQ ID NO: 2970467 - RNA, 15 nt, Human
aaagaggaaugaagu

SEQ ID NO: 2970468 - RNA, 17 nt, Human
aaagaugcuucucacug

SEQ ID NO: 2970469 - RNA, 14 nt, Human
aaagaugcuucuca

SEQ ID NO: 2970470 - RNA, 19 nt, Human
aaagaugcuucucacugcc

SEQ ID NO: 2970471 - RNA, 14 nt, Human
aaagacuguacaaa

SEQ ID NO: 2970472 - RNA, 13 nt, Human
aaagacuguacaa

SEQ ID NO: 2970473 - RNA, 23 nt, Human
aaagacugaguacguugugcauu

SEQ ID NO: 2970474 - RNA, 12 nt, Human
gguccugcugca

SEQ ID NO: 2970475 - RNA, 11 nt, Human
gguccugcugc

SEQ ID NO: 2970476 - RNA, 16 nt, Human
aaagguacuuugcagg

SEQ ID NO: 2970477 - RNA, 20 nt, Human
aaagguauuuuaaucaccaa

SEQ ID NO: 2970478 - RNA, 20 nt, Human
aaaguacacuguuucaaacu

SEQ ID NO: 2970479 - RNA, 19 nt, Human
aaaguacuucuccacccug

SEQ ID NO: 2970480 - RNA, 18 nt, Human
aaaguaucccuacuguaa

SEQ ID NO: 2970481 - RNA, 18 nt, Human
aaaguauguuagugcaaa

SEQ ID NO: 2970482 - RNA, 21 nt, Human
aaaguacuucuccacccugcu

SEQ ID NO: 2970483 - RNA, 20 nt, Human
aaaguacuucuccacccugc

SEQ ID NO: 2970484 - RNA, 23 nt, Human
aaaguacuucuccacccugcucu

SEQ ID NO: 2970485 - RNA, 17 nt, Human
aaaguauguuagugcaa

SEQ ID NO: 2970486 - RNA, 23 nt, Human
aaaguucugcagauaaacaguag

SEQ ID NO: 2970487 - RNA, 17 nt, Human
aaauaacagaagaaaau

SEQ ID NO: 2970488 - RNA, 16 nt, Human
aaauaacagaagaaaa

SEQ ID NO: 2970489 - RNA, 19 nt, Human
aaauaaguguauuuugaaa

SEQ ID NO: 2970490 - RNA, 14 nt, Human
aaauaaguguauuu

SEQ ID NO: 2970491 - RNA, 13 nt, Human
aaauaaucucuga

SEQ ID NO: 2970492 - RNA, 20 nt, Human
aaauaaguguauuuugaaau

SEQ ID NO: 2970493 - RNA, 14 nt, Human
guaacucuguaauu

SEQ ID NO: 2970494 - RNA, 20 nt, Human
guaauaggcguaacuaauuu

SEQ ID NO: 2970495 - RNA, 18 nt, Human
guaauaugcacacauuuu

SEQ ID NO: 2970496 - RNA, 17 nt, Human
guaauaugcacacauuu

SEQ ID NO: 2970497 - RNA, 16 nt, Human
guaauaugcacacauu

SEQ ID NO: 2970498 - RNA, 14 nt, Human
guaauaugcacaca

SEQ ID NO: 2970499 - RNA, 22 nt, Human
guaauuugugauacaaugcugu

SEQ ID NO: 2970500 - RNA, 21 nt, Human
aaauaauuuuuauauuugaaa

SEQ ID NO: 2970501 - RNA, 14 nt, Human
guacacauaagcca

SEQ ID NO: 2970502 - RNA, 15 nt, Human
aaauacacacucaaa

SEQ ID NO: 2970503 - RNA, 23 nt, Human
aaauaauuuuuauauuugaaaua

SEQ ID NO: 2970504 - RNA, 22 nt, Human
aaauaauuuuuauauuugaaau

SEQ ID NO: 2970505 - RNA, 17 nt, Human
aaauacagauagauaua

SEQ ID NO: 2970506 - RNA, 19 nt, Human
aaauacacacucaaaucaa

SEQ ID NO: 2970507 - RNA, 18 nt, Human
aaauaccagccaguaaau

SEQ ID NO: 2970508 - RNA, 22 nt, Human
aaauacgugggcauucaaaugu

SEQ ID NO: 2970509 - RNA, 14 nt, Human
aaauauaauugaca

SEQ ID NO: 2970510 - RNA, 21 nt, Human
guacucugccacuuuauuucu

SEQ ID NO: 2970511 - RNA, 17 nt, Human
guacuauguaucaauga

SEQ ID NO: 2970512 - RNA, 15 nt, Human
guacuauguaucaau

SEQ ID NO: 2970513 - RNA, 18 nt, Human
guacuacaguccucccau

SEQ ID NO: 2970514 - RNA, 19 nt, Human
guacuacaguccucccauc

SEQ ID NO: 2970515 - RNA, 14 nt, Human
guacccacugcucu

SEQ ID NO: 2970516 - RNA, 13 nt, Human
guacccacugcuc

SEQ ID NO: 2970517 - RNA, 13 nt, Human
guacuauguauca

SEQ ID NO: 2970518 - RNA, 21 nt, Human
guacuaucugugcguagaagu

SEQ ID NO: 2970519 - RNA, 17 nt, Human
guacuacaguccuccca

SEQ ID NO: 2970520 - RNA, 22 nt, Human
guacuucaaauccuugaagauu

SEQ ID NO: 2970521 - RNA, 21 nt, Human
guacuucaaauccuugaagau

SEQ ID NO: 2970522 - RNA, 16 nt, Human
guacuggagaaaaugg

SEQ ID NO: 2970523 - RNA, 20 nt, Human
guagacgugcacgcacacug

SEQ ID NO: 2970524 - RNA, 23 nt, Human
guagacgugcacgcacacugucu

SEQ ID NO: 2970525 - RNA, 12 nt, Human
guagagacaggg

SEQ ID NO: 2970526 - RNA, 11 nt, Human
guagagacagg

SEQ ID NO: 2970527 - RNA, 16 nt, Human
guagacaguuggguuu

SEQ ID NO: 2970528 - RNA, 11 nt, Human
guagagccagg

SEQ ID NO: 2970529 - RNA, 10 nt, Human
guagagccag

SEQ ID NO: 2970530 - RNA, 13 nt, Human
guagagacagggu

SEQ ID NO: 2970531 - RNA, 15 nt, Human
guagagccagggucu

SEQ ID NO: 2970532 - RNA, 14 nt, Human
guagaauguuuuca

SEQ ID NO: 2970533 - RNA, 19 nt, Human
guagaaguucuaguguuuu

SEQ ID NO: 2970534 - RNA, 18 nt, Human
guagaaguucuaguguuu

SEQ ID NO: 2970535 - RNA, 22 nt, Human
guagaaguucuaguguuuucaa

SEQ ID NO: 2970536 - RNA, 21 nt, Human
guagaagucuuagauguauau

SEQ ID NO: 2970537 - RNA, 18 nt, Human
guagaagcccuucuaccu

SEQ ID NO: 2970538 - RNA, 23 nt, Human
guagaaauaucugaaaauguaug

SEQ ID NO: 2970539 - RNA, 21 nt, Human
guagaaauaucugaaaaugua

SEQ ID NO: 2970540 - RNA, 20 nt, Human
guagaaauaucugaaaaugu

SEQ ID NO: 2970541 - RNA, 19 nt, Human
aaaucauuucugcaucagc

SEQ ID NO: 2970542 - RNA, 21 nt, Human
aaaucauuucugcaucagcug

SEQ ID NO: 2970543 - RNA, 22 nt, Human
aaaucauuucugcaucagcugc

SEQ ID NO: 2970544 - RNA, 23 nt, Human
aaaucauuucugcaucagcugcu

SEQ ID NO: 2970545 - RNA, 11 nt, Human
aaaucauuucu

SEQ ID NO: 2970546 - RNA, 19 nt, Human
aaaucagccguguaaccau

SEQ ID NO: 2970547 - RNA, 12 nt, Human
aaaucagccugc

SEQ ID NO: 2970548 - RNA, 18 nt, Human
aaaucagccugcuccagc

SEQ ID NO: 2970549 - RNA, 16 nt, Human
aaaucagcugcuacua

SEQ ID NO: 2970550 - RNA, 12 nt, Human
aaaucauuucug

SEQ ID NO: 2970551 - RNA, 22 nt, Human
aaaucagguuuucuuuuaagaa

SEQ ID NO: 2970552 - RNA, 19 nt, Human
aaaucagguuuucuuuuaa

SEQ ID NO: 2970553 - RNA, 18 nt, Human
aaaucagguuuucuuuua

SEQ ID NO: 2970554 - RNA, 16 nt, Human
aaaucagguuuucuuu

SEQ ID NO: 2970555 - RNA, 14 nt, Human
aaaucagguuuucu

SEQ ID NO: 2970556 - RNA, 17 nt, Human
aaauauuauguuaaaac

SEQ ID NO: 2970557 - RNA, 19 nt, Human
aaauauuaagaaagacuau

SEQ ID NO: 2970558 - RNA, 15 nt, Human
aaauccauacauuug

SEQ ID NO: 2970559 - RNA, 16 nt, Human
guacaugaaaacacau

SEQ ID NO: 2970560 - RNA, 15 nt, Human
guacaugaaaacaca

SEQ ID NO: 2970561 - RNA, 14 nt, Human
guacaugaaaacac

SEQ ID NO: 2970562 - RNA, 20 nt, Human
guacaugaaaacacauuuuu

SEQ ID NO: 2970563 - RNA, 19 nt, Human
guacaugaaaacacauuuu

SEQ ID NO: 2970564 - RNA, 18 nt, Human
guacaugaaaacacauuu

SEQ ID NO: 2970565 - RNA, 17 nt, Human
guacaugaaaacacauu

SEQ ID NO: 2970566 - RNA, 19 nt, Human
guacauggaauaacaugua

SEQ ID NO: 2970567 - RNA, 12 nt, Human
guacccacugcu

SEQ ID NO: 2970568 - RNA, 16 nt, Human
guaccacuuuugcaaa

SEQ ID NO: 2970569 - RNA, 20 nt, Human
aaaaggaagcuuacaugccu

SEQ ID NO: 2970570 - RNA, 12 nt, Human
aaaagcauuuuu

SEQ ID NO: 2970571 - RNA, 23 nt, Human
gggacuuggaagcuccgcuuucu

SEQ ID NO: 2970572 - RNA, 18 nt, Human
gggacuuggaagcuccgc

SEQ ID NO: 2970573 - RNA, 17 nt, Human
gggacuuggaagcuccg

SEQ ID NO: 2970574 - RNA, 15 nt, Human
gggacuuggaagcuc

SEQ ID NO: 2970575 - RNA, 21 nt, Human
gggagaaccaaaaagaggcua

SEQ ID NO: 2970576 - RNA, 18 nt, Human
gggaggucaaggcugcag

SEQ ID NO: 2970577 - RNA, 15 nt, Human
gggagggagggcucc

SEQ ID NO: 2970578 - RNA, 18 nt, Human
gggaggcugaggcaggag

SEQ ID NO: 2970579 - RNA, 16 nt, Human
gggagggagggcucca

SEQ ID NO: 2970580 - RNA, 15 nt, Human
gggagagccuuccag

SEQ ID NO: 2970581 - RNA, 19 nt, Human
gggagagccuuccaggggu

SEQ ID NO: 2970582 - RNA, 23 nt, Human
gggagcaggcucgggcuccccag

SEQ ID NO: 2970583 - RNA, 15 nt, Human
aaaacuucagacaua

SEQ ID NO: 2970584 - RNA, 13 nt, Human
aaaacugagcaua

SEQ ID NO: 2970585 - RNA, 18 nt, Human
aaaacucuccucugcugc

SEQ ID NO: 2970586 - RNA, 17 nt, Human
aaaaaugguuuaaaugg

SEQ ID NO: 2970587 - RNA, 20 nt, Human
aaaaaugguagcauuuuaaa

SEQ ID NO: 2970588 - RNA, 19 nt, Human
aaaaaugguagcauuuuaa

SEQ ID NO: 2970589 - RNA, 14 nt, Human
gggaccagagcugc

SEQ ID NO: 2970590 - RNA, 20 nt, Human
gggaccagagcugccaccug

SEQ ID NO: 2970591 - RNA, 14 nt, Human
aaaaccacagcagu

SEQ ID NO: 2970592 - RNA, 12 nt, Human
aaaacccaagug

SEQ ID NO: 2970593 - RNA, 14 nt, Human
aaaacaugcuacac

SEQ ID NO: 2970594 - RNA, 13 nt, Human
aaaacaugcuaca

SEQ ID NO: 2970595 - RNA, 21 nt, Human
gggacagucaccucauggaau

SEQ ID NO: 2970596 - RNA, 20 nt, Human
gggacagucaccucauggaa

SEQ ID NO: 2970597 - RNA, 22 nt, Human
gggacagucaccucauggaauu

SEQ ID NO: 2970598 - RNA, 15 nt, Human
gggacagcuccuucu

SEQ ID NO: 2970599 - RNA, 13 nt, Human
gggaagagacuug

SEQ ID NO: 2970600 - RNA, 13 nt, Human
gggacagcuccuu

SEQ ID NO: 2970601 - RNA, 12 nt, Human
gggacagcuccu

SEQ ID NO: 2970602 - RNA, 20 nt, Human
gggaacccaaguccaagcau

SEQ ID NO: 2970603 - RNA, 18 nt, Human
gggaagaagcucucuccu

SEQ ID NO: 2970604 - RNA, 21 nt, Human
ggcuuccuccugguguggaag

SEQ ID NO: 2970605 - RNA, 14 nt, Human
aaaaauaacaauga

SEQ ID NO: 2970606 - RNA, 19 nt, Human
ggcugggggccucagugcc

SEQ ID NO: 2970607 - RNA, 17 nt, Human
ggcugggggccucagug

SEQ ID NO: 2970608 - RNA, 16 nt, Human
ggcugggggccucagu

SEQ ID NO: 2970609 - RNA, 15 nt, Human
ggcugggggccucag

SEQ ID NO: 2970610 - RNA, 19 nt, Human
ggcuggguucuacccaggu

SEQ ID NO: 2970611 - RNA, 21 nt, Human
ggcuggguucuacccaggugc

SEQ ID NO: 2970612 - RNA, 19 nt, Human
ggcuggguggcaccagcag

SEQ ID NO: 2970613 - RNA, 18 nt, Human
ggcuguaucccaugagcc

SEQ ID NO: 2970614 - RNA, 20 nt, Human
ggcuucaguggcagcugcuu

SEQ ID NO: 2970615 - RNA, 19 nt, Human
ggcuucaguggcagcugcu

SEQ ID NO: 2970616 - RNA, 17 nt, Human
ggcuucaguggcagcug

SEQ ID NO: 2970617 - RNA, 18 nt, Human
ggcuucaguggcagcugc

SEQ ID NO: 2970618 - RNA, 16 nt, Human
ggcuuccucauaguau

SEQ ID NO: 2970619 - RNA, 18 nt, Human
ggcuucauccuccucaga

SEQ ID NO: 2970620 - RNA, 22 nt, Human
ggcuucauccuccucagaucuu

SEQ ID NO: 2970621 - RNA, 18 nt, Human
ggcugaacuuuguggucg

SEQ ID NO: 2970622 - RNA, 19 nt, Human
ggcugccaaugggagcuca

SEQ ID NO: 2970623 - RNA, 20 nt, Human
ggcugccaaugggagcucau

SEQ ID NO: 2970624 - RNA, 22 nt, Human
ggcugcaugcgggcuuccuccu

SEQ ID NO: 2970625 - RNA, 21 nt, Human
ggcugccaaugggagcucaug

SEQ ID NO: 2970626 - RNA, 22 nt, Human
ggcugcggaaugaaccacaucu

SEQ ID NO: 2970627 - RNA, 12 nt, Human
ggcucuuccagg

SEQ ID NO: 2970628 - RNA, 13 nt, Human
ggcucucaggcca

SEQ ID NO: 2970629 - RNA, 11 nt, Human
ggcucucaggc

SEQ ID NO: 2970630 - RNA, 13 nt, Human
ggcugggagagcc

SEQ ID NO: 2970631 - RNA, 14 nt, Human
ggcugggagagccu

SEQ ID NO: 2970632 - RNA, 15 nt, Human
ggcugggagagccuu

SEQ ID NO: 2970633 - RNA, 16 nt, Human
ggcugggagagccuuc

SEQ ID NO: 2970634 - RNA, 12 nt, Human
ggcugcucccac

SEQ ID NO: 2970635 - RNA, 11 nt, Human
ggcugcuccca

SEQ ID NO: 2970636 - RNA, 19 nt, Human
ggcugcucccaccuggcuc

SEQ ID NO: 2970637 - RNA, 18 nt, Human
ggcugcucccaccuggcu

SEQ ID NO: 2970638 - RNA, 15 nt, Human
ggcugcucccaccug

SEQ ID NO: 2970639 - RNA, 13 nt, Human
ggcugcucccacc

SEQ ID NO: 2970640 - RNA, 22 nt, Human
ggcugcucccaccuggcucugu

SEQ ID NO: 2970641 - RNA, 21 nt, Human
ggcugcucccaccuggcucug

SEQ ID NO: 2970642 - RNA, 18 nt, Human
ggcucagcggggacagcu

SEQ ID NO: 2970643 - RNA, 20 nt, Human
ggcucagcggggacagcucc

SEQ ID NO: 2970644 - RNA, 19 nt, Human
ggcucagcggggacagcuc

SEQ ID NO: 2970645 - RNA, 19 nt, Human
ggcucagguggggucacuc

SEQ ID NO: 2970646 - RNA, 20 nt, Human
ggcucagguggggucacucu

SEQ ID NO: 2970647 - RNA, 14 nt, Human
ggcuccacuugguc

SEQ ID NO: 2970648 - RNA, 19 nt, Human
ggcccuuuuucaauaacug

SEQ ID NO: 2970649 - RNA, 17 nt, Human
ggcccuugucggcccca

SEQ ID NO: 2970650 - RNA, 22 nt, Human
ggcccuucucuccagccccugg

SEQ ID NO: 2970651 - RNA, 23 nt, Human
ggcccuucucuccagccccugga

SEQ ID NO: 2970652 - RNA, 23 nt, Human
ggccucaagugauucuccugccu

SEQ ID NO: 2970653 - RNA, 13 nt, Human
ggccuccauccug

SEQ ID NO: 2970654 - RNA, 15 nt, Human
ggccuccauccugag

SEQ ID NO: 2970655 - RNA, 14 nt, Human
ggccuccauccuga

SEQ ID NO: 2970656 - RNA, 19 nt, Human
ggcccuucucuccagcccc

SEQ ID NO: 2970657 - RNA, 20 nt, Human
ggcccuucucuccagccccu

SEQ ID NO: 2970658 - RNA, 21 nt, Human
ggcccuucucuccagccccug

SEQ ID NO: 2970659 - RNA, 15 nt, Human
ggcccggcuccaggc

SEQ ID NO: 2970660 - RNA, 14 nt, Human
ggccccugcugguu

SEQ ID NO: 2970661 - RNA, 13 nt, Human
ggccccugcuggu

SEQ ID NO: 2970662 - RNA, 13 nt, Human
ggcccggcuccag

SEQ ID NO: 2970663 - RNA, 23 nt, Human
ggccccugcugguucaggguugg

SEQ ID NO: 2970664 - RNA, 20 nt, Human
ggccagugugacaaggauug

SEQ ID NO: 2970665 - RNA, 14 nt, Human
ggccaguugguccc

SEQ ID NO: 2970666 - RNA, 17 nt, Human
ggccaguuggucccccu

SEQ ID NO: 2970667 - RNA, 20 nt, Human
ggcacugguuuguucccugu

SEQ ID NO: 2970668 - RNA, 18 nt, Human
ggcacuuuaaaacacucu

SEQ ID NO: 2970669 - RNA, 16 nt, Human
ggcacuuuaaaacacu

SEQ ID NO: 2970670 - RNA, 11 nt, Human
ggcagccccug

SEQ ID NO: 2970671 - RNA, 23 nt, Human
ggcagccccauucugccugccca

SEQ ID NO: 2970672 - RNA, 23 nt, Human
ggcacagaaaauggaagacagcu

SEQ ID NO: 2970673 - RNA, 21 nt, Human
ggcacaguuuucugagaaaga

SEQ ID NO: 2970674 - RNA, 13 nt, Human
ggcacaucagcac

SEQ ID NO: 2970675 - RNA, 20 nt, Human
ggcacucagaagacacugau

SEQ ID NO: 2970676 - RNA, 23 nt, Human
ggcacucagaagacacugauggg

SEQ ID NO: 2970677 - RNA, 20 nt, Human
ggcacagaaaauggaagaca

SEQ ID NO: 2970678 - RNA, 21 nt, Human
ggcacagaaaauggaagacag

SEQ ID NO: 2970679 - RNA, 19 nt, Human
ggcacagaaaauggaagac

SEQ ID NO: 2970680 - RNA, 16 nt, Human
ggagagaagagaaugc

SEQ ID NO: 2970681 - RNA, 22 nt, Human
ggcagccccuguucuggcagag

SEQ ID NO: 2970682 - RNA, 21 nt, Human
ggcaguggugguuuucuguuc

SEQ ID NO: 2970683 - RNA, 20 nt, Human
ggcaguggugguuuucuguu

SEQ ID NO: 2970684 - RNA, 21 nt, Human
gacccucucaaacuaacaggc

SEQ ID NO: 2970685 - RNA, 12 nt, Human
gacgcugugcug

SEQ ID NO: 2970686 - RNA, 13 nt, Human
gacgcugugcugc

SEQ ID NO: 2970687 - RNA, 15 nt, Human
gacuauucaaacagu

SEQ ID NO: 2970688 - RNA, 16 nt, Human
gacuauucaaacaguc

SEQ ID NO: 2970689 - RNA, 22 nt, Human
gacuuugguuauuuuacuuuuu

SEQ ID NO: 2970690 - RNA, 22 nt, Human
gacuuuguuaguuucuccaagc

SEQ ID NO: 2970691 - RNA, 20 nt, Human
gacuuuuccaacccucauca

SEQ ID NO: 2970692 - RNA, 21 nt, Human
gacuuuucuguccgagcuuug

SEQ ID NO: 2970693 - RNA, 16 nt, Human
gacuguuuucucuuga

SEQ ID NO: 2970694 - RNA, 18 nt, Human
gacuguuuucucuugaga

SEQ ID NO: 2970695 - RNA, 14 nt, Human
gacuuuggaaagac

SEQ ID NO: 2970696 - RNA, 14 nt, Human
gacuuuggaaagag

SEQ ID NO: 2970697 - RNA, 14 nt, Human
gacucaaugcacug

SEQ ID NO: 2970698 - RNA, 17 nt, Human
gacucaaugcacugaca

SEQ ID NO: 2970699 - RNA, 22 nt, Human
gacuguacaaaguagaagucuu

SEQ ID NO: 2970700 - RNA, 17 nt, Human
gagaagcggcuggcagc

SEQ ID NO: 2970701 - RNA, 16 nt, Human
gagaagcggcuggcag

SEQ ID NO: 2970702 - RNA, 15 nt, Human
gacagcuccuucugu

SEQ ID NO: 2970703 - RNA, 14 nt, Human
gacagcuccuucug

SEQ ID NO: 2970704 - RNA, 13 nt, Human
gacagcuccuucu

SEQ ID NO: 2970705 - RNA, 20 nt, Human
gacagaaagcagaacaguga

SEQ ID NO: 2970706 - RNA, 21 nt, Human
gacagcccuucuuuccacaga

SEQ ID NO: 2970707 - RNA, 14 nt, Human
gacagaaagcagaa

SEQ ID NO: 2970708 - RNA, 18 nt, Human
gacccgucuccagcugcu

SEQ ID NO: 2970709 - RNA, 15 nt, Human
gacccgucuccagcu

SEQ ID NO: 2970710 - RNA, 14 nt, Human
gacccgucuccagc

SEQ ID NO: 2970711 - RNA, 16 nt, Human
gacccuauugcugcuu

SEQ ID NO: 2970712 - RNA, 13 nt, Human
gacccggcugcgu

SEQ ID NO: 2970713 - RNA, 12 nt, Human
gacccggcugcg

SEQ ID NO: 2970714 - RNA, 16 nt, Human
gaccaucccugaaggc

SEQ ID NO: 2970715 - RNA, 17 nt, Human
gaccaucccugaaggcc

SEQ ID NO: 2970716 - RNA, 16 nt, Human
gaccauucuccaccug

SEQ ID NO: 2970717 - RNA, 14 nt, Human
gaccaucccugaag

SEQ ID NO: 2970718 - RNA, 15 nt, Human
gaccaucccugaagg

SEQ ID NO: 2970719 - RNA, 12 nt, Human
gagccuuccagg

SEQ ID NO: 2970720 - RNA, 13 nt, Human
gagccuuccaggg

SEQ ID NO: 2970721 - RNA, 15 nt, Human
gagcgacagugagac

SEQ ID NO: 2970722 - RNA, 13 nt, Human
gagcgacagugag

SEQ ID NO: 2970723 - RNA, 17 nt, Human
gagcaucaggccaggcc

SEQ ID NO: 2970724 - RNA, 19 nt, Human
gagcugccuguucagcucc

SEQ ID NO: 2970725 - RNA, 16 nt, Human
gagcugccuguucagc

SEQ ID NO: 2970726 - RNA, 15 nt, Human
gagcugccuguucag

SEQ ID NO: 2970727 - RNA, 20 nt, Human
gagcaucaggccaggcccuc

SEQ ID NO: 2970728 - RNA, 22 nt, Human
gagcaucaggccaggcccucug

SEQ ID NO: 2970729 - RNA, 18 nt, Human
gagucagaaguuucugcc

SEQ ID NO: 2970730 - RNA, 18 nt, Human
gagugagacucugucuca

SEQ ID NO: 2970731 - RNA, 14 nt, Human
gagugagacucugu

SEQ ID NO: 2970732 - RNA, 18 nt, Human
gagugcagugagccgaga

SEQ ID NO: 2970733 - RNA, 13 nt, Human
gagugcagugagc

SEQ ID NO: 2970734 - RNA, 22 nt, Human
gaguugauacuacaguuuguua

SEQ ID NO: 2970735 - RNA, 21 nt, Human
gaguugauagcacagacccug

SEQ ID NO: 2970736 - RNA, 19 nt, Human
gaguugauacuacaguuug

SEQ ID NO: 2970737 - RNA, 14 nt, Human
gagucacuggaaca

SEQ ID NO: 2970738 - RNA, 21 nt, Human
gagucacuggaacacuaauga

SEQ ID NO: 2970739 - RNA, 17 nt, Human
gaggugggauccuccag

SEQ ID NO: 2970740 - RNA, 15 nt, Human
gaggugggauccucc

SEQ ID NO: 2970741 - RNA, 16 nt, Human
gaggugggauccucca

SEQ ID NO: 2970742 - RNA, 13 nt, Human
gaggugggauccu

SEQ ID NO: 2970743 - RNA, 12 nt, Human
gagggcuccaga

SEQ ID NO: 2970744 - RNA, 13 nt, Human
gagggcuccagac

SEQ ID NO: 2970745 - RNA, 14 nt, Human
gagggcuccagaca

SEQ ID NO: 2970746 - RNA, 15 nt, Human
gagggcuccagacac

SEQ ID NO: 2970747 - RNA, 12 nt, Human
gaggggaacaga

SEQ ID NO: 2970748 - RNA, 12 nt, Human
gaggcucugccc

SEQ ID NO: 2970749 - RNA, 13 nt, Human
gaggcucugcccu

SEQ ID NO: 2970750 - RNA, 14 nt, Human
gaggcucugcccuu

SEQ ID NO: 2970751 - RNA, 15 nt, Human
gaggcucugcccuug

SEQ ID NO: 2970752 - RNA, 17 nt, Human
gaggcucugcccuuggu

SEQ ID NO: 2970753 - RNA, 20 nt, Human
gaggccagagacacaagccu

SEQ ID NO: 2970754 - RNA, 14 nt, Human
gcaggcuggaguua

SEQ ID NO: 2970755 - RNA, 17 nt, Human
gcaggcugccagugccu

SEQ ID NO: 2970756 - RNA, 18 nt, Human
gcaggcugccagugccug

SEQ ID NO: 2970757 - RNA, 17 nt, Human
gcaggcucucaggccag

SEQ ID NO: 2970758 - RNA, 22 nt, Human
gcagggaaacagcuaaugggac

SEQ ID NO: 2970759 - RNA, 13 nt, Human
gcagggaaacagc

SEQ ID NO: 2970760 - RNA, 13 nt, Human
gcaggcucucagg

SEQ ID NO: 2970761 - RNA, 14 nt, Human
gcaggcucucaggc

SEQ ID NO: 2970762 - RNA, 15 nt, Human
gcaggcucucaggcc

SEQ ID NO: 2970763 - RNA, 16 nt, Human
gcaggcucucaggcca

SEQ ID NO: 2970764 - RNA, 22 nt, Human
gcaggcucgggcuccccagccc

SEQ ID NO: 2970765 - RNA, 12 nt, Human
gcaggcucucag

SEQ ID NO: 2970766 - RNA, 21 nt, Human
gcagcuugaggguugggcugg

SEQ ID NO: 2970767 - RNA, 19 nt, Human
gcagcuugaggguugggcu

SEQ ID NO: 2970768 - RNA, 15 nt, Human
gcagcuuauucacaa

SEQ ID NO: 2970769 - RNA, 16 nt, Human
gcagcuugaggguugg

SEQ ID NO: 2970770 - RNA, 20 nt, Human
gcagcugcuuuugucuaugg

SEQ ID NO: 2970771 - RNA, 13 nt, Human
gcagcugcuuuug

SEQ ID NO: 2970772 - RNA, 23 nt, Human
gcagcugcgguccacccaggagc

SEQ ID NO: 2970773 - RNA, 22 nt, Human
gcagcugcgguccacccaggag

SEQ ID NO: 2970774 - RNA, 16 nt, Human
gcacuuuguucuggcu

SEQ ID NO: 2970775 - RNA, 18 nt, Human
gcacuuugggaggcugag

SEQ ID NO: 2970776 - RNA, 22 nt, Human
gcaguugaaaagacuccaaaga

SEQ ID NO: 2970777 - RNA, 14 nt, Human
gcaguugccaguca

SEQ ID NO: 2970778 - RNA, 23 nt, Human
gcaguugccagucaccccggcca

SEQ ID NO: 2970779 - RNA, 15 nt, Human
gcauaaaaauuagcc

SEQ ID NO: 2970780 - RNA, 15 nt, Human
gcauaccacuuuugu

SEQ ID NO: 2970781 - RNA, 17 nt, Human
gccaaggccaaaggaag

SEQ ID NO: 2970782 - RNA, 11 nt, Human
gccaaggccaa

SEQ ID NO: 2970783 - RNA, 14 nt, Human
gccaagaauucuua

SEQ ID NO: 2970784 - RNA, 18 nt, Human
gccaagaauucuuaaaua

SEQ ID NO: 2970785 - RNA, 16 nt, Human
gcauuugaaaauuuug

SEQ ID NO: 2970786 - RNA, 14 nt, Human
gcauuugaaaauuu

SEQ ID NO: 2970787 - RNA, 15 nt, Human
gcauuuaaaagauac

SEQ ID NO: 2970788 - RNA, 12 nt, Human
gcauuuaaaaga

SEQ ID NO: 2970789 - RNA, 16 nt, Human
gcauuguaaaugugcu

SEQ ID NO: 2970790 - RNA, 17 nt, Human
gcaugugaugagaggaa

SEQ ID NO: 2970791 - RNA, 18 nt, Human
gcauguauuuuugucaau

SEQ ID NO: 2970792 - RNA, 13 nt, Human
gcaugggaaugaa

SEQ ID NO: 2970793 - RNA, 16 nt, Human
gcaugggaaugaaugu

SEQ ID NO: 2970794 - RNA, 19 nt, Human
gcaugggaaugaaugucag

SEQ ID NO: 2970795 - RNA, 23 nt, Human
gcauccuggcacccggccccugc

SEQ ID NO: 2970796 - RNA, 22 nt, Human
gcauccuggcacccggccccug

SEQ ID NO: 2970797 - RNA, 14 nt, Human
gcauccuggcaccc

SEQ ID NO: 2970798 - RNA, 21 nt, Human
gcauccuggcacccggccccu

SEQ ID NO: 2970799 - RNA, 17 nt, Human
gcauccuggcacccggc

SEQ ID NO: 2970800 - RNA, 21 nt, Human
gaugcugucuucguacuggga

SEQ ID NO: 2970801 - RNA, 21 nt, Human
gaugaugaaaugaggucagag

SEQ ID NO: 2970802 - RNA, 16 nt, Human
gaugcuuguacauaau

SEQ ID NO: 2970803 - RNA, 14 nt, Human
gaugcuuguacaua

SEQ ID NO: 2970804 - RNA, 19 nt, Human
gauggaggacuccaggcag

SEQ ID NO: 2970805 - RNA, 18 nt, Human
gaucuggguucacugcaa

SEQ ID NO: 2970806 - RNA, 20 nt, Human
gaucuggguucacugcaacc

SEQ ID NO: 2970807 - RNA, 21 nt, Human
gauucuuguauuuauuacaac

SEQ ID NO: 2970808 - RNA, 15 nt, Human
gauucuuguauuuau

SEQ ID NO: 2970809 - RNA, 23 nt, Human
gauuuaacagaaauguacagcaa

SEQ ID NO: 2970810 - RNA, 20 nt, Human
gauuuaacagaaauguacag

SEQ ID NO: 2970811 - RNA, 23 nt, Human
gauucuuauggacaaugacccag

SEQ ID NO: 2970812 - RNA, 21 nt, Human
gauucuucugcuucagccucc

SEQ ID NO: 2970813 - RNA, 21 nt, Human
gauucuccugccucagccucc

SEQ ID NO: 2970814 - RNA, 20 nt, Human
gauucuccugccucagccuc

SEQ ID NO: 2970815 - RNA, 19 nt, Human
gauucuccugccucagccu

SEQ ID NO: 2970816 - RNA, 17 nt, Human
gauuucacucuccuugg

SEQ ID NO: 2970817 - RNA, 18 nt, Human
gauuucacucuccuuggu

SEQ ID NO: 2970818 - RNA, 13 nt, Human
gauuucacucucc

SEQ ID NO: 2970819 - RNA, 16 nt, Human
gauuucacucuccuug

SEQ ID NO: 2970820 - RNA, 23 nt, Human
gauuuuuuuuuccuucagugccu

SEQ ID NO: 2970821 - RNA, 22 nt, Human
gauuuuuuuuuccuucagugcc

SEQ ID NO: 2970822 - RNA, 16 nt, Human
gcaaaaaaaauuagcc

SEQ ID NO: 2970823 - RNA, 13 nt, Human
gcaaaaaaaauua

SEQ ID NO: 2970824 - RNA, 11 nt, Human
gcaauaaagca

SEQ ID NO: 2970825 - RNA, 16 nt, Human
gcaauaaaauggguuu

SEQ ID NO: 2970826 - RNA, 18 nt, Human
gcaauagucaaauugugu

SEQ ID NO: 2970827 - RNA, 23 nt, Human
gcaauaaggggagaguaacccug

SEQ ID NO: 2970828 - RNA, 19 nt, Human
gcacacaccagagcccacc

SEQ ID NO: 2970829 - RNA, 18 nt, Human
gcacacaccagagcccac

SEQ ID NO: 2970830 - RNA, 17 nt, Human
gcacacaccagagccca

SEQ ID NO: 2970831 - RNA, 16 nt, Human
gcacacaccagagccc

SEQ ID NO: 2970832 - RNA, 15 nt, Human
gcacacaccagagcc

SEQ ID NO: 2970833 - RNA, 14 nt, Human
gcacacaccagagc

SEQ ID NO: 2970834 - RNA, 12 nt, Human
gcacacaccaga

SEQ ID NO: 2970835 - RNA, 15 nt, Human
gcaaaagaugcuucu

SEQ ID NO: 2970836 - RNA, 18 nt, Human
gcaacccccagccugcua

SEQ ID NO: 2970837 - RNA, 16 nt, Human
gcaaaagaugcuucuc

SEQ ID NO: 2970838 - RNA, 17 nt, Human
gcaacccccagccugcu

SEQ ID NO: 2970839 - RNA, 22 nt, Human
gcaacccuggugaccagcacca

SEQ ID NO: 2970840 - RNA, 18 nt, Human
gcaaccuccgccucuugg

SEQ ID NO: 2970841 - RNA, 12 nt, Human
gcacacauuuuu

SEQ ID NO: 2970842 - RNA, 11 nt, Human
gcacacauuuu

SEQ ID NO: 2970843 - RNA, 20 nt, Human
gcacacaccagagcccaccu

SEQ ID NO: 2970844 - RNA, 17 nt, Human
gcaccggcuggccuggc

SEQ ID NO: 2970845 - RNA, 15 nt, Human
gcaccggcuggccug

SEQ ID NO: 2970846 - RNA, 16 nt, Human
gcaccggcuggccugg

SEQ ID NO: 2970847 - RNA, 12 nt, Human
gcaccuccugcc

SEQ ID NO: 2970848 - RNA, 17 nt, Human
gcacuccagccugggug

SEQ ID NO: 2970849 - RNA, 15 nt, Human
gcacuccagccuggg

SEQ ID NO: 2970850 - RNA, 18 nt, Human
gcacuauuuauuuacaaa

SEQ ID NO: 2970851 - RNA, 17 nt, Human
gcacuauuuauuuacaa

SEQ ID NO: 2970852 - RNA, 21 nt, Human
gcacuauuuauuuacaaaugu

SEQ ID NO: 2970853 - RNA, 15 nt, Human
gcacuauuuauuuac

SEQ ID NO: 2970854 - RNA, 22 nt, Human
gcacuauagccuaggugacaga

SEQ ID NO: 2970855 - RNA, 22 nt, Human
gcacuauaauguaagcucuacu

SEQ ID NO: 2970856 - RNA, 12 nt, Human
gaaagggauuuu

SEQ ID NO: 2970857 - RNA, 20 nt, Human
gaaagggauuuucagcccuc

SEQ ID NO: 2970858 - RNA, 13 nt, Human
gaaagggcccaga

SEQ ID NO: 2970859 - RNA, 12 nt, Human
gaaaggcuccag

SEQ ID NO: 2970860 - RNA, 14 nt, Human
gaaaggcuccagga

SEQ ID NO: 2970861 - RNA, 15 nt, Human
gaaaggcuccaggag

SEQ ID NO: 2970862 - RNA, 13 nt, Human
gaaaggcuccagg

SEQ ID NO: 2970863 - RNA, 18 nt, Human
gaaagaaaaucaggcugg

SEQ ID NO: 2970864 - RNA, 16 nt, Human
gaaacuggcaaagcag

SEQ ID NO: 2970865 - RNA, 17 nt, Human
gaaacuggcaaagcaga

SEQ ID NO: 2970866 - RNA, 17 nt, Human
gaaacuggauuaaacuu

SEQ ID NO: 2970867 - RNA, 13 nt, Human
gaaacuggauuaa

SEQ ID NO: 2970868 - RNA, 16 nt, Human
gaaagggcccagagag

SEQ ID NO: 2970869 - RNA, 15 nt, Human
gaaagggcccagaga

SEQ ID NO: 2970870 - RNA, 18 nt, Human
gaaaucuaggaaaauuau

SEQ ID NO: 2970871 - RNA, 21 nt, Human
gaaaacuuuaugcuaagugaa

SEQ ID NO: 2970872 - RNA, 23 nt, Human
gaaaagaaaaaugagccuggcaa

SEQ ID NO: 2970873 - RNA, 14 nt, Human
gaaaagacuccaaa

SEQ ID NO: 2970874 - RNA, 16 nt, Human
gaaaagacuccaaaga

SEQ ID NO: 2970875 - RNA, 17 nt, Human
gaaaagacuccaaagaa

SEQ ID NO: 2970876 - RNA, 16 nt, Human
gaaaauuauucuauaa

SEQ ID NO: 2970877 - RNA, 16 nt, Human
gaagacucauucuucu

SEQ ID NO: 2970878 - RNA, 18 nt, Human
gaagacucauucuucugu

SEQ ID NO: 2970879 - RNA, 17 nt, Human
gaagacucauucuucug

SEQ ID NO: 2970880 - RNA, 17 nt, Human
gaagcacagugaucaag

SEQ ID NO: 2970881 - RNA, 22 nt, Human
gaagcacaugccucucucaggc

SEQ ID NO: 2970882 - RNA, 14 nt, Human
gaagcacagcuuca

SEQ ID NO: 2970883 - RNA, 13 nt, Human
gaagcacagcuuc

SEQ ID NO: 2970884 - RNA, 16 nt, Human
gaagcaccauaacuuu

SEQ ID NO: 2970885 - RNA, 21 nt, Human
gaagcacaugccucucucagg

SEQ ID NO: 2970886 - RNA, 20 nt, Human
gaagcacccauuaugcgcug

SEQ ID NO: 2970887 - RNA, 14 nt, Human
gaagacagcucuua

SEQ ID NO: 2970888 - RNA, 15 nt, Human
gaagacagcucuuau

SEQ ID NO: 2970889 - RNA, 13 nt, Human
gaagacagagcua

SEQ ID NO: 2970890 - RNA, 15 nt, Human
gaagacagagcuaca

SEQ ID NO: 2970891 - RNA, 12 nt, Human
gaagacagcucu

SEQ ID NO: 2970892 - RNA, 13 nt, Human
gaagacagcucuu

SEQ ID NO: 2970893 - RNA, 21 nt, Human
gaagacacugaugggcaaccc

SEQ ID NO: 2970894 - RNA, 16 nt, Human
gaagacacugaugggc

SEQ ID NO: 2970895 - RNA, 16 nt, Human
gaacccaaguccaagc

SEQ ID NO: 2970896 - RNA, 17 nt, Human
gaacccaaguccaagca

SEQ ID NO: 2970897 - RNA, 22 nt, Human
gaaccauggucggaaaacaugc

SEQ ID NO: 2970898 - RNA, 23 nt, Human
gaaccaccacacccagcccacuu

SEQ ID NO: 2970899 - RNA, 17 nt, Human
gaacccgggaggcagag

SEQ ID NO: 2970900 - RNA, 13 nt, Human
gaacuccuggccu

SEQ ID NO: 2970901 - RNA, 14 nt, Human
gaacuccuggccuc

SEQ ID NO: 2970902 - RNA, 17 nt, Human
gaacugauguaaguaaa

SEQ ID NO: 2970903 - RNA, 20 nt, Human
gaacugaucauguuuaugag

SEQ ID NO: 2970904 - RNA, 22 nt, Human
gaacugaucauguuuaugagaa

SEQ ID NO: 2970905 - RNA, 22 nt, Human
gaaccaccacacccagcccacu

SEQ ID NO: 2970906 - RNA, 21 nt, Human
gaaccaccacacccagcccac

SEQ ID NO: 2970907 - RNA, 20 nt, Human
gaaccaccacacccagccca

SEQ ID NO: 2970908 - RNA, 18 nt, Human
gaaccaccacacccagcc

SEQ ID NO: 2970909 - RNA, 22 nt, Human
cuugugaauaaagagggugggu

SEQ ID NO: 2970910 - RNA, 13 nt, Human
cuugucuuuggac

SEQ ID NO: 2970911 - RNA, 15 nt, Human
cuugucuuuggaccc

SEQ ID NO: 2970912 - RNA, 18 nt, Human
cuugucuuuggacccuga

SEQ ID NO: 2970913 - RNA, 19 nt, Human
cuuggugucgggcaugaca

SEQ ID NO: 2970914 - RNA, 14 nt, Human
cuugguccugcugc

SEQ ID NO: 2970915 - RNA, 16 nt, Human
cuuggucugugagaug

SEQ ID NO: 2970916 - RNA, 19 nt, Human
cuuggucugugagaugcua

SEQ ID NO: 2970917 - RNA, 22 nt, Human
cuugguagaagcccuucuaccu

SEQ ID NO: 2970918 - RNA, 20 nt, Human
cuuuaccaauugaaguaaaa

SEQ ID NO: 2970919 - RNA, 19 nt, Human
cuuuaccaauugaaguaaa

SEQ ID NO: 2970920 - RNA, 16 nt, Human
cuuuaccaauugaagu

SEQ ID NO: 2970921 - RNA, 18 nt, Human
cuuuaccaauugaaguaa

SEQ ID NO: 2970922 - RNA, 14 nt, Human
cuuucacccuuuuc

SEQ ID NO: 2970923 - RNA, 15 nt, Human
cuuucacccuuuucu

SEQ ID NO: 2970924 - RNA, 20 nt, Human
cuuucacccuuuucuguuug

SEQ ID NO: 2970925 - RNA, 23 nt, Human
cuuuaaugucacaggcaggucca

SEQ ID NO: 2970926 - RNA, 13 nt, Human
cuuugguuauuuu

SEQ ID NO: 2970927 - RNA, 20 nt, Human
cuuugcacacuuuggcccag

SEQ ID NO: 2970928 - RNA, 19 nt, Human
cuuugcacacuuuggccca

SEQ ID NO: 2970929 - RNA, 22 nt, Human
cuuugcacacuuuggcccaggg

SEQ ID NO: 2970930 - RNA, 19 nt, Human
cuuugguuauuuuacuuuu

SEQ ID NO: 2970931 - RNA, 17 nt, Human
cuuugguuauuuuacuu

SEQ ID NO: 2970932 - RNA, 23 nt, Human
cuuugguuauuuuacuuuuugga

SEQ ID NO: 2970933 - RNA, 15 nt, Human
cuuugcacacuuugg

SEQ ID NO: 2970934 - RNA, 17 nt, Human
cuuuguauucucuccug

SEQ ID NO: 2970935 - RNA, 21 nt, Human
cuuuuauaaacuuuaccuuuu

SEQ ID NO: 2970936 - RNA, 20 nt, Human
cuuuuauaaacuuuaccuuu

SEQ ID NO: 2970937 - RNA, 22 nt, Human
cuuuguauucucuccuguaccu

SEQ ID NO: 2970938 - RNA, 19 nt, Human
cuuuuauaaacuuuaccuu

SEQ ID NO: 2970939 - RNA, 16 nt, Human
cuuugacgccauccca

SEQ ID NO: 2970940 - RNA, 17 nt, Human
cuuugacgccaucccag

SEQ ID NO: 2970941 - RNA, 16 nt, Human
cuuucuacccagcgag

SEQ ID NO: 2970942 - RNA, 15 nt, Human
cuuucuacccagcga

SEQ ID NO: 2970943 - RNA, 13 nt, Human
cuucuaaguaaaa

SEQ ID NO: 2970944 - RNA, 17 nt, Human
cuucuaaguaaaaccac

SEQ ID NO: 2970945 - RNA, 21 nt, Human
cuucuaaguaaaaccacagca

SEQ ID NO: 2970946 - RNA, 13 nt, Human
cuucucacauuua

SEQ ID NO: 2970947 - RNA, 20 nt, Human
cuucucacauuuauauuuuu

SEQ ID NO: 2970948 - RNA, 21 nt, Human
cuuccucuuuccaucuacccu

SEQ ID NO: 2970949 - RNA, 22 nt, Human
cuuccucuuuccaucuacccuc

SEQ ID NO: 2970950 - RNA, 13 nt, Human
cuuccuccuggug

SEQ ID NO: 2970951 - RNA, 23 nt, Human
cuucugaacuuggcgcugccccu

SEQ ID NO: 2970952 - RNA, 13 nt, Human
cuucuucagagac

SEQ ID NO: 2970953 - RNA, 14 nt, Human
cuucuucagagacu

SEQ ID NO: 2970954 - RNA, 16 nt, Human
cuugacaucaacugca

SEQ ID NO: 2970955 - RNA, 20 nt, Human
cuugacagggcacaccgggc

SEQ ID NO: 2970956 - RNA, 22 nt, Human
cuugauauccucuuugagugaa

SEQ ID NO: 2970957 - RNA, 17 nt, Human
cuugauauccucuuuga

SEQ ID NO: 2970958 - RNA, 18 nt, Human
cuugauguguuaucucuu

SEQ ID NO: 2970959 - RNA, 12 nt, Human
cuugcaaaguau

SEQ ID NO: 2970960 - RNA, 12 nt, Human
cuugauucauaa

SEQ ID NO: 2970961 - RNA, 23 nt, Human
cuuggauuguccccgacccuugc

SEQ ID NO: 2970962 - RNA, 24 nt, Human
cuuggauuguccccgacccuugcc

SEQ ID NO: 2970963 - RNA, 22 nt, Human
cuuggauuguccccgacccuug

SEQ ID NO: 2970964 - RNA, 17 nt, Human
cugucggagcccugucu

SEQ ID NO: 2970965 - RNA, 16 nt, Human
cugucgcccagucugg

SEQ ID NO: 2970966 - RNA, 15 nt, Human
cugucgcccagucug

SEQ ID NO: 2970967 - RNA, 23 nt, Human
cugucaauuacaggaaguacugg

SEQ ID NO: 2970968 - RNA, 19 nt, Human
cugucaauuacaggaagua

SEQ ID NO: 2970969 - RNA, 20 nt, Human
cugucaauuacaggaaguac

SEQ ID NO: 2970970 - RNA, 21 nt, Human
cuguccugggagugagcuggu

SEQ ID NO: 2970971 - RNA, 13 nt, Human
cuguagaguggga

SEQ ID NO: 2970972 - RNA, 13 nt, Human
cuguuauaaucuu

SEQ ID NO: 2970973 - RNA, 15 nt, Human
cugugcugcccugcc

SEQ ID NO: 2970974 - RNA, 17 nt, Human
cugugcugcccugccca

SEQ ID NO: 2970975 - RNA, 18 nt, Human
cugugcugcccugcccac

SEQ ID NO: 2970976 - RNA, 19 nt, Human
cugugcugcccugcccacc

SEQ ID NO: 2970977 - RNA, 17 nt, Human
cugugucagcauagaag

SEQ ID NO: 2970978 - RNA, 19 nt, Human
cugugucagcauagaagua

SEQ ID NO: 2970979 - RNA, 18 nt, Human
cugugccucugggacugg

SEQ ID NO: 2970980 - RNA, 13 nt, Human
cugugcugcccug

SEQ ID NO: 2970981 - RNA, 14 nt, Human
cugugcugcccugc

SEQ ID NO: 2970982 - RNA, 12 nt, Human
cugugcugcccu

SEQ ID NO: 2970983 - RNA, 14 nt, Human
cuuaaaacaacacu

SEQ ID NO: 2970984 - RNA, 15 nt, Human
cuuaccagcagagca

SEQ ID NO: 2970985 - RNA, 21 nt, Human
cuuaaaaaugguuuaaauggu

SEQ ID NO: 2970986 - RNA, 22 nt, Human
cuguuggcugggggccucagug

SEQ ID NO: 2970987 - RNA, 19 nt, Human
cuguuggcugggggccuca

SEQ ID NO: 2970988 - RNA, 14 nt, Human
cuguuggcuggggg

SEQ ID NO: 2970989 - RNA, 23 nt, Human
cuuagcucauucuccuuguguua

SEQ ID NO: 2970990 - RNA, 22 nt, Human
cuuagcucauucuccuuguguu

SEQ ID NO: 2970991 - RNA, 16 nt, Human
cuuaccagcagagcac

SEQ ID NO: 2970992 - RNA, 21 nt, Human
cuuagcagggaaacagcuaau

SEQ ID NO: 2970993 - RNA, 19 nt, Human
cuuagggaaggauacaaaa

SEQ ID NO: 2970994 - RNA, 21 nt, Human
cuuagggaaggauacaaaagc

SEQ ID NO: 2970995 - RNA, 18 nt, Human
cuggauaguccgucucug

SEQ ID NO: 2970996 - RNA, 19 nt, Human
cuggauaguccgucucugc

SEQ ID NO: 2970997 - RNA, 18 nt, Human
cuggauauagcuagguga

SEQ ID NO: 2970998 - RNA, 14 nt, Human
cuggagaaaaugga

SEQ ID NO: 2970999 - RNA, 18 nt, Human
cuggacugagggggccug

SEQ ID NO: 2971000 - RNA, 22 nt, Human
cuggacugagggggccuggaug

SEQ ID NO: 2971001 - RNA, 21 nt, Human
cuggacugagggggccuggau

SEQ ID NO: 2971002 - RNA, 20 nt, Human
cuggacugagggggccugga

SEQ ID NO: 2971003 - RNA, 23 nt, Human
cuggacugagggggccuggaugc

SEQ ID NO: 2971004 - RNA, 19 nt, Human
cugcuuuuuaaagaaugcu

SEQ ID NO: 2971005 - RNA, 21 nt, Human
cugcuuuugucuaugggacuc

SEQ ID NO: 2971006 - RNA, 19 nt, Human
cugcuuuugucuaugggac

SEQ ID NO: 2971007 - RNA, 19 nt, Human
cugcuucaaauauuucccu

SEQ ID NO: 2971008 - RNA, 12 nt, Human
cugcuucaagga

SEQ ID NO: 2971009 - RNA, 13 nt, Human
cugcuucaaggau

SEQ ID NO: 2971010 - RNA, 21 nt, Human
cugcuucaaggauccugagcc

SEQ ID NO: 2971011 - RNA, 22 nt, Human
cugcuucaaggauccugagcca

SEQ ID NO: 2971012 - RNA, 23 nt, Human
cugcuucaaggauccugagccag

SEQ ID NO: 2971013 - RNA, 20 nt, Human
cugcuuuugucuaugggacu

SEQ ID NO: 2971014 - RNA, 20 nt, Human
cugcuucaaggauccugagc

SEQ ID NO: 2971015 - RNA, 14 nt, Human
cugcuucaaauauu

SEQ ID NO: 2971016 - RNA, 23 nt, Human
cugccucucccaucacuucccua

SEQ ID NO: 2971017 - RNA, 22 nt, Human
cugccucucccaucacuucccu

SEQ ID NO: 2971018 - RNA, 15 nt, Human
cugccucucccauca

SEQ ID NO: 2971019 - RNA, 20 nt, Human
cugccuguugggccaggagc

SEQ ID NO: 2971020 - RNA, 19 nt, Human
cugccuguucagcuccagc

SEQ ID NO: 2971021 - RNA, 18 nt, Human
cugccuguucagcuccag

SEQ ID NO: 2971022 - RNA, 17 nt, Human
cugccuguucagcucca

SEQ ID NO: 2971023 - RNA, 21 nt, Human
cugccuccccuccucugcuug

SEQ ID NO: 2971024 - RNA, 21 nt, Human
cugccuguugggccaggagcc

SEQ ID NO: 2971025 - RNA, 22 nt, Human
cugccuguugggccaggagccu

SEQ ID NO: 2971026 - RNA, 23 nt, Human
cugccuguugggccaggagccuc

SEQ ID NO: 2971027 - RNA, 18 nt, Human
cugcugacuguuuucucu

SEQ ID NO: 2971028 - RNA, 21 nt, Human
cugcugacuguuuucucuuga

SEQ ID NO: 2971029 - RNA, 15 nt, Human
cuggguucacugcaa

SEQ ID NO: 2971030 - RNA, 20 nt, Human
cuggguucacugcaaccucc

SEQ ID NO: 2971031 - RNA, 18 nt, Human
cuggguucacugcaaccu

SEQ ID NO: 2971032 - RNA, 14 nt, Human
cuggggagaaagua

SEQ ID NO: 2971033 - RNA, 12 nt, Human
cugggcagaagg

SEQ ID NO: 2971034 - RNA, 15 nt, Human
cugggcagaaggaag

SEQ ID NO: 2971035 - RNA, 22 nt, Human
cuggccccucagggucccuggu

SEQ ID NO: 2971036 - RNA, 14 nt, Human
cuggccuagcauac

SEQ ID NO: 2971037 - RNA, 11 nt, Human
cugggacacag

SEQ ID NO: 2971038 - RNA, 11 nt, Human
cuggcagccca

SEQ ID NO: 2971039 - RNA, 12 nt, Human
cuggcagccccu

SEQ ID NO: 2971040 - RNA, 17 nt, Human
cuggcagaguugaagac

SEQ ID NO: 2971041 - RNA, 18 nt, Human
cuggcagaguugaagaca

SEQ ID NO: 2971042 - RNA, 14 nt, Human
auuauguuaauauu

SEQ ID NO: 2971043 - RNA, 16 nt, Human
auuauguuaauauuuc

SEQ ID NO: 2971044 - RNA, 13 nt, Human
auuauguuaauau

SEQ ID NO: 2971045 - RNA, 17 nt, Human
auuauguuaauauuucu

SEQ ID NO: 2971046 - RNA, 20 nt, Human
auuauuaccuuacagaaguu

SEQ ID NO: 2971047 - RNA, 18 nt, Human
auuaucuagauacuguau

SEQ ID NO: 2971048 - RNA, 14 nt, Human
auuaucuagauacu

SEQ ID NO: 2971049 - RNA, 21 nt, Human
auuauguuaaaacugggacag

SEQ ID NO: 2971050 - RNA, 18 nt, Human
auuauauuuauuacugua

SEQ ID NO: 2971051 - RNA, 15 nt, Human
auuauauuuauuacu

SEQ ID NO: 2971052 - RNA, 19 nt, Human
auucaaacagucucaggaa

SEQ ID NO: 2971053 - RNA, 20 nt, Human
auucaaacagucucaggaaa

SEQ ID NO: 2971054 - RNA, 16 nt, Human
auucaaacagucucag

SEQ ID NO: 2971055 - RNA, 18 nt, Human
auucaaacagucucagga

SEQ ID NO: 2971056 - RNA, 13 nt, Human
auucaggaagcuc

SEQ ID NO: 2971057 - RNA, 14 nt, Human
auucagacagcugc

SEQ ID NO: 2971058 - RNA, 15 nt, Human
auucagacagcugcc

SEQ ID NO: 2971059 - RNA, 16 nt, Human
auucagacagcugccu

SEQ ID NO: 2971060 - RNA, 17 nt, Human
auucagacagcugccug

SEQ ID NO: 2971061 - RNA, 18 nt, Human
auucagacagcugccugg

SEQ ID NO: 2971062 - RNA, 12 nt, Human
auucaggaagcu

SEQ ID NO: 2971063 - RNA, 12 nt, Human
auucagacagcu

SEQ ID NO: 2971064 - RNA, 13 nt, Human
auucagacagcug

SEQ ID NO: 2971065 - RNA, 11 nt, Human
auucagacagc

SEQ ID NO: 2971066 - RNA, 16 nt, Human
auuauauucauucuuu

SEQ ID NO: 2971067 - RNA, 17 nt, Human
uuuguggaaaauaacuc

SEQ ID NO: 2971068 - RNA, 19 nt, Human
auucagacagcugccuggg

SEQ ID NO: 2971069 - RNA, 13 nt, Human
auugaagcagagu

SEQ ID NO: 2971070 - RNA, 15 nt, Human
auugaagcagagugg

SEQ ID NO: 2971071 - RNA, 14 nt, Human
auugaagcagagug

SEQ ID NO: 2971072 - RNA, 18 nt, Human
auugaagcagaguggcag

SEQ ID NO: 2971073 - RNA, 17 nt, Human
auugacacuuaaaaaug

SEQ ID NO: 2971074 - RNA, 15 nt, Human
auugacacuuaaaaa

SEQ ID NO: 2971075 - RNA, 17 nt, Human
auugaccugaggcccuu

SEQ ID NO: 2971076 - RNA, 19 nt, Human
auugacacuuaaaaauggu

SEQ ID NO: 2971077 - RNA, 17 nt, Human
auugaaaucuuuuugcu

SEQ ID NO: 2971078 - RNA, 18 nt, Human
auugaaaucuuuuugcuu

SEQ ID NO: 2971079 - RNA, 20 nt, Human
auugaaaucuuuuugcuuug

SEQ ID NO: 2971080 - RNA, 12 nt, Human
auugaaaucuuu

SEQ ID NO: 2971081 - RNA, 14 nt, Human
auucuuaaauaugu

SEQ ID NO: 2971082 - RNA, 14 nt, Human
auucuguuggccag

SEQ ID NO: 2971083 - RNA, 21 nt, Human
auucuguuggccagugugaca

SEQ ID NO: 2971084 - RNA, 19 nt, Human
auucuguuggccaguguga

SEQ ID NO: 2971085 - RNA, 22 nt, Human
auucugcucacauaucugucau

SEQ ID NO: 2971086 - RNA, 21 nt, Human
auucugcucacauaucuguca

SEQ ID NO: 2971087 - RNA, 20 nt, Human
auucugcucacauaucuguc

SEQ ID NO: 2971088 - RNA, 19 nt, Human
auucugcucacauaucugu

SEQ ID NO: 2971089 - RNA, 21 nt, Human
auucugccugcccaggccccu

SEQ ID NO: 2971090 - RNA, 20 nt, Human
auucugccugcccaggcccc

SEQ ID NO: 2971091 - RNA, 18 nt, Human
auucugcucacauaucug

SEQ ID NO: 2971092 - RNA, 19 nt, Human
auucugccugcccaggccc

SEQ ID NO: 2971093 - RNA, 18 nt, Human
auucugccugcccaggcc

SEQ ID NO: 2971094 - RNA, 17 nt, Human
auucugccugcccaggc

SEQ ID NO: 2971095 - RNA, 16 nt, Human
auucugccugcccagg

SEQ ID NO: 2971096 - RNA, 15 nt, Human
auucugccugcccag

SEQ ID NO: 2971097 - RNA, 14 nt, Human
auucugccugccca

SEQ ID NO: 2971098 - RNA, 13 nt, Human
auucugccugccc

SEQ ID NO: 2971099 - RNA, 11 nt, Human
auucugccugc

SEQ ID NO: 2971100 - RNA, 17 nt, Human
auucucauuugucacac

SEQ ID NO: 2971101 - RNA, 19 nt, Human
auuuuugguauuugaaaca

SEQ ID NO: 2971102 - RNA, 19 nt, Human
auuuuucuuauuucauuuc

SEQ ID NO: 2971103 - RNA, 20 nt, Human
auuuuucuuauuucauuucu

SEQ ID NO: 2971104 - RNA, 22 nt, Human
auuuuucuuagggaaggauaca

SEQ ID NO: 2971105 - RNA, 15 nt, Human
auuuuucuuauuuca

SEQ ID NO: 2971106 - RNA, 21 nt, Human
auuuuucuuagggaaggauac

SEQ ID NO: 2971107 - RNA, 19 nt, Human
auuuuuguuuuuauuaaaa

SEQ ID NO: 2971108 - RNA, 21 nt, Human
auuuuuguuuuuauuaaaagg

SEQ ID NO: 2971109 - RNA, 21 nt, Human
auuuuuguuuucauuaucuca

SEQ ID NO: 2971110 - RNA, 14 nt, Human
auuuuuuaaaauaa

SEQ ID NO: 2971111 - RNA, 14 nt, Human
auuuuuuaaaugca

SEQ ID NO: 2971112 - RNA, 13 nt, Human
auuuuuuaaaugc

SEQ ID NO: 2971113 - RNA, 23 nt, Human
auuuuuuaaccuccuaaguauca

SEQ ID NO: 2971114 - RNA, 22 nt, Human
auuuuugugauuuugugauuga

SEQ ID NO: 2971115 - RNA, 12 nt, Human
auuuuuguaauu

SEQ ID NO: 2971116 - RNA, 19 nt, Human
auuuuuguagagccagggu

SEQ ID NO: 2971117 - RNA, 18 nt, Human
auuuuuuguuaaaugauu

SEQ ID NO: 2971118 - RNA, 23 nt, Human
auuuuuucucuaggaaauauuua

SEQ ID NO: 2971119 - RNA, 20 nt, Human
auuuuuucucuaggaaauau

SEQ ID NO: 2971120 - RNA, 19 nt, Human
auuuuuuacauuuuacaca

SEQ ID NO: 2971121 - RNA, 14 nt, Human
auuuucuauaauuu

SEQ ID NO: 2971122 - RNA, 15 nt, Human
auuuucuauaauuua

SEQ ID NO: 2971123 - RNA, 19 nt, Human
auuuucccuauuagagaag

SEQ ID NO: 2971124 - RNA, 14 nt, Human
auuuuccugaaaac

SEQ ID NO: 2971125 - RNA, 16 nt, Human
auuuuccugccaggca

SEQ ID NO: 2971126 - RNA, 17 nt, Human
auuuugauguuuuaagg

SEQ ID NO: 2971127 - RNA, 15 nt, Human
auuuugauguuuuaa

SEQ ID NO: 2971128 - RNA, 19 nt, Human
auuuugauccaagcugguc

SEQ ID NO: 2971129 - RNA, 18 nt, Human
auuuugauccaagcuggu

SEQ ID NO: 2971130 - RNA, 21 nt, Human
auuuugcugucccuuuuccuu

SEQ ID NO: 2971131 - RNA, 20 nt, Human
auuuugcuaaaugugaauga

SEQ ID NO: 2971132 - RNA, 16 nt, Human
auuuuguuucagugca

SEQ ID NO: 2971133 - RNA, 23 nt, Human
auuuugucauauaagauucauau

SEQ ID NO: 2971134 - RNA, 19 nt, Human
auuuugugcccccauguaa

SEQ ID NO: 2971135 - RNA, 12 nt, Human
auuuugcuuugu

SEQ ID NO: 2971136 - RNA, 20 nt, Human
auuuugcuuugugauuuuug

SEQ ID NO: 2971137 - RNA, 18 nt, Human
auuuugcuuugugauuuu

SEQ ID NO: 2971138 - RNA, 19 nt, Human
auuuuggaaaauaaauuau

SEQ ID NO: 2971139 - RNA, 14 nt, Human
auuuuggaaaauaa

SEQ ID NO: 2971140 - RNA, 20 nt, Human
auuuuggaaaauaaauuauu

SEQ ID NO: 2971141 - RNA, 17 nt, Human
auuugaaacacugguuu

SEQ ID NO: 2971142 - RNA, 14 nt, Human
auuugaaacacugg

SEQ ID NO: 2971143 - RNA, 16 nt, Human
auuugaaaauuuugau

SEQ ID NO: 2971144 - RNA, 15 nt, Human
auuugaaaauuuuga

SEQ ID NO: 2971145 - RNA, 18 nt, Human
auuucuaggacugaauua

SEQ ID NO: 2971146 - RNA, 17 nt, Human
auuucuaggacugaauu

SEQ ID NO: 2971147 - RNA, 20 nt, Human
auuucuuccacaagagccca

SEQ ID NO: 2971148 - RNA, 23 nt, Human
auuucuuccacaagagcccaggc

SEQ ID NO: 2971149 - RNA, 23 nt, Human
auuucuaggacugaauuaugaaa

SEQ ID NO: 2971150 - RNA, 20 nt, Human
auuucuaggacugaauuaug

SEQ ID NO: 2971151 - RNA, 16 nt, Human
auuuauuuauuuauuc

SEQ ID NO: 2971152 - RNA, 14 nt, Human
auuuauuuaaauuu

SEQ ID NO: 2971153 - RNA, 12 nt, Human
auuuauuuaaau

SEQ ID NO: 2971154 - RNA, 14 nt, Human
auuuauuuuaauaa

SEQ ID NO: 2971155 - RNA, 19 nt, Human
auuucccaaagcagugcau

SEQ ID NO: 2971156 - RNA, 14 nt, Human
auuuguauaaaaua

SEQ ID NO: 2971157 - RNA, 22 nt, Human
auuuguaguguuggagaagaac

SEQ ID NO: 2971158 - RNA, 19 nt, Human
auuuguaguguuggagaag

SEQ ID NO: 2971159 - RNA, 23 nt, Human
auuuuaaaagaaugauuaugaau

SEQ ID NO: 2971160 - RNA, 14 nt, Human
auuugucccaagug

SEQ ID NO: 2971161 - RNA, 13 nt, Human
auuugucccaagu

SEQ ID NO: 2971162 - RNA, 18 nt, Human
auuugucccaagugccaa

SEQ ID NO: 2971163 - RNA, 22 nt, Human
auuuuaaaaauacagauagaua

SEQ ID NO: 2971164 - RNA, 16 nt, Human
auuuuaaaagaaugau

SEQ ID NO: 2971165 - RNA, 23 nt, Human
auugauugggcacaucauuucaa

SEQ ID NO: 2971166 - RNA, 19 nt, Human
auugauugggcacaucauu

SEQ ID NO: 2971167 - RNA, 20 nt, Human
auugauuauuacuggcaaaa

SEQ ID NO: 2971168 - RNA, 13 nt, Human
auugacuuuuuau

SEQ ID NO: 2971169 - RNA, 21 nt, Human
auugauuuccguuaaaauacc

SEQ ID NO: 2971170 - RNA, 19 nt, Human
auuggacaguaaaauccac

SEQ ID NO: 2971171 - RNA, 19 nt, Human
auuggagcucgugggacag

SEQ ID NO: 2971172 - RNA, 13 nt, Human
auugucuagugaa

SEQ ID NO: 2971173 - RNA, 14 nt, Human
auugugggaagggg

SEQ ID NO: 2971174 - RNA, 13 nt, Human
auugugggaaggg

SEQ ID NO: 2971175 - RNA, 23 nt, Human
auugucaaaguggugagaggcau

SEQ ID NO: 2971176 - RNA, 16 nt, Human
auugucaaagugguga

SEQ ID NO: 2971177 - RNA, 21 nt, Human
auuguuuggggaugagaaagg

SEQ ID NO: 2971178 - RNA, 13 nt, Human
auuuaaaagauac

SEQ ID NO: 2971179 - RNA, 16 nt, Human
auuuaaaagauacagu

SEQ ID NO: 2971180 - RNA, 14 nt, Human
auuuaaaagauaca

SEQ ID NO: 2971181 - RNA, 17 nt, Human
auuuaaaagauacaguu

SEQ ID NO: 2971182 - RNA, 14 nt, Human
uuucaaauguucuc

SEQ ID NO: 2971183 - RNA, 17 nt, Human
uuuccaugaguccccug

SEQ ID NO: 2971184 - RNA, 18 nt, Human
uuuccaugaguccccugu

SEQ ID NO: 2971185 - RNA, 14 nt, Human
auggacuucuggau

SEQ ID NO: 2971186 - RNA, 11 nt, Human
auggacuuugu

SEQ ID NO: 2971187 - RNA, 12 nt, Human
auggacuuuguu

SEQ ID NO: 2971188 - RNA, 22 nt, Human
auggacuuugcacacuuuggcc

SEQ ID NO: 2971189 - RNA, 19 nt, Human
auggacuaacuugucuuug

SEQ ID NO: 2971190 - RNA, 19 nt, Human
auggcuaagcaaaauguga

SEQ ID NO: 2971191 - RNA, 18 nt, Human
auggcuaauguacugcau

SEQ ID NO: 2971192 - RNA, 23 nt, Human
auggcuauaggugcuacaaaaac

SEQ ID NO: 2971193 - RNA, 22 nt, Human
augggagcugucaagcauguau

SEQ ID NO: 2971194 - RNA, 19 nt, Human
augggagagaagagaaugc

SEQ ID NO: 2971195 - RNA, 21 nt, Human
augggagcugucaagcaugua

SEQ ID NO: 2971196 - RNA, 15 nt, Human
augggagagaagaga

SEQ ID NO: 2971197 - RNA, 16 nt, Human
auggcacuaguauuuc

SEQ ID NO: 2971198 - RNA, 14 nt, Human
auggcacuaguauu

SEQ ID NO: 2971199 - RNA, 21 nt, Human
augcuagaacucccuuucaac

SEQ ID NO: 2971200 - RNA, 20 nt, Human
augcuagaacucccuuucaa

SEQ ID NO: 2971201 - RNA, 22 nt, Human
augcuagaacucccuuucaaca

SEQ ID NO: 2971202 - RNA, 19 nt, Human
augcuagaacucccuuuca

SEQ ID NO: 2971203 - RNA, 13 nt, Human
augcuucucacug

SEQ ID NO: 2971204 - RNA, 19 nt, Human
augcuguucaugaaagauu

SEQ ID NO: 2971205 - RNA, 22 nt, Human
augcugugcccuaaaguguauu

SEQ ID NO: 2971206 - RNA, 17 nt, Human
augcuguucaugaaaga

SEQ ID NO: 2971207 - RNA, 23 nt, Human
augcugcugccccugcacagcag

SEQ ID NO: 2971208 - RNA, 22 nt, Human
augcugcugccccugcacagca

SEQ ID NO: 2971209 - RNA, 21 nt, Human
augcugcugccccugcacagc

SEQ ID NO: 2971210 - RNA, 15 nt, Human
augcugcugccccug

SEQ ID NO: 2971211 - RNA, 13 nt, Human
augcugcugcccc

SEQ ID NO: 2971212 - RNA, 16 nt, Human
uuucaaacauauauaa

SEQ ID NO: 2971213 - RNA, 16 nt, Human
uuucaaacuuuacuau

SEQ ID NO: 2971214 - RNA, 22 nt, Human
uuucaaacuuuacuauggcccu

SEQ ID NO: 2971215 - RNA, 15 nt, Human
uuucaaacuuuacua

SEQ ID NO: 2971216 - RNA, 19 nt, Human
augauugccuuuuuauaac

SEQ ID NO: 2971217 - RNA, 19 nt, Human
augcacuuuguucuggcuc

SEQ ID NO: 2971218 - RNA, 20 nt, Human
augcacuuuguucuggcucu

SEQ ID NO: 2971219 - RNA, 17 nt, Human
augcacuuuguucuggc

SEQ ID NO: 2971220 - RNA, 16 nt, Human
augcacuuuguucugg

SEQ ID NO: 2971221 - RNA, 13 nt, Human
augcaccuggaau

SEQ ID NO: 2971222 - RNA, 22 nt, Human
augcaccagcccuuagcaggga

SEQ ID NO: 2971223 - RNA, 17 nt, Human
uuuaaagauguagacag

SEQ ID NO: 2971224 - RNA, 13 nt, Human
uuuaaagaaugcu

SEQ ID NO: 2971225 - RNA, 18 nt, Human
uuguuuugccaauuugca

SEQ ID NO: 2971226 - RNA, 23 nt, Human
uuuaaaaauacagauagauauau

SEQ ID NO: 2971227 - RNA, 16 nt, Human
augauauaagguuuuu

SEQ ID NO: 2971228 - RNA, 14 nt, Human
augauuaaguaaug

SEQ ID NO: 2971229 - RNA, 18 nt, Human
augauuaaguaaugauaa

SEQ ID NO: 2971230 - RNA, 17 nt, Human
augaucuaggaagacuu

SEQ ID NO: 2971231 - RNA, 20 nt, Human
augaucuaggaagacuuugg

SEQ ID NO: 2971232 - RNA, 15 nt, Human
augaucuaggaagac

SEQ ID NO: 2971233 - RNA, 15 nt, Human
augauaacuggaaac

SEQ ID NO: 2971234 - RNA, 20 nt, Human
uuguucuugguuuguaaauu

SEQ ID NO: 2971235 - RNA, 20 nt, Human
uuguguuacuaaguuuuuau

SEQ ID NO: 2971236 - RNA, 15 nt, Human
uuguguuacuaaguu

SEQ ID NO: 2971237 - RNA, 13 nt, Human
uuguguuacuaag

SEQ ID NO: 2971238 - RNA, 16 nt, Human
uuggugcgggguacac

SEQ ID NO: 2971239 - RNA, 21 nt, Human
uuguuccacaaguuaaauaaa

SEQ ID NO: 2971240 - RNA, 22 nt, Human
uuuaauuugaagguagaauguu

SEQ ID NO: 2971241 - RNA, 12 nt, Human
uuuacaaauguu

SEQ ID NO: 2971242 - RNA, 19 nt, Human
uuuaauuuuuuugagacag

SEQ ID NO: 2971243 - RNA, 18 nt, Human
augcagccucacaguccu

SEQ ID NO: 2971244 - RNA, 15 nt, Human
uuuaaauagaugaca

SEQ ID NO: 2971245 - RNA, 18 nt, Human
uuuaaauauaugcuaagu

SEQ ID NO: 2971246 - RNA, 13 nt, Human
augcaguucugaa

SEQ ID NO: 2971247 - RNA, 13 nt, Human
augcagugcuucc

SEQ ID NO: 2971248 - RNA, 23 nt, Human
augcagugguaugaucacggcuc

SEQ ID NO: 2971249 - RNA, 17 nt, Human
augccauuuaaagcuua

SEQ ID NO: 2971250 - RNA, 21 nt, Human
augccauuuaaagcuuauuaa

SEQ ID NO: 2971251 - RNA, 11 nt, Human
augcccagccc

SEQ ID NO: 2971252 - RNA, 12 nt, Human
augcccagcccc

SEQ ID NO: 2971253 - RNA, 13 nt, Human
augcccagccccu

SEQ ID NO: 2971254 - RNA, 14 nt, Human
augcccagccccuu

SEQ ID NO: 2971255 - RNA, 18 nt, Human
auguagacaguuggguuu

SEQ ID NO: 2971256 - RNA, 20 nt, Human
auguagacaguuggguuuuu

SEQ ID NO: 2971257 - RNA, 13 nt, Human
auguagaggagaa

SEQ ID NO: 2971258 - RNA, 12 nt, Human
auguagaggaga

SEQ ID NO: 2971259 - RNA, 19 nt, Human
auguagaggagaaacugga

SEQ ID NO: 2971260 - RNA, 17 nt, Human
auguagaggagaaacug

SEQ ID NO: 2971261 - RNA, 18 nt, Human
auguagauguaugcacac

SEQ ID NO: 2971262 - RNA, 17 nt, Human
auguagauguaugcaca

SEQ ID NO: 2971263 - RNA, 16 nt, Human
auguacuucaugcugu

SEQ ID NO: 2971264 - RNA, 17 nt, Human
auguacgacuugcauac

SEQ ID NO: 2971265 - RNA, 12 nt, Human
uuugaccucugc

SEQ ID NO: 2971266 - RNA, 22 nt, Human
auguaggcuggcuuucagagua

SEQ ID NO: 2971267 - RNA, 22 nt, Human
auguagauguaugcacacacau

SEQ ID NO: 2971268 - RNA, 19 nt, Human
auguagauguaugcacaca

SEQ ID NO: 2971269 - RNA, 13 nt, Human
uuugcucauggaa

SEQ ID NO: 2971270 - RNA, 13 nt, Human
uuugccucugccu

SEQ ID NO: 2971271 - RNA, 15 nt, Human
uuugccguuauuaaa

SEQ ID NO: 2971272 - RNA, 14 nt, Human
uuugcaagccagau

SEQ ID NO: 2971273 - RNA, 22 nt, Human
uuugauucagacagcugccugg

SEQ ID NO: 2971274 - RNA, 13 nt, Human
uuugcaaauaagu

SEQ ID NO: 2971275 - RNA, 13 nt, Human
uuugacgccaucc

SEQ ID NO: 2971276 - RNA, 14 nt, Human
uuugacgccauccc

SEQ ID NO: 2971277 - RNA, 16 nt, Human
uuugacgccaucccag

SEQ ID NO: 2971278 - RNA, 19 nt, Human
uuugacgccaucccagccc

SEQ ID NO: 2971279 - RNA, 20 nt, Human
uuugacgccaucccagcccc

SEQ ID NO: 2971280 - RNA, 23 nt, Human
uuugauuaaauucuugcaaagua

SEQ ID NO: 2971281 - RNA, 21 nt, Human
uuugauucagacagcugccug

SEQ ID NO: 2971282 - RNA, 21 nt, Human
uuugauuaaauucuugcaaag

SEQ ID NO: 2971283 - RNA, 18 nt, Human
uuugauuaaauucuugca

SEQ ID NO: 2971284 - RNA, 13 nt, Human
uuugauuaaauuc

SEQ ID NO: 2971285 - RNA, 22 nt, Human
uuugauguucuuucacccuuuu

SEQ ID NO: 2971286 - RNA, 16 nt, Human
augucaguauuucaac

SEQ ID NO: 2971287 - RNA, 13 nt, Human
augucaguauuuc

SEQ ID NO: 2971288 - RNA, 22 nt, Human
auguauuacaguggggaaugaa

SEQ ID NO: 2971289 - RNA, 17 nt, Human
auguauguguaauaaau

SEQ ID NO: 2971290 - RNA, 16 nt, Human
auguauguguaaguau

SEQ ID NO: 2971291 - RNA, 17 nt, Human
auguaugcacacacaua

SEQ ID NO: 2971292 - RNA, 16 nt, Human
auguaugcacacacau

SEQ ID NO: 2971293 - RNA, 15 nt, Human
auguaugcacacaca

SEQ ID NO: 2971294 - RNA, 15 nt, Human
auguauguguaagua

SEQ ID NO: 2971295 - RNA, 12 nt, Human
augucaguguga

SEQ ID NO: 2971296 - RNA, 13 nt, Human
augucagugugac

SEQ ID NO: 2971297 - RNA, 17 nt, Human
auguccacugguucuuc

SEQ ID NO: 2971298 - RNA, 16 nt, Human
auguccacugguucuu

SEQ ID NO: 2971299 - RNA, 22 nt, Human
augucagucugcuuagaaauaa

SEQ ID NO: 2971300 - RNA, 21 nt, Human
augucagucugcuuagaaaua

SEQ ID NO: 2971301 - RNA, 20 nt, Human
augucagucugcuuagaaau

SEQ ID NO: 2971302 - RNA, 19 nt, Human
augucagucugcuuagaaa

SEQ ID NO: 2971303 - RNA, 18 nt, Human
augucagucugcuuagaa

SEQ ID NO: 2971304 - RNA, 19 nt, Human
augugcacaucuguuuugu

SEQ ID NO: 2971305 - RNA, 23 nt, Human
augugcacaugcacgugugugca

SEQ ID NO: 2971306 - RNA, 16 nt, Human
augugaugagaggaaa

SEQ ID NO: 2971307 - RNA, 15 nt, Human
augugaugagaggaa

SEQ ID NO: 2971308 - RNA, 17 nt, Human
augugaugagaggaaau

SEQ ID NO: 2971309 - RNA, 19 nt, Human
augugaugagaggaaauca

SEQ ID NO: 2971310 - RNA, 21 nt, Human
uuuguaguguuggagaagaac

SEQ ID NO: 2971311 - RNA, 19 nt, Human
uuuguaguguuggagaaga

SEQ ID NO: 2971312 - RNA, 17 nt, Human
uuuguaguguuggagaa

SEQ ID NO: 2971313 - RNA, 17 nt, Human
uuugugaagcaaaauuu

SEQ ID NO: 2971314 - RNA, 15 nt, Human
uuugaaauauugacu

SEQ ID NO: 2971315 - RNA, 18 nt, Human
augggccuccugugugug

SEQ ID NO: 2971316 - RNA, 20 nt, Human
augggcuggguucuacccag

SEQ ID NO: 2971317 - RNA, 12 nt, Human
auggggcugcac

SEQ ID NO: 2971318 - RNA, 24 nt, Human
auggggcugcaccggcuggccugg

SEQ ID NO: 2971319 - RNA, 14 nt, Human
augggggugcauuu

SEQ ID NO: 2971320 - RNA, 15 nt, Human
augggggugcauuug

SEQ ID NO: 2971321 - RNA, 17 nt, Human
uuucucccagucauuua

SEQ ID NO: 2971322 - RNA, 18 nt, Human
uuucucccagucauuuaa

SEQ ID NO: 2971323 - RNA, 15 nt, Human
augggauccuggagu

SEQ ID NO: 2971324 - RNA, 19 nt, Human
uuucuggcuaugcauuuga

SEQ ID NO: 2971325 - RNA, 18 nt, Human
uuucuggcuaugcauuug

SEQ ID NO: 2971326 - RNA, 16 nt, Human
uuucuggcuaugcauu

SEQ ID NO: 2971327 - RNA, 15 nt, Human
uuucuggcuaugcau

SEQ ID NO: 2971328 - RNA, 19 nt, Human
uuucugcagccacuauugu

SEQ ID NO: 2971329 - RNA, 21 nt, Human
uuucugcagccacuauuguua

SEQ ID NO: 2971330 - RNA, 19 nt, Human
auggugcaaugaccuuuca

SEQ ID NO: 2971331 - RNA, 16 nt, Human
auggugcaaugaccuu

SEQ ID NO: 2971332 - RNA, 17 nt, Human
auggugcaaugaccuuu

SEQ ID NO: 2971333 - RNA, 12 nt, Human
auggugcaauga

SEQ ID NO: 2971334 - RNA, 13 nt, Human
auggugcaaugac

SEQ ID NO: 2971335 - RNA, 15 nt, Human
auggugcaaugaccu

SEQ ID NO: 2971336 - RNA, 15 nt, Human
augggugcuuggagg

SEQ ID NO: 2971337 - RNA, 20 nt, Human
auggugagggauacccaucc

SEQ ID NO: 2971338 - RNA, 17 nt, Human
augguggcuggguugga

SEQ ID NO: 2971339 - RNA, 15 nt, Human
augguggcuggguug

SEQ ID NO: 2971340 - RNA, 13 nt, Human
augguggcugggu

SEQ ID NO: 2971341 - RNA, 12 nt, Human
augguggcuggg

SEQ ID NO: 2971342 - RNA, 21 nt, Human
augguucccuugaugaagaag

SEQ ID NO: 2971343 - RNA, 15 nt, Human
augguuuucaaaaua

SEQ ID NO: 2971344 - RNA, 14 nt, Human
augguuuucaaaau

SEQ ID NO: 2971345 - RNA, 14 nt, Human
augguuuggagcug

SEQ ID NO: 2971346 - RNA, 15 nt, Human
augguuuggagcuga

SEQ ID NO: 2971347 - RNA, 16 nt, Human
augguuuucaaaauaa

SEQ ID NO: 2971348 - RNA, 14 nt, Human
augguuuucuugug

SEQ ID NO: 2971349 - RNA, 15 nt, Human
uucccucaaaugugu

SEQ ID NO: 2971350 - RNA, 20 nt, Human
uucccucaccuuucccaucu

SEQ ID NO: 2971351 - RNA, 15 nt, Human
uucccuauuagagaa

SEQ ID NO: 2971352 - RNA, 19 nt, Human
uuccguagguuauuuucag

SEQ ID NO: 2971353 - RNA, 16 nt, Human
uuccguuaaaauacca

SEQ ID NO: 2971354 - RNA, 14 nt, Human
uuccguuaaaauac

SEQ ID NO: 2971355 - RNA, 13 nt, Human
uuccucuuuccau

SEQ ID NO: 2971356 - RNA, 22 nt, Human
uuccucuuuccaucuacccucc

SEQ ID NO: 2971357 - RNA, 17 nt, Human
uuccucuuuccaucuac

SEQ ID NO: 2971358 - RNA, 14 nt, Human
uuccugaaccgaug

SEQ ID NO: 2971359 - RNA, 14 nt, Human
uuccugaacaggau

SEQ ID NO: 2971360 - RNA, 15 nt, Human
uuccugaacaggaua

SEQ ID NO: 2971361 - RNA, 17 nt, Human
uuccuaauccucuagga

SEQ ID NO: 2971362 - RNA, 13 nt, Human
uuccuaaaauuau

SEQ ID NO: 2971363 - RNA, 20 nt, Human
auauuuuuuguuaaaugauu

SEQ ID NO: 2971364 - RNA, 18 nt, Human
auauuuuuuguuaaauga

SEQ ID NO: 2971365 - RNA, 14 nt, Human
aucaacagauaaau

SEQ ID NO: 2971366 - RNA, 21 nt, Human
aucaagaugugacauguuuua

SEQ ID NO: 2971367 - RNA, 17 nt, Human
aucaacagugagagacu

SEQ ID NO: 2971368 - RNA, 11 nt, Human
uuccugugucu

SEQ ID NO: 2971369 - RNA, 14 nt, Human
aucaaugaguaaca

SEQ ID NO: 2971370 - RNA, 20 nt, Human
aucaaucaugucagucugcu

SEQ ID NO: 2971371 - RNA, 15 nt, Human
aucacggcucacugc

SEQ ID NO: 2971372 - RNA, 13 nt, Human
aucacgccacugc

SEQ ID NO: 2971373 - RNA, 19 nt, Human
aucacggcucacugcagcc

SEQ ID NO: 2971374 - RNA, 18 nt, Human
aucacggcucacugcagc

SEQ ID NO: 2971375 - RNA, 19 nt, Human
uucuagcaugaagacagag

SEQ ID NO: 2971376 - RNA, 16 nt, Human
uucuagcauggcugcc

SEQ ID NO: 2971377 - RNA, 16 nt, Human
uucuaaguaaaaccac

SEQ ID NO: 2971378 - RNA, 15 nt, Human
uucuaaguaaaacca

SEQ ID NO: 2971379 - RNA, 13 nt, Human
uucuaagaaguga

SEQ ID NO: 2971380 - RNA, 23 nt, Human
uucuaagaagugaaaaucuacac

SEQ ID NO: 2971381 - RNA, 21 nt, Human
uucuaaaggcuaccuuuguau

SEQ ID NO: 2971382 - RNA, 20 nt, Human
uucuaaaggcuaccuuugua

SEQ ID NO: 2971383 - RNA, 19 nt, Human
uucuaaaggcuaccuuugu

SEQ ID NO: 2971384 - RNA, 15 nt, Human
uucggccuccauccu

SEQ ID NO: 2971385 - RNA, 21 nt, Human
uucuaaaucuccaaaauaaaa

SEQ ID NO: 2971386 - RNA, 19 nt, Human
uucgcuccugugucuugca

SEQ ID NO: 2971387 - RNA, 15 nt, Human
uucgcuccugugucu

SEQ ID NO: 2971388 - RNA, 14 nt, Human
uucggccuccaucc

SEQ ID NO: 2971389 - RNA, 22 nt, Human
aucacuugucaauaaaauccau

SEQ ID NO: 2971390 - RNA, 11 nt, Human
aucagaauucu

SEQ ID NO: 2971391 - RNA, 16 nt, Human
uucuaggacugaauua

SEQ ID NO: 2971392 - RNA, 20 nt, Human
uucucacagcuccaagaauu

SEQ ID NO: 2971393 - RNA, 14 nt, Human
uucuaggacugaau

SEQ ID NO: 2971394 - RNA, 13 nt, Human
uucuaggacugaa

SEQ ID NO: 2971395 - RNA, 17 nt, Human
aucaggguuaguauugu

SEQ ID NO: 2971396 - RNA, 14 nt, Human
aucaggccaggccc

SEQ ID NO: 2971397 - RNA, 13 nt, Human
aucagcacgauuu

SEQ ID NO: 2971398 - RNA, 15 nt, Human
aucaggccaggcccu

SEQ ID NO: 2971399 - RNA, 16 nt, Human
aucaggccaggcccuc

SEQ ID NO: 2971400 - RNA, 18 nt, Human
aucaggccaggcccucug

SEQ ID NO: 2971401 - RNA, 12 nt, Human
aucagaauucuc

SEQ ID NO: 2971402 - RNA, 17 nt, Human
uucucuaguuugauuaa

SEQ ID NO: 2971403 - RNA, 15 nt, Human
uucucuaguuugauu

SEQ ID NO: 2971404 - RNA, 12 nt, Human
uucucuaggaaa

SEQ ID NO: 2971405 - RNA, 21 nt, Human
uucuccuuguguuacuaaguu

SEQ ID NO: 2971406 - RNA, 20 nt, Human
aucagguuuucuuuuaagaa

SEQ ID NO: 2971407 - RNA, 19 nt, Human
uucugaacuuggcgcugcc

SEQ ID NO: 2971408 - RNA, 22 nt, Human
uucugaacuuggcgcugccccu

SEQ ID NO: 2971409 - RNA, 15 nt, Human
uucugccauauucug

SEQ ID NO: 2971410 - RNA, 18 nt, Human
uucugccugcccaggccc

SEQ ID NO: 2971411 - RNA, 17 nt, Human
uucugccugcccaggcc

SEQ ID NO: 2971412 - RNA, 15 nt, Human
uucuggcucuuccag

SEQ ID NO: 2971413 - RNA, 21 nt, Human
uucugccugcccaggccccug

SEQ ID NO: 2971414 - RNA, 16 nt, Human
uucuggcucuuccagg

SEQ ID NO: 2971415 - RNA, 17 nt, Human
uucuggcucuuccaggc

SEQ ID NO: 2971416 - RNA, 21 nt, Human
auccaguaucuugaagacuuu

SEQ ID NO: 2971417 - RNA, 19 nt, Human
aucccaaacccuucagugc

SEQ ID NO: 2971418 - RNA, 20 nt, Human
aucccaaacccuucagugcc

SEQ ID NO: 2971419 - RNA, 12 nt, Human
aucccagcccca

SEQ ID NO: 2971420 - RNA, 18 nt, Human
aucccauaugccugggca

SEQ ID NO: 2971421 - RNA, 15 nt, Human
auccaguaucuugaa

SEQ ID NO: 2971422 - RNA, 16 nt, Human
auccaguaucuugaag

SEQ ID NO: 2971423 - RNA, 15 nt, Human
auccacccaccucag

SEQ ID NO: 2971424 - RNA, 13 nt, Human
auccacccaccuc

SEQ ID NO: 2971425 - RNA, 21 nt, Human
auccaagcuggucccacucag

SEQ ID NO: 2971426 - RNA, 18 nt, Human
auccaagcuggucccacu

SEQ ID NO: 2971427 - RNA, 21 nt, Human
aucccucauccucauacccac

SEQ ID NO: 2971428 - RNA, 23 nt, Human
aucccucauccucauacccaccc

SEQ ID NO: 2971429 - RNA, 13 nt, Human
aucccucauccuc

SEQ ID NO: 2971430 - RNA, 14 nt, Human
aucccucauccuca

SEQ ID NO: 2971431 - RNA, 24 nt, Human
aucccauaugccugggcagaagga

SEQ ID NO: 2971432 - RNA, 13 nt, Human
uucuucucccuca

SEQ ID NO: 2971433 - RNA, 11 nt, Human
uucuucucccu

SEQ ID NO: 2971434 - RNA, 14 nt, Human
uucuucucccucag

SEQ ID NO: 2971435 - RNA, 15 nt, Human
uucuucugcuucagc

SEQ ID NO: 2971436 - RNA, 13 nt, Human
uucuucugcuuca

SEQ ID NO: 2971437 - RNA, 20 nt, Human
uucuucugcuucagccuccc

SEQ ID NO: 2971438 - RNA, 12 nt, Human
auccuaagcuau

SEQ ID NO: 2971439 - RNA, 16 nt, Human
auccuaggcauuugcu

SEQ ID NO: 2971440 - RNA, 16 nt, Human
auccuccucagaucuu

SEQ ID NO: 2971441 - RNA, 19 nt, Human
uugaacccgggaggcagag

SEQ ID NO: 2971442 - RNA, 17 nt, Human
uugaaauuguauuacaa

SEQ ID NO: 2971443 - RNA, 18 nt, Human
uugaacccgggaggcaga

SEQ ID NO: 2971444 - RNA, 17 nt, Human
aucugaaauaaggaaug

SEQ ID NO: 2971445 - RNA, 12 nt, Human
aucugaaaaugu

SEQ ID NO: 2971446 - RNA, 23 nt, Human
aucugaaaauguauguguaagua

SEQ ID NO: 2971447 - RNA, 23 nt, Human
uugauguuuuaaggaugcuugua

SEQ ID NO: 2971448 - RNA, 13 nt, Human
uugauuaaauucu

SEQ ID NO: 2971449 - RNA, 16 nt, Human
uugcaaggcaaauguu

SEQ ID NO: 2971450 - RNA, 22 nt, Human
uugcaagccagauuuuccugaa

SEQ ID NO: 2971451 - RNA, 14 nt, Human
uugauuaaauucuu

SEQ ID NO: 2971452 - RNA, 17 nt, Human
uugcauauugcauacua

SEQ ID NO: 2971453 - RNA, 13 nt, Human
uugcaucaauuuu

SEQ ID NO: 2971454 - RNA, 14 nt, Human
uugcaccacugcac

SEQ ID NO: 2971455 - RNA, 15 nt, Human
uugcaccacugcacu

SEQ ID NO: 2971456 - RNA, 16 nt, Human
uugcaccacugcacuc

SEQ ID NO: 2971457 - RNA, 18 nt, Human
uugcaccacugcacucca

SEQ ID NO: 2971458 - RNA, 19 nt, Human
uugcaauggcagccuuggc

SEQ ID NO: 2971459 - RNA, 17 nt, Human
uugcaauggcagccuug

SEQ ID NO: 2971460 - RNA, 16 nt, Human
uugcaauggcagccuu

SEQ ID NO: 2971461 - RNA, 13 nt, Human
aucuccaaaauaa

SEQ ID NO: 2971462 - RNA, 21 nt, Human
aucuccaaaauaaaacuuuuu

SEQ ID NO: 2971463 - RNA, 20 nt, Human
aucuccaaaauaaaacuuuu

SEQ ID NO: 2971464 - RNA, 17 nt, Human
aucuccaaaauaaaacu

SEQ ID NO: 2971465 - RNA, 14 nt, Human
aucuccaaaauaaa

SEQ ID NO: 2971466 - RNA, 14 nt, Human
aucucagggccugg

SEQ ID NO: 2971467 - RNA, 16 nt, Human
aucucagggccugguc

SEQ ID NO: 2971468 - RNA, 16 nt, Human
aucucccccagcccca

SEQ ID NO: 2971469 - RNA, 17 nt, Human
aucucccccagccccau

SEQ ID NO: 2971470 - RNA, 14 nt, Human
aucucccccagccc

SEQ ID NO: 2971471 - RNA, 15 nt, Human
aucucccccagcccc

SEQ ID NO: 2971472 - RNA, 22 nt, Human
aucugaaaauguauguguaagu

SEQ ID NO: 2971473 - RNA, 20 nt, Human
aucugaaaauguauguguaa

SEQ ID NO: 2971474 - RNA, 19 nt, Human
aucugaaaauguaugugua

SEQ ID NO: 2971475 - RNA, 16 nt, Human
aucugaaaauguaugu

SEQ ID NO: 2971476 - RNA, 14 nt, Human
aucugaaaauguau

SEQ ID NO: 2971477 - RNA, 15 nt, Human
aucucuugagccugg

SEQ ID NO: 2971478 - RNA, 21 nt, Human
uugaaggaugcugucuucgua

SEQ ID NO: 2971479 - RNA, 17 nt, Human
uugaagggaaauuucag

SEQ ID NO: 2971480 - RNA, 13 nt, Human
aucuaaauggaac

SEQ ID NO: 2971481 - RNA, 18 nt, Human
aucuaaauggaaccacuc

SEQ ID NO: 2971482 - RNA, 17 nt, Human
aucuaaauggaaccacu

SEQ ID NO: 2971483 - RNA, 16 nt, Human
auccucuguacagagc

SEQ ID NO: 2971484 - RNA, 17 nt, Human
auccucuguacagagcc

SEQ ID NO: 2971485 - RNA, 18 nt, Human
auccuccugggauuggcu

SEQ ID NO: 2971486 - RNA, 19 nt, Human
aucuacacuccagugagac

SEQ ID NO: 2971487 - RNA, 18 nt, Human
aucuacacuccagugaga

SEQ ID NO: 2971488 - RNA, 18 nt, Human
aucuaauauguaacaagc

SEQ ID NO: 2971489 - RNA, 20 nt, Human
uugagugaagcugggagaac

SEQ ID NO: 2971490 - RNA, 20 nt, Human
uugaguugauucagcucugc

SEQ ID NO: 2971491 - RNA, 12 nt, Human
uugagacagagu

SEQ ID NO: 2971492 - RNA, 16 nt, Human
uugagaucagccuggg

SEQ ID NO: 2971493 - RNA, 15 nt, Human
uugagaucagccugg

SEQ ID NO: 2971494 - RNA, 23 nt, Human
augaauggcuaagcaaaauguga

SEQ ID NO: 2971495 - RNA, 15 nt, Human
augaauuacauuugu

SEQ ID NO: 2971496 - RNA, 15 nt, Human
augaauuaaguuuuu

SEQ ID NO: 2971497 - RNA, 18 nt, Human
uuggggaccagagcugcc

SEQ ID NO: 2971498 - RNA, 16 nt, Human
augaauuacauuugua

SEQ ID NO: 2971499 - RNA, 19 nt, Human
augaaagggcccagagagg

SEQ ID NO: 2971500 - RNA, 14 nt, Human
augaaaugagguca

SEQ ID NO: 2971501 - RNA, 14 nt, Human
uugcuugaaagaaa

SEQ ID NO: 2971502 - RNA, 16 nt, Human
uuggagggugucccaa

SEQ ID NO: 2971503 - RNA, 18 nt, Human
uuggccccugcccggcug

SEQ ID NO: 2971504 - RNA, 23 nt, Human
uuggcuauuagagaucaaccccu

SEQ ID NO: 2971505 - RNA, 22 nt, Human
aucuuuucauuuaggugaggaa

SEQ ID NO: 2971506 - RNA, 17 nt, Human
aucuuugcagacaggca

SEQ ID NO: 2971507 - RNA, 18 nt, Human
augaaagggcccagagag

SEQ ID NO: 2971508 - RNA, 15 nt, Human
augaaagggcccaga

SEQ ID NO: 2971509 - RNA, 23 nt, Human
aucugcgggggcagugcucaccc

SEQ ID NO: 2971510 - RNA, 21 nt, Human
aucugcgggggcagugcucac

SEQ ID NO: 2971511 - RNA, 20 nt, Human
aucugcgggggcagugcuca

SEQ ID NO: 2971512 - RNA, 19 nt, Human
aucugcgggggcagugcuc

SEQ ID NO: 2971513 - RNA, 18 nt, Human
aucugcgggggcagugcu

SEQ ID NO: 2971514 - RNA, 16 nt, Human
aucuggugacuuuccu

SEQ ID NO: 2971515 - RNA, 17 nt, Human
aucuggugacuuuccuc

SEQ ID NO: 2971516 - RNA, 10 nt, Human
aucuggugac

SEQ ID NO: 2971517 - RNA, 17 nt, Human
aucugugaaaggaaaga

SEQ ID NO: 2971518 - RNA, 18 nt, Human
aucugugaaaggaaagag

SEQ ID NO: 2971519 - RNA, 20 nt, Human
aucuuggucagauuugaacu

SEQ ID NO: 2971520 - RNA, 13 nt, Human
aucuugcucugcu

SEQ ID NO: 2971521 - RNA, 18 nt, Human
auaacuuuuuauauucuc

SEQ ID NO: 2971522 - RNA, 22 nt, Human
auaacuuuuuauauucucagca

SEQ ID NO: 2971523 - RNA, 14 nt, Human
auaagauucauauu

SEQ ID NO: 2971524 - RNA, 16 nt, Human
uuagaagucacacagu

SEQ ID NO: 2971525 - RNA, 23 nt, Human
uuacuguacaugaaaacacauuu

SEQ ID NO: 2971526 - RNA, 22 nt, Human
uuacuguacaugaaaacacauu

SEQ ID NO: 2971527 - RNA, 14 nt, Human
uuacuguacaugaa

SEQ ID NO: 2971528 - RNA, 13 nt, Human
uuacuguacauga

SEQ ID NO: 2971529 - RNA, 12 nt, Human
uuacuguacaug

SEQ ID NO: 2971530 - RNA, 15 nt, Human
uuacugcagcuuugu

SEQ ID NO: 2971531 - RNA, 11 nt, Human
uuacaaauguu

SEQ ID NO: 2971532 - RNA, 17 nt, Human
uuacaguggggaaugaa

SEQ ID NO: 2971533 - RNA, 19 nt, Human
uuaccagcagagcaccuua

SEQ ID NO: 2971534 - RNA, 14 nt, Human
uuacaggugugaac

SEQ ID NO: 2971535 - RNA, 14 nt, Human
auaaucuuucacag

SEQ ID NO: 2971536 - RNA, 23 nt, Human
auaauuuccauuuacuuaagacu

SEQ ID NO: 2971537 - RNA, 22 nt, Human
auaauuuccauuuacuuaagac

SEQ ID NO: 2971538 - RNA, 18 nt, Human
auaauuuaccugaagucu

SEQ ID NO: 2971539 - RNA, 21 nt, Human
auaagauucauauuuacuucu

SEQ ID NO: 2971540 - RNA, 22 nt, Human
auaagccaaaaaaugcuugcuu

SEQ ID NO: 2971541 - RNA, 19 nt, Human
auaagccaaaacugagcau

SEQ ID NO: 2971542 - RNA, 16 nt, Human
uuaggguuaugauuaa

SEQ ID NO: 2971543 - RNA, 14 nt, Human
uuaggguuaugauu

SEQ ID NO: 2971544 - RNA, 14 nt, Human
uuagggagagaaga

SEQ ID NO: 2971545 - RNA, 15 nt, Human
uuagggagagaagau

SEQ ID NO: 2971546 - RNA, 19 nt, Human
uuaggugugggggaagcac

SEQ ID NO: 2971547 - RNA, 14 nt, Human
uuagguugaaacau

SEQ ID NO: 2971548 - RNA, 16 nt, Human
uuagguugaaacauau

SEQ ID NO: 2971549 - RNA, 13 nt, Human
uuaguagagacag

SEQ ID NO: 2971550 - RNA, 14 nt, Human
uuaguagagacagg

SEQ ID NO: 2971551 - RNA, 15 nt, Human
uuauaaaagugaaua

SEQ ID NO: 2971552 - RNA, 13 nt, Human
uuauaaacuuuac

SEQ ID NO: 2971553 - RNA, 15 nt, Human
aguuuuacaguguuu

SEQ ID NO: 2971554 - RNA, 19 nt, Human
aguuucugccgcagcccug

SEQ ID NO: 2971555 - RNA, 22 nt, Human
aguuuguuaguaugaggcauuu

SEQ ID NO: 2971556 - RNA, 15 nt, Human
aguuucugccgcagc

SEQ ID NO: 2971557 - RNA, 14 nt, Human
aguuucucuuuuca

SEQ ID NO: 2971558 - RNA, 15 nt, Human
aguuuaucuguucau

SEQ ID NO: 2971559 - RNA, 14 nt, Human
uuaacagaaaugua

SEQ ID NO: 2971560 - RNA, 13 nt, Human
uuaacagaaaugu

SEQ ID NO: 2971561 - RNA, 12 nt, Human
uuaacagaaaug

SEQ ID NO: 2971562 - RNA, 17 nt, Human
aguuuaaauuguaauag

SEQ ID NO: 2971563 - RNA, 20 nt, Human
aguuuaaauuguaauaggcg

SEQ ID NO: 2971564 - RNA, 15 nt, Human
aguuuagcuggaaaa

SEQ ID NO: 2971565 - RNA, 19 nt, Human
uuaaaaaagaaacauuugg

SEQ ID NO: 2971566 - RNA, 22 nt, Human
aguuuagcccugaacauuucau

SEQ ID NO: 2971567 - RNA, 18 nt, Human
aguuuagcccugaacauu

SEQ ID NO: 2971568 - RNA, 19 nt, Human
uuaaaaaucucaaauuucu

SEQ ID NO: 2971569 - RNA, 16 nt, Human
uuaaaaaauggaacau

SEQ ID NO: 2971570 - RNA, 20 nt, Human
uuaaaaaucucaaauuucua

SEQ ID NO: 2971571 - RNA, 17 nt, Human
uuaaaaaucucaaauuu

SEQ ID NO: 2971572 - RNA, 22 nt, Human
uuaaaaucauuucugcaucagc

SEQ ID NO: 2971573 - RNA, 14 nt, Human
uuaaaaucauuucu

SEQ ID NO: 2971574 - RNA, 19 nt, Human
uuaagacuuugguuauuuu

SEQ ID NO: 2971575 - RNA, 22 nt, Human
uuaagagagucuauuuacggaa

SEQ ID NO: 2971576 - RNA, 23 nt, Human
uuaagacuuaaugagacuuuaaa

SEQ ID NO: 2971577 - RNA, 16 nt, Human
uuaagacuuaaugaga

SEQ ID NO: 2971578 - RNA, 15 nt, Human
uuaaucuaaauggaa

SEQ ID NO: 2971579 - RNA, 16 nt, Human
uuaauuugguuuucac

SEQ ID NO: 2971580 - RNA, 16 nt, Human
uuaauuuauccucugu

SEQ ID NO: 2971581 - RNA, 19 nt, Human
aguuuuuuuccuucaagaa

SEQ ID NO: 2971582 - RNA, 18 nt, Human
uuaacuuuuauaaacuuu

SEQ ID NO: 2971583 - RNA, 22 nt, Human
uuaacuuuuauaaacuuuaccu

SEQ ID NO: 2971584 - RNA, 23 nt, Human
uuaacuuuuauaaacuuuaccuu

SEQ ID NO: 2971585 - RNA, 16 nt, Human
aguuuuauaugcuucu

SEQ ID NO: 2971586 - RNA, 13 nt, Human
uuauguuaauauu

SEQ ID NO: 2971587 - RNA, 19 nt, Human
uuauguuaaaacugggaca

SEQ ID NO: 2971588 - RNA, 14 nt, Human
uuauuauauuuaca

SEQ ID NO: 2971589 - RNA, 12 nt, Human
uuauuaugcaug

SEQ ID NO: 2971590 - RNA, 15 nt, Human
uuauuauauuuacaa

SEQ ID NO: 2971591 - RNA, 18 nt, Human
uuauucauuaguuuugaa

SEQ ID NO: 2971592 - RNA, 21 nt, Human
uuauucauuaguuuugaagau

SEQ ID NO: 2971593 - RNA, 14 nt, Human
uuauuauuaacaaa

SEQ ID NO: 2971594 - RNA, 13 nt, Human
uuauuauuaacaa

SEQ ID NO: 2971595 - RNA, 13 nt, Human
uuauuaugcauga

SEQ ID NO: 2971596 - RNA, 18 nt, Human
auacugccuuguuuaaug

SEQ ID NO: 2971597 - RNA, 20 nt, Human
auacugccuuguuuaauggu

SEQ ID NO: 2971598 - RNA, 16 nt, Human
auacucugcuuagaau

SEQ ID NO: 2971599 - RNA, 18 nt, Human
auacucuuauaucuauau

SEQ ID NO: 2971600 - RNA, 14 nt, Human
auacucuuauaucu

SEQ ID NO: 2971601 - RNA, 17 nt, Human
auacuccuccaagguua

SEQ ID NO: 2971602 - RNA, 14 nt, Human
auacucccaucugu

SEQ ID NO: 2971603 - RNA, 22 nt, Human
uuauuccaagggaauauugcca

SEQ ID NO: 2971604 - RNA, 16 nt, Human
auacucauuaggaugg

SEQ ID NO: 2971605 - RNA, 11 nt, Human
auacucccauc

SEQ ID NO: 2971606 - RNA, 14 nt, Human
auagauguugcuaa

SEQ ID NO: 2971607 - RNA, 20 nt, Human
auagauguugcuaacagcaa

SEQ ID NO: 2971608 - RNA, 17 nt, Human
auagauugcucaaauca

SEQ ID NO: 2971609 - RNA, 18 nt, Human
auagauaggucagugcaa

SEQ ID NO: 2971610 - RNA, 22 nt, Human
auagagugugauguauguguaa

SEQ ID NO: 2971611 - RNA, 16 nt, Human
auagagugugauguau

SEQ ID NO: 2971612 - RNA, 14 nt, Human
auagagagagacca

SEQ ID NO: 2971613 - RNA, 17 nt, Human
auagaauuaacacauga

SEQ ID NO: 2971614 - RNA, 22 nt, Human
auagaauaggcacuuuaaaaca

SEQ ID NO: 2971615 - RNA, 20 nt, Human
auagaauaggcacuuuaaaa

SEQ ID NO: 2971616 - RNA, 18 nt, Human
auagaauaggcacuuuaa

SEQ ID NO: 2971617 - RNA, 22 nt, Human
auagacaauuuauuauggcaca

SEQ ID NO: 2971618 - RNA, 16 nt, Human
auagacaauuuauuau

SEQ ID NO: 2971619 - RNA, 22 nt, Human
auagaauugacauugaaaucua

SEQ ID NO: 2971620 - RNA, 18 nt, Human
auagaauugacauugaaa

SEQ ID NO: 2971621 - RNA, 13 nt, Human
auagaauugacau

SEQ ID NO: 2971622 - RNA, 23 nt, Human
auagacaauuuauuauggcacau

SEQ ID NO: 2971623 - RNA, 13 nt, Human
auagaaguaaaaa

SEQ ID NO: 2971624 - RNA, 17 nt, Human
auacuauuaaacaugcu

SEQ ID NO: 2971625 - RNA, 17 nt, Human
auacuauggaauuucuc

SEQ ID NO: 2971626 - RNA, 20 nt, Human
auacuaaccagcagaaaugc

SEQ ID NO: 2971627 - RNA, 19 nt, Human
auacuaaccagcagaaaug

SEQ ID NO: 2971628 - RNA, 13 nt, Human
auacuaaccagca

SEQ ID NO: 2971629 - RNA, 19 nt, Human
auacuauuaaacaugcugu

SEQ ID NO: 2971630 - RNA, 18 nt, Human
auacuauuaaacaugcug

SEQ ID NO: 2971631 - RNA, 15 nt, Human
uuauauuugaaauau

SEQ ID NO: 2971632 - RNA, 19 nt, Human
uuauauuugaaauauugac

SEQ ID NO: 2971633 - RNA, 18 nt, Human
auaccacuuuuguucuug

SEQ ID NO: 2971634 - RNA, 17 nt, Human
auaccacuuuuguucuu

SEQ ID NO: 2971635 - RNA, 22 nt, Human
auaccacaggaaccacaagacu

SEQ ID NO: 2971636 - RNA, 14 nt, Human
auaccuuuuuuaga

SEQ ID NO: 2971637 - RNA, 16 nt, Human
auacguacacauuuua

SEQ ID NO: 2971638 - RNA, 19 nt, Human
auacgugggcauucaaaug

SEQ ID NO: 2971639 - RNA, 18 nt, Human
auacgugggcauucaaau

SEQ ID NO: 2971640 - RNA, 15 nt, Human
auacguacacauuuu

SEQ ID NO: 2971641 - RNA, 14 nt, Human
auacguacacauuu

SEQ ID NO: 2971642 - RNA, 13 nt, Human
auacguacacauu

SEQ ID NO: 2971643 - RNA, 18 nt, Human
uuauaaacuuuaccuuuu

SEQ ID NO: 2971644 - RNA, 17 nt, Human
uuauaaacuuuaccuuu

SEQ ID NO: 2971645 - RNA, 16 nt, Human
auacagaggcaacugc

SEQ ID NO: 2971646 - RNA, 17 nt, Human
auacagaggcaacugca

SEQ ID NO: 2971647 - RNA, 23 nt, Human
auacaggaaaagcugcugacagu

SEQ ID NO: 2971648 - RNA, 22 nt, Human
auacaggaaaagcugcugacag

SEQ ID NO: 2971649 - RNA, 23 nt, Human
auacagauagauauaugcucugc

SEQ ID NO: 2971650 - RNA, 18 nt, Human
auacaguuacucagaauu

SEQ ID NO: 2971651 - RNA, 20 nt, Human
auacaguuacucagaauucu

SEQ ID NO: 2971652 - RNA, 20 nt, Human
auacauaaacaagaccacgu

SEQ ID NO: 2971653 - RNA, 18 nt, Human
auacauacuuacaugugu

SEQ ID NO: 2971654 - RNA, 20 nt, Human
auacauacuuacaugugugu

SEQ ID NO: 2971655 - RNA, 17 nt, Human
uuaugaauuacauuugu

SEQ ID NO: 2971656 - RNA, 16 nt, Human
uuaugaauuacauuug

SEQ ID NO: 2971657 - RNA, 14 nt, Human
uuaugaauuacauu

SEQ ID NO: 2971658 - RNA, 21 nt, Human
uuaugaauuacauuuguauaa

SEQ ID NO: 2971659 - RNA, 11 nt, Human
uuaugacucca

SEQ ID NO: 2971660 - RNA, 23 nt, Human
uuaugagaaacuggcaaagcaga

SEQ ID NO: 2971661 - RNA, 21 nt, Human
uuaugagaaacuggcaaagca

SEQ ID NO: 2971662 - RNA, 18 nt, Human
uuaugaaacuuuuggaag

SEQ ID NO: 2971663 - RNA, 17 nt, Human
uuaugaaacuuuuggaa

SEQ ID NO: 2971664 - RNA, 14 nt, Human
uuaugaaacuuuug

SEQ ID NO: 2971665 - RNA, 13 nt, Human
uuaugaaaauaau

SEQ ID NO: 2971666 - RNA, 19 nt, Human
uuaugaaacuuuuggaagg

SEQ ID NO: 2971667 - RNA, 21 nt, Human
uuaucacccagaagaaaauag

SEQ ID NO: 2971668 - RNA, 19 nt, Human
uuaucacccagaagaaaau

SEQ ID NO: 2971669 - RNA, 18 nt, Human
uuaucacccagaagaaaa

SEQ ID NO: 2971670 - RNA, 17 nt, Human
uuaucacccagaagaaa

SEQ ID NO: 2971671 - RNA, 19 nt, Human
uuaugauuaaguaaugaua

SEQ ID NO: 2971672 - RNA, 18 nt, Human
uuauggcuuuugugcauu

SEQ ID NO: 2971673 - RNA, 19 nt, Human
uuauggcuuuugugcauua

SEQ ID NO: 2971674 - RNA, 13 nt, Human
uuaugggcugggu

SEQ ID NO: 2971675 - RNA, 24 nt, Human
uuaugggagcugucaagcauguau

SEQ ID NO: 2971676 - RNA, 22 nt, Human
uuaugggcuggguucuacccag

SEQ ID NO: 2971677 - RNA, 15 nt, Human
agucucccuuccuau

SEQ ID NO: 2971678 - RNA, 11 nt, Human
ugugaggaagc

SEQ ID NO: 2971679 - RNA, 16 nt, Human
ugugacugaucucucg

SEQ ID NO: 2971680 - RNA, 13 nt, Human
agucuuagaugua

SEQ ID NO: 2971681 - RNA, 16 nt, Human
agucuuagauguauau

SEQ ID NO: 2971682 - RNA, 14 nt, Human
agucuuagauguau

SEQ ID NO: 2971683 - RNA, 16 nt, Human
agucucuugauucaua

SEQ ID NO: 2971684 - RNA, 17 nt, Human
agucucuugauucauaa

SEQ ID NO: 2971685 - RNA, 21 nt, Human
agugaacaaauuuacagagac

SEQ ID NO: 2971686 - RNA, 20 nt, Human
agugaacaaauuuacagaga

SEQ ID NO: 2971687 - RNA, 16 nt, Human
agucuuucacauuuaa

SEQ ID NO: 2971688 - RNA, 23 nt, Human
agugaacaaauuuacagagacag

SEQ ID NO: 2971689 - RNA, 22 nt, Human
agugaacaaauuuacagagaca

SEQ ID NO: 2971690 - RNA, 16 nt, Human
agugaacuugggccac

SEQ ID NO: 2971691 - RNA, 21 nt, Human
agugacugauggcuaauguac

SEQ ID NO: 2971692 - RNA, 22 nt, Human
agugagcacuaaggugugcucu

SEQ ID NO: 2971693 - RNA, 14 nt, Human
agugagcacuaagg

SEQ ID NO: 2971694 - RNA, 12 nt, Human
agugagcugguu

SEQ ID NO: 2971695 - RNA, 22 nt, Human
ugugaugaugaaaugaggucag

SEQ ID NO: 2971696 - RNA, 19 nt, Human
ugugaugagaggaaaucac

SEQ ID NO: 2971697 - RNA, 18 nt, Human
ugugaugagaggaaauca

SEQ ID NO: 2971698 - RNA, 18 nt, Human
agugcaaacuucagaguu

SEQ ID NO: 2971699 - RNA, 22 nt, Human
agugcaaauugucacaggacag

SEQ ID NO: 2971700 - RNA, 13 nt, Human
agugaggcucugc

SEQ ID NO: 2971701 - RNA, 12 nt, Human
agugaggcucug

SEQ ID NO: 2971702 - RNA, 16 nt, Human
agugaggaugaaaaaa

SEQ ID NO: 2971703 - RNA, 14 nt, Human
agugcaugcugucc

SEQ ID NO: 2971704 - RNA, 16 nt, Human
agugcaugcugucccu

SEQ ID NO: 2971705 - RNA, 21 nt, Human
agugcacuaauguguaagaca

SEQ ID NO: 2971706 - RNA, 17 nt, Human
agugcacuaauguguaa

SEQ ID NO: 2971707 - RNA, 14 nt, Human
agugcacuaaugug

SEQ ID NO: 2971708 - RNA, 17 nt, Human
agugcagugagccgaga

SEQ ID NO: 2971709 - RNA, 17 nt, Human
ugugccuaauguguuug

SEQ ID NO: 2971710 - RNA, 18 nt, Human
ugugccuaauguguuuga

SEQ ID NO: 2971711 - RNA, 14 nt, Human
ugugccuaaugugu

SEQ ID NO: 2971712 - RNA, 15 nt, Human
ugugccuaauguguu

SEQ ID NO: 2971713 - RNA, 18 nt, Human
ugugcugagucugaaggc

SEQ ID NO: 2971714 - RNA, 19 nt, Human
ugugcugagucugaaggcu

SEQ ID NO: 2971715 - RNA, 20 nt, Human
uguggauuuaacagaaaugu

SEQ ID NO: 2971716 - RNA, 19 nt, Human
uguggauuuaacagaaaug

SEQ ID NO: 2971717 - RNA, 22 nt, Human
uguggauuuaacagaaauguac

SEQ ID NO: 2971718 - RNA, 23 nt, Human
agugagcugguuuuuagcggaga

SEQ ID NO: 2971719 - RNA, 14 nt, Human
uguggaugauaaaa

SEQ ID NO: 2971720 - RNA, 18 nt, Human
ugugcugcccugcccacc

SEQ ID NO: 2971721 - RNA, 19 nt, Human
ugugcugcccugcccaccu

SEQ ID NO: 2971722 - RNA, 20 nt, Human
ugugcugcccugcccaccug

SEQ ID NO: 2971723 - RNA, 21 nt, Human
ugugcugcccugcccaccugg

SEQ ID NO: 2971724 - RNA, 22 nt, Human
uguggucaacauuucucauguu

SEQ ID NO: 2971725 - RNA, 14 nt, Human
ugugucauuucaaa

SEQ ID NO: 2971726 - RNA, 13 nt, Human
ugugucauuucaa

SEQ ID NO: 2971727 - RNA, 20 nt, Human
ugugucagguggggcagcuu

SEQ ID NO: 2971728 - RNA, 22 nt, Human
ugugucucuugguccugcugca

SEQ ID NO: 2971729 - RNA, 11 nt, Human
uguguguuuau

SEQ ID NO: 2971730 - RNA, 19 nt, Human
uguuacauaagauaaaugu

SEQ ID NO: 2971731 - RNA, 22 nt, Human
uguguuaucacccagaagaaaa

SEQ ID NO: 2971732 - RNA, 16 nt, Human
aguggggaaugaagau

SEQ ID NO: 2971733 - RNA, 22 nt, Human
agugggcccaaugcacuuuguu

SEQ ID NO: 2971734 - RNA, 18 nt, Human
agugggggaucacagccu

SEQ ID NO: 2971735 - RNA, 22 nt, Human
uguucuaaauaucccuuggaca

SEQ ID NO: 2971736 - RNA, 15 nt, Human
uguucuaagaaguga

SEQ ID NO: 2971737 - RNA, 19 nt, Human
aguguguggucaacauuuc

SEQ ID NO: 2971738 - RNA, 22 nt, Human
uguugcccacagcuguaugauu

SEQ ID NO: 2971739 - RNA, 20 nt, Human
uguugcccaggcuggcgugc

SEQ ID NO: 2971740 - RNA, 23 nt, Human
uguugcccaggcuggcgugcagu

SEQ ID NO: 2971741 - RNA, 16 nt, Human
aguguuguggauuuaa

SEQ ID NO: 2971742 - RNA, 23 nt, Human
aguguuggagaagaacugaaauc

SEQ ID NO: 2971743 - RNA, 20 nt, Human
aguguuguggauuuaacaga

SEQ ID NO: 2971744 - RNA, 19 nt, Human
aguguuguggauuuaacag

SEQ ID NO: 2971745 - RNA, 13 nt, Human
aguuacucagaau

SEQ ID NO: 2971746 - RNA, 20 nt, Human
agugugguguuuccuggcac

SEQ ID NO: 2971747 - RNA, 21 nt, Human
agugugccugaagucccagau

SEQ ID NO: 2971748 - RNA, 20 nt, Human
agugugccugaagucccaga

SEQ ID NO: 2971749 - RNA, 20 nt, Human
agugugacugaucucucgug

SEQ ID NO: 2971750 - RNA, 17 nt, Human
uguuaugacuccagaau

SEQ ID NO: 2971751 - RNA, 13 nt, Human
uguuaugacucca

SEQ ID NO: 2971752 - RNA, 22 nt, Human
agugugguguuuccuggcacug

SEQ ID NO: 2971753 - RNA, 19 nt, Human
uguuccacaaguuaaauaa

SEQ ID NO: 2971754 - RNA, 20 nt, Human
aguaaaaaaugguguuuuau

SEQ ID NO: 2971755 - RNA, 16 nt, Human
agguuuuuuuuucuca

SEQ ID NO: 2971756 - RNA, 21 nt, Human
uguacauggaauaacauguaa

SEQ ID NO: 2971757 - RNA, 16 nt, Human
aguaaaaccacagcag

SEQ ID NO: 2971758 - RNA, 17 nt, Human
aguaaaaccacagcagu

SEQ ID NO: 2971759 - RNA, 19 nt, Human
aguaaaaccacagcaguug

SEQ ID NO: 2971760 - RNA, 19 nt, Human
aguaauaaaugaaugucac

SEQ ID NO: 2971761 - RNA, 16 nt, Human
aguaauaaaugaaugu

SEQ ID NO: 2971762 - RNA, 17 nt, Human
aguaaugagcuuaagaa

SEQ ID NO: 2971763 - RNA, 13 nt, Human
aguaauuggaaag

SEQ ID NO: 2971764 - RNA, 12 nt, Human
aguaauuggaaa

SEQ ID NO: 2971765 - RNA, 21 nt, Human
aguacacuguuucaaacuuua

SEQ ID NO: 2971766 - RNA, 23 nt, Human
aguacacuguuucaaacuuuacu

SEQ ID NO: 2971767 - RNA, 18 nt, Human
uguaguguuggagaagaa

SEQ ID NO: 2971768 - RNA, 17 nt, Human
uguaguguuggagaaga

SEQ ID NO: 2971769 - RNA, 18 nt, Human
uguauauauuuccuauau

SEQ ID NO: 2971770 - RNA, 22 nt, Human
uguauauauuuccuauauuguu

SEQ ID NO: 2971771 - RNA, 21 nt, Human
uguauauguagauguaugcac

SEQ ID NO: 2971772 - RNA, 16 nt, Human
uguauauguagaugua

SEQ ID NO: 2971773 - RNA, 16 nt, Human
uguaguguuggagaag

SEQ ID NO: 2971774 - RNA, 15 nt, Human
uguagugagccgaga

SEQ ID NO: 2971775 - RNA, 17 nt, Human
uguaggguuauaauaau

SEQ ID NO: 2971776 - RNA, 16 nt, Human
uguaggguuauaauaa

SEQ ID NO: 2971777 - RNA, 15 nt, Human
uguacauacuuuuug

SEQ ID NO: 2971778 - RNA, 20 nt, Human
uguacauacuuuuuggguuu

SEQ ID NO: 2971779 - RNA, 14 nt, Human
uguacaugaaaaca

SEQ ID NO: 2971780 - RNA, 16 nt, Human
uguacaugaaaacaca

SEQ ID NO: 2971781 - RNA, 20 nt, Human
uguacaugaaaacacauuuu

SEQ ID NO: 2971782 - RNA, 20 nt, Human
uguacauaaugcgugcauac

SEQ ID NO: 2971783 - RNA, 19 nt, Human
uguacauaaugcgugcaua

SEQ ID NO: 2971784 - RNA, 20 nt, Human
uguaauuuuuuuaucgucac

SEQ ID NO: 2971785 - RNA, 21 nt, Human
uguaauuaaguacuauguauc

SEQ ID NO: 2971786 - RNA, 19 nt, Human
uguaauuaaguacuaugua

SEQ ID NO: 2971787 - RNA, 18 nt, Human
uguaauuaaguacuaugu

SEQ ID NO: 2971788 - RNA, 19 nt, Human
uguaagggaaacugccagc

SEQ ID NO: 2971789 - RNA, 17 nt, Human
uguaauuaaguacuaug

SEQ ID NO: 2971790 - RNA, 13 nt, Human
uguaagggaaacu

SEQ ID NO: 2971791 - RNA, 18 nt, Human
uguaagggaaacugccag

SEQ ID NO: 2971792 - RNA, 20 nt, Human
agguuggcaaaaaggcagga

SEQ ID NO: 2971793 - RNA, 22 nt, Human
aggugggauaucacuuccauga

SEQ ID NO: 2971794 - RNA, 12 nt, Human
aggugggaggau

SEQ ID NO: 2971795 - RNA, 16 nt, Human
aggugcuacaaaaaca

SEQ ID NO: 2971796 - RNA, 22 nt, Human
aggugugagucaccaagcccag

SEQ ID NO: 2971797 - RNA, 21 nt, Human
aggugugagucaccaagccca

SEQ ID NO: 2971798 - RNA, 16 nt, Human
aggugucccugcacuu

SEQ ID NO: 2971799 - RNA, 14 nt, Human
agguugcagugagc

SEQ ID NO: 2971800 - RNA, 14 nt, Human
agguugaagcacca

SEQ ID NO: 2971801 - RNA, 20 nt, Human
uguccagccccguagacgug

SEQ ID NO: 2971802 - RNA, 16 nt, Human
uguccaagaagcccag

SEQ ID NO: 2971803 - RNA, 17 nt, Human
uguccaagaagcccagg

SEQ ID NO: 2971804 - RNA, 18 nt, Human
uguccaagaagcccagga

SEQ ID NO: 2971805 - RNA, 22 nt, Human
uguccaagaagcccaggaaagg

SEQ ID NO: 2971806 - RNA, 23 nt, Human
ugucccugcacuugcagacucua

SEQ ID NO: 2971807 - RNA, 22 nt, Human
ugucccugcacuugcagacucu

SEQ ID NO: 2971808 - RNA, 20 nt, Human
ugucccugcacuugcagacu

SEQ ID NO: 2971809 - RNA, 22 nt, Human
ugucauuugagcagggcucagc

SEQ ID NO: 2971810 - RNA, 21 nt, Human
ugucauuugagcagggcucag

SEQ ID NO: 2971811 - RNA, 20 nt, Human
ugucauuugagcagggcuca

SEQ ID NO: 2971812 - RNA, 20 nt, Human
ugucagguggggcagcuuga

SEQ ID NO: 2971813 - RNA, 18 nt, Human
ugucagguggggcagcuu

SEQ ID NO: 2971814 - RNA, 17 nt, Human
ugucagguggggcagcu

SEQ ID NO: 2971815 - RNA, 14 nt, Human
uguccaagaagccc

SEQ ID NO: 2971816 - RNA, 15 nt, Human
uguccaagaagccca

SEQ ID NO: 2971817 - RNA, 16 nt, Human
ugucagguggggcagc

SEQ ID NO: 2971818 - RNA, 16 nt, Human
aguauagaaaaucuuc

SEQ ID NO: 2971819 - RNA, 15 nt, Human
aguauagaaaaucuu

SEQ ID NO: 2971820 - RNA, 12 nt, Human
aguauagaauag

SEQ ID NO: 2971821 - RNA, 19 nt, Human
aguauucuuauuuaaugaa

SEQ ID NO: 2971822 - RNA, 17 nt, Human
agucaccccggccaccu

SEQ ID NO: 2971823 - RNA, 15 nt, Human
agucaccaagcccag

SEQ ID NO: 2971824 - RNA, 14 nt, Human
agucaccaagccca

SEQ ID NO: 2971825 - RNA, 16 nt, Human
aguccccucuccucca

SEQ ID NO: 2971826 - RNA, 14 nt, Human
aguccucccaucuc

SEQ ID NO: 2971827 - RNA, 16 nt, Human
aguccucccaucucac

SEQ ID NO: 2971828 - RNA, 13 nt, Human
agucucaggaaau

SEQ ID NO: 2971829 - RNA, 21 nt, Human
agucucacuguugcccaggcu

SEQ ID NO: 2971830 - RNA, 22 nt, Human
ugucucaguccaugaagaugua

SEQ ID NO: 2971831 - RNA, 20 nt, Human
agucuagguugguagaguuu

SEQ ID NO: 2971832 - RNA, 20 nt, Human
agucuauuuacggaacucaa

SEQ ID NO: 2971833 - RNA, 15 nt, Human
agucuauuuacggaa

SEQ ID NO: 2971834 - RNA, 23 nt, Human
agucucacuguugcccaggcugg

SEQ ID NO: 2971835 - RNA, 16 nt, Human
agucccaccuuggcug

SEQ ID NO: 2971836 - RNA, 15 nt, Human
agucccaccuuggcu

SEQ ID NO: 2971837 - RNA, 19 nt, Human
agucccaccuuggcugcag

SEQ ID NO: 2971838 - RNA, 18 nt, Human
agucccaccuuggcugca

SEQ ID NO: 2971839 - RNA, 19 nt, Human
agucccagcuacucgggag

SEQ ID NO: 2971840 - RNA, 19 nt, Human
ugucccuuacgugaguccu

SEQ ID NO: 2971841 - RNA, 23 nt, Human
ugucccuuacgugaguccuggca

SEQ ID NO: 2971842 - RNA, 14 nt, Human
ugucccugcacuug

SEQ ID NO: 2971843 - RNA, 23 nt, Human
ugucggccccaccagugccucuc

SEQ ID NO: 2971844 - RNA, 22 nt, Human
ugucggccccaccagugccucu

SEQ ID NO: 2971845 - RNA, 21 nt, Human
ugucggccccaccagugccuc

SEQ ID NO: 2971846 - RNA, 20 nt, Human
ugucggccccaccagugccu

SEQ ID NO: 2971847 - RNA, 14 nt, Human
agucaggaaagaga

SEQ ID NO: 2971848 - RNA, 16 nt, Human
uggcuaacuuggguua

SEQ ID NO: 2971849 - RNA, 19 nt, Human
uggcuaauguacugcauau

SEQ ID NO: 2971850 - RNA, 17 nt, Human
uggcuaauguacugcau

SEQ ID NO: 2971851 - RNA, 15 nt, Human
uggcuauaggugcua

SEQ ID NO: 2971852 - RNA, 19 nt, Human
uggcuauaggugcuacaaa

SEQ ID NO: 2971853 - RNA, 17 nt, Human
aggcuccaggagcagcc

SEQ ID NO: 2971854 - RNA, 18 nt, Human
aggcuccaggagcagcca

SEQ ID NO: 2971855 - RNA, 19 nt, Human
aggcuccaggagcagccac

SEQ ID NO: 2971856 - RNA, 23 nt, Human
aggcuccaggagcagccacauuc

SEQ ID NO: 2971857 - RNA, 18 nt, Human
uggcuaagcaaaauguga

SEQ ID NO: 2971858 - RNA, 14 nt, Human
uggcuaaauucaug

SEQ ID NO: 2971859 - RNA, 23 nt, Human
uggcuauaggugcuacaaaaaca

SEQ ID NO: 2971860 - RNA, 13 nt, Human
uggcucacgccug

SEQ ID NO: 2971861 - RNA, 16 nt, Human
uggcucacccaguccu

SEQ ID NO: 2971862 - RNA, 13 nt, Human
uggcucacccagu

SEQ ID NO: 2971863 - RNA, 17 nt, Human
uggcuucacggaagagc

SEQ ID NO: 2971864 - RNA, 20 nt, Human
uggcuucacggaagagccuu

SEQ ID NO: 2971865 - RNA, 16 nt, Human
uggcuuuugugcauua

SEQ ID NO: 2971866 - RNA, 15 nt, Human
uggcuuuugugcauu

SEQ ID NO: 2971867 - RNA, 18 nt, Human
ugggaaacaaaaggauaa

SEQ ID NO: 2971868 - RNA, 21 nt, Human
uggcuuuugugcauuaucuag

SEQ ID NO: 2971869 - RNA, 17 nt, Human
ugggaaagcauuguaaa

SEQ ID NO: 2971870 - RNA, 18 nt, Human
ugggaaagcauuguaaau

SEQ ID NO: 2971871 - RNA, 14 nt, Human
ugggaaagcauugu

SEQ ID NO: 2971872 - RNA, 16 nt, Human
ugggaaagcauuguaa

SEQ ID NO: 2971873 - RNA, 23 nt, Human
uggcugcaaaggguaucaggugc

SEQ ID NO: 2971874 - RNA, 14 nt, Human
uggcugugaacuga

SEQ ID NO: 2971875 - RNA, 18 nt, Human
uggcuguuggcugggggc

SEQ ID NO: 2971876 - RNA, 16 nt, Human
uggcuguuggcugggg

SEQ ID NO: 2971877 - RNA, 14 nt, Human
uggcuucacggaag

SEQ ID NO: 2971878 - RNA, 23 nt, Human
uggcuguuggcugggggccucag

SEQ ID NO: 2971879 - RNA, 18 nt, Human
aggcuuagugauguaauu

SEQ ID NO: 2971880 - RNA, 17 nt, Human
aggcuuagugauguaau

SEQ ID NO: 2971881 - RNA, 19 nt, Human
aggcuuagugauguaauua

SEQ ID NO: 2971882 - RNA, 23 nt, Human
aggcuuagucacugagacagccc

SEQ ID NO: 2971883 - RNA, 21 nt, Human
aggcuuagucacugagacagc

SEQ ID NO: 2971884 - RNA, 22 nt, Human
aggcuuagucacugagacagcc

SEQ ID NO: 2971885 - RNA, 16 nt, Human
agggaaacugccagca

SEQ ID NO: 2971886 - RNA, 19 nt, Human
agggaaacugccagcaacg

SEQ ID NO: 2971887 - RNA, 21 nt, Human
agggaaacugccagcaacgca

SEQ ID NO: 2971888 - RNA, 23 nt, Human
agggaaacugccagcaacgcagg

SEQ ID NO: 2971889 - RNA, 14 nt, Human
agggaaacugccag

SEQ ID NO: 2971890 - RNA, 15 nt, Human
agggaaacugccagc

SEQ ID NO: 2971891 - RNA, 19 nt, Human
aggcugggagagccuucca

SEQ ID NO: 2971892 - RNA, 16 nt, Human
aggcugggagagccuu

SEQ ID NO: 2971893 - RNA, 20 nt, Human
ugggaacccaaguccaagca

SEQ ID NO: 2971894 - RNA, 20 nt, Human
aggcugggagagccuuccag

SEQ ID NO: 2971895 - RNA, 21 nt, Human
aggcugggagagccuuccagg

SEQ ID NO: 2971896 - RNA, 22 nt, Human
aggcugggagagccuuccaggg

SEQ ID NO: 2971897 - RNA, 21 nt, Human
aggcugggcucccuucccacc

SEQ ID NO: 2971898 - RNA, 23 nt, Human
aggcugggcucccuucccaccuc

SEQ ID NO: 2971899 - RNA, 14 nt, Human
aggcugggcuucag

SEQ ID NO: 2971900 - RNA, 14 nt, Human
aggcugggcucccu

SEQ ID NO: 2971901 - RNA, 18 nt, Human
aggcugggcucccuuccc

SEQ ID NO: 2971902 - RNA, 13 nt, Human
aggcugggcuccc

SEQ ID NO: 2971903 - RNA, 22 nt, Human
aggcugggggaagaagcucucu

SEQ ID NO: 2971904 - RNA, 14 nt, Human
aggcuggguucuga

SEQ ID NO: 2971905 - RNA, 17 nt, Human
aggcuggguucugaucc

SEQ ID NO: 2971906 - RNA, 21 nt, Human
aggcugggcuucaguggcagc

SEQ ID NO: 2971907 - RNA, 20 nt, Human
aggcugggcuucaguggcag

SEQ ID NO: 2971908 - RNA, 19 nt, Human
aggcugggcuucaguggca

SEQ ID NO: 2971909 - RNA, 18 nt, Human
aggcugggcuucaguggc

SEQ ID NO: 2971910 - RNA, 23 nt, Human
aggcugggcuucaguggcagcug

SEQ ID NO: 2971911 - RNA, 22 nt, Human
aggcugggcuucaguggcagcu

SEQ ID NO: 2971912 - RNA, 17 nt, Human
aggcugggggaagaagc

SEQ ID NO: 2971913 - RNA, 22 nt, Human
ugggaggauugcuugagcucag

SEQ ID NO: 2971914 - RNA, 18 nt, Human
ugggaggauugcuugagc

SEQ ID NO: 2971915 - RNA, 21 nt, Human
ugggaggauugcuugagcuca

SEQ ID NO: 2971916 - RNA, 21 nt, Human
ugggagaaccaaaaagaggcu

SEQ ID NO: 2971917 - RNA, 22 nt, Human
ugggaggaucucuugagccugg

SEQ ID NO: 2971918 - RNA, 19 nt, Human
ugggaggcugagaugggag

SEQ ID NO: 2971919 - RNA, 23 nt, Human
ugggcagaaggaagacuucaucc

SEQ ID NO: 2971920 - RNA, 13 nt, Human
ugggcauucaaau

SEQ ID NO: 2971921 - RNA, 14 nt, Human
ugggcauucaaaug

SEQ ID NO: 2971922 - RNA, 16 nt, Human
ugggcagaaggaagac

SEQ ID NO: 2971923 - RNA, 20 nt, Human
ugggcagaaggaagacuuca

SEQ ID NO: 2971924 - RNA, 13 nt, Human
ugggcagaaggaa

SEQ ID NO: 2971925 - RNA, 21 nt, Human
ugggcaacccccagccugcua

SEQ ID NO: 2971926 - RNA, 15 nt, Human
ugggcaacagagcaa

SEQ ID NO: 2971927 - RNA, 19 nt, Human
ugggcaacagagcaagacu

SEQ ID NO: 2971928 - RNA, 14 nt, Human
ugggcaacagagca

SEQ ID NO: 2971929 - RNA, 18 nt, Human
ugggacucaaugcacuga

SEQ ID NO: 2971930 - RNA, 16 nt, Human
ugggacuacaggugug

SEQ ID NO: 2971931 - RNA, 18 nt, Human
ugggacuacaggcaccca

SEQ ID NO: 2971932 - RNA, 13 nt, Human
agggagagaagau

SEQ ID NO: 2971933 - RNA, 14 nt, Human
agggagagaagaua

SEQ ID NO: 2971934 - RNA, 20 nt, Human
agggacuuggaagcuccgcu

SEQ ID NO: 2971935 - RNA, 23 nt, Human
agggacuucugucuucacaacag

SEQ ID NO: 2971936 - RNA, 15 nt, Human
agggacuuggaagcu

SEQ ID NO: 2971937 - RNA, 19 nt, Human
agggacuuggaagcuccgc

SEQ ID NO: 2971938 - RNA, 18 nt, Human
agggacuuggaagcuccg

SEQ ID NO: 2971939 - RNA, 22 nt, Human
agggcuguuauaaucuuucaca

SEQ ID NO: 2971940 - RNA, 14 nt, Human
ugggcucccuuccc

SEQ ID NO: 2971941 - RNA, 21 nt, Human
ugggcucccuucccaccucuc

SEQ ID NO: 2971942 - RNA, 20 nt, Human
agggcuccagacacaugucc

SEQ ID NO: 2971943 - RNA, 15 nt, Human
agggcuccagacaca

SEQ ID NO: 2971944 - RNA, 14 nt, Human
agggcccagagagg

SEQ ID NO: 2971945 - RNA, 17 nt, Human
agggagggcuccagaca

SEQ ID NO: 2971946 - RNA, 19 nt, Human
agggagggcuccagacaca

SEQ ID NO: 2971947 - RNA, 12 nt, Human
agggagggcucc

SEQ ID NO: 2971948 - RNA, 17 nt, Human
agggagggagggcucca

SEQ ID NO: 2971949 - RNA, 22 nt, Human
agggagggcuccagacacaugu

SEQ ID NO: 2971950 - RNA, 20 nt, Human
agggaguccgaaagggacuu

SEQ ID NO: 2971951 - RNA, 20 nt, Human
agggagugaguugauagcac

SEQ ID NO: 2971952 - RNA, 20 nt, Human
agggagugacagaggcagcc

SEQ ID NO: 2971953 - RNA, 23 nt, Human
agggaguccgaaagggacuugga

SEQ ID NO: 2971954 - RNA, 13 nt, Human
agggcccagagag

SEQ ID NO: 2971955 - RNA, 12 nt, Human
agggcccagaga

SEQ ID NO: 2971956 - RNA, 11 nt, Human
uggcccaggag

SEQ ID NO: 2971957 - RNA, 13 nt, Human
uggcccacugcau

SEQ ID NO: 2971958 - RNA, 14 nt, Human
uggcccacugcauc

SEQ ID NO: 2971959 - RNA, 19 nt, Human
uggcccacgcacuucggga

SEQ ID NO: 2971960 - RNA, 22 nt, Human
uggcaugggaaugaaugucagu

SEQ ID NO: 2971961 - RNA, 19 nt, Human
uggccucugcacuccccug

SEQ ID NO: 2971962 - RNA, 18 nt, Human
uggccucugcacuccccu

SEQ ID NO: 2971963 - RNA, 20 nt, Human
uggccucugcacuccccugc

SEQ ID NO: 2971964 - RNA, 18 nt, Human
uggccugagcugggauga

SEQ ID NO: 2971965 - RNA, 22 nt, Human
aggcuccacuuggucugugaga

SEQ ID NO: 2971966 - RNA, 21 nt, Human
aggcuccacuuggucugugag

SEQ ID NO: 2971967 - RNA, 17 nt, Human
aggcuccacuuggucug

SEQ ID NO: 2971968 - RNA, 11 nt, Human
aggcuccacuu

SEQ ID NO: 2971969 - RNA, 14 nt, Human
aggcuccaggagca

SEQ ID NO: 2971970 - RNA, 16 nt, Human
aggcuccaggagcagc

SEQ ID NO: 2971971 - RNA, 13 nt, Human
aggcuccaggagc

SEQ ID NO: 2971972 - RNA, 18 nt, Human
aggccuucucugaaggac

SEQ ID NO: 2971973 - RNA, 17 nt, Human
aggccuucucugaagga

SEQ ID NO: 2971974 - RNA, 22 nt, Human
aggcuauuccugagagcugcau

SEQ ID NO: 2971975 - RNA, 20 nt, Human
aggcuauuccugagagcugc

SEQ ID NO: 2971976 - RNA, 15 nt, Human
aggcuauuccugaga

SEQ ID NO: 2971977 - RNA, 21 nt, Human
aggccccugccacccugggga

SEQ ID NO: 2971978 - RNA, 12 nt, Human
aggccccugcca

SEQ ID NO: 2971979 - RNA, 18 nt, Human
aggccccugccacccugg

SEQ ID NO: 2971980 - RNA, 17 nt, Human
aggccccugccacccug

SEQ ID NO: 2971981 - RNA, 19 nt, Human
aggcccagagggccugcaa

SEQ ID NO: 2971982 - RNA, 20 nt, Human
aggcccagagggccugcaag

SEQ ID NO: 2971983 - RNA, 15 nt, Human
aggccccugccaccc

SEQ ID NO: 2971984 - RNA, 13 nt, Human
aggccccugccac

SEQ ID NO: 2971985 - RNA, 16 nt, Human
aggcccggcuccaggc

SEQ ID NO: 2971986 - RNA, 15 nt, Human
aggcccggcuccagg

SEQ ID NO: 2971987 - RNA, 14 nt, Human
aggcccggcuccag

SEQ ID NO: 2971988 - RNA, 12 nt, Human
aggccuggccag

SEQ ID NO: 2971989 - RNA, 13 nt, Human
aggccuggccaga

SEQ ID NO: 2971990 - RNA, 16 nt, Human
uggcaccagcagccug

SEQ ID NO: 2971991 - RNA, 17 nt, Human
uggcaccagcagccugg

SEQ ID NO: 2971992 - RNA, 16 nt, Human
uggcagcucagagagg

SEQ ID NO: 2971993 - RNA, 13 nt, Human
aggccagagacac

SEQ ID NO: 2971994 - RNA, 18 nt, Human
aggccagagacacaagcc

SEQ ID NO: 2971995 - RNA, 14 nt, Human
uggcagcucagaga

SEQ ID NO: 2971996 - RNA, 15 nt, Human
uggcagcucagagag

SEQ ID NO: 2971997 - RNA, 23 nt, Human
aggccagagacacaagccuucgg

SEQ ID NO: 2971998 - RNA, 18 nt, Human
aggccaugggccuccugu

SEQ ID NO: 2971999 - RNA, 17 nt, Human
aggccaugggccuccug

SEQ ID NO: 2972000 - RNA, 15 nt, Human
aggcccagagggccu

SEQ ID NO: 2972001 - RNA, 16 nt, Human
aggcccagagggccug

SEQ ID NO: 2972002 - RNA, 12 nt, Human
aggaguuuggcc

SEQ ID NO: 2972003 - RNA, 13 nt, Human
aggaguuuggcca

SEQ ID NO: 2972004 - RNA, 21 nt, Human
aggaguuugagaccaaccugg

SEQ ID NO: 2972005 - RNA, 15 nt, Human
aggaggccagccuug

SEQ ID NO: 2972006 - RNA, 19 nt, Human
uggaacacucuauaacaaa

SEQ ID NO: 2972007 - RNA, 20 nt, Human
ugcugccccugcacagcagg

SEQ ID NO: 2972008 - RNA, 21 nt, Human
ugcugccccugcacagcaggc

SEQ ID NO: 2972009 - RNA, 10 nt, Human
ugcugcccug

SEQ ID NO: 2972010 - RNA, 22 nt, Human
ugcugccccugcacagcaggcu

SEQ ID NO: 2972011 - RNA, 12 nt, Human
uggaacacucug

SEQ ID NO: 2972012 - RNA, 13 nt, Human
uggaagcuccgcu

SEQ ID NO: 2972013 - RNA, 20 nt, Human
uggaaguacuauaauuuacc

SEQ ID NO: 2972014 - RNA, 18 nt, Human
uggaaguacuauaauuua

SEQ ID NO: 2972015 - RNA, 19 nt, Human
aggcaacugcauuggcuuu

SEQ ID NO: 2972016 - RNA, 14 nt, Human
aggcaagcaccucc

SEQ ID NO: 2972017 - RNA, 22 nt, Human
uggaauuucucccagucauuua

SEQ ID NO: 2972018 - RNA, 15 nt, Human
uggacaccggaaaca

SEQ ID NO: 2972019 - RNA, 17 nt, Human
uggacaaaauggaauac

SEQ ID NO: 2972020 - RNA, 14 nt, Human
uggacaaaauggaa

SEQ ID NO: 2972021 - RNA, 16 nt, Human
aggaugcuuguacaua

SEQ ID NO: 2972022 - RNA, 15 nt, Human
aggaugcuuguacau

SEQ ID NO: 2972023 - RNA, 21 nt, Human
aggauccugagccagauuuca

SEQ ID NO: 2972024 - RNA, 12 nt, Human
aggaucagucug

SEQ ID NO: 2972025 - RNA, 18 nt, Human
aggaugcuuguacauaau

SEQ ID NO: 2972026 - RNA, 22 nt, Human
aggauugcuacuguccuaccca

SEQ ID NO: 2972027 - RNA, 21 nt, Human
aggcagggucucacucugucg

SEQ ID NO: 2972028 - RNA, 20 nt, Human
aggcagggucucacucuguc

SEQ ID NO: 2972029 - RNA, 18 nt, Human
aggcagggucucacucug

SEQ ID NO: 2972030 - RNA, 19 nt, Human
aggcagggucucacucugu

SEQ ID NO: 2972031 - RNA, 14 nt, Human
aggcagguccaggg

SEQ ID NO: 2972032 - RNA, 22 nt, Human
aggcagggucucacucugucgc

SEQ ID NO: 2972033 - RNA, 21 nt, Human
aggcaggucuugaacuccugg

SEQ ID NO: 2972034 - RNA, 12 nt, Human
aggcaggauggc

SEQ ID NO: 2972035 - RNA, 18 nt, Human
aggcaggagacuggcgug

SEQ ID NO: 2972036 - RNA, 15 nt, Human
aggcaggagacuggc

SEQ ID NO: 2972037 - RNA, 21 nt, Human
aggcagccccauucugccugc

SEQ ID NO: 2972038 - RNA, 20 nt, Human
aggcagccccauucugccug

SEQ ID NO: 2972039 - RNA, 19 nt, Human
aggcagccccauucugccu

SEQ ID NO: 2972040 - RNA, 22 nt, Human
aggcagccccauucugccugcc

SEQ ID NO: 2972041 - RNA, 24 nt, Human
uggacuuuguuaguuucuccaagc

SEQ ID NO: 2972042 - RNA, 14 nt, Human
uggagaagaacuga

SEQ ID NO: 2972043 - RNA, 16 nt, Human
uggagaagaacugaaa

SEQ ID NO: 2972044 - RNA, 11 nt, Human
uggacuuuguu

SEQ ID NO: 2972045 - RNA, 22 nt, Human
uggacuuuguuaguuucuccaa

SEQ ID NO: 2972046 - RNA, 16 nt, Human
aggcaaugcuggcugu

SEQ ID NO: 2972047 - RNA, 15 nt, Human
aggcaaugcuggcug

SEQ ID NO: 2972048 - RNA, 21 nt, Human
uggagcucgugggacagucac

SEQ ID NO: 2972049 - RNA, 20 nt, Human
ugccuuuuuauaacuuuuua

SEQ ID NO: 2972050 - RNA, 13 nt, Human
ugcgaaaggauga

SEQ ID NO: 2972051 - RNA, 17 nt, Human
ugcggacagccacggcc

SEQ ID NO: 2972052 - RNA, 18 nt, Human
ugcggacagccacggcca

SEQ ID NO: 2972053 - RNA, 19 nt, Human
ugcgaaaggaugaaaguga

SEQ ID NO: 2972054 - RNA, 16 nt, Human
ugccuguucagcucca

SEQ ID NO: 2972055 - RNA, 15 nt, Human
ugccuguucagcucc

SEQ ID NO: 2972056 - RNA, 21 nt, Human
agcugccugggaucccucauc

SEQ ID NO: 2972057 - RNA, 13 nt, Human
agcugccugggau

SEQ ID NO: 2972058 - RNA, 19 nt, Human
agcugccugggaucccuca

SEQ ID NO: 2972059 - RNA, 13 nt, Human
agcuggaaaagua

SEQ ID NO: 2972060 - RNA, 23 nt, Human
agcugccuccccuccucugcuug

SEQ ID NO: 2972061 - RNA, 22 nt, Human
agcugccuccccuccucugcuu

SEQ ID NO: 2972062 - RNA, 21 nt, Human
agcugccuccccuccucugcu

SEQ ID NO: 2972063 - RNA, 20 nt, Human
agcugccuccccuccucugc

SEQ ID NO: 2972064 - RNA, 19 nt, Human
agcugccuccccuccucug

SEQ ID NO: 2972065 - RNA, 18 nt, Human
agcugccuccccuccucu

SEQ ID NO: 2972066 - RNA, 17 nt, Human
agcugccuccccuccuc

SEQ ID NO: 2972067 - RNA, 22 nt, Human
ugccucugacacacagcucugu

SEQ ID NO: 2972068 - RNA, 14 nt, Human
agcugggcagguug

SEQ ID NO: 2972069 - RNA, 19 nt, Human
agcugggacuacaggugug

SEQ ID NO: 2972070 - RNA, 17 nt, Human
agcugggacuacaggug

SEQ ID NO: 2972071 - RNA, 23 nt, Human
agcugggaugauuggagggggga

SEQ ID NO: 2972072 - RNA, 19 nt, Human
ugcccuccaagaccuucuc

SEQ ID NO: 2972073 - RNA, 20 nt, Human
ugcccuccaagaccuucucc

SEQ ID NO: 2972074 - RNA, 22 nt, Human
ugcccuccaagaccuucuccuu

SEQ ID NO: 2972075 - RNA, 16 nt, Human
agcucucuccucccuu

SEQ ID NO: 2972076 - RNA, 20 nt, Human
agcucugguccauagagagc

SEQ ID NO: 2972077 - RNA, 22 nt, Human
agcucugcuccucuccccagca

SEQ ID NO: 2972078 - RNA, 12 nt, Human
agcucugcuccu

SEQ ID NO: 2972079 - RNA, 12 nt, Human
agcucuguccug

SEQ ID NO: 2972080 - RNA, 17 nt, Human
agcucuucuccaggcug

SEQ ID NO: 2972081 - RNA, 18 nt, Human
agcucuucuccaggcugu

SEQ ID NO: 2972082 - RNA, 20 nt, Human
agcugaucgcuucuccccca

SEQ ID NO: 2972083 - RNA, 18 nt, Human
agcugcacccucaggcag

SEQ ID NO: 2972084 - RNA, 19 nt, Human
agcugcacccucaggcagg

SEQ ID NO: 2972085 - RNA, 20 nt, Human
agcugcacccucaggcaggu

SEQ ID NO: 2972086 - RNA, 22 nt, Human
agcugcacccucaggcaggugg

SEQ ID NO: 2972087 - RNA, 13 nt, Human
agcugcacccuca

SEQ ID NO: 2972088 - RNA, 17 nt, Human
agcugcacccucaggca

SEQ ID NO: 2972089 - RNA, 13 nt, Human
agcugccaccugc

SEQ ID NO: 2972090 - RNA, 18 nt, Human
agcugcauacaguuugca

SEQ ID NO: 2972091 - RNA, 13 nt, Human
ugccucccaucac

SEQ ID NO: 2972092 - RNA, 14 nt, Human
ugccucccaucacc

SEQ ID NO: 2972093 - RNA, 19 nt, Human
ugccucccaucacccgcua

SEQ ID NO: 2972094 - RNA, 13 nt, Human
ugccucucucagg

SEQ ID NO: 2972095 - RNA, 14 nt, Human
ugccucucucaggc

SEQ ID NO: 2972096 - RNA, 15 nt, Human
ugccucucucaggcc

SEQ ID NO: 2972097 - RNA, 21 nt, Human
ugccucugacacacagcucug

SEQ ID NO: 2972098 - RNA, 20 nt, Human
ugccucugacacacagcucu

SEQ ID NO: 2972099 - RNA, 22 nt, Human
ugcugccaauauccuaauaaaa

SEQ ID NO: 2972100 - RNA, 23 nt, Human
ugcugccaauauccuaauaaaaa

SEQ ID NO: 2972101 - RNA, 11 nt, Human
ugcugccaucc

SEQ ID NO: 2972102 - RNA, 15 nt, Human
ugcugccauccaggu

SEQ ID NO: 2972103 - RNA, 14 nt, Human
ugcugccauccagg

SEQ ID NO: 2972104 - RNA, 13 nt, Human
ugcugccauccag

SEQ ID NO: 2972105 - RNA, 12 nt, Human
ugcugccaucca

SEQ ID NO: 2972106 - RNA, 22 nt, Human
ugcugccauccagguucagcuu

SEQ ID NO: 2972107 - RNA, 21 nt, Human
ugcugccauccagguucagcu

SEQ ID NO: 2972108 - RNA, 19 nt, Human
aggaauugacccacaagaa

SEQ ID NO: 2972109 - RNA, 23 nt, Human
aggaauccagacccggcugcgug

SEQ ID NO: 2972110 - RNA, 15 nt, Human
aggaagacuuuggaa

SEQ ID NO: 2972111 - RNA, 14 nt, Human
aggaagagaaaaaa

SEQ ID NO: 2972112 - RNA, 18 nt, Human
aggaagcucagggccugg

SEQ ID NO: 2972113 - RNA, 22 nt, Human
aggaagcucagggccuggcuca

SEQ ID NO: 2972114 - RNA, 17 nt, Human
aggaagcucagggccug

SEQ ID NO: 2972115 - RNA, 23 nt, Human
aggaaagcaaaucaguuugguug

SEQ ID NO: 2972116 - RNA, 19 nt, Human
aggaaagcaaaggagauug

SEQ ID NO: 2972117 - RNA, 21 nt, Human
ugcugacuguuuucucuugag

SEQ ID NO: 2972118 - RNA, 24 nt, Human
ugcugacuguuuucucuugagagg

SEQ ID NO: 2972119 - RNA, 16 nt, Human
ugcugacuguuuucuc

SEQ ID NO: 2972120 - RNA, 22 nt, Human
aggaaaggcuccaggagcagcc

SEQ ID NO: 2972121 - RNA, 13 nt, Human
aggaaauauuuau

SEQ ID NO: 2972122 - RNA, 18 nt, Human
aggaaauauuuauuuuaa

SEQ ID NO: 2972123 - RNA, 14 nt, Human
aggaaauauuuauu

SEQ ID NO: 2972124 - RNA, 18 nt, Human
aggaaaggcuccaggagc

SEQ ID NO: 2972125 - RNA, 20 nt, Human
aggaaaggcuccaggagcag

SEQ ID NO: 2972126 - RNA, 18 nt, Human
ugcucugcauguuacaua

SEQ ID NO: 2972127 - RNA, 15 nt, Human
ugcucugcauguuac

SEQ ID NO: 2972128 - RNA, 17 nt, Human
ugcucuggacaggcaug

SEQ ID NO: 2972129 - RNA, 17 nt, Human
ugcugacuguuuucucu

SEQ ID NO: 2972130 - RNA, 22 nt, Human
ugcucugaucauccacugugcc

SEQ ID NO: 2972131 - RNA, 19 nt, Human
ugcucugaucauccacugu

SEQ ID NO: 2972132 - RNA, 16 nt, Human
ugcuaguaauuggaaa

SEQ ID NO: 2972133 - RNA, 16 nt, Human
aggaaagaggcucugg

SEQ ID NO: 2972134 - RNA, 17 nt, Human
aggaaagcaaaggagau

SEQ ID NO: 2972135 - RNA, 14 nt, Human
ugcuaguaauugga

SEQ ID NO: 2972136 - RNA, 12 nt, Human
aggaaagaggcu

SEQ ID NO: 2972137 - RNA, 13 nt, Human
aggaaagaggcuc

SEQ ID NO: 2972138 - RNA, 19 nt, Human
aggaaagagaacuuccaga

SEQ ID NO: 2972139 - RNA, 13 nt, Human
aggaaagagaacu

SEQ ID NO: 2972140 - RNA, 12 nt, Human
agcuuugaaaau

SEQ ID NO: 2972141 - RNA, 16 nt, Human
agcuuugaaaauucag

SEQ ID NO: 2972142 - RNA, 18 nt, Human
agcuuugaaaauucagug

SEQ ID NO: 2972143 - RNA, 19 nt, Human
agcuuugaaaauucagugg

SEQ ID NO: 2972144 - RNA, 16 nt, Human
aggaaacccagcucug

SEQ ID NO: 2972145 - RNA, 17 nt, Human
aggaaacccagcucugg

SEQ ID NO: 2972146 - RNA, 15 nt, Human
aggaaacccagcucu

SEQ ID NO: 2972147 - RNA, 18 nt, Human
aggaaacccagcucuggu

SEQ ID NO: 2972148 - RNA, 20 nt, Human
aggaaacccagcucuggucc

SEQ ID NO: 2972149 - RNA, 21 nt, Human
aggaaacccagcucuggucca

SEQ ID NO: 2972150 - RNA, 20 nt, Human
agcuuauuaaaacucauuuu

SEQ ID NO: 2972151 - RNA, 15 nt, Human
agcuuauuaaaacuc

SEQ ID NO: 2972152 - RNA, 21 nt, Human
agcuuauugucuagugaaacu

SEQ ID NO: 2972153 - RNA, 21 nt, Human
agcuuguaaauagcucaggug

SEQ ID NO: 2972154 - RNA, 20 nt, Human
agcuuguaaauagcucaggu

SEQ ID NO: 2972155 - RNA, 19 nt, Human
agcuuguaaauagcucagg

SEQ ID NO: 2972156 - RNA, 18 nt, Human
agcuuguaaauagcucag

SEQ ID NO: 2972157 - RNA, 21 nt, Human
ugcggacagccacggccaggc

SEQ ID NO: 2972158 - RNA, 20 nt, Human
ugcggacagccacggccagg

SEQ ID NO: 2972159 - RNA, 12 nt, Human
agcuuaucucag

SEQ ID NO: 2972160 - RNA, 14 nt, Human
agcuuaucucaggg

SEQ ID NO: 2972161 - RNA, 15 nt, Human
agcuuaucucagggg

SEQ ID NO: 2972162 - RNA, 15 nt, Human
ugccaauauccuaau

SEQ ID NO: 2972163 - RNA, 16 nt, Human
ugccaauauccuaaua

SEQ ID NO: 2972164 - RNA, 17 nt, Human
ugccaauauccuaauaa

SEQ ID NO: 2972165 - RNA, 18 nt, Human
ugccaauauccuaauaaa

SEQ ID NO: 2972166 - RNA, 19 nt, Human
ugccaauauccuaauaaaa

SEQ ID NO: 2972167 - RNA, 21 nt, Human
ugccaauauccuaauaaaaag

SEQ ID NO: 2972168 - RNA, 23 nt, Human
ugccaauauccuaauaaaaaggu

SEQ ID NO: 2972169 - RNA, 23 nt, Human
ugcauuugaaaauuuugauguuu

SEQ ID NO: 2972170 - RNA, 19 nt, Human
ugcauuugaaaauuuugau

SEQ ID NO: 2972171 - RNA, 22 nt, Human
agcgcccaguuggguggaugcc

SEQ ID NO: 2972172 - RNA, 14 nt, Human
agcgcccaguuggg

SEQ ID NO: 2972173 - RNA, 19 nt, Human
agcuacuaauuuuaaaaug

SEQ ID NO: 2972174 - RNA, 23 nt, Human
agcgugguggacaugcacagcua

SEQ ID NO: 2972175 - RNA, 20 nt, Human
agcgugguggacaugcacag

SEQ ID NO: 2972176 - RNA, 17 nt, Human
agcgugagccacugcac

SEQ ID NO: 2972177 - RNA, 16 nt, Human
agcgugagccacugca

SEQ ID NO: 2972178 - RNA, 21 nt, Human
ugccauauucuguuggccagu

SEQ ID NO: 2972179 - RNA, 20 nt, Human
ugccauauucuguuggccag

SEQ ID NO: 2972180 - RNA, 15 nt, Human
agcggggacagcucc

SEQ ID NO: 2972181 - RNA, 17 nt, Human
agcggggacagcuccuu

SEQ ID NO: 2972182 - RNA, 16 nt, Human
agcggggacagcuccu

SEQ ID NO: 2972183 - RNA, 15 nt, Human
agcgugagccacugc

SEQ ID NO: 2972184 - RNA, 13 nt, Human
agcgugagccacu

SEQ ID NO: 2972185 - RNA, 15 nt, Human
ugccagucaccccgg

SEQ ID NO: 2972186 - RNA, 16 nt, Human
ugccagucaccccggc

SEQ ID NO: 2972187 - RNA, 18 nt, Human
ugccagucaccccggcca

SEQ ID NO: 2972188 - RNA, 20 nt, Human
ugccagucaccccggccacc

SEQ ID NO: 2972189 - RNA, 15 nt, Human
ugccauauucuguug

SEQ ID NO: 2972190 - RNA, 17 nt, Human
ugccauauucuguuggc

SEQ ID NO: 2972191 - RNA, 16 nt, Human
ugccauauucuguugg

SEQ ID NO: 2972192 - RNA, 22 nt, Human
ugccagucaccccggccaccug

SEQ ID NO: 2972193 - RNA, 23 nt, Human
ugccagucaccccggccaccugc

SEQ ID NO: 2972194 - RNA, 19 nt, Human
ugcccucaagagcaaagua

SEQ ID NO: 2972195 - RNA, 21 nt, Human
ugcccccuguggaugcugcug

SEQ ID NO: 2972196 - RNA, 19 nt, Human
ugcccccuguggaugcugc

SEQ ID NO: 2972197 - RNA, 13 nt, Human
ugcccccugugga

SEQ ID NO: 2972198 - RNA, 11 nt, Human
ugcccaggccc

SEQ ID NO: 2972199 - RNA, 20 nt, Human
ugcccaggcaggucuugaac

SEQ ID NO: 2972200 - RNA, 17 nt, Human
ugcccaggcaggucuug

SEQ ID NO: 2972201 - RNA, 16 nt, Human
ugcccaggcaggucuu

SEQ ID NO: 2972202 - RNA, 15 nt, Human
ugcccaggcaggucu

SEQ ID NO: 2972203 - RNA, 14 nt, Human
ugcccacaggauca

SEQ ID NO: 2972204 - RNA, 22 nt, Human
ugcccaggccccugccacccug

SEQ ID NO: 2972205 - RNA, 20 nt, Human
ugcccaggccccugccaccc

SEQ ID NO: 2972206 - RNA, 12 nt, Human
ugcccaggcccc

SEQ ID NO: 2972207 - RNA, 14 nt, Human
agcucagggccugg

SEQ ID NO: 2972208 - RNA, 15 nt, Human
agcucagggccuggc

SEQ ID NO: 2972209 - RNA, 16 nt, Human
agcucagggccuggcu

SEQ ID NO: 2972210 - RNA, 19 nt, Human
ugccauguuggccaggcug

SEQ ID NO: 2972211 - RNA, 18 nt, Human
ugccauguuggccaggcu

SEQ ID NO: 2972212 - RNA, 17 nt, Human
agcucagggccuggcuc

SEQ ID NO: 2972213 - RNA, 17 nt, Human
ugccauguuggccaggc

SEQ ID NO: 2972214 - RNA, 20 nt, Human
ugccauguuggccaggcugg

SEQ ID NO: 2972215 - RNA, 21 nt, Human
ugccauguuggccaggcuggu

SEQ ID NO: 2972216 - RNA, 22 nt, Human
agcuacugccauccuggcccag

SEQ ID NO: 2972217 - RNA, 15 nt, Human
agcuacucgggaggc

SEQ ID NO: 2972218 - RNA, 19 nt, Human
agcuacucgggaggcugag

SEQ ID NO: 2972219 - RNA, 18 nt, Human
agcuacugccauccuggc

SEQ ID NO: 2972220 - RNA, 16 nt, Human
agcuacugccauccug

SEQ ID NO: 2972221 - RNA, 14 nt, Human
agcuacugccaucc

SEQ ID NO: 2972222 - RNA, 13 nt, Human
agcuacugccauc

SEQ ID NO: 2972223 - RNA, 12 nt, Human
agcuacugccau

SEQ ID NO: 2972224 - RNA, 17 nt, Human
ugcacaucuguuuugua

SEQ ID NO: 2972225 - RNA, 13 nt, Human
ugcacacacauau

SEQ ID NO: 2972226 - RNA, 18 nt, Human
ugcacacacauauauuau

SEQ ID NO: 2972227 - RNA, 15 nt, Human
ugcacacacauauau

SEQ ID NO: 2972228 - RNA, 15 nt, Human
ugcacacaccagagc

SEQ ID NO: 2972229 - RNA, 18 nt, Human
ugcacaagcuccaagcuc

SEQ ID NO: 2972230 - RNA, 20 nt, Human
ugcacaagcuccaagcuccc

SEQ ID NO: 2972231 - RNA, 22 nt, Human
ugcacaagcuccaagcucccag

SEQ ID NO: 2972232 - RNA, 23 nt, Human
ugcacaagcuccaagcucccagg

SEQ ID NO: 2972233 - RNA, 15 nt, Human
ugcacaagcuccaag

SEQ ID NO: 2972234 - RNA, 16 nt, Human
ugcacaagcuccaagc

SEQ ID NO: 2972235 - RNA, 12 nt, Human
ugcacuccccug

SEQ ID NO: 2972236 - RNA, 13 nt, Human
ugcacuccccugc

SEQ ID NO: 2972237 - RNA, 19 nt, Human
ugcacguacacacacauac

SEQ ID NO: 2972238 - RNA, 14 nt, Human
ugcaccacugcacu

SEQ ID NO: 2972239 - RNA, 19 nt, Human
agcccuucuuuccacagaa

SEQ ID NO: 2972240 - RNA, 18 nt, Human
agcccuucuuuccacaga

SEQ ID NO: 2972241 - RNA, 17 nt, Human
agccuaggugacagagu

SEQ ID NO: 2972242 - RNA, 15 nt, Human
agccuaggugacaga

SEQ ID NO: 2972243 - RNA, 15 nt, Human
agccucaaccuccug

SEQ ID NO: 2972244 - RNA, 17 nt, Human
agcccuucuuuccacag

SEQ ID NO: 2972245 - RNA, 22 nt, Human
ugcagacucuacagaggccaug

SEQ ID NO: 2972246 - RNA, 15 nt, Human
ugcacuccccugcug

SEQ ID NO: 2972247 - RNA, 18 nt, Human
ugcagacucuacagaggc

SEQ ID NO: 2972248 - RNA, 20 nt, Human
ugcagacucuacagaggcca

SEQ ID NO: 2972249 - RNA, 19 nt, Human
ugcagacucuacagaggcc

SEQ ID NO: 2972250 - RNA, 16 nt, Human
ugcauacuauuaaaca

SEQ ID NO: 2972251 - RNA, 15 nt, Human
ugcauacuauuaaac

SEQ ID NO: 2972252 - RNA, 12 nt, Human
ugcauacuauua

SEQ ID NO: 2972253 - RNA, 22 nt, Human
ugcauaccacuuuuguucuugg

SEQ ID NO: 2972254 - RNA, 21 nt, Human
ugcauaccacuuuuguucuug

SEQ ID NO: 2972255 - RNA, 20 nt, Human
ugcauacuauuaaacaugcu

SEQ ID NO: 2972256 - RNA, 18 nt, Human
ugcauacuauuaaacaug

SEQ ID NO: 2972257 - RNA, 17 nt, Human
ugcauacuauuaaacau

SEQ ID NO: 2972258 - RNA, 20 nt, Human
ugcaugaaguaauaugcaca

SEQ ID NO: 2972259 - RNA, 22 nt, Human
ugcaugaaguaauaugcacaca

SEQ ID NO: 2972260 - RNA, 21 nt, Human
ugcaugaggcuaguguggugu

SEQ ID NO: 2972261 - RNA, 14 nt, Human
ugcaugcugucccu

SEQ ID NO: 2972262 - RNA, 15 nt, Human
ugcaugcugucccuu

SEQ ID NO: 2972263 - RNA, 13 nt, Human
ugcaugcuguccc

SEQ ID NO: 2972264 - RNA, 16 nt, Human
ugcaugcugucccuua

SEQ ID NO: 2972265 - RNA, 16 nt, Human
agccugccucuucucu

SEQ ID NO: 2972266 - RNA, 19 nt, Human
agccugccucuucucuacu

SEQ ID NO: 2972267 - RNA, 23 nt, Human
agccugcaguuauuaacacuaac

SEQ ID NO: 2972268 - RNA, 18 nt, Human
agccugagcgacagugag

SEQ ID NO: 2972269 - RNA, 15 nt, Human
agccucagcauccug

SEQ ID NO: 2972270 - RNA, 14 nt, Human
agccucagcauccu

SEQ ID NO: 2972271 - RNA, 13 nt, Human
agccucagcaucc

SEQ ID NO: 2972272 - RNA, 18 nt, Human
agccucaaccuccugggc

SEQ ID NO: 2972273 - RNA, 17 nt, Human
agccucaaccuccuggg

SEQ ID NO: 2972274 - RNA, 19 nt, Human
ugcagccucaaccuccugg

SEQ ID NO: 2972275 - RNA, 18 nt, Human
ugcagccucaaccuccug

SEQ ID NO: 2972276 - RNA, 14 nt, Human
ugcagugagccgag

SEQ ID NO: 2972277 - RNA, 16 nt, Human
ucugucuuuuaaacuc

SEQ ID NO: 2972278 - RNA, 12 nt, Human
ucugucuuuuaa

SEQ ID NO: 2972279 - RNA, 15 nt, Human
ucugugaaaggaaag

SEQ ID NO: 2972280 - RNA, 21 nt, Human
ucugugaaaggaaagagggag

SEQ ID NO: 2972281 - RNA, 18 nt, Human
ucugucuuuuaaacucug

SEQ ID NO: 2972282 - RNA, 16 nt, Human
ucugugcguagaaguu

SEQ ID NO: 2972283 - RNA, 20 nt, Human
ucuguuggccagugugacaa

SEQ ID NO: 2972284 - RNA, 19 nt, Human
ucuguuggccagugugaca

SEQ ID NO: 2972285 - RNA, 18 nt, Human
ucuguuggccagugugac

SEQ ID NO: 2972286 - RNA, 18 nt, Human
ucuguuuuauaauuuugu

SEQ ID NO: 2972287 - RNA, 23 nt, Human
agaauuucccaaagcagugcaug

SEQ ID NO: 2972288 - RNA, 21 nt, Human
agaauuucuaggacugaauua

SEQ ID NO: 2972289 - RNA, 13 nt, Human
agaauuucuagga

SEQ ID NO: 2972290 - RNA, 17 nt, Human
agaauuucccaaagcag

SEQ ID NO: 2972291 - RNA, 18 nt, Human
agaauuucccaaagcagu

SEQ ID NO: 2972292 - RNA, 15 nt, Human
ucugucauuugagca

SEQ ID NO: 2972293 - RNA, 23 nt, Human
ucugucauuugagcagggcucag

SEQ ID NO: 2972294 - RNA, 20 nt, Human
ucugucauuugagcagggcu

SEQ ID NO: 2972295 - RNA, 18 nt, Human
ucugguccauagagagca

SEQ ID NO: 2972296 - RNA, 16 nt, Human
ucuggguucacugcaa

SEQ ID NO: 2972297 - RNA, 14 nt, Human
ucuggguucacugc

SEQ ID NO: 2972298 - RNA, 11 nt, Human
ucuggggcugu

SEQ ID NO: 2972299 - RNA, 16 nt, Human
ucuucccucaaaugug

SEQ ID NO: 2972300 - RNA, 22 nt, Human
ucuuccaggcugggagagccuu

SEQ ID NO: 2972301 - RNA, 18 nt, Human
ucuuaauuaaaagaauau

SEQ ID NO: 2972302 - RNA, 21 nt, Human
ucuuaauuaaaagaauauuuu

SEQ ID NO: 2972303 - RNA, 14 nt, Human
ucuuaauuaaaaga

SEQ ID NO: 2972304 - RNA, 15 nt, Human
ucuuaugggcugggu

SEQ ID NO: 2972305 - RNA, 16 nt, Human
ucuuaugggcuggguu

SEQ ID NO: 2972306 - RNA, 14 nt, Human
ucuuaugggcuggg

SEQ ID NO: 2972307 - RNA, 22 nt, Human
ucuuauugcccacgcuggagug

SEQ ID NO: 2972308 - RNA, 18 nt, Human
ucuuauugcccacgcugg

SEQ ID NO: 2972309 - RNA, 14 nt, Human
ucuuauugcccacg

SEQ ID NO: 2972310 - RNA, 17 nt, Human
agaauuugauaugugaa

SEQ ID NO: 2972311 - RNA, 19 nt, Human
agaauuugauaugugaaca

SEQ ID NO: 2972312 - RNA, 18 nt, Human
agaauuugauaugugaac

SEQ ID NO: 2972313 - RNA, 20 nt, Human
agaauuugauaugugaacag

SEQ ID NO: 2972314 - RNA, 21 nt, Human
agacaggguuuugccauguug

SEQ ID NO: 2972315 - RNA, 15 nt, Human
agacaggaccaggga

SEQ ID NO: 2972316 - RNA, 22 nt, Human
agacaggcaagcaccuccugcc

SEQ ID NO: 2972317 - RNA, 23 nt, Human
agacaggcaagcaccuccugccu

SEQ ID NO: 2972318 - RNA, 16 nt, Human
agacagucccugccaa

SEQ ID NO: 2972319 - RNA, 17 nt, Human
agacagucccugccaau

SEQ ID NO: 2972320 - RNA, 15 nt, Human
agacagucccugcca

SEQ ID NO: 2972321 - RNA, 14 nt, Human
agacagucccugcc

SEQ ID NO: 2972322 - RNA, 20 nt, Human
agacuggauaguccgucucu

SEQ ID NO: 2972323 - RNA, 19 nt, Human
agacucuacagaggccaug

SEQ ID NO: 2972324 - RNA, 21 nt, Human
agacucgcgacaaugcaaacc

SEQ ID NO: 2972325 - RNA, 17 nt, Human
agacucuacagaggcca

SEQ ID NO: 2972326 - RNA, 18 nt, Human
agacuccugcaggcagcc

SEQ ID NO: 2972327 - RNA, 19 nt, Human
agacuccugcaggcagcca

SEQ ID NO: 2972328 - RNA, 20 nt, Human
agacuccugcaggcagccag

SEQ ID NO: 2972329 - RNA, 23 nt, Human
agacuccugcaggcagccaggcc

SEQ ID NO: 2972330 - RNA, 13 nt, Human
ucuuuccugaggc

SEQ ID NO: 2972331 - RNA, 14 nt, Human
ucuuuccugaggcu

SEQ ID NO: 2972332 - RNA, 15 nt, Human
ucuuuccugaggcug

SEQ ID NO: 2972333 - RNA, 12 nt, Human
ucuuuccugagg

SEQ ID NO: 2972334 - RNA, 14 nt, Human
agacuccugcaggc

SEQ ID NO: 2972335 - RNA, 15 nt, Human
agacuccugcaggca

SEQ ID NO: 2972336 - RNA, 16 nt, Human
agacuccugcaggcag

SEQ ID NO: 2972337 - RNA, 17 nt, Human
agacuccugcaggcagc

SEQ ID NO: 2972338 - RNA, 21 nt, Human
ucuuuaaagggauggcaagau

SEQ ID NO: 2972339 - RNA, 17 nt, Human
ucuuuaaaauacacacu

SEQ ID NO: 2972340 - RNA, 15 nt, Human
ucuuuacuucaugga

SEQ ID NO: 2972341 - RNA, 21 nt, Human
agacuggauaguccgucucug

SEQ ID NO: 2972342 - RNA, 14 nt, Human
agacuggcacaguu

SEQ ID NO: 2972343 - RNA, 15 nt, Human
agacuggcacaguuu

SEQ ID NO: 2972344 - RNA, 14 nt, Human
agacuucaucccuc

SEQ ID NO: 2972345 - RNA, 17 nt, Human
agacuucaucccucugg

SEQ ID NO: 2972346 - RNA, 13 nt, Human
agagaccaucccu

SEQ ID NO: 2972347 - RNA, 14 nt, Human
agagaccaucccug

SEQ ID NO: 2972348 - RNA, 20 nt, Human
agagacacacugaagaagca

SEQ ID NO: 2972349 - RNA, 18 nt, Human
agagacacacugaagaag

SEQ ID NO: 2972350 - RNA, 15 nt, Human
agagaccaucccuga

SEQ ID NO: 2972351 - RNA, 15 nt, Human
agagaaugagagaca

SEQ ID NO: 2972352 - RNA, 17 nt, Human
agagacacacugaagaa

SEQ ID NO: 2972353 - RNA, 12 nt, Human
agacuuuggaaa

SEQ ID NO: 2972354 - RNA, 14 nt, Human
agacuuuggaaaga

SEQ ID NO: 2972355 - RNA, 18 nt, Human
agagaaugaaagggccca

SEQ ID NO: 2972356 - RNA, 16 nt, Human
agacccucucaaacua

SEQ ID NO: 2972357 - RNA, 24 nt, Human
agacccucaugcugccaauauccu

SEQ ID NO: 2972358 - RNA, 20 nt, Human
agacccucaugcugccaaua

SEQ ID NO: 2972359 - RNA, 21 nt, Human
agacccucaugcugccaauau

SEQ ID NO: 2972360 - RNA, 18 nt, Human
agacccucaugcugccaa

SEQ ID NO: 2972361 - RNA, 19 nt, Human
agacccucaugcugccaau

SEQ ID NO: 2972362 - RNA, 17 nt, Human
agacccucaugcugcca

SEQ ID NO: 2972363 - RNA, 13 nt, Human
agacccugcccug

SEQ ID NO: 2972364 - RNA, 14 nt, Human
agacccugcccugu

SEQ ID NO: 2972365 - RNA, 12 nt, Human
agacccugcccu

SEQ ID NO: 2972366 - RNA, 19 nt, Human
agacccuuguggucccacc

SEQ ID NO: 2972367 - RNA, 20 nt, Human
agacccuuguggucccaccc

SEQ ID NO: 2972368 - RNA, 22 nt, Human
agacccuuguggucccacccca

SEQ ID NO: 2972369 - RNA, 23 nt, Human
agacccuuguggucccaccccac

SEQ ID NO: 2972370 - RNA, 16 nt, Human
agacccugcccugugg

SEQ ID NO: 2972371 - RNA, 19 nt, Human
agacccugcccugugggcc

SEQ ID NO: 2972372 - RNA, 21 nt, Human
agacccugcccugugggcccc

SEQ ID NO: 2972373 - RNA, 23 nt, Human
agacccugcccugugggccccca

SEQ ID NO: 2972374 - RNA, 13 nt, Human
agacccuuguggu

SEQ ID NO: 2972375 - RNA, 15 nt, Human
agacccuuguggucc

SEQ ID NO: 2972376 - RNA, 18 nt, Human
agacuauucaaacagucu

SEQ ID NO: 2972377 - RNA, 20 nt, Human
agacuauucaaacagucuca

SEQ ID NO: 2972378 - RNA, 21 nt, Human
agacuauucaaacagucucag

SEQ ID NO: 2972379 - RNA, 17 nt, Human
agacucauucuucugua

SEQ ID NO: 2972380 - RNA, 13 nt, Human
agacuccaaagaa

SEQ ID NO: 2972381 - RNA, 14 nt, Human
agacuccaaagaaa

SEQ ID NO: 2972382 - RNA, 12 nt, Human
agacuccaaaga

SEQ ID NO: 2972383 - RNA, 18 nt, Human
agacucauucuucuguac

SEQ ID NO: 2972384 - RNA, 18 nt, Human
agacuaucuaaauguuga

SEQ ID NO: 2972385 - RNA, 17 nt, Human
agacuaucuaaauguug

SEQ ID NO: 2972386 - RNA, 19 nt, Human
agacuaucuaaauguugaa

SEQ ID NO: 2972387 - RNA, 16 nt, Human
agacuauucaaacagu

SEQ ID NO: 2972388 - RNA, 15 nt, Human
agacuaucuaaaugu

SEQ ID NO: 2972389 - RNA, 16 nt, Human
agacuccaaagaaaug

SEQ ID NO: 2972390 - RNA, 19 nt, Human
agacuccaaagaaauguaa

SEQ ID NO: 2972391 - RNA, 15 nt, Human
agacucauucuucug

SEQ ID NO: 2972392 - RNA, 16 nt, Human
ucuugcaauggcagcc

SEQ ID NO: 2972393 - RNA, 13 nt, Human
ucuugcaauggca

SEQ ID NO: 2972394 - RNA, 17 nt, Human
ucuugcaauggcagccu

SEQ ID NO: 2972395 - RNA, 15 nt, Human
ucuggauucauauuu

SEQ ID NO: 2972396 - RNA, 14 nt, Human
ucuggcagcucaga

SEQ ID NO: 2972397 - RNA, 15 nt, Human
ucuggcagcucagag

SEQ ID NO: 2972398 - RNA, 12 nt, Human
ucugcuugccau

SEQ ID NO: 2972399 - RNA, 23 nt, Human
ucugcuuuuuaaagaaugcucuu

SEQ ID NO: 2972400 - RNA, 18 nt, Human
ucuggagguacgaaaaga

SEQ ID NO: 2972401 - RNA, 15 nt, Human
agaagcggcuggcag

SEQ ID NO: 2972402 - RNA, 16 nt, Human
agaagcggcuggcagc

SEQ ID NO: 2972403 - RNA, 11 nt, Human
ucugcuugcca

SEQ ID NO: 2972404 - RNA, 22 nt, Human
ucugcuuagaaauaacagaaga

SEQ ID NO: 2972405 - RNA, 17 nt, Human
ucugcuuagaaauaaca

SEQ ID NO: 2972406 - RNA, 16 nt, Human
ucugcuuagaaauaac

SEQ ID NO: 2972407 - RNA, 14 nt, Human
ucugcuuagaaaua

SEQ ID NO: 2972408 - RNA, 12 nt, Human
ucugcuuagaaa

SEQ ID NO: 2972409 - RNA, 16 nt, Human
ucugcucacauaucug

SEQ ID NO: 2972410 - RNA, 21 nt, Human
agaagaacugaaaucauacuu

SEQ ID NO: 2972411 - RNA, 14 nt, Human
ucugcccuccaaga

SEQ ID NO: 2972412 - RNA, 23 nt, Human
ucugccgcagcccugcagagggc

SEQ ID NO: 2972413 - RNA, 17 nt, Human
agaacuaaaauguucua

SEQ ID NO: 2972414 - RNA, 14 nt, Human
agaacucccuuuca

SEQ ID NO: 2972415 - RNA, 19 nt, Human
agaagaaaauagaauugac

SEQ ID NO: 2972416 - RNA, 20 nt, Human
agaacaaaggggcuuaauua

SEQ ID NO: 2972417 - RNA, 16 nt, Human
agaaauguacagcaag

SEQ ID NO: 2972418 - RNA, 17 nt, Human
agaaauguacagcaagg

SEQ ID NO: 2972419 - RNA, 11 nt, Human
agaaauguguu

SEQ ID NO: 2972420 - RNA, 21 nt, Human
ucugagaaagacuauucaaac

SEQ ID NO: 2972421 - RNA, 22 nt, Human
ucugagaaagacuauucaaaca

SEQ ID NO: 2972422 - RNA, 23 nt, Human
ucugagaaagacuauucaaacag

SEQ ID NO: 2972423 - RNA, 22 nt, Human
ucugcacuccccugcugggugu

SEQ ID NO: 2972424 - RNA, 21 nt, Human
ucugauucccaagcucugcuc

SEQ ID NO: 2972425 - RNA, 20 nt, Human
ucugauucccaagcucugcu

SEQ ID NO: 2972426 - RNA, 19 nt, Human
ucugauucccaagcucugc

SEQ ID NO: 2972427 - RNA, 17 nt, Human
ucugauacagaaaaguu

SEQ ID NO: 2972428 - RNA, 16 nt, Human
ucugauacagaaaagu

SEQ ID NO: 2972429 - RNA, 13 nt, Human
ucugauacagaaa

SEQ ID NO: 2972430 - RNA, 18 nt, Human
ucugauucccaagcucug

SEQ ID NO: 2972431 - RNA, 14 nt, Human
ucugagaaagacua

SEQ ID NO: 2972432 - RNA, 15 nt, Human
ucugagaaagacuau

SEQ ID NO: 2972433 - RNA, 19 nt, Human
ucugagaaagacuauucaa

SEQ ID NO: 2972434 - RNA, 20 nt, Human
ucugagaaagacuauucaaa

SEQ ID NO: 2972435 - RNA, 21 nt, Human
ucugacuguuuccaucaaggg

SEQ ID NO: 2972436 - RNA, 19 nt, Human
agaaagacuauucaaacag

SEQ ID NO: 2972437 - RNA, 18 nt, Human
agaaagacuauucaaaca

SEQ ID NO: 2972438 - RNA, 20 nt, Human
agaaagacuauucaaacagu

SEQ ID NO: 2972439 - RNA, 23 nt, Human
agaaagacuauucaaacagucuc

SEQ ID NO: 2972440 - RNA, 19 nt, Human
ucugacccugcuucaaaua

SEQ ID NO: 2972441 - RNA, 15 nt, Human
ucuccucucucugua

SEQ ID NO: 2972442 - RNA, 12 nt, Human
ucuccucugcug

SEQ ID NO: 2972443 - RNA, 19 nt, Human
ucucccuuggauugucccc

SEQ ID NO: 2972444 - RNA, 20 nt, Human
acuuguugaggguauguuuu

SEQ ID NO: 2972445 - RNA, 13 nt, Human
ucuccucugcugc

SEQ ID NO: 2972446 - RNA, 14 nt, Human
ucuccucugcugcu

SEQ ID NO: 2972447 - RNA, 11 nt, Human
ucucccuugga

SEQ ID NO: 2972448 - RNA, 18 nt, Human
ucucccuuggauuguccc

SEQ ID NO: 2972449 - RNA, 15 nt, Human
ucucccagucauuua

SEQ ID NO: 2972450 - RNA, 17 nt, Human
acuuuggaaagacuuuu

SEQ ID NO: 2972451 - RNA, 13 nt, Human
acuuuggaaagac

SEQ ID NO: 2972452 - RNA, 14 nt, Human
acuuuggaaagacu

SEQ ID NO: 2972453 - RNA, 12 nt, Human
acuuuggaaaga

SEQ ID NO: 2972454 - RNA, 18 nt, Human
acuuuaccuuuuuuauac

SEQ ID NO: 2972455 - RNA, 22 nt, Human
acuuuaccuuuuuuauacauaa

SEQ ID NO: 2972456 - RNA, 19 nt, Human
acuuuaccuuuuuuauaca

SEQ ID NO: 2972457 - RNA, 19 nt, Human
acuuugaccucugcagcaa

SEQ ID NO: 2972458 - RNA, 23 nt, Human
acuuugaccucugcagcaauaaa

SEQ ID NO: 2972459 - RNA, 14 nt, Human
acuuuuggaaggua

SEQ ID NO: 2972460 - RNA, 22 nt, Human
acuuuuuauggcacuaguauuu

SEQ ID NO: 2972461 - RNA, 13 nt, Human
agaaacuggaacu

SEQ ID NO: 2972462 - RNA, 14 nt, Human
agaaagaaaaucag

SEQ ID NO: 2972463 - RNA, 15 nt, Human
agaaacauuugguaa

SEQ ID NO: 2972464 - RNA, 19 nt, Human
agaaaacaaggaugaauua

SEQ ID NO: 2972465 - RNA, 16 nt, Human
agaaaacaaggaugaa

SEQ ID NO: 2972466 - RNA, 17 nt, Human
agaaaaaugagccuggc

SEQ ID NO: 2972467 - RNA, 18 nt, Human
agaaaaaggaugcacaga

SEQ ID NO: 2972468 - RNA, 22 nt, Human
ucucuuuaaugucacaggcagg

SEQ ID NO: 2972469 - RNA, 13 nt, Human
ucucuugagccug

SEQ ID NO: 2972470 - RNA, 14 nt, Human
ucucuugagccugg

SEQ ID NO: 2972471 - RNA, 15 nt, Human
ucucuugagccuggg

SEQ ID NO: 2972472 - RNA, 17 nt, Human
ucucuggccuucggccu

SEQ ID NO: 2972473 - RNA, 16 nt, Human
ucucuggccuucggcc

SEQ ID NO: 2972474 - RNA, 13 nt, Human
ucucuggccuucg

SEQ ID NO: 2972475 - RNA, 14 nt, Human
ucucuugagagggu

SEQ ID NO: 2972476 - RNA, 13 nt, Human
ucucuucuuuaaa

SEQ ID NO: 2972477 - RNA, 12 nt, Human
ucucuucuuuaa

SEQ ID NO: 2972478 - RNA, 13 nt, Human
ucucuccagcccc

SEQ ID NO: 2972479 - RNA, 14 nt, Human
ucucuccagccccu

SEQ ID NO: 2972480 - RNA, 20 nt, Human
ucuccuucaccuuugucccc

SEQ ID NO: 2972481 - RNA, 18 nt, Human
ucuccuucaccuuugucc

SEQ ID NO: 2972482 - RNA, 22 nt, Human
ucucuccuguaccucuugagcc

SEQ ID NO: 2972483 - RNA, 20 nt, Human
ucucuccuguaccucuugag

SEQ ID NO: 2972484 - RNA, 15 nt, Human
ucucuccagccccug

SEQ ID NO: 2972485 - RNA, 17 nt, Human
ucucuccuguaccucuu

SEQ ID NO: 2972486 - RNA, 18 nt, Human
agcaacacaaagcuuuug

SEQ ID NO: 2972487 - RNA, 16 nt, Human
agcaacacaaagcuuu

SEQ ID NO: 2972488 - RNA, 21 nt, Human
agcaacacaaagcuuuugcau

SEQ ID NO: 2972489 - RNA, 15 nt, Human
agcaacacaaagcuu

SEQ ID NO: 2972490 - RNA, 16 nt, Human
agauugugccccugca

SEQ ID NO: 2972491 - RNA, 16 nt, Human
agauuuaccacuugug

SEQ ID NO: 2972492 - RNA, 13 nt, Human
agauuucacucuc

SEQ ID NO: 2972493 - RNA, 14 nt, Human
agauuucacucucc

SEQ ID NO: 2972494 - RNA, 15 nt, Human
ugacuguuuccauca

SEQ ID NO: 2972495 - RNA, 20 nt, Human
ugacuccagaauuucccaaa

SEQ ID NO: 2972496 - RNA, 23 nt, Human
ugacuccagaauuucccaaagca

SEQ ID NO: 2972497 - RNA, 17 nt, Human
ugacuccagaauuuccc

SEQ ID NO: 2972498 - RNA, 19 nt, Human
ugacuccagaauuucccaa

SEQ ID NO: 2972499 - RNA, 14 nt, Human
ugaccugaggcccu

SEQ ID NO: 2972500 - RNA, 15 nt, Human
ugaccugaggcccuu

SEQ ID NO: 2972501 - RNA, 21 nt, Human
agauucaaugccccugaauuu

SEQ ID NO: 2972502 - RNA, 22 nt, Human
agauucaaugccccugaauuua

SEQ ID NO: 2972503 - RNA, 23 nt, Human
agauuauauauauuuuuuucuga

SEQ ID NO: 2972504 - RNA, 24 nt, Human
ugacuucuaaguaaaaccacagca

SEQ ID NO: 2972505 - RNA, 16 nt, Human
ugacauugacuauuuu

SEQ ID NO: 2972506 - RNA, 14 nt, Human
ugacauugacuauu

SEQ ID NO: 2972507 - RNA, 21 nt, Human
ugacauugaaaucuaggaaaa

SEQ ID NO: 2972508 - RNA, 20 nt, Human
ugacauugaaaucuaggaaa

SEQ ID NO: 2972509 - RNA, 13 nt, Human
ugacauugaaauc

SEQ ID NO: 2972510 - RNA, 17 nt, Human
ugacauugcaccuggau

SEQ ID NO: 2972511 - RNA, 14 nt, Human
ugacauugcaccug

SEQ ID NO: 2972512 - RNA, 19 nt, Human
agaugaugaugaucuuuaa

SEQ ID NO: 2972513 - RNA, 14 nt, Human
agauccuggaaauc

SEQ ID NO: 2972514 - RNA, 22 nt, Human
agaugcuagaacucccuuucaa

SEQ ID NO: 2972515 - RNA, 23 nt, Human
agaugcuagaacucccuuucaac

SEQ ID NO: 2972516 - RNA, 18 nt, Human
agaugcuucucacugcca

SEQ ID NO: 2972517 - RNA, 16 nt, Human
agaugcuucucacugc

SEQ ID NO: 2972518 - RNA, 13 nt, Human
ugaccucugccug

SEQ ID NO: 2972519 - RNA, 14 nt, Human
ugaccucugccuga

SEQ ID NO: 2972520 - RNA, 12 nt, Human
ugaccugaggcc

SEQ ID NO: 2972521 - RNA, 21 nt, Human
ugaagauucuauguuaauauu

SEQ ID NO: 2972522 - RNA, 18 nt, Human
ugaagauguagaggagaa

SEQ ID NO: 2972523 - RNA, 17 nt, Human
ugaagcagaguggcagu

SEQ ID NO: 2972524 - RNA, 17 nt, Human
ugaagauguagaggaga

SEQ ID NO: 2972525 - RNA, 22 nt, Human
agagggagggagggcuccagac

SEQ ID NO: 2972526 - RNA, 21 nt, Human
agagggagggagggcuccaga

SEQ ID NO: 2972527 - RNA, 20 nt, Human
agagggagggagggcuccag

SEQ ID NO: 2972528 - RNA, 11 nt, Human
ugaagacaaug

SEQ ID NO: 2972529 - RNA, 17 nt, Human
ugaagacaaugacuuac

SEQ ID NO: 2972530 - RNA, 13 nt, Human
ugaagacaaugac

SEQ ID NO: 2972531 - RNA, 20 nt, Human
ugaagaagcaccaaucauga

SEQ ID NO: 2972532 - RNA, 14 nt, Human
ugaagaagauggua

SEQ ID NO: 2972533 - RNA, 16 nt, Human
ugaacuuugaccucug

SEQ ID NO: 2972534 - RNA, 11 nt, Human
ugaacuuugac

SEQ ID NO: 2972535 - RNA, 22 nt, Human
ugaacuuguaaaggaauuuaaa

SEQ ID NO: 2972536 - RNA, 14 nt, Human
ucuuuggucuacac

SEQ ID NO: 2972537 - RNA, 21 nt, Human
ucuuuggucuacacugugcug

SEQ ID NO: 2972538 - RNA, 18 nt, Human
agaggcaacugcauuggc

SEQ ID NO: 2972539 - RNA, 21 nt, Human
agaggaaaucaccgaaaacgu

SEQ ID NO: 2972540 - RNA, 11 nt, Human
agaggaaauca

SEQ ID NO: 2972541 - RNA, 12 nt, Human
agaggaaaucac

SEQ ID NO: 2972542 - RNA, 12 nt, Human
agaggaaagcaa

SEQ ID NO: 2972543 - RNA, 16 nt, Human
agaggaaagcaaagga

SEQ ID NO: 2972544 - RNA, 18 nt, Human
agaggaaagcaaaggaga

SEQ ID NO: 2972545 - RNA, 19 nt, Human
agaggaaagcaaaggagau

SEQ ID NO: 2972546 - RNA, 19 nt, Human
agagcugggugucaagagg

SEQ ID NO: 2972547 - RNA, 19 nt, Human
ugaauggacuuugcacacu

SEQ ID NO: 2972548 - RNA, 22 nt, Human
agagugaacaaauuuacagaga

SEQ ID NO: 2972549 - RNA, 18 nt, Human
agagucuauuuacggaac

SEQ ID NO: 2972550 - RNA, 16 nt, Human
agagugagacucuguc

SEQ ID NO: 2972551 - RNA, 15 nt, Human
agagugagacucugu

SEQ ID NO: 2972552 - RNA, 14 nt, Human
agagugaacaaauu

SEQ ID NO: 2972553 - RNA, 22 nt, Human
agagucucacuguugcccaggc

SEQ ID NO: 2972554 - RNA, 20 nt, Human
agagucucacuguugcccag

SEQ ID NO: 2972555 - RNA, 15 nt, Human
ugaaugucaguguga

SEQ ID NO: 2972556 - RNA, 18 nt, Human
ugaaugucagugugacug

SEQ ID NO: 2972557 - RNA, 14 nt, Human
ugaaugucagugug

SEQ ID NO: 2972558 - RNA, 16 nt, Human
ugaaugucacuucugg

SEQ ID NO: 2972559 - RNA, 21 nt, Human
agaucaaccccuucgcuccug

SEQ ID NO: 2972560 - RNA, 19 nt, Human
agaucaaccccuucgcucc

SEQ ID NO: 2972561 - RNA, 14 nt, Human
agaucaaccccuuc

SEQ ID NO: 2972562 - RNA, 19 nt, Human
agauacaggaaaagcugcu

SEQ ID NO: 2972563 - RNA, 22 nt, Human
agauauuuugcuuugugauuuu

SEQ ID NO: 2972564 - RNA, 19 nt, Human
agagugagacucugucuca

SEQ ID NO: 2972565 - RNA, 19 nt, Human
agauaaggguaucugguga

SEQ ID NO: 2972566 - RNA, 17 nt, Human
agauaaggguaucuggu

SEQ ID NO: 2972567 - RNA, 13 nt, Human
agcagagugcuuu

SEQ ID NO: 2972568 - RNA, 10 nt, Human
agcagagugc

SEQ ID NO: 2972569 - RNA, 17 nt, Human
agcagaggaaggagagg

SEQ ID NO: 2972570 - RNA, 19 nt, Human
agcagauggagaccccuug

SEQ ID NO: 2972571 - RNA, 22 nt, Human
ugagguacugagagugaacaaa

SEQ ID NO: 2972572 - RNA, 13 nt, Human
ugaggucagagcc

SEQ ID NO: 2972573 - RNA, 16 nt, Human
ugaggucagagccugc

SEQ ID NO: 2972574 - RNA, 14 nt, Human
ugaggucagagccu

SEQ ID NO: 2972575 - RNA, 17 nt, Human
ugagguacugagaguga

SEQ ID NO: 2972576 - RNA, 20 nt, Human
ugaggguugggcugguguca

SEQ ID NO: 2972577 - RNA, 18 nt, Human
agcagagaccaucccuga

SEQ ID NO: 2972578 - RNA, 19 nt, Human
agcagagaccaucccugaa

SEQ ID NO: 2972579 - RNA, 17 nt, Human
agcagagaccaucccug

SEQ ID NO: 2972580 - RNA, 17 nt, Human
ugaggucagagccugca

SEQ ID NO: 2972581 - RNA, 20 nt, Human
agcagagcaccuuagacagu

SEQ ID NO: 2972582 - RNA, 20 nt, Human
agcagagaccaucccugaag

SEQ ID NO: 2972583 - RNA, 13 nt, Human
ugaggggccucuu

SEQ ID NO: 2972584 - RNA, 12 nt, Human
ugaggggccucu

SEQ ID NO: 2972585 - RNA, 20 nt, Human
ugaggcccuucucuccagcc

SEQ ID NO: 2972586 - RNA, 22 nt, Human
ugaggcccuucucuccagcccc

SEQ ID NO: 2972587 - RNA, 23 nt, Human
ugaggcccuucucuccagccccu

SEQ ID NO: 2972588 - RNA, 24 nt, Human
ugaggcccuucucuccagccccug

SEQ ID NO: 2972589 - RNA, 18 nt, Human
ugaggcccuucucuccag

SEQ ID NO: 2972590 - RNA, 19 nt, Human
ugaggcccuucucuccagc

SEQ ID NO: 2972591 - RNA, 16 nt, Human
ugaggcccuucucucc

SEQ ID NO: 2972592 - RNA, 19 nt, Human
ugagggauacccaucccau

SEQ ID NO: 2972593 - RNA, 15 nt, Human
ugaggacacugauau

SEQ ID NO: 2972594 - RNA, 21 nt, Human
ugaggacacuaaccacgcugg

SEQ ID NO: 2972595 - RNA, 23 nt, Human
ugaggcauuuguuugaacugaua

SEQ ID NO: 2972596 - RNA, 12 nt, Human
ugaggccagaga

SEQ ID NO: 2972597 - RNA, 22 nt, Human
ugaggaauccagacccggcugc

SEQ ID NO: 2972598 - RNA, 21 nt, Human
ugaggaauccagacccggcug

SEQ ID NO: 2972599 - RNA, 23 nt, Human
ugaggcccagagggccugcaagg

SEQ ID NO: 2972600 - RNA, 21 nt, Human
ugaggcccagagggccugcaa

SEQ ID NO: 2972601 - RNA, 22 nt, Human
ugaggcccagagggccugcaag

SEQ ID NO: 2972602 - RNA, 15 nt, Human
ugaggcccagagggc

SEQ ID NO: 2972603 - RNA, 17 nt, Human
ugaggcccagagggccu

SEQ ID NO: 2972604 - RNA, 18 nt, Human
ugaggcccagagggccug

SEQ ID NO: 2972605 - RNA, 20 nt, Human
ugaggcccagagggccugca

SEQ ID NO: 2972606 - RNA, 20 nt, Human
ugaggccagagacacaagcc

SEQ ID NO: 2972607 - RNA, 14 nt, Human
ugaggccagagaca

SEQ ID NO: 2972608 - RNA, 16 nt, Human
ugaggccagagacaca

SEQ ID NO: 2972609 - RNA, 12 nt, Human
ugaggcccagag

SEQ ID NO: 2972610 - RNA, 13 nt, Human
ugaggcccagagg

SEQ ID NO: 2972611 - RNA, 13 nt, Human
ugagcuacaaaug

SEQ ID NO: 2972612 - RNA, 14 nt, Human
ugagcuacaaaugc

SEQ ID NO: 2972613 - RNA, 16 nt, Human
ugagcuacaaaugcau

SEQ ID NO: 2972614 - RNA, 15 nt, Human
ugaggaagcaaaagc

SEQ ID NO: 2972615 - RNA, 22 nt, Human
ugaggaagcaaaagcaucuaug

SEQ ID NO: 2972616 - RNA, 14 nt, Human
ugaggaagccgcug

SEQ ID NO: 2972617 - RNA, 17 nt, Human
ugaggaagccgcugggg

SEQ ID NO: 2972618 - RNA, 18 nt, Human
ugaggaagccgcuggggc

SEQ ID NO: 2972619 - RNA, 19 nt, Human
ugaggaagccgcuggggcc

SEQ ID NO: 2972620 - RNA, 21 nt, Human
ugaggaagccgcuggggccag

SEQ ID NO: 2972621 - RNA, 23 nt, Human
ugagcaucgcuuaggagaagucu

SEQ ID NO: 2972622 - RNA, 22 nt, Human
ugagcaucaggccaggcccucu

SEQ ID NO: 2972623 - RNA, 24 nt, Human
ugagcaucaggccaggcccucugc

SEQ ID NO: 2972624 - RNA, 21 nt, Human
ugagcaucaggccaggcccuc

SEQ ID NO: 2972625 - RNA, 14 nt, Human
ugagccagauuuca

SEQ ID NO: 2972626 - RNA, 16 nt, Human
ugagccagauuucacu

SEQ ID NO: 2972627 - RNA, 13 nt, Human
ugagccagauuuc

SEQ ID NO: 2972628 - RNA, 23 nt, Human
ugagccacugcaccgggccacag

SEQ ID NO: 2972629 - RNA, 18 nt, Human
ugagccacugcaccgggc

SEQ ID NO: 2972630 - RNA, 21 nt, Human
ugagccacugcaccgggccac

SEQ ID NO: 2972631 - RNA, 14 nt, Human
agcaacgcaggccc

SEQ ID NO: 2972632 - RNA, 15 nt, Human
ugagcaauccugcaa

SEQ ID NO: 2972633 - RNA, 23 nt, Human
ugagcacuaaggugugcucugau

SEQ ID NO: 2972634 - RNA, 22 nt, Human
ugagcacuaaggugugcucuga

SEQ ID NO: 2972635 - RNA, 21 nt, Human
ugagcacuaaggugugcucug

SEQ ID NO: 2972636 - RNA, 20 nt, Human
ugagcacuaaggugugcucu

SEQ ID NO: 2972637 - RNA, 17 nt, Human
ugagccagauuucacuc

SEQ ID NO: 2972638 - RNA, 22 nt, Human
ugagccagauuucacucuccuu

SEQ ID NO: 2972639 - RNA, 13 nt, Human
agcaagugagagc

SEQ ID NO: 2972640 - RNA, 20 nt, Human
agcaagugagacccugucuc

SEQ ID NO: 2972641 - RNA, 14 nt, Human
agcaagugagagcu

SEQ ID NO: 2972642 - RNA, 18 nt, Human
agcaagugagagcugggu

SEQ ID NO: 2972643 - RNA, 22 nt, Human
agcaagugagagcuggguguca

SEQ ID NO: 2972644 - RNA, 16 nt, Human
agcaccaaucaugaau

SEQ ID NO: 2972645 - RNA, 13 nt, Human
agcacaugccucu

SEQ ID NO: 2972646 - RNA, 14 nt, Human
agcacaugccucuc

SEQ ID NO: 2972647 - RNA, 22 nt, Human
agcaccaaaagcuuaccaaggg

SEQ ID NO: 2972648 - RNA, 22 nt, Human
agcacagccucuuagaugcagu

SEQ ID NO: 2972649 - RNA, 16 nt, Human
agcacagcuucauuuc

SEQ ID NO: 2972650 - RNA, 15 nt, Human
agcacagugaucaag

SEQ ID NO: 2972651 - RNA, 19 nt, Human
agcagaaaugccuuacccu

SEQ ID NO: 2972652 - RNA, 13 nt, Human
agcagaaaugccu

SEQ ID NO: 2972653 - RNA, 12 nt, Human
agcagaaaugcc

SEQ ID NO: 2972654 - RNA, 14 nt, Human
agcagaacagugau

SEQ ID NO: 2972655 - RNA, 23 nt, Human
agcacuuugggaggccaaggugg

SEQ ID NO: 2972656 - RNA, 19 nt, Human
agcacuuugggaggcugag

SEQ ID NO: 2972657 - RNA, 22 nt, Human
agcacuuugggaggccaaggug

SEQ ID NO: 2972658 - RNA, 15 nt, Human
agcacgauuucuguu

SEQ ID NO: 2972659 - RNA, 14 nt, Human
agcacgauuucugu

SEQ ID NO: 2972660 - RNA, 16 nt, Human
agcacgauuucuguuu

SEQ ID NO: 2972661 - RNA, 23 nt, Human
agcaccuuagacagucccugcca

SEQ ID NO: 2972662 - RNA, 13 nt, Human
agcacgauuucug

SEQ ID NO: 2972663 - RNA, 19 nt, Human
agcaccuuagacagucccu

SEQ ID NO: 2972664 - RNA, 20 nt, Human
agcaccuuagacagucccug

SEQ ID NO: 2972665 - RNA, 21 nt, Human
agcaccuuagacagucccugc

SEQ ID NO: 2972666 - RNA, 22 nt, Human
agcaccuuagacagucccugcc

SEQ ID NO: 2972667 - RNA, 19 nt, Human
ugagccuugaacuuugacc

SEQ ID NO: 2972668 - RNA, 18 nt, Human
ugagccuugaacuuugac

SEQ ID NO: 2972669 - RNA, 17 nt, Human
ugagccuugaacuuuga

SEQ ID NO: 2972670 - RNA, 15 nt, Human
ugagccuugaacuuu

SEQ ID NO: 2972671 - RNA, 20 nt, Human
ugagcgacagugagacucug

SEQ ID NO: 2972672 - RNA, 16 nt, Human
ugagcgacagugagac

SEQ ID NO: 2972673 - RNA, 14 nt, Human
ugagcgacagugag

SEQ ID NO: 2972674 - RNA, 13 nt, Human
ugagcgacaguga

SEQ ID NO: 2972675 - RNA, 19 nt, Human
ugagccugggaggucaagg

SEQ ID NO: 2972676 - RNA, 22 nt, Human
ugagccugggaggucaaggcug

SEQ ID NO: 2972677 - RNA, 14 nt, Human
ugagccuugaacuu

SEQ ID NO: 2972678 - RNA, 11 nt, Human
ugagccuggca

SEQ ID NO: 2972679 - RNA, 16 nt, Human
ugagccuggcaagaau

SEQ ID NO: 2972680 - RNA, 14 nt, Human
ugagccugggaggu

SEQ ID NO: 2972681 - RNA, 21 nt, Human
agcagagaaugaaagggccca

SEQ ID NO: 2972682 - RNA, 23 nt, Human
agcagaccauuggggcucccagc

SEQ ID NO: 2972683 - RNA, 22 nt, Human
agcagaccauuggggcucccag

SEQ ID NO: 2972684 - RNA, 12 nt, Human
agcagacacaug

SEQ ID NO: 2972685 - RNA, 11 nt, Human
agcagacacau

SEQ ID NO: 2972686 - RNA, 16 nt, Human
agcagacacaugccag

SEQ ID NO: 2972687 - RNA, 13 nt, Human
agcagaaugugau

SEQ ID NO: 2972688 - RNA, 21 nt, Human
agcagagaauucucuuaucca

SEQ ID NO: 2972689 - RNA, 14 nt, Human
agcagagaauucuc

SEQ ID NO: 2972690 - RNA, 23 nt, Human
agcagagaaugaaagggcccaga

SEQ ID NO: 2972691 - RNA, 22 nt, Human
agcagagaaugaaagggcccag

SEQ ID NO: 2972692 - RNA, 15 nt, Human
agcagagaccauccc

SEQ ID NO: 2972693 - RNA, 16 nt, Human
agcagagaccaucccu

SEQ ID NO: 2972694 - RNA, 10 nt, Human
ugagccuggc

SEQ ID NO: 2972695 - RNA, 18 nt, Human
ucagaugcacaugagcug

SEQ ID NO: 2972696 - RNA, 16 nt, Human
ucagaacuauguuuuu

SEQ ID NO: 2972697 - RNA, 19 nt, Human
ucagaacuauguuuuuguu

SEQ ID NO: 2972698 - RNA, 13 nt, Human
ucagaagacacug

SEQ ID NO: 2972699 - RNA, 13 nt, Human
ucagaucuucugu

SEQ ID NO: 2972700 - RNA, 13 nt, Human
acccagcucuggu

SEQ ID NO: 2972701 - RNA, 15 nt, Human
acccagcucuggucc

SEQ ID NO: 2972702 - RNA, 16 nt, Human
acccaguccugcccgc

SEQ ID NO: 2972703 - RNA, 10 nt, Human
ucagccuggg

SEQ ID NO: 2972704 - RNA, 12 nt, Human
ucagccugggca

SEQ ID NO: 2972705 - RNA, 14 nt, Human
acccccagccugcu

SEQ ID NO: 2972706 - RNA, 15 nt, Human
acccccagccugcua

SEQ ID NO: 2972707 - RNA, 20 nt, Human
ucaggccaaacucaccugcc

SEQ ID NO: 2972708 - RNA, 23 nt, Human
ucaggccaaacucaccugccccu

SEQ ID NO: 2972709 - RNA, 16 nt, Human
ucaggaagcucagggc

SEQ ID NO: 2972710 - RNA, 17 nt, Human
ucaggaagcucagggcc

SEQ ID NO: 2972711 - RNA, 19 nt, Human
ucaggaagcucagggccug

SEQ ID NO: 2972712 - RNA, 20 nt, Human
ucaggaagcucagggccugg

SEQ ID NO: 2972713 - RNA, 17 nt, Human
ucagcggggacagcucc

SEQ ID NO: 2972714 - RNA, 16 nt, Human
ucagcggggacagcuc

SEQ ID NO: 2972715 - RNA, 15 nt, Human
ucagcggggacagcu

SEQ ID NO: 2972716 - RNA, 15 nt, Human
ucaggccagcugcuu

SEQ ID NO: 2972717 - RNA, 20 nt, Human
ucaggccagcugcuugggcu

SEQ ID NO: 2972718 - RNA, 11 nt, Human
ucaggccaggc

SEQ ID NO: 2972719 - RNA, 14 nt, Human
ucaggccagcugcu

SEQ ID NO: 2972720 - RNA, 19 nt, Human
accccuucgcuccuguguc

SEQ ID NO: 2972721 - RNA, 16 nt, Human
ucagguaacaggcaga

SEQ ID NO: 2972722 - RNA, 15 nt, Human
ucagguaacaggcag

SEQ ID NO: 2972723 - RNA, 13 nt, Human
ucagguaacaggc

SEQ ID NO: 2972724 - RNA, 14 nt, Human
ucagggucccuggu

SEQ ID NO: 2972725 - RNA, 18 nt, Human
ucagggucccugguggca

SEQ ID NO: 2972726 - RNA, 13 nt, Human
ucagggucccugg

SEQ ID NO: 2972727 - RNA, 20 nt, Human
accccuucgcuccugugucu

SEQ ID NO: 2972728 - RNA, 23 nt, Human
ucaggguuggccccugcccggcu

SEQ ID NO: 2972729 - RNA, 16 nt, Human
acccuuguggucccac

SEQ ID NO: 2972730 - RNA, 17 nt, Human
acccuuguggucccacc

SEQ ID NO: 2972731 - RNA, 19 nt, Human
acccuuguggucccacccc

SEQ ID NO: 2972732 - RNA, 15 nt, Human
acccuugugguccca

SEQ ID NO: 2972733 - RNA, 11 nt, Human
acccugcccug

SEQ ID NO: 2972734 - RNA, 12 nt, Human
acccugcccugu

SEQ ID NO: 2972735 - RNA, 13 nt, Human
acccugcccugug

SEQ ID NO: 2972736 - RNA, 14 nt, Human
acccucuuagaaaa

SEQ ID NO: 2972737 - RNA, 12 nt, Human
uauuucauuucu

SEQ ID NO: 2972738 - RNA, 11 nt, Human
accacagcagu

SEQ ID NO: 2972739 - RNA, 14 nt, Human
accacaucuugcuc

SEQ ID NO: 2972740 - RNA, 22 nt, Human
accacagacauacuaaccagca

SEQ ID NO: 2972741 - RNA, 21 nt, Human
accacagacauacuaaccagc

SEQ ID NO: 2972742 - RNA, 19 nt, Human
accacugcagaagacagua

SEQ ID NO: 2972743 - RNA, 14 nt, Human
accacugcagaaga

SEQ ID NO: 2972744 - RNA, 13 nt, Human
accacugcagaag

SEQ ID NO: 2972745 - RNA, 13 nt, Human
accacuucagcug

SEQ ID NO: 2972746 - RNA, 14 nt, Human
accacuucagcuga

SEQ ID NO: 2972747 - RNA, 15 nt, Human
accacuucagcugac

SEQ ID NO: 2972748 - RNA, 24 nt, Human
accacaucuugcucugcugacaga

SEQ ID NO: 2972749 - RNA, 21 nt, Human
accacaucuugcucugcugac

SEQ ID NO: 2972750 - RNA, 20 nt, Human
accacaucuugcucugcuga

SEQ ID NO: 2972751 - RNA, 20 nt, Human
accacucuaucaaguauuau

SEQ ID NO: 2972752 - RNA, 11 nt, Human
ucaccuccuaa

SEQ ID NO: 2972753 - RNA, 19 nt, Human
ucaccugaagacucauucu

SEQ ID NO: 2972754 - RNA, 16 nt, Human
ucaccugaagacucau

SEQ ID NO: 2972755 - RNA, 23 nt, Human
ucaccugaagacucauucuucug

SEQ ID NO: 2972756 - RNA, 23 nt, Human
accacuuguguuuugcaagccag

SEQ ID NO: 2972757 - RNA, 19 nt, Human
accacuuguguuuugcaag

SEQ ID NO: 2972758 - RNA, 12 nt, Human
accacuuuuguu

SEQ ID NO: 2972759 - RNA, 17 nt, Human
accagacaccuugacag

SEQ ID NO: 2972760 - RNA, 23 nt, Human
accagacaccuugacagggcaca

SEQ ID NO: 2972761 - RNA, 22 nt, Human
accagacaccuugacagggcac

SEQ ID NO: 2972762 - RNA, 17 nt, Human
accagagcccaccuugg

SEQ ID NO: 2972763 - RNA, 22 nt, Human
accagagcccaccuuggcucaa

SEQ ID NO: 2972764 - RNA, 19 nt, Human
accagagcccaccuuggcu

SEQ ID NO: 2972765 - RNA, 15 nt, Human
acccaaaaggcagaa

SEQ ID NO: 2972766 - RNA, 13 nt, Human
acccaaaaggcag

SEQ ID NO: 2972767 - RNA, 23 nt, Human
accauuuugggguacccacugcu

SEQ ID NO: 2972768 - RNA, 22 nt, Human
accauuuugggguacccacugc

SEQ ID NO: 2972769 - RNA, 13 nt, Human
accauucuccacc

SEQ ID NO: 2972770 - RNA, 16 nt, Human
accauucuccaccugc

SEQ ID NO: 2972771 - RNA, 18 nt, Human
accauucuccaccugcca

SEQ ID NO: 2972772 - RNA, 22 nt, Human
accaugauuaaccacuucagcu

SEQ ID NO: 2972773 - RNA, 23 nt, Human
accaugauuaaccacuucagcug

SEQ ID NO: 2972774 - RNA, 21 nt, Human
acccaaauguucaucaaugaa

SEQ ID NO: 2972775 - RNA, 18 nt, Human
acccaaaaggcagaagca

SEQ ID NO: 2972776 - RNA, 16 nt, Human
acccagaagaaaauag

SEQ ID NO: 2972777 - RNA, 16 nt, Human
ucagaacagagccuuu

SEQ ID NO: 2972778 - RNA, 18 nt, Human
acccagcccacuucugcc

SEQ ID NO: 2972779 - RNA, 17 nt, Human
acccagcccacuucugc

SEQ ID NO: 2972780 - RNA, 16 nt, Human
acccagcccacuucug

SEQ ID NO: 2972781 - RNA, 21 nt, Human
accaguguuguggauuuaaca

SEQ ID NO: 2972782 - RNA, 23 nt, Human
accagugccucucccugcugcuc

SEQ ID NO: 2972783 - RNA, 22 nt, Human
accagugccucucccugcugcu

SEQ ID NO: 2972784 - RNA, 21 nt, Human
accagugccucucccugcugc

SEQ ID NO: 2972785 - RNA, 18 nt, Human
accagugccucucccugc

SEQ ID NO: 2972786 - RNA, 10 nt, Human
accagugccu

SEQ ID NO: 2972787 - RNA, 13 nt, Human
accagugccucuc

SEQ ID NO: 2972788 - RNA, 18 nt, Human
ucacuguugcccaggcug

SEQ ID NO: 2972789 - RNA, 17 nt, Human
ucacuguugcccaggcu

SEQ ID NO: 2972790 - RNA, 14 nt, Human
accagggacugagg

SEQ ID NO: 2972791 - RNA, 16 nt, Human
ucaccugccccucaac

SEQ ID NO: 2972792 - RNA, 16 nt, Human
ucaccuccuaaaacaa

SEQ ID NO: 2972793 - RNA, 14 nt, Human
ucacugagacagcc

SEQ ID NO: 2972794 - RNA, 15 nt, Human
ucacugagacagccc

SEQ ID NO: 2972795 - RNA, 13 nt, Human
ucacugagacagc

SEQ ID NO: 2972796 - RNA, 16 nt, Human
ucacuguugcccaggc

SEQ ID NO: 2972797 - RNA, 12 nt, Human
ucacugcagccu

SEQ ID NO: 2972798 - RNA, 21 nt, Human
uccacauuuguuuugccaauu

SEQ ID NO: 2972799 - RNA, 11 nt, Human
uccaagcuggu

SEQ ID NO: 2972800 - RNA, 17 nt, Human
uccaauaaaaugccuca

SEQ ID NO: 2972801 - RNA, 12 nt, Human
uccaagcuccca

SEQ ID NO: 2972802 - RNA, 13 nt, Human
uccaagcucccag

SEQ ID NO: 2972803 - RNA, 14 nt, Human
uccaagcucccagg

SEQ ID NO: 2972804 - RNA, 15 nt, Human
uccaagcucccaggc

SEQ ID NO: 2972805 - RNA, 16 nt, Human
uccaagcucccaggca

SEQ ID NO: 2972806 - RNA, 13 nt, Human
ucauuuuuuuuaa

SEQ ID NO: 2972807 - RNA, 21 nt, Human
ucauuugagcagggcucagcg

SEQ ID NO: 2972808 - RNA, 20 nt, Human
ucauuuuagggguagcauuu

SEQ ID NO: 2972809 - RNA, 17 nt, Human
accuggaauauauaacc

SEQ ID NO: 2972810 - RNA, 14 nt, Human
accuggaauauaua

SEQ ID NO: 2972811 - RNA, 19 nt, Human
ucauuugagcagggcucag

SEQ ID NO: 2972812 - RNA, 19 nt, Human
accugcggugcuaucuccc

SEQ ID NO: 2972813 - RNA, 22 nt, Human
accugcggugcuaucuccccca

SEQ ID NO: 2972814 - RNA, 23 nt, Human
accugcggugcuaucucccccag

SEQ ID NO: 2972815 - RNA, 15 nt, Human
accugaagucuuugu

SEQ ID NO: 2972816 - RNA, 22 nt, Human
accugaagucuuuguacagaca

SEQ ID NO: 2972817 - RNA, 18 nt, Human
accugcggugcuaucucc

SEQ ID NO: 2972818 - RNA, 17 nt, Human
accuuagacagucccug

SEQ ID NO: 2972819 - RNA, 15 nt, Human
uccaccaucaagcca

SEQ ID NO: 2972820 - RNA, 12 nt, Human
accuucuccuuc

SEQ ID NO: 2972821 - RNA, 13 nt, Human
accuucuccuuca

SEQ ID NO: 2972822 - RNA, 15 nt, Human
accuugaaugaugcc

SEQ ID NO: 2972823 - RNA, 14 nt, Human
accuugacagggca

SEQ ID NO: 2972824 - RNA, 15 nt, Human
accuugacagggcac

SEQ ID NO: 2972825 - RNA, 20 nt, Human
uccagccugagcgacaguga

SEQ ID NO: 2972826 - RNA, 22 nt, Human
uccagccccuggaugcagccuc

SEQ ID NO: 2972827 - RNA, 21 nt, Human
uccagccugagcgacagugag

SEQ ID NO: 2972828 - RNA, 11 nt, Human
uccagccuggg

SEQ ID NO: 2972829 - RNA, 16 nt, Human
uccagccccuggaugc

SEQ ID NO: 2972830 - RNA, 17 nt, Human
uccagccccuggaugca

SEQ ID NO: 2972831 - RNA, 19 nt, Human
uccagccccuggaugcagc

SEQ ID NO: 2972832 - RNA, 21 nt, Human
uccagccccuggaugcagccu

SEQ ID NO: 2972833 - RNA, 15 nt, Human
uccagccccuggaug

SEQ ID NO: 2972834 - RNA, 14 nt, Human
uccagccccuggau

SEQ ID NO: 2972835 - RNA, 22 nt, Human
uccagaaguuugagaucagccu

SEQ ID NO: 2972836 - RNA, 19 nt, Human
accuuuguauucucuccug

SEQ ID NO: 2972837 - RNA, 15 nt, Human
accuuuguauucucu

SEQ ID NO: 2972838 - RNA, 23 nt, Human
accuuuguauucucuccuguacc

SEQ ID NO: 2972839 - RNA, 22 nt, Human
ucaugaauuaguuuuauaugcu

SEQ ID NO: 2972840 - RNA, 23 nt, Human
ucauccacugugccaugugccag

SEQ ID NO: 2972841 - RNA, 21 nt, Human
ucauccacugugccaugugcc

SEQ ID NO: 2972842 - RNA, 19 nt, Human
ucauccacugugccaugug

SEQ ID NO: 2972843 - RNA, 19 nt, Human
ucaugacaaagacugagua

SEQ ID NO: 2972844 - RNA, 21 nt, Human
ucaugaauuaguuuuauaugc

SEQ ID NO: 2972845 - RNA, 13 nt, Human
ucaugucuggcua

SEQ ID NO: 2972846 - RNA, 17 nt, Human
ucauguucuuaauucuu

SEQ ID NO: 2972847 - RNA, 11 nt, Human
ucauguucuua

SEQ ID NO: 2972848 - RNA, 22 nt, Human
ucauugaccugaggcccuucuc

SEQ ID NO: 2972849 - RNA, 21 nt, Human
ucauucuccuuguguuacuaa

SEQ ID NO: 2972850 - RNA, 19 nt, Human
ucauugaccugaggcccuu

SEQ ID NO: 2972851 - RNA, 17 nt, Human
accucggugccuuccuc

SEQ ID NO: 2972852 - RNA, 18 nt, Human
accucuaaauucuuucau

SEQ ID NO: 2972853 - RNA, 13 nt, Human
accucucccuugg

SEQ ID NO: 2972854 - RNA, 14 nt, Human
accucucccuugga

SEQ ID NO: 2972855 - RNA, 15 nt, Human
accucucccuuggau

SEQ ID NO: 2972856 - RNA, 21 nt, Human
accucuaaauucuuucauuuu

SEQ ID NO: 2972857 - RNA, 14 nt, Human
accucuaaauucuu

SEQ ID NO: 2972858 - RNA, 23 nt, Human
accucucccuuggauuguccccg

SEQ ID NO: 2972859 - RNA, 14 nt, Human
accucucucacucc

SEQ ID NO: 2972860 - RNA, 19 nt, Human
accucucucacuccuugaa

SEQ ID NO: 2972861 - RNA, 12 nt, Human
accucugcacaa

SEQ ID NO: 2972862 - RNA, 20 nt, Human
accgcagacaggaccaggga

SEQ ID NO: 2972863 - RNA, 17 nt, Human
accgccaaggcuggggg

SEQ ID NO: 2972864 - RNA, 17 nt, Human
accgcagacaggaccag

SEQ ID NO: 2972865 - RNA, 21 nt, Human
accgaacugauguaaguaaac

SEQ ID NO: 2972866 - RNA, 16 nt, Human
ucauauuuacuucuua

SEQ ID NO: 2972867 - RNA, 22 nt, Human
ucauauuuacuucuuauacauu

SEQ ID NO: 2972868 - RNA, 21 nt, Human
ucauauuuacuucuuauacau

SEQ ID NO: 2972869 - RNA, 20 nt, Human
ucauauuuacuucuuauaca

SEQ ID NO: 2972870 - RNA, 10 nt, Human
acccuuuucu

SEQ ID NO: 2972871 - RNA, 20 nt, Human
accuccgccucuuggguuca

SEQ ID NO: 2972872 - RNA, 18 nt, Human
ucauccacugugccaugu

SEQ ID NO: 2972873 - RNA, 14 nt, Human
accuccuaaaacaa

SEQ ID NO: 2972874 - RNA, 13 nt, Human
accuagccuuaga

SEQ ID NO: 2972875 - RNA, 20 nt, Human
uccuguuuuuauuauuaaca

SEQ ID NO: 2972876 - RNA, 16 nt, Human
uccuguuuuuauuauu

SEQ ID NO: 2972877 - RNA, 21 nt, Human
uccuguuuuuauuauuaacaa

SEQ ID NO: 2972878 - RNA, 15 nt, Human
uccuguuuuuauuau

SEQ ID NO: 2972879 - RNA, 19 nt, Human
uccuguucccaugagauga

SEQ ID NO: 2972880 - RNA, 24 nt, Human
uccugugucuugcaauggcagccu

SEQ ID NO: 2972881 - RNA, 23 nt, Human
uccugugucuugcaauggcagcc

SEQ ID NO: 2972882 - RNA, 14 nt, Human
uccugugugugcgc

SEQ ID NO: 2972883 - RNA, 13 nt, Human
uccugugugugcg

SEQ ID NO: 2972884 - RNA, 18 nt, Human
uccugugugugcgccuac

SEQ ID NO: 2972885 - RNA, 23 nt, Human
acugcagccucaaccuccugggc

SEQ ID NO: 2972886 - RNA, 13 nt, Human
acugcacuguuuu

SEQ ID NO: 2972887 - RNA, 22 nt, Human
acugcagccucaaccuccuggg

SEQ ID NO: 2972888 - RNA, 21 nt, Human
acugcagccucaaccuccugg

SEQ ID NO: 2972889 - RNA, 19 nt, Human
acugcagccucaaccuccu

SEQ ID NO: 2972890 - RNA, 13 nt, Human
uccugcugcaguu

SEQ ID NO: 2972891 - RNA, 17 nt, Human
uccugggcagcugccuc

SEQ ID NO: 2972892 - RNA, 16 nt, Human
uccugggcagcugccu

SEQ ID NO: 2972893 - RNA, 15 nt, Human
uccugggcagcugcc

SEQ ID NO: 2972894 - RNA, 14 nt, Human
uccugggcagcugc

SEQ ID NO: 2972895 - RNA, 23 nt, Human
uccugggcagcugccuccccucc

SEQ ID NO: 2972896 - RNA, 22 nt, Human
uccugggcagcugccuccccuc

SEQ ID NO: 2972897 - RNA, 19 nt, Human
uccugggcagcugccuccc

SEQ ID NO: 2972898 - RNA, 18 nt, Human
uccugggcagcugccucc

SEQ ID NO: 2972899 - RNA, 22 nt, Human
acugaggggaggggagcauggg

SEQ ID NO: 2972900 - RNA, 17 nt, Human
acugaggggaggggagc

SEQ ID NO: 2972901 - RNA, 15 nt, Human
uccucuccccagcaa

SEQ ID NO: 2972902 - RNA, 22 nt, Human
acugcaaccuccgccucuuggg

SEQ ID NO: 2972903 - RNA, 16 nt, Human
acugcaaccuccgccu

SEQ ID NO: 2972904 - RNA, 14 nt, Human
acugcaaccuccgc

SEQ ID NO: 2972905 - RNA, 13 nt, Human
acugcaaccuccg

SEQ ID NO: 2972906 - RNA, 21 nt, Human
acugaguacguugugcauuug

SEQ ID NO: 2972907 - RNA, 19 nt, Human
acugaguacguugugcauu

SEQ ID NO: 2972908 - RNA, 18 nt, Human
acugaguacguugugcau

SEQ ID NO: 2972909 - RNA, 18 nt, Human
acugagggggccuggaug

SEQ ID NO: 2972910 - RNA, 17 nt, Human
acugagggggccuggau

SEQ ID NO: 2972911 - RNA, 16 nt, Human
acugagggggccugga

SEQ ID NO: 2972912 - RNA, 23 nt, Human
acugaguacguugugcauuuggu

SEQ ID NO: 2972913 - RNA, 22 nt, Human
acugaguacguugugcauuugg

SEQ ID NO: 2972914 - RNA, 19 nt, Human
acugagggggccuggaugc

SEQ ID NO: 2972915 - RNA, 15 nt, Human
uccugcaggcagcca

SEQ ID NO: 2972916 - RNA, 16 nt, Human
uccugcaggcagccag

SEQ ID NO: 2972917 - RNA, 17 nt, Human
uccugcaggcagccagg

SEQ ID NO: 2972918 - RNA, 19 nt, Human
uccugcaggcagccaggcc

SEQ ID NO: 2972919 - RNA, 20 nt, Human
uccugcaggcagccaggcca

SEQ ID NO: 2972920 - RNA, 19 nt, Human
uccugccucagccucccaa

SEQ ID NO: 2972921 - RNA, 22 nt, Human
uccugcaggcagccaggccaca

SEQ ID NO: 2972922 - RNA, 20 nt, Human
uccugccucgaacuggcugc

SEQ ID NO: 2972923 - RNA, 17 nt, Human
uccugccucagccuccc

SEQ ID NO: 2972924 - RNA, 20 nt, Human
uccugcugagccucacagca

SEQ ID NO: 2972925 - RNA, 15 nt, Human
acuguacaaaguaga

SEQ ID NO: 2972926 - RNA, 14 nt, Human
acuguacaaaguag

SEQ ID NO: 2972927 - RNA, 13 nt, Human
acuguacaaagua

SEQ ID NO: 2972928 - RNA, 19 nt, Human
acuguaauuugugauacaa

SEQ ID NO: 2972929 - RNA, 14 nt, Human
acuguacaugaaaa

SEQ ID NO: 2972930 - RNA, 13 nt, Human
acuguacaugaaa

SEQ ID NO: 2972931 - RNA, 23 nt, Human
acuguacaugaaaacacauuuuu

SEQ ID NO: 2972932 - RNA, 22 nt, Human
acugggcuuggggaccagagcu

SEQ ID NO: 2972933 - RNA, 13 nt, Human
ucgcuccuguguc

SEQ ID NO: 2972934 - RNA, 12 nt, Human
ucgcuccugugu

SEQ ID NO: 2972935 - RNA, 19 nt, Human
acuggguacuuguggacac

SEQ ID NO: 2972936 - RNA, 23 nt, Human
acuggguacuuguggacacagcu

SEQ ID NO: 2972937 - RNA, 20 nt, Human
acuggguacuuguggacaca

SEQ ID NO: 2972938 - RNA, 18 nt, Human
acuggguacuuguggaca

SEQ ID NO: 2972939 - RNA, 13 nt, Human
ucgaacuggcugc

SEQ ID NO: 2972940 - RNA, 14 nt, Human
ucgaacuggcugca

SEQ ID NO: 2972941 - RNA, 15 nt, Human
ucgaacuggcugcaa

SEQ ID NO: 2972942 - RNA, 15 nt, Human
uccuuucaccacaug

SEQ ID NO: 2972943 - RNA, 14 nt, Human
ucgagcaugccugg

SEQ ID NO: 2972944 - RNA, 13 nt, Human
ucgaggacaggga

SEQ ID NO: 2972945 - RNA, 13 nt, Human
ucgcgacaaugca

SEQ ID NO: 2972946 - RNA, 17 nt, Human
ucgaggacagggaggug

SEQ ID NO: 2972947 - RNA, 14 nt, Human
ucgaggacagggag

SEQ ID NO: 2972948 - RNA, 20 nt, Human
acuggcaaacagggccucug

SEQ ID NO: 2972949 - RNA, 19 nt, Human
acuggcaaacagggccucu

SEQ ID NO: 2972950 - RNA, 17 nt, Human
acuggcaaacagggccu

SEQ ID NO: 2972951 - RNA, 21 nt, Human
acuggcaaacagggccucugc

SEQ ID NO: 2972952 - RNA, 22 nt, Human
acuggauuaaacuuaaucuaaa

SEQ ID NO: 2972953 - RNA, 18 nt, Human
acugcuuccagugaggcu

SEQ ID NO: 2972954 - RNA, 21 nt, Human
acugcuuccagugaggcucug

SEQ ID NO: 2972955 - RNA, 22 nt, Human
acugcuuccagugaggcucugc

SEQ ID NO: 2972956 - RNA, 23 nt, Human
acugcuuccagugaggcucugcc

SEQ ID NO: 2972957 - RNA, 22 nt, Human
acugccuucucaacuccaaacu

SEQ ID NO: 2972958 - RNA, 20 nt, Human
acugccuucucaacuccaaa

SEQ ID NO: 2972959 - RNA, 22 nt, Human
acuggcugcaaaggguaucagg

SEQ ID NO: 2972960 - RNA, 18 nt, Human
acuggcucacccaguccu

SEQ ID NO: 2972961 - RNA, 12 nt, Human
acuggcucaccc

SEQ ID NO: 2972962 - RNA, 15 nt, Human
acuggcucacccagu

SEQ ID NO: 2972963 - RNA, 21 nt, Human
acuggcgugaacccaggaggc

SEQ ID NO: 2972964 - RNA, 21 nt, Human
acuggcacaguuuucugagaa

SEQ ID NO: 2972965 - RNA, 22 nt, Human
acuggcacaguuuucugagaaa

SEQ ID NO: 2972966 - RNA, 13 nt, Human
acuggcaaagcag

SEQ ID NO: 2972967 - RNA, 15 nt, Human
acuggcaaagcagaa

SEQ ID NO: 2972968 - RNA, 13 nt, Human
uccuucagugccu

SEQ ID NO: 2972969 - RNA, 20 nt, Human
uccuucagugccuuauggaa

SEQ ID NO: 2972970 - RNA, 22 nt, Human
uccuucagugccuuauggaaca

SEQ ID NO: 2972971 - RNA, 11 nt, Human
uccuucagugc

SEQ ID NO: 2972972 - RNA, 13 nt, Human
uccuucagccuga

SEQ ID NO: 2972973 - RNA, 12 nt, Human
uccuucagugcc

SEQ ID NO: 2972974 - RNA, 14 nt, Human
acuaaaauguucua

SEQ ID NO: 2972975 - RNA, 16 nt, Human
acuaaccagcagaaau

SEQ ID NO: 2972976 - RNA, 13 nt, Human
acuaaccacgcug

SEQ ID NO: 2972977 - RNA, 17 nt, Human
acuaaccagcagaaaug

SEQ ID NO: 2972978 - RNA, 23 nt, Human
acuacaggugugagucaccaagc

SEQ ID NO: 2972979 - RNA, 15 nt, Human
acuacaguccuccca

SEQ ID NO: 2972980 - RNA, 13 nt, Human
acuaaaaauacaa

SEQ ID NO: 2972981 - RNA, 15 nt, Human
acuaaaaaugcaaaa

SEQ ID NO: 2972982 - RNA, 14 nt, Human
acguuucuaaaggc

SEQ ID NO: 2972983 - RNA, 12 nt, Human
acguuucuaaag

SEQ ID NO: 2972984 - RNA, 14 nt, Human
uccagcucaccagc

SEQ ID NO: 2972985 - RNA, 24 nt, Human
uccagccugggugacagagcaagu

SEQ ID NO: 2972986 - RNA, 13 nt, Human
uccagccugggug

SEQ ID NO: 2972987 - RNA, 20 nt, Human
acuacauuagguugugaaug

SEQ ID NO: 2972988 - RNA, 19 nt, Human
acuacauuagguugugaau

SEQ ID NO: 2972989 - RNA, 18 nt, Human
acuacauuagguugugaa

SEQ ID NO: 2972990 - RNA, 16 nt, Human
acuacaguccucccau

SEQ ID NO: 2972991 - RNA, 19 nt, Human
ucccagugccgagaaggaa

SEQ ID NO: 2972992 - RNA, 22 nt, Human
ucccagugccgagaaggaagcc

SEQ ID NO: 2972993 - RNA, 14 nt, Human
ucccaucucacaca

SEQ ID NO: 2972994 - RNA, 19 nt, Human
ucccaucucacacaugagc

SEQ ID NO: 2972995 - RNA, 13 nt, Human
ucccaucucacac

SEQ ID NO: 2972996 - RNA, 15 nt, Human
ucccauaugccuggg

SEQ ID NO: 2972997 - RNA, 22 nt, Human
uccccaccgcagacaggaccag

SEQ ID NO: 2972998 - RNA, 20 nt, Human
acuauguuuuuguucaguuu

SEQ ID NO: 2972999 - RNA, 23 nt, Human
acuauguugcccaggcaggucuu

SEQ ID NO: 2973000 - RNA, 20 nt, Human
acuauguugcccaggcaggu

SEQ ID NO: 2973001 - RNA, 19 nt, Human
acuauguugcccaggcagg

SEQ ID NO: 2973002 - RNA, 21 nt, Human
acuauuaaacaugcuguacau

SEQ ID NO: 2973003 - RNA, 18 nt, Human
acuauguugcccaggcag

SEQ ID NO: 2973004 - RNA, 17 nt, Human
acuauguugcccaggca

SEQ ID NO: 2973005 - RNA, 22 nt, Human
acuaucugugcguagaaguucu

SEQ ID NO: 2973006 - RNA, 20 nt, Human
acuaucugugcguagaaguu

SEQ ID NO: 2973007 - RNA, 17 nt, Human
acuaucacugguuuggu

SEQ ID NO: 2973008 - RNA, 23 nt, Human
acuauaauuuaccugaagucuuu

SEQ ID NO: 2973009 - RNA, 21 nt, Human
acuauaauguaagcucuacug

SEQ ID NO: 2973010 - RNA, 17 nt, Human
acuauagccuaggugac

SEQ ID NO: 2973011 - RNA, 23 nt, Human
uccccaggaggccagccuugacc

SEQ ID NO: 2973012 - RNA, 24 nt, Human
uccccaccgcagacaggaccaggg

SEQ ID NO: 2973013 - RNA, 12 nt, Human
uccccuccucug

SEQ ID NO: 2973014 - RNA, 16 nt, Human
ucccgaauagcuggga

SEQ ID NO: 2973015 - RNA, 15 nt, Human
ucccgaauagcuggg

SEQ ID NO: 2973016 - RNA, 18 nt, Human
ucccgaauagcugggacu

SEQ ID NO: 2973017 - RNA, 20 nt, Human
ucccgaguagcugggacuac

SEQ ID NO: 2973018 - RNA, 18 nt, Human
ucccuauuagagaagaga

SEQ ID NO: 2973019 - RNA, 22 nt, Human
ucccuuuccaaaugcccagcuu

SEQ ID NO: 2973020 - RNA, 18 nt, Human
ucccuuacgugaguccug

SEQ ID NO: 2973021 - RNA, 22 nt, Human
ucccuuacgugaguccuggcau

SEQ ID NO: 2973022 - RNA, 23 nt, Human
ucccugguggcagcucaccucuc

SEQ ID NO: 2973023 - RNA, 22 nt, Human
ucccuuugacgccaucccagcc

SEQ ID NO: 2973024 - RNA, 23 nt, Human
ucccuuugacgccaucccagccc

SEQ ID NO: 2973025 - RNA, 21 nt, Human
ucccuuugacgccaucccagc

SEQ ID NO: 2973026 - RNA, 14 nt, Human
uccuaggcauuugc

SEQ ID NO: 2973027 - RNA, 12 nt, Human
uccuaaaacaac

SEQ ID NO: 2973028 - RNA, 13 nt, Human
uccuaaaacaaca

SEQ ID NO: 2973029 - RNA, 20 nt, Human
uccuaaaacaacagauguac

SEQ ID NO: 2973030 - RNA, 16 nt, Human
uccuaaaacaacagau

SEQ ID NO: 2973031 - RNA, 22 nt, Human
uccuaaaauuauggaaacagau

SEQ ID NO: 2973032 - RNA, 17 nt, Human
uccuaaaauuauggaaa

SEQ ID NO: 2973033 - RNA, 22 nt, Human
acuccaggcagcagacacaugc

SEQ ID NO: 2973034 - RNA, 20 nt, Human
acuccaggcagcagacacau

SEQ ID NO: 2973035 - RNA, 17 nt, Human
acuccaggcagcagaca

SEQ ID NO: 2973036 - RNA, 21 nt, Human
acuccaaagaaauguaaggga

SEQ ID NO: 2973037 - RNA, 22 nt, Human
ucccucauccucauacccaccc

SEQ ID NO: 2973038 - RNA, 21 nt, Human
ucccucagucuggcccuuccu

SEQ ID NO: 2973039 - RNA, 20 nt, Human
uccucaaaacuucagacaua

SEQ ID NO: 2973040 - RNA, 19 nt, Human
acucuuauugcccacgcug

SEQ ID NO: 2973041 - RNA, 16 nt, Human
acucuuauugcccacg

SEQ ID NO: 2973042 - RNA, 20 nt, Human
uccucagaucuucugugggu

SEQ ID NO: 2973043 - RNA, 15 nt, Human
uccucccucccucuu

SEQ ID NO: 2973044 - RNA, 17 nt, Human
uccucccucccucuuuc

SEQ ID NO: 2973045 - RNA, 19 nt, Human
uccucccucccucuuuccc

SEQ ID NO: 2973046 - RNA, 12 nt, Human
uccucuccccag

SEQ ID NO: 2973047 - RNA, 14 nt, Human
uccucauacccacc

SEQ ID NO: 2973048 - RNA, 18 nt, Human
uccucauacccaccccca

SEQ ID NO: 2973049 - RNA, 22 nt, Human
uccucauacccacccccaccca

SEQ ID NO: 2973050 - RNA, 17 nt, Human
acucuccucugcugcug

SEQ ID NO: 2973051 - RNA, 21 nt, Human
acucgggaggcugaggcagga

SEQ ID NO: 2973052 - RNA, 18 nt, Human
acucgcgacaaugcaaac

SEQ ID NO: 2973053 - RNA, 19 nt, Human
uccuaggcauuugcugaau

SEQ ID NO: 2973054 - RNA, 20 nt, Human
acucgcgacaaugcaaacca

SEQ ID NO: 2973055 - RNA, 23 nt, Human
acucgcgacaaugcaaaccauca

SEQ ID NO: 2973056 - RNA, 17 nt, Human
acucgcgacaaugcaaa

SEQ ID NO: 2973057 - RNA, 22 nt, Human
acucuuauaucuauauuuuaca

SEQ ID NO: 2973058 - RNA, 23 nt, Human
acucuuauaucuauauuuuacau

SEQ ID NO: 2973059 - RNA, 18 nt, Human
acucuccucugcugcugg

SEQ ID NO: 2973060 - RNA, 19 nt, Human
acucuccucugcugcuggc

SEQ ID NO: 2973061 - RNA, 14 nt, Human
uagucauucuuccc

SEQ ID NO: 2973062 - RNA, 15 nt, Human
uagucauucuucccu

SEQ ID NO: 2973063 - RNA, 22 nt, Human
uagugagcagucaggaaagaga

SEQ ID NO: 2973064 - RNA, 19 nt, Human
acaagcugcacccucaggc

SEQ ID NO: 2973065 - RNA, 21 nt, Human
acaagcugcacccucaggcag

SEQ ID NO: 2973066 - RNA, 22 nt, Human
acaagcugcacccucaggcagg

SEQ ID NO: 2973067 - RNA, 23 nt, Human
acaagcugcacccucaggcaggu

SEQ ID NO: 2973068 - RNA, 21 nt, Human
uagucaggugccucaagagaa

SEQ ID NO: 2973069 - RNA, 16 nt, Human
uaguuuuauaugcuuc

SEQ ID NO: 2973070 - RNA, 15 nt, Human
uaguuuuauaugcuu

SEQ ID NO: 2973071 - RNA, 20 nt, Human
uaguuccucauuagcauuuu

SEQ ID NO: 2973072 - RNA, 21 nt, Human
acacaugcaaggucauuuuuu

SEQ ID NO: 2973073 - RNA, 21 nt, Human
acacccagcccacuucugcca

SEQ ID NO: 2973074 - RNA, 20 nt, Human
acacccagcccacuucugcc

SEQ ID NO: 2973075 - RNA, 19 nt, Human
acacccagcccacuucugc

SEQ ID NO: 2973076 - RNA, 12 nt, Human
acacccugugau

SEQ ID NO: 2973077 - RNA, 18 nt, Human
acacccugugauggggcc

SEQ ID NO: 2973078 - RNA, 11 nt, Human
acacccuguga

SEQ ID NO: 2973079 - RNA, 20 nt, Human
acaccauaagcuacugccau

SEQ ID NO: 2973080 - RNA, 19 nt, Human
acaccauaagcuacugcca

SEQ ID NO: 2973081 - RNA, 22 nt, Human
uauaaaauaauuuuuauauuug

SEQ ID NO: 2973082 - RNA, 21 nt, Human
uauaaaauaauuuuuauauuu

SEQ ID NO: 2973083 - RNA, 22 nt, Human
acacaucagcuugcccuguuaa

SEQ ID NO: 2973084 - RNA, 20 nt, Human
acacaugcaaggucauuuuu

SEQ ID NO: 2973085 - RNA, 19 nt, Human
acacaugcaaggucauuuu

SEQ ID NO: 2973086 - RNA, 18 nt, Human
acacaugcaaggucauuu

SEQ ID NO: 2973087 - RNA, 13 nt, Human
uauagcaagacau

SEQ ID NO: 2973088 - RNA, 20 nt, Human
uauagccuaggugacagagu

SEQ ID NO: 2973089 - RNA, 19 nt, Human
uauagcuaggugacauaua

SEQ ID NO: 2973090 - RNA, 22 nt, Human
uauagcuaggugacauauacau

SEQ ID NO: 2973091 - RNA, 12 nt, Human
uauaggaauuga

SEQ ID NO: 2973092 - RNA, 13 nt, Human
uauaggaauugac

SEQ ID NO: 2973093 - RNA, 14 nt, Human
uauaggaauugacc

SEQ ID NO: 2973094 - RNA, 21 nt, Human
uauaggugcuacaaaaacaca

SEQ ID NO: 2973095 - RNA, 20 nt, Human
uauaggugcuacaaaaacac

SEQ ID NO: 2973096 - RNA, 23 nt, Human
uauaggugcuacaaaaacacagc

SEQ ID NO: 2973097 - RNA, 21 nt, Human
acacucauugaccugaggccc

SEQ ID NO: 2973098 - RNA, 23 nt, Human
acacucauugaccugaggcccuu

SEQ ID NO: 2973099 - RNA, 19 nt, Human
acacucauugaccugaggc

SEQ ID NO: 2973100 - RNA, 22 nt, Human
uauauauuuuuuucugaaauuu

SEQ ID NO: 2973101 - RNA, 21 nt, Human
uauauauuuuuuucugaaauu

SEQ ID NO: 2973102 - RNA, 20 nt, Human
uauauauuuuuuucugaaau

SEQ ID NO: 2973103 - RNA, 23 nt, Human
uauauauuuuuuucugaaauuuc

SEQ ID NO: 2973104 - RNA, 14 nt, Human
uauacauuugauaa

SEQ ID NO: 2973105 - RNA, 14 nt, Human
uauacauaaacaag

SEQ ID NO: 2973106 - RNA, 13 nt, Human
uauacauaaacaa

SEQ ID NO: 2973107 - RNA, 14 nt, Human
uauaauuuugugaa

SEQ ID NO: 2973108 - RNA, 22 nt, Human
uauaauuuccauuuacuuaaga

SEQ ID NO: 2973109 - RNA, 21 nt, Human
uauaauuuccauuuacuuaag

SEQ ID NO: 2973110 - RNA, 20 nt, Human
uauaauuuccauuuacuuaa

SEQ ID NO: 2973111 - RNA, 15 nt, Human
uauaauuuccauuua

SEQ ID NO: 2973112 - RNA, 21 nt, Human
uauaauuuaccugaagucuuu

SEQ ID NO: 2973113 - RNA, 20 nt, Human
uauaaccaguguuguggauu

SEQ ID NO: 2973114 - RNA, 18 nt, Human
uauaacaaugcuguauuu

SEQ ID NO: 2973115 - RNA, 15 nt, Human
uaugaugacuguuuu

SEQ ID NO: 2973116 - RNA, 14 nt, Human
uaugaugacuguuu

SEQ ID NO: 2973117 - RNA, 14 nt, Human
uaugcucugcaugu

SEQ ID NO: 2973118 - RNA, 18 nt, Human
uaugcucugcauguuaca

SEQ ID NO: 2973119 - RNA, 16 nt, Human
uauggcuauaggugcu

SEQ ID NO: 2973120 - RNA, 22 nt, Human
uauggcccuggccuagcauacg

SEQ ID NO: 2973121 - RNA, 19 nt, Human
uaugcucugcauguuacau

SEQ ID NO: 2973122 - RNA, 14 nt, Human
acagcuaacaugga

SEQ ID NO: 2973123 - RNA, 15 nt, Human
acagcuaacauggaa

SEQ ID NO: 2973124 - RNA, 17 nt, Human
acagcuaacauggaagu

SEQ ID NO: 2973125 - RNA, 15 nt, Human
acagcuccaagaauu

SEQ ID NO: 2973126 - RNA, 17 nt, Human
uauggcuauaggugcua

SEQ ID NO: 2973127 - RNA, 16 nt, Human
uauggcuuuugugcau

SEQ ID NO: 2973128 - RNA, 10 nt, Human
uaugggagag

SEQ ID NO: 2973129 - RNA, 13 nt, Human
uaugggagcuguc

SEQ ID NO: 2973130 - RNA, 23 nt, Human
uaugaucacggcucacugcagcc

SEQ ID NO: 2973131 - RNA, 21 nt, Human
uaugaucacggcucacugcag

SEQ ID NO: 2973132 - RNA, 14 nt, Human
uaugaucacggcuc

SEQ ID NO: 2973133 - RNA, 15 nt, Human
uaucuugaagacuuu

SEQ ID NO: 2973134 - RNA, 13 nt, Human
uaugaggcauuug

SEQ ID NO: 2973135 - RNA, 23 nt, Human
uaugaggcauuuguuugaacuga

SEQ ID NO: 2973136 - RNA, 14 nt, Human
acagcaggcugcca

SEQ ID NO: 2973137 - RNA, 18 nt, Human
acagaguuuucacucuua

SEQ ID NO: 2973138 - RNA, 20 nt, Human
acagaguuuucacucuuauu

SEQ ID NO: 2973139 - RNA, 14 nt, Human
uaucuugaagacuu

SEQ ID NO: 2973140 - RNA, 20 nt, Human
uaucagaacuauguuuuugu

SEQ ID NO: 2973141 - RNA, 14 nt, Human
uaucagaacuaugu

SEQ ID NO: 2973142 - RNA, 16 nt, Human
uaucuagauacuguau

SEQ ID NO: 2973143 - RNA, 15 nt, Human
uaucuagauacugua

SEQ ID NO: 2973144 - RNA, 19 nt, Human
uaucuagauacuguaucau

SEQ ID NO: 2973145 - RNA, 16 nt, Human
uaucucccccagcccc

SEQ ID NO: 2973146 - RNA, 18 nt, Human
uaucucccccagccccau

SEQ ID NO: 2973147 - RNA, 17 nt, Human
uaucucccccagcccca

SEQ ID NO: 2973148 - RNA, 16 nt, Human
acagagcuacacaggg

SEQ ID NO: 2973149 - RNA, 20 nt, Human
acagagcccacgcccccacu

SEQ ID NO: 2973150 - RNA, 21 nt, Human
acagagugagacucugucuca

SEQ ID NO: 2973151 - RNA, 23 nt, Human
acagaguggaauaagacagagac

SEQ ID NO: 2973152 - RNA, 22 nt, Human
acagaguggaauaagacagaga

SEQ ID NO: 2973153 - RNA, 21 nt, Human
acagaguggaauaagacagag

SEQ ID NO: 2973154 - RNA, 22 nt, Human
acagacuggaagcacagcuuca

SEQ ID NO: 2973155 - RNA, 22 nt, Human
acagagaccugcccucaagagc

SEQ ID NO: 2973156 - RNA, 17 nt, Human
uauauucucagcagagu

SEQ ID NO: 2973157 - RNA, 14 nt, Human
acagacuggaagca

SEQ ID NO: 2973158 - RNA, 19 nt, Human
uauauucucagcagagugc

SEQ ID NO: 2973159 - RNA, 18 nt, Human
acagacccugcccugugg

SEQ ID NO: 2973160 - RNA, 20 nt, Human
acagacccugcccugugggc

SEQ ID NO: 2973161 - RNA, 11 nt, Human
acacuccuuca

SEQ ID NO: 2973162 - RNA, 23 nt, Human
acagacacaggcccggcuccagg

SEQ ID NO: 2973163 - RNA, 17 nt, Human
acagacccugcccugug

SEQ ID NO: 2973164 - RNA, 16 nt, Human
acagacccugcccugu

SEQ ID NO: 2973165 - RNA, 20 nt, Human
uaucacuuccaugacauaag

SEQ ID NO: 2973166 - RNA, 18 nt, Human
uaucacccagaagaaaau

SEQ ID NO: 2973167 - RNA, 14 nt, Human
uauauuuacaaaug

SEQ ID NO: 2973168 - RNA, 18 nt, Human
uaucaaguauuauaccuu

SEQ ID NO: 2973169 - RNA, 21 nt, Human
uaucaaguauuauaccuuuuu

SEQ ID NO: 2973170 - RNA, 15 nt, Human
uauauuuacaaaugg

SEQ ID NO: 2973171 - RNA, 21 nt, Human
acaguaacauagcugugauuu

SEQ ID NO: 2973172 - RNA, 21 nt, Human
acaguauggcagcuuuccuca

SEQ ID NO: 2973173 - RNA, 17 nt, Human
acaggcugggcuucagu

SEQ ID NO: 2973174 - RNA, 14 nt, Human
acaggcugggcuuc

SEQ ID NO: 2973175 - RNA, 21 nt, Human
acaggcugggcuucaguggca

SEQ ID NO: 2973176 - RNA, 20 nt, Human
acagggcacaccgggcacuc

SEQ ID NO: 2973177 - RNA, 12 nt, Human
acaggcugggcu

SEQ ID NO: 2973178 - RNA, 22 nt, Human
acagguuuuccugaagaauuga

SEQ ID NO: 2973179 - RNA, 22 nt, Human
acagggcacaccgggcacucag

SEQ ID NO: 2973180 - RNA, 15 nt, Human
acagucccugccaau

SEQ ID NO: 2973181 - RNA, 13 nt, Human
acaguccucccau

SEQ ID NO: 2973182 - RNA, 14 nt, Human
acaguccucccauc

SEQ ID NO: 2973183 - RNA, 15 nt, Human
acaguccucccaucu

SEQ ID NO: 2973184 - RNA, 18 nt, Human
acaguccuuaccagcaga

SEQ ID NO: 2973185 - RNA, 20 nt, Human
acaguccuuaccagcagagc

SEQ ID NO: 2973186 - RNA, 17 nt, Human
acaguccucccaucuca

SEQ ID NO: 2973187 - RNA, 19 nt, Human
acaguauuacuucugcuac

SEQ ID NO: 2973188 - RNA, 17 nt, Human
acaguauuacuucugcu

SEQ ID NO: 2973189 - RNA, 16 nt, Human
acaguauuacuucugc

SEQ ID NO: 2973190 - RNA, 15 nt, Human
acaguauuacuucug

SEQ ID NO: 2973191 - RNA, 12 nt, Human
acagucccugcc

SEQ ID NO: 2973192 - RNA, 13 nt, Human
acagucccugcca

SEQ ID NO: 2973193 - RNA, 22 nt, Human
acaguguguggucaacauuucu

SEQ ID NO: 2973194 - RNA, 23 nt, Human
acagugagagacuccauaguuug

SEQ ID NO: 2973195 - RNA, 12 nt, Human
acagugagagac

SEQ ID NO: 2973196 - RNA, 18 nt, Human
acagugagacucugucuc

SEQ ID NO: 2973197 - RNA, 14 nt, Human
acagugagacucug

SEQ ID NO: 2973198 - RNA, 15 nt, Human
acaguuaagagaaau

SEQ ID NO: 2973199 - RNA, 21 nt, Human
acaguuaccucugccucagaa

SEQ ID NO: 2973200 - RNA, 13 nt, Human
acagucucaggaa

SEQ ID NO: 2973201 - RNA, 14 nt, Human
acagucucaggaaa

SEQ ID NO: 2973202 - RNA, 15 nt, Human
acagucucaggaaau

SEQ ID NO: 2973203 - RNA, 16 nt, Human
acagucucaggaaauc

SEQ ID NO: 2973204 - RNA, 21 nt, Human
acaguccuuaccagcagagca

SEQ ID NO: 2973205 - RNA, 22 nt, Human
acaguccuuaccagcagagcac

SEQ ID NO: 2973206 - RNA, 20 nt, Human
acagugaaagaaaauaacaa

SEQ ID NO: 2973207 - RNA, 17 nt, Human
acagucucaggaaauca

SEQ ID NO: 2973208 - RNA, 15 nt, Human
uauguuuuauauagc

SEQ ID NO: 2973209 - RNA, 19 nt, Human
uauguuuuaagaggcaggg

SEQ ID NO: 2973210 - RNA, 17 nt, Human
uauguuuuaagaggcag

SEQ ID NO: 2973211 - RNA, 22 nt, Human
uauuaaaaaucucaaauuucua

SEQ ID NO: 2973212 - RNA, 20 nt, Human
uauuaaaaaucucaaauuuc

SEQ ID NO: 2973213 - RNA, 18 nt, Human
uauuaaaaaucucaaauu

SEQ ID NO: 2973214 - RNA, 16 nt, Human
uauuaaaaaucucaaa

SEQ ID NO: 2973215 - RNA, 19 nt, Human
uauuaaacaugcuguacau

SEQ ID NO: 2973216 - RNA, 15 nt, Human
uauuaaacaugcugu

SEQ ID NO: 2973217 - RNA, 17 nt, Human
uauuaaacaugcuguac

SEQ ID NO: 2973218 - RNA, 12 nt, Human
uauuaaaacuca

SEQ ID NO: 2973219 - RNA, 23 nt, Human
uauuaaaaaucucaaauuucuaa

SEQ ID NO: 2973220 - RNA, 23 nt, Human
uauuacaguggggaaugaagaua

SEQ ID NO: 2973221 - RNA, 23 nt, Human
uauucauagcagcuuauucacaa

SEQ ID NO: 2973222 - RNA, 18 nt, Human
uauucaggaagcucaggg

SEQ ID NO: 2973223 - RNA, 22 nt, Human
uauucaggaagcucagggccug

SEQ ID NO: 2973224 - RNA, 16 nt, Human
uauucaggaagcucag

SEQ ID NO: 2973225 - RNA, 15 nt, Human
uauuagaauaccaca

SEQ ID NO: 2973226 - RNA, 16 nt, Human
uauuaccacagacaua

SEQ ID NO: 2973227 - RNA, 12 nt, Human
uauuagagaaga

SEQ ID NO: 2973228 - RNA, 15 nt, Human
uauucugagaugacu

SEQ ID NO: 2973229 - RNA, 16 nt, Human
uauucuguuggccagu

SEQ ID NO: 2973230 - RNA, 15 nt, Human
uauucuuauuuaaug

SEQ ID NO: 2973231 - RNA, 24 nt, Human
uauucucuccuguaccucuugagc

SEQ ID NO: 2973232 - RNA, 20 nt, Human
uauucucuccuguaccucuu

SEQ ID NO: 2973233 - RNA, 18 nt, Human
uauucucuccuguaccuc

SEQ ID NO: 2973234 - RNA, 17 nt, Human
acaguucucuccuucuu

SEQ ID NO: 2973235 - RNA, 19 nt, Human
acaguucggugagcuacaa

SEQ ID NO: 2973236 - RNA, 22 nt, Human
acaguucggugagcuacaaaug

SEQ ID NO: 2973237 - RNA, 16 nt, Human
acaguucucuccuucu

SEQ ID NO: 2973238 - RNA, 23 nt, Human
acaguucggugagcuacaaaugc

SEQ ID NO: 2973239 - RNA, 20 nt, Human
acaguucaauucucauuugu

SEQ ID NO: 2973240 - RNA, 20 nt, Human
acaguuacucagaauucucu

SEQ ID NO: 2973241 - RNA, 13 nt, Human
acaguuacucaga

SEQ ID NO: 2973242 - RNA, 20 nt, Human
uauugaagcagaguggcagu

SEQ ID NO: 2973243 - RNA, 16 nt, Human
uauugaagcagagugg

SEQ ID NO: 2973244 - RNA, 14 nt, Human
uauugaagcagagu

SEQ ID NO: 2973245 - RNA, 16 nt, Human
uauugaaaugauuuca

SEQ ID NO: 2973246 - RNA, 15 nt, Human
uauuuaaucuuuuau

SEQ ID NO: 2973247 - RNA, 13 nt, Human
uauuuaaucuuuu

SEQ ID NO: 2973248 - RNA, 14 nt, Human
uauuuaauagguuu

SEQ ID NO: 2973249 - RNA, 21 nt, Human
uauuuaaugaaagacuguaca

SEQ ID NO: 2973250 - RNA, 15 nt, Human
uauuuaaugaaagac

SEQ ID NO: 2973251 - RNA, 17 nt, Human
uauugucuagugaaacu

SEQ ID NO: 2973252 - RNA, 18 nt, Human
uauuuaaccucuaaauuc

SEQ ID NO: 2973253 - RNA, 17 nt, Human
uauuuaaccucuaaauu

SEQ ID NO: 2973254 - RNA, 13 nt, Human
uauugucaaagug

SEQ ID NO: 2973255 - RNA, 17 nt, Human
uauugucaaagugguga

SEQ ID NO: 2973256 - RNA, 21 nt, Human
uauuguagcauccuggaauau

SEQ ID NO: 2973257 - RNA, 20 nt, Human
uauuguagcauccuggaaua

SEQ ID NO: 2973258 - RNA, 18 nt, Human
uauuguagcauccuggaa

SEQ ID NO: 2973259 - RNA, 17 nt, Human
uauuguagcauccugga

SEQ ID NO: 2973260 - RNA, 16 nt, Human
uauuuaauuugaaggu

SEQ ID NO: 2973261 - RNA, 23 nt, Human
uauuuaauuugaagguagaaugu

SEQ ID NO: 2973262 - RNA, 13 nt, Human
uauuuaauuugaa

SEQ ID NO: 2973263 - RNA, 21 nt, Human
uauuuacaaauguuuugcuca

SEQ ID NO: 2973264 - RNA, 14 nt, Human
uauuuacaaauguu

SEQ ID NO: 2973265 - RNA, 23 nt, Human
uauuuaauuuuuuugagacagag

SEQ ID NO: 2973266 - RNA, 18 nt, Human
uauuuacuucuuauacau

SEQ ID NO: 2973267 - RNA, 13 nt, Human
uauuuauuuguga

SEQ ID NO: 2973268 - RNA, 14 nt, Human
uauuuauuuauuua

SEQ ID NO: 2973269 - RNA, 18 nt, Human
uauuuauuuuaauaaugu

SEQ ID NO: 2973270 - RNA, 16 nt, Human
uauuuauuuuaauaau

SEQ ID NO: 2973271 - RNA, 14 nt, Human
uauuuauuuuaaua

SEQ ID NO: 2973272 - RNA, 14 nt, Human
uauuuauuuaaauu

SEQ ID NO: 2973273 - RNA, 15 nt, Human
uauuuauuuacaaau

SEQ ID NO: 2973274 - RNA, 16 nt, Human
uauuuauuuacaaaug

SEQ ID NO: 2973275 - RNA, 13 nt, Human
uauuuauuuaaau

SEQ ID NO: 2973276 - RNA, 13 nt, Human
uacuauuaaacau

SEQ ID NO: 2973277 - RNA, 16 nt, Human
uacuauguaucaauga

SEQ ID NO: 2973278 - RNA, 16 nt, Human
uacuauaauuuaccug

SEQ ID NO: 2973279 - RNA, 16 nt, Human
uacuauuaaacaugcu

SEQ ID NO: 2973280 - RNA, 15 nt, Human
uacuauuaaacaugc

SEQ ID NO: 2973281 - RNA, 14 nt, Human
uacuauuaaacaug

SEQ ID NO: 2973282 - RNA, 18 nt, Human
uacuauuaaacaugcugu

SEQ ID NO: 2973283 - RNA, 14 nt, Human
uacgucugacaggc

SEQ ID NO: 2973284 - RNA, 14 nt, Human
uacguugugcauuu

SEQ ID NO: 2973285 - RNA, 13 nt, Human
uacguugugcauu

SEQ ID NO: 2973286 - RNA, 22 nt, Human
uacucuuauaucuauauuuuac

SEQ ID NO: 2973287 - RNA, 20 nt, Human
uacucuuauaucuauauuuu

SEQ ID NO: 2973288 - RNA, 21 nt, Human
uacucugugucagguggggca

SEQ ID NO: 2973289 - RNA, 20 nt, Human
aauucuugcaaaguaucccu

SEQ ID NO: 2973290 - RNA, 14 nt, Human
aauucuugcaaagu

SEQ ID NO: 2973291 - RNA, 21 nt, Human
aauucuugccaaauauaaaua

SEQ ID NO: 2973292 - RNA, 22 nt, Human
aauucuucuccacuuucuagcc

SEQ ID NO: 2973293 - RNA, 13 nt, Human
aauucuuaaauau

SEQ ID NO: 2973294 - RNA, 14 nt, Human
aauucuuucauuuu

SEQ ID NO: 2973295 - RNA, 14 nt, Human
uacguacacauuuu

SEQ ID NO: 2973296 - RNA, 15 nt, Human
uacguacacauuuua

SEQ ID NO: 2973297 - RNA, 19 nt, Human
aauugacccacaagaaaug

SEQ ID NO: 2973298 - RNA, 16 nt, Human
aauugacccacaagaa

SEQ ID NO: 2973299 - RNA, 13 nt, Human
aauugacccacaa

SEQ ID NO: 2973300 - RNA, 20 nt, Human
aauuucucccagucauuuaa

SEQ ID NO: 2973301 - RNA, 19 nt, Human
aauuucucccagucauuua

SEQ ID NO: 2973302 - RNA, 21 nt, Human
aauuucuaaaucuccaaaaua

SEQ ID NO: 2973303 - RNA, 13 nt, Human
aauuucuaaaucu

SEQ ID NO: 2973304 - RNA, 17 nt, Human
aauuuagaaauauaauu

SEQ ID NO: 2973305 - RNA, 19 nt, Human
uacuucaaauccuugaaga

SEQ ID NO: 2973306 - RNA, 14 nt, Human
uacuucaaauccuu

SEQ ID NO: 2973307 - RNA, 19 nt, Human
aauuugauaugugaacagu

SEQ ID NO: 2973308 - RNA, 15 nt, Human
aauuugauaugugaa

SEQ ID NO: 2973309 - RNA, 18 nt, Human
aauuugauaugugaacag

SEQ ID NO: 2973310 - RNA, 16 nt, Human
aauuugauaugugaac

SEQ ID NO: 2973311 - RNA, 23 nt, Human
aauugugugaaagguacuucaaa

SEQ ID NO: 2973312 - RNA, 22 nt, Human
aauuguuuggggaugagaaagg

SEQ ID NO: 2973313 - RNA, 21 nt, Human
aauuguuugacggcaagguuu

SEQ ID NO: 2973314 - RNA, 13 nt, Human
aauuuaaaagucu

SEQ ID NO: 2973315 - RNA, 15 nt, Human
aauuuaaauagcuuu

SEQ ID NO: 2973316 - RNA, 16 nt, Human
aauuuaaauagcuuuu

SEQ ID NO: 2973317 - RNA, 19 nt, Human
aauuuacauacucugcuua

SEQ ID NO: 2973318 - RNA, 15 nt, Human
aauuuacauacucug

SEQ ID NO: 2973319 - RNA, 21 nt, Human
uagcaugucgucaaagcugaa

SEQ ID NO: 2973320 - RNA, 18 nt, Human
uagcaugucgucaaagcu

SEQ ID NO: 2973321 - RNA, 24 nt, Human
uagcacagacccugcccugugggc

SEQ ID NO: 2973322 - RNA, 16 nt, Human
uagcacagacccugcc

SEQ ID NO: 2973323 - RNA, 17 nt, Human
uagcacagacccugccc

SEQ ID NO: 2973324 - RNA, 18 nt, Human
uagcacagacccugcccu

SEQ ID NO: 2973325 - RNA, 19 nt, Human
uagcacagacccugcccug

SEQ ID NO: 2973326 - RNA, 22 nt, Human
uagauuuuagacccuauugcug

SEQ ID NO: 2973327 - RNA, 19 nt, Human
uagaugcaguucugaagaa

SEQ ID NO: 2973328 - RNA, 17 nt, Human
uagaugcaguucugaag

SEQ ID NO: 2973329 - RNA, 16 nt, Human
uagaugcaguucugaa

SEQ ID NO: 2973330 - RNA, 18 nt, Human
acaagcacuaaacaaaga

SEQ ID NO: 2973331 - RNA, 17 nt, Human
acaagagcccaggccuc

SEQ ID NO: 2973332 - RNA, 12 nt, Human
acaagccacccc

SEQ ID NO: 2973333 - RNA, 21 nt, Human
acaagcgugagccacugcacc

SEQ ID NO: 2973334 - RNA, 20 nt, Human
acaagcgugagccacugcac

SEQ ID NO: 2973335 - RNA, 13 nt, Human
acaagcugcaccc

SEQ ID NO: 2973336 - RNA, 18 nt, Human
acaagcgugagccacugc

SEQ ID NO: 2973337 - RNA, 22 nt, Human
acaagaaaugaaagcagggacu

SEQ ID NO: 2973338 - RNA, 15 nt, Human
acaacaacaaaauga

SEQ ID NO: 2973339 - RNA, 12 nt, Human
acaacacucaca

SEQ ID NO: 2973340 - RNA, 13 nt, Human
acaaauguuuugc

SEQ ID NO: 2973341 - RNA, 23 nt, Human
acaaauguuuugcucaauagauu

SEQ ID NO: 2973342 - RNA, 14 nt, Human
acaaauguuuugcu

SEQ ID NO: 2973343 - RNA, 18 nt, Human
uagaacucccuuucaaca

SEQ ID NO: 2973344 - RNA, 15 nt, Human
uagaagucacacagu

SEQ ID NO: 2973345 - RNA, 21 nt, Human
uacuucaaauccuugaagauu

SEQ ID NO: 2973346 - RNA, 21 nt, Human
uagaauugacauugaaaucua

SEQ ID NO: 2973347 - RNA, 19 nt, Human
uagaauugacauugaaauc

SEQ ID NO: 2973348 - RNA, 19 nt, Human
uagaagucuuagauguaua

SEQ ID NO: 2973349 - RNA, 18 nt, Human
uagaagucuuagauguau

SEQ ID NO: 2973350 - RNA, 17 nt, Human
uagaagucuuagaugua

SEQ ID NO: 2973351 - RNA, 16 nt, Human
uagaagucuuagaugu

SEQ ID NO: 2973352 - RNA, 23 nt, Human
uagaagucacauuccugaacagg

SEQ ID NO: 2973353 - RNA, 16 nt, Human
uagaagucacacagua

SEQ ID NO: 2973354 - RNA, 16 nt, Human
uagacaauuuauuaug

SEQ ID NO: 2973355 - RNA, 21 nt, Human
uagacagagucucacuguugc

SEQ ID NO: 2973356 - RNA, 19 nt, Human
aauuuuuauauuugaaaua

SEQ ID NO: 2973357 - RNA, 14 nt, Human
aauuuuaaacauau

SEQ ID NO: 2973358 - RNA, 13 nt, Human
aauuuuaaacaua

SEQ ID NO: 2973359 - RNA, 18 nt, Human
aauuuuuauuaaauuaug

SEQ ID NO: 2973360 - RNA, 17 nt, Human
aauuuuuauuaaauuau

SEQ ID NO: 2973361 - RNA, 12 nt, Human
uagacagucccu

SEQ ID NO: 2973362 - RNA, 14 nt, Human
uagacagucccugc

SEQ ID NO: 2973363 - RNA, 13 nt, Human
acaaaaacauggc

SEQ ID NO: 2973364 - RNA, 16 nt, Human
acaaaaacacagcaag

SEQ ID NO: 2973365 - RNA, 17 nt, Human
aauuuuuuugagacaga

SEQ ID NO: 2973366 - RNA, 19 nt, Human
aauuuuuucucuaggaaau

SEQ ID NO: 2973367 - RNA, 22 nt, Human
aauuuuuuuaucgucacugcuu

SEQ ID NO: 2973368 - RNA, 13 nt, Human
aauuaaguacuau

SEQ ID NO: 2973369 - RNA, 23 nt, Human
uacauggcuggagcuagaauuug

SEQ ID NO: 2973370 - RNA, 22 nt, Human
aauuaacuuuuauaaacuuuac

SEQ ID NO: 2973371 - RNA, 15 nt, Human
aauuaagagagucua

SEQ ID NO: 2973372 - RNA, 20 nt, Human
aauuaacuuuuauaaacuuu

SEQ ID NO: 2973373 - RNA, 18 nt, Human
aauuaacuuuuauaaacu

SEQ ID NO: 2973374 - RNA, 18 nt, Human
aauguugacaugggacau

SEQ ID NO: 2973375 - RNA, 17 nt, Human
uaccauccccuguagag

SEQ ID NO: 2973376 - RNA, 19 nt, Human
uaccccaagacucccauga

SEQ ID NO: 2973377 - RNA, 17 nt, Human
uaccacuuuuguucuug

SEQ ID NO: 2973378 - RNA, 15 nt, Human
uaccacuuuugcaaa

SEQ ID NO: 2973379 - RNA, 17 nt, Human
uaccacuuuugcaaaua

SEQ ID NO: 2973380 - RNA, 22 nt, Human
uacccuggcacuauaauguaag

SEQ ID NO: 2973381 - RNA, 20 nt, Human
uacccuggcacuauaaugua

SEQ ID NO: 2973382 - RNA, 16 nt, Human
uacccucauguucuua

SEQ ID NO: 2973383 - RNA, 15 nt, Human
uacccucauguucuu

SEQ ID NO: 2973384 - RNA, 20 nt, Human
uacccgggaagggggcuggg

SEQ ID NO: 2973385 - RNA, 12 nt, Human
uacauacuuuuu

SEQ ID NO: 2973386 - RNA, 15 nt, Human
uacauacuuuuuggg

SEQ ID NO: 2973387 - RNA, 14 nt, Human
uacauacuuuuugg

SEQ ID NO: 2973388 - RNA, 14 nt, Human
aauguaggcuggcu

SEQ ID NO: 2973389 - RNA, 22 nt, Human
aaugugaaacuggauuaaacuu

SEQ ID NO: 2973390 - RNA, 14 nt, Human
aaugucacaggcag

SEQ ID NO: 2973391 - RNA, 13 nt, Human
aaugucacaggca

SEQ ID NO: 2973392 - RNA, 18 nt, Human
uacaguaucucagggccu

SEQ ID NO: 2973393 - RNA, 12 nt, Human
uacaguccuccc

SEQ ID NO: 2973394 - RNA, 15 nt, Human
uacaguccucccauc

SEQ ID NO: 2973395 - RNA, 17 nt, Human
uacaguccucccaucuc

SEQ ID NO: 2973396 - RNA, 18 nt, Human
uacaguccucccaucuca

SEQ ID NO: 2973397 - RNA, 20 nt, Human
uacaguggggaaugaagaua

SEQ ID NO: 2973398 - RNA, 16 nt, Human
aaugguuuaaaugguc

SEQ ID NO: 2973399 - RNA, 15 nt, Human
aauguaagcucuacu

SEQ ID NO: 2973400 - RNA, 13 nt, Human
aauguaagcucua

SEQ ID NO: 2973401 - RNA, 17 nt, Human
aaugguuuucuugugug

SEQ ID NO: 2973402 - RNA, 18 nt, Human
aaugguuuucuugugugu

SEQ ID NO: 2973403 - RNA, 22 nt, Human
aaugguuuucuuguguguuuau

SEQ ID NO: 2973404 - RNA, 22 nt, Human
uacagcaaggagauuuacaacu

SEQ ID NO: 2973405 - RNA, 23 nt, Human
aauguacagcaaggagauuuaca

SEQ ID NO: 2973406 - RNA, 21 nt, Human
aauguacagcaaggagauuua

SEQ ID NO: 2973407 - RNA, 21 nt, Human
uaauuaugguuaguagaggua

SEQ ID NO: 2973408 - RNA, 19 nt, Human
aaugcacaaacagaggccg

SEQ ID NO: 2973409 - RNA, 20 nt, Human
aaugcacaaacagaggccgc

SEQ ID NO: 2973410 - RNA, 13 nt, Human
aaugcacuuuguu

SEQ ID NO: 2973411 - RNA, 16 nt, Human
aaugcacuuuguucug

SEQ ID NO: 2973412 - RNA, 19 nt, Human
aaugcacuuuguucuggcu

SEQ ID NO: 2973413 - RNA, 20 nt, Human
aaugcacuuuguucuggcuc

SEQ ID NO: 2973414 - RNA, 23 nt, Human
uaauuaguuccucauuagcauuu

SEQ ID NO: 2973415 - RNA, 12 nt, Human
aaugcaaagaug

SEQ ID NO: 2973416 - RNA, 18 nt, Human
aaugcaaagaugaagguc

SEQ ID NO: 2973417 - RNA, 14 nt, Human
aaugcaaagaugaa

SEQ ID NO: 2973418 - RNA, 21 nt, Human
aaugcaaagaugaaggucugu

SEQ ID NO: 2973419 - RNA, 22 nt, Human
aaugcaaaccaucauugaaauc

SEQ ID NO: 2973420 - RNA, 23 nt, Human
aaugcaaaccaucauugaaaucu

SEQ ID NO: 2973421 - RNA, 18 nt, Human
aaugcacaaacagaggcc

SEQ ID NO: 2973422 - RNA, 13 nt, Human
aaugaccuuucaa

SEQ ID NO: 2973423 - RNA, 14 nt, Human
aaugaccuuucaau

SEQ ID NO: 2973424 - RNA, 14 nt, Human
aaugcaaaccauca

SEQ ID NO: 2973425 - RNA, 16 nt, Human
aaugcaaaccaucauu

SEQ ID NO: 2973426 - RNA, 20 nt, Human
aaugaaugucagugugacug

SEQ ID NO: 2973427 - RNA, 21 nt, Human
aaugaaugucagugugacuga

SEQ ID NO: 2973428 - RNA, 20 nt, Human
uaauuugaagguagaauguu

SEQ ID NO: 2973429 - RNA, 17 nt, Human
uaauuuaccugaagucu

SEQ ID NO: 2973430 - RNA, 18 nt, Human
uaauuuaccugaagucuu

SEQ ID NO: 2973431 - RNA, 22 nt, Human
uaauuuccauuuacuuaagacu

SEQ ID NO: 2973432 - RNA, 17 nt, Human
uacaaaaacacagcaag

SEQ ID NO: 2973433 - RNA, 18 nt, Human
uacaaaaacacagcaagg

SEQ ID NO: 2973434 - RNA, 16 nt, Human
uacaaaaacauggccu

SEQ ID NO: 2973435 - RNA, 16 nt, Human
uacaaaaacacagcaa

SEQ ID NO: 2973436 - RNA, 20 nt, Human
uacaagcgugagccacugca

SEQ ID NO: 2973437 - RNA, 19 nt, Human
uacaagcgugagccacugc

SEQ ID NO: 2973438 - RNA, 18 nt, Human
uacaagcgugagccacug

SEQ ID NO: 2973439 - RNA, 16 nt, Human
uacaagcgugagccac

SEQ ID NO: 2973440 - RNA, 21 nt, Human
uacaagcgugagccacugcac

SEQ ID NO: 2973441 - RNA, 19 nt, Human
aaucuuuuaugauugccuu

SEQ ID NO: 2973442 - RNA, 23 nt, Human
aaucuucugaacuuggcgcugcc

SEQ ID NO: 2973443 - RNA, 15 nt, Human
aaugaaugucagugu

SEQ ID NO: 2973444 - RNA, 14 nt, Human
aaugaaugucagug

SEQ ID NO: 2973445 - RNA, 14 nt, Human
aaugaaugaaacau

SEQ ID NO: 2973446 - RNA, 15 nt, Human
aaugaaugaaugaau

SEQ ID NO: 2973447 - RNA, 23 nt, Human
uaaugugaaacuggauuaaacuu

SEQ ID NO: 2973448 - RNA, 22 nt, Human
uaaugugaaacuggauuaaacu

SEQ ID NO: 2973449 - RNA, 20 nt, Human
uaaugugaaacuggauuaaa

SEQ ID NO: 2973450 - RNA, 12 nt, Human
uaaugugaaacu

SEQ ID NO: 2973451 - RNA, 15 nt, Human
uaaugucacaggcag

SEQ ID NO: 2973452 - RNA, 17 nt, Human
uaaugucacaggcaggu

SEQ ID NO: 2973453 - RNA, 16 nt, Human
uaaugucacaggcagg

SEQ ID NO: 2973454 - RNA, 17 nt, Human
uaauguaagcucuacug

SEQ ID NO: 2973455 - RNA, 16 nt, Human
uaauguaagcucuacu

SEQ ID NO: 2973456 - RNA, 21 nt, Human
uaauacaccacuacauucugu

SEQ ID NO: 2973457 - RNA, 22 nt, Human
uaauacaccacuacauucuguu

SEQ ID NO: 2973458 - RNA, 23 nt, Human
uaauacaccacuacauucuguua

SEQ ID NO: 2973459 - RNA, 20 nt, Human
aauacaguaucucagggccu

SEQ ID NO: 2973460 - RNA, 21 nt, Human
uaauauugauaugcuuauaca

SEQ ID NO: 2973461 - RNA, 13 nt, Human
aacucuguaauuc

SEQ ID NO: 2973462 - RNA, 20 nt, Human
aacugaaaucauacuucuua

SEQ ID NO: 2973463 - RNA, 13 nt, Human
aacugaaaucaua

SEQ ID NO: 2973464 - RNA, 19 nt, Human
gugaguacuacaguccucc

SEQ ID NO: 2973465 - RNA, 17 nt, Human
gugaguccuggcauggg

SEQ ID NO: 2973466 - RNA, 20 nt, Human
gugaguccuggcaugggaau

SEQ ID NO: 2973467 - RNA, 16 nt, Human
gugagaggggaacaga

SEQ ID NO: 2973468 - RNA, 13 nt, Human
gugagagcugggu

SEQ ID NO: 2973469 - RNA, 15 nt, Human
gugagcaauccugca

SEQ ID NO: 2973470 - RNA, 21 nt, Human
gugagcacuaaggugugcucu

SEQ ID NO: 2973471 - RNA, 17 nt, Human
gugaguacuacaguccu

SEQ ID NO: 2973472 - RNA, 12 nt, Human
gugaccccaggu

SEQ ID NO: 2973473 - RNA, 12 nt, Human
gugagagcuggg

SEQ ID NO: 2973474 - RNA, 17 nt, Human
gugaccaaugaugguca

SEQ ID NO: 2973475 - RNA, 18 nt, Human
gugaccagcaccaucucu

SEQ ID NO: 2973476 - RNA, 21 nt, Human
gugaccagcaccaucucuccu

SEQ ID NO: 2973477 - RNA, 18 nt, Human
gugaccauguuuuguuua

SEQ ID NO: 2973478 - RNA, 14 nt, Human
gugacaugucuuuu

SEQ ID NO: 2973479 - RNA, 19 nt, Human
gugacagaggcagccccau

SEQ ID NO: 2973480 - RNA, 18 nt, Human
gugacagaggcagcccca

SEQ ID NO: 2973481 - RNA, 16 nt, Human
gugacagaggcagccc

SEQ ID NO: 2973482 - RNA, 20 nt, Human
aacuaucucauuuccaagca

SEQ ID NO: 2973483 - RNA, 13 nt, Human
aacuauauuguuu

SEQ ID NO: 2973484 - RNA, 23 nt, Human
gugaagacaaugacuuacuguac

SEQ ID NO: 2973485 - RNA, 14 nt, Human
gugaagugaagaca

SEQ ID NO: 2973486 - RNA, 18 nt, Human
aacuaacaggcuuaguga

SEQ ID NO: 2973487 - RNA, 22 nt, Human
aacuaacaggcuuagugaugua

SEQ ID NO: 2973488 - RNA, 23 nt, Human
aacguggcugcuucaaggauccu

SEQ ID NO: 2973489 - RNA, 15 nt, Human
gucuuuguacagaca

SEQ ID NO: 2973490 - RNA, 16 nt, Human
gucuuuguacagacaa

SEQ ID NO: 2973491 - RNA, 16 nt, Human
gucuucaguaagccgu

SEQ ID NO: 2973492 - RNA, 19 nt, Human
aaccugauugugucucuug

SEQ ID NO: 2973493 - RNA, 18 nt, Human
aaccugauugugucucuu

SEQ ID NO: 2973494 - RNA, 13 nt, Human
gucuucacaacag

SEQ ID NO: 2973495 - RNA, 23 nt, Human
gucugacaggcaaugcuggcugu

SEQ ID NO: 2973496 - RNA, 22 nt, Human
gucugacaggcaaugcuggcug

SEQ ID NO: 2973497 - RNA, 21 nt, Human
gucugacaggcaaugcuggcu

SEQ ID NO: 2973498 - RNA, 18 nt, Human
gucuggaaugcaguggua

SEQ ID NO: 2973499 - RNA, 13 nt, Human
gucucuugguccu

SEQ ID NO: 2973500 - RNA, 20 nt, Human
gucucuugguccugcugcag

SEQ ID NO: 2973501 - RNA, 18 nt, Human
gucucuugguccugcugc

SEQ ID NO: 2973502 - RNA, 19 nt, Human
gucucuugguccugcugca

SEQ ID NO: 2973503 - RNA, 17 nt, Human
gucucuugguccugcug

SEQ ID NO: 2973504 - RNA, 22 nt, Human
gucucuuuaaugucacaggcag

SEQ ID NO: 2973505 - RNA, 19 nt, Human
gucugaaggcuggguucug

SEQ ID NO: 2973506 - RNA, 14 nt, Human
gucugaaggcuggg

SEQ ID NO: 2973507 - RNA, 20 nt, Human
gucucuuuaaugucacaggc

SEQ ID NO: 2973508 - RNA, 19 nt, Human
gucucuuuaaugucacagg

SEQ ID NO: 2973509 - RNA, 18 nt, Human
gucucuuuaaugucacag

SEQ ID NO: 2973510 - RNA, 23 nt, Human
gucucaguccaugaagauguaga

SEQ ID NO: 2973511 - RNA, 14 nt, Human
gucuaugggacuca

SEQ ID NO: 2973512 - RNA, 22 nt, Human
gucucaaacucuugaccucagg

SEQ ID NO: 2973513 - RNA, 19 nt, Human
gucucaaaaaaagaaaaag

SEQ ID NO: 2973514 - RNA, 13 nt, Human
gucuccagcugcu

SEQ ID NO: 2973515 - RNA, 13 nt, Human
gucuccauguuug

SEQ ID NO: 2973516 - RNA, 14 nt, Human
gucuccagcugcug

SEQ ID NO: 2973517 - RNA, 13 nt, Human
aaccacaucuugc

SEQ ID NO: 2973518 - RNA, 23 nt, Human
aaccaucauugaaaucuuuuugc

SEQ ID NO: 2973519 - RNA, 14 nt, Human
gucgcccagucugg

SEQ ID NO: 2973520 - RNA, 13 nt, Human
gucgcccagucug

SEQ ID NO: 2973521 - RNA, 14 nt, Human
gucgaggacaggga

SEQ ID NO: 2973522 - RNA, 23 nt, Human
gucgcccagucuggaaugcagug

SEQ ID NO: 2973523 - RNA, 20 nt, Human
gucuaccugaggggccucuu

SEQ ID NO: 2973524 - RNA, 13 nt, Human
guccugcugcagu

SEQ ID NO: 2973525 - RNA, 16 nt, Human
guccugcugcaguugc

SEQ ID NO: 2973526 - RNA, 22 nt, Human
guagcucuaggagggcuggcaa

SEQ ID NO: 2973527 - RNA, 23 nt, Human
guccaugaagauguagaggagaa

SEQ ID NO: 2973528 - RNA, 18 nt, Human
gucccaccuuggcugcag

SEQ ID NO: 2973529 - RNA, 17 nt, Human
gucccaccuuggcugca

SEQ ID NO: 2973530 - RNA, 19 nt, Human
gucccaccuuggcugcagg

SEQ ID NO: 2973531 - RNA, 13 nt, Human
gucccuuuuccuu

SEQ ID NO: 2973532 - RNA, 21 nt, Human
guccgaaagggacuuggaagc

SEQ ID NO: 2973533 - RNA, 22 nt, Human
guccgaaagggacuuggaagcu

SEQ ID NO: 2973534 - RNA, 13 nt, Human
gucccccugacaa

SEQ ID NO: 2973535 - RNA, 15 nt, Human
guccccgcacugggc

SEQ ID NO: 2973536 - RNA, 16 nt, Human
guccccgcacugggcu

SEQ ID NO: 2973537 - RNA, 23 nt, Human
guccccuguuuguuucugaaagg

SEQ ID NO: 2973538 - RNA, 22 nt, Human
aacauguuuuucuucucccuca

SEQ ID NO: 2973539 - RNA, 14 nt, Human
aacauauccaaguu

SEQ ID NO: 2973540 - RNA, 16 nt, Human
aacauauauaacaaug

SEQ ID NO: 2973541 - RNA, 14 nt, Human
aacaucaacaucuu

SEQ ID NO: 2973542 - RNA, 20 nt, Human
aacauauccaaguuugaauu

SEQ ID NO: 2973543 - RNA, 19 nt, Human
aacauauccaaguuugaau

SEQ ID NO: 2973544 - RNA, 23 nt, Human
aacagugagagacuccauaguuu

SEQ ID NO: 2973545 - RNA, 18 nt, Human
aacauacucccaucugug

SEQ ID NO: 2973546 - RNA, 16 nt, Human
aacauacucccaucug

SEQ ID NO: 2973547 - RNA, 20 nt, Human
aacauacucccaucugugaa

SEQ ID NO: 2973548 - RNA, 19 nt, Human
aacagauuauuaccuuaca

SEQ ID NO: 2973549 - RNA, 20 nt, Human
aacagacuggaagcacagcu

SEQ ID NO: 2973550 - RNA, 13 nt, Human
guccuacccaccc

SEQ ID NO: 2973551 - RNA, 19 nt, Human
aacagucucaggaaaucaa

SEQ ID NO: 2973552 - RNA, 17 nt, Human
aacagucucaggaaauc

SEQ ID NO: 2973553 - RNA, 23 nt, Human
guguguggucaacauuucucaug

SEQ ID NO: 2973554 - RNA, 19 nt, Human
gugugguguuuccuggcac

SEQ ID NO: 2973555 - RNA, 16 nt, Human
aagcaaguauuagaau

SEQ ID NO: 2973556 - RNA, 20 nt, Human
gugucccaaaaagaaaggag

SEQ ID NO: 2973557 - RNA, 19 nt, Human
gugucuugcaauggcagcc

SEQ ID NO: 2973558 - RNA, 15 nt, Human
gugugguguuuccug

SEQ ID NO: 2973559 - RNA, 18 nt, Human
gugugagucaccaagccc

SEQ ID NO: 2973560 - RNA, 13 nt, Human
gugugagucacca

SEQ ID NO: 2973561 - RNA, 21 nt, Human
gugucuugcaauggcagccuu

SEQ ID NO: 2973562 - RNA, 22 nt, Human
aagauguagaggagaaacugga

SEQ ID NO: 2973563 - RNA, 13 nt, Human
aagcaaaauguga

SEQ ID NO: 2973564 - RNA, 19 nt, Human
aagauguagaggagaaacu

SEQ ID NO: 2973565 - RNA, 19 nt, Human
aagcaaaauuuuuucucua

SEQ ID NO: 2973566 - RNA, 16 nt, Human
aagaguaggaagacuu

SEQ ID NO: 2973567 - RNA, 18 nt, Human
aagaguaggaagacuuug

SEQ ID NO: 2973568 - RNA, 19 nt, Human
aagaguaggaagacuuugg

SEQ ID NO: 2973569 - RNA, 15 nt, Human
aagauauuuugcuuu

SEQ ID NO: 2973570 - RNA, 18 nt, Human
gugguuauggagagggug

SEQ ID NO: 2973571 - RNA, 19 nt, Human
gugguguuuccuggcacug

SEQ ID NO: 2973572 - RNA, 17 nt, Human
gugguuauaacuuaaug

SEQ ID NO: 2973573 - RNA, 20 nt, Human
gugguuauaacuuaaugaaa

SEQ ID NO: 2973574 - RNA, 14 nt, Human
aagaguaggaagac

SEQ ID NO: 2973575 - RNA, 20 nt, Human
aagauauuuugcuuugugau

SEQ ID NO: 2973576 - RNA, 17 nt, Human
aagauauuuugcuuugu

SEQ ID NO: 2973577 - RNA, 22 nt, Human
aagauauuuugcuuugugauuu

SEQ ID NO: 2973578 - RNA, 23 nt, Human
aagacgcugugcugcccugccca

SEQ ID NO: 2973579 - RNA, 20 nt, Human
aagacgcugugcugcccugc

SEQ ID NO: 2973580 - RNA, 13 nt, Human
aagacuauucaaa

SEQ ID NO: 2973581 - RNA, 14 nt, Human
aagacuauucaaac

SEQ ID NO: 2973582 - RNA, 21 nt, Human
aagacgcugugcugcccugcc

SEQ ID NO: 2973583 - RNA, 22 nt, Human
aagacgcugugcugcccugccc

SEQ ID NO: 2973584 - RNA, 16 nt, Human
aagacuccaaagaaau

SEQ ID NO: 2973585 - RNA, 17 nt, Human
aagacuccaaagaaaug

SEQ ID NO: 2973586 - RNA, 14 nt, Human
aagacuccaaagaa

SEQ ID NO: 2973587 - RNA, 17 nt, Human
aagacucauucuucugu

SEQ ID NO: 2973588 - RNA, 22 nt, Human
aagacucccaugagggagaugc

SEQ ID NO: 2973589 - RNA, 17 nt, Human
aagacugcauuauauuu

SEQ ID NO: 2973590 - RNA, 18 nt, Human
aagagcuguucacagcca

SEQ ID NO: 2973591 - RNA, 16 nt, Human
aagagauugugguuuc

SEQ ID NO: 2973592 - RNA, 19 nt, Human
aagagauugugguuucauu

SEQ ID NO: 2973593 - RNA, 12 nt, Human
aagagcccaggc

SEQ ID NO: 2973594 - RNA, 14 nt, Human
aagagcccaggccu

SEQ ID NO: 2973595 - RNA, 16 nt, Human
aagagcccaggccucc

SEQ ID NO: 2973596 - RNA, 15 nt, Human
guggccucccaacuc

SEQ ID NO: 2973597 - RNA, 13 nt, Human
guggccucccaac

SEQ ID NO: 2973598 - RNA, 14 nt, Human
guggccucccaacu

SEQ ID NO: 2973599 - RNA, 15 nt, Human
gugggauccuccagg

SEQ ID NO: 2973600 - RNA, 18 nt, Human
gugggauccuccaggugc

SEQ ID NO: 2973601 - RNA, 12 nt, Human
gugggagcugag

SEQ ID NO: 2973602 - RNA, 14 nt, Human
guggguagacacac

SEQ ID NO: 2973603 - RNA, 15 nt, Human
gugguguuuccuggc

SEQ ID NO: 2973604 - RNA, 16 nt, Human
gugguguuuccuggca

SEQ ID NO: 2973605 - RNA, 20 nt, Human
guggugguuuucuguucuuu

SEQ ID NO: 2973606 - RNA, 14 nt, Human
gugguggcaggcac

SEQ ID NO: 2973607 - RNA, 23 nt, Human
gugguggcaggcaccuguagucc

SEQ ID NO: 2973608 - RNA, 13 nt, Human
aagaauauuuuaa

SEQ ID NO: 2973609 - RNA, 17 nt, Human
guggcagcugcggucca

SEQ ID NO: 2973610 - RNA, 13 nt, Human
aagacccaaaagg

SEQ ID NO: 2973611 - RNA, 24 nt, Human
aagaauuucuaggacugaauuaug

SEQ ID NO: 2973612 - RNA, 22 nt, Human
guggcagcucaccucucccuug

SEQ ID NO: 2973613 - RNA, 14 nt, Human
guggcagcugcggu

SEQ ID NO: 2973614 - RNA, 13 nt, Human
guggcaccagcag

SEQ ID NO: 2973615 - RNA, 14 nt, Human
guggcaccagcagc

SEQ ID NO: 2973616 - RNA, 23 nt, Human
guggauuuaacagaaauguacag

SEQ ID NO: 2973617 - RNA, 20 nt, Human
guggauuuaacagaaaugua

SEQ ID NO: 2973618 - RNA, 21 nt, Human
guggauuuaacagaaauguac

SEQ ID NO: 2973619 - RNA, 21 nt, Human
gugcugcccugcccaccuggc

SEQ ID NO: 2973620 - RNA, 19 nt, Human
gugcugcccugcccaccug

SEQ ID NO: 2973621 - RNA, 20 nt, Human
gugcugcccugcccaccugg

SEQ ID NO: 2973622 - RNA, 18 nt, Human
gugcugcccugcccaccu

SEQ ID NO: 2973623 - RNA, 24 nt, Human
guggacacagcucuucuccaggcu

SEQ ID NO: 2973624 - RNA, 15 nt, Human
guggacacagcucuu

SEQ ID NO: 2973625 - RNA, 14 nt, Human
guggacacagcucu

SEQ ID NO: 2973626 - RNA, 13 nt, Human
aagaaaauaucac

SEQ ID NO: 2973627 - RNA, 16 nt, Human
aagaagcccaggaaag

SEQ ID NO: 2973628 - RNA, 17 nt, Human
aagaagcccaggaaagg

SEQ ID NO: 2973629 - RNA, 22 nt, Human
aagaagcaccaaucaugaauua

SEQ ID NO: 2973630 - RNA, 14 nt, Human
aagaagcucucucc

SEQ ID NO: 2973631 - RNA, 15 nt, Human
aagaagcucucuccu

SEQ ID NO: 2973632 - RNA, 20 nt, Human
aagaaaaaggaugcacagag

SEQ ID NO: 2973633 - RNA, 19 nt, Human
aagaaaaaggaugcacaga

SEQ ID NO: 2973634 - RNA, 22 nt, Human
aagaaaaaggaugcacagaguu

SEQ ID NO: 2973635 - RNA, 18 nt, Human
aagaaaaguuuauaaaag

SEQ ID NO: 2973636 - RNA, 23 nt, Human
aacuugguucccauuugcuccuu

SEQ ID NO: 2973637 - RNA, 22 nt, Human
aacuugucuuuggacccugagg

SEQ ID NO: 2973638 - RNA, 14 nt, Human
aacuuggcgcugcc

SEQ ID NO: 2973639 - RNA, 21 nt, Human
gugccuggguggaugggccac

SEQ ID NO: 2973640 - RNA, 15 nt, Human
gugccucugggacug

SEQ ID NO: 2973641 - RNA, 14 nt, Human
gugccucugggacu

SEQ ID NO: 2973642 - RNA, 22 nt, Human
gugcauuugaggucuguucuuu

SEQ ID NO: 2973643 - RNA, 21 nt, Human
gugcauuugaggucuguucuu

SEQ ID NO: 2973644 - RNA, 20 nt, Human
gugcauuugaggucuguucu

SEQ ID NO: 2973645 - RNA, 20 nt, Human
gugcacuaauguguaagaca

SEQ ID NO: 2973646 - RNA, 15 nt, Human
gugcauuuggugguu

SEQ ID NO: 2973647 - RNA, 14 nt, Human
gugccaagcagagg

SEQ ID NO: 2973648 - RNA, 17 nt, Human
gugcacacaccagagcc

SEQ ID NO: 2973649 - RNA, 23 nt, Human
gugcacaagcuccaagcucccag

SEQ ID NO: 2973650 - RNA, 18 nt, Human
gugcacguacacacacau

SEQ ID NO: 2973651 - RNA, 14 nt, Human
gugcacacaccaga

SEQ ID NO: 2973652 - RNA, 12 nt, Human
gugcacacacca

SEQ ID NO: 2973653 - RNA, 12 nt, Human
guuuggccagaa

SEQ ID NO: 2973654 - RNA, 18 nt, Human
guuuggccagaagucaag

SEQ ID NO: 2973655 - RNA, 23 nt, Human
guuuggccagaagucaaggcuua

SEQ ID NO: 2973656 - RNA, 11 nt, Human
guuuggccaga

SEQ ID NO: 2973657 - RNA, 16 nt, Human
guuuuaagaggcaggg

SEQ ID NO: 2973658 - RNA, 14 nt, Human
guuuuaagaggcag

SEQ ID NO: 2973659 - RNA, 15 nt, Human
guuuucugagaaaga

SEQ ID NO: 2973660 - RNA, 22 nt, Human
guuuuauaauuuugugaagcaa

SEQ ID NO: 2973661 - RNA, 15 nt, Human
guuuuauaauuuugu

SEQ ID NO: 2973662 - RNA, 16 nt, Human
guuuuacugcagcuuu

SEQ ID NO: 2973663 - RNA, 18 nt, Human
guuuuacugcagcuuugu

SEQ ID NO: 2973664 - RNA, 15 nt, Human
guuuuacugcagcuu

SEQ ID NO: 2973665 - RNA, 13 nt, Human
guuugcuaaguga

SEQ ID NO: 2973666 - RNA, 17 nt, Human
guuugccucugccucug

SEQ ID NO: 2973667 - RNA, 18 nt, Human
guuucugccgcagcccug

SEQ ID NO: 2973668 - RNA, 22 nt, Human
guuucugccgcagcccugcaga

SEQ ID NO: 2973669 - RNA, 16 nt, Human
aagggcccuuuuucaa

SEQ ID NO: 2973670 - RNA, 22 nt, Human
aagggcccuuuuucaauaacug

SEQ ID NO: 2973671 - RNA, 16 nt, Human
aaggguaucuggugac

SEQ ID NO: 2973672 - RNA, 19 nt, Human
aaggguaucaggugcugcc

SEQ ID NO: 2973673 - RNA, 14 nt, Human
aaggggcaguggug

SEQ ID NO: 2973674 - RNA, 17 nt, Human
aaggguaucaggugcug

SEQ ID NO: 2973675 - RNA, 13 nt, Human
aagggcccagaga

SEQ ID NO: 2973676 - RNA, 15 nt, Human
aagggcccagagagg

SEQ ID NO: 2973677 - RNA, 21 nt, Human
guuucuagcaugaagacagag

SEQ ID NO: 2973678 - RNA, 17 nt, Human
aaguaaaaccacagcag

SEQ ID NO: 2973679 - RNA, 18 nt, Human
aaguaaaaccacagcagu

SEQ ID NO: 2973680 - RNA, 21 nt, Human
aagggugaugggaaagcauug

SEQ ID NO: 2973681 - RNA, 15 nt, Human
aaguaaaaccacagc

SEQ ID NO: 2973682 - RNA, 16 nt, Human
aaguaaaaccacagca

SEQ ID NO: 2973683 - RNA, 14 nt, Human
aaguaaaaccacag

SEQ ID NO: 2973684 - RNA, 13 nt, Human
aagucaaggcuua

SEQ ID NO: 2973685 - RNA, 22 nt, Human
aagucaaggcuuagacccucau

SEQ ID NO: 2973686 - RNA, 21 nt, Human
aagucaagugaaaaaggagga

SEQ ID NO: 2973687 - RNA, 24 nt, Human
aagucacacaguauuacuucugcu

SEQ ID NO: 2973688 - RNA, 19 nt, Human
aaguauucuuauuuaauga

SEQ ID NO: 2973689 - RNA, 18 nt, Human
aaguauucuuauuuaaug

SEQ ID NO: 2973690 - RNA, 13 nt, Human
aagucacacagug

SEQ ID NO: 2973691 - RNA, 20 nt, Human
aagucacauuccugaacagg

SEQ ID NO: 2973692 - RNA, 21 nt, Human
aaguauguuagugcaaauugu

SEQ ID NO: 2973693 - RNA, 23 nt, Human
aaguauguuagugcaaauuguca

SEQ ID NO: 2973694 - RNA, 23 nt, Human
aaguacuucuccacccugcucuc

SEQ ID NO: 2973695 - RNA, 22 nt, Human
aaguacuucuccacccugcucu

SEQ ID NO: 2973696 - RNA, 20 nt, Human
aaguacuucuccacccugcu

SEQ ID NO: 2973697 - RNA, 16 nt, Human
guuuucugagaaagac

SEQ ID NO: 2973698 - RNA, 17 nt, Human
guuuucugagaaagacu

SEQ ID NO: 2973699 - RNA, 15 nt, Human
aaguacuauguauca

SEQ ID NO: 2973700 - RNA, 22 nt, Human
guuuucugagaaagacuauuca

SEQ ID NO: 2973701 - RNA, 16 nt, Human
aaguacuauguaucaa

SEQ ID NO: 2973702 - RNA, 15 nt, Human
aaguacuggagaaaa

SEQ ID NO: 2973703 - RNA, 21 nt, Human
aaguacuucuccacccugcuc

SEQ ID NO: 2973704 - RNA, 23 nt, Human
guuuuuuaagggcccuuuuucaa

SEQ ID NO: 2973705 - RNA, 23 nt, Human
guuuuuuuuuaaaaaagaaacau

SEQ ID NO: 2973706 - RNA, 16 nt, Human
guuuuugucuuaaaaa

SEQ ID NO: 2973707 - RNA, 17 nt, Human
aagucuuagauguauau

SEQ ID NO: 2973708 - RNA, 19 nt, Human
aagucuuagauguauauau

SEQ ID NO: 2973709 - RNA, 18 nt, Human
aagucuuagauguauaua

SEQ ID NO: 2973710 - RNA, 18 nt, Human
guuuuucuaggccugggg

SEQ ID NO: 2973711 - RNA, 23 nt, Human
guugcuaacagcaacacaaagcu

SEQ ID NO: 2973712 - RNA, 16 nt, Human
guugcccaggcuggcg

SEQ ID NO: 2973713 - RNA, 15 nt, Human
guugcccaggcuggc

SEQ ID NO: 2973714 - RNA, 23 nt, Human
guuggcugggggccucagugcca

SEQ ID NO: 2973715 - RNA, 17 nt, Human
guugggcuggugucacc

SEQ ID NO: 2973716 - RNA, 15 nt, Human
guugggcugguguca

SEQ ID NO: 2973717 - RNA, 19 nt, Human
aaggaugcccaaagaugca

SEQ ID NO: 2973718 - RNA, 14 nt, Human
aaggaugcccaaag

SEQ ID NO: 2973719 - RNA, 22 nt, Human
aaggaugcacagaguuguuaca

SEQ ID NO: 2973720 - RNA, 24 nt, Human
aaggaugcacagaguuguuacauu

SEQ ID NO: 2973721 - RNA, 14 nt, Human
aaggccccgcccag

SEQ ID NO: 2973722 - RNA, 16 nt, Human
aaggccccgcccaggc

SEQ ID NO: 2973723 - RNA, 19 nt, Human
aaggccccgcccaggcuua

SEQ ID NO: 2973724 - RNA, 15 nt, Human
aaggcuaccuuugua

SEQ ID NO: 2973725 - RNA, 14 nt, Human
guugcccaggcugg

SEQ ID NO: 2973726 - RNA, 13 nt, Human
aaggcuaccuuug

SEQ ID NO: 2973727 - RNA, 20 nt, Human
aaggccugucagcuaaagaa

SEQ ID NO: 2973728 - RNA, 20 nt, Human
aaggaggaagagaaaaaaua

SEQ ID NO: 2973729 - RNA, 20 nt, Human
aaggauccugagccagauuu

SEQ ID NO: 2973730 - RNA, 22 nt, Human
aaggauccugagccagauuuca

SEQ ID NO: 2973731 - RNA, 11 nt, Human
aaggauccuga

SEQ ID NO: 2973732 - RNA, 12 nt, Human
aaggauccugag

SEQ ID NO: 2973733 - RNA, 17 nt, Human
aaggagauuuacaacug

SEQ ID NO: 2973734 - RNA, 18 nt, Human
aaggagauuuacaacugg

SEQ ID NO: 2973735 - RNA, 15 nt, Human
aaggaaacccagcuc

SEQ ID NO: 2973736 - RNA, 18 nt, Human
guucuccagucauuaugu

SEQ ID NO: 2973737 - RNA, 20 nt, Human
guucuccagucauuauguua

SEQ ID NO: 2973738 - RNA, 14 nt, Human
guucucugaggaca

SEQ ID NO: 2973739 - RNA, 11 nt, Human
guucucugccc

SEQ ID NO: 2973740 - RNA, 16 nt, Human
guucucugaggacacu

SEQ ID NO: 2973741 - RNA, 12 nt, Human
guucucugcccu

SEQ ID NO: 2973742 - RNA, 13 nt, Human
guugaauuuuaca

SEQ ID NO: 2973743 - RNA, 23 nt, Human
guugauagcacagacccugcccu

SEQ ID NO: 2973744 - RNA, 22 nt, Human
guugauagcacagacccugccc

SEQ ID NO: 2973745 - RNA, 16 nt, Human
aaggaaaaaauaacaa

SEQ ID NO: 2973746 - RNA, 18 nt, Human
aagcuguuacugucuuca

SEQ ID NO: 2973747 - RNA, 13 nt, Human
aagcucugcuccu

SEQ ID NO: 2973748 - RNA, 12 nt, Human
aagcucccaggc

SEQ ID NO: 2973749 - RNA, 22 nt, Human
aagcucccaggcauuccccagg

SEQ ID NO: 2973750 - RNA, 23 nt, Human
aagcucccaggcauuccccagga

SEQ ID NO: 2973751 - RNA, 21 nt, Human
aagcucuacugaggugcuaug

SEQ ID NO: 2973752 - RNA, 11 nt, Human
aagcucccagg

SEQ ID NO: 2973753 - RNA, 13 nt, Human
guguuuauuguca

SEQ ID NO: 2973754 - RNA, 20 nt, Human
uaaacucugagugcaaacuu

SEQ ID NO: 2973755 - RNA, 12 nt, Human
uaaacucauuuc

SEQ ID NO: 2973756 - RNA, 17 nt, Human
uaaacucauuucuagca

SEQ ID NO: 2973757 - RNA, 22 nt, Human
uaaacuacauuagguugugaau

SEQ ID NO: 2973758 - RNA, 17 nt, Human
uaaacgucuuaaauauu

SEQ ID NO: 2973759 - RNA, 13 nt, Human
uaaacgucuuaaa

SEQ ID NO: 2973760 - RNA, 16 nt, Human
uaaaccgccaaggcug

SEQ ID NO: 2973761 - RNA, 18 nt, Human
uaaaccgccaaggcuggg

SEQ ID NO: 2973762 - RNA, 21 nt, Human
uaaaggcuaccuuuguauucu

SEQ ID NO: 2973763 - RNA, 19 nt, Human
uaaaggcuaccuuuguauu

SEQ ID NO: 2973764 - RNA, 18 nt, Human
uaaagaaguuugaacauu

SEQ ID NO: 2973765 - RNA, 14 nt, Human
uaaagaaguuugaa

SEQ ID NO: 2973766 - RNA, 13 nt, Human
uaaagaaguuuga

SEQ ID NO: 2973767 - RNA, 13 nt, Human
aaguuuugagaaa

SEQ ID NO: 2973768 - RNA, 19 nt, Human
uaaaccaaggcuagaacca

SEQ ID NO: 2973769 - RNA, 17 nt, Human
uaaacaaaauagaaagu

SEQ ID NO: 2973770 - RNA, 16 nt, Human
uaaacaaaauagaaag

SEQ ID NO: 2973771 - RNA, 15 nt, Human
uaaacaaaauagaaa

SEQ ID NO: 2973772 - RNA, 22 nt, Human
uaaacaaaauagaaaguugcaa

SEQ ID NO: 2973773 - RNA, 18 nt, Human
uaaacaaaauagaaaguu

SEQ ID NO: 2973774 - RNA, 16 nt, Human
uaaaauuauggaaaca

SEQ ID NO: 2973775 - RNA, 19 nt, Human
uaaaauuauggaaacagau

SEQ ID NO: 2973776 - RNA, 22 nt, Human
aaguucuaguguuuucaauuuu

SEQ ID NO: 2973777 - RNA, 21 nt, Human
aaguucuaguguuuucaauuu

SEQ ID NO: 2973778 - RNA, 14 nt, Human
aaguucuaguguuu

SEQ ID NO: 2973779 - RNA, 14 nt, Human
aaguuaaauaaauc

SEQ ID NO: 2973780 - RNA, 12 nt, Human
aaguuaaauaaa

SEQ ID NO: 2973781 - RNA, 16 nt, Human
uaaaugacucuucccu

SEQ ID NO: 2973782 - RNA, 21 nt, Human
uaaaucuccaaaauaaaacuu

SEQ ID NO: 2973783 - RNA, 20 nt, Human
uaaaucuccaaaauaaaacu

SEQ ID NO: 2973784 - RNA, 17 nt, Human
uaaaugauuucauucaa

SEQ ID NO: 2973785 - RNA, 15 nt, Human
uaaauguugacaugg

SEQ ID NO: 2973786 - RNA, 22 nt, Human
uaaauuaacuuuuauaaacuuu

SEQ ID NO: 2973787 - RNA, 17 nt, Human
uaacaaugcuguauuuu

SEQ ID NO: 2973788 - RNA, 15 nt, Human
uaacaaugcuguauu

SEQ ID NO: 2973789 - RNA, 13 nt, Human
uaacaaugcugua

SEQ ID NO: 2973790 - RNA, 13 nt, Human
uaacaagccaccc

SEQ ID NO: 2973791 - RNA, 15 nt, Human
aauacaccacuacau

SEQ ID NO: 2973792 - RNA, 14 nt, Human
aauacacacucaaa

SEQ ID NO: 2973793 - RNA, 20 nt, Human
aauacaccacuacauucugu

SEQ ID NO: 2973794 - RNA, 18 nt, Human
aauacaccacuacauucu

SEQ ID NO: 2973795 - RNA, 16 nt, Human
aauacaccacuacauu

SEQ ID NO: 2973796 - RNA, 19 nt, Human
uaaaucuccaaaauaaaac

SEQ ID NO: 2973797 - RNA, 12 nt, Human
uaaauagcuuuu

SEQ ID NO: 2973798 - RNA, 12 nt, Human
aauaaaaauaau

SEQ ID NO: 2973799 - RNA, 22 nt, Human
aauaaaauccauacauuugugu

SEQ ID NO: 2973800 - RNA, 14 nt, Human
aauaaaguaauuau

SEQ ID NO: 2973801 - RNA, 19 nt, Human
uaaaguguauuuuuuuacu

SEQ ID NO: 2973802 - RNA, 15 nt, Human
uaaaguguauuuuuu

SEQ ID NO: 2973803 - RNA, 14 nt, Human
uaaaguguauuuuu

SEQ ID NO: 2973804 - RNA, 13 nt, Human
uaaagucaggggu

SEQ ID NO: 2973805 - RNA, 19 nt, Human
aauaacauguaauuaagua

SEQ ID NO: 2973806 - RNA, 15 nt, Human
aauaacgauaaaaga

SEQ ID NO: 2973807 - RNA, 12 nt, Human
aauaacauguaa

SEQ ID NO: 2973808 - RNA, 22 nt, Human
aauaacagaagaaaauagaauu

SEQ ID NO: 2973809 - RNA, 15 nt, Human
aauaacaauaaaaga

SEQ ID NO: 2973810 - RNA, 12 nt, Human
aauaaaugugcc

SEQ ID NO: 2973811 - RNA, 21 nt, Human
aauaaaugugccuucauuuuu

SEQ ID NO: 2973812 - RNA, 12 nt, Human
aauaaauuauuu

SEQ ID NO: 2973813 - RNA, 19 nt, Human
aauaauguuucaaacauau

SEQ ID NO: 2973814 - RNA, 15 nt, Human
aauaagucugauuua

SEQ ID NO: 2973815 - RNA, 12 nt, Human
aauaagucugau

SEQ ID NO: 2973816 - RNA, 15 nt, Human
aauaacuaaaaggua

SEQ ID NO: 2973817 - RNA, 14 nt, Human
augcugccaauauc

SEQ ID NO: 2973818 - RNA, 17 nt, Human
augcugccaauauccua

SEQ ID NO: 2973819 - RNA, 18 nt, Human
augcugccaauauccuaa

SEQ ID NO: 2973820 - RNA, 19 nt, Human
augcugccaauauccuaau

SEQ ID NO: 2973821 - RNA, 13 nt, Human
augcugccaauau

SEQ ID NO: 2973822 - RNA, 20 nt, Human
augcugccaauauccuaaua

SEQ ID NO: 2973823 - RNA, 21 nt, Human
augcugccaauauccuaauaa

SEQ ID NO: 2973824 - RNA, 22 nt, Human
augcugccaauauccuaauaaa

SEQ ID NO: 2973825 - RNA, 23 nt, Human
augcugccaauauccuaauaaaa

SEQ ID NO: 2973826 - RNA, 11 nt, Human
augcugcccug

SEQ ID NO: 2973827 - RNA, 16 nt, Human
augcucuuuacuucau

SEQ ID NO: 2973828 - RNA, 15 nt, Human
auggauuuccagcca

SEQ ID NO: 2973829 - RNA, 21 nt, Human
auggaggacuccaggcagcag

SEQ ID NO: 2973830 - RNA, 19 nt, Human
auggaggacuccaggcagc

SEQ ID NO: 2973831 - RNA, 18 nt, Human
auggaggacuccaggcag

SEQ ID NO: 2973832 - RNA, 17 nt, Human
auggaggacuccaggca

SEQ ID NO: 2973833 - RNA, 12 nt, Human
augcuuguacau

SEQ ID NO: 2973834 - RNA, 14 nt, Human
augcuuguacauaa

SEQ ID NO: 2973835 - RNA, 13 nt, Human
augcuuguacaua

SEQ ID NO: 2973836 - RNA, 18 nt, Human
augcacagaguuguuaca

SEQ ID NO: 2973837 - RNA, 17 nt, Human
augcacagaguuguuac

SEQ ID NO: 2973838 - RNA, 16 nt, Human
augcacaaacagaggc

SEQ ID NO: 2973839 - RNA, 17 nt, Human
augcacaaacagaggcc

SEQ ID NO: 2973840 - RNA, 16 nt, Human
augcacagaguuguua

SEQ ID NO: 2973841 - RNA, 23 nt, Human
augcacacauuuuuuaaaugcac

SEQ ID NO: 2973842 - RNA, 17 nt, Human
augccucucucaggcca

SEQ ID NO: 2973843 - RNA, 16 nt, Human
augcaugaaguaauau

SEQ ID NO: 2973844 - RNA, 19 nt, Human
augccucucucaggccaaa

SEQ ID NO: 2973845 - RNA, 16 nt, Human
augaugccaugaggaa

SEQ ID NO: 2973846 - RNA, 17 nt, Human
augaugccaugaggaac

SEQ ID NO: 2973847 - RNA, 24 nt, Human
augauguuuuccaugaguccccug

SEQ ID NO: 2973848 - RNA, 15 nt, Human
augcacaaacagagg

SEQ ID NO: 2973849 - RNA, 20 nt, Human
auguucuccagucauuaugu

SEQ ID NO: 2973850 - RNA, 12 nt, Human
auguucugggac

SEQ ID NO: 2973851 - RNA, 11 nt, Human
auguucuggga

SEQ ID NO: 2973852 - RNA, 17 nt, Human
auguucuaagaagugaa

SEQ ID NO: 2973853 - RNA, 18 nt, Human
augugggcagugauguca

SEQ ID NO: 2973854 - RNA, 12 nt, Human
auguuuucaaau

SEQ ID NO: 2973855 - RNA, 15 nt, Human
auguuuucaaauguu

SEQ ID NO: 2973856 - RNA, 17 nt, Human
auguuuuauauagcaag

SEQ ID NO: 2973857 - RNA, 18 nt, Human
auguuuucaaauguucuc

SEQ ID NO: 2973858 - RNA, 21 nt, Human
auguuucaaacauauauaaca

SEQ ID NO: 2973859 - RNA, 16 nt, Human
auguuucacacaaaca

SEQ ID NO: 2973860 - RNA, 17 nt, Human
auguuucacacaaacaa

SEQ ID NO: 2973861 - RNA, 13 nt, Human
auguucugggaca

SEQ ID NO: 2973862 - RNA, 18 nt, Human
auguuugccucugccucu

SEQ ID NO: 2973863 - RNA, 22 nt, Human
auguuugccucugccucugaca

SEQ ID NO: 2973864 - RNA, 19 nt, Human
auguuugccucugccucug

SEQ ID NO: 2973865 - RNA, 17 nt, Human
auguaauuaaguacuau

SEQ ID NO: 2973866 - RNA, 15 nt, Human
auguaauuaaguacu

SEQ ID NO: 2973867 - RNA, 19 nt, Human
auguaagggaaacugccag

SEQ ID NO: 2973868 - RNA, 14 nt, Human
auguaagggaaacu

SEQ ID NO: 2973869 - RNA, 16 nt, Human
auguaagggaaacugc

SEQ ID NO: 2973870 - RNA, 17 nt, Human
auguauuuuugucaauu

SEQ ID NO: 2973871 - RNA, 19 nt, Human
auggucaccaaaucagcug

SEQ ID NO: 2973872 - RNA, 22 nt, Human
augugaaacuggauuaaacuua

SEQ ID NO: 2973873 - RNA, 21 nt, Human
augugaacaguuguguuugaa

SEQ ID NO: 2973874 - RNA, 11 nt, Human
augugaacagu

SEQ ID NO: 2973875 - RNA, 23 nt, Human
augugaacaguuguguuugaagc

SEQ ID NO: 2973876 - RNA, 14 nt, Human
augucuuuucuugc

SEQ ID NO: 2973877 - RNA, 21 nt, Human
aucuauauuuuacauaaauuu

SEQ ID NO: 2973878 - RNA, 17 nt, Human
aucuauauuuuacauaa

SEQ ID NO: 2973879 - RNA, 14 nt, Human
aucuauauuuuaca

SEQ ID NO: 2973880 - RNA, 21 nt, Human
aucucccccagccccauccuc

SEQ ID NO: 2973881 - RNA, 22 nt, Human
aucugcuuuuuaaagaaugcuc

SEQ ID NO: 2973882 - RNA, 22 nt, Human
aucuucugaacuuggcgcugcc

SEQ ID NO: 2973883 - RNA, 18 nt, Human
aucuugaagacuuuucuu

SEQ ID NO: 2973884 - RNA, 14 nt, Human
aucuucuuuauaau

SEQ ID NO: 2973885 - RNA, 17 nt, Human
aucuugaauuguaagga

SEQ ID NO: 2973886 - RNA, 19 nt, Human
augaaagacuguacaaagu

SEQ ID NO: 2973887 - RNA, 17 nt, Human
augaaagacuguacaaa

SEQ ID NO: 2973888 - RNA, 16 nt, Human
augaaagacuguacaa

SEQ ID NO: 2973889 - RNA, 13 nt, Human
augaaagacugua

SEQ ID NO: 2973890 - RNA, 21 nt, Human
augaccuuucaauaggaaaaa

SEQ ID NO: 2973891 - RNA, 18 nt, Human
augaccuuucaauaggaa

SEQ ID NO: 2973892 - RNA, 22 nt, Human
augaccuuucaauaggaaaaac

SEQ ID NO: 2973893 - RNA, 23 nt, Human
augaccuuucaauaggaaaaacu

SEQ ID NO: 2973894 - RNA, 11 nt, Human
auccuccaggu

SEQ ID NO: 2973895 - RNA, 23 nt, Human
auccucauacccacccccaccca

SEQ ID NO: 2973896 - RNA, 23 nt, Human
auccuccaggugcacaagcucca

SEQ ID NO: 2973897 - RNA, 15 nt, Human
auccucccaccucag

SEQ ID NO: 2973898 - RNA, 15 nt, Human
auccccuguagagug

SEQ ID NO: 2973899 - RNA, 15 nt, Human
auccagacccggcug

SEQ ID NO: 2973900 - RNA, 14 nt, Human
aucccauuuaaaaa

SEQ ID NO: 2973901 - RNA, 15 nt, Human
aucccauuuaaaaaa

SEQ ID NO: 2973902 - RNA, 19 nt, Human
auccucccaccucagccuc

SEQ ID NO: 2973903 - RNA, 18 nt, Human
auccucccaccucagccu

SEQ ID NO: 2973904 - RNA, 20 nt, Human
auccucccaccucagccucc

SEQ ID NO: 2973905 - RNA, 15 nt, Human
auauuuauuuuaaua

SEQ ID NO: 2973906 - RNA, 14 nt, Human
auauuuauuuuaau

SEQ ID NO: 2973907 - RNA, 17 nt, Human
auauuuauuuuaauaau

SEQ ID NO: 2973908 - RNA, 19 nt, Human
aucaccaacgucugugcca

SEQ ID NO: 2973909 - RNA, 23 nt, Human
aucacccgcuaagagggagggag

SEQ ID NO: 2973910 - RNA, 18 nt, Human
aucaccaacgucugugcc

SEQ ID NO: 2973911 - RNA, 21 nt, Human
aucacagccucugaaaaccaa

SEQ ID NO: 2973912 - RNA, 19 nt, Human
aucagccugcuccagcugu

SEQ ID NO: 2973913 - RNA, 17 nt, Human
aucagccugcuccagcu

SEQ ID NO: 2973914 - RNA, 18 nt, Human
aucagccugcuccagcug

SEQ ID NO: 2973915 - RNA, 21 nt, Human
aucagcugcugaaacaacaaa

SEQ ID NO: 2973916 - RNA, 19 nt, Human
aucaccgaaaacguggcug

SEQ ID NO: 2973917 - RNA, 21 nt, Human
aucaccgaaaacguggcugcu

SEQ ID NO: 2973918 - RNA, 14 nt, Human
aucaccgaaaacgu

SEQ ID NO: 2973919 - RNA, 20 nt, Human
aucagcacgauuucuguuua

SEQ ID NO: 2973920 - RNA, 19 nt, Human
aucagcacgauuucuguuu

SEQ ID NO: 2973921 - RNA, 23 nt, Human
aucagcacgauuucuguuuagau

SEQ ID NO: 2973922 - RNA, 22 nt, Human
aucagcugcugaaacaacaaau

SEQ ID NO: 2973923 - RNA, 23 nt, Human
aucagcugcugaaacaacaaaua

SEQ ID NO: 2973924 - RNA, 20 nt, Human
auaacaaaggauacuuauuu

SEQ ID NO: 2973925 - RNA, 21 nt, Human
auaacaaaggauacuuauuua

SEQ ID NO: 2973926 - RNA, 18 nt, Human
auaaaggauuaaugucaa

SEQ ID NO: 2973927 - RNA, 20 nt, Human
auaaagcagcguuucuauga

SEQ ID NO: 2973928 - RNA, 19 nt, Human
auaaagcagcguuucuaug

SEQ ID NO: 2973929 - RNA, 18 nt, Human
auaaagcagcguuucuau

SEQ ID NO: 2973930 - RNA, 14 nt, Human
auaaagcagcguuu

SEQ ID NO: 2973931 - RNA, 13 nt, Human
auaaagcagcguu

SEQ ID NO: 2973932 - RNA, 11 nt, Human
auaaaacuuuu

SEQ ID NO: 2973933 - RNA, 15 nt, Human
auaaaacuuuuuaaa

SEQ ID NO: 2973934 - RNA, 24 nt, Human
auaaacuuuaccuuuuuuauacau

SEQ ID NO: 2973935 - RNA, 16 nt, Human
auaaacuuuaccuuuu

SEQ ID NO: 2973936 - RNA, 21 nt, Human
auaaacuuuaccuuuuuuaua

SEQ ID NO: 2973937 - RNA, 17 nt, Human
auaaaacuuuuuaaaau

SEQ ID NO: 2973938 - RNA, 15 nt, Human
auaaugucccuucac

SEQ ID NO: 2973939 - RNA, 23 nt, Human
auaauguuucaaacauauauaac

SEQ ID NO: 2973940 - RNA, 15 nt, Human
auaauguaagcucua

SEQ ID NO: 2973941 - RNA, 18 nt, Human
auacaccacuacauucug

SEQ ID NO: 2973942 - RNA, 17 nt, Human
auacacacucaaaucaa

SEQ ID NO: 2973943 - RNA, 18 nt, Human
auacacacucaaaucaag

SEQ ID NO: 2973944 - RNA, 20 nt, Human
auacaccacuacauucuguu

SEQ ID NO: 2973945 - RNA, 19 nt, Human
auacaccacuacauucugu

SEQ ID NO: 2973946 - RNA, 21 nt, Human
auacaccacuacauucuguua

SEQ ID NO: 2973947 - RNA, 20 nt, Human
auaaugcgugcauaccacuu

SEQ ID NO: 2973948 - RNA, 21 nt, Human
auaaugcgugcauaccacuuu

SEQ ID NO: 2973949 - RNA, 14 nt, Human
auaauguaagcucu

SEQ ID NO: 2973950 - RNA, 12 nt, Human
auacccaccccc

SEQ ID NO: 2973951 - RNA, 11 nt, Human
auacccacccc

SEQ ID NO: 2973952 - RNA, 18 nt, Human
auaccugucccccugaca

SEQ ID NO: 2973953 - RNA, 17 nt, Human
auaccugucccccugac

SEQ ID NO: 2973954 - RNA, 15 nt, Human
auagcaguaaaaaau

SEQ ID NO: 2973955 - RNA, 21 nt, Human
auagcaguaaaaaaugguguu

SEQ ID NO: 2973956 - RNA, 18 nt, Human
auagcagcuuauucacaa

SEQ ID NO: 2973957 - RNA, 15 nt, Human
auagccaaggccaaa

SEQ ID NO: 2973958 - RNA, 21 nt, Human
auagccaaggccaaaggaagc

SEQ ID NO: 2973959 - RNA, 15 nt, Human
auagguuuaauaauu

SEQ ID NO: 2973960 - RNA, 14 nt, Human
auagguuuggacaa

SEQ ID NO: 2973961 - RNA, 18 nt, Human
auaguaugguggcugggu

SEQ ID NO: 2973962 - RNA, 17 nt, Human
auaguaugguggcuggg

SEQ ID NO: 2973963 - RNA, 14 nt, Human
auaggugcuacaaa

SEQ ID NO: 2973964 - RNA, 15 nt, Human
auaggugcuacaaaa

SEQ ID NO: 2973965 - RNA, 21 nt, Human
auaggugcuacaaaaacacag

SEQ ID NO: 2973966 - RNA, 23 nt, Human
auaggugcuacaaaaacacagca

SEQ ID NO: 2973967 - RNA, 14 nt, Human
auagucaaauugug

SEQ ID NO: 2973968 - RNA, 16 nt, Human
auauccuaauaaaaag

SEQ ID NO: 2973969 - RNA, 18 nt, Human
auauccuaauaaaaaggu

SEQ ID NO: 2973970 - RNA, 20 nt, Human
auauccuaauaaaaagguga

SEQ ID NO: 2973971 - RNA, 22 nt, Human
auaucccuuggacauuuuaugu

SEQ ID NO: 2973972 - RNA, 23 nt, Human
auaucccuuggacauuuuauguc

SEQ ID NO: 2973973 - RNA, 12 nt, Human
auauccuaauaa

SEQ ID NO: 2973974 - RNA, 13 nt, Human
auauccuaauaaa

SEQ ID NO: 2973975 - RNA, 14 nt, Human
auauccuaauaaaa

SEQ ID NO: 2973976 - RNA, 20 nt, Human
auaucccuuggacauuuuau

SEQ ID NO: 2973977 - RNA, 16 nt, Human
auauccaaguuugaau

SEQ ID NO: 2973978 - RNA, 21 nt, Human
auaugcuuauacacuuacacu

SEQ ID NO: 2973979 - RNA, 22 nt, Human
auaugcuucuguuuuauaauuu

SEQ ID NO: 2973980 - RNA, 20 nt, Human
auaugcuucuguuuuauaau

SEQ ID NO: 2973981 - RNA, 22 nt, Human
auauuaccacagacauacuaac

SEQ ID NO: 2973982 - RNA, 19 nt, Human
auauuaccacagacauacu

SEQ ID NO: 2973983 - RNA, 13 nt, Human
auauuuauuuuaa

SEQ ID NO: 2973984 - RNA, 19 nt, Human
auauuuacuucuuauacau

SEQ ID NO: 2973985 - RNA, 22 nt, Human
auauuuauuacuguaagaaaau

SEQ ID NO: 2973986 - RNA, 22 nt, Human
auauuauuugcagugcaguaua

SEQ ID NO: 2973987 - RNA, 16 nt, Human
auauuauguuaaaacu

SEQ ID NO: 2973988 - RNA, 19 nt, Human
auauauuuuuuucugaaau

SEQ ID NO: 2973989 - RNA, 19 nt, Human
agucaaauugugugaaagg

SEQ ID NO: 2973990 - RNA, 23 nt, Human
agucaaauugugugaaagguacu

SEQ ID NO: 2973991 - RNA, 11 nt, Human
aguaucuugaa

SEQ ID NO: 2973992 - RNA, 12 nt, Human
aguaucuugaag

SEQ ID NO: 2973993 - RNA, 15 nt, Human
aguaucuugaagacu

SEQ ID NO: 2973994 - RNA, 15 nt, Human
aguaucucagggccu

SEQ ID NO: 2973995 - RNA, 16 nt, Human
aguaugaggcauuugu

SEQ ID NO: 2973996 - RNA, 15 nt, Human
aguaugaggcauuug

SEQ ID NO: 2973997 - RNA, 12 nt, Human
agucugaaggcu

SEQ ID NO: 2973998 - RNA, 16 nt, Human
agucugaaggcugggu

SEQ ID NO: 2973999 - RNA, 13 nt, Human
agucugaaggcug

SEQ ID NO: 2974000 - RNA, 15 nt, Human
agucugaaggcuggg

SEQ ID NO: 2974001 - RNA, 12 nt, Human
aguccuguaaug

SEQ ID NO: 2974002 - RNA, 20 nt, Human
aguccuggcaugggaaugaa

SEQ ID NO: 2974003 - RNA, 21 nt, Human
aguccuggcaugggaaugaau

SEQ ID NO: 2974004 - RNA, 22 nt, Human
aguccuggcaugggaaugaaug

SEQ ID NO: 2974005 - RNA, 17 nt, Human
agucugcuuagaaauaa

SEQ ID NO: 2974006 - RNA, 20 nt, Human
agugaacuugggccacugug

SEQ ID NO: 2974007 - RNA, 17 nt, Human
agucuggaaugcagugg

SEQ ID NO: 2974008 - RNA, 18 nt, Human
agucugauucccaagcuc

SEQ ID NO: 2974009 - RNA, 16 nt, Human
agucugauucccaagc

SEQ ID NO: 2974010 - RNA, 16 nt, Human
agugaagacaaugacu

SEQ ID NO: 2974011 - RNA, 14 nt, Human
agugaagacaauga

SEQ ID NO: 2974012 - RNA, 22 nt, Human
aguugaaaaucuuauaauuuaa

SEQ ID NO: 2974013 - RNA, 21 nt, Human
aguugaaaagacuccaaagaa

SEQ ID NO: 2974014 - RNA, 22 nt, Human
aguucaucuugaauuguaagga

SEQ ID NO: 2974015 - RNA, 19 nt, Human
aguucagguaacaggcaga

SEQ ID NO: 2974016 - RNA, 18 nt, Human
aguucagguaacaggcag

SEQ ID NO: 2974017 - RNA, 20 nt, Human
aguucagguaacaggcagau

SEQ ID NO: 2974018 - RNA, 14 nt, Human
aguuacagacaaag

SEQ ID NO: 2974019 - RNA, 16 nt, Human
aguuacagacaaagcg

SEQ ID NO: 2974020 - RNA, 18 nt, Human
aguuacacuaaaagguga

SEQ ID NO: 2974021 - RNA, 12 nt, Human
aguuaaauaaau

SEQ ID NO: 2974022 - RNA, 20 nt, Human
aguuguuugauucagacagc

SEQ ID NO: 2974023 - RNA, 17 nt, Human
aguuguucugaaauguc

SEQ ID NO: 2974024 - RNA, 13 nt, Human
aguuguucugaaa

SEQ ID NO: 2974025 - RNA, 14 nt, Human
aguugaagacagag

SEQ ID NO: 2974026 - RNA, 16 nt, Human
aguuguguuugaagca

SEQ ID NO: 2974027 - RNA, 21 nt, Human
aguugugugaauaccccaaga

SEQ ID NO: 2974028 - RNA, 23 nt, Human
aguugaaaaucuuauaauuuaaa

SEQ ID NO: 2974029 - RNA, 22 nt, Human
aguugaaaagacuccaaagaaa

SEQ ID NO: 2974030 - RNA, 17 nt, Human
agugucuuaauuaaaag

SEQ ID NO: 2974031 - RNA, 18 nt, Human
agugucuuaauuaaaaga

SEQ ID NO: 2974032 - RNA, 15 nt, Human
agugucuuaauuaaa

SEQ ID NO: 2974033 - RNA, 18 nt, Human
aguguauuuuuuuacuaa

SEQ ID NO: 2974034 - RNA, 17 nt, Human
aguguauuuuuuuacua

SEQ ID NO: 2974035 - RNA, 16 nt, Human
aguguauuuugaaauu

SEQ ID NO: 2974036 - RNA, 14 nt, Human
agugggagcugccu

SEQ ID NO: 2974037 - RNA, 15 nt, Human
agugggagcugccug

SEQ ID NO: 2974038 - RNA, 23 nt, Human
aguggcuuaaaacaacacucaca

SEQ ID NO: 2974039 - RNA, 22 nt, Human
aggucuguuuuguguacuuuua

SEQ ID NO: 2974040 - RNA, 18 nt, Human
aggugcuacaaaaacaca

SEQ ID NO: 2974041 - RNA, 23 nt, Human
aggucuguucuuuccaaaguaca

SEQ ID NO: 2974042 - RNA, 22 nt, Human
aggucuguucuuuccaaaguac

SEQ ID NO: 2974043 - RNA, 19 nt, Human
aggugcuacaaaaacacag

SEQ ID NO: 2974044 - RNA, 20 nt, Human
aggugcuacaaaaacacagc

SEQ ID NO: 2974045 - RNA, 21 nt, Human
aggugcuacaaaaacacagca

SEQ ID NO: 2974046 - RNA, 22 nt, Human
aggugcuacaaaaacacagcaa

SEQ ID NO: 2974047 - RNA, 18 nt, Human
aggucuguucuuuccaaa

SEQ ID NO: 2974048 - RNA, 19 nt, Human
agguaaugaccaugaaaga

SEQ ID NO: 2974049 - RNA, 21 nt, Human
agguaaugaccaugaaagacu

SEQ ID NO: 2974050 - RNA, 20 nt, Human
agguaaugaccaugaaagac

SEQ ID NO: 2974051 - RNA, 20 nt, Human
agguaaaagcaucacaugaa

SEQ ID NO: 2974052 - RNA, 22 nt, Human
agguucccuuugacgccauccc

SEQ ID NO: 2974053 - RNA, 13 nt, Human
agguucccuuuga

SEQ ID NO: 2974054 - RNA, 14 nt, Human
agguucaaagauau

SEQ ID NO: 2974055 - RNA, 23 nt, Human
agguucccuuugacgccauccca

SEQ ID NO: 2974056 - RNA, 19 nt, Human
aggugcuaggaacacuccu

SEQ ID NO: 2974057 - RNA, 22 nt, Human
aggugcuaggaacacuccuuca

SEQ ID NO: 2974058 - RNA, 23 nt, Human
aggugcuacaaaaacacagcaag

SEQ ID NO: 2974059 - RNA, 24 nt, Human
aggugcuacaaaaacacagcaagg

SEQ ID NO: 2974060 - RNA, 23 nt, Human
aggugcuaggaacacuccuucac

SEQ ID NO: 2974061 - RNA, 16 nt, Human
agguuaaaaagaaaag

SEQ ID NO: 2974062 - RNA, 19 nt, Human
aggggccucuuaugggcug

SEQ ID NO: 2974063 - RNA, 20 nt, Human
aggggccucuuaugggcugg

SEQ ID NO: 2974064 - RNA, 21 nt, Human
aggggccucuuaugggcuggg

SEQ ID NO: 2974065 - RNA, 15 nt, Human
aggguaucuggugac

SEQ ID NO: 2974066 - RNA, 21 nt, Human
aggguaucaggugcugccauc

SEQ ID NO: 2974067 - RNA, 18 nt, Human
aggguaucaggugcugcc

SEQ ID NO: 2974068 - RNA, 19 nt, Human
aggguaucaggugcugcca

SEQ ID NO: 2974069 - RNA, 11 nt, Human
agggucccugg

SEQ ID NO: 2974070 - RNA, 17 nt, Human
aggcuacugucagcucc

SEQ ID NO: 2974071 - RNA, 21 nt, Human
aggcuagaaccaccugccuau

SEQ ID NO: 2974072 - RNA, 20 nt, Human
aggcccuucucuccagcccc

SEQ ID NO: 2974073 - RNA, 21 nt, Human
aggcccuucucuccagccccu

SEQ ID NO: 2974074 - RNA, 22 nt, Human
aggcccuucucuccagccccug

SEQ ID NO: 2974075 - RNA, 23 nt, Human
aggcccuucucuccagccccugg

SEQ ID NO: 2974076 - RNA, 22 nt, Human
aggcccuugucggccccaccag

SEQ ID NO: 2974077 - RNA, 16 nt, Human
aggcuagauguaugua

SEQ ID NO: 2974078 - RNA, 15 nt, Human
aggcuagauguaugu

SEQ ID NO: 2974079 - RNA, 20 nt, Human
aggcugucaauuacaggaag

SEQ ID NO: 2974080 - RNA, 19 nt, Human
aggcugucaauuacaggaa

SEQ ID NO: 2974081 - RNA, 18 nt, Human
aggcuguaucccaugagc

SEQ ID NO: 2974082 - RNA, 13 nt, Human
aggcuguauccca

SEQ ID NO: 2974083 - RNA, 22 nt, Human
agggacagaggggguggccucc

SEQ ID NO: 2974084 - RNA, 21 nt, Human
aggcugucaauuacaggaagu

SEQ ID NO: 2974085 - RNA, 23 nt, Human
agggacagaggggguggccuccc

SEQ ID NO: 2974086 - RNA, 23 nt, Human
aggagaagucuucuauuuauuua

SEQ ID NO: 2974087 - RNA, 22 nt, Human
aggagaagucuucuauuuauuu

SEQ ID NO: 2974088 - RNA, 13 nt, Human
aggaccucaggug

SEQ ID NO: 2974089 - RNA, 23 nt, Human
aggaugcuuguacauaaugcgug

SEQ ID NO: 2974090 - RNA, 21 nt, Human
aggaugcuuguacauaaugcg

SEQ ID NO: 2974091 - RNA, 23 nt, Human
aggaugguucccuugaugaagaa

SEQ ID NO: 2974092 - RNA, 22 nt, Human
aggauguucuagcauggcugcc

SEQ ID NO: 2974093 - RNA, 16 nt, Human
aggauguucugggaca

SEQ ID NO: 2974094 - RNA, 15 nt, Human
aggauguucugggac

SEQ ID NO: 2974095 - RNA, 17 nt, Human
aggauguugaaaaaguu

SEQ ID NO: 2974096 - RNA, 14 nt, Human
aggauuauuggaaa

SEQ ID NO: 2974097 - RNA, 12 nt, Human
agcuuuugcaua

SEQ ID NO: 2974098 - RNA, 21 nt, Human
aggaaucaugugccaagcaga

SEQ ID NO: 2974099 - RNA, 17 nt, Human
aggaauccagacccggc

SEQ ID NO: 2974100 - RNA, 20 nt, Human
aggaauccagacccggcugc

SEQ ID NO: 2974101 - RNA, 22 nt, Human
agcuccccucggagaagagcug

SEQ ID NO: 2974102 - RNA, 21 nt, Human
agcugcgguccacccaggagc

SEQ ID NO: 2974103 - RNA, 13 nt, Human
agcuccuucuguc

SEQ ID NO: 2974104 - RNA, 12 nt, Human
agcuccuucugu

SEQ ID NO: 2974105 - RNA, 21 nt, Human
agcuccgcuuucuacccagcg

SEQ ID NO: 2974106 - RNA, 20 nt, Human
agcuccgcuuucuacccagc

SEQ ID NO: 2974107 - RNA, 23 nt, Human
agcuccgcuuucuacccagcgag

SEQ ID NO: 2974108 - RNA, 23 nt, Human
agcugcgguccacccaggagccc

SEQ ID NO: 2974109 - RNA, 21 nt, Human
agacgugcacgcacacugucu

SEQ ID NO: 2974110 - RNA, 22 nt, Human
agacgugcacgcacacugucug

SEQ ID NO: 2974111 - RNA, 22 nt, Human
agacgcugugcugcccugccca

SEQ ID NO: 2974112 - RNA, 18 nt, Human
agacggagucccaccuug

SEQ ID NO: 2974113 - RNA, 21 nt, Human
agacgcugugcugcccugccc

SEQ ID NO: 2974114 - RNA, 11 nt, Human
agacagcucuu

SEQ ID NO: 2974115 - RNA, 12 nt, Human
agacagcucuua

SEQ ID NO: 2974116 - RNA, 12 nt, Human
agacagcugccu

SEQ ID NO: 2974117 - RNA, 14 nt, Human
agacagcccgggcu

SEQ ID NO: 2974118 - RNA, 15 nt, Human
agacagcccgggcuc

SEQ ID NO: 2974119 - RNA, 15 nt, Human
agacagauacuccuc

SEQ ID NO: 2974120 - RNA, 21 nt, Human
agacagauacuccuccaaggu

SEQ ID NO: 2974121 - RNA, 23 nt, Human
agacagagucucacuguugccca

SEQ ID NO: 2974122 - RNA, 21 nt, Human
agacugcauuauauuuauuac

SEQ ID NO: 2974123 - RNA, 16 nt, Human
agacuggaagcacagc

SEQ ID NO: 2974124 - RNA, 17 nt, Human
agacuggaagcacagcu

SEQ ID NO: 2974125 - RNA, 19 nt, Human
agacuggaagcacagcuuc

SEQ ID NO: 2974126 - RNA, 17 nt, Human
agagaacuuccagaucc

SEQ ID NO: 2974127 - RNA, 21 nt, Human
agagaggguggugaccucugc

SEQ ID NO: 2974128 - RNA, 20 nt, Human
agagaggguggugaccucug

SEQ ID NO: 2974129 - RNA, 22 nt, Human
agagaggguggugaccucugcc

SEQ ID NO: 2974130 - RNA, 16 nt, Human
agagcccacgccccca

SEQ ID NO: 2974131 - RNA, 13 nt, Human
agagcccacgccc

SEQ ID NO: 2974132 - RNA, 19 nt, Human
agagcccaccuuggcucaa

SEQ ID NO: 2974133 - RNA, 15 nt, Human
agagcccaggccucc

SEQ ID NO: 2974134 - RNA, 13 nt, Human
agagcccaggccu

SEQ ID NO: 2974135 - RNA, 14 nt, Human
agagcccaggccuc

SEQ ID NO: 2974136 - RNA, 14 nt, Human
agagugugccugaa

SEQ ID NO: 2974137 - RNA, 20 nt, Human
agagugugauguauguguaa

SEQ ID NO: 2974138 - RNA, 19 nt, Human
agaguggggauaugauuua

SEQ ID NO: 2974139 - RNA, 11 nt, Human
agagugggagc

SEQ ID NO: 2974140 - RNA, 12 nt, Human
agagggcacaga

SEQ ID NO: 2974141 - RNA, 22 nt, Human
agaggguggugaccucugccug

SEQ ID NO: 2974142 - RNA, 20 nt, Human
agaggguggugaccucugcc

SEQ ID NO: 2974143 - RNA, 19 nt, Human
agaggguggugaccucugc

SEQ ID NO: 2974144 - RNA, 15 nt, Human
agaggagagaggacc

SEQ ID NO: 2974145 - RNA, 16 nt, Human
agaggagagaggaccc

SEQ ID NO: 2974146 - RNA, 23 nt, Human
agaggacuuuucuuuguggcuuc

SEQ ID NO: 2974147 - RNA, 16 nt, Human
agaggaaggagaggag

SEQ ID NO: 2974148 - RNA, 14 nt, Human
agaucuucuguggg

SEQ ID NO: 2974149 - RNA, 19 nt, Human
agauauaugcucugcaugu

SEQ ID NO: 2974150 - RNA, 16 nt, Human
agcccucaauugugaa

SEQ ID NO: 2974151 - RNA, 17 nt, Human
agcccucaauugugaaa

SEQ ID NO: 2974152 - RNA, 16 nt, Human
agccccauucugccug

SEQ ID NO: 2974153 - RNA, 13 nt, Human
agccccauucugc

SEQ ID NO: 2974154 - RNA, 15 nt, Human
agccccagugcccac

SEQ ID NO: 2974155 - RNA, 14 nt, Human
agccccagugccca

SEQ ID NO: 2974156 - RNA, 13 nt, Human
agccccagugccc

SEQ ID NO: 2974157 - RNA, 18 nt, Human
agccagcaggcucucagg

SEQ ID NO: 2974158 - RNA, 19 nt, Human
agccagcaggcucucaggc

SEQ ID NO: 2974159 - RNA, 17 nt, Human
agccagcaggcucucag

SEQ ID NO: 2974160 - RNA, 20 nt, Human
agccagcaggcucucaggcc

SEQ ID NO: 2974161 - RNA, 16 nt, Human
agccgcccaaggccuu

SEQ ID NO: 2974162 - RNA, 15 nt, Human
agccgcccaaggccu

SEQ ID NO: 2974163 - RNA, 13 nt, Human
agccgcccaaggc

SEQ ID NO: 2974164 - RNA, 12 nt, Human
agccgcccaagg

SEQ ID NO: 2974165 - RNA, 13 nt, Human
agccgcuggggcc

SEQ ID NO: 2974166 - RNA, 21 nt, Human
agccgccaugcuccuggccca

SEQ ID NO: 2974167 - RNA, 19 nt, Human
agccucccgaguagcuggg

SEQ ID NO: 2974168 - RNA, 18 nt, Human
agccucccgaguagcugg

SEQ ID NO: 2974169 - RNA, 20 nt, Human
agccucccgaguagcuggga

SEQ ID NO: 2974170 - RNA, 14 nt, Human
agccuccuccagcc

SEQ ID NO: 2974171 - RNA, 21 nt, Human
agccucccaaagugcugggau

SEQ ID NO: 2974172 - RNA, 22 nt, Human
agccucccacgacugcccggca

SEQ ID NO: 2974173 - RNA, 22 nt, Human
agccgggcgugguggcaggcac

SEQ ID NO: 2974174 - RNA, 15 nt, Human
agcaugaagacagag

SEQ ID NO: 2974175 - RNA, 23 nt, Human
agcauccuggcacccggccccug

SEQ ID NO: 2974176 - RNA, 22 nt, Human
agcauccuggcacccggccccu

SEQ ID NO: 2974177 - RNA, 18 nt, Human
agcauccuggcacccggc

SEQ ID NO: 2974178 - RNA, 23 nt, Human
agccaagugugguagagugugcc

SEQ ID NO: 2974179 - RNA, 20 nt, Human
agcaugccuggauggggcug

SEQ ID NO: 2974180 - RNA, 23 nt, Human
agcaugccuggauggggcugcac

SEQ ID NO: 2974181 - RNA, 20 nt, Human
agcaguucagagcugcccuc

SEQ ID NO: 2974182 - RNA, 23 nt, Human
agcaguucagagcugcccucucc

SEQ ID NO: 2974183 - RNA, 13 nt, Human
agcaguugaaaag

SEQ ID NO: 2974184 - RNA, 16 nt, Human
agcaguugaaaagacu

SEQ ID NO: 2974185 - RNA, 16 nt, Human
agcacugacuucuaag

SEQ ID NO: 2974186 - RNA, 18 nt, Human
agcacagacccugcccug

SEQ ID NO: 2974187 - RNA, 19 nt, Human
agcacagacccugcccugu

SEQ ID NO: 2974188 - RNA, 20 nt, Human
agcacagacccugcccugug

SEQ ID NO: 2974189 - RNA, 17 nt, Human
agcacagacccugcccu

SEQ ID NO: 2974190 - RNA, 20 nt, Human
agcacacuggcucacccagu

SEQ ID NO: 2974191 - RNA, 23 nt, Human
agcacacuugacaucaacugcau

SEQ ID NO: 2974192 - RNA, 19 nt, Human
agcacacuggcucacccag

SEQ ID NO: 2974193 - RNA, 12 nt, Human
agcacacuggcu

SEQ ID NO: 2974194 - RNA, 18 nt, Human
agcagugcaugcuguccc

SEQ ID NO: 2974195 - RNA, 19 nt, Human
agcagugcaugcugucccu

SEQ ID NO: 2974196 - RNA, 20 nt, Human
agcagugcaugcugucccuu

SEQ ID NO: 2974197 - RNA, 13 nt, Human
agcagcguuucua

SEQ ID NO: 2974198 - RNA, 11 nt, Human
aagauucuaug

SEQ ID NO: 2974199 - RNA, 14 nt, Human
aagcagcguuucua

SEQ ID NO: 2974200 - RNA, 20 nt, Human
aagcagcguuucuaugacac

SEQ ID NO: 2974201 - RNA, 17 nt, Human
aagcagcguuucuauga

SEQ ID NO: 2974202 - RNA, 19 nt, Human
aagccagcaggcucucagg

SEQ ID NO: 2974203 - RNA, 22 nt, Human
aagcagcguuucuaugacacau

SEQ ID NO: 2974204 - RNA, 21 nt, Human
aagcagcguuucuaugacaca

SEQ ID NO: 2974205 - RNA, 20 nt, Human
aagccagcaggcucucaggc

SEQ ID NO: 2974206 - RNA, 23 nt, Human
aagccagcaggcucucaggccag

SEQ ID NO: 2974207 - RNA, 13 nt, Human
aagauacugaaau

SEQ ID NO: 2974208 - RNA, 13 nt, Human
aagauaaaugugc

SEQ ID NO: 2974209 - RNA, 23 nt, Human
aagauacaguuacucagaauucu

SEQ ID NO: 2974210 - RNA, 12 nt, Human
aagauaaaugug

SEQ ID NO: 2974211 - RNA, 17 nt, Human
aagcgauucuucugcuu

SEQ ID NO: 2974212 - RNA, 21 nt, Human
aagcgauucuucugcuucagc

SEQ ID NO: 2974213 - RNA, 20 nt, Human
aaggcagcucuaaaugucaa

SEQ ID NO: 2974214 - RNA, 15 nt, Human
aaggauugcuacugu

SEQ ID NO: 2974215 - RNA, 15 nt, Human
aaggauguucuagca

SEQ ID NO: 2974216 - RNA, 13 nt, Human
aaggacacuagaa

SEQ ID NO: 2974217 - RNA, 21 nt, Human
aagcuggucccacucagucca

SEQ ID NO: 2974218 - RNA, 18 nt, Human
aagcuggucccacucagu

SEQ ID NO: 2974219 - RNA, 15 nt, Human
aagcugggcagguug

SEQ ID NO: 2974220 - RNA, 17 nt, Human
aagcuacugccauccug

SEQ ID NO: 2974221 - RNA, 22 nt, Human
aagcuacugccauccuggccca

SEQ ID NO: 2974222 - RNA, 12 nt, Human
aaggugcaucug

SEQ ID NO: 2974223 - RNA, 20 nt, Human
aaguagaagucuuagaugua

SEQ ID NO: 2974224 - RNA, 19 nt, Human
aaguagaagucuuagaugu

SEQ ID NO: 2974225 - RNA, 21 nt, Human
aaguagggacuucugucuuca

SEQ ID NO: 2974226 - RNA, 21 nt, Human
aaguagaagucuuagauguau

SEQ ID NO: 2974227 - RNA, 23 nt, Human
aaguaucccuacuguaauuugug

SEQ ID NO: 2974228 - RNA, 18 nt, Human
aaguaucccuacuguaau

SEQ ID NO: 2974229 - RNA, 17 nt, Human
aaguaucccuacuguaa

SEQ ID NO: 2974230 - RNA, 17 nt, Human
aaguccaagcauaccaa

SEQ ID NO: 2974231 - RNA, 18 nt, Human
aaguccaagcauuuagau

SEQ ID NO: 2974232 - RNA, 18 nt, Human
aaguccucuuuucugaga

SEQ ID NO: 2974233 - RNA, 22 nt, Human
aaguccucuuuucugagaggac

SEQ ID NO: 2974234 - RNA, 20 nt, Human
aagucuagguugguagaguu

SEQ ID NO: 2974235 - RNA, 16 nt, Human
aagggaaacugccagc

SEQ ID NO: 2974236 - RNA, 17 nt, Human
aagggaaacugccagca

SEQ ID NO: 2974237 - RNA, 23 nt, Human
aagggaaacugccagcaacgcag

SEQ ID NO: 2974238 - RNA, 19 nt, Human
aaggucauuuuuuuuaaga

SEQ ID NO: 2974239 - RNA, 18 nt, Human
aaggucauuuuuuuuaag

SEQ ID NO: 2974240 - RNA, 19 nt, Human
aaguggaaaaauagccugc

SEQ ID NO: 2974241 - RNA, 21 nt, Human
aaguggaaaaauagccugccu

SEQ ID NO: 2974242 - RNA, 12 nt, Human
aaguugaauuuu

SEQ ID NO: 2974243 - RNA, 23 nt, Human
aaugccuuacccucauguucuua

SEQ ID NO: 2974244 - RNA, 18 nt, Human
aaugcgugcauaccacuu

SEQ ID NO: 2974245 - RNA, 19 nt, Human
aaugcgugcauaccacuuu

SEQ ID NO: 2974246 - RNA, 23 nt, Human
aauguuucaaacauauauaacaa

SEQ ID NO: 2974247 - RNA, 16 nt, Human
aauguuugccucugcc

SEQ ID NO: 2974248 - RNA, 15 nt, Human
aauguuugccucugc

SEQ ID NO: 2974249 - RNA, 15 nt, Human
aaugugaaaagaaaa

SEQ ID NO: 2974250 - RNA, 16 nt, Human
aaugauuaauuaaaac

SEQ ID NO: 2974251 - RNA, 21 nt, Human
aaugauuaugaauuacauuug

SEQ ID NO: 2974252 - RNA, 15 nt, Human
aaugauuaugaauua

SEQ ID NO: 2974253 - RNA, 18 nt, Human
aaucucaaauuucuaaau

SEQ ID NO: 2974254 - RNA, 17 nt, Human
aaucucaaauuucuaaa

SEQ ID NO: 2974255 - RNA, 21 nt, Human
aaucucugauucccugauuua

SEQ ID NO: 2974256 - RNA, 15 nt, Human
aaucucaaauuucua

SEQ ID NO: 2974257 - RNA, 16 nt, Human
aaucucaaauuucuaa

SEQ ID NO: 2974258 - RNA, 17 nt, Human
aauccagacccggcugc

SEQ ID NO: 2974259 - RNA, 19 nt, Human
aauccagacccggcugcgu

SEQ ID NO: 2974260 - RNA, 15 nt, Human
aaucaccgaaaacgu

SEQ ID NO: 2974261 - RNA, 14 nt, Human
aaucaccgaaaacg

SEQ ID NO: 2974262 - RNA, 15 nt, Human
aauauguuucacaca

SEQ ID NO: 2974263 - RNA, 13 nt, Human
aauauguuucaca

SEQ ID NO: 2974264 - RNA, 22 nt, Human
aauagaauugacauugaaaucu

SEQ ID NO: 2974265 - RNA, 21 nt, Human
aauagaauugacauugaaauc

SEQ ID NO: 2974266 - RNA, 15 nt, Human
aauagaauugacauu

SEQ ID NO: 2974267 - RNA, 13 nt, Human
aauagacaauuua

SEQ ID NO: 2974268 - RNA, 20 nt, Human
aauacucuacccucuuagaa

SEQ ID NO: 2974269 - RNA, 22 nt, Human
aauacucuacccucuuagaaaa

SEQ ID NO: 2974270 - RNA, 13 nt, Human
aauacucuuauau

SEQ ID NO: 2974271 - RNA, 22 nt, Human
aacagcaacacaaagcuuuugc

SEQ ID NO: 2974272 - RNA, 16 nt, Human
aacccgggaggcagag

SEQ ID NO: 2974273 - RNA, 21 nt, Human
aaccgaacugauguaaguaaa

SEQ ID NO: 2974274 - RNA, 22 nt, Human
aaccacuggaaaguuuaugguu

SEQ ID NO: 2974275 - RNA, 15 nt, Human
aaccacuucagcuga

SEQ ID NO: 2974276 - RNA, 13 nt, Human
aaccacgcuggac

SEQ ID NO: 2974277 - RNA, 15 nt, Human
aacacauuaaaggua

SEQ ID NO: 2974278 - RNA, 20 nt, Human
aacacauuaaagguacuuug

SEQ ID NO: 2974279 - RNA, 21 nt, Human
aacacaucuaguaguuguucu

SEQ ID NO: 2974280 - RNA, 18 nt, Human
aacaaauuuacagagaca

SEQ ID NO: 2974281 - RNA, 16 nt, Human
aacacaucagcuugcc

SEQ ID NO: 2974282 - RNA, 14 nt, Human
aaauguuuauuuaa

SEQ ID NO: 2974283 - RNA, 18 nt, Human
aaauguuuauuuaaaaga

SEQ ID NO: 2974284 - RNA, 17 nt, Human
aaauguuuauuuaaaag

SEQ ID NO: 2974285 - RNA, 15 nt, Human
aaauguuuauuuaaa

SEQ ID NO: 2974286 - RNA, 22 nt, Human
aaauguuuauuuaaaagagcag

SEQ ID NO: 2974287 - RNA, 22 nt, Human
aaauguuguucucuucuuuaaa

SEQ ID NO: 2974288 - RNA, 17 nt, Human
aaaucuuauaauuuaaa

SEQ ID NO: 2974289 - RNA, 23 nt, Human
aaaugccuuacccucauguucuu

SEQ ID NO: 2974290 - RNA, 18 nt, Human
aaauucuugcaaaguauc

SEQ ID NO: 2974291 - RNA, 21 nt, Human
aaauucuugcaaaguaucccu

SEQ ID NO: 2974292 - RNA, 13 nt, Human
aaauucuuucauu

SEQ ID NO: 2974293 - RNA, 19 nt, Human
aaauugacacuuaaaaaug

SEQ ID NO: 2974294 - RNA, 20 nt, Human
aacuuuaugcuaagugaaau

SEQ ID NO: 2974295 - RNA, 21 nt, Human
aacuuuaugcuaagugaaaua

SEQ ID NO: 2974296 - RNA, 16 nt, Human
aacuuaaucuaaaugg

SEQ ID NO: 2974297 - RNA, 15 nt, Human
aacuuaaucuaaaug

SEQ ID NO: 2974298 - RNA, 18 nt, Human
aacuuaaucuaaauggaa

SEQ ID NO: 2974299 - RNA, 13 nt, Human
aacuuaaugaaaa

SEQ ID NO: 2974300 - RNA, 20 nt, Human
aacugacucuuaagaagacu

SEQ ID NO: 2974301 - RNA, 19 nt, Human
aacugacucuuaagaagac

SEQ ID NO: 2974302 - RNA, 20 nt, Human
aacugagaugugaacacauc

SEQ ID NO: 2974303 - RNA, 18 nt, Human
aacugacucuuaagaaga

SEQ ID NO: 2974304 - RNA, 15 nt, Human
aacugacucuuaaga

SEQ ID NO: 2974305 - RNA, 19 nt, Human
aacuuaaauaaugugaaac

SEQ ID NO: 2974306 - RNA, 14 nt, Human
aacugauaaagaug

SEQ ID NO: 2974307 - RNA, 19 nt, Human
aaacacugguuuuaaauau

SEQ ID NO: 2974308 - RNA, 16 nt, Human
aaacacuguucucugc

SEQ ID NO: 2974309 - RNA, 22 nt, Human
aaaaucucaaauuucuaaaucu

SEQ ID NO: 2974310 - RNA, 19 nt, Human
aaaaucucaaauuucuaaa

SEQ ID NO: 2974311 - RNA, 16 nt, Human
aaaaucucaauauuuc

SEQ ID NO: 2974312 - RNA, 16 nt, Human
aaaaagaaacauuugg

SEQ ID NO: 2974313 - RNA, 15 nt, Human
aaaaagaaaggaggg

SEQ ID NO: 2974314 - RNA, 17 nt, Human
aaaauaaaacuuuuuaa

SEQ ID NO: 2974315 - RNA, 18 nt, Human
aaaaguucugcagauaaa

SEQ ID NO: 2974316 - RNA, 21 nt, Human
aaaaucuacacuccagugaga

SEQ ID NO: 2974317 - RNA, 22 nt, Human
aaaaucccuuaccucggugccu

SEQ ID NO: 2974318 - RNA, 13 nt, Human
aaacucugagugc

SEQ ID NO: 2974319 - RNA, 15 nt, Human
aaacucugagugcaa

SEQ ID NO: 2974320 - RNA, 21 nt, Human
aaacugagaugugaacacauc

SEQ ID NO: 2974321 - RNA, 23 nt, Human
aaacugagaugugaacacaucag

SEQ ID NO: 2974322 - RNA, 11 nt, Human
aaacugagcau

SEQ ID NO: 2974323 - RNA, 14 nt, Human
aaagaguaggaaga

SEQ ID NO: 2974324 - RNA, 23 nt, Human
aaagaaggcauggacuucuggau

SEQ ID NO: 2974325 - RNA, 16 nt, Human
aaagaagcagaccauu

SEQ ID NO: 2974326 - RNA, 13 nt, Human
aaagaagcagacc

SEQ ID NO: 2974327 - RNA, 15 nt, Human
aaagaaauguaaggg

SEQ ID NO: 2974328 - RNA, 17 nt, Human
aaagauauuuugcuuug

SEQ ID NO: 2974329 - RNA, 16 nt, Human
aaagauauuuugcuuu

SEQ ID NO: 2974330 - RNA, 12 nt, Human
aaagauauuuug

SEQ ID NO: 2974331 - RNA, 18 nt, Human
aaaccaucauugaaaucu

SEQ ID NO: 2974332 - RNA, 21 nt, Human
aaacccgucucuacuaaaaau

SEQ ID NO: 2974333 - RNA, 20 nt, Human
aaacccgucucuacuaaaaa

SEQ ID NO: 2974334 - RNA, 18 nt, Human
aaacucuccucugcugcu

SEQ ID NO: 2974335 - RNA, 13 nt, Human
aaacucuccucug

SEQ ID NO: 2974336 - RNA, 15 nt, Human
aaaucaaauaugcaa

SEQ ID NO: 2974337 - RNA, 12 nt, Human
aaaucaaauaug

SEQ ID NO: 2974338 - RNA, 14 nt, Human
aaaucaaauaugca

SEQ ID NO: 2974339 - RNA, 15 nt, Human
aaauauuuauuuuaa

SEQ ID NO: 2974340 - RNA, 13 nt, Human
aaauauuuauuuu

SEQ ID NO: 2974341 - RNA, 20 nt, Human
aaauauuuauuuuaauaaug

SEQ ID NO: 2974342 - RNA, 18 nt, Human
aaaucugcuuuuuaaaga

SEQ ID NO: 2974343 - RNA, 24 nt, Human
aaauagcucaggugucccugcacu

SEQ ID NO: 2974344 - RNA, 17 nt, Human
aaauagcuuuuuucucu

SEQ ID NO: 2974345 - RNA, 20 nt, Human
aaauagcuuuuuucucugau

SEQ ID NO: 2974346 - RNA, 19 nt, Human
aaauaguggugugauuugg

SEQ ID NO: 2974347 - RNA, 19 nt, Human
aaauaaaacuuuuuaaaau

SEQ ID NO: 2974348 - RNA, 16 nt, Human
aaauaaaacuuuuuaa

SEQ ID NO: 2974349 - RNA, 13 nt, Human
aaauaaaacuuuu

SEQ ID NO: 2974350 - RNA, 13 nt, Human
aaaguggaaaaau

SEQ ID NO: 2974351 - RNA, 19 nt, Human
aaaggcuccaggagcagcc

SEQ ID NO: 2974352 - RNA, 20 nt, Human
aaaggcuccaggagcagcca

SEQ ID NO: 2974353 - RNA, 14 nt, Human
aaaggcagaagcaa

SEQ ID NO: 2974354 - RNA, 15 nt, Human
aaaggcuccaggagc

SEQ ID NO: 2974355 - RNA, 16 nt, Human
aaaggcuccaggagca

SEQ ID NO: 2974356 - RNA, 22 nt, Human
acccaguguuuuaggagcauga

SEQ ID NO: 2974357 - RNA, 19 nt, Human
acccaguguuuuaggagca

SEQ ID NO: 2974358 - RNA, 16 nt, Human
acccaccucagccucc

SEQ ID NO: 2974359 - RNA, 11 nt, Human
acccccugaau

SEQ ID NO: 2974360 - RNA, 23 nt, Human
acccaagggccuggccugagcug

SEQ ID NO: 2974361 - RNA, 17 nt, Human
acccacaagaaaugaaa

SEQ ID NO: 2974362 - RNA, 21 nt, Human
acccacaagaaaugaaagcag

SEQ ID NO: 2974363 - RNA, 15 nt, Human
acccaccucagccuc

SEQ ID NO: 2974364 - RNA, 14 nt, Human
acccaccucagccu

SEQ ID NO: 2974365 - RNA, 13 nt, Human
acccaccucagcc

SEQ ID NO: 2974366 - RNA, 19 nt, Human
acccaagggccuggccuga

SEQ ID NO: 2974367 - RNA, 22 nt, Human
acccaagggccuggccugagcu

SEQ ID NO: 2974368 - RNA, 18 nt, Human
acccaagggccuggccug

SEQ ID NO: 2974369 - RNA, 20 nt, Human
accauauuaccacagacaua

SEQ ID NO: 2974370 - RNA, 20 nt, Human
accauccuggcuaacacggu

SEQ ID NO: 2974371 - RNA, 16 nt, Human
accauauuaccacaga

SEQ ID NO: 2974372 - RNA, 14 nt, Human
accauauuaccaca

SEQ ID NO: 2974373 - RNA, 19 nt, Human
accccuccaugugggcuag

SEQ ID NO: 2974374 - RNA, 16 nt, Human
accccuccaugugggc

SEQ ID NO: 2974375 - RNA, 23 nt, Human
acaggcaaugcuggcuguuggcu

SEQ ID NO: 2974376 - RNA, 19 nt, Human
acaggcaaugcuggcuguu

SEQ ID NO: 2974377 - RNA, 19 nt, Human
acaggguuuugccauguug

SEQ ID NO: 2974378 - RNA, 21 nt, Human
acauaaugcgugcauaccacu

SEQ ID NO: 2974379 - RNA, 22 nt, Human
acauaaugcgugcauaccacuu

SEQ ID NO: 2974380 - RNA, 23 nt, Human
acauaaugcgugcauaccacuuu

SEQ ID NO: 2974381 - RNA, 17 nt, Human
acaucagcacgauuucu

SEQ ID NO: 2974382 - RNA, 15 nt, Human
acaucagcacgauuu

SEQ ID NO: 2974383 - RNA, 18 nt, Human
acaucagcacgauuucug

SEQ ID NO: 2974384 - RNA, 19 nt, Human
acaugaucuucuuuauaau

SEQ ID NO: 2974385 - RNA, 18 nt, Human
acaugugcacaugcacgu

SEQ ID NO: 2974386 - RNA, 16 nt, Human
acaugugcacaugcac

SEQ ID NO: 2974387 - RNA, 14 nt, Human
acauuuauucugcu

SEQ ID NO: 2974388 - RNA, 15 nt, Human
acauuuauucugcuc

SEQ ID NO: 2974389 - RNA, 21 nt, Human
acauuuguauaaaauaauuuu

SEQ ID NO: 2974390 - RNA, 17 nt, Human
accagccaguaaauggg

SEQ ID NO: 2974391 - RNA, 13 nt, Human
accagcagaaaug

SEQ ID NO: 2974392 - RNA, 19 nt, Human
accagagcugccaccugcc

SEQ ID NO: 2974393 - RNA, 22 nt, Human
acagcaguugaaaagacuccaa

SEQ ID NO: 2974394 - RNA, 23 nt, Human
acagcaguugaaaagacuccaaa

SEQ ID NO: 2974395 - RNA, 21 nt, Human
acagcaguugaaaagacucca

SEQ ID NO: 2974396 - RNA, 19 nt, Human
acagagugagacucugucu

SEQ ID NO: 2974397 - RNA, 15 nt, Human
acagagugagacucu

SEQ ID NO: 2974398 - RNA, 23 nt, Human
acagagucucacuguugcccagg

SEQ ID NO: 2974399 - RNA, 11 nt, Human
acagacacagg

SEQ ID NO: 2974400 - RNA, 15 nt, Human
acacuguacugcaau

SEQ ID NO: 2974401 - RNA, 15 nt, Human
acagaggcagcccca

SEQ ID NO: 2974402 - RNA, 14 nt, Human
acagaggcagcccc

SEQ ID NO: 2974403 - RNA, 14 nt, Human
acagacacaggccc

SEQ ID NO: 2974404 - RNA, 13 nt, Human
acagacacaggcc

SEQ ID NO: 2974405 - RNA, 23 nt, Human
acagaggccaugggccuccugug

SEQ ID NO: 2974406 - RNA, 19 nt, Human
acagaggcagccccauucu

SEQ ID NO: 2974407 - RNA, 15 nt, Human
acacugcauguuugu

SEQ ID NO: 2974408 - RNA, 14 nt, Human
acacugcauguuug

SEQ ID NO: 2974409 - RNA, 20 nt, Human
acacuggcucacccaguccu

SEQ ID NO: 2974410 - RNA, 21 nt, Human
acacuggcucacccaguccug

SEQ ID NO: 2974411 - RNA, 12 nt, Human
acaggcaagcac

SEQ ID NO: 2974412 - RNA, 18 nt, Human
acaggcaaugcuggcugu

SEQ ID NO: 2974413 - RNA, 14 nt, Human
acaggauuauugga

SEQ ID NO: 2974414 - RNA, 15 nt, Human
acaggaucagucuga

SEQ ID NO: 2974415 - RNA, 17 nt, Human
acagcucuucuccaggc

SEQ ID NO: 2974416 - RNA, 16 nt, Human
acagcucuucuccagg

SEQ ID NO: 2974417 - RNA, 17 nt, Human
acagccacggccaggcc

SEQ ID NO: 2974418 - RNA, 16 nt, Human
acagccacggccaggc

SEQ ID NO: 2974419 - RNA, 15 nt, Human
acagccacggccagg

SEQ ID NO: 2974420 - RNA, 18 nt, Human
acagccacggccaggcca

SEQ ID NO: 2974421 - RNA, 22 nt, Human
acaaaauguaggguuauaauaa

SEQ ID NO: 2974422 - RNA, 12 nt, Human
acaaggcaaggc

SEQ ID NO: 2974423 - RNA, 14 nt, Human
acaaggcaaggcug

SEQ ID NO: 2974424 - RNA, 17 nt, Human
acaaggauugcuacugu

SEQ ID NO: 2974425 - RNA, 20 nt, Human
acaaggcaaggcugucaauu

SEQ ID NO: 2974426 - RNA, 21 nt, Human
acacgagcaggcuacugucag

SEQ ID NO: 2974427 - RNA, 17 nt, Human
acacgcgugcacacacc

SEQ ID NO: 2974428 - RNA, 15 nt, Human
acacgcgugcacaca

SEQ ID NO: 2974429 - RNA, 14 nt, Human
acacgagcaggcua

SEQ ID NO: 2974430 - RNA, 19 nt, Human
acacgagcaggcuacuguc

SEQ ID NO: 2974431 - RNA, 19 nt, Human
acacauuuuuuaaaugcac

SEQ ID NO: 2974432 - RNA, 12 nt, Human
acacauuuuucu

SEQ ID NO: 2974433 - RNA, 22 nt, Human
acacauuuuuuaaaugcaccug

SEQ ID NO: 2974434 - RNA, 20 nt, Human
acacauuuuuuaaaugcacc

SEQ ID NO: 2974435 - RNA, 13 nt, Human
acacagcucuucu

SEQ ID NO: 2974436 - RNA, 11 nt, Human
acacagcucuu

SEQ ID NO: 2974437 - RNA, 22 nt, Human
acacauuuuauuuuauuaugca

SEQ ID NO: 2974438 - RNA, 21 nt, Human
acacauuuuauuuuauuaugc

SEQ ID NO: 2974439 - RNA, 19 nt, Human
acacagaggcugccucucc

SEQ ID NO: 2974440 - RNA, 14 nt, Human
acacagcucugucc

SEQ ID NO: 2974441 - RNA, 20 nt, Human
acacagcucuguccugggag

SEQ ID NO: 2974442 - RNA, 16 nt, Human
acuuuauuucucucau

SEQ ID NO: 2974443 - RNA, 16 nt, Human
acuuuguucuggcucu

SEQ ID NO: 2974444 - RNA, 17 nt, Human
acuuuguucuggcucuu

SEQ ID NO: 2974445 - RNA, 22 nt, Human
acuuuauuuucuauaauuuaaa

SEQ ID NO: 2974446 - RNA, 13 nt, Human
acuuuuaagacuu

SEQ ID NO: 2974447 - RNA, 12 nt, Human
acuuuuaagacu

SEQ ID NO: 2974448 - RNA, 20 nt, Human
acuuuguucuggcucuucca

SEQ ID NO: 2974449 - RNA, 19 nt, Human
acuuuguucuggcucuucc

SEQ ID NO: 2974450 - RNA, 13 nt, Human
acuuuuauaaacu

SEQ ID NO: 2974451 - RNA, 15 nt, Human
agaaaauaccaagga

SEQ ID NO: 2974452 - RNA, 19 nt, Human
agaaaauaguggugugauu

SEQ ID NO: 2974453 - RNA, 16 nt, Human
agaaaaucaggcuggc

SEQ ID NO: 2974454 - RNA, 14 nt, Human
agaaaauaacaaua

SEQ ID NO: 2974455 - RNA, 14 nt, Human
acuuuucuuugugg

SEQ ID NO: 2974456 - RNA, 14 nt, Human
acuuuugcaaauaa

SEQ ID NO: 2974457 - RNA, 15 nt, Human
acuuuugcaaauaag

SEQ ID NO: 2974458 - RNA, 16 nt, Human
acuuuucuuucagcca

SEQ ID NO: 2974459 - RNA, 20 nt, Human
acuuuucauaaccuagccuu

SEQ ID NO: 2974460 - RNA, 22 nt, Human
agaaaguugcaaggcaaauguu

SEQ ID NO: 2974461 - RNA, 21 nt, Human
agaaauaacagaagaaaauag

SEQ ID NO: 2974462 - RNA, 13 nt, Human
agaaauaacagaa

SEQ ID NO: 2974463 - RNA, 22 nt, Human
agaaauaacagaagaaaauaga

SEQ ID NO: 2974464 - RNA, 23 nt, Human
agaaaguacuucuccacccugcu

SEQ ID NO: 2974465 - RNA, 22 nt, Human
agaaaguacuucuccacccugc

SEQ ID NO: 2974466 - RNA, 23 nt, Human
agaaaaucuucauggaauucaca

SEQ ID NO: 2974467 - RNA, 16 nt, Human
acuucacgcccuuggc

SEQ ID NO: 2974468 - RNA, 23 nt, Human
acuucacauauugauuuccguua

SEQ ID NO: 2974469 - RNA, 21 nt, Human
acuucugucuucacaacagau

SEQ ID NO: 2974470 - RNA, 22 nt, Human
acuucugucuucacaacagauu

SEQ ID NO: 2974471 - RNA, 14 nt, Human
acuugggccacugu

SEQ ID NO: 2974472 - RNA, 15 nt, Human
acuugggccacugug

SEQ ID NO: 2974473 - RNA, 16 nt, Human
acuugguuuuuaaaaa

SEQ ID NO: 2974474 - RNA, 21 nt, Human
acuuggucugugagaugcuag

SEQ ID NO: 2974475 - RNA, 20 nt, Human
acugugcugagucugaaggc

SEQ ID NO: 2974476 - RNA, 18 nt, Human
acugugcuccagccuggg

SEQ ID NO: 2974477 - RNA, 22 nt, Human
acugugcugagucugaaggcug

SEQ ID NO: 2974478 - RNA, 20 nt, Human
acugugcuccagccugggca

SEQ ID NO: 2974479 - RNA, 14 nt, Human
acugguuuuaaaua

SEQ ID NO: 2974480 - RNA, 22 nt, Human
acuguaagaaaauaucacuugu

SEQ ID NO: 2974481 - RNA, 13 nt, Human
acuguaagaaaau

SEQ ID NO: 2974482 - RNA, 19 nt, Human
acuguaagaaaauaucacu

SEQ ID NO: 2974483 - RNA, 17 nt, Human
acugguuuguucccugu

SEQ ID NO: 2974484 - RNA, 18 nt, Human
acugguuccauggccucu

SEQ ID NO: 2974485 - RNA, 15 nt, Human
acuggagaaaaugga

SEQ ID NO: 2974486 - RNA, 17 nt, Human
acuggaagcacagcuuc

SEQ ID NO: 2974487 - RNA, 19 nt, Human
acuggaagcacagcuucau

SEQ ID NO: 2974488 - RNA, 16 nt, Human
acuggaagcacagcuu

SEQ ID NO: 2974489 - RNA, 18 nt, Human
acucugucucaguccaug

SEQ ID NO: 2974490 - RNA, 20 nt, Human
acucugucucaguccaugaa

SEQ ID NO: 2974491 - RNA, 13 nt, Human
acugccagcaacg

SEQ ID NO: 2974492 - RNA, 22 nt, Human
acuauuuuuguuuuuauuaaaa

SEQ ID NO: 2974493 - RNA, 21 nt, Human
acuauuuuuguuuuuauuaaa

SEQ ID NO: 2974494 - RNA, 19 nt, Human
acucaguccauagcagaga

SEQ ID NO: 2974495 - RNA, 18 nt, Human
acuauucugagaugacua

SEQ ID NO: 2974496 - RNA, 19 nt, Human
acuauucugagaugacuau

SEQ ID NO: 2974497 - RNA, 21 nt, Human
acuauucaaacagucucagga

SEQ ID NO: 2974498 - RNA, 18 nt, Human
acuauucaaacagucuca

SEQ ID NO: 2974499 - RNA, 20 nt, Human
acuaguauuucuaugaaaua

SEQ ID NO: 2974500 - RNA, 20 nt, Human
acuauuuuuguuuuuauuaa

SEQ ID NO: 2974501 - RNA, 18 nt, Human
acuauuuauuuacaaaug

SEQ ID NO: 2974502 - RNA, 17 nt, Human
acuauuuauuuacaaau

SEQ ID NO: 2974503 - RNA, 16 nt, Human
acuauuuauuuacaaa

SEQ ID NO: 2974504 - RNA, 13 nt, Human
acucaaaagcugg

SEQ ID NO: 2974505 - RNA, 14 nt, Human
acucaaaucaagaa

SEQ ID NO: 2974506 - RNA, 15 nt, Human
acucuagggaaaaac

SEQ ID NO: 2974507 - RNA, 17 nt, Human
acucuagggaaaaacca

SEQ ID NO: 2974508 - RNA, 23 nt, Human
acucuaucaaguauuauaccuuu

SEQ ID NO: 2974509 - RNA, 17 nt, Human
acucuauguucuaagaa

SEQ ID NO: 2974510 - RNA, 21 nt, Human
acucuaucaaguauuauaccu

SEQ ID NO: 2974511 - RNA, 19 nt, Human
acucugucgcccagucugg

SEQ ID NO: 2974512 - RNA, 15 nt, Human
acucauauuuucaug

SEQ ID NO: 2974513 - RNA, 15 nt, Human
accucugcagcaaua

SEQ ID NO: 2974514 - RNA, 20 nt, Human
accucugcagcaauaaagca

SEQ ID NO: 2974515 - RNA, 18 nt, Human
accucugcagcaauaaag

SEQ ID NO: 2974516 - RNA, 21 nt, Human
accucugcagcaauaaagcag

SEQ ID NO: 2974517 - RNA, 12 nt, Human
accugucccccu

SEQ ID NO: 2974518 - RNA, 15 nt, Human
accugucccccugac

SEQ ID NO: 2974519 - RNA, 16 nt, Human
accugucccccugaca

SEQ ID NO: 2974520 - RNA, 15 nt, Human
accuuuaagagaaau

SEQ ID NO: 2974521 - RNA, 18 nt, Human
accuuucccaucuuccaa

SEQ ID NO: 2974522 - RNA, 13 nt, Human
accuuucccaucu

SEQ ID NO: 2974523 - RNA, 17 nt, Human
accuuggcugcagggag

SEQ ID NO: 2974524 - RNA, 18 nt, Human
accuuggcugcagggagu

SEQ ID NO: 2974525 - RNA, 19 nt, Human
acgcaggcccccaggugcc

SEQ ID NO: 2974526 - RNA, 22 nt, Human
acgcaggcccccaggugccagu

SEQ ID NO: 2974527 - RNA, 12 nt, Human
acgcugugcugc

SEQ ID NO: 2974528 - RNA, 14 nt, Human
acgcugugcugccc

SEQ ID NO: 2974529 - RNA, 11 nt, Human
acgcugugcug

SEQ ID NO: 2974530 - RNA, 14 nt, Human
acgucugacaggca

SEQ ID NO: 2974531 - RNA, 14 nt, Human
acggaacucaaaua

SEQ ID NO: 2974532 - RNA, 13 nt, Human
acgucugacaggc

SEQ ID NO: 2974533 - RNA, 13 nt, Human
acuaagagagaau

SEQ ID NO: 2974534 - RNA, 11 nt, Human
acgugaguccu

SEQ ID NO: 2974535 - RNA, 13 nt, Human
aaaaacacagcaa

SEQ ID NO: 2974536 - RNA, 18 nt, Human
aaaaacacagcaagggug

SEQ ID NO: 2974537 - RNA, 12 nt, Human
aaaaacacagca

SEQ ID NO: 2974538 - RNA, 15 nt, Human
aaaaaauauuuuccu

SEQ ID NO: 2974539 - RNA, 15 nt, Human
cacaaagcagauccu

SEQ ID NO: 2974540 - RNA, 23 nt, Human
cacaaagaaccaccaggaaagca

SEQ ID NO: 2974541 - RNA, 18 nt, Human
cacaaaaguuucucuuuu

SEQ ID NO: 2974542 - RNA, 16 nt, Human
cacaaaaguuucucuu

SEQ ID NO: 2974543 - RNA, 11 nt, Human
cacaacagauu

SEQ ID NO: 2974544 - RNA, 15 nt, Human
caauuuuaaacauau

SEQ ID NO: 2974545 - RNA, 13 nt, Human
caauuuuaaacau

SEQ ID NO: 2974546 - RNA, 12 nt, Human
caauuuuaaaca

SEQ ID NO: 2974547 - RNA, 22 nt, Human
caaugaaugaaugaauggcuaa

SEQ ID NO: 2974548 - RNA, 19 nt, Human
caaugcaaaccaucauuga

SEQ ID NO: 2974549 - RNA, 22 nt, Human
caaugcacuuuguucuggcucu

SEQ ID NO: 2974550 - RNA, 23 nt, Human
caaugcacuuuguucuggcucuu

SEQ ID NO: 2974551 - RNA, 17 nt, Human
caaugcaaaccaucauu

SEQ ID NO: 2974552 - RNA, 18 nt, Human
caaugcaaaccaucauug

SEQ ID NO: 2974553 - RNA, 21 nt, Human
caauaucuuuuuuuuaauaaa

SEQ ID NO: 2974554 - RNA, 22 nt, Human
caauaggugcugaguguacaga

SEQ ID NO: 2974555 - RNA, 21 nt, Human
caauaggaaaaacugauuuuu

SEQ ID NO: 2974556 - RNA, 20 nt, Human
caauaggaaaaacugauuuu

SEQ ID NO: 2974557 - RNA, 18 nt, Human
caauaggaaaaacugauu

SEQ ID NO: 2974558 - RNA, 19 nt, Human
cacacucaaaucaagaaac

SEQ ID NO: 2974559 - RNA, 14 nt, Human
cacacugaagaagc

SEQ ID NO: 2974560 - RNA, 12 nt, Human
cacacuggcuca

SEQ ID NO: 2974561 - RNA, 19 nt, Human
cacacuggcucacccaguc

SEQ ID NO: 2974562 - RNA, 16 nt, Human
cacacuggcucaccca

SEQ ID NO: 2974563 - RNA, 15 nt, Human
cacacuggcucaccc

SEQ ID NO: 2974564 - RNA, 17 nt, Human
cacagaguuguuacauu

SEQ ID NO: 2974565 - RNA, 16 nt, Human
cacagaguuguuacau

SEQ ID NO: 2974566 - RNA, 21 nt, Human
cacagagaaaguacuucucca

SEQ ID NO: 2974567 - RNA, 22 nt, Human
cacagacccugcccugugggcc

SEQ ID NO: 2974568 - RNA, 21 nt, Human
cacacuugacaucaacugcau

SEQ ID NO: 2974569 - RNA, 13 nt, Human
cacaacuauauug

SEQ ID NO: 2974570 - RNA, 14 nt, Human
cacacaccagagcc

SEQ ID NO: 2974571 - RNA, 19 nt, Human
cacacagaggcugccucuc

SEQ ID NO: 2974572 - RNA, 12 nt, Human
cacacagcucug

SEQ ID NO: 2974573 - RNA, 23 nt, Human
cacaccauaagcuacugccaucc

SEQ ID NO: 2974574 - RNA, 21 nt, Human
cacaccauaagcuacugccau

SEQ ID NO: 2974575 - RNA, 15 nt, Human
cacaccauaagcuac

SEQ ID NO: 2974576 - RNA, 13 nt, Human
cacaccagagccc

SEQ ID NO: 2974577 - RNA, 12 nt, Human
cacaccagagcc

SEQ ID NO: 2974578 - RNA, 15 nt, Human
cacaccagagcccac

SEQ ID NO: 2974579 - RNA, 15 nt, Human
cacauuaaaugacuc

SEQ ID NO: 2974580 - RNA, 13 nt, Human
cacauuaaaugac

SEQ ID NO: 2974581 - RNA, 17 nt, Human
cacauuaaagguacuuu

SEQ ID NO: 2974582 - RNA, 16 nt, Human
cacauuccugaugcuu

SEQ ID NO: 2974583 - RNA, 16 nt, Human
cacauuccugaacagg

SEQ ID NO: 2974584 - RNA, 15 nt, Human
cacaugugcacaugc

SEQ ID NO: 2974585 - RNA, 14 nt, Human
cacaugugcacaug

SEQ ID NO: 2974586 - RNA, 17 nt, Human
cacaugugcacaugcac

SEQ ID NO: 2974587 - RNA, 19 nt, Human
cacaugccucucucaggcc

SEQ ID NO: 2974588 - RNA, 23 nt, Human
cacauguccaagaagcccaggaa

SEQ ID NO: 2974589 - RNA, 19 nt, Human
cacaucagcacgauuucug

SEQ ID NO: 2974590 - RNA, 13 nt, Human
cacaugccucucu

SEQ ID NO: 2974591 - RNA, 17 nt, Human
cacaugccucucucagg

SEQ ID NO: 2974592 - RNA, 18 nt, Human
cacaugccucucucaggc

SEQ ID NO: 2974593 - RNA, 18 nt, Human
cacaucagcacgauuucu

SEQ ID NO: 2974594 - RNA, 12 nt, Human
cacauaucuguc

SEQ ID NO: 2974595 - RNA, 20 nt, Human
cacauauugauuuccguuaa

SEQ ID NO: 2974596 - RNA, 15 nt, Human
caccaagcccaguua

SEQ ID NO: 2974597 - RNA, 17 nt, Human
cacauuggaaacaaguc

SEQ ID NO: 2974598 - RNA, 15 nt, Human
caccacacccagccc

SEQ ID NO: 2974599 - RNA, 13 nt, Human
caccacacccagc

SEQ ID NO: 2974600 - RNA, 17 nt, Human
caccacacccagcccac

SEQ ID NO: 2974601 - RNA, 18 nt, Human
caccacuacauucuguua

SEQ ID NO: 2974602 - RNA, 17 nt, Human
caccacuacauucuguu

SEQ ID NO: 2974603 - RNA, 16 nt, Human
caccacuacauucugu

SEQ ID NO: 2974604 - RNA, 14 nt, Human
caccaccucuuugg

SEQ ID NO: 2974605 - RNA, 20 nt, Human
caccacuacauucuguuaau

SEQ ID NO: 2974606 - RNA, 19 nt, Human
caccacuacauucuguuaa

SEQ ID NO: 2974607 - RNA, 18 nt, Human
caccacaugugcacaugc

SEQ ID NO: 2974608 - RNA, 15 nt, Human
caccacaugugcaca

SEQ ID NO: 2974609 - RNA, 19 nt, Human
caccacaugugcacaugca

SEQ ID NO: 2974610 - RNA, 22 nt, Human
cacagcaguugaaaagacucca

SEQ ID NO: 2974611 - RNA, 20 nt, Human
cacagaugggugcuuggagg

SEQ ID NO: 2974612 - RNA, 14 nt, Human
cacagaugggugcu

SEQ ID NO: 2974613 - RNA, 18 nt, Human
cacagaugggugcuugga

SEQ ID NO: 2974614 - RNA, 20 nt, Human
cacagaguuguuacauuuuu

SEQ ID NO: 2974615 - RNA, 20 nt, Human
cacaggaaccacaagacugc

SEQ ID NO: 2974616 - RNA, 15 nt, Human
cacaggaaguagagg

SEQ ID NO: 2974617 - RNA, 19 nt, Human
cacaggaaccacaagacug

SEQ ID NO: 2974618 - RNA, 16 nt, Human
cacaggaucagucuga

SEQ ID NO: 2974619 - RNA, 15 nt, Human
cacaggaucagucug

SEQ ID NO: 2974620 - RNA, 12 nt, Human
cacaggaucagu

SEQ ID NO: 2974621 - RNA, 10 nt, Human
cacaggcagg

SEQ ID NO: 2974622 - RNA, 19 nt, Human
cacaggcccggcuccaggc

SEQ ID NO: 2974623 - RNA, 18 nt, Human
cacaggcccggcuccagg

SEQ ID NO: 2974624 - RNA, 17 nt, Human
cacaggcccggcuccag

SEQ ID NO: 2974625 - RNA, 16 nt, Human
cacaggcccggcucca

SEQ ID NO: 2974626 - RNA, 14 nt, Human
cacaguuuucugag

SEQ ID NO: 2974627 - RNA, 21 nt, Human
cacauaagccaaaacugagca

SEQ ID NO: 2974628 - RNA, 19 nt, Human
cacauaagccaaaacugag

SEQ ID NO: 2974629 - RNA, 22 nt, Human
cacauaagccaaaacugagcau

SEQ ID NO: 2974630 - RNA, 17 nt, Human
cacauacacacacacgc

SEQ ID NO: 2974631 - RNA, 23 nt, Human
cacaggcccggcuccaggcuccu

SEQ ID NO: 2974632 - RNA, 20 nt, Human
cacaggcccggcuccaggcu

SEQ ID NO: 2974633 - RNA, 18 nt, Human
cacagugagucgaggaca

SEQ ID NO: 2974634 - RNA, 20 nt, Human
cacagugagucgaggacagg

SEQ ID NO: 2974635 - RNA, 19 nt, Human
cacagugagucgaggacag

SEQ ID NO: 2974636 - RNA, 22 nt, Human
caacauuucucauguugaaacu

SEQ ID NO: 2974637 - RNA, 19 nt, Human
caaccccuucgcuccugug

SEQ ID NO: 2974638 - RNA, 18 nt, Human
caaccccuucgcuccugu

SEQ ID NO: 2974639 - RNA, 21 nt, Human
caaccccuucgcuccuguguc

SEQ ID NO: 2974640 - RNA, 23 nt, Human
caacaugccagccacugugauag

SEQ ID NO: 2974641 - RNA, 15 nt, Human
caaauugugugaaag

SEQ ID NO: 2974642 - RNA, 14 nt, Human
caaauuuacagaga

SEQ ID NO: 2974643 - RNA, 15 nt, Human
caaauuuacagagac

SEQ ID NO: 2974644 - RNA, 23 nt, Human
caacaggcugggcuucaguggca

SEQ ID NO: 2974645 - RNA, 24 nt, Human
caacaggcugggcuucaguggcag

SEQ ID NO: 2974646 - RNA, 19 nt, Human
caacagguuuuccugaaga

SEQ ID NO: 2974647 - RNA, 18 nt, Human
caacaggguuuuuuucca

SEQ ID NO: 2974648 - RNA, 15 nt, Human
caacagguuuuccug

SEQ ID NO: 2974649 - RNA, 22 nt, Human
caacaucuuggucagauuugaa

SEQ ID NO: 2974650 - RNA, 20 nt, Human
caacucuccuccagagucag

SEQ ID NO: 2974651 - RNA, 21 nt, Human
caacucugaaggguaauuaua

SEQ ID NO: 2974652 - RNA, 16 nt, Human
caacugcauuggcuuu

SEQ ID NO: 2974653 - RNA, 12 nt, Human
caacccucauca

SEQ ID NO: 2974654 - RNA, 15 nt, Human
caacccucaucacca

SEQ ID NO: 2974655 - RNA, 16 nt, Human
caaccugauugugucu

SEQ ID NO: 2974656 - RNA, 19 nt, Human
caacucuccuccagaguca

SEQ ID NO: 2974657 - RNA, 17 nt, Human
caagcacuaaacaaaga

SEQ ID NO: 2974658 - RNA, 18 nt, Human
caagcaccuccugccucg

SEQ ID NO: 2974659 - RNA, 21 nt, Human
caagccaccaacauacuccca

SEQ ID NO: 2974660 - RNA, 16 nt, Human
caagcgugagccacug

SEQ ID NO: 2974661 - RNA, 13 nt, Human
caaggauccugag

SEQ ID NO: 2974662 - RNA, 21 nt, Human
caaggaugaucuaggaagacu

SEQ ID NO: 2974663 - RNA, 22 nt, Human
caaggauccugagccagauuuc

SEQ ID NO: 2974664 - RNA, 22 nt, Human
caaggacccagccugagauggu

SEQ ID NO: 2974665 - RNA, 18 nt, Human
caagcgugagccacugca

SEQ ID NO: 2974666 - RNA, 17 nt, Human
caagcgugagccacugc

SEQ ID NO: 2974667 - RNA, 17 nt, Human
caagugauucuccugcc

SEQ ID NO: 2974668 - RNA, 16 nt, Human
caagugauucuccugc

SEQ ID NO: 2974669 - RNA, 19 nt, Human
caagugaaaaaggaggaag

SEQ ID NO: 2974670 - RNA, 21 nt, Human
caagugauucuccugccucag

SEQ ID NO: 2974671 - RNA, 22 nt, Human
caagugauucuccugccucagc

SEQ ID NO: 2974672 - RNA, 22 nt, Human
caagugugguagagugugccug

SEQ ID NO: 2974673 - RNA, 23 nt, Human
caaggugggaggauugcuugagc

SEQ ID NO: 2974674 - RNA, 12 nt, Human
caaggugggagg

SEQ ID NO: 2974675 - RNA, 19 nt, Human
caagggccuggccugagcu

SEQ ID NO: 2974676 - RNA, 16 nt, Human
caagggccuggccuga

SEQ ID NO: 2974677 - RNA, 15 nt, Human
caaggauugcuacug

SEQ ID NO: 2974678 - RNA, 17 nt, Human
caaagcuuuugcauauu

SEQ ID NO: 2974679 - RNA, 16 nt, Human
caaagcuuguuaagau

SEQ ID NO: 2974680 - RNA, 15 nt, Human
caaagcuaggccugg

SEQ ID NO: 2974681 - RNA, 21 nt, Human
caaagccaaagcuaggccugg

SEQ ID NO: 2974682 - RNA, 20 nt, Human
caaagccaaagcuaggccug

SEQ ID NO: 2974683 - RNA, 17 nt, Human
caaagcuaggccuggcc

SEQ ID NO: 2974684 - RNA, 16 nt, Human
caaagcuaggccuggc

SEQ ID NO: 2974685 - RNA, 18 nt, Human
caaagcuaggccuggcca

SEQ ID NO: 2974686 - RNA, 23 nt, Human
caaacuuuauugauucaccuccu

SEQ ID NO: 2974687 - RNA, 18 nt, Human
auuuuuuuacuaauagac

SEQ ID NO: 2974688 - RNA, 16 nt, Human
caaaggauacuuauuu

SEQ ID NO: 2974689 - RNA, 21 nt, Human
caaaggauacuuauuuaaaua

SEQ ID NO: 2974690 - RNA, 21 nt, Human
caaaggaugcccaaagaugca

SEQ ID NO: 2974691 - RNA, 13 nt, Human
caaauaaguguau

SEQ ID NO: 2974692 - RNA, 18 nt, Human
caaauaaguguauuuuga

SEQ ID NO: 2974693 - RNA, 17 nt, Human
caaauaaguguauuuug

SEQ ID NO: 2974694 - RNA, 16 nt, Human
caaauaaguguauuuu

SEQ ID NO: 2974695 - RNA, 14 nt, Human
caaauaugcaaagc

SEQ ID NO: 2974696 - RNA, 21 nt, Human
caaauaaguguauuuugaaau

SEQ ID NO: 2974697 - RNA, 20 nt, Human
caaauaaguguauuuugaaa

SEQ ID NO: 2974698 - RNA, 19 nt, Human
caaauaaguguauuuugaa

SEQ ID NO: 2974699 - RNA, 16 nt, Human
caaauaugcaaagcac

SEQ ID NO: 2974700 - RNA, 17 nt, Human
caaauaugcaaagcacu

SEQ ID NO: 2974701 - RNA, 18 nt, Human
caaauaugcaaagcacug

SEQ ID NO: 2974702 - RNA, 13 nt, Human
caaaucagcugcu

SEQ ID NO: 2974703 - RNA, 16 nt, Human
caaaucagcugcuacu

SEQ ID NO: 2974704 - RNA, 22 nt, Human
caaauucugcuugcuugcuuuu

SEQ ID NO: 2974705 - RNA, 20 nt, Human
caaauguucaucaaugaaug

SEQ ID NO: 2974706 - RNA, 21 nt, Human
caaauguucaucaaugaauga

SEQ ID NO: 2974707 - RNA, 22 nt, Human
cacccccacccaagggccuggc

SEQ ID NO: 2974708 - RNA, 14 nt, Human
caccccggccaccu

SEQ ID NO: 2974709 - RNA, 15 nt, Human
caccccggccaccug

SEQ ID NO: 2974710 - RNA, 16 nt, Human
caccccggccaccugc

SEQ ID NO: 2974711 - RNA, 17 nt, Human
caccccggccaccugcg

SEQ ID NO: 2974712 - RNA, 16 nt, Human
cacccaagggccuggc

SEQ ID NO: 2974713 - RNA, 17 nt, Human
cacccaagggccuggcc

SEQ ID NO: 2974714 - RNA, 18 nt, Human
cacccaagggccuggccu

SEQ ID NO: 2974715 - RNA, 19 nt, Human
cacccaagggccuggccug

SEQ ID NO: 2974716 - RNA, 20 nt, Human
cacccaagggccuggccuga

SEQ ID NO: 2974717 - RNA, 21 nt, Human
cacccaagggccuggccugag

SEQ ID NO: 2974718 - RNA, 23 nt, Human
cacccaagggccuggccugagcu

SEQ ID NO: 2974719 - RNA, 15 nt, Human
cacccacaccauaag

SEQ ID NO: 2974720 - RNA, 22 nt, Human
cacccaccaucaugucuggcua

SEQ ID NO: 2974721 - RNA, 20 nt, Human
cacccaccaucaugucuggc

SEQ ID NO: 2974722 - RNA, 16 nt, Human
cacccaccucagccuc

SEQ ID NO: 2974723 - RNA, 14 nt, Human
cacccaccucagcc

SEQ ID NO: 2974724 - RNA, 13 nt, Human
cacccaccucagc

SEQ ID NO: 2974725 - RNA, 12 nt, Human
cacccaccucag

SEQ ID NO: 2974726 - RNA, 12 nt, Human
caccccagcccc

SEQ ID NO: 2974727 - RNA, 13 nt, Human
caccccagcccca

SEQ ID NO: 2974728 - RNA, 14 nt, Human
uuuguguacuuuua

SEQ ID NO: 2974729 - RNA, 13 nt, Human
uuuguguacuuuu

SEQ ID NO: 2974730 - RNA, 17 nt, Human
uuuguguacuuuuaaga

SEQ ID NO: 2974731 - RNA, 23 nt, Human
uugcuaacagcaacacaaagcuu

SEQ ID NO: 2974732 - RNA, 16 nt, Human
uugcuaagcauuccaa

SEQ ID NO: 2974733 - RNA, 18 nt, Human
uugcuaagcauuccaacu

SEQ ID NO: 2974734 - RNA, 19 nt, Human
uugcugcugauuuaaacac

SEQ ID NO: 2974735 - RNA, 17 nt, Human
uugcugcugauuuaaac

SEQ ID NO: 2974736 - RNA, 21 nt, Human
uugcugcugauuuaaacacau

SEQ ID NO: 2974737 - RNA, 14 nt, Human
uugcugcuugaggc

SEQ ID NO: 2974738 - RNA, 16 nt, Human
uugcugcuugaggcaa

SEQ ID NO: 2974739 - RNA, 16 nt, Human
uugcugcuuguacacu

SEQ ID NO: 2974740 - RNA, 16 nt, Human
uugcugucccuuuucc

SEQ ID NO: 2974741 - RNA, 18 nt, Human
uugcugucccuuuuccuu

SEQ ID NO: 2974742 - RNA, 18 nt, Human
uugccuuggcugcaguuu

SEQ ID NO: 2974743 - RNA, 21 nt, Human
uugccauguuggccaggcugg

SEQ ID NO: 2974744 - RNA, 20 nt, Human
uugccauguuggccaggcug

SEQ ID NO: 2974745 - RNA, 17 nt, Human
uugccuuuuuauaacuu

SEQ ID NO: 2974746 - RNA, 15 nt, Human
uuggauuguccccga

SEQ ID NO: 2974747 - RNA, 15 nt, Human
uuggacccugaggcc

SEQ ID NO: 2974748 - RNA, 18 nt, Human
uuggacccugaggcccag

SEQ ID NO: 2974749 - RNA, 19 nt, Human
uuggacccugaggcccaga

SEQ ID NO: 2974750 - RNA, 21 nt, Human
uuggacccugaggcccagagg

SEQ ID NO: 2974751 - RNA, 19 nt, Human
uuggaagcuccgcuuucua

SEQ ID NO: 2974752 - RNA, 18 nt, Human
uuggacaaaauggaauac

SEQ ID NO: 2974753 - RNA, 20 nt, Human
uugggcacaucauuucaaga

SEQ ID NO: 2974754 - RNA, 18 nt, Human
uugguaacucuguaauuc

SEQ ID NO: 2974755 - RNA, 20 nt, Human
uugguaaggggaauugagga

SEQ ID NO: 2974756 - RNA, 13 nt, Human
uuguaaaauggug

SEQ ID NO: 2974757 - RNA, 12 nt, Human
uuguaaaauggu

SEQ ID NO: 2974758 - RNA, 20 nt, Human
uuggucugacccacugcuuu

SEQ ID NO: 2974759 - RNA, 13 nt, Human
uugguccugcugc

SEQ ID NO: 2974760 - RNA, 23 nt, Human
uuggcuucacggaagagccuugc

SEQ ID NO: 2974761 - RNA, 20 nt, Human
uuguaaaauggugugaccac

SEQ ID NO: 2974762 - RNA, 16 nt, Human
uuguaccgcaauguga

SEQ ID NO: 2974763 - RNA, 20 nt, Human
uuguaccacuuuugcaaaua

SEQ ID NO: 2974764 - RNA, 17 nt, Human
uuguagaagucacauuc

SEQ ID NO: 2974765 - RNA, 22 nt, Human
uuguagaagucacauuccugaa

SEQ ID NO: 2974766 - RNA, 15 nt, Human
uuguagcauccugga

SEQ ID NO: 2974767 - RNA, 20 nt, Human
uugucuaugggacucaaugc

SEQ ID NO: 2974768 - RNA, 22 nt, Human
uugucuuaaaaaguggaaaaau

SEQ ID NO: 2974769 - RNA, 22 nt, Human
uugucaaaguggugagaggcau

SEQ ID NO: 2974770 - RNA, 14 nt, Human
uugucuaugggacu

SEQ ID NO: 2974771 - RNA, 20 nt, Human
uuguauuuuacuaauaaaau

SEQ ID NO: 2974772 - RNA, 23 nt, Human
uugcagcucuccccuucucugua

SEQ ID NO: 2974773 - RNA, 23 nt, Human
uugcagacaggcaagcaccuccu

SEQ ID NO: 2974774 - RNA, 13 nt, Human
uugauucauaaug

SEQ ID NO: 2974775 - RNA, 17 nt, Human
uugauucauaaugacuu

SEQ ID NO: 2974776 - RNA, 22 nt, Human
uugcagacaggcaagcaccucc

SEQ ID NO: 2974777 - RNA, 18 nt, Human
uugccaucccucccucca

SEQ ID NO: 2974778 - RNA, 17 nt, Human
uugccaucccucccucc

SEQ ID NO: 2974779 - RNA, 16 nt, Human
uugccaucccucccuc

SEQ ID NO: 2974780 - RNA, 14 nt, Human
uugccaucccuccc

SEQ ID NO: 2974781 - RNA, 23 nt, Human
uugccaucccucccuccaccucc

SEQ ID NO: 2974782 - RNA, 22 nt, Human
uugccaucccucccuccaccuc

SEQ ID NO: 2974783 - RNA, 19 nt, Human
uugccauguuggccaggcu

SEQ ID NO: 2974784 - RNA, 18 nt, Human
uugccauguuggccaggc

SEQ ID NO: 2974785 - RNA, 17 nt, Human
uugccauguuggccagg

SEQ ID NO: 2974786 - RNA, 16 nt, Human
uugccauguuggccag

SEQ ID NO: 2974787 - RNA, 13 nt, Human
uugccaucccucc

SEQ ID NO: 2974788 - RNA, 20 nt, Human
uugauaugccuuuucccaac

SEQ ID NO: 2974789 - RNA, 16 nt, Human
uugauaugcuuauaca

SEQ ID NO: 2974790 - RNA, 16 nt, Human
uugauaugugaacagu

SEQ ID NO: 2974791 - RNA, 16 nt, Human
uugauucagcucugca

SEQ ID NO: 2974792 - RNA, 23 nt, Human
uugauucagacagcugccuggga

SEQ ID NO: 2974793 - RNA, 17 nt, Human
uugauucagacagcugc

SEQ ID NO: 2974794 - RNA, 21 nt, Human
uugauucagacagcugccugg

SEQ ID NO: 2974795 - RNA, 14 nt, Human
uugagccugggagg

SEQ ID NO: 2974796 - RNA, 14 nt, Human
uugagccuugaacu

SEQ ID NO: 2974797 - RNA, 16 nt, Human
uugagccuugaacuuu

SEQ ID NO: 2974798 - RNA, 15 nt, Human
uugagccuugaacuu

SEQ ID NO: 2974799 - RNA, 22 nt, Human
uugaauuccuaaaauuauggaa

SEQ ID NO: 2974800 - RNA, 19 nt, Human
uugagccuugaacuuugac

SEQ ID NO: 2974801 - RNA, 15 nt, Human
uugaaacacugguuu

SEQ ID NO: 2974802 - RNA, 15 nt, Human
uugaacuuugaccuc

SEQ ID NO: 2974803 - RNA, 21 nt, Human
uugaaaaucuuauaauuuaaa

SEQ ID NO: 2974804 - RNA, 21 nt, Human
uucuuuccugaggcugggcuc

SEQ ID NO: 2974805 - RNA, 18 nt, Human
uucuuuccacagaagcuc

SEQ ID NO: 2974806 - RNA, 22 nt, Human
uugaagauucuauguuaauauu

SEQ ID NO: 2974807 - RNA, 23 nt, Human
uugaagauucuauguuaauauuu

SEQ ID NO: 2974808 - RNA, 13 nt, Human
uugaagauucuau

SEQ ID NO: 2974809 - RNA, 21 nt, Human
uugaagagguuuuaaagcuuc

SEQ ID NO: 2974810 - RNA, 12 nt, Human
uugaagcagagu

SEQ ID NO: 2974811 - RNA, 14 nt, Human
uugaagcagagugg

SEQ ID NO: 2974812 - RNA, 20 nt, Human
uugaagcacagugaucaagu

SEQ ID NO: 2974813 - RNA, 18 nt, Human
uugaacuuugaccucugc

SEQ ID NO: 2974814 - RNA, 17 nt, Human
uugaacuuugaccucug

SEQ ID NO: 2974815 - RNA, 16 nt, Human
uugaagagguuuuaaa

SEQ ID NO: 2974816 - RNA, 12 nt, Human
uugaaugaugcc

SEQ ID NO: 2974817 - RNA, 16 nt, Human
uugaaugaugccauga

SEQ ID NO: 2974818 - RNA, 13 nt, Human
uucuuguauuuau

SEQ ID NO: 2974819 - RNA, 17 nt, Human
uucuuagggaaggauac

SEQ ID NO: 2974820 - RNA, 19 nt, Human
uucuuaggguuaugauuaa

SEQ ID NO: 2974821 - RNA, 13 nt, Human
uucuucagagacu

SEQ ID NO: 2974822 - RNA, 24 nt, Human
uucuaaguaaaaccacagcaguug

SEQ ID NO: 2974823 - RNA, 20 nt, Human
uucuggcagaguugaagaca

SEQ ID NO: 2974824 - RNA, 22 nt, Human
uuucacaguguguggucaacau

SEQ ID NO: 2974825 - RNA, 16 nt, Human
uuucacacaaacaagg

SEQ ID NO: 2974826 - RNA, 16 nt, Human
uuucagccaagaauuc

SEQ ID NO: 2974827 - RNA, 17 nt, Human
uuucagccaagaauucu

SEQ ID NO: 2974828 - RNA, 12 nt, Human
uuucucuaggaa

SEQ ID NO: 2974829 - RNA, 18 nt, Human
uuucuacccagcgagccc

SEQ ID NO: 2974830 - RNA, 15 nt, Human
uuucuacccagcgag

SEQ ID NO: 2974831 - RNA, 22 nt, Human
uuucuacccagcgagcccuggu

SEQ ID NO: 2974832 - RNA, 12 nt, Human
uuucugaaauuu

SEQ ID NO: 2974833 - RNA, 14 nt, Human
uuucugaaauaaca

SEQ ID NO: 2974834 - RNA, 19 nt, Human
uuuccuggcacugcuucca

SEQ ID NO: 2974835 - RNA, 23 nt, Human
uuuccuggcacugcuuccaguga

SEQ ID NO: 2974836 - RNA, 19 nt, Human
uuucuaaaucuccaaaaua

SEQ ID NO: 2974837 - RNA, 17 nt, Human
uuuggguuuauuuggaa

SEQ ID NO: 2974838 - RNA, 18 nt, Human
uuugguaaggggaauuga

SEQ ID NO: 2974839 - RNA, 14 nt, Human
uuugguuauuuuac

SEQ ID NO: 2974840 - RNA, 13 nt, Human
uuugguuauuuua

SEQ ID NO: 2974841 - RNA, 22 nt, Human
uuugguugguaacucuguaauu

SEQ ID NO: 2974842 - RNA, 15 nt, Human
uuugccaauuugcac

SEQ ID NO: 2974843 - RNA, 20 nt, Human
uuugccaauuugcacauuaa

SEQ ID NO: 2974844 - RNA, 17 nt, Human
uuugauaugugaacagu

SEQ ID NO: 2974845 - RNA, 15 nt, Human
uuugauaugugaaca

SEQ ID NO: 2974846 - RNA, 14 nt, Human
uuugauaugugaac

SEQ ID NO: 2974847 - RNA, 18 nt, Human
uuugauauggguaguauu

SEQ ID NO: 2974848 - RNA, 15 nt, Human
uuuggacccugaggc

SEQ ID NO: 2974849 - RNA, 19 nt, Human
uuuggacccugaggcccag

SEQ ID NO: 2974850 - RNA, 23 nt, Human
uuugcuuuauggguuuggcuugu

SEQ ID NO: 2974851 - RNA, 14 nt, Human
uuugcuugaaagaa

SEQ ID NO: 2974852 - RNA, 16 nt, Human
uuugcuugaaagaaaa

SEQ ID NO: 2974853 - RNA, 21 nt, Human
uuugaagguagaauguuuuca

SEQ ID NO: 2974854 - RNA, 16 nt, Human
uuugagaucagccugg

SEQ ID NO: 2974855 - RNA, 17 nt, Human
uuugagaucagccuggg

SEQ ID NO: 2974856 - RNA, 21 nt, Human
uuugaaauuguauuacaaauc

SEQ ID NO: 2974857 - RNA, 18 nt, Human
uuugaagcacagugauca

SEQ ID NO: 2974858 - RNA, 19 nt, Human
uuucuuguguguuuauugu

SEQ ID NO: 2974859 - RNA, 15 nt, Human
uuuaaacuacauuag

SEQ ID NO: 2974860 - RNA, 13 nt, Human
uuuaacagaaaug

SEQ ID NO: 2974861 - RNA, 15 nt, Human
uuuaaacacauuaaa

SEQ ID NO: 2974862 - RNA, 14 nt, Human
uuuaaacacauuaa

SEQ ID NO: 2974863 - RNA, 12 nt, Human
uuuaaacauauc

SEQ ID NO: 2974864 - RNA, 22 nt, Human
uuuaaacauauccaaguuugaa

SEQ ID NO: 2974865 - RNA, 13 nt, Human
uuuaaacauaucc

SEQ ID NO: 2974866 - RNA, 12 nt, Human
uuuaaaaugucu

SEQ ID NO: 2974867 - RNA, 13 nt, Human
uuuaaacaaaaua

SEQ ID NO: 2974868 - RNA, 16 nt, Human
uuuaaacaaaauagaa

SEQ ID NO: 2974869 - RNA, 19 nt, Human
uuuaaaauacacacucaaa

SEQ ID NO: 2974870 - RNA, 16 nt, Human
uuuaaaauaagucuga

SEQ ID NO: 2974871 - RNA, 16 nt, Human
uuuaaaaucauuucug

SEQ ID NO: 2974872 - RNA, 14 nt, Human
uuuaaaagaaugau

SEQ ID NO: 2974873 - RNA, 17 nt, Human
uuuaaaagaaugauuau

SEQ ID NO: 2974874 - RNA, 13 nt, Human
uuuaaaagauaca

SEQ ID NO: 2974875 - RNA, 14 nt, Human
uuuaaaagcauuuu

SEQ ID NO: 2974876 - RNA, 15 nt, Human
uuuaaaagcauuuuu

SEQ ID NO: 2974877 - RNA, 20 nt, Human
uuguuauuuauugaaaugau

SEQ ID NO: 2974878 - RNA, 15 nt, Human
uuguuauuuauugaa

SEQ ID NO: 2974879 - RNA, 18 nt, Human
uuguuuaaaaucauuucu

SEQ ID NO: 2974880 - RNA, 17 nt, Human
uuguuuaaaaucauuuc

SEQ ID NO: 2974881 - RNA, 12 nt, Human
uuguuuaauggu

SEQ ID NO: 2974882 - RNA, 23 nt, Human
uuguuuaaugguaguuuuacagu

SEQ ID NO: 2974883 - RNA, 15 nt, Human
uugucuuuggacccu

SEQ ID NO: 2974884 - RNA, 20 nt, Human
uugucuuuggacccugaggc

SEQ ID NO: 2974885 - RNA, 24 nt, Human
uugucuuuggacccugaggcccag

SEQ ID NO: 2974886 - RNA, 20 nt, Human
uuguuuggggaugagaaagg

SEQ ID NO: 2974887 - RNA, 22 nt, Human
uuuauccuagucauucuucccu

SEQ ID NO: 2974888 - RNA, 20 nt, Human
uuuauacauaaacaagacca

SEQ ID NO: 2974889 - RNA, 12 nt, Human
uuuauacauaaa

SEQ ID NO: 2974890 - RNA, 16 nt, Human
uuuaucuguucauaug

SEQ ID NO: 2974891 - RNA, 15 nt, Human
uuuaucuguucauau

SEQ ID NO: 2974892 - RNA, 22 nt, Human
uuuaugagaaacuggcaaagca

SEQ ID NO: 2974893 - RNA, 23 nt, Human
uuuauccuagucauucuucccua

SEQ ID NO: 2974894 - RNA, 18 nt, Human
uuuauaaacuuuaccuuu

SEQ ID NO: 2974895 - RNA, 22 nt, Human
uuuagacccuauugcugcuuga

SEQ ID NO: 2974896 - RNA, 19 nt, Human
uuuagacccuauugcugcu

SEQ ID NO: 2974897 - RNA, 17 nt, Human
uuuacaguguuucuggc

SEQ ID NO: 2974898 - RNA, 19 nt, Human
uuuacaguguuucuggcuu

SEQ ID NO: 2974899 - RNA, 13 nt, Human
uuuacagagacag

SEQ ID NO: 2974900 - RNA, 12 nt, Human
uuuaauaugcaa

SEQ ID NO: 2974901 - RNA, 16 nt, Human
uuuaauaugcaaaguc

SEQ ID NO: 2974902 - RNA, 15 nt, Human
uuuaauaauguuuca

SEQ ID NO: 2974903 - RNA, 14 nt, Human
uuuaauaauguuuc

SEQ ID NO: 2974904 - RNA, 13 nt, Human
uuuaauaaaccau

SEQ ID NO: 2974905 - RNA, 19 nt, Human
uuuaauaauguuucaaaca

SEQ ID NO: 2974906 - RNA, 14 nt, Human
uuuaaccucuaaau

SEQ ID NO: 2974907 - RNA, 15 nt, Human
uuuaacagaaaugua

SEQ ID NO: 2974908 - RNA, 14 nt, Human
uuuaacagaaaugu

SEQ ID NO: 2974909 - RNA, 12 nt, Human
uuauugaagcag

SEQ ID NO: 2974910 - RNA, 11 nt, Human
uuauucugcuc

SEQ ID NO: 2974911 - RNA, 17 nt, Human
uuauugaagcagagugg

SEQ ID NO: 2974912 - RNA, 16 nt, Human
uuauugaagcagagug

SEQ ID NO: 2974913 - RNA, 15 nt, Human
uuauugaagcagagu

SEQ ID NO: 2974914 - RNA, 13 nt, Human
uuauugaagcaga

SEQ ID NO: 2974915 - RNA, 15 nt, Human
uuauugauguuuuca

SEQ ID NO: 2974916 - RNA, 15 nt, Human
uuauugcccacgcug

SEQ ID NO: 2974917 - RNA, 18 nt, Human
uuauuacuguaagaaaau

SEQ ID NO: 2974918 - RNA, 17 nt, Human
uuauuacuguaagaaaa

SEQ ID NO: 2974919 - RNA, 16 nt, Human
uuauuacuguaagaaa

SEQ ID NO: 2974920 - RNA, 17 nt, Human
uuauggcuauaggugcu

SEQ ID NO: 2974921 - RNA, 16 nt, Human
uuauggaacacucuga

SEQ ID NO: 2974922 - RNA, 21 nt, Human
uuauggcacuaguauuucuau

SEQ ID NO: 2974923 - RNA, 22 nt, Human
uuaugcaugaaguaauaugcac

SEQ ID NO: 2974924 - RNA, 16 nt, Human
uuaugcaugaaguaau

SEQ ID NO: 2974925 - RNA, 17 nt, Human
uuaucuagauacuguau

SEQ ID NO: 2974926 - RNA, 16 nt, Human
uuaucuagauacugua

SEQ ID NO: 2974927 - RNA, 14 nt, Human
uuaucuagauacug

SEQ ID NO: 2974928 - RNA, 16 nt, Human
uuaguuccucauuagc

SEQ ID NO: 2974929 - RNA, 14 nt, Human
uuaguuccuugagu

SEQ ID NO: 2974930 - RNA, 13 nt, Human
uuauuuuacuuuu

SEQ ID NO: 2974931 - RNA, 15 nt, Human
uuauuuuacuuuuug

SEQ ID NO: 2974932 - RNA, 17 nt, Human
uuauuuuaauucaguug

SEQ ID NO: 2974933 - RNA, 18 nt, Human
uuauugucaaagugguga

SEQ ID NO: 2974934 - RNA, 15 nt, Human
uuauugucuagugaa

SEQ ID NO: 2974935 - RNA, 17 nt, Human
uuauugucaaaguggug

SEQ ID NO: 2974936 - RNA, 16 nt, Human
uuauuuuaauaauguu

SEQ ID NO: 2974937 - RNA, 15 nt, Human
uuauuuuaauaaugu

SEQ ID NO: 2974938 - RNA, 13 nt, Human
uucagagcugccc

SEQ ID NO: 2974939 - RNA, 21 nt, Human
uucagacagcugccugggauc

SEQ ID NO: 2974940 - RNA, 16 nt, Human
uucagacauagaauua

SEQ ID NO: 2974941 - RNA, 19 nt, Human
uucagagacuccugcaggc

SEQ ID NO: 2974942 - RNA, 20 nt, Human
uucagacauagaauuaacac

SEQ ID NO: 2974943 - RNA, 13 nt, Human
uucacucuccuug

SEQ ID NO: 2974944 - RNA, 15 nt, Human
uucacgugguccuaa

SEQ ID NO: 2974945 - RNA, 18 nt, Human
uucacggaagagccuugc

SEQ ID NO: 2974946 - RNA, 13 nt, Human
uucaauaggaaaa

SEQ ID NO: 2974947 - RNA, 15 nt, Human
uucaauaggaaaaac

SEQ ID NO: 2974948 - RNA, 18 nt, Human
uucaauaggaaaaacuga

SEQ ID NO: 2974949 - RNA, 20 nt, Human
uucaauaggaaaaacugauu

SEQ ID NO: 2974950 - RNA, 17 nt, Human
uucaauuuuaaacauau

SEQ ID NO: 2974951 - RNA, 17 nt, Human
uuccccaggaggccagc

SEQ ID NO: 2974952 - RNA, 18 nt, Human
uuccccaggaggccagcc

SEQ ID NO: 2974953 - RNA, 19 nt, Human
uuccccaggaggccagccu

SEQ ID NO: 2974954 - RNA, 20 nt, Human
uuccccaggaggccagccuu

SEQ ID NO: 2974955 - RNA, 21 nt, Human
uuccccaggaggccagccuug

SEQ ID NO: 2974956 - RNA, 20 nt, Human
uucccucccuuccucuuucc

SEQ ID NO: 2974957 - RNA, 17 nt, Human
uucccucccuuccucuu

SEQ ID NO: 2974958 - RNA, 11 nt, Human
uucccucccuu

SEQ ID NO: 2974959 - RNA, 16 nt, Human
uucccauuugcuccuu

SEQ ID NO: 2974960 - RNA, 15 nt, Human
uuccccaggaggcca

SEQ ID NO: 2974961 - RNA, 16 nt, Human
uuccccaggaggccag

SEQ ID NO: 2974962 - RNA, 16 nt, Human
uucauuuccugugucu

SEQ ID NO: 2974963 - RNA, 15 nt, Human
uucauuuccuguguc

SEQ ID NO: 2974964 - RNA, 11 nt, Human
uucaggaagcu

SEQ ID NO: 2974965 - RNA, 13 nt, Human
uucaggaagcuca

SEQ ID NO: 2974966 - RNA, 17 nt, Human
uucaucuugaauuguaa

SEQ ID NO: 2974967 - RNA, 15 nt, Human
uucaugaaagauuca

SEQ ID NO: 2974968 - RNA, 17 nt, Human
uucaugaaagauucaau

SEQ ID NO: 2974969 - RNA, 21 nt, Human
uucaucuugaauuguaaggaa

SEQ ID NO: 2974970 - RNA, 15 nt, Human
uuccaaauucugcuu

SEQ ID NO: 2974971 - RNA, 19 nt, Human
uuccagauccuggaaauca

SEQ ID NO: 2974972 - RNA, 20 nt, Human
uuccuuggacucauuuuaaa

SEQ ID NO: 2974973 - RNA, 17 nt, Human
uuccuuggacucauuuu

SEQ ID NO: 2974974 - RNA, 20 nt, Human
uucgggaggucgaggcagga

SEQ ID NO: 2974975 - RNA, 22 nt, Human
uucggccuccauccugaggcuc

SEQ ID NO: 2974976 - RNA, 13 nt, Human
uucuaaagcugcc

SEQ ID NO: 2974977 - RNA, 17 nt, Human
uucuaaagcugccagcc

SEQ ID NO: 2974978 - RNA, 18 nt, Human
uuccugaugcuucuucag

SEQ ID NO: 2974979 - RNA, 19 nt, Human
uuccugaugcuucuucaga

SEQ ID NO: 2974980 - RNA, 15 nt, Human
uuccugaugcuucuu

SEQ ID NO: 2974981 - RNA, 17 nt, Human
uuccugccaggcauggu

SEQ ID NO: 2974982 - RNA, 14 nt, Human
uuccuggcacugcu

SEQ ID NO: 2974983 - RNA, 20 nt, Human
uuccuugaguugauucagcu

SEQ ID NO: 2974984 - RNA, 20 nt, Human
uucccuuugacgccauccca

SEQ ID NO: 2974985 - RNA, 21 nt, Human
uucccuuugacgccaucccag

SEQ ID NO: 2974986 - RNA, 22 nt, Human
uucccuuugacgccaucccagc

SEQ ID NO: 2974987 - RNA, 13 nt, Human
uuccucauuagca

SEQ ID NO: 2974988 - RNA, 17 nt, Human
uucccuugaugaagaag

SEQ ID NO: 2974989 - RNA, 13 nt, Human
uuacuuuaaacua

SEQ ID NO: 2974990 - RNA, 18 nt, Human
uuacuuuaaaaggagcca

SEQ ID NO: 2974991 - RNA, 17 nt, Human
uuacuuuaaaaggagcc

SEQ ID NO: 2974992 - RNA, 15 nt, Human
uuagacagucccugc

SEQ ID NO: 2974993 - RNA, 14 nt, Human
uuacuuuguguuca

SEQ ID NO: 2974994 - RNA, 19 nt, Human
uuagacccucaugcugcca

SEQ ID NO: 2974995 - RNA, 20 nt, Human
uuagacccucaugcugccaa

SEQ ID NO: 2974996 - RNA, 16 nt, Human
uuagacagucccugcc

SEQ ID NO: 2974997 - RNA, 17 nt, Human
uuagacagucccugcca

SEQ ID NO: 2974998 - RNA, 18 nt, Human
uuagacagucccugccaa

SEQ ID NO: 2974999 - RNA, 14 nt, Human
uuagacagucccug

SEQ ID NO: 2975000 - RNA, 17 nt, Human
uuacuaguuucccuugc

SEQ ID NO: 2975001 - RNA, 16 nt, Human
uuacuaauagacaauu

SEQ ID NO: 2975002 - RNA, 14 nt, Human
uuacuaaguuuuua

SEQ ID NO: 2975003 - RNA, 13 nt, Human
uuacuaaguuuuu

SEQ ID NO: 2975004 - RNA, 23 nt, Human
uuacuucuuauacauuugauaaa

SEQ ID NO: 2975005 - RNA, 12 nt, Human
uuacuucugcua

SEQ ID NO: 2975006 - RNA, 11 nt, Human
uuacuucugcu

SEQ ID NO: 2975007 - RNA, 18 nt, Human
uuacuuagguguggggga

SEQ ID NO: 2975008 - RNA, 22 nt, Human
uuacuuaagacuuaaugagacu

SEQ ID NO: 2975009 - RNA, 21 nt, Human
uuacuuaaaccgccaaggcug

SEQ ID NO: 2975010 - RNA, 20 nt, Human
uuaggagaagucuucuauuu

SEQ ID NO: 2975011 - RNA, 18 nt, Human
uuaggauguugaaaaagu

SEQ ID NO: 2975012 - RNA, 23 nt, Human
uuaguagagguacacuugugaau

SEQ ID NO: 2975013 - RNA, 22 nt, Human
uuaguagagguacacuugugaa

SEQ ID NO: 2975014 - RNA, 17 nt, Human
uuaguagagacaggguu

SEQ ID NO: 2975015 - RNA, 16 nt, Human
uuaguaugaggcauuu

SEQ ID NO: 2975016 - RNA, 18 nt, Human
uuaguaugaggcauuugu

SEQ ID NO: 2975017 - RNA, 21 nt, Human
uuagaugcaguucugaagaag

SEQ ID NO: 2975018 - RNA, 20 nt, Human
uuagaugcaguucugaagaa

SEQ ID NO: 2975019 - RNA, 22 nt, Human
uuagauaauacaccacuacauu

SEQ ID NO: 2975020 - RNA, 14 nt, Human
uuagaguugauacu

SEQ ID NO: 2975021 - RNA, 13 nt, Human
uuagcuggaaaag

SEQ ID NO: 2975022 - RNA, 12 nt, Human
uuagcuggaaaa

SEQ ID NO: 2975023 - RNA, 19 nt, Human
uuaaugguaguuuuacagu

SEQ ID NO: 2975024 - RNA, 20 nt, Human
uuacaagcgugagccacugc

SEQ ID NO: 2975025 - RNA, 21 nt, Human
uuacaagcgugagccacugca

SEQ ID NO: 2975026 - RNA, 22 nt, Human
uuaauauugauaugcuuauaca

SEQ ID NO: 2975027 - RNA, 18 nt, Human
uuaauauugauaugcuua

SEQ ID NO: 2975028 - RNA, 17 nt, Human
uuaagcuguuacugucu

SEQ ID NO: 2975029 - RNA, 16 nt, Human
uuaacuucacauauug

SEQ ID NO: 2975030 - RNA, 15 nt, Human
uuaacuuuuauaaac

SEQ ID NO: 2975031 - RNA, 17 nt, Human
uuaacuuuuauaaacuu

SEQ ID NO: 2975032 - RNA, 16 nt, Human
uuaacuuuuauaaacu

SEQ ID NO: 2975033 - RNA, 17 nt, Human
uuaaccacuucagcuga

SEQ ID NO: 2975034 - RNA, 21 nt, Human
uuaaacucugagugcaaacuu

SEQ ID NO: 2975035 - RNA, 15 nt, Human
uuaaaagaugaaaau

SEQ ID NO: 2975036 - RNA, 18 nt, Human
uuaaaagaugaaaauauu

SEQ ID NO: 2975037 - RNA, 21 nt, Human
uuaaaauaccagccaguaaau

SEQ ID NO: 2975038 - RNA, 19 nt, Human
uuaaaauacacacucaaau

SEQ ID NO: 2975039 - RNA, 14 nt, Human
uuaaaagcauuuuu

SEQ ID NO: 2975040 - RNA, 17 nt, Human
uuaaaagauacaguuac

SEQ ID NO: 2975041 - RNA, 14 nt, Human
uuaaaagauacagu

SEQ ID NO: 2975042 - RNA, 21 nt, Human
uuaaaagaauauuuuaacuuc

SEQ ID NO: 2975043 - RNA, 22 nt, Human
uuaaaagaauauuuuaacuucc

SEQ ID NO: 2975044 - RNA, 18 nt, Human
uguuuuaaggaugcuugu

SEQ ID NO: 2975045 - RNA, 22 nt, Human
uguuuuaagaggcagggucuca

SEQ ID NO: 2975046 - RNA, 16 nt, Human
uguuuagauaauacac

SEQ ID NO: 2975047 - RNA, 19 nt, Human
uguuucaaacauauauaac

SEQ ID NO: 2975048 - RNA, 22 nt, Human
uguuucaaacauauauaacaau

SEQ ID NO: 2975049 - RNA, 21 nt, Human
uguuucaaacauauauaacaa

SEQ ID NO: 2975050 - RNA, 15 nt, Human
uguuucaaacuuuac

SEQ ID NO: 2975051 - RNA, 20 nt, Human
uguuuuaagaggcagggucu

SEQ ID NO: 2975052 - RNA, 13 nt, Human
uguuugugauuga

SEQ ID NO: 2975053 - RNA, 23 nt, Human
uguuuccuggcacugcuuccagu

SEQ ID NO: 2975054 - RNA, 19 nt, Human
uguuuggggaugagaaagg

SEQ ID NO: 2975055 - RNA, 15 nt, Human
ugguauuugaaacac

SEQ ID NO: 2975056 - RNA, 13 nt, Human
ugguauguuuuca

SEQ ID NO: 2975057 - RNA, 18 nt, Human
ugguaugaucacggcuca

SEQ ID NO: 2975058 - RNA, 14 nt, Human
uggucaacauuucu

SEQ ID NO: 2975059 - RNA, 22 nt, Human
uggucacaggaaguagaggagg

SEQ ID NO: 2975060 - RNA, 17 nt, Human
uggucacaggaaguaga

SEQ ID NO: 2975061 - RNA, 14 nt, Human
uggucccccuucca

SEQ ID NO: 2975062 - RNA, 16 nt, Human
uggucccagccagcag

SEQ ID NO: 2975063 - RNA, 13 nt, Human
uggucccacucag

SEQ ID NO: 2975064 - RNA, 15 nt, Human
uggucccccuuccau

SEQ ID NO: 2975065 - RNA, 16 nt, Human
uggucccccuuccaug

SEQ ID NO: 2975066 - RNA, 18 nt, Human
uggucccccuuccaugga

SEQ ID NO: 2975067 - RNA, 23 nt, Human
uggucccccuuccauggacuuug

SEQ ID NO: 2975068 - RNA, 13 nt, Human
ugguccugcugca

SEQ ID NO: 2975069 - RNA, 15 nt, Human
ugguccugcugcagu

SEQ ID NO: 2975070 - RNA, 23 nt, Human
ugguccugcugcaguugccaguc

SEQ ID NO: 2975071 - RNA, 17 nt, Human
ugguccuaaucuucuga

SEQ ID NO: 2975072 - RNA, 19 nt, Human
ugguccuaaucuucugaac

SEQ ID NO: 2975073 - RNA, 16 nt, Human
uggugauuuagcagga

SEQ ID NO: 2975074 - RNA, 22 nt, Human
uggugauuuagcaggaagcugu

SEQ ID NO: 2975075 - RNA, 21 nt, Human
uggugcaaugaccuuucaaua

SEQ ID NO: 2975076 - RNA, 20 nt, Human
uggugcaaugaccuuucaau

SEQ ID NO: 2975077 - RNA, 19 nt, Human
uggugacuuuccucuuugg

SEQ ID NO: 2975078 - RNA, 22 nt, Human
uggugaccucugccugaaguca

SEQ ID NO: 2975079 - RNA, 17 nt, Human
uggugaccucugccuga

SEQ ID NO: 2975080 - RNA, 16 nt, Human
uggugaccucugccug

SEQ ID NO: 2975081 - RNA, 15 nt, Human
uggugaccucugccu

SEQ ID NO: 2975082 - RNA, 15 nt, Human
uggucuacacugugc

SEQ ID NO: 2975083 - RNA, 16 nt, Human
uggucuacacugugcu

SEQ ID NO: 2975084 - RNA, 17 nt, Human
uggucuacacugugcug

SEQ ID NO: 2975085 - RNA, 18 nt, Human
uggucuacacugugcuga

SEQ ID NO: 2975086 - RNA, 19 nt, Human
uggucuacacugugcugag

SEQ ID NO: 2975087 - RNA, 14 nt, Human
uggugaccucugcc

SEQ ID NO: 2975088 - RNA, 13 nt, Human
uggugaccucugc

SEQ ID NO: 2975089 - RNA, 17 nt, Human
uggucggaaaacaugcu

SEQ ID NO: 2975090 - RNA, 14 nt, Human
uggucggaaaacau

SEQ ID NO: 2975091 - RNA, 14 nt, Human
uggguauagauguu

SEQ ID NO: 2975092 - RNA, 18 nt, Human
uggguauagauguugcua

SEQ ID NO: 2975093 - RNA, 18 nt, Human
uggguacuuguggacaca

SEQ ID NO: 2975094 - RNA, 17 nt, Human
uggguacuuguggacac

SEQ ID NO: 2975095 - RNA, 16 nt, Human
ugggggaguggccaca

SEQ ID NO: 2975096 - RNA, 20 nt, Human
uggggccaguuggucccccu

SEQ ID NO: 2975097 - RNA, 23 nt, Human
uggggaugagaaagguugaagca

SEQ ID NO: 2975098 - RNA, 15 nt, Human
uggggaugagaaagg

SEQ ID NO: 2975099 - RNA, 22 nt, Human
ugggcuucauccuccucagauc

SEQ ID NO: 2975100 - RNA, 19 nt, Human
ugggcagcugccuccccuc

SEQ ID NO: 2975101 - RNA, 17 nt, Human
ugggcagcugccucccc

SEQ ID NO: 2975102 - RNA, 15 nt, Human
ugggcagcugccucc

SEQ ID NO: 2975103 - RNA, 14 nt, Human
ugggcagcugccuc

SEQ ID NO: 2975104 - RNA, 13 nt, Human
ugggcagcugccu

SEQ ID NO: 2975105 - RNA, 12 nt, Human
ugggcagcugcc

SEQ ID NO: 2975106 - RNA, 23 nt, Human
ugggcagagcagagaccaucccu

SEQ ID NO: 2975107 - RNA, 14 nt, Human
ugggccuggcuccc

SEQ ID NO: 2975108 - RNA, 22 nt, Human
ugggcagagcagagaccauccc

SEQ ID NO: 2975109 - RNA, 18 nt, Human
ugggcagagcagagacca

SEQ ID NO: 2975110 - RNA, 22 nt, Human
ugggauuacaagcgugagccac

SEQ ID NO: 2975111 - RNA, 12 nt, Human
ugggauccucca

SEQ ID NO: 2975112 - RNA, 13 nt, Human
ugggauccuccag

SEQ ID NO: 2975113 - RNA, 17 nt, Human
uggcugggggccucagu

SEQ ID NO: 2975114 - RNA, 16 nt, Human
uggcugggggccucag

SEQ ID NO: 2975115 - RNA, 20 nt, Human
uggcugggggccucagugcc

SEQ ID NO: 2975116 - RNA, 14 nt, Human
ugggagugggccca

SEQ ID NO: 2975117 - RNA, 16 nt, Human
ugggagugggcccaau

SEQ ID NO: 2975118 - RNA, 19 nt, Human
uggaucuguauguguucua

SEQ ID NO: 2975119 - RNA, 21 nt, Human
uggaggaaggaaacccagcuc

SEQ ID NO: 2975120 - RNA, 23 nt, Human
uggaggaaggaaacccagcucug

SEQ ID NO: 2975121 - RNA, 15 nt, Human
uggcacuaguauuuc

SEQ ID NO: 2975122 - RNA, 20 nt, Human
uggcaauagucaaauugugu

SEQ ID NO: 2975123 - RNA, 16 nt, Human
uggcacuauaauguaa

SEQ ID NO: 2975124 - RNA, 15 nt, Human
uggcacuauaaugua

SEQ ID NO: 2975125 - RNA, 12 nt, Human
uggcaaaaaggc

SEQ ID NO: 2975126 - RNA, 16 nt, Human
uggcaaaaaggcagga

SEQ ID NO: 2975127 - RNA, 24 nt, Human
uggcaaacagggccucugcggagc

SEQ ID NO: 2975128 - RNA, 20 nt, Human
uggcaaacagggccucugcg

SEQ ID NO: 2975129 - RNA, 19 nt, Human
uggcaaacagggccucugc

SEQ ID NO: 2975130 - RNA, 18 nt, Human
uggcaaacagggccucug

SEQ ID NO: 2975131 - RNA, 16 nt, Human
uggcaaacagggccuc

SEQ ID NO: 2975132 - RNA, 15 nt, Human
uggcaaacagggccu

SEQ ID NO: 2975133 - RNA, 18 nt, Human
uggcaaagcagaauguga

SEQ ID NO: 2975134 - RNA, 13 nt, Human
uggcaaagcagaa

SEQ ID NO: 2975135 - RNA, 22 nt, Human
uggacugagggggccuggaugc

SEQ ID NO: 2975136 - RNA, 20 nt, Human
uggacugagggggccuggau

SEQ ID NO: 2975137 - RNA, 23 nt, Human
uggacugagggggccuggaugcc

SEQ ID NO: 2975138 - RNA, 19 nt, Human
uggacugagggggccugga

SEQ ID NO: 2975139 - RNA, 23 nt, Human
uggacaggcauguucucugagga

SEQ ID NO: 2975140 - RNA, 19 nt, Human
uggccagaugcaccagccc

SEQ ID NO: 2975141 - RNA, 15 nt, Human
uggcagaguugaaga

SEQ ID NO: 2975142 - RNA, 21 nt, Human
uggcagaguggauucuugaac

SEQ ID NO: 2975143 - RNA, 17 nt, Human
uggcagaguugaagaca

SEQ ID NO: 2975144 - RNA, 19 nt, Human
uggcagaguugaagacaga

SEQ ID NO: 2975145 - RNA, 18 nt, Human
uggccagaugcaccagcc

SEQ ID NO: 2975146 - RNA, 17 nt, Human
uggccagaugcaccagc

SEQ ID NO: 2975147 - RNA, 18 nt, Human
uggcccaggguggccaca

SEQ ID NO: 2975148 - RNA, 17 nt, Human
uggcccaggguggccac

SEQ ID NO: 2975149 - RNA, 16 nt, Human
uggcccaggguggcca

SEQ ID NO: 2975150 - RNA, 13 nt, Human
uggccaggcuggu

SEQ ID NO: 2975151 - RNA, 16 nt, Human
uggccccugcccggcu

SEQ ID NO: 2975152 - RNA, 15 nt, Human
uggccccugcccggc

SEQ ID NO: 2975153 - RNA, 14 nt, Human
uggccccugcccgg

SEQ ID NO: 2975154 - RNA, 15 nt, Human
uggcgcugccccugg

SEQ ID NO: 2975155 - RNA, 23 nt, Human
uggcgcugccccuggcagccccu

SEQ ID NO: 2975156 - RNA, 16 nt, Human
uggcgcugccccuggc

SEQ ID NO: 2975157 - RNA, 22 nt, Human
uggcgagccauuugucccaagu

SEQ ID NO: 2975158 - RNA, 23 nt, Human
uggcgagccauuugucccaagug

SEQ ID NO: 2975159 - RNA, 22 nt, Human
uggcgcagcauauucaggaagc

SEQ ID NO: 2975160 - RNA, 23 nt, Human
uggcgcagcauauucaggaagcu

SEQ ID NO: 2975161 - RNA, 23 nt, Human
uggccucccaacucaccccagcc

SEQ ID NO: 2975162 - RNA, 15 nt, Human
uggcugcuucaagga

SEQ ID NO: 2975163 - RNA, 15 nt, Human
uggcugggggccuca

SEQ ID NO: 2975164 - RNA, 11 nt, Human
uggcugcuuca

SEQ ID NO: 2975165 - RNA, 16 nt, Human
ugcagggacagagcau

SEQ ID NO: 2975166 - RNA, 13 nt, Human
ugcagggaguccg

SEQ ID NO: 2975167 - RNA, 15 nt, Human
ugauuuaauaugcaa

SEQ ID NO: 2975168 - RNA, 17 nt, Human
ugauuuaauaugcaaag

SEQ ID NO: 2975169 - RNA, 21 nt, Human
ugcaguuacacuaaaagguga

SEQ ID NO: 2975170 - RNA, 21 nt, Human
ugcaguggugcgaucuggguu

SEQ ID NO: 2975171 - RNA, 20 nt, Human
ugcaguggugcgaucugggu

SEQ ID NO: 2975172 - RNA, 23 nt, Human
ugcauauugcauacuauuaaaca

SEQ ID NO: 2975173 - RNA, 15 nt, Human
ugcauauugcauacu

SEQ ID NO: 2975174 - RNA, 22 nt, Human
ugcaucaauuuuucuuauuuca

SEQ ID NO: 2975175 - RNA, 12 nt, Human
ugcaguucugaa

SEQ ID NO: 2975176 - RNA, 16 nt, Human
ugcaguugccagucac

SEQ ID NO: 2975177 - RNA, 13 nt, Human
ugcaucagcugcu

SEQ ID NO: 2975178 - RNA, 21 nt, Human
ugcauuuggugguuucagaaa

SEQ ID NO: 2975179 - RNA, 23 nt, Human
ugcauuuggugguuucagaaaug

SEQ ID NO: 2975180 - RNA, 17 nt, Human
ugccaaagaagcagacc

SEQ ID NO: 2975181 - RNA, 20 nt, Human
ugccaggaagccagcaggcu

SEQ ID NO: 2975182 - RNA, 22 nt, Human
ugccaggaagccagcaggcucu

SEQ ID NO: 2975183 - RNA, 16 nt, Human
ugccacuaaauugaca

SEQ ID NO: 2975184 - RNA, 10 nt, Human
ugccaggcau

SEQ ID NO: 2975185 - RNA, 14 nt, Human
ugccaggcauggug

SEQ ID NO: 2975186 - RNA, 20 nt, Human
ugccacccuggggagaaagu

SEQ ID NO: 2975187 - RNA, 15 nt, Human
ugccucaagagaagg

SEQ ID NO: 2975188 - RNA, 14 nt, Human
ugccucaagagaag

SEQ ID NO: 2975189 - RNA, 16 nt, Human
ugcccugcccaccugg

SEQ ID NO: 2975190 - RNA, 20 nt, Human
ugcccugcccaccuggccuc

SEQ ID NO: 2975191 - RNA, 15 nt, Human
ugcccugcccaccug

SEQ ID NO: 2975192 - RNA, 14 nt, Human
ugcccugcccaccu

SEQ ID NO: 2975193 - RNA, 20 nt, Human
ugcccaggcuggcgugcagu

SEQ ID NO: 2975194 - RNA, 13 nt, Human
ugcccaggcuggc

SEQ ID NO: 2975195 - RNA, 19 nt, Human
ugcccaggcuggcgugcag

SEQ ID NO: 2975196 - RNA, 18 nt, Human
ugcccaggcuggcgugca

SEQ ID NO: 2975197 - RNA, 14 nt, Human
ugcccggcugcgga

SEQ ID NO: 2975198 - RNA, 12 nt, Human
ugcccggcugcg

SEQ ID NO: 2975199 - RNA, 16 nt, Human
ugccccuggcagcccc

SEQ ID NO: 2975200 - RNA, 21 nt, Human
ugcugccaauauccuaauaaa

SEQ ID NO: 2975201 - RNA, 15 nt, Human
ugcugccaauauccu

SEQ ID NO: 2975202 - RNA, 14 nt, Human
ugcugcauuuaaaa

SEQ ID NO: 2975203 - RNA, 23 nt, Human
ugcugcauuuaaaagauacaguu

SEQ ID NO: 2975204 - RNA, 16 nt, Human
ugcugccaauauccua

SEQ ID NO: 2975205 - RNA, 17 nt, Human
ugcugccaauauccuaa

SEQ ID NO: 2975206 - RNA, 18 nt, Human
ugcugccaauauccuaau

SEQ ID NO: 2975207 - RNA, 19 nt, Human
ugcugccaauauccuaaua

SEQ ID NO: 2975208 - RNA, 19 nt, Human
ugcugcauuuaaaagauac

SEQ ID NO: 2975209 - RNA, 18 nt, Human
ugcugcauuuaaaagaua

SEQ ID NO: 2975210 - RNA, 17 nt, Human
ugcugcauuuaaaagau

SEQ ID NO: 2975211 - RNA, 19 nt, Human
ugcugcuugaggcaacuca

SEQ ID NO: 2975212 - RNA, 20 nt, Human
ugcugggauuacagguguga

SEQ ID NO: 2975213 - RNA, 12 nt, Human
ugcugcuugagg

SEQ ID NO: 2975214 - RNA, 12 nt, Human
ugcugcugcccc

SEQ ID NO: 2975215 - RNA, 19 nt, Human
ugcugcugccccugcacag

SEQ ID NO: 2975216 - RNA, 21 nt, Human
ugcuguucacuggacacuuca

SEQ ID NO: 2975217 - RNA, 16 nt, Human
ugcuguucaugaaaga

SEQ ID NO: 2975218 - RNA, 17 nt, Human
ugcuguucaugaaagau

SEQ ID NO: 2975219 - RNA, 17 nt, Human
ugcugggcuugucugua

SEQ ID NO: 2975220 - RNA, 20 nt, Human
ugcugggggggauuguaaaa

SEQ ID NO: 2975221 - RNA, 13 nt, Human
ugcuggguguggc

SEQ ID NO: 2975222 - RNA, 17 nt, Human
ugcuagaacucccuuuc

SEQ ID NO: 2975223 - RNA, 15 nt, Human
ugcuagaacucccuu

SEQ ID NO: 2975224 - RNA, 14 nt, Human
ugcuagaacucccu

SEQ ID NO: 2975225 - RNA, 13 nt, Human
ugcuagaacuccc

SEQ ID NO: 2975226 - RNA, 21 nt, Human
ugcuaggaacacuccuucaca

SEQ ID NO: 2975227 - RNA, 20 nt, Human
ugcuaggaacacuccuucac

SEQ ID NO: 2975228 - RNA, 22 nt, Human
ugcuaggaacacuccuucacag

SEQ ID NO: 2975229 - RNA, 17 nt, Human
ugcucacauaucuguca

SEQ ID NO: 2975230 - RNA, 23 nt, Human
ugcucuccgaccagacaccuuga

SEQ ID NO: 2975231 - RNA, 22 nt, Human
ugcuacuguccuacccacccuc

SEQ ID NO: 2975232 - RNA, 21 nt, Human
ugcuacuguccuacccacccu

SEQ ID NO: 2975233 - RNA, 17 nt, Human
ugauugggcacaucauu

SEQ ID NO: 2975234 - RNA, 21 nt, Human
ugauugggcacaucauuucaa

SEQ ID NO: 2975235 - RNA, 20 nt, Human
ugauugggcacaucauuuca

SEQ ID NO: 2975236 - RNA, 18 nt, Human
ugauugggcacaucauuu

SEQ ID NO: 2975237 - RNA, 13 nt, Human
ugauuggaggggg

SEQ ID NO: 2975238 - RNA, 21 nt, Human
ugauuggaggggggagguggg

SEQ ID NO: 2975239 - RNA, 23 nt, Human
ugauugggcacaucauuucaaga

SEQ ID NO: 2975240 - RNA, 17 nt, Human
ugauuuaaacacauuaa

SEQ ID NO: 2975241 - RNA, 16 nt, Human
ugauuuaaacacauua

SEQ ID NO: 2975242 - RNA, 18 nt, Human
ugauuuaaacacauuaaa

SEQ ID NO: 2975243 - RNA, 15 nt, Human
ugauuuaaacacauu

SEQ ID NO: 2975244 - RNA, 16 nt, Human
ugauugugucucuugg

SEQ ID NO: 2975245 - RNA, 17 nt, Human
ugauugccuuuuuauaa

SEQ ID NO: 2975246 - RNA, 22 nt, Human
ugauugccuuuuuauaacuuuu

SEQ ID NO: 2975247 - RNA, 18 nt, Human
ugauucagacagcugccu

SEQ ID NO: 2975248 - RNA, 19 nt, Human
ugauucagacagcugccug

SEQ ID NO: 2975249 - RNA, 20 nt, Human
ugauucagacagcugccugg

SEQ ID NO: 2975250 - RNA, 21 nt, Human
ugauucagacagcugccuggg

SEQ ID NO: 2975251 - RNA, 23 nt, Human
ugauucagacagcugccugggau

SEQ ID NO: 2975252 - RNA, 21 nt, Human
ugauucuccugccucagccuc

SEQ ID NO: 2975253 - RNA, 16 nt, Human
ugauuaccagggacug

SEQ ID NO: 2975254 - RNA, 20 nt, Human
ugauguucuuucacccuuuu

SEQ ID NO: 2975255 - RNA, 19 nt, Human
ugauuaugaauuacauuug

SEQ ID NO: 2975256 - RNA, 17 nt, Human
ugauuaugaauuacauu

SEQ ID NO: 2975257 - RNA, 13 nt, Human
ugauuauauguca

SEQ ID NO: 2975258 - RNA, 22 nt, Human
ugauuaugaauuacauuuguau

SEQ ID NO: 2975259 - RNA, 21 nt, Human
ugauuaugaauuacauuugua

SEQ ID NO: 2975260 - RNA, 16 nt, Human
ugauuauuacuggcaa

SEQ ID NO: 2975261 - RNA, 20 nt, Human
ugauucaacagguuuuccug

SEQ ID NO: 2975262 - RNA, 13 nt, Human
ugauucagacagc

SEQ ID NO: 2975263 - RNA, 14 nt, Human
ugauucagacagcu

SEQ ID NO: 2975264 - RNA, 15 nt, Human
ugauucagacagcug

SEQ ID NO: 2975265 - RNA, 16 nt, Human
ugauucagacagcugc

SEQ ID NO: 2975266 - RNA, 21 nt, Human
ugauucaccuccuaaaacaac

SEQ ID NO: 2975267 - RNA, 16 nt, Human
ugaugcuucuucagag

SEQ ID NO: 2975268 - RNA, 17 nt, Human
ugaugcuucuucagaga

SEQ ID NO: 2975269 - RNA, 15 nt, Human
ugauggugguauguu

SEQ ID NO: 2975270 - RNA, 16 nt, Human
ugauguguuaucucuu

SEQ ID NO: 2975271 - RNA, 20 nt, Human
ugaugcuacaggauuugaaa

SEQ ID NO: 2975272 - RNA, 23 nt, Human
ugaugcuacaggauuugaaauug

SEQ ID NO: 2975273 - RNA, 17 nt, Human
ugaucuuuaaaauacac

SEQ ID NO: 2975274 - RNA, 16 nt, Human
ugaucuuugcagacag

SEQ ID NO: 2975275 - RNA, 20 nt, Human
ugaucuucuuuauaauucua

SEQ ID NO: 2975276 - RNA, 14 nt, Human
ugaucuuuaaaaua

SEQ ID NO: 2975277 - RNA, 19 nt, Human
ugauccacccaccucagcc

SEQ ID NO: 2975278 - RNA, 18 nt, Human
ugauccacccaccucagc

SEQ ID NO: 2975279 - RNA, 17 nt, Human
ugauccacccaccucag

SEQ ID NO: 2975280 - RNA, 17 nt, Human
ugaucucucgugauuga

SEQ ID NO: 2975281 - RNA, 16 nt, Human
ugauccacccaccuca

SEQ ID NO: 2975282 - RNA, 15 nt, Human
ugauccaagcugguc

SEQ ID NO: 2975283 - RNA, 14 nt, Human
ugauccaagcuggu

SEQ ID NO: 2975284 - RNA, 13 nt, Human
ugauccaagcugg

SEQ ID NO: 2975285 - RNA, 18 nt, Human
ugaucauguuuaugagaa

SEQ ID NO: 2975286 - RNA, 13 nt, Human
ugauagcacagac

SEQ ID NO: 2975287 - RNA, 14 nt, Human
ugauagcacagacc

SEQ ID NO: 2975288 - RNA, 24 nt, Human
ugaucagcuuauugucuagugaaa

SEQ ID NO: 2975289 - RNA, 17 nt, Human
ugaucagcuuauugucu

SEQ ID NO: 2975290 - RNA, 20 nt, Human
ugagacucgcgacaaugcaa

SEQ ID NO: 2975291 - RNA, 21 nt, Human
ugagacucgcgacaaugcaaa

SEQ ID NO: 2975292 - RNA, 22 nt, Human
ugagacucgcgacaaugcaaac

SEQ ID NO: 2975293 - RNA, 23 nt, Human
ugagacucgcgacaaugcaaacc

SEQ ID NO: 2975294 - RNA, 16 nt, Human
ugagagugaacaaauu

SEQ ID NO: 2975295 - RNA, 15 nt, Human
ugagaucaaaacggu

SEQ ID NO: 2975296 - RNA, 14 nt, Human
ugagaucagccugg

SEQ ID NO: 2975297 - RNA, 15 nt, Human
ugagcagggcucagc

SEQ ID NO: 2975298 - RNA, 14 nt, Human
ugagcagggcucag

SEQ ID NO: 2975299 - RNA, 13 nt, Human
ugagcagggcuca

SEQ ID NO: 2975300 - RNA, 12 nt, Human
ugagcagggcuc

SEQ ID NO: 2975301 - RNA, 21 nt, Human
ugaccucaggugauccaccca

SEQ ID NO: 2975302 - RNA, 20 nt, Human
ugaccucaggugauccaccc

SEQ ID NO: 2975303 - RNA, 19 nt, Human
ugagacucgcgacaaugca

SEQ ID NO: 2975304 - RNA, 18 nt, Human
ugagcaucaggccaggcc

SEQ ID NO: 2975305 - RNA, 19 nt, Human
ugagcaucaggccaggccc

SEQ ID NO: 2975306 - RNA, 20 nt, Human
ugagcaucaggccaggcccu

SEQ ID NO: 2975307 - RNA, 13 nt, Human
ugagccccaaaag

SEQ ID NO: 2975308 - RNA, 16 nt, Human
ugagcaucaggccagg

SEQ ID NO: 2975309 - RNA, 17 nt, Human
ugagcagggcucagcgg

SEQ ID NO: 2975310 - RNA, 16 nt, Human
ugagcagggcucagcg

SEQ ID NO: 2975311 - RNA, 19 nt, Human
ugagcagggcucagcgggg

SEQ ID NO: 2975312 - RNA, 17 nt, Human
ugagccucagcauccug

SEQ ID NO: 2975313 - RNA, 21 nt, Human
ugagccgagaucacgccacug

SEQ ID NO: 2975314 - RNA, 19 nt, Human
ugagccgagaucacgccac

SEQ ID NO: 2975315 - RNA, 21 nt, Human
ugagccucagcauccuggcac

SEQ ID NO: 2975316 - RNA, 18 nt, Human
ugagccucagcauccugg

SEQ ID NO: 2975317 - RNA, 22 nt, Human
ugagccucagcauccuggcacc

SEQ ID NO: 2975318 - RNA, 13 nt, Human
ugaggcucugccc

SEQ ID NO: 2975319 - RNA, 14 nt, Human
ugaggcucugcccu

SEQ ID NO: 2975320 - RNA, 20 nt, Human
ugaggcuccacuuggucugu

SEQ ID NO: 2975321 - RNA, 18 nt, Human
ugaggcuccacuuggucu

SEQ ID NO: 2975322 - RNA, 17 nt, Human
ugagggaacagagaggu

SEQ ID NO: 2975323 - RNA, 16 nt, Human
ugagggagaugccaug

SEQ ID NO: 2975324 - RNA, 12 nt, Human
ugaggugggagg

SEQ ID NO: 2975325 - RNA, 13 nt, Human
ugaggugggagga

SEQ ID NO: 2975326 - RNA, 21 nt, Human
ugaggcauuuguuugaacuga

SEQ ID NO: 2975327 - RNA, 17 nt, Human
ugaggcuaguguggugu

SEQ ID NO: 2975328 - RNA, 23 nt, Human
ugaggcuagugugguguuuccug

SEQ ID NO: 2975329 - RNA, 20 nt, Human
ugaggcauuuguuugaacug

SEQ ID NO: 2975330 - RNA, 19 nt, Human
ugaggcauuuguuugaacu

SEQ ID NO: 2975331 - RNA, 12 nt, Human
ugaggcauuugu

SEQ ID NO: 2975332 - RNA, 13 nt, Human
ugagcugggauga

SEQ ID NO: 2975333 - RNA, 13 nt, Human
ugagucugaaggc

SEQ ID NO: 2975334 - RNA, 15 nt, Human
ugagucugaaggcug

SEQ ID NO: 2975335 - RNA, 17 nt, Human
ugagucugaaggcuggg

SEQ ID NO: 2975336 - RNA, 18 nt, Human
ugagucugaaggcugggu

SEQ ID NO: 2975337 - RNA, 19 nt, Human
ugagucgaggacagggagg

SEQ ID NO: 2975338 - RNA, 18 nt, Human
ugagucgaggacagggag

SEQ ID NO: 2975339 - RNA, 13 nt, Human
ugaguccagaagu

SEQ ID NO: 2975340 - RNA, 19 nt, Human
ugaguccagaaguuugaga

SEQ ID NO: 2975341 - RNA, 16 nt, Human
ugaguugauagcacag

SEQ ID NO: 2975342 - RNA, 20 nt, Human
ugaguugauagcacagaccc

SEQ ID NO: 2975343 - RNA, 14 nt, Human
ugagugagcaugcc

SEQ ID NO: 2975344 - RNA, 16 nt, Human
ugauaacuggaaacuu

SEQ ID NO: 2975345 - RNA, 17 nt, Human
ugaacaguaacauagcu

SEQ ID NO: 2975346 - RNA, 19 nt, Human
ugaacaguuguguuugaag

SEQ ID NO: 2975347 - RNA, 16 nt, Human
ugaacuccuggccuca

SEQ ID NO: 2975348 - RNA, 20 nt, Human
ugaaccaccacacccagccc

SEQ ID NO: 2975349 - RNA, 17 nt, Human
ugaaccaccacacccag

SEQ ID NO: 2975350 - RNA, 23 nt, Human
ugaaccacaucuugcucugcuga

SEQ ID NO: 2975351 - RNA, 22 nt, Human
ugaaccaagaacuuuccaggaa

SEQ ID NO: 2975352 - RNA, 17 nt, Human
ugaacauuucauggugu

SEQ ID NO: 2975353 - RNA, 22 nt, Human
ugaacauuuggguuacuauuuc

SEQ ID NO: 2975354 - RNA, 13 nt, Human
ugaaaugucaacc

SEQ ID NO: 2975355 - RNA, 17 nt, Human
ugaaaugucaguucuga

SEQ ID NO: 2975356 - RNA, 13 nt, Human
ugaaaugucaguu

SEQ ID NO: 2975357 - RNA, 20 nt, Human
ugaaaugucaguucugauau

SEQ ID NO: 2975358 - RNA, 18 nt, Human
ugaaaugucaguucugau

SEQ ID NO: 2975359 - RNA, 19 nt, Human
ugaaauggacuuuuguaca

SEQ ID NO: 2975360 - RNA, 16 nt, Human
ugaaauauugacuuuu

SEQ ID NO: 2975361 - RNA, 18 nt, Human
ugaaauauuauguuaaaa

SEQ ID NO: 2975362 - RNA, 22 nt, Human
ugaaacaacaaauaggaauugu

SEQ ID NO: 2975363 - RNA, 14 nt, Human
ugaaacauuuuguc

SEQ ID NO: 2975364 - RNA, 13 nt, Human
ugaaaauuuugau

SEQ ID NO: 2975365 - RNA, 21 nt, Human
ugaaaauuuugauguuuuaag

SEQ ID NO: 2975366 - RNA, 19 nt, Human
ugaaaauuuugauguuuua

SEQ ID NO: 2975367 - RNA, 16 nt, Human
ugaaaagccucuguuu

SEQ ID NO: 2975368 - RNA, 19 nt, Human
ugaaaagccucuguuuuga

SEQ ID NO: 2975369 - RNA, 22 nt, Human
ugaaaagccucuguuuugauau

SEQ ID NO: 2975370 - RNA, 20 nt, Human
ugaaaagccucuguuuugau

SEQ ID NO: 2975371 - RNA, 18 nt, Human
ugaaagaggcagcuugaa

SEQ ID NO: 2975372 - RNA, 18 nt, Human
ugaaagcccugagcuuuc

SEQ ID NO: 2975373 - RNA, 23 nt, Human
ugaaagcagggacuugaacccau

SEQ ID NO: 2975374 - RNA, 15 nt, Human
ugaaagguacuucaa

SEQ ID NO: 2975375 - RNA, 18 nt, Human
ugaaagggcccagagagg

SEQ ID NO: 2975376 - RNA, 16 nt, Human
ugaaagguacuucaaa

SEQ ID NO: 2975377 - RNA, 23 nt, Human
ugaaagggaguauuacaaaaaca

SEQ ID NO: 2975378 - RNA, 13 nt, Human
ugaaagggcccag

SEQ ID NO: 2975379 - RNA, 19 nt, Human
ucuuuccacagaagcucca

SEQ ID NO: 2975380 - RNA, 16 nt, Human
ucuuucagccaagaau

SEQ ID NO: 2975381 - RNA, 19 nt, Human
ucuuucagccaagaauucu

SEQ ID NO: 2975382 - RNA, 20 nt, Human
ucuuucagccaagaauucuu

SEQ ID NO: 2975383 - RNA, 21 nt, Human
ucuuucagccaagaauucuua

SEQ ID NO: 2975384 - RNA, 14 nt, Human
ucuuuccaaaguac

SEQ ID NO: 2975385 - RNA, 13 nt, Human
ucuuuccaaagua

SEQ ID NO: 2975386 - RNA, 12 nt, Human
ucuuugccaagu

SEQ ID NO: 2975387 - RNA, 17 nt, Human
ucuuuggacacucacac

SEQ ID NO: 2975388 - RNA, 16 nt, Human
ucucccuucauccuuc

SEQ ID NO: 2975389 - RNA, 20 nt, Human
ucuccucugcugcuggcugg

SEQ ID NO: 2975390 - RNA, 23 nt, Human
ucuugcaauggcagccuuggcaa

SEQ ID NO: 2975391 - RNA, 16 nt, Human
ucuuguguguuuauug

SEQ ID NO: 2975392 - RNA, 21 nt, Human
ucuuguguguuuauugucaaa

SEQ ID NO: 2975393 - RNA, 17 nt, Human
ucuuucacauuuaaaua

SEQ ID NO: 2975394 - RNA, 23 nt, Human
ucuuucacccuuuucuguuugcu

SEQ ID NO: 2975395 - RNA, 12 nt, Human
ugacaagcucac

SEQ ID NO: 2975396 - RNA, 20 nt, Human
ugacaagcucacagaccuuu

SEQ ID NO: 2975397 - RNA, 15 nt, Human
ugacaagcucacaga

SEQ ID NO: 2975398 - RNA, 18 nt, Human
ugacaaggauugcuacug

SEQ ID NO: 2975399 - RNA, 17 nt, Human
ugacagaggcagcccca

SEQ ID NO: 2975400 - RNA, 16 nt, Human
ugacagaggcagcccc

SEQ ID NO: 2975401 - RNA, 15 nt, Human
ugacagaggcagccc

SEQ ID NO: 2975402 - RNA, 14 nt, Human
ugacagaggcagcc

SEQ ID NO: 2975403 - RNA, 23 nt, Human
ugacagacacaggcccggcucca

SEQ ID NO: 2975404 - RNA, 20 nt, Human
ugacagacacaggcccggcu

SEQ ID NO: 2975405 - RNA, 13 nt, Human
ugacagaggcagc

SEQ ID NO: 2975406 - RNA, 17 nt, Human
ugacagagugagacucu

SEQ ID NO: 2975407 - RNA, 14 nt, Human
ugacagagugagac

SEQ ID NO: 2975408 - RNA, 23 nt, Human
ugacagaggcagccccauucugc

SEQ ID NO: 2975409 - RNA, 18 nt, Human
ugacagaggcagccccau

SEQ ID NO: 2975410 - RNA, 19 nt, Human
ugacagagugagacucugu

SEQ ID NO: 2975411 - RNA, 19 nt, Human
ugaccagcaccaucucucc

SEQ ID NO: 2975412 - RNA, 20 nt, Human
ugaccacugcagaagacagu

SEQ ID NO: 2975413 - RNA, 18 nt, Human
ugaccacugcagaagaca

SEQ ID NO: 2975414 - RNA, 15 nt, Human
ugacaugucuuuucu

SEQ ID NO: 2975415 - RNA, 13 nt, Human
ugacaugucuuuu

SEQ ID NO: 2975416 - RNA, 18 nt, Human
ugacaugggacauuugcu

SEQ ID NO: 2975417 - RNA, 17 nt, Human
ugacaugggacauuugc

SEQ ID NO: 2975418 - RNA, 16 nt, Human
ugacaugggacauuug

SEQ ID NO: 2975419 - RNA, 18 nt, Human
ugacauauacauacuuac

SEQ ID NO: 2975420 - RNA, 13 nt, Human
ugacauauacaua

SEQ ID NO: 2975421 - RNA, 13 nt, Human
ugaccgugaggcc

SEQ ID NO: 2975422 - RNA, 14 nt, Human
ugaccgugaggcca

SEQ ID NO: 2975423 - RNA, 16 nt, Human
ugaccgugaggccaga

SEQ ID NO: 2975424 - RNA, 20 nt, Human
ugaccgugaggccagagaca

SEQ ID NO: 2975425 - RNA, 17 nt, Human
ugaccauucuccaccug

SEQ ID NO: 2975426 - RNA, 18 nt, Human
ugaccauucuccaccugc

SEQ ID NO: 2975427 - RNA, 16 nt, Human
ugaccauucuccaccu

SEQ ID NO: 2975428 - RNA, 20 nt, Human
ugaaugaauggcuaagcaaa

SEQ ID NO: 2975429 - RNA, 18 nt, Human
ugaauuacauuuguauaa

SEQ ID NO: 2975430 - RNA, 16 nt, Human
ugaauuacauuuguau

SEQ ID NO: 2975431 - RNA, 15 nt, Human
ugaauuacauuugua

SEQ ID NO: 2975432 - RNA, 14 nt, Human
ugaauuacauuugu

SEQ ID NO: 2975433 - RNA, 13 nt, Human
ugaauuaugaaac

SEQ ID NO: 2975434 - RNA, 17 nt, Human
ugaauuaugaaacuuuu

SEQ ID NO: 2975435 - RNA, 15 nt, Human
ugaauuaugaaacuu

SEQ ID NO: 2975436 - RNA, 23 nt, Human
ugaauuccuaaaauuauggaaac

SEQ ID NO: 2975437 - RNA, 17 nt, Human
ugaauuccuaaaauuau

SEQ ID NO: 2975438 - RNA, 16 nt, Human
ugaauuccuaaaauua

SEQ ID NO: 2975439 - RNA, 20 nt, Human
ugaaggacauugcggacagc

SEQ ID NO: 2975440 - RNA, 19 nt, Human
ugaaggacauugcggacag

SEQ ID NO: 2975441 - RNA, 22 nt, Human
ugaaggacauugcggacagcca

SEQ ID NO: 2975442 - RNA, 15 nt, Human
ugaaggccccgccca

SEQ ID NO: 2975443 - RNA, 16 nt, Human
ugaaggccccgcccag

SEQ ID NO: 2975444 - RNA, 14 nt, Human
ugaagauacugaaa

SEQ ID NO: 2975445 - RNA, 17 nt, Human
ugaacuccuggccucaa

SEQ ID NO: 2975446 - RNA, 23 nt, Human
ugaacauuuggguuacuauuucu

SEQ ID NO: 2975447 - RNA, 18 nt, Human
ugaagauacugaaauaaa

SEQ ID NO: 2975448 - RNA, 16 nt, Human
ugaagauacugaaaua

SEQ ID NO: 2975449 - RNA, 15 nt, Human
ugaagauacugaaau

SEQ ID NO: 2975450 - RNA, 11 nt, Human
ugaaguccaag

SEQ ID NO: 2975451 - RNA, 17 nt, Human
ugaaggccccgcccagg

SEQ ID NO: 2975452 - RNA, 13 nt, Human
ugaaguccaagca

SEQ ID NO: 2975453 - RNA, 22 nt, Human
uccugucggagcccugucuccu

SEQ ID NO: 2975454 - RNA, 13 nt, Human
uccuguagcccua

SEQ ID NO: 2975455 - RNA, 11 nt, Human
uccuguagccc

SEQ ID NO: 2975456 - RNA, 22 nt, Human
uccuguaccucuugagccuuga

SEQ ID NO: 2975457 - RNA, 12 nt, Human
uccuggccucaa

SEQ ID NO: 2975458 - RNA, 19 nt, Human
uccuggcccagggcaucug

SEQ ID NO: 2975459 - RNA, 16 nt, Human
uccuggcccagggcau

SEQ ID NO: 2975460 - RNA, 15 nt, Human
uccuggcccagggca

SEQ ID NO: 2975461 - RNA, 22 nt, Human
uccuggcccagggcaucuggga

SEQ ID NO: 2975462 - RNA, 13 nt, Human
uccuggcccaggg

SEQ ID NO: 2975463 - RNA, 13 nt, Human
uccuggcacugcu

SEQ ID NO: 2975464 - RNA, 16 nt, Human
uccuggcacugcuucc

SEQ ID NO: 2975465 - RNA, 22 nt, Human
uccuggcacccggccccugcug

SEQ ID NO: 2975466 - RNA, 23 nt, Human
uccuggcacccggccccugcugg

SEQ ID NO: 2975467 - RNA, 14 nt, Human
uccuggaguucugg

SEQ ID NO: 2975468 - RNA, 14 nt, Human
uccuggacugaggg

SEQ ID NO: 2975469 - RNA, 20 nt, Human
uccuggacugagggggccug

SEQ ID NO: 2975470 - RNA, 22 nt, Human
uccuggacugagggggccugga

SEQ ID NO: 2975471 - RNA, 17 nt, Human
uccugcccuuaccugcc

SEQ ID NO: 2975472 - RNA, 20 nt, Human
uccugcccuuaccugccagg

SEQ ID NO: 2975473 - RNA, 17 nt, Human
uccugccccugagccca

SEQ ID NO: 2975474 - RNA, 18 nt, Human
uccugccccugagcccau

SEQ ID NO: 2975475 - RNA, 20 nt, Human
uccugaggcuccacuugguc

SEQ ID NO: 2975476 - RNA, 19 nt, Human
uccugaggcuccacuuggu

SEQ ID NO: 2975477 - RNA, 17 nt, Human
uccugaggcuccacuug

SEQ ID NO: 2975478 - RNA, 13 nt, Human
uccugccaggcau

SEQ ID NO: 2975479 - RNA, 14 nt, Human
uccugccaggcaug

SEQ ID NO: 2975480 - RNA, 21 nt, Human
uccugagccagauuucacucu

SEQ ID NO: 2975481 - RNA, 20 nt, Human
ucccuucacaaacccagugu

SEQ ID NO: 2975482 - RNA, 15 nt, Human
ucccccuuccaugga

SEQ ID NO: 2975483 - RNA, 16 nt, Human
ucccuuccucuuucca

SEQ ID NO: 2975484 - RNA, 15 nt, Human
ucccuuccucuuucc

SEQ ID NO: 2975485 - RNA, 16 nt, Human
ucccuuggacauuuua

SEQ ID NO: 2975486 - RNA, 18 nt, Human
ucccuuggacauuuuaug

SEQ ID NO: 2975487 - RNA, 19 nt, Human
ucccuuggacauuuuaugu

SEQ ID NO: 2975488 - RNA, 21 nt, Human
ucccuuggacauuuuaugucu

SEQ ID NO: 2975489 - RNA, 15 nt, Human
ucccuuggacauuuu

SEQ ID NO: 2975490 - RNA, 14 nt, Human
uccgccucuugggu

SEQ ID NO: 2975491 - RNA, 21 nt, Human
uccuaagcuauucaguaauaa

SEQ ID NO: 2975492 - RNA, 20 nt, Human
uccuaagcuauucaguaaua

SEQ ID NO: 2975493 - RNA, 20 nt, Human
uccgcuuucuacccagcgag

SEQ ID NO: 2975494 - RNA, 18 nt, Human
uccgcuuucuacccagcg

SEQ ID NO: 2975495 - RNA, 16 nt, Human
uccgcuuucuacccag

SEQ ID NO: 2975496 - RNA, 17 nt, Human
uccuagucauucuuccc

SEQ ID NO: 2975497 - RNA, 14 nt, Human
uccuagugaaagag

SEQ ID NO: 2975498 - RNA, 23 nt, Human
uccuagugaaagaggcagcuuga

SEQ ID NO: 2975499 - RNA, 21 nt, Human
uccuauauuguuuucagugua

SEQ ID NO: 2975500 - RNA, 23 nt, Human
uccuauauuguuuucaguguaca

SEQ ID NO: 2975501 - RNA, 22 nt, Human
uccucauuuuuauaaugucccu

SEQ ID NO: 2975502 - RNA, 18 nt, Human
uccucauuagcauuuugc

SEQ ID NO: 2975503 - RNA, 13 nt, Human
uccuccacauuug

SEQ ID NO: 2975504 - RNA, 16 nt, Human
uccuccacauuuguuu

SEQ ID NO: 2975505 - RNA, 10 nt, Human
uccuccaggu

SEQ ID NO: 2975506 - RNA, 12 nt, Human
uccucccaccuc

SEQ ID NO: 2975507 - RNA, 22 nt, Human
ucuccagccccuggaugcagcc

SEQ ID NO: 2975508 - RNA, 16 nt, Human
ucuccagccccuggau

SEQ ID NO: 2975509 - RNA, 18 nt, Human
ucuccagccccuggaugc

SEQ ID NO: 2975510 - RNA, 15 nt, Human
ucuccagcugcugag

SEQ ID NO: 2975511 - RNA, 13 nt, Human
ucuccagcugcug

SEQ ID NO: 2975512 - RNA, 12 nt, Human
ucuccagccccu

SEQ ID NO: 2975513 - RNA, 13 nt, Human
ucuccagccccug

SEQ ID NO: 2975514 - RNA, 14 nt, Human
ucuccagccccugg

SEQ ID NO: 2975515 - RNA, 15 nt, Human
ucuccagccccugga

SEQ ID NO: 2975516 - RNA, 12 nt, Human
ucucccccagcc

SEQ ID NO: 2975517 - RNA, 23 nt, Human
ucucccucagucuggcccuuccu

SEQ ID NO: 2975518 - RNA, 18 nt, Human
ucucccucagucuggccc

SEQ ID NO: 2975519 - RNA, 20 nt, Human
ucucccugcugcuccuagga

SEQ ID NO: 2975520 - RNA, 18 nt, Human
ucucccugcugcuccuag

SEQ ID NO: 2975521 - RNA, 14 nt, Human
ucuccaccugccag

SEQ ID NO: 2975522 - RNA, 15 nt, Human
ucuccaccugccagg

SEQ ID NO: 2975523 - RNA, 16 nt, Human
ucuccaccugccaggg

SEQ ID NO: 2975524 - RNA, 17 nt, Human
ucuccaccugccaggga

SEQ ID NO: 2975525 - RNA, 19 nt, Human
ucuccaccugccagggaca

SEQ ID NO: 2975526 - RNA, 22 nt, Human
ucuccaccugccagggacagag

SEQ ID NO: 2975527 - RNA, 16 nt, Human
ucuccacccugcucuc

SEQ ID NO: 2975528 - RNA, 14 nt, Human
ucuccacccugcuc

SEQ ID NO: 2975529 - RNA, 17 nt, Human
ucuccacccugcucucc

SEQ ID NO: 2975530 - RNA, 12 nt, Human
ucuccacccugc

SEQ ID NO: 2975531 - RNA, 13 nt, Human
ucuccacccugcu

SEQ ID NO: 2975532 - RNA, 23 nt, Human
ucucaguccaugaagauguagag

SEQ ID NO: 2975533 - RNA, 13 nt, Human
ucuaugggacuca

SEQ ID NO: 2975534 - RNA, 12 nt, Human
ucuaugggacuc

SEQ ID NO: 2975535 - RNA, 19 nt, Human
ucuaugggacucaaugcac

SEQ ID NO: 2975536 - RNA, 18 nt, Human
ucucauacucaccucacc

SEQ ID NO: 2975537 - RNA, 16 nt, Human
ucucauacucaccuca

SEQ ID NO: 2975538 - RNA, 17 nt, Human
ucuaugacacaugcaag

SEQ ID NO: 2975539 - RNA, 14 nt, Human
ucuaugacacaugc

SEQ ID NO: 2975540 - RNA, 18 nt, Human
ucuaugaaauauuauguu

SEQ ID NO: 2975541 - RNA, 19 nt, Human
ucuaggaagacuuuggaaa

SEQ ID NO: 2975542 - RNA, 15 nt, Human
ucuaggaagacuuug

SEQ ID NO: 2975543 - RNA, 16 nt, Human
ucuaggaagacuuugg

SEQ ID NO: 2975544 - RNA, 14 nt, Human
ucuaccuuccugca

SEQ ID NO: 2975545 - RNA, 16 nt, Human
ucuacagaggccaugg

SEQ ID NO: 2975546 - RNA, 15 nt, Human
ucuacagaggccaug

SEQ ID NO: 2975547 - RNA, 21 nt, Human
ucuacacugugcugagucuga

SEQ ID NO: 2975548 - RNA, 20 nt, Human
ucuaaaggcuaccuuuguau

SEQ ID NO: 2975549 - RNA, 19 nt, Human
ucuaaaggcuaccuuugua

SEQ ID NO: 2975550 - RNA, 17 nt, Human
ucuaaaggcuaccuuug

SEQ ID NO: 2975551 - RNA, 18 nt, Human
ucuaaaggcuaccuuugu

SEQ ID NO: 2975552 - RNA, 14 nt, Human
ucggagaagagcug

SEQ ID NO: 2975553 - RNA, 16 nt, Human
ucggagaagagcuguu

SEQ ID NO: 2975554 - RNA, 12 nt, Human
ucggagaagagc

SEQ ID NO: 2975555 - RNA, 15 nt, Human
ucggccccaccagug

SEQ ID NO: 2975556 - RNA, 13 nt, Human
ucgugacaacacu

SEQ ID NO: 2975557 - RNA, 18 nt, Human
uccccagauugcaacagg

SEQ ID NO: 2975558 - RNA, 13 nt, Human
uccccagauugca

SEQ ID NO: 2975559 - RNA, 20 nt, Human
ucccaugagccucagcaucc

SEQ ID NO: 2975560 - RNA, 17 nt, Human
ucccaugagccucagca

SEQ ID NO: 2975561 - RNA, 22 nt, Human
uccccagcaagugagagcuggg

SEQ ID NO: 2975562 - RNA, 21 nt, Human
uccccagcaagugagagcugg

SEQ ID NO: 2975563 - RNA, 20 nt, Human
uccccagcaagugagagcug

SEQ ID NO: 2975564 - RNA, 23 nt, Human
uccccagauugcaacaggcuggg

SEQ ID NO: 2975565 - RNA, 22 nt, Human
uccccagauugcaacaggcugg

SEQ ID NO: 2975566 - RNA, 20 nt, Human
uccccagauugcaacaggcu

SEQ ID NO: 2975567 - RNA, 19 nt, Human
uccccagauugcaacaggc

SEQ ID NO: 2975568 - RNA, 13 nt, Human
uccccaggaggcc

SEQ ID NO: 2975569 - RNA, 17 nt, Human
ucccccagccccauccu

SEQ ID NO: 2975570 - RNA, 15 nt, Human
uccccaggaggccag

SEQ ID NO: 2975571 - RNA, 16 nt, Human
uccccaggaggccagc

SEQ ID NO: 2975572 - RNA, 20 nt, Human
ucccccagccccauccucug

SEQ ID NO: 2975573 - RNA, 21 nt, Human
ucccccagccccauccucugu

SEQ ID NO: 2975574 - RNA, 22 nt, Human
ucccccagccccauccucugua

SEQ ID NO: 2975575 - RNA, 14 nt, Human
uccccaggaggcca

SEQ ID NO: 2975576 - RNA, 19 nt, Human
ucccaugagccucagcauc

SEQ ID NO: 2975577 - RNA, 18 nt, Human
ucccaugagccucagcau

SEQ ID NO: 2975578 - RNA, 21 nt, Human
ucccaucugugaaaggaaaga

SEQ ID NO: 2975579 - RNA, 15 nt, Human
ucccaucuuccaagg

SEQ ID NO: 2975580 - RNA, 22 nt, Human
ucccagcugugcucuggacagg

SEQ ID NO: 2975581 - RNA, 21 nt, Human
ucccagcugugcucuggacag

SEQ ID NO: 2975582 - RNA, 23 nt, Human
ucccagcugugcucuggacaggc

SEQ ID NO: 2975583 - RNA, 20 nt, Human
ucccaccuggcucuguggcg

SEQ ID NO: 2975584 - RNA, 23 nt, Human
ucccaggcauuccccaggaggcc

SEQ ID NO: 2975585 - RNA, 24 nt, Human
ucccaggcauuccccaggaggcca

SEQ ID NO: 2975586 - RNA, 20 nt, Human
uccaugugggcuaguugggc

SEQ ID NO: 2975587 - RNA, 22 nt, Human
ucccaccucucucacuccuuga

SEQ ID NO: 2975588 - RNA, 20 nt, Human
ucccagcugugcucuggaca

SEQ ID NO: 2975589 - RNA, 17 nt, Human
ucccaccuuggcugcag

SEQ ID NO: 2975590 - RNA, 16 nt, Human
ucccaccuuggcugca

SEQ ID NO: 2975591 - RNA, 19 nt, Human
ucccaccuggcucuguggc

SEQ ID NO: 2975592 - RNA, 16 nt, Human
ucccaccuggcucugu

SEQ ID NO: 2975593 - RNA, 15 nt, Human
ucccaccuggcucug

SEQ ID NO: 2975594 - RNA, 14 nt, Human
ucccaccuggcucu

SEQ ID NO: 2975595 - RNA, 13 nt, Human
ucccaccuuggcu

SEQ ID NO: 2975596 - RNA, 16 nt, Human
uccaaaguacacuguu

SEQ ID NO: 2975597 - RNA, 14 nt, Human
uccaaaguacacug

SEQ ID NO: 2975598 - RNA, 17 nt, Human
uccacuuggucugugag

SEQ ID NO: 2975599 - RNA, 21 nt, Human
uccacuuggucugugagaugc

SEQ ID NO: 2975600 - RNA, 20 nt, Human
uccacuuucuagccagagga

SEQ ID NO: 2975601 - RNA, 21 nt, Human
uccacuuucuagccagaggag

SEQ ID NO: 2975602 - RNA, 23 nt, Human
uccacuuggucugugagaugcua

SEQ ID NO: 2975603 - RNA, 19 nt, Human
uccacuuucuagccagagg

SEQ ID NO: 2975604 - RNA, 12 nt, Human
uccaggagcagc

SEQ ID NO: 2975605 - RNA, 13 nt, Human
uccaggagcagcc

SEQ ID NO: 2975606 - RNA, 14 nt, Human
uccaggagcagcca

SEQ ID NO: 2975607 - RNA, 15 nt, Human
uccaggagcagccac

SEQ ID NO: 2975608 - RNA, 19 nt, Human
uccaggggugggacacccu

SEQ ID NO: 2975609 - RNA, 20 nt, Human
uccaggggugggacacccug

SEQ ID NO: 2975610 - RNA, 14 nt, Human
uccagcugcugaga

SEQ ID NO: 2975611 - RNA, 20 nt, Human
uccagguuuaagcuguuacu

SEQ ID NO: 2975612 - RNA, 19 nt, Human
uccagguagagggugugua

SEQ ID NO: 2975613 - RNA, 18 nt, Human
uccagguuuaagcuguua

SEQ ID NO: 2975614 - RNA, 12 nt, Human
uccauacauuug

SEQ ID NO: 2975615 - RNA, 20 nt, Human
uccaugggccauaugaaaag

SEQ ID NO: 2975616 - RNA, 14 nt, Human
uccauagagagcaa

SEQ ID NO: 2975617 - RNA, 15 nt, Human
uccauagagagcaag

SEQ ID NO: 2975618 - RNA, 15 nt, Human
uccauacauuugugu

SEQ ID NO: 2975619 - RNA, 23 nt, Human
ucaggaagcucagggccuggcuc

SEQ ID NO: 2975620 - RNA, 23 nt, Human
ucagcucugcaagaauugaagca

SEQ ID NO: 2975621 - RNA, 24 nt, Human
ucagcuccagcucaccagccccag

SEQ ID NO: 2975622 - RNA, 23 nt, Human
ucagcuccagcucaccagcccca

SEQ ID NO: 2975623 - RNA, 21 nt, Human
ucaggccugggggcugggcag

SEQ ID NO: 2975624 - RNA, 19 nt, Human
ucagguggggcagcuugag

SEQ ID NO: 2975625 - RNA, 18 nt, Human
ucagguggggcagcuuga

SEQ ID NO: 2975626 - RNA, 23 nt, Human
ucaggugauccacccaccucagc

SEQ ID NO: 2975627 - RNA, 23 nt, Human
ucaggugagaagcagaggaagga

SEQ ID NO: 2975628 - RNA, 16 nt, Human
ucaggugauccaccca

SEQ ID NO: 2975629 - RNA, 23 nt, Human
ucagucugauucccaagcucugc

SEQ ID NO: 2975630 - RNA, 22 nt, Human
ucagucugauucccaagcucug

SEQ ID NO: 2975631 - RNA, 21 nt, Human
ucagucugauucccaagcucu

SEQ ID NO: 2975632 - RNA, 19 nt, Human
ucagucugauucccaagcu

SEQ ID NO: 2975633 - RNA, 20 nt, Human
ucagguggggcagcuugagg

SEQ ID NO: 2975634 - RNA, 16 nt, Human
ucauuaggauggcuag

SEQ ID NO: 2975635 - RNA, 14 nt, Human
uccaaagaaaugua

SEQ ID NO: 2975636 - RNA, 17 nt, Human
uccaaagaaauguaagg

SEQ ID NO: 2975637 - RNA, 13 nt, Human
uccaaaguacacu

SEQ ID NO: 2975638 - RNA, 11 nt, Human
ucauagcagcu

SEQ ID NO: 2975639 - RNA, 12 nt, Human
ucauagcagcuu

SEQ ID NO: 2975640 - RNA, 20 nt, Human
ucaguguacauggaauaaca

SEQ ID NO: 2975641 - RNA, 17 nt, Human
ucaucaaugaaugaaug

SEQ ID NO: 2975642 - RNA, 14 nt, Human
ucaucauccuaagc

SEQ ID NO: 2975643 - RNA, 19 nt, Human
ucaucuugaauuguaagga

SEQ ID NO: 2975644 - RNA, 17 nt, Human
ucauccacugugccaug

SEQ ID NO: 2975645 - RNA, 14 nt, Human
ucauccacugugcc

SEQ ID NO: 2975646 - RNA, 17 nt, Human
ucaugcuguucaugaaa

SEQ ID NO: 2975647 - RNA, 20 nt, Human
uaugauugccuuuuuauaac

SEQ ID NO: 2975648 - RNA, 23 nt, Human
uaugauugccuuuuuauaacuuu

SEQ ID NO: 2975649 - RNA, 16 nt, Human
uaugauucccagccag

SEQ ID NO: 2975650 - RNA, 21 nt, Human
uaugauucaaaugucuauaaa

SEQ ID NO: 2975651 - RNA, 16 nt, Human
uaugauucaaaugucu

SEQ ID NO: 2975652 - RNA, 21 nt, Human
uaugagaaacuggcaaagcag

SEQ ID NO: 2975653 - RNA, 16 nt, Human
uaugacuccagaauuu

SEQ ID NO: 2975654 - RNA, 17 nt, Human
uaugacuccagaauuuc

SEQ ID NO: 2975655 - RNA, 23 nt, Human
uaugacuccagaauuucccaaag

SEQ ID NO: 2975656 - RNA, 13 nt, Human
uaugcaaagcacu

SEQ ID NO: 2975657 - RNA, 14 nt, Human
uaugcaaagcacug

SEQ ID NO: 2975658 - RNA, 12 nt, Human
uaugcaaagcac

SEQ ID NO: 2975659 - RNA, 18 nt, Human
uaugcaaucaaaucugcu

SEQ ID NO: 2975660 - RNA, 15 nt, Human
uaugcaaagcacuga

SEQ ID NO: 2975661 - RNA, 13 nt, Human
uaugcaaagucua

SEQ ID NO: 2975662 - RNA, 14 nt, Human
uaugcacacauuuu

SEQ ID NO: 2975663 - RNA, 16 nt, Human
uaugcacacacauaua

SEQ ID NO: 2975664 - RNA, 14 nt, Human
uaugcacacacaua

SEQ ID NO: 2975665 - RNA, 13 nt, Human
uaugcacacauuu

SEQ ID NO: 2975666 - RNA, 13 nt, Human
uauggaacacucu

SEQ ID NO: 2975667 - RNA, 16 nt, Human
uauggaacacucugag

SEQ ID NO: 2975668 - RNA, 17 nt, Human
uauggaacacucugaga

SEQ ID NO: 2975669 - RNA, 18 nt, Human
uauggaacacucugagac

SEQ ID NO: 2975670 - RNA, 19 nt, Human
uauggaacacucugagacu

SEQ ID NO: 2975671 - RNA, 16 nt, Human
uauggaagcacccauu

SEQ ID NO: 2975672 - RNA, 17 nt, Human
uauggacaaugacccag

SEQ ID NO: 2975673 - RNA, 22 nt, Human
uaugcuuauacacuuacacuuu

SEQ ID NO: 2975674 - RNA, 18 nt, Human
uaugcaugaaguaauaug

SEQ ID NO: 2975675 - RNA, 13 nt, Human
uaugcaugaagua

SEQ ID NO: 2975676 - RNA, 16 nt, Human
uaugcuucuguuuuau

SEQ ID NO: 2975677 - RNA, 15 nt, Human
uaugcuucuguuuua

SEQ ID NO: 2975678 - RNA, 18 nt, Human
uaucuguucauauggaua

SEQ ID NO: 2975679 - RNA, 16 nt, Human
uaucuuacgaaaaaau

SEQ ID NO: 2975680 - RNA, 13 nt, Human
uaucuuacgaaaa

SEQ ID NO: 2975681 - RNA, 23 nt, Human
uaucugucauuugagcagggcuc

SEQ ID NO: 2975682 - RNA, 21 nt, Human
uaucugucauuugagcagggc

SEQ ID NO: 2975683 - RNA, 20 nt, Human
uaucugucauuugagcaggg

SEQ ID NO: 2975684 - RNA, 23 nt, Human
uaugaauuacauuuguauaaaau

SEQ ID NO: 2975685 - RNA, 17 nt, Human
uaugaauuacauuugua

SEQ ID NO: 2975686 - RNA, 22 nt, Human
uaugacacaugcaaggucauuu

SEQ ID NO: 2975687 - RNA, 12 nt, Human
uaugacacaugc

SEQ ID NO: 2975688 - RNA, 21 nt, Human
uaucuaauauguaacaagcca

SEQ ID NO: 2975689 - RNA, 14 nt, Human
uauccuucagccug

SEQ ID NO: 2975690 - RNA, 15 nt, Human
uauccuucagccuga

SEQ ID NO: 2975691 - RNA, 16 nt, Human
uaucuaaauguugaaa

SEQ ID NO: 2975692 - RNA, 14 nt, Human
uauccucuguugau

SEQ ID NO: 2975693 - RNA, 19 nt, Human
uauauguuuuaagaggcag

SEQ ID NO: 2975694 - RNA, 13 nt, Human
uauaugcuucugu

SEQ ID NO: 2975695 - RNA, 21 nt, Human
uauaugcucugcauguuacau

SEQ ID NO: 2975696 - RNA, 20 nt, Human
uauaugcucugcauguuaca

SEQ ID NO: 2975697 - RNA, 21 nt, Human
uauaucuauauuuuacauaaa

SEQ ID NO: 2975698 - RNA, 18 nt, Human
uauaaacuuuaccuuuuu

SEQ ID NO: 2975699 - RNA, 13 nt, Human
uaguaucaaaaga

SEQ ID NO: 2975700 - RNA, 23 nt, Human
uaggugacagagugagacucugu

SEQ ID NO: 2975701 - RNA, 13 nt, Human
uaggugacauaua

SEQ ID NO: 2975702 - RNA, 16 nt, Human
uaguauuucuaugaaa

SEQ ID NO: 2975703 - RNA, 19 nt, Human
uaguauuucuaugaaauau

SEQ ID NO: 2975704 - RNA, 18 nt, Human
uaguauuucuaugaaaua

SEQ ID NO: 2975705 - RNA, 18 nt, Human
uaguauuuuuuacauuuu

SEQ ID NO: 2975706 - RNA, 15 nt, Human
uagugcaaauuguca

SEQ ID NO: 2975707 - RNA, 14 nt, Human
uagugcaaauuguc

SEQ ID NO: 2975708 - RNA, 13 nt, Human
uagucaaauugug

SEQ ID NO: 2975709 - RNA, 23 nt, Human
uaguauuuuuuacauuuuacaca

SEQ ID NO: 2975710 - RNA, 12 nt, Human
uaggaauugacc

SEQ ID NO: 2975711 - RNA, 16 nt, Human
uaggccaugggacagg

SEQ ID NO: 2975712 - RNA, 18 nt, Human
uaggccaugggacaggga

SEQ ID NO: 2975713 - RNA, 19 nt, Human
uaggacccgucuccagcug

SEQ ID NO: 2975714 - RNA, 15 nt, Human
uaggccuggccagau

SEQ ID NO: 2975715 - RNA, 18 nt, Human
uaggccuggccagaugca

SEQ ID NO: 2975716 - RNA, 16 nt, Human
uaggucagugcaaaua

SEQ ID NO: 2975717 - RNA, 20 nt, Human
uagggaaaaaccagcgugug

SEQ ID NO: 2975718 - RNA, 21 nt, Human
uagggaaaaaccagcguguga

SEQ ID NO: 2975719 - RNA, 19 nt, Human
uagggaaaaaccagcgugu

SEQ ID NO: 2975720 - RNA, 11 nt, Human
uagggaaaaac

SEQ ID NO: 2975721 - RNA, 17 nt, Human
uaggcuauuccugagag

SEQ ID NO: 2975722 - RNA, 15 nt, Human
uaggcuauuccugag

SEQ ID NO: 2975723 - RNA, 13 nt, Human
uauguuaauauuu

SEQ ID NO: 2975724 - RNA, 16 nt, Human
uauguuaauauuucug

SEQ ID NO: 2975725 - RNA, 14 nt, Human
uauguuaauauuuu

SEQ ID NO: 2975726 - RNA, 19 nt, Human
uauguuagugcaaauuguc

SEQ ID NO: 2975727 - RNA, 13 nt, Human
uauguguucuauu

SEQ ID NO: 2975728 - RNA, 12 nt, Human
uauguuaaaacu

SEQ ID NO: 2975729 - RNA, 19 nt, Human
uauggaggcuuugcauaga

SEQ ID NO: 2975730 - RNA, 22 nt, Human
uauguucuuaguggauguucug

SEQ ID NO: 2975731 - RNA, 17 nt, Human
uauguucuaagaaguga

SEQ ID NO: 2975732 - RNA, 21 nt, Human
uauguugcccaggcaggucuu

SEQ ID NO: 2975733 - RNA, 16 nt, Human
uauuaagaaagacuau

SEQ ID NO: 2975734 - RNA, 17 nt, Human
uauuaaaugcccagccc

SEQ ID NO: 2975735 - RNA, 19 nt, Human
uauuaaaugcccagccccu

SEQ ID NO: 2975736 - RNA, 15 nt, Human
uauuaaaugcccagc

SEQ ID NO: 2975737 - RNA, 13 nt, Human
uauuauauucauu

SEQ ID NO: 2975738 - RNA, 17 nt, Human
uauuauauucauucuuu

SEQ ID NO: 2975739 - RNA, 23 nt, Human
uauuauauucauucuuuuugaaa

SEQ ID NO: 2975740 - RNA, 17 nt, Human
uauuauauuuacaaaug

SEQ ID NO: 2975741 - RNA, 14 nt, Human
uauuauaccuuuuu

SEQ ID NO: 2975742 - RNA, 14 nt, Human
uauuaaggaagaca

SEQ ID NO: 2975743 - RNA, 13 nt, Human
uauuauaccuuuu

SEQ ID NO: 2975744 - RNA, 12 nt, Human
uauuauaccuuu

SEQ ID NO: 2975745 - RNA, 16 nt, Human
uauuauguuaaaacug

SEQ ID NO: 2975746 - RNA, 21 nt, Human
uauuauuugcagugcaguaua

SEQ ID NO: 2975747 - RNA, 20 nt, Human
uauuauuugcagugcaguau

SEQ ID NO: 2975748 - RNA, 12 nt, Human
uauuauuugcag

SEQ ID NO: 2975749 - RNA, 18 nt, Human
uauucauucuuuuugaaa

SEQ ID NO: 2975750 - RNA, 23 nt, Human
uauucauucuuuuugaaauguca

SEQ ID NO: 2975751 - RNA, 20 nt, Human
uauugauaugcuuauacacu

SEQ ID NO: 2975752 - RNA, 19 nt, Human
uauugcauacuauuaaaca

SEQ ID NO: 2975753 - RNA, 23 nt, Human
uauugcauacuauuaaacaugcu

SEQ ID NO: 2975754 - RNA, 16 nt, Human
uauuguuuaaaaucau

SEQ ID NO: 2975755 - RNA, 17 nt, Human
uauuguuuaaaaucauu

SEQ ID NO: 2975756 - RNA, 15 nt, Human
uauuguuuaaaauca

SEQ ID NO: 2975757 - RNA, 15 nt, Human
uauugcccacgcugg

SEQ ID NO: 2975758 - RNA, 14 nt, Human
uauugccaaugcua

SEQ ID NO: 2975759 - RNA, 14 nt, Human
uauugcccacgcug

SEQ ID NO: 2975760 - RNA, 13 nt, Human
uauugcccacgcu

SEQ ID NO: 2975761 - RNA, 23 nt, Human
uauugcugauggugcaaugaccu

SEQ ID NO: 2975762 - RNA, 22 nt, Human
uauugcugauggugcaaugacc

SEQ ID NO: 2975763 - RNA, 18 nt, Human
uauuugaaacacugguuu

SEQ ID NO: 2975764 - RNA, 15 nt, Human
uauuucuaugaaaua

SEQ ID NO: 2975765 - RNA, 14 nt, Human
uauuucuaugaaau

SEQ ID NO: 2975766 - RNA, 20 nt, Human
uauuucuugugguuauaacu

SEQ ID NO: 2975767 - RNA, 23 nt, Human
uauuucuugugguuauaacuuaa

SEQ ID NO: 2975768 - RNA, 22 nt, Human
uauuuauuaaaugcccagcccc

SEQ ID NO: 2975769 - RNA, 14 nt, Human
uauuuauuacugua

SEQ ID NO: 2975770 - RNA, 13 nt, Human
uauuucuaugaaa

SEQ ID NO: 2975771 - RNA, 13 nt, Human
uauuuauuacugu

SEQ ID NO: 2975772 - RNA, 17 nt, Human
uauuuaaauagaugaca

SEQ ID NO: 2975773 - RNA, 15 nt, Human
uauuuaaauagauga

SEQ ID NO: 2975774 - RNA, 20 nt, Human
uauuguuuaaaaucauuucu

SEQ ID NO: 2975775 - RNA, 17 nt, Human
uauuuaugggauccugg

SEQ ID NO: 2975776 - RNA, 12 nt, Human
ucaaauguguac

SEQ ID NO: 2975777 - RNA, 18 nt, Human
ucaaauaugcaaagcacu

SEQ ID NO: 2975778 - RNA, 19 nt, Human
ucaaauaugcaaagcacug

SEQ ID NO: 2975779 - RNA, 15 nt, Human
ucaaauccuugaaga

SEQ ID NO: 2975780 - RNA, 16 nt, Human
ucaaauccuugaagau

SEQ ID NO: 2975781 - RNA, 12 nt, Human
ucaaagagguuu

SEQ ID NO: 2975782 - RNA, 23 nt, Human
ucaaagagguuuuaaaaaaaucc

SEQ ID NO: 2975783 - RNA, 16 nt, Human
ucaaauaugcaaagca

SEQ ID NO: 2975784 - RNA, 17 nt, Human
ucaaauaugcaaagcac

SEQ ID NO: 2975785 - RNA, 22 nt, Human
ucaaacagucucaggaaaucaa

SEQ ID NO: 2975786 - RNA, 17 nt, Human
ucaaacauauauaacaa

SEQ ID NO: 2975787 - RNA, 22 nt, Human
uauuugcagugcaguauagaau

SEQ ID NO: 2975788 - RNA, 20 nt, Human
uauuugcagugcaguauaga

SEQ ID NO: 2975789 - RNA, 22 nt, Human
ucaacuccaaacugacucuuaa

SEQ ID NO: 2975790 - RNA, 19 nt, Human
ucaacuccaaacugacucu

SEQ ID NO: 2975791 - RNA, 20 nt, Human
ucaacucuccuccagaguca

SEQ ID NO: 2975792 - RNA, 19 nt, Human
ucaaccccuucgcuccugu

SEQ ID NO: 2975793 - RNA, 18 nt, Human
ucaaccccuucgcuccug

SEQ ID NO: 2975794 - RNA, 15 nt, Human
ucaaccuccugggcu

SEQ ID NO: 2975795 - RNA, 20 nt, Human
ucaaccccuucgcuccugug

SEQ ID NO: 2975796 - RNA, 16 nt, Human
ucaaccuccugggcua

SEQ ID NO: 2975797 - RNA, 15 nt, Human
ucaaggauccugagc

SEQ ID NO: 2975798 - RNA, 16 nt, Human
ucaaggauccugagcc

SEQ ID NO: 2975799 - RNA, 17 nt, Human
ucaaggauccugagcca

SEQ ID NO: 2975800 - RNA, 13 nt, Human
ucaaggauccuga

SEQ ID NO: 2975801 - RNA, 14 nt, Human
ucaaggauccugag

SEQ ID NO: 2975802 - RNA, 19 nt, Human
ucaagcgauucuucugcuu

SEQ ID NO: 2975803 - RNA, 18 nt, Human
ucaagcgauucuucugcu

SEQ ID NO: 2975804 - RNA, 21 nt, Human
ucaagcgauucuucugcuuca

SEQ ID NO: 2975805 - RNA, 12 nt, Human
ucaagccaccaa

SEQ ID NO: 2975806 - RNA, 20 nt, Human
ucaagccaccaacauacucc

SEQ ID NO: 2975807 - RNA, 17 nt, Human
ucaagcgauucuucugc

SEQ ID NO: 2975808 - RNA, 17 nt, Human
ucacauuggaaacaagu

SEQ ID NO: 2975809 - RNA, 12 nt, Human
ucacauuuaaau

SEQ ID NO: 2975810 - RNA, 17 nt, Human
ucaccaacgucugugcc

SEQ ID NO: 2975811 - RNA, 18 nt, Human
ucaccaacgucugugcca

SEQ ID NO: 2975812 - RNA, 21 nt, Human
ucaccaaaucagcugcuacua

SEQ ID NO: 2975813 - RNA, 14 nt, Human
ucacauuuauucug

SEQ ID NO: 2975814 - RNA, 13 nt, Human
ucaccaagcccag

SEQ ID NO: 2975815 - RNA, 16 nt, Human
ucaccacaugugcaca

SEQ ID NO: 2975816 - RNA, 18 nt, Human
ucacccgcuaagagggag

SEQ ID NO: 2975817 - RNA, 12 nt, Human
ucacccuuuucu

SEQ ID NO: 2975818 - RNA, 14 nt, Human
ucaccgaaaacgug

SEQ ID NO: 2975819 - RNA, 19 nt, Human
ucacccgcuaagagggagg

SEQ ID NO: 2975820 - RNA, 15 nt, Human
ucaccgaaaacgugg

SEQ ID NO: 2975821 - RNA, 19 nt, Human
ucaccgaaaacguggcugc

SEQ ID NO: 2975822 - RNA, 20 nt, Human
ucaccgaaaacguggcugcu

SEQ ID NO: 2975823 - RNA, 21 nt, Human
ucaccgaaaacguggcugcuu

SEQ ID NO: 2975824 - RNA, 22 nt, Human
ucaccgaaaacguggcugcuuc

SEQ ID NO: 2975825 - RNA, 23 nt, Human
ucaccgaaaacguggcugcuuca

SEQ ID NO: 2975826 - RNA, 22 nt, Human
ucacacaugagcaucaggccag

SEQ ID NO: 2975827 - RNA, 23 nt, Human
ucacacaugagcaucaggccagg

SEQ ID NO: 2975828 - RNA, 15 nt, Human
ucacacacuuuggcu

SEQ ID NO: 2975829 - RNA, 20 nt, Human
ucacauuccugaacaggaua

SEQ ID NO: 2975830 - RNA, 14 nt, Human
ucacauuggaaaca

SEQ ID NO: 2975831 - RNA, 22 nt, Human
ucacaagacccaaaaggcagaa

SEQ ID NO: 2975832 - RNA, 18 nt, Human
ucacaagacccaaaaggc

SEQ ID NO: 2975833 - RNA, 14 nt, Human
guggaaaauaacuc

SEQ ID NO: 2975834 - RNA, 18 nt, Human
guggaaaaauagccugcc

SEQ ID NO: 2975835 - RNA, 13 nt, Human
gugcuuggcccag

SEQ ID NO: 2975836 - RNA, 14 nt, Human
gugcuuggcccagg

SEQ ID NO: 2975837 - RNA, 15 nt, Human
gugcuuggcccagga

SEQ ID NO: 2975838 - RNA, 16 nt, Human
gugcuuggcccaggag

SEQ ID NO: 2975839 - RNA, 17 nt, Human
gugcuuggcccaggagu

SEQ ID NO: 2975840 - RNA, 19 nt, Human
gugcuuggcccaggaguuu

SEQ ID NO: 2975841 - RNA, 24 nt, Human
gugcuuggcccaggaguuuggcca

SEQ ID NO: 2975842 - RNA, 13 nt, Human
gugcuuggaggaa

SEQ ID NO: 2975843 - RNA, 15 nt, Human
gugcuuggaggaagg

SEQ ID NO: 2975844 - RNA, 12 nt, Human
gugcuuggagga

SEQ ID NO: 2975845 - RNA, 11 nt, Human
gugcugcccug

SEQ ID NO: 2975846 - RNA, 22 nt, Human
gugcugccauccagguucagcu

SEQ ID NO: 2975847 - RNA, 23 nt, Human
gugcugaaugguuuucaaaauaa

SEQ ID NO: 2975848 - RNA, 20 nt, Human
gugcugaaugguuuucaaaa

SEQ ID NO: 2975849 - RNA, 19 nt, Human
gugcugaaugguuuucaaa

SEQ ID NO: 2975850 - RNA, 18 nt, Human
gugcucuggacaggcaug

SEQ ID NO: 2975851 - RNA, 17 nt, Human
gugcucuggacaggcau

SEQ ID NO: 2975852 - RNA, 21 nt, Human
gugccuuggggacaagagcag

SEQ ID NO: 2975853 - RNA, 16 nt, Human
gugcucuggacaggca

SEQ ID NO: 2975854 - RNA, 15 nt, Human
gugcucuggacaggc

SEQ ID NO: 2975855 - RNA, 16 nt, Human
gugcugagucugaagg

SEQ ID NO: 2975856 - RNA, 17 nt, Human
gugcugagucugaaggc

SEQ ID NO: 2975857 - RNA, 18 nt, Human
gugcugagucugaaggcu

SEQ ID NO: 2975858 - RNA, 19 nt, Human
gugcugagucugaaggcug

SEQ ID NO: 2975859 - RNA, 12 nt, Human
gugcugagucug

SEQ ID NO: 2975860 - RNA, 19 nt, Human
gugcugccauccagguuca

SEQ ID NO: 2975861 - RNA, 18 nt, Human
gugcugccauccagguuc

SEQ ID NO: 2975862 - RNA, 15 nt, Human
gugcugccauccagg

SEQ ID NO: 2975863 - RNA, 20 nt, Human
gugcugcauuuaaaagauac

SEQ ID NO: 2975864 - RNA, 19 nt, Human
gugcugcauuuaaaagaua

SEQ ID NO: 2975865 - RNA, 12 nt, Human
gugcugcauuua

SEQ ID NO: 2975866 - RNA, 21 nt, Human
gugcugaguguacagagugga

SEQ ID NO: 2975867 - RNA, 21 nt, Human
guggcagugggagcugccugu

SEQ ID NO: 2975868 - RNA, 19 nt, Human
guggcagugggagcugccu

SEQ ID NO: 2975869 - RNA, 22 nt, Human
guggccacaccucuaucccggc

SEQ ID NO: 2975870 - RNA, 23 nt, Human
guggccacaccucuaucccggcu

SEQ ID NO: 2975871 - RNA, 19 nt, Human
guggcagcugcuuuugucu

SEQ ID NO: 2975872 - RNA, 13 nt, Human
guggcagcugcuu

SEQ ID NO: 2975873 - RNA, 12 nt, Human
guggcagcugcu

SEQ ID NO: 2975874 - RNA, 23 nt, Human
guggcagcugcgguccacccagg

SEQ ID NO: 2975875 - RNA, 22 nt, Human
guggcagcugcgguccacccag

SEQ ID NO: 2975876 - RNA, 21 nt, Human
guggcagcugcgguccaccca

SEQ ID NO: 2975877 - RNA, 20 nt, Human
guggaugccugguggcagcu

SEQ ID NO: 2975878 - RNA, 19 nt, Human
guggcagcugcgguccacc

SEQ ID NO: 2975879 - RNA, 17 nt, Human
guggcagugggagcugc

SEQ ID NO: 2975880 - RNA, 16 nt, Human
guggcagugggagcug

SEQ ID NO: 2975881 - RNA, 15 nt, Human
guggcagugggagcu

SEQ ID NO: 2975882 - RNA, 17 nt, Human
guggaguucaucuugaa

SEQ ID NO: 2975883 - RNA, 21 nt, Human
guggaucacgaggucaggaga

SEQ ID NO: 2975884 - RNA, 18 nt, Human
guggaugccugguggcag

SEQ ID NO: 2975885 - RNA, 16 nt, Human
guggaugccugguggc

SEQ ID NO: 2975886 - RNA, 20 nt, Human
guggagaagcggcuggcagc

SEQ ID NO: 2975887 - RNA, 18 nt, Human
gugcaaauugucacagga

SEQ ID NO: 2975888 - RNA, 19 nt, Human
gugcauaaguuaacuucca

SEQ ID NO: 2975889 - RNA, 20 nt, Human
gugcaguauagaauaggcac

SEQ ID NO: 2975890 - RNA, 14 nt, Human
gugcauaccacuuu

SEQ ID NO: 2975891 - RNA, 13 nt, Human
gugcauaccacuu

SEQ ID NO: 2975892 - RNA, 21 nt, Human
gugcauaccacuuuuguucuu

SEQ ID NO: 2975893 - RNA, 22 nt, Human
gugccagguuuuuggucugacc

SEQ ID NO: 2975894 - RNA, 20 nt, Human
gugccagguuuuuggucuga

SEQ ID NO: 2975895 - RNA, 20 nt, Human
gugcccacaggaucagucug

SEQ ID NO: 2975896 - RNA, 20 nt, Human
gugauccacccaccucagcc

SEQ ID NO: 2975897 - RNA, 18 nt, Human
gugauccacccaccucag

SEQ ID NO: 2975898 - RNA, 13 nt, Human
gugaggccagaga

SEQ ID NO: 2975899 - RNA, 15 nt, Human
gugauccacccaccu

SEQ ID NO: 2975900 - RNA, 11 nt, Human
gugaggccaga

SEQ ID NO: 2975901 - RNA, 18 nt, Human
gugauccucccaccucag

SEQ ID NO: 2975902 - RNA, 15 nt, Human
gugauccucccaccu

SEQ ID NO: 2975903 - RNA, 14 nt, Human
gugauccucccacc

SEQ ID NO: 2975904 - RNA, 22 nt, Human
gugauccucccaccucagccuc

SEQ ID NO: 2975905 - RNA, 20 nt, Human
gugauccucccaccucagcc

SEQ ID NO: 2975906 - RNA, 22 nt, Human
gugauucuccugccucagccuc

SEQ ID NO: 2975907 - RNA, 20 nt, Human
gugauucuccugccucagcc

SEQ ID NO: 2975908 - RNA, 19 nt, Human
gugauucuccugccucagc

SEQ ID NO: 2975909 - RNA, 18 nt, Human
gugauucuccugccucag

SEQ ID NO: 2975910 - RNA, 17 nt, Human
gugauucuccugccuca

SEQ ID NO: 2975911 - RNA, 16 nt, Human
gugauucuccugccuc

SEQ ID NO: 2975912 - RNA, 14 nt, Human
gugauucuccugcc

SEQ ID NO: 2975913 - RNA, 12 nt, Human
gugauuuucauu

SEQ ID NO: 2975914 - RNA, 23 nt, Human
gugauucuccugccucagccucc

SEQ ID NO: 2975915 - RNA, 16 nt, Human
gugagcagucaggaaa

SEQ ID NO: 2975916 - RNA, 17 nt, Human
gugacugaucucucgug

SEQ ID NO: 2975917 - RNA, 13 nt, Human
gugagccacugca

SEQ ID NO: 2975918 - RNA, 14 nt, Human
gugagcuacaaaug

SEQ ID NO: 2975919 - RNA, 16 nt, Human
gugaggaagccgcugg

SEQ ID NO: 2975920 - RNA, 19 nt, Human
gugaggaagccgcuggggc

SEQ ID NO: 2975921 - RNA, 11 nt, Human
gugaggaagcc

SEQ ID NO: 2975922 - RNA, 15 nt, Human
gugacugaauuucuu

SEQ ID NO: 2975923 - RNA, 18 nt, Human
gugacugaauuucuuuug

SEQ ID NO: 2975924 - RNA, 16 nt, Human
gugacugaauuucuuu

SEQ ID NO: 2975925 - RNA, 16 nt, Human
gugacaacacuugugu

SEQ ID NO: 2975926 - RNA, 15 nt, Human
gugaccucugccuga

SEQ ID NO: 2975927 - RNA, 20 nt, Human
gugaaacucguuaauuugua

SEQ ID NO: 2975928 - RNA, 12 nt, Human
gugaaacuggau

SEQ ID NO: 2975929 - RNA, 19 nt, Human
gugaaagaaaauaacaaua

SEQ ID NO: 2975930 - RNA, 14 nt, Human
gugaaaagaaaaau

SEQ ID NO: 2975931 - RNA, 23 nt, Human
gugaaaagaaaaaugagccuggc

SEQ ID NO: 2975932 - RNA, 23 nt, Human
gugaauaccccaagacucccaug

SEQ ID NO: 2975933 - RNA, 14 nt, Human
gugaauaccccaag

SEQ ID NO: 2975934 - RNA, 19 nt, Human
gugaaaggaaagagggagg

SEQ ID NO: 2975935 - RNA, 23 nt, Human
gugaauguaggcuggcuuucaga

SEQ ID NO: 2975936 - RNA, 18 nt, Human
guccugucggagcccugu

SEQ ID NO: 2975937 - RNA, 20 nt, Human
guccugucggagcccugucu

SEQ ID NO: 2975938 - RNA, 21 nt, Human
guccugucggagcccugucuc

SEQ ID NO: 2975939 - RNA, 18 nt, Human
guccugggagugagcugg

SEQ ID NO: 2975940 - RNA, 17 nt, Human
guccugggagugagcug

SEQ ID NO: 2975941 - RNA, 19 nt, Human
guccugggagugagcuggu

SEQ ID NO: 2975942 - RNA, 23 nt, Human
guccucccaucucacacaugagc

SEQ ID NO: 2975943 - RNA, 13 nt, Human
guccucccaucuc

SEQ ID NO: 2975944 - RNA, 14 nt, Human
guccucccaucuca

SEQ ID NO: 2975945 - RNA, 12 nt, Human
guccucccaucu

SEQ ID NO: 2975946 - RNA, 17 nt, Human
guccuggcaugggaaug

SEQ ID NO: 2975947 - RNA, 16 nt, Human
guccugggagugagcu

SEQ ID NO: 2975948 - RNA, 15 nt, Human
guccugggagugagc

SEQ ID NO: 2975949 - RNA, 21 nt, Human
guccuauuauauucauucuuu

SEQ ID NO: 2975950 - RNA, 19 nt, Human
guccuauuauauucauucu

SEQ ID NO: 2975951 - RNA, 23 nt, Human
guccuagaaauuccccacccuga

SEQ ID NO: 2975952 - RNA, 23 nt, Human
guccuacucugugucaggugggg

SEQ ID NO: 2975953 - RNA, 15 nt, Human
guccuacucuguguc

SEQ ID NO: 2975954 - RNA, 16 nt, Human
gucccugguggcagcu

SEQ ID NO: 2975955 - RNA, 17 nt, Human
gucccugguggcagcuc

SEQ ID NO: 2975956 - RNA, 13 nt, Human
guccuacucugug

SEQ ID NO: 2975957 - RNA, 12 nt, Human
gucccagugccg

SEQ ID NO: 2975958 - RNA, 15 nt, Human
gucuacacugugcug

SEQ ID NO: 2975959 - RNA, 23 nt, Human
gucuacacuaagagagaaugaga

SEQ ID NO: 2975960 - RNA, 17 nt, Human
gucuacacuaagagaga

SEQ ID NO: 2975961 - RNA, 16 nt, Human
guccuuaccagcagag

SEQ ID NO: 2975962 - RNA, 17 nt, Human
guccuuaccagcagagc

SEQ ID NO: 2975963 - RNA, 15 nt, Human
guccuuaccagcaga

SEQ ID NO: 2975964 - RNA, 23 nt, Human
gucucacuguugcccaggcuggc

SEQ ID NO: 2975965 - RNA, 22 nt, Human
gucucacuguugcccaggcugg

SEQ ID NO: 2975966 - RNA, 21 nt, Human
gucucacuguugcccaggcug

SEQ ID NO: 2975967 - RNA, 20 nt, Human
gucucacuguugcccaggcu

SEQ ID NO: 2975968 - RNA, 19 nt, Human
gucucacuguugcccaggc

SEQ ID NO: 2975969 - RNA, 18 nt, Human
gucucacuguugcccagg

SEQ ID NO: 2975970 - RNA, 17 nt, Human
gucucacuguugcccag

SEQ ID NO: 2975971 - RNA, 16 nt, Human
gucucacuguugccca

SEQ ID NO: 2975972 - RNA, 23 nt, Human
gucucacuauguugcccaggcag

SEQ ID NO: 2975973 - RNA, 13 nt, Human
gucucacuguugc

SEQ ID NO: 2975974 - RNA, 21 nt, Human
gucucacuauguugcccaggc

SEQ ID NO: 2975975 - RNA, 20 nt, Human
gucucacuauguugcccagg

SEQ ID NO: 2975976 - RNA, 19 nt, Human
gucugaggaauccagaccc

SEQ ID NO: 2975977 - RNA, 18 nt, Human
gucugaggaauccagacc

SEQ ID NO: 2975978 - RNA, 15 nt, Human
gucugacccacugcu

SEQ ID NO: 2975979 - RNA, 14 nt, Human
gucugacccacugc

SEQ ID NO: 2975980 - RNA, 13 nt, Human
gucugacccacug

SEQ ID NO: 2975981 - RNA, 21 nt, Human
gucugauucccaagcucugcu

SEQ ID NO: 2975982 - RNA, 20 nt, Human
gucugauucccaagcucugc

SEQ ID NO: 2975983 - RNA, 21 nt, Human
gucugaggaauccagacccgg

SEQ ID NO: 2975984 - RNA, 19 nt, Human
gucugauucccaagcucug

SEQ ID NO: 2975985 - RNA, 18 nt, Human
gucugauucccaagcucu

SEQ ID NO: 2975986 - RNA, 17 nt, Human
gucugauucccaagcuc

SEQ ID NO: 2975987 - RNA, 20 nt, Human
guagagguacacuugugaau

SEQ ID NO: 2975988 - RNA, 13 nt, Human
guagagugggagc

SEQ ID NO: 2975989 - RNA, 15 nt, Human
guagagugggagcug

SEQ ID NO: 2975990 - RNA, 20 nt, Human
guauuacaguggggaaugaa

SEQ ID NO: 2975991 - RNA, 15 nt, Human
guauuacuucugcua

SEQ ID NO: 2975992 - RNA, 14 nt, Human
guauuacuucugcu

SEQ ID NO: 2975993 - RNA, 13 nt, Human
guauuacuucugc

SEQ ID NO: 2975994 - RNA, 22 nt, Human
guauuacaguggggaaugaaga

SEQ ID NO: 2975995 - RNA, 14 nt, Human
guauuauaccuuuu

SEQ ID NO: 2975996 - RNA, 22 nt, Human
guauuucuaugaaauauuaugu

SEQ ID NO: 2975997 - RNA, 17 nt, Human
guauuucuaugaaauau

SEQ ID NO: 2975998 - RNA, 13 nt, Human
gucaaggcuuaga

SEQ ID NO: 2975999 - RNA, 19 nt, Human
gucaagugaaaaaggagga

SEQ ID NO: 2976000 - RNA, 16 nt, Human
gucaagugaaaaagga

SEQ ID NO: 2976001 - RNA, 18 nt, Human
gucaagugaaaaaggagg

SEQ ID NO: 2976002 - RNA, 16 nt, Human
gucaagcauguauuuu

SEQ ID NO: 2976003 - RNA, 14 nt, Human
gucaagcauguauu

SEQ ID NO: 2976004 - RNA, 19 nt, Human
gucaagagggucugaggaa

SEQ ID NO: 2976005 - RNA, 18 nt, Human
gucaagagggucugagga

SEQ ID NO: 2976006 - RNA, 17 nt, Human
guauuuuaaaagaauga

SEQ ID NO: 2976007 - RNA, 16 nt, Human
guauuuuaaaagaaug

SEQ ID NO: 2976008 - RNA, 14 nt, Human
gucaccucauggaa

SEQ ID NO: 2976009 - RNA, 20 nt, Human
gucaccugaagacucauucu

SEQ ID NO: 2976010 - RNA, 13 nt, Human
gucaccccggcca

SEQ ID NO: 2976011 - RNA, 15 nt, Human
gucaauaaaauccau

SEQ ID NO: 2976012 - RNA, 21 nt, Human
gucaauaaaauccauacauuu

SEQ ID NO: 2976013 - RNA, 13 nt, Human
gucaauuacagga

SEQ ID NO: 2976014 - RNA, 15 nt, Human
gucaauuacaggaag

SEQ ID NO: 2976015 - RNA, 16 nt, Human
gucaauuacaggaagu

SEQ ID NO: 2976016 - RNA, 21 nt, Human
gucauauaagauucauauuua

SEQ ID NO: 2976017 - RNA, 13 nt, Human
gucagcuaaagaa

SEQ ID NO: 2976018 - RNA, 20 nt, Human
gucccagccagcaguucaga

SEQ ID NO: 2976019 - RNA, 17 nt, Human
gucccagauacuugggg

SEQ ID NO: 2976020 - RNA, 14 nt, Human
gucccacucagucc

SEQ ID NO: 2976021 - RNA, 15 nt, Human
gucccacucagucca

SEQ ID NO: 2976022 - RNA, 16 nt, Human
guccacccaggagccc

SEQ ID NO: 2976023 - RNA, 15 nt, Human
guccacccaggagcc

SEQ ID NO: 2976024 - RNA, 13 nt, Human
guccacccaggag

SEQ ID NO: 2976025 - RNA, 14 nt, Human
guccacccaggagc

SEQ ID NO: 2976026 - RNA, 23 nt, Human
gguagaauguuuucaaauguucu

SEQ ID NO: 2976027 - RNA, 15 nt, Human
gguagacacacauga

SEQ ID NO: 2976028 - RNA, 22 nt, Human
gguagacacacaugaaguccaa

SEQ ID NO: 2976029 - RNA, 12 nt, Human
ggucacucuggc

SEQ ID NO: 2976030 - RNA, 16 nt, Human
ggucagagccugcagu

SEQ ID NO: 2976031 - RNA, 15 nt, Human
ggucagagccugcag

SEQ ID NO: 2976032 - RNA, 14 nt, Human
ggucagagccugca

SEQ ID NO: 2976033 - RNA, 13 nt, Human
ggucagagccugc

SEQ ID NO: 2976034 - RNA, 16 nt, Human
ggucacucuggcagcu

SEQ ID NO: 2976035 - RNA, 20 nt, Human
ggucacucuggcagcucaga

SEQ ID NO: 2976036 - RNA, 22 nt, Human
ggucacucuggcagcucagaga

SEQ ID NO: 2976037 - RNA, 12 nt, Human
ggucagagccug

SEQ ID NO: 2976038 - RNA, 18 nt, Human
ggucccccuuccauggac

SEQ ID NO: 2976039 - RNA, 23 nt, Human
ggucccccuuccauggacuuugu

SEQ ID NO: 2976040 - RNA, 13 nt, Human
ggucccccuucca

SEQ ID NO: 2976041 - RNA, 20 nt, Human
ggucccaucugcagggcccc

SEQ ID NO: 2976042 - RNA, 14 nt, Human
ggucccacucaguc

SEQ ID NO: 2976043 - RNA, 12 nt, Human
ggucccacucag

SEQ ID NO: 2976044 - RNA, 22 nt, Human
ggucccacucaguccauagcag

SEQ ID NO: 2976045 - RNA, 22 nt, Human
ggucccaccccacacacgccag

SEQ ID NO: 2976046 - RNA, 21 nt, Human
ggguagccacuggacugacga

SEQ ID NO: 2976047 - RNA, 19 nt, Human
ggguuggccccugcccggc

SEQ ID NO: 2976048 - RNA, 16 nt, Human
ggguuggccccugccc

SEQ ID NO: 2976049 - RNA, 17 nt, Human
ggguucuacccaggugc

SEQ ID NO: 2976050 - RNA, 22 nt, Human
ggguucuacccaggugcuagga

SEQ ID NO: 2976051 - RNA, 23 nt, Human
ggguucccuuuuuuggcugcuga

SEQ ID NO: 2976052 - RNA, 22 nt, Human
gguacuucaaauccuugaagau

SEQ ID NO: 2976053 - RNA, 21 nt, Human
gguacuuguggacacagcucu

SEQ ID NO: 2976054 - RNA, 22 nt, Human
gguacuuguggacacagcucuu

SEQ ID NO: 2976055 - RNA, 20 nt, Human
gguacuuguggacacagcuc

SEQ ID NO: 2976056 - RNA, 15 nt, Human
ggguugggcuggugu

SEQ ID NO: 2976057 - RNA, 16 nt, Human
gguacccacugcucug

SEQ ID NO: 2976058 - RNA, 17 nt, Human
gguacccacugcucugg

SEQ ID NO: 2976059 - RNA, 19 nt, Human
ggugcuacaaaaacacagc

SEQ ID NO: 2976060 - RNA, 15 nt, Human
ggugcgaucuggguu

SEQ ID NO: 2976061 - RNA, 23 nt, Human
ggugcuaucucccccagccccau

SEQ ID NO: 2976062 - RNA, 21 nt, Human
ggugcuaucucccccagcccc

SEQ ID NO: 2976063 - RNA, 22 nt, Human
ggugcuaucucccccagcccca

SEQ ID NO: 2976064 - RNA, 13 nt, Human
gguggcagcugcg

SEQ ID NO: 2976065 - RNA, 12 nt, Human
gguggcagcugc

SEQ ID NO: 2976066 - RNA, 13 nt, Human
gguggcagcucac

SEQ ID NO: 2976067 - RNA, 11 nt, Human
gguggcagcug

SEQ ID NO: 2976068 - RNA, 23 nt, Human
gguggcagcugcgguccacccag

SEQ ID NO: 2976069 - RNA, 15 nt, Human
gguggcagcugcggu

SEQ ID NO: 2976070 - RNA, 14 nt, Human
ggugaccucugccu

SEQ ID NO: 2976071 - RNA, 16 nt, Human
ggugaccucugccuga

SEQ ID NO: 2976072 - RNA, 18 nt, Human
ggugaagugaagacaaug

SEQ ID NO: 2976073 - RNA, 16 nt, Human
ggugaacuugguuccc

SEQ ID NO: 2976074 - RNA, 19 nt, Human
ggucugaggaauccagacc

SEQ ID NO: 2976075 - RNA, 12 nt, Human
ggucucacucug

SEQ ID NO: 2976076 - RNA, 21 nt, Human
ggucucacuauguugcccagg

SEQ ID NO: 2976077 - RNA, 16 nt, Human
ggucugacccacugcu

SEQ ID NO: 2976078 - RNA, 15 nt, Human
ggucugacccacugc

SEQ ID NO: 2976079 - RNA, 22 nt, Human
ggucccugguggcagcucaccu

SEQ ID NO: 2976080 - RNA, 22 nt, Human
ggucucacuauguugcccaggc

SEQ ID NO: 2976081 - RNA, 14 nt, Human
ggucccugguggca

SEQ ID NO: 2976082 - RNA, 18 nt, Human
ggguacccacugcucugg

SEQ ID NO: 2976083 - RNA, 15 nt, Human
ggguacccacugcuc

SEQ ID NO: 2976084 - RNA, 13 nt, Human
ggguacccacugc

SEQ ID NO: 2976085 - RNA, 23 nt, Human
ggguagagcggagaaaggaaggg

SEQ ID NO: 2976086 - RNA, 23 nt, Human
ggguacuuguggacacagcucuu

SEQ ID NO: 2976087 - RNA, 22 nt, Human
ggguacuuguggacacagcucu

SEQ ID NO: 2976088 - RNA, 19 nt, Human
ggguacuuguggacacagc

SEQ ID NO: 2976089 - RNA, 23 nt, Human
gggguucccuuuuuuggcugcug

SEQ ID NO: 2976090 - RNA, 13 nt, Human
ggggcugggacau

SEQ ID NO: 2976091 - RNA, 16 nt, Human
ggggcugggcagagga

SEQ ID NO: 2976092 - RNA, 17 nt, Human
ggggcugggcagaggaa

SEQ ID NO: 2976093 - RNA, 18 nt, Human
ggggcugcucccaccugg

SEQ ID NO: 2976094 - RNA, 14 nt, Human
ggggcugcucccac

SEQ ID NO: 2976095 - RNA, 17 nt, Human
ggggaucacagccucug

SEQ ID NO: 2976096 - RNA, 13 nt, Human
ggggaguggccac

SEQ ID NO: 2976097 - RNA, 21 nt, Human
gggcuuggggaccagagcugc

SEQ ID NO: 2976098 - RNA, 11 nt, Human
ggggagaaagu

SEQ ID NO: 2976099 - RNA, 18 nt, Human
gggcuucaguggcagcug

SEQ ID NO: 2976100 - RNA, 17 nt, Human
gggcuucaguggcagcu

SEQ ID NO: 2976101 - RNA, 16 nt, Human
gggcuucaguggcagc

SEQ ID NO: 2976102 - RNA, 15 nt, Human
gggcuucaguggcag

SEQ ID NO: 2976103 - RNA, 19 nt, Human
gggcuucauccuccucaga

SEQ ID NO: 2976104 - RNA, 20 nt, Human
gggcuucaguggcagcugcu

SEQ ID NO: 2976105 - RNA, 19 nt, Human
gggcuucaguggcagcugc

SEQ ID NO: 2976106 - RNA, 20 nt, Human
gggcuuggggaccagagcug

SEQ ID NO: 2976107 - RNA, 20 nt, Human
gggcuucauccuccucagau

SEQ ID NO: 2976108 - RNA, 14 nt, Human
gggcucccuuccca

SEQ ID NO: 2976109 - RNA, 17 nt, Human
gggcucccuucccaccu

SEQ ID NO: 2976110 - RNA, 18 nt, Human
gggcucccuucccaccuc

SEQ ID NO: 2976111 - RNA, 23 nt, Human
gggcucccuucccaccucucuca

SEQ ID NO: 2976112 - RNA, 13 nt, Human
gggcucccuuccc

SEQ ID NO: 2976113 - RNA, 16 nt, Human
gggcgcgguggcucac

SEQ ID NO: 2976114 - RNA, 18 nt, Human
gggccuggucguuuucaa

SEQ ID NO: 2976115 - RNA, 14 nt, Human
gggccuggcucagg

SEQ ID NO: 2976116 - RNA, 16 nt, Human
gggccuggcucaggug

SEQ ID NO: 2976117 - RNA, 12 nt, Human
gggccuggcuca

SEQ ID NO: 2976118 - RNA, 19 nt, Human
gggccuggccugagcuggg

SEQ ID NO: 2976119 - RNA, 12 nt, Human
gggccuggaugc

SEQ ID NO: 2976120 - RNA, 15 nt, Human
ggcucccagccaggc

SEQ ID NO: 2976121 - RNA, 14 nt, Human
ggcucccagccagg

SEQ ID NO: 2976122 - RNA, 17 nt, Human
ggcucccagccaggccc

SEQ ID NO: 2976123 - RNA, 16 nt, Human
ggcucccagccaggcc

SEQ ID NO: 2976124 - RNA, 18 nt, Human
ggcucccagccaggcccu

SEQ ID NO: 2976125 - RNA, 15 nt, Human
gggcucugccuccca

SEQ ID NO: 2976126 - RNA, 16 nt, Human
gggcucugccucccau

SEQ ID NO: 2976127 - RNA, 17 nt, Human
gggcucugccucccauc

SEQ ID NO: 2976128 - RNA, 20 nt, Human
gggcucugccucccaucacc

SEQ ID NO: 2976129 - RNA, 13 nt, Human
gggcucugccucc

SEQ ID NO: 2976130 - RNA, 16 nt, Human
gggcugaggugggagg

SEQ ID NO: 2976131 - RNA, 14 nt, Human
gggcugcaccggcu

SEQ ID NO: 2976132 - RNA, 14 nt, Human
gggcuucaguggca

SEQ ID NO: 2976133 - RNA, 14 nt, Human
guacacuugugaau

SEQ ID NO: 2976134 - RNA, 23 nt, Human
guacacugccuucucaacuccaa

SEQ ID NO: 2976135 - RNA, 21 nt, Human
guacacuguuucaaacuuuac

SEQ ID NO: 2976136 - RNA, 20 nt, Human
guacacuguuucaaacuuua

SEQ ID NO: 2976137 - RNA, 19 nt, Human
guacacuguuucaaacuuu

SEQ ID NO: 2976138 - RNA, 15 nt, Human
guacacuugugaaua

SEQ ID NO: 2976139 - RNA, 16 nt, Human
guacagacaacaaacc

SEQ ID NO: 2976140 - RNA, 12 nt, Human
guacagagccca

SEQ ID NO: 2976141 - RNA, 18 nt, Human
guacagagcccacgcccc

SEQ ID NO: 2976142 - RNA, 22 nt, Human
guacagagcccacgcccccacu

SEQ ID NO: 2976143 - RNA, 20 nt, Human
guacagcaaggagauuuaca

SEQ ID NO: 2976144 - RNA, 23 nt, Human
guacaggacauauauuuuuuaaa

SEQ ID NO: 2976145 - RNA, 17 nt, Human
guacaggacauauauuu

SEQ ID NO: 2976146 - RNA, 15 nt, Human
guacaggacauauau

SEQ ID NO: 2976147 - RNA, 19 nt, Human
guacagaguggaauaagac

SEQ ID NO: 2976148 - RNA, 14 nt, Human
guacauacuuuuug

SEQ ID NO: 2976149 - RNA, 13 nt, Human
guacauacuuuuu

SEQ ID NO: 2976150 - RNA, 19 nt, Human
guacauacuuuuuggguuu

SEQ ID NO: 2976151 - RNA, 15 nt, Human
guacccacugcucug

SEQ ID NO: 2976152 - RNA, 20 nt, Human
guacauaaugcgugcauacc

SEQ ID NO: 2976153 - RNA, 19 nt, Human
guaaugauaacuggaaacu

SEQ ID NO: 2976154 - RNA, 17 nt, Human
guaaugaccaugaaaga

SEQ ID NO: 2976155 - RNA, 15 nt, Human
guaauuggaaaggca

SEQ ID NO: 2976156 - RNA, 18 nt, Human
guacacuguuucaaacuu

SEQ ID NO: 2976157 - RNA, 21 nt, Human
guaauuaaguacuauguauca

SEQ ID NO: 2976158 - RNA, 20 nt, Human
guaauuaaguacuauguauc

SEQ ID NO: 2976159 - RNA, 17 nt, Human
guaauuaaguacuaugu

SEQ ID NO: 2976160 - RNA, 14 nt, Human
guaauuaaguacua

SEQ ID NO: 2976161 - RNA, 18 nt, Human
guacuaacauuuauuuga

SEQ ID NO: 2976162 - RNA, 15 nt, Human
guacuucaugcuguc

SEQ ID NO: 2976163 - RNA, 15 nt, Human
guacuucuccacccu

SEQ ID NO: 2976164 - RNA, 14 nt, Human
guacuucuccaccc

SEQ ID NO: 2976165 - RNA, 23 nt, Human
guacuaaggaaucuuucugcuuu

SEQ ID NO: 2976166 - RNA, 15 nt, Human
guacuaaggaaucuu

SEQ ID NO: 2976167 - RNA, 17 nt, Human
guacguugugcauuugg

SEQ ID NO: 2976168 - RNA, 16 nt, Human
guacguugugcauuug

SEQ ID NO: 2976169 - RNA, 15 nt, Human
guacguugugcauuu

SEQ ID NO: 2976170 - RNA, 14 nt, Human
guacguugugcauu

SEQ ID NO: 2976171 - RNA, 17 nt, Human
guacgucugacaggcaa

SEQ ID NO: 2976172 - RNA, 15 nt, Human
guacgucugacaggc

SEQ ID NO: 2976173 - RNA, 14 nt, Human
guacgucugacagg

SEQ ID NO: 2976174 - RNA, 15 nt, Human
guaccgcaaugugac

SEQ ID NO: 2976175 - RNA, 16 nt, Human
guacccacugcucugg

SEQ ID NO: 2976176 - RNA, 22 nt, Human
guaccucuugagccuugaacuu

SEQ ID NO: 2976177 - RNA, 21 nt, Human
guaccucuugagccuugaacu

SEQ ID NO: 2976178 - RNA, 13 nt, Human
guaccucuugagc

SEQ ID NO: 2976179 - RNA, 19 nt, Human
guagagguacacuugugaa

SEQ ID NO: 2976180 - RNA, 17 nt, Human
guagagguacacuugug

SEQ ID NO: 2976181 - RNA, 15 nt, Human
guagagguacacuug

SEQ ID NO: 2976182 - RNA, 15 nt, Human
guagaggagaaacug

SEQ ID NO: 2976183 - RNA, 18 nt, Human
guagagccagggucucac

SEQ ID NO: 2976184 - RNA, 16 nt, Human
guagagcggagaaagg

SEQ ID NO: 2976185 - RNA, 14 nt, Human
guacuuuuaagacu

SEQ ID NO: 2976186 - RNA, 23 nt, Human
guacuuuauuuucuauaauuuaa

SEQ ID NO: 2976187 - RNA, 21 nt, Human
guacuuguggacacagcucuu

SEQ ID NO: 2976188 - RNA, 19 nt, Human
guacuucuccacccugcuc

SEQ ID NO: 2976189 - RNA, 18 nt, Human
guacuucuccacccugcu

SEQ ID NO: 2976190 - RNA, 17 nt, Human
guacuucuccacccugc

SEQ ID NO: 2976191 - RNA, 16 nt, Human
guacuucuccacccug

SEQ ID NO: 2976192 - RNA, 21 nt, Human
guacuucuccacccugcucuc

SEQ ID NO: 2976193 - RNA, 20 nt, Human
guacuucuccacccugcucu

SEQ ID NO: 2976194 - RNA, 20 nt, Human
guacuuguggacacagcucu

SEQ ID NO: 2976195 - RNA, 16 nt, Human
guacuuguggacacag

SEQ ID NO: 2976196 - RNA, 16 nt, Human
guaaaaaaugguguuu

SEQ ID NO: 2976197 - RNA, 18 nt, Human
guaaaaaaugguguuuua

SEQ ID NO: 2976198 - RNA, 14 nt, Human
guaaaaccacagca

SEQ ID NO: 2976199 - RNA, 15 nt, Human
guaaaaccacagcag

SEQ ID NO: 2976200 - RNA, 16 nt, Human
guaaaaccacagcagu

SEQ ID NO: 2976201 - RNA, 18 nt, Human
guaaaaccacagcaguug

SEQ ID NO: 2976202 - RNA, 23 nt, Human
guaaaaccacagcaguugaaaag

SEQ ID NO: 2976203 - RNA, 13 nt, Human
gguuuucuguucu

SEQ ID NO: 2976204 - RNA, 12 nt, Human
gguuuucuguuc

SEQ ID NO: 2976205 - RNA, 15 nt, Human
gguuuucuguucuuu

SEQ ID NO: 2976206 - RNA, 16 nt, Human
gguuuucuuuuaagaa

SEQ ID NO: 2976207 - RNA, 20 nt, Human
gguuuucacauuggaaacaa

SEQ ID NO: 2976208 - RNA, 23 nt, Human
gguuuugccauguuggccaggcu

SEQ ID NO: 2976209 - RNA, 10 nt, Human
gguugugaau

SEQ ID NO: 2976210 - RNA, 13 nt, Human
gguuggugggggc

SEQ ID NO: 2976211 - RNA, 13 nt, Human
gguuuaagcuguu

SEQ ID NO: 2976212 - RNA, 14 nt, Human
gguugggcuggugu

SEQ ID NO: 2976213 - RNA, 14 nt, Human
gguugaagcaccaa

SEQ ID NO: 2976214 - RNA, 23 nt, Human
gguucaagcgauucuucugcuuc

SEQ ID NO: 2976215 - RNA, 22 nt, Human
gguucaagcgauucuucugcuu

SEQ ID NO: 2976216 - RNA, 20 nt, Human
gguucacugcaaccuccgcc

SEQ ID NO: 2976217 - RNA, 17 nt, Human
gguggccucccaacuca

SEQ ID NO: 2976218 - RNA, 21 nt, Human
gguucaagcgauucuucugcu

SEQ ID NO: 2976219 - RNA, 13 nt, Human
gguggccucccaa

SEQ ID NO: 2976220 - RNA, 22 nt, Human
guaacuguuuagaugaauguca

SEQ ID NO: 2976221 - RNA, 23 nt, Human
guaaauuaacuuuuauaaacuuu

SEQ ID NO: 2976222 - RNA, 18 nt, Human
guaagggaaacugccagc

SEQ ID NO: 2976223 - RNA, 17 nt, Human
guaagggaaacugccag

SEQ ID NO: 2976224 - RNA, 22 nt, Human
guaaguauucuuauuuaaugaa

SEQ ID NO: 2976225 - RNA, 20 nt, Human
guaaggaauaccuguccccc

SEQ ID NO: 2976226 - RNA, 21 nt, Human
guaaggaauaccugucccccu

SEQ ID NO: 2976227 - RNA, 23 nt, Human
guaaggaauaccugucccccuga

SEQ ID NO: 2976228 - RNA, 13 nt, Human
guaaggaaugauu

SEQ ID NO: 2976229 - RNA, 18 nt, Human
guaaggaauaccuguccc

SEQ ID NO: 2976230 - RNA, 20 nt, Human
guaaaugggggugcauuuga

SEQ ID NO: 2976231 - RNA, 19 nt, Human
guaaaugggggugcauuug

SEQ ID NO: 2976232 - RNA, 18 nt, Human
guaaaugggggugcauuu

SEQ ID NO: 2976233 - RNA, 22 nt, Human
guaaauuaacuuuuauaaacuu

SEQ ID NO: 2976234 - RNA, 21 nt, Human
guaaauuaacuuuuauaaacu

SEQ ID NO: 2976235 - RNA, 17 nt, Human
guaaauuaacuuuuaua

SEQ ID NO: 2976236 - RNA, 16 nt, Human
guaaauuaacuuuuau

SEQ ID NO: 2976237 - RNA, 15 nt, Human
guaaauuaacuuuua

SEQ ID NO: 2976238 - RNA, 16 nt, Human
gcugccaauauccuaa

SEQ ID NO: 2976239 - RNA, 17 nt, Human
gcugccaauauccuaau

SEQ ID NO: 2976240 - RNA, 18 nt, Human
gcugccaauauccuaaua

SEQ ID NO: 2976241 - RNA, 19 nt, Human
gcugccaauauccuaauaa

SEQ ID NO: 2976242 - RNA, 14 nt, Human
gcugccaauauccu

SEQ ID NO: 2976243 - RNA, 15 nt, Human
gcugccaauauccua

SEQ ID NO: 2976244 - RNA, 13 nt, Human
gcugcaguuuuuu

SEQ ID NO: 2976245 - RNA, 17 nt, Human
gcugcaguugccaguca

SEQ ID NO: 2976246 - RNA, 21 nt, Human
gcugcaguugccagucacccc

SEQ ID NO: 2976247 - RNA, 18 nt, Human
gcugcaguugccagucac

SEQ ID NO: 2976248 - RNA, 20 nt, Human
gcugcaguugccagucaccc

SEQ ID NO: 2976249 - RNA, 18 nt, Human
gcugauggugcaaugacc

SEQ ID NO: 2976250 - RNA, 21 nt, Human
gcugauggugcaaugaccuuu

SEQ ID NO: 2976251 - RNA, 19 nt, Human
gcugagucugaaggcuggg

SEQ ID NO: 2976252 - RNA, 16 nt, Human
gcugagucugaaggcu

SEQ ID NO: 2976253 - RNA, 18 nt, Human
gcugagucugaaggcugg

SEQ ID NO: 2976254 - RNA, 15 nt, Human
gcugagucugaaggc

SEQ ID NO: 2976255 - RNA, 15 nt, Human
gcugauggugcaaug

SEQ ID NO: 2976256 - RNA, 16 nt, Human
gcugauggugcaauga

SEQ ID NO: 2976257 - RNA, 22 nt, Human
gcugagugggggaucacagccu

SEQ ID NO: 2976258 - RNA, 23 nt, Human
gcugagugggggaucacagccuc

SEQ ID NO: 2976259 - RNA, 16 nt, Human
gcucuucuccaggcug

SEQ ID NO: 2976260 - RNA, 14 nt, Human
gcucuucuccaggc

SEQ ID NO: 2976261 - RNA, 19 nt, Human
gcucuuccaggcugggaga

SEQ ID NO: 2976262 - RNA, 18 nt, Human
gcucuuccaggcugggag

SEQ ID NO: 2976263 - RNA, 12 nt, Human
gcucuucuccag

SEQ ID NO: 2976264 - RNA, 22 nt, Human
gcucuuccaggcugggagagcc

SEQ ID NO: 2976265 - RNA, 20 nt, Human
gcugacagacacaggcccgg

SEQ ID NO: 2976266 - RNA, 21 nt, Human
gcugacagacacaggcccggc

SEQ ID NO: 2976267 - RNA, 11 nt, Human
gcucucuggcc

SEQ ID NO: 2976268 - RNA, 13 nt, Human
gcucucuggccuu

SEQ ID NO: 2976269 - RNA, 12 nt, Human
gcucucuggccu

SEQ ID NO: 2976270 - RNA, 17 nt, Human
gcucuccgaccagacac

SEQ ID NO: 2976271 - RNA, 13 nt, Human
gcucuccgaccag

SEQ ID NO: 2976272 - RNA, 19 nt, Human
gcucuccgaccagacaccu

SEQ ID NO: 2976273 - RNA, 21 nt, Human
gcuccuucuguccuacucugu

SEQ ID NO: 2976274 - RNA, 19 nt, Human
gcucccuucccaccucucu

SEQ ID NO: 2976275 - RNA, 15 nt, Human
gcuccuucuguccua

SEQ ID NO: 2976276 - RNA, 16 nt, Human
gcucccuucccaccuc

SEQ ID NO: 2976277 - RNA, 18 nt, Human
gcucccuucccaccucuc

SEQ ID NO: 2976278 - RNA, 15 nt, Human
gcucccuucccaccu

SEQ ID NO: 2976279 - RNA, 16 nt, Human
gcucgagcaugccugg

SEQ ID NO: 2976280 - RNA, 20 nt, Human
gcucucuggccuucggccuc

SEQ ID NO: 2976281 - RNA, 19 nt, Human
gcucucuggccuucggccu

SEQ ID NO: 2976282 - RNA, 15 nt, Human
gcucucuggccuucg

SEQ ID NO: 2976283 - RNA, 14 nt, Human
gcucucuggccuuc

SEQ ID NO: 2976284 - RNA, 23 nt, Human
gcucugcccuugguuaggcauug

SEQ ID NO: 2976285 - RNA, 11 nt, Human
gcucugccucc

SEQ ID NO: 2976286 - RNA, 14 nt, Human
gcucugcccuuggu

SEQ ID NO: 2976287 - RNA, 13 nt, Human
gcucugccuccca

SEQ ID NO: 2976288 - RNA, 14 nt, Human
gcucugccucccau

SEQ ID NO: 2976289 - RNA, 15 nt, Human
gcucugccucccauc

SEQ ID NO: 2976290 - RNA, 22 nt, Human
gcucugccucccaucacccgcu

SEQ ID NO: 2976291 - RNA, 14 nt, Human
gcucugcuccucuc

SEQ ID NO: 2976292 - RNA, 13 nt, Human
gcucugcuccucu

SEQ ID NO: 2976293 - RNA, 23 nt, Human
gcucugcugacagacacaggccc

SEQ ID NO: 2976294 - RNA, 20 nt, Human
gcucugcugacagacacagg

SEQ ID NO: 2976295 - RNA, 19 nt, Human
gcucugcugacagacacag

SEQ ID NO: 2976296 - RNA, 18 nt, Human
gcucugcugacagacaca

SEQ ID NO: 2976297 - RNA, 14 nt, Human
gcucugcugacaga

SEQ ID NO: 2976298 - RNA, 13 nt, Human
gcucugcugacag

SEQ ID NO: 2976299 - RNA, 21 nt, Human
gcucugcuccucuccccagca

SEQ ID NO: 2976300 - RNA, 19 nt, Human
gcucugcuccucuccccag

SEQ ID NO: 2976301 - RNA, 22 nt, Human
gcucuggacaggcauguucucu

SEQ ID NO: 2976302 - RNA, 21 nt, Human
gcucuggacaggcauguucuc

SEQ ID NO: 2976303 - RNA, 16 nt, Human
gcucuggacaggcaug

SEQ ID NO: 2976304 - RNA, 15 nt, Human
gcucuggacaggcau

SEQ ID NO: 2976305 - RNA, 14 nt, Human
gcucuggacaggca

SEQ ID NO: 2976306 - RNA, 19 nt, Human
gcucaccccaucaucccuu

SEQ ID NO: 2976307 - RNA, 17 nt, Human
gcucaccccaucauccc

SEQ ID NO: 2976308 - RNA, 15 nt, Human
gcucacccaguccug

SEQ ID NO: 2976309 - RNA, 19 nt, Human
gcucaccagccccagugcc

SEQ ID NO: 2976310 - RNA, 18 nt, Human
gcucaccagccccagugc

SEQ ID NO: 2976311 - RNA, 23 nt, Human
gcucaccagccccagugcccaca

SEQ ID NO: 2976312 - RNA, 20 nt, Human
gcucaccagccccagugccc

SEQ ID NO: 2976313 - RNA, 17 nt, Human
gcucagcaaaagaugcu

SEQ ID NO: 2976314 - RNA, 20 nt, Human
gcucagcaaaagaugcuucu

SEQ ID NO: 2976315 - RNA, 22 nt, Human
gcucagcaaaagaugcuucuca

SEQ ID NO: 2976316 - RNA, 23 nt, Human
gcucagcaaaagaugcuucucac

SEQ ID NO: 2976317 - RNA, 15 nt, Human
gcucagcggggacag

SEQ ID NO: 2976318 - RNA, 19 nt, Human
gcucagcggggacagcucc

SEQ ID NO: 2976319 - RNA, 20 nt, Human
gcucagcggggacagcuccu

SEQ ID NO: 2976320 - RNA, 17 nt, Human
gcucaggugucccugca

SEQ ID NO: 2976321 - RNA, 18 nt, Human
gcucaggugucccugcac

SEQ ID NO: 2976322 - RNA, 22 nt, Human
gcucagcggggacagcuccuuc

SEQ ID NO: 2976323 - RNA, 21 nt, Human
gcucagcggggacagcuccuu

SEQ ID NO: 2976324 - RNA, 19 nt, Human
gcucaggugucccugcacu

SEQ ID NO: 2976325 - RNA, 23 nt, Human
gcuccaggcuccuuuagcgccca

SEQ ID NO: 2976326 - RNA, 16 nt, Human
gcuccaggcuccuuua

SEQ ID NO: 2976327 - RNA, 11 nt, Human
gcuccagcugu

SEQ ID NO: 2976328 - RNA, 13 nt, Human
gcuccaggcuccu

SEQ ID NO: 2976329 - RNA, 17 nt, Human
gcuccauccuccuggga

SEQ ID NO: 2976330 - RNA, 16 nt, Human
gcuccaagcucccagg

SEQ ID NO: 2976331 - RNA, 17 nt, Human
gcuccaagcucccaggc

SEQ ID NO: 2976332 - RNA, 18 nt, Human
gcuccaagcucccaggca

SEQ ID NO: 2976333 - RNA, 19 nt, Human
gcuccaagcucccaggcau

SEQ ID NO: 2976334 - RNA, 21 nt, Human
gcuccaagcucccaggcauuc

SEQ ID NO: 2976335 - RNA, 14 nt, Human
gcuccaagaauuuc

SEQ ID NO: 2976336 - RNA, 14 nt, Human
gcuccaagcuccca

SEQ ID NO: 2976337 - RNA, 15 nt, Human
gcuccaagcucccag

SEQ ID NO: 2976338 - RNA, 13 nt, Human
gcuccaagcuccc

SEQ ID NO: 2976339 - RNA, 23 nt, Human
gcuaagagggagggagggcucca

SEQ ID NO: 2976340 - RNA, 17 nt, Human
gcuaagcaaaaugugau

SEQ ID NO: 2976341 - RNA, 14 nt, Human
gcuaagcauuccaa

SEQ ID NO: 2976342 - RNA, 14 nt, Human
gcuacccgggaagg

SEQ ID NO: 2976343 - RNA, 15 nt, Human
gcuacccgggaaggg

SEQ ID NO: 2976344 - RNA, 18 nt, Human
gcuagagguucaaagaua

SEQ ID NO: 2976345 - RNA, 21 nt, Human
gcuagagguucaaagauauuu

SEQ ID NO: 2976346 - RNA, 19 nt, Human
gcuagagguucaaagauau

SEQ ID NO: 2976347 - RNA, 21 nt, Human
gcuacccgggaagggggcugg

SEQ ID NO: 2976348 - RNA, 20 nt, Human
gcuaccuuuguauucucucc

SEQ ID NO: 2976349 - RNA, 16 nt, Human
gcuaucucccccagcc

SEQ ID NO: 2976350 - RNA, 17 nt, Human
gcuaucucccccagccc

SEQ ID NO: 2976351 - RNA, 18 nt, Human
gcuaucucccccagcccc

SEQ ID NO: 2976352 - RNA, 22 nt, Human
gcuagcagcagggagggcuucu

SEQ ID NO: 2976353 - RNA, 19 nt, Human
gcuaucucccccagcccca

SEQ ID NO: 2976354 - RNA, 20 nt, Human
gcuaucucccccagccccau

SEQ ID NO: 2976355 - RNA, 21 nt, Human
gcuaucucccccagccccauc

SEQ ID NO: 2976356 - RNA, 22 nt, Human
gcuaucucccccagccccaucc

SEQ ID NO: 2976357 - RNA, 23 nt, Human
gcuaucucccccagccccauccu

SEQ ID NO: 2976358 - RNA, 15 nt, Human
gcuaucucccccagc

SEQ ID NO: 2976359 - RNA, 16 nt, Human
gcgguccacccaggag

SEQ ID NO: 2976360 - RNA, 13 nt, Human
gcggggacagcuc

SEQ ID NO: 2976361 - RNA, 15 nt, Human
gcgggcuuccuccug

SEQ ID NO: 2976362 - RNA, 12 nt, Human
gcggggacagcu

SEQ ID NO: 2976363 - RNA, 19 nt, Human
gcgguccacccaggagccc

SEQ ID NO: 2976364 - RNA, 18 nt, Human
gcgguccacccaggagcc

SEQ ID NO: 2976365 - RNA, 23 nt, Human
gcgugagccacugcaccgggcca

SEQ ID NO: 2976366 - RNA, 18 nt, Human
gcgugagccacugcaccg

SEQ ID NO: 2976367 - RNA, 16 nt, Human
gcgugagccacugcac

SEQ ID NO: 2976368 - RNA, 20 nt, Human
gcgugaacccaggaggcgga

SEQ ID NO: 2976369 - RNA, 21 nt, Human
gcuaagagggagggagggcuc

SEQ ID NO: 2976370 - RNA, 22 nt, Human
gcuaagagggagggagggcucc

SEQ ID NO: 2976371 - RNA, 19 nt, Human
gcuaacacggugaaacccg

SEQ ID NO: 2976372 - RNA, 13 nt, Human
gcuaaaugugaau

SEQ ID NO: 2976373 - RNA, 16 nt, Human
gcuaaaugugaaugau

SEQ ID NO: 2976374 - RNA, 18 nt, Human
gccuaauaugaugacugu

SEQ ID NO: 2976375 - RNA, 22 nt, Human
gccuauauuuuuuguuaaauga

SEQ ID NO: 2976376 - RNA, 19 nt, Human
gccgagauagccaaggcca

SEQ ID NO: 2976377 - RNA, 17 nt, Human
gccuaagugcagccccg

SEQ ID NO: 2976378 - RNA, 21 nt, Human
gccucaagugauucuccugcc

SEQ ID NO: 2976379 - RNA, 20 nt, Human
gccucaagugauucuccugc

SEQ ID NO: 2976380 - RNA, 19 nt, Human
gccucaagugauucuccug

SEQ ID NO: 2976381 - RNA, 16 nt, Human
gccucaaccuccuggg

SEQ ID NO: 2976382 - RNA, 14 nt, Human
gccucaaccuccug

SEQ ID NO: 2976383 - RNA, 21 nt, Human
gccucacaguccuuaccagca

SEQ ID NO: 2976384 - RNA, 23 nt, Human
gccucagccucccaaagugcugg

SEQ ID NO: 2976385 - RNA, 14 nt, Human
gccucagugccacu

SEQ ID NO: 2976386 - RNA, 12 nt, Human
gccucagugcca

SEQ ID NO: 2976387 - RNA, 21 nt, Human
gccucccacgacugcccggca

SEQ ID NO: 2976388 - RNA, 23 nt, Human
gccuccccuccucugcuugccau

SEQ ID NO: 2976389 - RNA, 14 nt, Human
gccucccacgacug

SEQ ID NO: 2976390 - RNA, 21 nt, Human
gccucccgaauagcugggacu

SEQ ID NO: 2976391 - RNA, 22 nt, Human
gccucccaacucaccccagccc

SEQ ID NO: 2976392 - RNA, 23 nt, Human
gccucccaacucaccccagcccc

SEQ ID NO: 2976393 - RNA, 21 nt, Human
gccucccaacucaccccagcc

SEQ ID NO: 2976394 - RNA, 15 nt, Human
gccucagugccacua

SEQ ID NO: 2976395 - RNA, 15 nt, Human
gccucccgaguagcu

SEQ ID NO: 2976396 - RNA, 23 nt, Human
gccucccgaauagcugggacuac

SEQ ID NO: 2976397 - RNA, 21 nt, Human
gccucucccugcugcuccuag

SEQ ID NO: 2976398 - RNA, 20 nt, Human
gccucucccugcugcuccua

SEQ ID NO: 2976399 - RNA, 19 nt, Human
gccucucccugcugcuccu

SEQ ID NO: 2976400 - RNA, 18 nt, Human
gccucucccugcugcucc

SEQ ID NO: 2976401 - RNA, 22 nt, Human
gccucucccugcugcuccuagg

SEQ ID NO: 2976402 - RNA, 17 nt, Human
gccucucccugcugcuc

SEQ ID NO: 2976403 - RNA, 15 nt, Human
gccugcuccagcugu

SEQ ID NO: 2976404 - RNA, 16 nt, Human
gccugcuccagcuguu

SEQ ID NO: 2976405 - RNA, 18 nt, Human
gccugcuccagcuguuca

SEQ ID NO: 2976406 - RNA, 18 nt, Human
gccucugccucugacaca

SEQ ID NO: 2976407 - RNA, 22 nt, Human
gccugaagucacacagugaguc

SEQ ID NO: 2976408 - RNA, 24 nt, Human
gccucugcggagcacacuggcuca

SEQ ID NO: 2976409 - RNA, 21 nt, Human
gccucugcggagcacacuggc

SEQ ID NO: 2976410 - RNA, 19 nt, Human
gccucugcggagcacacug

SEQ ID NO: 2976411 - RNA, 15 nt, Human
gccuggauggggcug

SEQ ID NO: 2976412 - RNA, 14 nt, Human
gccuggauggggcu

SEQ ID NO: 2976413 - RNA, 22 nt, Human
gccuggccagaugcaccagccc

SEQ ID NO: 2976414 - RNA, 15 nt, Human
gccuggccagaugca

SEQ ID NO: 2976415 - RNA, 14 nt, Human
gccuggccagaugc

SEQ ID NO: 2976416 - RNA, 15 nt, Human
gccugggcagaagga

SEQ ID NO: 2976417 - RNA, 18 nt, Human
gccugggcagaaggaaga

SEQ ID NO: 2976418 - RNA, 16 nt, Human
gccugggcagaaggaa

SEQ ID NO: 2976419 - RNA, 17 nt, Human
gccugggcagaaggaag

SEQ ID NO: 2976420 - RNA, 20 nt, Human
gccugggggcugggcagagg

SEQ ID NO: 2976421 - RNA, 14 nt, Human
gcccuuuuucaaua

SEQ ID NO: 2976422 - RNA, 16 nt, Human
gccgagaucacgccac

SEQ ID NO: 2976423 - RNA, 18 nt, Human
gccgagauugcaccacug

SEQ ID NO: 2976424 - RNA, 17 nt, Human
gccgagauugcaccacu

SEQ ID NO: 2976425 - RNA, 19 nt, Human
gccgagaucacgccacugc

SEQ ID NO: 2976426 - RNA, 18 nt, Human
gccgagaucacgccacug

SEQ ID NO: 2976427 - RNA, 19 nt, Human
gcccuucucuccagccccu

SEQ ID NO: 2976428 - RNA, 21 nt, Human
gcccuucucuccagccccugg

SEQ ID NO: 2976429 - RNA, 22 nt, Human
gcccuucucuccagccccugga

SEQ ID NO: 2976430 - RNA, 23 nt, Human
gcccugguggcagugggagcugc

SEQ ID NO: 2976431 - RNA, 22 nt, Human
gcccugguggcagugggagcug

SEQ ID NO: 2976432 - RNA, 21 nt, Human
gcccugguggcagugggagcu

SEQ ID NO: 2976433 - RNA, 20 nt, Human
gcccugguggcagugggagc

SEQ ID NO: 2976434 - RNA, 19 nt, Human
gcccugguggcagugggag

SEQ ID NO: 2976435 - RNA, 18 nt, Human
gcccugguggcaguggga

SEQ ID NO: 2976436 - RNA, 17 nt, Human
gcccugguggcaguggg

SEQ ID NO: 2976437 - RNA, 14 nt, Human
gcccugguggcagu

SEQ ID NO: 2976438 - RNA, 13 nt, Human
gcccucuccuggg

SEQ ID NO: 2976439 - RNA, 12 nt, Human
gcccucuccugg

SEQ ID NO: 2976440 - RNA, 23 nt, Human
gcccucuccugggcagcugccuc

SEQ ID NO: 2976441 - RNA, 22 nt, Human
gcccucuccugggcagcugccu

SEQ ID NO: 2976442 - RNA, 12 nt, Human
gcccucugccca

SEQ ID NO: 2976443 - RNA, 16 nt, Human
gcccugagcuuucugc

SEQ ID NO: 2976444 - RNA, 14 nt, Human
gcccugagcuuucu

SEQ ID NO: 2976445 - RNA, 18 nt, Human
gcccggcuccaggcuccu

SEQ ID NO: 2976446 - RNA, 17 nt, Human
gcccggcuccaggcucc

SEQ ID NO: 2976447 - RNA, 15 nt, Human
gcagacucuacagag

SEQ ID NO: 2976448 - RNA, 21 nt, Human
gccccuguucuggcagaguug

SEQ ID NO: 2976449 - RNA, 17 nt, Human
gccccuguucuggcaga

SEQ ID NO: 2976450 - RNA, 15 nt, Human
gccccugccacccug

SEQ ID NO: 2976451 - RNA, 14 nt, Human
gccccugccacccu

SEQ ID NO: 2976452 - RNA, 13 nt, Human
gccccugccaccc

SEQ ID NO: 2976453 - RNA, 16 nt, Human
gcccggcuccaggcuc

SEQ ID NO: 2976454 - RNA, 20 nt, Human
gcugccaauauccuaauaaa

SEQ ID NO: 2976455 - RNA, 21 nt, Human
gcugccaauauccuaauaaaa

SEQ ID NO: 2976456 - RNA, 15 nt, Human
gcugccaaugggagc

SEQ ID NO: 2976457 - RNA, 16 nt, Human
gcugccaaugggagcu

SEQ ID NO: 2976458 - RNA, 19 nt, Human
gcugccaaugggagcucau

SEQ ID NO: 2976459 - RNA, 23 nt, Human
gcugccaauauccuaauaaaaag

SEQ ID NO: 2976460 - RNA, 20 nt, Human
gcugucuacacuaagagaga

SEQ ID NO: 2976461 - RNA, 14 nt, Human
gcuguucagcuggu

SEQ ID NO: 2976462 - RNA, 13 nt, Human
gcuguucagcugg

SEQ ID NO: 2976463 - RNA, 12 nt, Human
gcuguucaugaa

SEQ ID NO: 2976464 - RNA, 21 nt, Human
gcuguucaugaaagauucaau

SEQ ID NO: 2976465 - RNA, 21 nt, Human
gcuuaggagaagucuucuauu

SEQ ID NO: 2976466 - RNA, 21 nt, Human
gcuuagucacugagacagccc

SEQ ID NO: 2976467 - RNA, 19 nt, Human
gcuuagucacugagacagc

SEQ ID NO: 2976468 - RNA, 20 nt, Human
gcuuagucacugagacagcc

SEQ ID NO: 2976469 - RNA, 15 nt, Human
gcuuagucacugaga

SEQ ID NO: 2976470 - RNA, 17 nt, Human
gcuuagucacugagaca

SEQ ID NO: 2976471 - RNA, 16 nt, Human
gcuuccagugaggcuc

SEQ ID NO: 2976472 - RNA, 17 nt, Human
gcuucauuuccuguguc

SEQ ID NO: 2976473 - RNA, 15 nt, Human
gcuuccagugaggcu

SEQ ID NO: 2976474 - RNA, 16 nt, Human
gcuugaggguugggcu

SEQ ID NO: 2976475 - RNA, 22 nt, Human
gcuucucccccacccccuaggg

SEQ ID NO: 2976476 - RNA, 12 nt, Human
gcuucauccucc

SEQ ID NO: 2976477 - RNA, 15 nt, Human
gcuucauccuccuca

SEQ ID NO: 2976478 - RNA, 16 nt, Human
gcuucauuuccugugu

SEQ ID NO: 2976479 - RNA, 13 nt, Human
gcuucauuuccug

SEQ ID NO: 2976480 - RNA, 18 nt, Human
gcuucaguggcagcugcu

SEQ ID NO: 2976481 - RNA, 17 nt, Human
gcuucaguggcagcugc

SEQ ID NO: 2976482 - RNA, 12 nt, Human
gcuuauacacuu

SEQ ID NO: 2976483 - RNA, 13 nt, Human
gcuuaucucaggg

SEQ ID NO: 2976484 - RNA, 19 nt, Human
gcuuaucucaggggugugc

SEQ ID NO: 2976485 - RNA, 15 nt, Human
gcuucaguggcagcu

SEQ ID NO: 2976486 - RNA, 16 nt, Human
gcuucaguggcagcug

SEQ ID NO: 2976487 - RNA, 23 nt, Human
ggaaagggauuuucagcccucag

SEQ ID NO: 2976488 - RNA, 22 nt, Human
ggaaaggcuccaggagcagcca

SEQ ID NO: 2976489 - RNA, 17 nt, Human
ggaaaggcuccaggagc

SEQ ID NO: 2976490 - RNA, 19 nt, Human
ggaaaggcuccaggagcag

SEQ ID NO: 2976491 - RNA, 20 nt, Human
ggaaaggcuccaggagcagc

SEQ ID NO: 2976492 - RNA, 21 nt, Human
ggaaaggcuccaggagcagcc

SEQ ID NO: 2976493 - RNA, 23 nt, Human
ggaaaaucagccugcuccagcug

SEQ ID NO: 2976494 - RNA, 19 nt, Human
ggaaaaucagccugcucca

SEQ ID NO: 2976495 - RNA, 13 nt, Human
ggaaaggcuccag

SEQ ID NO: 2976496 - RNA, 14 nt, Human
ggaaaggcuccagg

SEQ ID NO: 2976497 - RNA, 12 nt, Human
ggaaaggcucca

SEQ ID NO: 2976498 - RNA, 16 nt, Human
ggaacaggaaacugau

SEQ ID NO: 2976499 - RNA, 14 nt, Human
ggaaaucaccgaaa

SEQ ID NO: 2976500 - RNA, 17 nt, Human
ggaaaucaaauaugcaa

SEQ ID NO: 2976501 - RNA, 21 nt, Human
ggaaaucaccgaaaacguggc

SEQ ID NO: 2976502 - RNA, 16 nt, Human
ggaaaucaaauaugca

SEQ ID NO: 2976503 - RNA, 20 nt, Human
ggaaaagcugcugacagugu

SEQ ID NO: 2976504 - RNA, 18 nt, Human
ggaaaagcugcugacagu

SEQ ID NO: 2976505 - RNA, 14 nt, Human
ggaaaagcugcuga

SEQ ID NO: 2976506 - RNA, 18 nt, Human
ggaaaacaugcuacacac

SEQ ID NO: 2976507 - RNA, 21 nt, Human
gcuuuguuuguugucagcuga

SEQ ID NO: 2976508 - RNA, 15 nt, Human
gcuuugugauuuuug

SEQ ID NO: 2976509 - RNA, 20 nt, Human
gcuugaggguugggcuggug

SEQ ID NO: 2976510 - RNA, 18 nt, Human
gcuugaggguugggcugg

SEQ ID NO: 2976511 - RNA, 13 nt, Human
ggaaugcaaagau

SEQ ID NO: 2976512 - RNA, 24 nt, Human
ggaaugauuaauuaaaacacaaca

SEQ ID NO: 2976513 - RNA, 12 nt, Human
ggaaugcagugg

SEQ ID NO: 2976514 - RNA, 19 nt, Human
ggaauguuugccucugccu

SEQ ID NO: 2976515 - RNA, 23 nt, Human
ggaauuucucccagucauuuaau

SEQ ID NO: 2976516 - RNA, 22 nt, Human
ggaauuggagcucgugggacag

SEQ ID NO: 2976517 - RNA, 16 nt, Human
ggaauuggagcucgug

SEQ ID NO: 2976518 - RNA, 17 nt, Human
ggacaaaauggaauacu

SEQ ID NO: 2976519 - RNA, 16 nt, Human
ggacaaaauggaauac

SEQ ID NO: 2976520 - RNA, 20 nt, Human
ggaagugacgguuuaauggg

SEQ ID NO: 2976521 - RNA, 14 nt, Human
ggaaugauuaauua

SEQ ID NO: 2976522 - RNA, 12 nt, Human
ggaaguacugga

SEQ ID NO: 2976523 - RNA, 16 nt, Human
ggaaguacuggagaaa

SEQ ID NO: 2976524 - RNA, 18 nt, Human
ggaaguacuggagaaaau

SEQ ID NO: 2976525 - RNA, 23 nt, Human
ggaaggggagauaaggguaucug

SEQ ID NO: 2976526 - RNA, 20 nt, Human
ggacauugcggacagccacg

SEQ ID NO: 2976527 - RNA, 14 nt, Human
ggacauggacaagg

SEQ ID NO: 2976528 - RNA, 21 nt, Human
ggacagccacggccaggccag

SEQ ID NO: 2976529 - RNA, 20 nt, Human
ggacagccacggccaggcca

SEQ ID NO: 2976530 - RNA, 19 nt, Human
ggacagccacggccaggcc

SEQ ID NO: 2976531 - RNA, 15 nt, Human
ggacagccacggcca

SEQ ID NO: 2976532 - RNA, 17 nt, Human
ggacacucaaaagcugg

SEQ ID NO: 2976533 - RNA, 19 nt, Human
ggacgcuacccgggaaggg

SEQ ID NO: 2976534 - RNA, 20 nt, Human
ggacgcuacccgggaagggg

SEQ ID NO: 2976535 - RNA, 17 nt, Human
ggacgcuacccgggaag

SEQ ID NO: 2976536 - RNA, 17 nt, Human
ggaccuugaacugggua

SEQ ID NO: 2976537 - RNA, 15 nt, Human
ggaccuugaacuggg

SEQ ID NO: 2976538 - RNA, 19 nt, Human
ggaccucaggugagaagca

SEQ ID NO: 2976539 - RNA, 20 nt, Human
ggaccucaggccugggggcu

SEQ ID NO: 2976540 - RNA, 23 nt, Human
ggaccucaggugagaagcagagg

SEQ ID NO: 2976541 - RNA, 13 nt, Human
ggaccagagcugc

SEQ ID NO: 2976542 - RNA, 14 nt, Human
ggacgcucucuggc

SEQ ID NO: 2976543 - RNA, 13 nt, Human
ggacgcucucugg

SEQ ID NO: 2976544 - RNA, 17 nt, Human
ggagaagcggcuggcag

SEQ ID NO: 2976545 - RNA, 18 nt, Human
ggagaagcggcuggcagc

SEQ ID NO: 2976546 - RNA, 19 nt, Human
ggagaaucacuugaacccg

SEQ ID NO: 2976547 - RNA, 15 nt, Human
ggagaaucacuugaa

SEQ ID NO: 2976548 - RNA, 13 nt, Human
ggauacuuauuua

SEQ ID NO: 2976549 - RNA, 18 nt, Human
ggauacaaaagcauguga

SEQ ID NO: 2976550 - RNA, 23 nt, Human
ggagugaguugauagcacagacc

SEQ ID NO: 2976551 - RNA, 21 nt, Human
ggagaugccaugagccgccca

SEQ ID NO: 2976552 - RNA, 12 nt, Human
ggagugcaguga

SEQ ID NO: 2976553 - RNA, 14 nt, Human
ggagugcagugagc

SEQ ID NO: 2976554 - RNA, 22 nt, Human
ggaucccucauccucauaccca

SEQ ID NO: 2976555 - RNA, 13 nt, Human
ggaucccucaucc

SEQ ID NO: 2976556 - RNA, 17 nt, Human
ggaucccucauccucau

SEQ ID NO: 2976557 - RNA, 12 nt, Human
ggauccuccagg

SEQ ID NO: 2976558 - RNA, 13 nt, Human
ggauccuccaggu

SEQ ID NO: 2976559 - RNA, 23 nt, Human
ggaugcacagaguuguuacauuu

SEQ ID NO: 2976560 - RNA, 21 nt, Human
ggaugauuggaggggggaggu

SEQ ID NO: 2976561 - RNA, 16 nt, Human
ggaugcagccucacag

SEQ ID NO: 2976562 - RNA, 17 nt, Human
ggaugcagccucacagu

SEQ ID NO: 2976563 - RNA, 19 nt, Human
ggauuacaagcgugagcca

SEQ ID NO: 2976564 - RNA, 15 nt, Human
ggaugcuuguacaua

SEQ ID NO: 2976565 - RNA, 17 nt, Human
ggaugcugcugccccug

SEQ ID NO: 2976566 - RNA, 19 nt, Human
ggaugcagccucacagucc

SEQ ID NO: 2976567 - RNA, 22 nt, Human
ggcacccggccccugcugguuc

SEQ ID NO: 2976568 - RNA, 23 nt, Human
ggcacccaccaucaugucuggcu

SEQ ID NO: 2976569 - RNA, 20 nt, Human
ggcacccaccaucaugucug

SEQ ID NO: 2976570 - RNA, 18 nt, Human
ggcaacccccagccugcu

SEQ ID NO: 2976571 - RNA, 23 nt, Human
ggcaaugcuggcuguuggcuggg

SEQ ID NO: 2976572 - RNA, 15 nt, Human
ggcaaugcuggcugu

SEQ ID NO: 2976573 - RNA, 14 nt, Human
ggcaaugcuggcug

SEQ ID NO: 2976574 - RNA, 15 nt, Human
ggauuguaaaauggu

SEQ ID NO: 2976575 - RNA, 17 nt, Human
ggcaacccccagccugc

SEQ ID NO: 2976576 - RNA, 16 nt, Human
ggcaacccccagccug

SEQ ID NO: 2976577 - RNA, 17 nt, Human
ggauugcuacuguccua

SEQ ID NO: 2976578 - RNA, 23 nt, Human
ggauuacaagcgugagccacugc

SEQ ID NO: 2976579 - RNA, 16 nt, Human
ggauucuuauggacaa

SEQ ID NO: 2976580 - RNA, 22 nt, Human
ggcaugggaaugaaugucagug

SEQ ID NO: 2976581 - RNA, 17 nt, Human
ggcauuccccaggaggc

SEQ ID NO: 2976582 - RNA, 18 nt, Human
ggcaugggaaugaauguc

SEQ ID NO: 2976583 - RNA, 14 nt, Human
ggcauggcugggaa

SEQ ID NO: 2976584 - RNA, 18 nt, Human
ggcauuccccaggaggcc

SEQ ID NO: 2976585 - RNA, 19 nt, Human
ggcauuccccaggaggcca

SEQ ID NO: 2976586 - RNA, 16 nt, Human
ggcauuccccaggagg

SEQ ID NO: 2976587 - RNA, 16 nt, Human
ggccaccgccuugccc

SEQ ID NO: 2976588 - RNA, 16 nt, Human
ggccaugggccuccug

SEQ ID NO: 2976589 - RNA, 17 nt, Human
ggccaugucagacacag

SEQ ID NO: 2976590 - RNA, 16 nt, Human
ggccaugucagacaca

SEQ ID NO: 2976591 - RNA, 23 nt, Human
ggccagcugcuugggcuucaucc

SEQ ID NO: 2976592 - RNA, 18 nt, Human
ggccaggcccucugccca

SEQ ID NO: 2976593 - RNA, 22 nt, Human
ggccagccuugaccauucucca

SEQ ID NO: 2976594 - RNA, 17 nt, Human
ggccagcugcuugggcu

SEQ ID NO: 2976595 - RNA, 20 nt, Human
ggccagccuugaccauucuc

SEQ ID NO: 2976596 - RNA, 12 nt, Human
ggcagcucaccu

SEQ ID NO: 2976597 - RNA, 14 nt, Human
ggcagcucaccucu

SEQ ID NO: 2976598 - RNA, 15 nt, Human
ggcacuauuuauuua

SEQ ID NO: 2976599 - RNA, 20 nt, Human
ggcaccuguagucccagcua

SEQ ID NO: 2976600 - RNA, 17 nt, Human
ggcagcuugaggguugg

SEQ ID NO: 2976601 - RNA, 22 nt, Human
ggcagcugcuuuugucuauggg

SEQ ID NO: 2976602 - RNA, 13 nt, Human
ggcagcucagaga

SEQ ID NO: 2976603 - RNA, 21 nt, Human
ggcagcucagagaggguggga

SEQ ID NO: 2976604 - RNA, 16 nt, Human
ggcagugggagcugcc

SEQ ID NO: 2976605 - RNA, 14 nt, Human
ggcagugggagcug

SEQ ID NO: 2976606 - RNA, 13 nt, Human
ggcagugggagcu

SEQ ID NO: 2976607 - RNA, 20 nt, Human
ggcagggucucacucugucg

SEQ ID NO: 2976608 - RNA, 19 nt, Human
ggcagggucucacucuguc

SEQ ID NO: 2976609 - RNA, 18 nt, Human
ggcaugacacgaauauug

SEQ ID NO: 2976610 - RNA, 15 nt, Human
ggcaugaagacagau

SEQ ID NO: 2976611 - RNA, 14 nt, Human
ggcauggacuucug

SEQ ID NO: 2976612 - RNA, 15 nt, Human
ggcauggacuucugg

SEQ ID NO: 2976613 - RNA, 20 nt, Human
ggccugggggcugggcagag

SEQ ID NO: 2976614 - RNA, 22 nt, Human
ggccugggggcugggcagagga

SEQ ID NO: 2976615 - RNA, 14 nt, Human
ggccugggggcugg

SEQ ID NO: 2976616 - RNA, 20 nt, Human
ggccugucagcuaaagaagu

SEQ ID NO: 2976617 - RNA, 19 nt, Human
ggccuggccugagcuggga

SEQ ID NO: 2976618 - RNA, 18 nt, Human
ggcgcugccccuggcagc

SEQ ID NO: 2976619 - RNA, 19 nt, Human
ggcgcugccccuggcagcc

SEQ ID NO: 2976620 - RNA, 21 nt, Human
ggcgcugccccuggcagcccc

SEQ ID NO: 2976621 - RNA, 23 nt, Human
ggcgcugccccuggcagccccug

SEQ ID NO: 2976622 - RNA, 21 nt, Human
ggcggaccuuguagugagccg

SEQ ID NO: 2976623 - RNA, 20 nt, Human
ggcggaccuuguagugagcc

SEQ ID NO: 2976624 - RNA, 16 nt, Human
ggcuccaggcuccuuu

SEQ ID NO: 2976625 - RNA, 18 nt, Human
ggcuccaggagcagccac

SEQ ID NO: 2976626 - RNA, 11 nt, Human
ggcuccaggcu

SEQ ID NO: 2976627 - RNA, 15 nt, Human
ggcuccaggcuccuu

SEQ ID NO: 2976628 - RNA, 13 nt, Human
ggcuccaggagca

SEQ ID NO: 2976629 - RNA, 19 nt, Human
ggcuccaggagcagccaca

SEQ ID NO: 2976630 - RNA, 12 nt, Human
ggcuccaggagc

SEQ ID NO: 2976631 - RNA, 21 nt, Human
ggcucaaguccucuuuucuga

SEQ ID NO: 2976632 - RNA, 15 nt, Human
ggcucaaguccucuu

SEQ ID NO: 2976633 - RNA, 16 nt, Human
ggcuagagguucaaag

SEQ ID NO: 2976634 - RNA, 17 nt, Human
ggcuagagguucaaaga

SEQ ID NO: 2976635 - RNA, 22 nt, Human
ggcuagagguucaaagauauuu

SEQ ID NO: 2976636 - RNA, 16 nt, Human
ggcuaggaccccucca

SEQ ID NO: 2976637 - RNA, 22 nt, Human
ggcuaggaccccuccauguggg

SEQ ID NO: 2976638 - RNA, 23 nt, Human
ggcuagugugguguuuccuggca

SEQ ID NO: 2976639 - RNA, 15 nt, Human
ggcuaguugggcuuc

SEQ ID NO: 2976640 - RNA, 16 nt, Human
ggcuaguugggcuucc

SEQ ID NO: 2976641 - RNA, 14 nt, Human
ggcuaugcauuuga

SEQ ID NO: 2976642 - RNA, 15 nt, Human
ggcuaugcauuugaa

SEQ ID NO: 2976643 - RNA, 13 nt, Human
ggcccugccuccu

SEQ ID NO: 2976644 - RNA, 14 nt, Human
ggcccugccuccuu

SEQ ID NO: 2976645 - RNA, 15 nt, Human
ggcccugccuccuuu

SEQ ID NO: 2976646 - RNA, 21 nt, Human
ggcccucugcccacucccugc

SEQ ID NO: 2976647 - RNA, 19 nt, Human
ggcccucugcccacucccu

SEQ ID NO: 2976648 - RNA, 20 nt, Human
ggcccucugcccacucccug

SEQ ID NO: 2976649 - RNA, 13 nt, Human
ggcccucugccca

SEQ ID NO: 2976650 - RNA, 15 nt, Human
ggcccucugcccacu

SEQ ID NO: 2976651 - RNA, 16 nt, Human
ggcccucugcccacuc

SEQ ID NO: 2976652 - RNA, 17 nt, Human
ggcccucugcccacucc

SEQ ID NO: 2976653 - RNA, 11 nt, Human
ggcccagagag

SEQ ID NO: 2976654 - RNA, 13 nt, Human
ggccucugcacuc

SEQ ID NO: 2976655 - RNA, 14 nt, Human
ggccucugcacucc

SEQ ID NO: 2976656 - RNA, 15 nt, Human
ggccucugcacuccc

SEQ ID NO: 2976657 - RNA, 20 nt, Human
ggccucugcggagcacacug

SEQ ID NO: 2976658 - RNA, 18 nt, Human
ggccucuuaugggcuggg

SEQ ID NO: 2976659 - RNA, 17 nt, Human
ggccucuuaugggcugg

SEQ ID NO: 2976660 - RNA, 23 nt, Human
ggccuagcauacguacacauuuu

SEQ ID NO: 2976661 - RNA, 22 nt, Human
gauugccuuuuuauaacuuuuu

SEQ ID NO: 2976662 - RNA, 21 nt, Human
gauugccuuuuuauaacuuuu

SEQ ID NO: 2976663 - RNA, 15 nt, Human
gauugccuuuuuaua

SEQ ID NO: 2976664 - RNA, 14 nt, Human
gauucuccugccuc

SEQ ID NO: 2976665 - RNA, 20 nt, Human
gauucaaugccccugaauuu

SEQ ID NO: 2976666 - RNA, 19 nt, Human
gauucaaugccccugaauu

SEQ ID NO: 2976667 - RNA, 21 nt, Human
gauucaaugccccugaauuua

SEQ ID NO: 2976668 - RNA, 22 nt, Human
gauuuccguuaaaauaccagcc

SEQ ID NO: 2976669 - RNA, 15 nt, Human
gauuuaacagaaaug

SEQ ID NO: 2976670 - RNA, 14 nt, Human
gauuuaacagaaau

SEQ ID NO: 2976671 - RNA, 13 nt, Human
gauuuaacagaaa

SEQ ID NO: 2976672 - RNA, 12 nt, Human
gauuuaaaucag

SEQ ID NO: 2976673 - RNA, 14 nt, Human
gcaaagaugaaggu

SEQ ID NO: 2976674 - RNA, 18 nt, Human
gcaaagaugaaggucugu

SEQ ID NO: 2976675 - RNA, 15 nt, Human
gcaaaccaucauuga

SEQ ID NO: 2976676 - RNA, 16 nt, Human
gcaaauugucacagga

SEQ ID NO: 2976677 - RNA, 17 nt, Human
gcaaauguuuauuuaaa

SEQ ID NO: 2976678 - RNA, 20 nt, Human
gcaaauguuuauuuaaaaga

SEQ ID NO: 2976679 - RNA, 19 nt, Human
gcaaauguuuauuuaaaag

SEQ ID NO: 2976680 - RNA, 12 nt, Human
gcaaaccaucau

SEQ ID NO: 2976681 - RNA, 21 nt, Human
gauuuugaaauuuuuauuaaa

SEQ ID NO: 2976682 - RNA, 19 nt, Human
gauuuugauccaagcuggu

SEQ ID NO: 2976683 - RNA, 16 nt, Human
gauguugcuaacagca

SEQ ID NO: 2976684 - RNA, 19 nt, Human
gauguugaaaaaguucugc

SEQ ID NO: 2976685 - RNA, 23 nt, Human
gauuacaagcgugagccacugca

SEQ ID NO: 2976686 - RNA, 15 nt, Human
gauuaaacuuaaucu

SEQ ID NO: 2976687 - RNA, 22 nt, Human
gauuacaagcgugagccacugc

SEQ ID NO: 2976688 - RNA, 17 nt, Human
gauggugcaaugaccuu

SEQ ID NO: 2976689 - RNA, 15 nt, Human
gauggugcaaugacc

SEQ ID NO: 2976690 - RNA, 16 nt, Human
gauggugcaaugaccu

SEQ ID NO: 2976691 - RNA, 12 nt, Human
gauggugcaaug

SEQ ID NO: 2976692 - RNA, 14 nt, Human
gauggugcaaugac

SEQ ID NO: 2976693 - RNA, 24 nt, Human
gauggggcccugccuccuuuguga

SEQ ID NO: 2976694 - RNA, 21 nt, Human
gaugggcaacccccagccugc

SEQ ID NO: 2976695 - RNA, 20 nt, Human
gaugggcaacccccagccug

SEQ ID NO: 2976696 - RNA, 22 nt, Human
gauggccgggcgcgguggcuca

SEQ ID NO: 2976697 - RNA, 15 nt, Human
gauggggcugcaccg

SEQ ID NO: 2976698 - RNA, 13 nt, Human
gauggggcugcac

SEQ ID NO: 2976699 - RNA, 19 nt, Human
gaugggugcuuggaggaag

SEQ ID NO: 2976700 - RNA, 20 nt, Human
gaugcuagaacucccuuuca

SEQ ID NO: 2976701 - RNA, 18 nt, Human
gaugcuagaacucccuuu

SEQ ID NO: 2976702 - RNA, 20 nt, Human
gaugcccaaagaugcagccg

SEQ ID NO: 2976703 - RNA, 22 nt, Human
gaugccaugagccgcccaaggc

SEQ ID NO: 2976704 - RNA, 19 nt, Human
gaugcccaaagaugcagcc

SEQ ID NO: 2976705 - RNA, 13 nt, Human
gcacacugucugc

SEQ ID NO: 2976706 - RNA, 19 nt, Human
gcacacuggcucacccagu

SEQ ID NO: 2976707 - RNA, 22 nt, Human
gcacacuggcucacccaguccu

SEQ ID NO: 2976708 - RNA, 20 nt, Human
gcacagaaaauggaagacag

SEQ ID NO: 2976709 - RNA, 16 nt, Human
gcacacuuuggcccag

SEQ ID NO: 2976710 - RNA, 18 nt, Human
gcacacuuuggcccaggg

SEQ ID NO: 2976711 - RNA, 20 nt, Human
gcacaccgggcacucagaag

SEQ ID NO: 2976712 - RNA, 13 nt, Human
gcacacuggcuca

SEQ ID NO: 2976713 - RNA, 18 nt, Human
gcacaagcuccaagcucc

SEQ ID NO: 2976714 - RNA, 15 nt, Human
gcacaagcuccaagc

SEQ ID NO: 2976715 - RNA, 17 nt, Human
gcacaagcuccaagcuc

SEQ ID NO: 2976716 - RNA, 18 nt, Human
gcacagacccugcccugu

SEQ ID NO: 2976717 - RNA, 19 nt, Human
gcacagacccugcccugug

SEQ ID NO: 2976718 - RNA, 20 nt, Human
gcacagacccugcccugugg

SEQ ID NO: 2976719 - RNA, 21 nt, Human
gcacagacccugcccuguggg

SEQ ID NO: 2976720 - RNA, 15 nt, Human
gcacagaguuguuac

SEQ ID NO: 2976721 - RNA, 22 nt, Human
gcacagacccugcccugugggc

SEQ ID NO: 2976722 - RNA, 14 nt, Human
gcacagacccugcc

SEQ ID NO: 2976723 - RNA, 15 nt, Human
gcacagacccugccc

SEQ ID NO: 2976724 - RNA, 16 nt, Human
gcacagacccugcccu

SEQ ID NO: 2976725 - RNA, 17 nt, Human
gcacagacccugcccug

SEQ ID NO: 2976726 - RNA, 21 nt, Human
gcacagaaaauggaagacagc

SEQ ID NO: 2976727 - RNA, 22 nt, Human
gcacagaaaauggaagacagcu

SEQ ID NO: 2976728 - RNA, 23 nt, Human
gcacagaaaauggaagacagcuc

SEQ ID NO: 2976729 - RNA, 14 nt, Human
gcacaaacagaggc

SEQ ID NO: 2976730 - RNA, 15 nt, Human
gcacaaacagaggcc

SEQ ID NO: 2976731 - RNA, 16 nt, Human
gcacaaacagaggccg

SEQ ID NO: 2976732 - RNA, 14 nt, Human
gcaaugugauaaaa

SEQ ID NO: 2976733 - RNA, 12 nt, Human
gcaauuaugaaa

SEQ ID NO: 2976734 - RNA, 16 nt, Human
gcaauuaugaaaauaa

SEQ ID NO: 2976735 - RNA, 14 nt, Human
gcaauuaugaaaau

SEQ ID NO: 2976736 - RNA, 19 nt, Human
gcaauuaugaaaauaaucu

SEQ ID NO: 2976737 - RNA, 14 nt, Human
gcaacucaucuuag

SEQ ID NO: 2976738 - RNA, 13 nt, Human
gcaacucugaagg

SEQ ID NO: 2976739 - RNA, 15 nt, Human
gcaauggcagccuug

SEQ ID NO: 2976740 - RNA, 14 nt, Human
gcacauuaaaugac

SEQ ID NO: 2976741 - RNA, 12 nt, Human
gcacauuaaaug

SEQ ID NO: 2976742 - RNA, 21 nt, Human
gcacauuaaaugacucuuccc

SEQ ID NO: 2976743 - RNA, 16 nt, Human
gcacauuaaaugacuc

SEQ ID NO: 2976744 - RNA, 21 nt, Human
gcacagaguuguuacauuuuu

SEQ ID NO: 2976745 - RNA, 19 nt, Human
gcacagaguuguuacauuu

SEQ ID NO: 2976746 - RNA, 18 nt, Human
gcacagaguuguuacauu

SEQ ID NO: 2976747 - RNA, 16 nt, Human
gcacagaguuguuaca

SEQ ID NO: 2976748 - RNA, 22 nt, Human
gcacagaguuguuacauuuuua

SEQ ID NO: 2976749 - RNA, 20 nt, Human
gcaccuuagacagucccugc

SEQ ID NO: 2976750 - RNA, 21 nt, Human
gcaccuuagacagucccugcc

SEQ ID NO: 2976751 - RNA, 15 nt, Human
gcacgauuucuguuu

SEQ ID NO: 2976752 - RNA, 13 nt, Human
gcacgauuucugu

SEQ ID NO: 2976753 - RNA, 19 nt, Human
gcaccuuagacagucccug

SEQ ID NO: 2976754 - RNA, 12 nt, Human
gcaccauaacuu

SEQ ID NO: 2976755 - RNA, 16 nt, Human
gcacgauuucuguuua

SEQ ID NO: 2976756 - RNA, 15 nt, Human
gcacugacuucuaag

SEQ ID NO: 2976757 - RNA, 18 nt, Human
gcacugacuucuaaguaa

SEQ ID NO: 2976758 - RNA, 23 nt, Human
gcacugcuuccagugaggcucug

SEQ ID NO: 2976759 - RNA, 22 nt, Human
gcacugcuuccagugaggcucu

SEQ ID NO: 2976760 - RNA, 17 nt, Human
gcacuggcaaacagggc

SEQ ID NO: 2976761 - RNA, 23 nt, Human
gcacuggcaaacagggccucugc

SEQ ID NO: 2976762 - RNA, 22 nt, Human
gcacuggcaaacagggccucug

SEQ ID NO: 2976763 - RNA, 20 nt, Human
gcacuggcaaacagggccuc

SEQ ID NO: 2976764 - RNA, 19 nt, Human
gcacuggcaaacagggccu

SEQ ID NO: 2976765 - RNA, 18 nt, Human
gcagacaggaccagggau

SEQ ID NO: 2976766 - RNA, 12 nt, Human
gcagacaggcaa

SEQ ID NO: 2976767 - RNA, 14 nt, Human
gcagacaggcaagc

SEQ ID NO: 2976768 - RNA, 13 nt, Human
gcagacaggcaag

SEQ ID NO: 2976769 - RNA, 18 nt, Human
gcagaaggaagacuucau

SEQ ID NO: 2976770 - RNA, 12 nt, Human
gagcccugucuc

SEQ ID NO: 2976771 - RNA, 13 nt, Human
gaggaucucuuga

SEQ ID NO: 2976772 - RNA, 16 nt, Human
gaggaucucuugagcc

SEQ ID NO: 2976773 - RNA, 19 nt, Human
gaggaucucuugagccugg

SEQ ID NO: 2976774 - RNA, 22 nt, Human
gaggaucucuugagccugggag

SEQ ID NO: 2976775 - RNA, 20 nt, Human
gaggauugcuugagcucagg

SEQ ID NO: 2976776 - RNA, 23 nt, Human
gaggccaugggccuccugugugu

SEQ ID NO: 2976777 - RNA, 21 nt, Human
gaggccaugggccuccugugu

SEQ ID NO: 2976778 - RNA, 20 nt, Human
gaggccaugggccuccugug

SEQ ID NO: 2976779 - RNA, 18 nt, Human
gaggccaugggccuccug

SEQ ID NO: 2976780 - RNA, 17 nt, Human
gaggccaugggccuccu

SEQ ID NO: 2976781 - RNA, 14 nt, Human
gaggccaugggccu

SEQ ID NO: 2976782 - RNA, 18 nt, Human
gaggcagccccauucugc

SEQ ID NO: 2976783 - RNA, 19 nt, Human
gaggcagccccauucugcc

SEQ ID NO: 2976784 - RNA, 9 nt, Human
gaggcaggg

SEQ ID NO: 2976785 - RNA, 20 nt, Human
gaggcagccccauucugccu

SEQ ID NO: 2976786 - RNA, 19 nt, Human
gaggccuucucugaaggac

SEQ ID NO: 2976787 - RNA, 18 nt, Human
gaggccuucucugaagga

SEQ ID NO: 2976788 - RNA, 16 nt, Human
gaggccuucucugaag

SEQ ID NO: 2976789 - RNA, 14 nt, Human
gaggcugccucucc

SEQ ID NO: 2976790 - RNA, 20 nt, Human
gaggcggaccuuguagugag

SEQ ID NO: 2976791 - RNA, 16 nt, Human
gaggcugggcucccuu

SEQ ID NO: 2976792 - RNA, 11 nt, Human
gaggcccagag

SEQ ID NO: 2976793 - RNA, 13 nt, Human
gaggcccagaggg

SEQ ID NO: 2976794 - RNA, 14 nt, Human
gaggcccagagggc

SEQ ID NO: 2976795 - RNA, 19 nt, Human
gaggcccagagggccugca

SEQ ID NO: 2976796 - RNA, 15 nt, Human
gaggcccagagggcc

SEQ ID NO: 2976797 - RNA, 16 nt, Human
gaggcccagagggccu

SEQ ID NO: 2976798 - RNA, 21 nt, Human
gaggcccuucucuccagcccc

SEQ ID NO: 2976799 - RNA, 15 nt, Human
gaggcccuucucucc

SEQ ID NO: 2976800 - RNA, 20 nt, Human
gaggcccuucucuccagccc

SEQ ID NO: 2976801 - RNA, 18 nt, Human
gagguacacuugugaaua

SEQ ID NO: 2976802 - RNA, 24 nt, Human
gagguaaggaauaccugucccccu

SEQ ID NO: 2976803 - RNA, 21 nt, Human
gagguaaggaauaccuguccc

SEQ ID NO: 2976804 - RNA, 14 nt, Human
gaggguugggcugg

SEQ ID NO: 2976805 - RNA, 15 nt, Human
gaggguugggcuggu

SEQ ID NO: 2976806 - RNA, 17 nt, Human
gaggucaaggcugcagu

SEQ ID NO: 2976807 - RNA, 13 nt, Human
gaggucagagccu

SEQ ID NO: 2976808 - RNA, 12 nt, Human
gaggucagagcc

SEQ ID NO: 2976809 - RNA, 22 nt, Human
gagggugucccaaaaagaaagg

SEQ ID NO: 2976810 - RNA, 21 nt, Human
gaggguggugaccucugccug

SEQ ID NO: 2976811 - RNA, 15 nt, Human
gagggugggaguggg

SEQ ID NO: 2976812 - RNA, 14 nt, Human
gaggguggugaccu

SEQ ID NO: 2976813 - RNA, 21 nt, Human
gagggugaagugaagacaaug

SEQ ID NO: 2976814 - RNA, 12 nt, Human
gaggguggaaua

SEQ ID NO: 2976815 - RNA, 14 nt, Human
gagggucugaggaa

SEQ ID NO: 2976816 - RNA, 13 nt, Human
gagggucugagga

SEQ ID NO: 2976817 - RNA, 19 nt, Human
gagggagggcuccagacac

SEQ ID NO: 2976818 - RNA, 20 nt, Human
gaggcugggcucccuuccca

SEQ ID NO: 2976819 - RNA, 20 nt, Human
gagggagggcuccagacaca

SEQ ID NO: 2976820 - RNA, 16 nt, Human
gagggagggcuccaga

SEQ ID NO: 2976821 - RNA, 16 nt, Human
gagggagugacagagg

SEQ ID NO: 2976822 - RNA, 18 nt, Human
gagggagugacagaggca

SEQ ID NO: 2976823 - RNA, 22 nt, Human
gagggagugacagaggcagccc

SEQ ID NO: 2976824 - RNA, 21 nt, Human
gagggagugacagaggcagcc

SEQ ID NO: 2976825 - RNA, 13 nt, Human
gaggguaaggcug

SEQ ID NO: 2976826 - RNA, 17 nt, Human
gaggggguggccuccca

SEQ ID NO: 2976827 - RNA, 15 nt, Human
gagggggccuggaug

SEQ ID NO: 2976828 - RNA, 15 nt, Human
gagggggcugcuccc

SEQ ID NO: 2976829 - RNA, 17 nt, Human
gagugaagcugggagaa

SEQ ID NO: 2976830 - RNA, 23 nt, Human
gagugaacaaauuuacagagaca

SEQ ID NO: 2976831 - RNA, 16 nt, Human
gagugacagaggcagc

SEQ ID NO: 2976832 - RNA, 15 nt, Human
gagugacagaggcag

SEQ ID NO: 2976833 - RNA, 14 nt, Human
gagugacagaggca

SEQ ID NO: 2976834 - RNA, 12 nt, Human
gagucugaaggc

SEQ ID NO: 2976835 - RNA, 13 nt, Human
gagucugaaggcu

SEQ ID NO: 2976836 - RNA, 21 nt, Human
gagucuauuuacggaacucaa

SEQ ID NO: 2976837 - RNA, 15 nt, Human
gagucugaaggcugg

SEQ ID NO: 2976838 - RNA, 14 nt, Human
gagucugaaggcug

SEQ ID NO: 2976839 - RNA, 14 nt, Human
gagucgaggacagg

SEQ ID NO: 2976840 - RNA, 19 nt, Human
gaguccgaaagggacuugg

SEQ ID NO: 2976841 - RNA, 15 nt, Human
gagucgaggacaggg

SEQ ID NO: 2976842 - RNA, 11 nt, Human
gaguauauguc

SEQ ID NO: 2976843 - RNA, 18 nt, Human
gaguaggaagacuuugga

SEQ ID NO: 2976844 - RNA, 19 nt, Human
gaguaggaagacuuuggaa

SEQ ID NO: 2976845 - RNA, 21 nt, Human
gaguacuacaguccucccauc

SEQ ID NO: 2976846 - RNA, 23 nt, Human
gaguacuacaguccucccaucuc

SEQ ID NO: 2976847 - RNA, 20 nt, Human
gaguacuacaguccucccau

SEQ ID NO: 2976848 - RNA, 13 nt, Human
gaguaggaagacu

SEQ ID NO: 2976849 - RNA, 17 nt, Human
gaguaggaagacuuugg

SEQ ID NO: 2976850 - RNA, 12 nt, Human
gaguaggaagac

SEQ ID NO: 2976851 - RNA, 22 nt, Human
gaguagcugggacuacaggcac

SEQ ID NO: 2976852 - RNA, 19 nt, Human
gaguagcugggacuacagg

SEQ ID NO: 2976853 - RNA, 16 nt, Human
gagguuucaaaccucc

SEQ ID NO: 2976854 - RNA, 15 nt, Human
gagguugggaggcca

SEQ ID NO: 2976855 - RNA, 17 nt, Human
gagguugggaggccauu

SEQ ID NO: 2976856 - RNA, 20 nt, Human
gaggucagagccugcaguua

SEQ ID NO: 2976857 - RNA, 17 nt, Human
gaggucagagccugcag

SEQ ID NO: 2976858 - RNA, 22 nt, Human
gauaugauucaaaugucuauaa

SEQ ID NO: 2976859 - RNA, 14 nt, Human
gauaugauucaaau

SEQ ID NO: 2976860 - RNA, 24 nt, Human
gauaugauucaaaugucuauaaac

SEQ ID NO: 2976861 - RNA, 16 nt, Human
gaucacggcucacugc

SEQ ID NO: 2976862 - RNA, 15 nt, Human
gaucacggcucacug

SEQ ID NO: 2976863 - RNA, 18 nt, Human
gaucacggcucacugcag

SEQ ID NO: 2976864 - RNA, 23 nt, Human
gauacaggaaaagcugcugacag

SEQ ID NO: 2976865 - RNA, 21 nt, Human
gauacaggaaaagcugcugac

SEQ ID NO: 2976866 - RNA, 19 nt, Human
gauacaggaaaagcugcug

SEQ ID NO: 2976867 - RNA, 22 nt, Human
gauaagaaccuuuugagugccu

SEQ ID NO: 2976868 - RNA, 20 nt, Human
gauacaggaaaagcugcuga

SEQ ID NO: 2976869 - RNA, 22 nt, Human
gauagccaaggccaaaggaagc

SEQ ID NO: 2976870 - RNA, 14 nt, Human
gauagccaaggcca

SEQ ID NO: 2976871 - RNA, 15 nt, Human
gauagcacagacccu

SEQ ID NO: 2976872 - RNA, 12 nt, Human
gaguuacagaca

SEQ ID NO: 2976873 - RNA, 20 nt, Human
gagugugccugaagucccag

SEQ ID NO: 2976874 - RNA, 16 nt, Human
gaguggucagaacaga

SEQ ID NO: 2976875 - RNA, 15 nt, Human
gaguguacagagugg

SEQ ID NO: 2976876 - RNA, 17 nt, Human
gagugacagaggcagcc

SEQ ID NO: 2976877 - RNA, 13 nt, Human
gagugggugaaua

SEQ ID NO: 2976878 - RNA, 13 nt, Human
gaguuacagacaa

SEQ ID NO: 2976879 - RNA, 15 nt, Human
gaguuacagacaaag

SEQ ID NO: 2976880 - RNA, 19 nt, Human
gaguucaucuugaauugua

SEQ ID NO: 2976881 - RNA, 20 nt, Human
gaguucaucuugaauuguaa

SEQ ID NO: 2976882 - RNA, 14 nt, Human
gaguucaucuugaa

SEQ ID NO: 2976883 - RNA, 20 nt, Human
gaguucauacccuguuacca

SEQ ID NO: 2976884 - RNA, 15 nt, Human
gaguugaagacagag

SEQ ID NO: 2976885 - RNA, 17 nt, Human
gaguugaagacagagcu

SEQ ID NO: 2976886 - RNA, 21 nt, Human
gaguugaagacagagcuacac

SEQ ID NO: 2976887 - RNA, 14 nt, Human
gaguugaagacaga

SEQ ID NO: 2976888 - RNA, 22 nt, Human
gauaaauggcuuccuggcaaua

SEQ ID NO: 2976889 - RNA, 19 nt, Human
gacagagccccacccucag

SEQ ID NO: 2976890 - RNA, 12 nt, Human
gacagaggcagc

SEQ ID NO: 2976891 - RNA, 16 nt, Human
gacagaggcagcccca

SEQ ID NO: 2976892 - RNA, 14 nt, Human
gacagaggcagccc

SEQ ID NO: 2976893 - RNA, 21 nt, Human
gacagagcaagugagacccug

SEQ ID NO: 2976894 - RNA, 21 nt, Human
gacagaggggguggccuccca

SEQ ID NO: 2976895 - RNA, 22 nt, Human
gacagaggggguggccucccaa

SEQ ID NO: 2976896 - RNA, 23 nt, Human
gacagaggggguggccucccaac

SEQ ID NO: 2976897 - RNA, 18 nt, Human
gacagaggggguggccuc

SEQ ID NO: 2976898 - RNA, 19 nt, Human
gacagaggggguggccucc

SEQ ID NO: 2976899 - RNA, 15 nt, Human
gacagaggggguggc

SEQ ID NO: 2976900 - RNA, 17 nt, Human
gacagaggcagccccau

SEQ ID NO: 2976901 - RNA, 16 nt, Human
gacagcugccugggau

SEQ ID NO: 2976902 - RNA, 17 nt, Human
gacagcugccugggauc

SEQ ID NO: 2976903 - RNA, 21 nt, Human
gacagccacggccaggccaga

SEQ ID NO: 2976904 - RNA, 20 nt, Human
gacagccacggccaggccag

SEQ ID NO: 2976905 - RNA, 18 nt, Human
gacagcugccugggaucc

SEQ ID NO: 2976906 - RNA, 21 nt, Human
gacagcugccugggaucccuc

SEQ ID NO: 2976907 - RNA, 19 nt, Human
gacagccacggccaggcca

SEQ ID NO: 2976908 - RNA, 18 nt, Human
gacagccacggccaggcc

SEQ ID NO: 2976909 - RNA, 17 nt, Human
gacagccacggccaggc

SEQ ID NO: 2976910 - RNA, 14 nt, Human
gacagccacggcca

SEQ ID NO: 2976911 - RNA, 22 nt, Human
gacagagugagacucugucuca

SEQ ID NO: 2976912 - RNA, 20 nt, Human
gacagagugagacucugucu

SEQ ID NO: 2976913 - RNA, 13 nt, Human
gacagagggggug

SEQ ID NO: 2976914 - RNA, 13 nt, Human
gacagccacggcc

SEQ ID NO: 2976915 - RNA, 20 nt, Human
gacauagaauuaacacauga

SEQ ID NO: 2976916 - RNA, 22 nt, Human
gacaguuaagagaaaugagcuu

SEQ ID NO: 2976917 - RNA, 14 nt, Human
gacaugaucuucuu

SEQ ID NO: 2976918 - RNA, 14 nt, Human
gacaugggaaaggg

SEQ ID NO: 2976919 - RNA, 15 nt, Human
gacaggaccagggau

SEQ ID NO: 2976920 - RNA, 23 nt, Human
gacaggaccagggauuuccauga

SEQ ID NO: 2976921 - RNA, 14 nt, Human
gacaggaccaggga

SEQ ID NO: 2976922 - RNA, 17 nt, Human
gacagggaggacgcucu

SEQ ID NO: 2976923 - RNA, 24 nt, Human
gacagggcacaccgggcacucaga

SEQ ID NO: 2976924 - RNA, 14 nt, Human
gacaguuaagagaa

SEQ ID NO: 2976925 - RNA, 18 nt, Human
gacagggaggacgcucuc

SEQ ID NO: 2976926 - RNA, 16 nt, Human
gacagggaggugaccc

SEQ ID NO: 2976927 - RNA, 23 nt, Human
gacagggcacaccgggcacucag

SEQ ID NO: 2976928 - RNA, 15 nt, Human
gacccacaagaaaug

SEQ ID NO: 2976929 - RNA, 16 nt, Human
gacccaaaaggcagaa

SEQ ID NO: 2976930 - RNA, 20 nt, Human
gacccaaaaggcagaagcaa

SEQ ID NO: 2976931 - RNA, 22 nt, Human
gacccugaggcccagagggccu

SEQ ID NO: 2976932 - RNA, 21 nt, Human
gaccccuccaugugggcuagu

SEQ ID NO: 2976933 - RNA, 18 nt, Human
gaccccuccaugugggcu

SEQ ID NO: 2976934 - RNA, 14 nt, Human
gaccccuccaugug

SEQ ID NO: 2976935 - RNA, 23 nt, Human
gacccugaggcccagagggccug

SEQ ID NO: 2976936 - RNA, 18 nt, Human
gaccgugaggccagagac

SEQ ID NO: 2976937 - RNA, 16 nt, Human
gaccgugaggccagag

SEQ ID NO: 2976938 - RNA, 17 nt, Human
gaccgugaggccagaga

SEQ ID NO: 2976939 - RNA, 15 nt, Human
gacccuugugguccc

SEQ ID NO: 2976940 - RNA, 21 nt, Human
gacccuuguggucccacccca

SEQ ID NO: 2976941 - RNA, 19 nt, Human
gacccuuguggucccaccc

SEQ ID NO: 2976942 - RNA, 20 nt, Human
gacccuuguggucccacccc

SEQ ID NO: 2976943 - RNA, 12 nt, Human
gacccugucuca

SEQ ID NO: 2976944 - RNA, 14 nt, Human
gaccacguuucuaa

SEQ ID NO: 2976945 - RNA, 21 nt, Human
gaccacugcagaagacaguau

SEQ ID NO: 2976946 - RNA, 11 nt, Human
gaccagagcug

SEQ ID NO: 2976947 - RNA, 24 nt, Human
gaccagacaccuugacagggcaca

SEQ ID NO: 2976948 - RNA, 18 nt, Human
gacaugggaaaggggaag

SEQ ID NO: 2976949 - RNA, 16 nt, Human
gacaugggacauuugc

SEQ ID NO: 2976950 - RNA, 13 nt, Human
gaccagagcugcc

SEQ ID NO: 2976951 - RNA, 14 nt, Human
gaccagagcugcca

SEQ ID NO: 2976952 - RNA, 15 nt, Human
gaccagagcugccac

SEQ ID NO: 2976953 - RNA, 17 nt, Human
gaccagagcugccaccu

SEQ ID NO: 2976954 - RNA, 18 nt, Human
gaccagagcugccaccug

SEQ ID NO: 2976955 - RNA, 19 nt, Human
gaccagagcugccaccugc

SEQ ID NO: 2976956 - RNA, 21 nt, Human
gaccauucuccaccugccagg

SEQ ID NO: 2976957 - RNA, 22 nt, Human
gaccauucuccaccugccaggg

SEQ ID NO: 2976958 - RNA, 21 nt, Human
gaccauuggggcucccagcca

SEQ ID NO: 2976959 - RNA, 20 nt, Human
gaccauuggggcucccagcc

SEQ ID NO: 2976960 - RNA, 19 nt, Human
gaccauuggggcucccagc

SEQ ID NO: 2976961 - RNA, 17 nt, Human
gaccauuggggcuccca

SEQ ID NO: 2976962 - RNA, 17 nt, Human
gaccauucuccaccugc

SEQ ID NO: 2976963 - RNA, 19 nt, Human
gaccauucuccaccugcca

SEQ ID NO: 2976964 - RNA, 20 nt, Human
gaccauucuccaccugccag

SEQ ID NO: 2976965 - RNA, 22 nt, Human
gaaugucaguuguuauuuauug

SEQ ID NO: 2976966 - RNA, 13 nt, Human
gaaugucagugug

SEQ ID NO: 2976967 - RNA, 13 nt, Human
gaauguaggcugg

SEQ ID NO: 2976968 - RNA, 22 nt, Human
gaauguaggcuggcuuucagag

SEQ ID NO: 2976969 - RNA, 15 nt, Human
gaaugucacuucugg

SEQ ID NO: 2976970 - RNA, 16 nt, Human
gaauuggagcucgugg

SEQ ID NO: 2976971 - RNA, 16 nt, Human
gaauugacauugaaau

SEQ ID NO: 2976972 - RNA, 21 nt, Human
gaauugacccacaagaaauga

SEQ ID NO: 2976973 - RNA, 16 nt, Human
gaauugacccacaaga

SEQ ID NO: 2976974 - RNA, 14 nt, Human
gaauugaagcagga

SEQ ID NO: 2976975 - RNA, 21 nt, Human
gaaugcacaaacagaggccgc

SEQ ID NO: 2976976 - RNA, 21 nt, Human
gaaugaaagggcccagagagg

SEQ ID NO: 2976977 - RNA, 20 nt, Human
gaaugcacaaacagaggccg

SEQ ID NO: 2976978 - RNA, 20 nt, Human
gaauccagacccggcugcgu

SEQ ID NO: 2976979 - RNA, 18 nt, Human
gaauccagacccggcugc

SEQ ID NO: 2976980 - RNA, 16 nt, Human
gacacaagccuucggc

SEQ ID NO: 2976981 - RNA, 19 nt, Human
gacacaggcccggcuccag

SEQ ID NO: 2976982 - RNA, 21 nt, Human
gacacaggcccggcuccaggc

SEQ ID NO: 2976983 - RNA, 20 nt, Human
gacacaggcccggcuccagg

SEQ ID NO: 2976984 - RNA, 14 nt, Human
gacacaugcaaggu

SEQ ID NO: 2976985 - RNA, 19 nt, Human
gacacaugcaaggucauuu

SEQ ID NO: 2976986 - RNA, 15 nt, Human
gacacauguccaaga

SEQ ID NO: 2976987 - RNA, 20 nt, Human
gacacauguccaagaagccc

SEQ ID NO: 2976988 - RNA, 23 nt, Human
gacacauguccaagaagcccagg

SEQ ID NO: 2976989 - RNA, 17 nt, Human
gacacaugccagggcca

SEQ ID NO: 2976990 - RNA, 16 nt, Human
gacaaggaaaaaauaa

SEQ ID NO: 2976991 - RNA, 19 nt, Human
gacaaggauugcuacuguc

SEQ ID NO: 2976992 - RNA, 21 nt, Human
gacaaggaugaucuaggaaga

SEQ ID NO: 2976993 - RNA, 18 nt, Human
gacaaggauugcuacugu

SEQ ID NO: 2976994 - RNA, 12 nt, Human
gacaaugugaaa

SEQ ID NO: 2976995 - RNA, 18 nt, Human
gacaaugugaaaagaaaa

SEQ ID NO: 2976996 - RNA, 22 nt, Human
gacaaugcaaaccaucauugaa

SEQ ID NO: 2976997 - RNA, 19 nt, Human
gacaaugugaaaagaaaaa

SEQ ID NO: 2976998 - RNA, 20 nt, Human
gacaaugugaaaagaaaaau

SEQ ID NO: 2976999 - RNA, 22 nt, Human
gaauuucuuuugccguuauuaa

SEQ ID NO: 2977000 - RNA, 20 nt, Human
gaauuugauaugugaacagu

SEQ ID NO: 2977001 - RNA, 20 nt, Human
gaauuucuaggacugaauua

SEQ ID NO: 2977002 - RNA, 19 nt, Human
gaauuucuaggacugaauu

SEQ ID NO: 2977003 - RNA, 15 nt, Human
gaauuguaaggaaug

SEQ ID NO: 2977004 - RNA, 22 nt, Human
gacaacacucauugaccugagg

SEQ ID NO: 2977005 - RNA, 23 nt, Human
gacaacacucauugaccugaggc

SEQ ID NO: 2977006 - RNA, 15 nt, Human
gacaagcucacagac

SEQ ID NO: 2977007 - RNA, 20 nt, Human
gagacagcucugcauacuca

SEQ ID NO: 2977008 - RNA, 20 nt, Human
gagaaugagagacacacuga

SEQ ID NO: 2977009 - RNA, 23 nt, Human
gagaaugcacaaacagaggccgc

SEQ ID NO: 2977010 - RNA, 18 nt, Human
gagaccaucccugaaggc

SEQ ID NO: 2977011 - RNA, 21 nt, Human
gagaccaucccugaaggcccc

SEQ ID NO: 2977012 - RNA, 14 nt, Human
gagaccaucccuga

SEQ ID NO: 2977013 - RNA, 12 nt, Human
gagaccaucccu

SEQ ID NO: 2977014 - RNA, 22 nt, Human
gagacaggguuuugccauguug

SEQ ID NO: 2977015 - RNA, 20 nt, Human
gagacucgcgacaaugcaaa

SEQ ID NO: 2977016 - RNA, 21 nt, Human
gagacucgcgacaaugcaaac

SEQ ID NO: 2977017 - RNA, 13 nt, Human
gagacucugucuc

SEQ ID NO: 2977018 - RNA, 20 nt, Human
gagacuccugcaggcagcca

SEQ ID NO: 2977019 - RNA, 21 nt, Human
gagacuccugcaggcagccag

SEQ ID NO: 2977020 - RNA, 19 nt, Human
gagacuccugcaggcagcc

SEQ ID NO: 2977021 - RNA, 18 nt, Human
gagacuccugcaggcagc

SEQ ID NO: 2977022 - RNA, 19 nt, Human
gagacuggcgugaacccag

SEQ ID NO: 2977023 - RNA, 22 nt, Human
gagacuggcgugaacccaggag

SEQ ID NO: 2977024 - RNA, 19 nt, Human
gagagacacacugaagaag

SEQ ID NO: 2977025 - RNA, 14 nt, Human
gagagggugggagu

SEQ ID NO: 2977026 - RNA, 16 nt, Human
gagagggugggagugg

SEQ ID NO: 2977027 - RNA, 13 nt, Human
gagaggggcacag

SEQ ID NO: 2977028 - RNA, 19 nt, Human
gagaggggaacagacugga

SEQ ID NO: 2977029 - RNA, 20 nt, Human
gagccagauuucacucuccu

SEQ ID NO: 2977030 - RNA, 19 nt, Human
gagccaauuuaaagaaaac

SEQ ID NO: 2977031 - RNA, 12 nt, Human
gagcagagacca

SEQ ID NO: 2977032 - RNA, 16 nt, Human
gagcagagaauucucu

SEQ ID NO: 2977033 - RNA, 23 nt, Human
gagccagauuucacucuccuugg

SEQ ID NO: 2977034 - RNA, 14 nt, Human
gagccagggucuca

SEQ ID NO: 2977035 - RNA, 19 nt, Human
gagccagggucucacuaug

SEQ ID NO: 2977036 - RNA, 18 nt, Human
gagcccugguggcagugg

SEQ ID NO: 2977037 - RNA, 21 nt, Human
gagcaccuuagacagucccug

SEQ ID NO: 2977038 - RNA, 22 nt, Human
gagcaccuuagacagucccugc

SEQ ID NO: 2977039 - RNA, 15 nt, Human
gagcacuaaggugug

SEQ ID NO: 2977040 - RNA, 19 nt, Human
gagcaccuuagacaguccc

SEQ ID NO: 2977041 - RNA, 21 nt, Human
gagcacuaaggugugcucuga

SEQ ID NO: 2977042 - RNA, 20 nt, Human
gagcaccuuagacagucccu

SEQ ID NO: 2977043 - RNA, 16 nt, Human
gagauagccaaggcca

SEQ ID NO: 2977044 - RNA, 23 nt, Human
gagaucaaccccuucgcuccugu

SEQ ID NO: 2977045 - RNA, 14 nt, Human
gagauagccaaggc

SEQ ID NO: 2977046 - RNA, 18 nt, Human
gagaucacgccacugcac

SEQ ID NO: 2977047 - RNA, 19 nt, Human
gagaucacgccacugcacu

SEQ ID NO: 2977048 - RNA, 17 nt, Human
gagcaaaguagaucaug

SEQ ID NO: 2977049 - RNA, 16 nt, Human
gacugcauuauauuua

SEQ ID NO: 2977050 - RNA, 14 nt, Human
gacugcauuauauu

SEQ ID NO: 2977051 - RNA, 23 nt, Human
gacugaguacguugugcauuugg

SEQ ID NO: 2977052 - RNA, 15 nt, Human
gacugcccggcaggg

SEQ ID NO: 2977053 - RNA, 13 nt, Human
gacugcccggcag

SEQ ID NO: 2977054 - RNA, 22 nt, Human
gacugaguacguugugcauuug

SEQ ID NO: 2977055 - RNA, 21 nt, Human
gacugaguacguugugcauuu

SEQ ID NO: 2977056 - RNA, 17 nt, Human
gacucgcgacaaugcaa

SEQ ID NO: 2977057 - RNA, 18 nt, Human
gacuggaagcacagcuuc

SEQ ID NO: 2977058 - RNA, 19 nt, Human
gacuggggccacuacauuu

SEQ ID NO: 2977059 - RNA, 16 nt, Human
gacuggaagcacagcu

SEQ ID NO: 2977060 - RNA, 15 nt, Human
gacuggaagcacagc

SEQ ID NO: 2977061 - RNA, 14 nt, Human
gacuggaagcacag

SEQ ID NO: 2977062 - RNA, 20 nt, Human
gacugcugggagguuaaaaa

SEQ ID NO: 2977063 - RNA, 21 nt, Human
gacucauuuuaaaaaauggaa

SEQ ID NO: 2977064 - RNA, 11 nt, Human
gacuccaaaga

SEQ ID NO: 2977065 - RNA, 12 nt, Human
gacuccaaagaa

SEQ ID NO: 2977066 - RNA, 15 nt, Human
gacuccaaagaaaug

SEQ ID NO: 2977067 - RNA, 16 nt, Human
gacuccaaagaaaugu

SEQ ID NO: 2977068 - RNA, 12 nt, Human
gacuccugcagg

SEQ ID NO: 2977069 - RNA, 13 nt, Human
gacuccugcaggc

SEQ ID NO: 2977070 - RNA, 13 nt, Human
gacucgcgacaau

SEQ ID NO: 2977071 - RNA, 15 nt, Human
gacucauucuucugu

SEQ ID NO: 2977072 - RNA, 14 nt, Human
gacucauucuucug

SEQ ID NO: 2977073 - RNA, 21 nt, Human
gacuacaggugugagucacca

SEQ ID NO: 2977074 - RNA, 18 nt, Human
gacuacaggugugaguca

SEQ ID NO: 2977075 - RNA, 13 nt, Human
gacuacaggugug

SEQ ID NO: 2977076 - RNA, 19 nt, Human
gacuucuaaguaaaaccac

SEQ ID NO: 2977077 - RNA, 23 nt, Human
gacuucuaaguaaaaccacagca

SEQ ID NO: 2977078 - RNA, 24 nt, Human
gacuucuaaguaaaaccacagcag

SEQ ID NO: 2977079 - RNA, 20 nt, Human
gacuucugucuucacaacag

SEQ ID NO: 2977080 - RNA, 23 nt, Human
gacuucugucuucacaacagauu

SEQ ID NO: 2977081 - RNA, 17 nt, Human
gacuucuaaguaaaacc

SEQ ID NO: 2977082 - RNA, 18 nt, Human
gacuucuaaguaaaacca

SEQ ID NO: 2977083 - RNA, 16 nt, Human
gacuucuaaguaaaac

SEQ ID NO: 2977084 - RNA, 19 nt, Human
gacuuaagcacacuugaca

SEQ ID NO: 2977085 - RNA, 19 nt, Human
gacuugcauaccugcuuuu

SEQ ID NO: 2977086 - RNA, 16 nt, Human
gagaaagguugaagca

SEQ ID NO: 2977087 - RNA, 14 nt, Human
gagaaaugagcuug

SEQ ID NO: 2977088 - RNA, 22 nt, Human
gagaaccuagggugauauuaac

SEQ ID NO: 2977089 - RNA, 21 nt, Human
gagaaccuagggugauauuaa

SEQ ID NO: 2977090 - RNA, 17 nt, Human
gagaaugagagacacac

SEQ ID NO: 2977091 - RNA, 16 nt, Human
gagaagagaaugcaca

SEQ ID NO: 2977092 - RNA, 16 nt, Human
gagaagcagaggaagg

SEQ ID NO: 2977093 - RNA, 14 nt, Human
gagaagagaaugca

SEQ ID NO: 2977094 - RNA, 23 nt, Human
gagaacuuccagauccuggaaau

SEQ ID NO: 2977095 - RNA, 22 nt, Human
gagaacuuccagauccuggaaa

SEQ ID NO: 2977096 - RNA, 18 nt, Human
cugugauggggcccugcc

SEQ ID NO: 2977097 - RNA, 17 nt, Human
cugugauggggcccugc

SEQ ID NO: 2977098 - RNA, 20 nt, Human
cugugaguacuacaguccuc

SEQ ID NO: 2977099 - RNA, 21 nt, Human
cugugaguacuacaguccucc

SEQ ID NO: 2977100 - RNA, 23 nt, Human
cugugaguacuacaguccuccca

SEQ ID NO: 2977101 - RNA, 18 nt, Human
cugucuccauguuugaug

SEQ ID NO: 2977102 - RNA, 21 nt, Human
cugugcaucuagccucaagcu

SEQ ID NO: 2977103 - RNA, 19 nt, Human
cugugauggggcccugccu

SEQ ID NO: 2977104 - RNA, 20 nt, Human
cugugauggggcccugccuc

SEQ ID NO: 2977105 - RNA, 18 nt, Human
cugugccaugugccaggu

SEQ ID NO: 2977106 - RNA, 16 nt, Human
cugugccaugugccag

SEQ ID NO: 2977107 - RNA, 14 nt, Human
cugugccauuuugu

SEQ ID NO: 2977108 - RNA, 16 nt, Human
cugugccucugggacu

SEQ ID NO: 2977109 - RNA, 14 nt, Human
cugugccucuggga

SEQ ID NO: 2977110 - RNA, 21 nt, Human
cugugcugcccugcccaccug

SEQ ID NO: 2977111 - RNA, 17 nt, Human
cugugccucugggacug

SEQ ID NO: 2977112 - RNA, 22 nt, Human
cugugcugcccugcccaccugg

SEQ ID NO: 2977113 - RNA, 14 nt, Human
cugugggcccccaa

SEQ ID NO: 2977114 - RNA, 23 nt, Human
cuguggcgagccauuugucccaa

SEQ ID NO: 2977115 - RNA, 22 nt, Human
cuguggcgagccauuuguccca

SEQ ID NO: 2977116 - RNA, 21 nt, Human
cuguggaugcugcugccccug

SEQ ID NO: 2977117 - RNA, 19 nt, Human
cuguggaugcugcugcccc

SEQ ID NO: 2977118 - RNA, 18 nt, Human
cuguggaugcugcugccc

SEQ ID NO: 2977119 - RNA, 16 nt, Human
cuguggaugcugcugc

SEQ ID NO: 2977120 - RNA, 23 nt, Human
cuguggaugcugcugccccugca

SEQ ID NO: 2977121 - RNA, 22 nt, Human
cuguggaugcugcugccccugc

SEQ ID NO: 2977122 - RNA, 14 nt, Human
cuguggaugcugcu

SEQ ID NO: 2977123 - RNA, 17 nt, Human
cuguggaugauaaaaca

SEQ ID NO: 2977124 - RNA, 20 nt, Human
cuguuaaaagaugaaaauau

SEQ ID NO: 2977125 - RNA, 21 nt, Human
cuguuaaaagaugaaaauauu

SEQ ID NO: 2977126 - RNA, 23 nt, Human
cuguuaaaagaugaaaauauuug

SEQ ID NO: 2977127 - RNA, 20 nt, Human
cugugugugcgccuacagga

SEQ ID NO: 2977128 - RNA, 18 nt, Human
cugugugugcgccuacag

SEQ ID NO: 2977129 - RNA, 22 nt, Human
cugugucuugcaauggcagccu

SEQ ID NO: 2977130 - RNA, 20 nt, Human
cugugucuugcaauggcagc

SEQ ID NO: 2977131 - RNA, 21 nt, Human
cugugucuugcaauggcagcc

SEQ ID NO: 2977132 - RNA, 17 nt, Human
cuguucaugaaagauuc

SEQ ID NO: 2977133 - RNA, 23 nt, Human
cuguucaugaaagauucaaugcc

SEQ ID NO: 2977134 - RNA, 18 nt, Human
cuguucaugaaagauuca

SEQ ID NO: 2977135 - RNA, 18 nt, Human
cuguucagcugguugagg

SEQ ID NO: 2977136 - RNA, 19 nt, Human
cuguucagcugguugaggu

SEQ ID NO: 2977137 - RNA, 21 nt, Human
cuguucagcugguugagguuu

SEQ ID NO: 2977138 - RNA, 14 nt, Human
cuguucucugcccu

SEQ ID NO: 2977139 - RNA, 15 nt, Human
cuguucucugcccuc

SEQ ID NO: 2977140 - RNA, 16 nt, Human
cuguucucugcccucc

SEQ ID NO: 2977141 - RNA, 17 nt, Human
cuguucucugcccucca

SEQ ID NO: 2977142 - RNA, 18 nt, Human
cuguucucugcccuccaa

SEQ ID NO: 2977143 - RNA, 19 nt, Human
cuguucucugcccuccaag

SEQ ID NO: 2977144 - RNA, 20 nt, Human
cuguucucugcccuccaaga

SEQ ID NO: 2977145 - RNA, 13 nt, Human
cuguucucugccc

SEQ ID NO: 2977146 - RNA, 22 nt, Human
cuguaauaaacucauuucuagc

SEQ ID NO: 2977147 - RNA, 23 nt, Human
cuguaaucacagcuacuugggag

SEQ ID NO: 2977148 - RNA, 16 nt, Human
cugguuccauggccuc

SEQ ID NO: 2977149 - RNA, 13 nt, Human
cuguacaaaguag

SEQ ID NO: 2977150 - RNA, 15 nt, Human
cuguacaaaguagaa

SEQ ID NO: 2977151 - RNA, 20 nt, Human
cuguaauccuagcacuuugg

SEQ ID NO: 2977152 - RNA, 14 nt, Human
cugguggcagcugc

SEQ ID NO: 2977153 - RNA, 13 nt, Human
cugguggcagcug

SEQ ID NO: 2977154 - RNA, 21 nt, Human
cugguggcagcucaccucucc

SEQ ID NO: 2977155 - RNA, 23 nt, Human
cugguggcagcucaccucucccu

SEQ ID NO: 2977156 - RNA, 19 nt, Human
cugggggcugggcagagga

SEQ ID NO: 2977157 - RNA, 22 nt, Human
cugggggggauuguaaaauggu

SEQ ID NO: 2977158 - RNA, 15 nt, Human
cugggggaagaagcu

SEQ ID NO: 2977159 - RNA, 24 nt, Human
cugggcuucaguggcagcugcuuu

SEQ ID NO: 2977160 - RNA, 13 nt, Human
cugggggaagaag

SEQ ID NO: 2977161 - RNA, 22 nt, Human
cuggguaacuagggaagauaau

SEQ ID NO: 2977162 - RNA, 20 nt, Human
cuggguaacuagggaagaua

SEQ ID NO: 2977163 - RNA, 14 nt, Human
cuggguucuaccca

SEQ ID NO: 2977164 - RNA, 15 nt, Human
cuggguucuacccag

SEQ ID NO: 2977165 - RNA, 16 nt, Human
cuggguucuacccagg

SEQ ID NO: 2977166 - RNA, 17 nt, Human
cuggguucuacccaggu

SEQ ID NO: 2977167 - RNA, 20 nt, Human
cugucuacacuaagagagaa

SEQ ID NO: 2977168 - RNA, 15 nt, Human
cuguccgagcuuuga

SEQ ID NO: 2977169 - RNA, 14 nt, Human
cuguccuacccacc

SEQ ID NO: 2977170 - RNA, 18 nt, Human
cugucucaaaaaaagaaa

SEQ ID NO: 2977171 - RNA, 16 nt, Human
cugucucaaaaaaaga

SEQ ID NO: 2977172 - RNA, 23 nt, Human
cugucucaaaaaaacacaaaagu

SEQ ID NO: 2977173 - RNA, 17 nt, Human
cuguccccgcacugggc

SEQ ID NO: 2977174 - RNA, 18 nt, Human
cuguccccgcacugggcu

SEQ ID NO: 2977175 - RNA, 19 nt, Human
cuguccccgcacugggcuu

SEQ ID NO: 2977176 - RNA, 22 nt, Human
cuguccccgcacugggcuuggg

SEQ ID NO: 2977177 - RNA, 14 nt, Human
cuguccgagcuuug

SEQ ID NO: 2977178 - RNA, 20 nt, Human
cugucccuuacgugaguccu

SEQ ID NO: 2977179 - RNA, 13 nt, Human
cuguacagagccc

SEQ ID NO: 2977180 - RNA, 22 nt, Human
cuguagucccagcuacucggga

SEQ ID NO: 2977181 - RNA, 19 nt, Human
cuguauuuuaaaagaauga

SEQ ID NO: 2977182 - RNA, 20 nt, Human
cuguauuuuaaaagaaugau

SEQ ID NO: 2977183 - RNA, 22 nt, Human
cuguauuuuaaaagaaugauua

SEQ ID NO: 2977184 - RNA, 23 nt, Human
cuguaucccaugagccucagcau

SEQ ID NO: 2977185 - RNA, 22 nt, Human
cuggcacugguuuguucccugu

SEQ ID NO: 2977186 - RNA, 18 nt, Human
cuggcacugcuuccagug

SEQ ID NO: 2977187 - RNA, 22 nt, Human
cuggcacuggcaaacagggccu

SEQ ID NO: 2977188 - RNA, 19 nt, Human
cuggcacugcuuccaguga

SEQ ID NO: 2977189 - RNA, 20 nt, Human
cuggcacugcuuccagugag

SEQ ID NO: 2977190 - RNA, 23 nt, Human
cuggcacugcuuccagugaggcu

SEQ ID NO: 2977191 - RNA, 21 nt, Human
cuggcacaguuuucugagaaa

SEQ ID NO: 2977192 - RNA, 22 nt, Human
cuggcacaguuuucugagaaag

SEQ ID NO: 2977193 - RNA, 20 nt, Human
cuggcacaguuuucugagaa

SEQ ID NO: 2977194 - RNA, 20 nt, Human
cuggagugcagugagccgag

SEQ ID NO: 2977195 - RNA, 19 nt, Human
cuggcacccggccccugcu

SEQ ID NO: 2977196 - RNA, 21 nt, Human
cuggcacccggccccugcugg

SEQ ID NO: 2977197 - RNA, 20 nt, Human
cuggcacccggccccugcug

SEQ ID NO: 2977198 - RNA, 15 nt, Human
cuggcccacugcauc

SEQ ID NO: 2977199 - RNA, 14 nt, Human
cuggccagaugcac

SEQ ID NO: 2977200 - RNA, 22 nt, Human
cuggccuucggccuccauccug

SEQ ID NO: 2977201 - RNA, 24 nt, Human
cuggccuggccccucagggucccu

SEQ ID NO: 2977202 - RNA, 19 nt, Human
cuggccuggccccucaggg

SEQ ID NO: 2977203 - RNA, 18 nt, Human
cuggccucugcacucccc

SEQ ID NO: 2977204 - RNA, 20 nt, Human
cuggccucugcacuccccug

SEQ ID NO: 2977205 - RNA, 21 nt, Human
cuggccucugcacuccccugc

SEQ ID NO: 2977206 - RNA, 16 nt, Human
cuggccucugcacucc

SEQ ID NO: 2977207 - RNA, 23 nt, Human
cuggccuucggccuccauccuga

SEQ ID NO: 2977208 - RNA, 15 nt, Human
cuggcgugcaguggu

SEQ ID NO: 2977209 - RNA, 14 nt, Human
cuggcgugcagugg

SEQ ID NO: 2977210 - RNA, 21 nt, Human
cuggcucuuccaggcugggag

SEQ ID NO: 2977211 - RNA, 22 nt, Human
cuggcucuuccaggcugggaga

SEQ ID NO: 2977212 - RNA, 22 nt, Human
cuggcgugaacccaggaggcgg

SEQ ID NO: 2977213 - RNA, 16 nt, Human
cuggcuaacacgguga

SEQ ID NO: 2977214 - RNA, 24 nt, Human
cuggcucuuccaggcugggagagc

SEQ ID NO: 2977215 - RNA, 16 nt, Human
cuggagcucugcccau

SEQ ID NO: 2977216 - RNA, 13 nt, Human
cuggagcucugcc

SEQ ID NO: 2977217 - RNA, 12 nt, Human
cuggagcucugc

SEQ ID NO: 2977218 - RNA, 17 nt, Human
cuggagugcagugagcc

SEQ ID NO: 2977219 - RNA, 16 nt, Human
cuggagugcagugagc

SEQ ID NO: 2977220 - RNA, 15 nt, Human
cuggagugcagugag

SEQ ID NO: 2977221 - RNA, 14 nt, Human
cuggagugcaguga

SEQ ID NO: 2977222 - RNA, 17 nt, Human
cuggagguacgaaaaga

SEQ ID NO: 2977223 - RNA, 22 nt, Human
cuggagguacgaaaagagggga

SEQ ID NO: 2977224 - RNA, 17 nt, Human
cuggacaggcauguucu

SEQ ID NO: 2977225 - RNA, 14 nt, Human
cuggacaggcaugu

SEQ ID NO: 2977226 - RNA, 23 nt, Human
cuggacaggcauguucucugagg

SEQ ID NO: 2977227 - RNA, 20 nt, Human
cuggaccuugaacuggguac

SEQ ID NO: 2977228 - RNA, 17 nt, Human
cuggaccuugaacuggg

SEQ ID NO: 2977229 - RNA, 21 nt, Human
cuggaccuugaacuggguacu

SEQ ID NO: 2977230 - RNA, 15 nt, Human
cuggacccuguggau

SEQ ID NO: 2977231 - RNA, 16 nt, Human
cuggaccuugaacugg

SEQ ID NO: 2977232 - RNA, 21 nt, Human
cugcccucuccugggcagcug

SEQ ID NO: 2977233 - RNA, 20 nt, Human
cugcccucuccugggcagcu

SEQ ID NO: 2977234 - RNA, 19 nt, Human
cugcccucuccugggcagc

SEQ ID NO: 2977235 - RNA, 18 nt, Human
cugcccucuccugggcag

SEQ ID NO: 2977236 - RNA, 16 nt, Human
cugcccucuccugggc

SEQ ID NO: 2977237 - RNA, 15 nt, Human
cugcccucuccuggg

SEQ ID NO: 2977238 - RNA, 14 nt, Human
cucccuucccaccu

SEQ ID NO: 2977239 - RNA, 15 nt, Human
cucccuucccaccuc

SEQ ID NO: 2977240 - RNA, 16 nt, Human
cucccuucccaccucu

SEQ ID NO: 2977241 - RNA, 17 nt, Human
cucccuucccaccucuc

SEQ ID NO: 2977242 - RNA, 12 nt, Human
cugcccuccaag

SEQ ID NO: 2977243 - RNA, 16 nt, Human
cugcccucaagagcaa

SEQ ID NO: 2977244 - RNA, 17 nt, Human
cugccgcagcccugcag

SEQ ID NO: 2977245 - RNA, 18 nt, Human
cugccgcagcccugcaga

SEQ ID NO: 2977246 - RNA, 14 nt, Human
cugccgcagcccug

SEQ ID NO: 2977247 - RNA, 15 nt, Human
cugccgcagcccugc

SEQ ID NO: 2977248 - RNA, 13 nt, Human
cugccuccccucc

SEQ ID NO: 2977249 - RNA, 23 nt, Human
cugccucugacacacagcucugu

SEQ ID NO: 2977250 - RNA, 22 nt, Human
cugccucugacacacagcucug

SEQ ID NO: 2977251 - RNA, 12 nt, Human
cugccucccauc

SEQ ID NO: 2977252 - RNA, 14 nt, Human
cugccucccaucac

SEQ ID NO: 2977253 - RNA, 16 nt, Human
cugccucccaucaccc

SEQ ID NO: 2977254 - RNA, 19 nt, Human
cugccucccaucacccgcu

SEQ ID NO: 2977255 - RNA, 11 nt, Human
cugccucccau

SEQ ID NO: 2977256 - RNA, 15 nt, Human
cugccucuucucuac

SEQ ID NO: 2977257 - RNA, 14 nt, Human
cugccucuucucua

SEQ ID NO: 2977258 - RNA, 17 nt, Human
cugccugcccaggcccc

SEQ ID NO: 2977259 - RNA, 16 nt, Human
cugccugcccaggccc

SEQ ID NO: 2977260 - RNA, 15 nt, Human
cugccugcccaggcc

SEQ ID NO: 2977261 - RNA, 15 nt, Human
cugccugaagucaca

SEQ ID NO: 2977262 - RNA, 21 nt, Human
cugccugggaucccucauccu

SEQ ID NO: 2977263 - RNA, 20 nt, Human
cugccugcccaggccccugc

SEQ ID NO: 2977264 - RNA, 11 nt, Human
cugcugaaggc

SEQ ID NO: 2977265 - RNA, 18 nt, Human
cugcugaaacaacaaaua

SEQ ID NO: 2977266 - RNA, 23 nt, Human
cugcugccccugcacagcaggcu

SEQ ID NO: 2977267 - RNA, 22 nt, Human
cugcugccccugcacagcaggc

SEQ ID NO: 2977268 - RNA, 14 nt, Human
cugcugccccugca

SEQ ID NO: 2977269 - RNA, 16 nt, Human
cugcugccccugcaca

SEQ ID NO: 2977270 - RNA, 19 nt, Human
cugcucuccgaccagacac

SEQ ID NO: 2977271 - RNA, 10 nt, Human
cugcucccac

SEQ ID NO: 2977272 - RNA, 15 nt, Human
cugcucccaccuggc

SEQ ID NO: 2977273 - RNA, 19 nt, Human
cugcuccagcuguucagcu

SEQ ID NO: 2977274 - RNA, 20 nt, Human
cugcuccagcuguucagcug

SEQ ID NO: 2977275 - RNA, 19 nt, Human
cugcgaccacaagaaggau

SEQ ID NO: 2977276 - RNA, 23 nt, Human
cugcugguucaggguuggccccu

SEQ ID NO: 2977277 - RNA, 15 nt, Human
cugcugguucagggu

SEQ ID NO: 2977278 - RNA, 13 nt, Human
cugcugguucagg

SEQ ID NO: 2977279 - RNA, 19 nt, Human
cugcuuccagugaggcucu

SEQ ID NO: 2977280 - RNA, 20 nt, Human
cugcuuccagugaggcucug

SEQ ID NO: 2977281 - RNA, 21 nt, Human
cugcuuccagugaggcucugc

SEQ ID NO: 2977282 - RNA, 23 nt, Human
cugcuuccagugaggcucugccc

SEQ ID NO: 2977283 - RNA, 16 nt, Human
cugcuuccagugaggc

SEQ ID NO: 2977284 - RNA, 18 nt, Human
cugcuuccagugaggcuc

SEQ ID NO: 2977285 - RNA, 15 nt, Human
cugcuuccagugagg

SEQ ID NO: 2977286 - RNA, 14 nt, Human
cugcugcuggcugg

SEQ ID NO: 2977287 - RNA, 15 nt, Human
cugcugcuggcuggu

SEQ ID NO: 2977288 - RNA, 18 nt, Human
cugcugcuccuaggaccc

SEQ ID NO: 2977289 - RNA, 15 nt, Human
cugcugcuccuagga

SEQ ID NO: 2977290 - RNA, 16 nt, Human
cuuagugauguaauua

SEQ ID NO: 2977291 - RNA, 15 nt, Human
cuuagugauguaauu

SEQ ID NO: 2977292 - RNA, 18 nt, Human
cuuagucacugagacagc

SEQ ID NO: 2977293 - RNA, 19 nt, Human
cuuagucacugagacagcc

SEQ ID NO: 2977294 - RNA, 14 nt, Human
cuuagucacugaga

SEQ ID NO: 2977295 - RNA, 20 nt, Human
cuuagaugcaguucugaaga

SEQ ID NO: 2977296 - RNA, 16 nt, Human
cuguucuggcagaguu

SEQ ID NO: 2977297 - RNA, 13 nt, Human
cuuagauguauau

SEQ ID NO: 2977298 - RNA, 22 nt, Human
cuuagaugcaguucugaagaag

SEQ ID NO: 2977299 - RNA, 16 nt, Human
cuuagucacugagaca

SEQ ID NO: 2977300 - RNA, 15 nt, Human
cuuauacauuugaua

SEQ ID NO: 2977301 - RNA, 19 nt, Human
cuuauaucuauauuuuaca

SEQ ID NO: 2977302 - RNA, 15 nt, Human
cuuauuuccucauuu

SEQ ID NO: 2977303 - RNA, 15 nt, Human
cuuauuucauuucuu

SEQ ID NO: 2977304 - RNA, 14 nt, Human
cuuauuucauuucu

SEQ ID NO: 2977305 - RNA, 18 nt, Human
cuuauuuaaugaaagacu

SEQ ID NO: 2977306 - RNA, 17 nt, Human
cuuauuuaaugaaagac

SEQ ID NO: 2977307 - RNA, 13 nt, Human
cuucaaggauccu

SEQ ID NO: 2977308 - RNA, 15 nt, Human
cuucaaggauccuga

SEQ ID NO: 2977309 - RNA, 16 nt, Human
cuucaaggauccugag

SEQ ID NO: 2977310 - RNA, 10 nt, Human
cuucaaggau

SEQ ID NO: 2977311 - RNA, 23 nt, Human
cuucacagaugggugcuuggagg

SEQ ID NO: 2977312 - RNA, 16 nt, Human
cuucaguaagccguga

SEQ ID NO: 2977313 - RNA, 23 nt, Human
cuucaguaagccgugauuuucau

SEQ ID NO: 2977314 - RNA, 16 nt, Human
cuucaguggcagcugc

SEQ ID NO: 2977315 - RNA, 15 nt, Human
cuucaguggcagcug

SEQ ID NO: 2977316 - RNA, 14 nt, Human
cuucaguggcagcu

SEQ ID NO: 2977317 - RNA, 13 nt, Human
cuucaguggcagc

SEQ ID NO: 2977318 - RNA, 18 nt, Human
cuucagugccuuauggaa

SEQ ID NO: 2977319 - RNA, 22 nt, Human
cuucagugccuuauggaacacu

SEQ ID NO: 2977320 - RNA, 15 nt, Human
cuucaguaagccgug

SEQ ID NO: 2977321 - RNA, 20 nt, Human
cuucauucaacccaccugcg

SEQ ID NO: 2977322 - RNA, 17 nt, Human
cuucaguggcagcugcu

SEQ ID NO: 2977323 - RNA, 19 nt, Human
cuuccacaagagcccaggc

SEQ ID NO: 2977324 - RNA, 21 nt, Human
cuuccacaagagcccaggccu

SEQ ID NO: 2977325 - RNA, 17 nt, Human
cuuccacaagagcccag

SEQ ID NO: 2977326 - RNA, 16 nt, Human
cuuccacaagagccca

SEQ ID NO: 2977327 - RNA, 12 nt, Human
cuuccaggcugg

SEQ ID NO: 2977328 - RNA, 14 nt, Human
cuuccaggcuggga

SEQ ID NO: 2977329 - RNA, 15 nt, Human
cuuccaggcugggag

SEQ ID NO: 2977330 - RNA, 16 nt, Human
cuuccaggcugggaga

SEQ ID NO: 2977331 - RNA, 19 nt, Human
cuuccaggcugggagagcc

SEQ ID NO: 2977332 - RNA, 14 nt, Human
cuuccagggguggg

SEQ ID NO: 2977333 - RNA, 15 nt, Human
cuuccagggguggga

SEQ ID NO: 2977334 - RNA, 17 nt, Human
cuuccaggggugggaca

SEQ ID NO: 2977335 - RNA, 21 nt, Human
cuuccaggggugggacacccu

SEQ ID NO: 2977336 - RNA, 17 nt, Human
cuuccccuggcacuggc

SEQ ID NO: 2977337 - RNA, 17 nt, Human
cuucccuacaguugaaa

SEQ ID NO: 2977338 - RNA, 21 nt, Human
cuucugucuucacaacagauu

SEQ ID NO: 2977339 - RNA, 22 nt, Human
cuucugucuucacaacagauua

SEQ ID NO: 2977340 - RNA, 18 nt, Human
cuucugucuucacaacag

SEQ ID NO: 2977341 - RNA, 21 nt, Human
cuucuguccuacucuguguca

SEQ ID NO: 2977342 - RNA, 19 nt, Human
cuucuguccuacucugugu

SEQ ID NO: 2977343 - RNA, 18 nt, Human
cuucuguccuacucugug

SEQ ID NO: 2977344 - RNA, 17 nt, Human
cuucuguccuacucugu

SEQ ID NO: 2977345 - RNA, 16 nt, Human
cuucuguccuacucug

SEQ ID NO: 2977346 - RNA, 20 nt, Human
cuucuguacgucugacaggc

SEQ ID NO: 2977347 - RNA, 18 nt, Human
cuucuguacgucugacag

SEQ ID NO: 2977348 - RNA, 15 nt, Human
cuucuguacgucuga

SEQ ID NO: 2977349 - RNA, 14 nt, Human
cuucuguacgucug

SEQ ID NO: 2977350 - RNA, 21 nt, Human
cuucuguacgucugacaggca

SEQ ID NO: 2977351 - RNA, 13 nt, Human
cuucugcuucagc

SEQ ID NO: 2977352 - RNA, 20 nt, Human
cuucugccauuucugagauc

SEQ ID NO: 2977353 - RNA, 13 nt, Human
cuucucugaagga

SEQ ID NO: 2977354 - RNA, 13 nt, Human
cuucucuccagcc

SEQ ID NO: 2977355 - RNA, 15 nt, Human
cuucucuccagcccc

SEQ ID NO: 2977356 - RNA, 17 nt, Human
cuucucuccagccccug

SEQ ID NO: 2977357 - RNA, 19 nt, Human
cuucucuccagccccugga

SEQ ID NO: 2977358 - RNA, 12 nt, Human
cuucucuccagc

SEQ ID NO: 2977359 - RNA, 11 nt, Human
cuucuccacuu

SEQ ID NO: 2977360 - RNA, 20 nt, Human
cuucuccacuuucuagccag

SEQ ID NO: 2977361 - RNA, 13 nt, Human
cuucuccaggcug

SEQ ID NO: 2977362 - RNA, 12 nt, Human
cuucuccaggcu

SEQ ID NO: 2977363 - RNA, 14 nt, Human
cuucuguggguuuc

SEQ ID NO: 2977364 - RNA, 21 nt, Human
cuucuguggguuucuaaagcu

SEQ ID NO: 2977365 - RNA, 13 nt, Human
cuucuguggguuu

SEQ ID NO: 2977366 - RNA, 14 nt, Human
cuugaaaacacugu

SEQ ID NO: 2977367 - RNA, 23 nt, Human
cuugaaaacacuguucucugccc

SEQ ID NO: 2977368 - RNA, 20 nt, Human
cuugaggguugggcuggugu

SEQ ID NO: 2977369 - RNA, 19 nt, Human
cuugaggguugggcuggug

SEQ ID NO: 2977370 - RNA, 21 nt, Human
cuugaguugauucagcucugc

SEQ ID NO: 2977371 - RNA, 21 nt, Human
cuugaggguugggcugguguc

SEQ ID NO: 2977372 - RNA, 13 nt, Human
cuugagcucagga

SEQ ID NO: 2977373 - RNA, 18 nt, Human
cuugagccuugaacuuug

SEQ ID NO: 2977374 - RNA, 17 nt, Human
cuugagccuugaacuuu

SEQ ID NO: 2977375 - RNA, 15 nt, Human
cuugagccuugaacu

SEQ ID NO: 2977376 - RNA, 16 nt, Human
cuugagccugggaggu

SEQ ID NO: 2977377 - RNA, 17 nt, Human
cuugaccgugaggccag

SEQ ID NO: 2977378 - RNA, 22 nt, Human
cuugaccauucuccaccugcca

SEQ ID NO: 2977379 - RNA, 23 nt, Human
cuugaccauucuccaccugccag

SEQ ID NO: 2977380 - RNA, 18 nt, Human
cuugaccgugaggccaga

SEQ ID NO: 2977381 - RNA, 20 nt, Human
cuugaccgugaggccagaga

SEQ ID NO: 2977382 - RNA, 21 nt, Human
cuugaccgugaggccagagac

SEQ ID NO: 2977383 - RNA, 13 nt, Human
cuugaccucaggu

SEQ ID NO: 2977384 - RNA, 13 nt, Human
cuugaacuccugg

SEQ ID NO: 2977385 - RNA, 21 nt, Human
cuugaacuuugaccucugcag

SEQ ID NO: 2977386 - RNA, 17 nt, Human
cuugaacuuugaccucu

SEQ ID NO: 2977387 - RNA, 14 nt, Human
cuuugcaggaaauc

SEQ ID NO: 2977388 - RNA, 20 nt, Human
cuuugcagacaggcaagcac

SEQ ID NO: 2977389 - RNA, 13 nt, Human
cuuugaccucugc

SEQ ID NO: 2977390 - RNA, 16 nt, Human
cuuugcagacaggcaa

SEQ ID NO: 2977391 - RNA, 24 nt, Human
cuuugaccucugcagcaauaaagc

SEQ ID NO: 2977392 - RNA, 20 nt, Human
cuuugaccucugcagcaaua

SEQ ID NO: 2977393 - RNA, 18 nt, Human
cuuugaccucugcagcaa

SEQ ID NO: 2977394 - RNA, 17 nt, Human
cuuugaccucugcagca

SEQ ID NO: 2977395 - RNA, 15 nt, Human
cuuugaccucugcag

SEQ ID NO: 2977396 - RNA, 14 nt, Human
cuuugaccucugca

SEQ ID NO: 2977397 - RNA, 15 nt, Human
cuuugugaggaagcc

SEQ ID NO: 2977398 - RNA, 15 nt, Human
cuuuguccccaccgc

SEQ ID NO: 2977399 - RNA, 19 nt, Human
cuuuggcuauuagagauca

SEQ ID NO: 2977400 - RNA, 15 nt, Human
cuuuggcccagggug

SEQ ID NO: 2977401 - RNA, 14 nt, Human
cuuuggcccagggu

SEQ ID NO: 2977402 - RNA, 16 nt, Human
cuuuggcccagggugg

SEQ ID NO: 2977403 - RNA, 13 nt, Human
cuuuggcccaggg

SEQ ID NO: 2977404 - RNA, 14 nt, Human
cuuuguccccaccg

SEQ ID NO: 2977405 - RNA, 13 nt, Human
cuuuccugaggcu

SEQ ID NO: 2977406 - RNA, 15 nt, Human
cuuuccugaggcugg

SEQ ID NO: 2977407 - RNA, 20 nt, Human
cuuucuggcuaugcauuuga

SEQ ID NO: 2977408 - RNA, 19 nt, Human
cuuucuggcuaugcauuug

SEQ ID NO: 2977409 - RNA, 18 nt, Human
cuuucuggcuaugcauuu

SEQ ID NO: 2977410 - RNA, 17 nt, Human
cuuucuggcuaugcauu

SEQ ID NO: 2977411 - RNA, 16 nt, Human
cuuucccucccuuccu

SEQ ID NO: 2977412 - RNA, 14 nt, Human
cuuucccucccuuc

SEQ ID NO: 2977413 - RNA, 13 nt, Human
cuuucccucccuu

SEQ ID NO: 2977414 - RNA, 11 nt, Human
cuuucccuccc

SEQ ID NO: 2977415 - RNA, 12 nt, Human
cuuuccugaggc

SEQ ID NO: 2977416 - RNA, 16 nt, Human
cuuuccucuuuggucu

SEQ ID NO: 2977417 - RNA, 15 nt, Human
cuuuccaucuacccu

SEQ ID NO: 2977418 - RNA, 15 nt, Human
cuuuccaggaaggcu

SEQ ID NO: 2977419 - RNA, 15 nt, Human
cuuuaugcacaaaau

SEQ ID NO: 2977420 - RNA, 19 nt, Human
cuuuauaauucuacuuuga

SEQ ID NO: 2977421 - RNA, 13 nt, Human
cuuuauaauucua

SEQ ID NO: 2977422 - RNA, 15 nt, Human
cuuuagcgcccaguu

SEQ ID NO: 2977423 - RNA, 14 nt, Human
cuuuagcgcccagu

SEQ ID NO: 2977424 - RNA, 22 nt, Human
cuuuaccuuuuuuauacauaaa

SEQ ID NO: 2977425 - RNA, 13 nt, Human
cuuuacuauggcc

SEQ ID NO: 2977426 - RNA, 22 nt, Human
cuuuaaaagcauuuuuuaaccu

SEQ ID NO: 2977427 - RNA, 15 nt, Human
cuuuaaaagcauuuu

SEQ ID NO: 2977428 - RNA, 23 nt, Human
cuuggggggcugaggugggagga

SEQ ID NO: 2977429 - RNA, 19 nt, Human
cuugaguuuaaauuguaau

SEQ ID NO: 2977430 - RNA, 22 nt, Human
cuuggggggcugaggugggagg

SEQ ID NO: 2977431 - RNA, 16 nt, Human
cuuguaaauagcucag

SEQ ID NO: 2977432 - RNA, 21 nt, Human
cuuguacauaaugcgugcaua

SEQ ID NO: 2977433 - RNA, 19 nt, Human
cuuguacauaaugcgugca

SEQ ID NO: 2977434 - RNA, 22 nt, Human
cuuguacauaaugcgugcauac

SEQ ID NO: 2977435 - RNA, 12 nt, Human
cuuguacauaau

SEQ ID NO: 2977436 - RNA, 15 nt, Human
cuuguacauaaugcg

SEQ ID NO: 2977437 - RNA, 18 nt, Human
cuuguaaauagcucaggu

SEQ ID NO: 2977438 - RNA, 17 nt, Human
cuuguaaauagcucagg

SEQ ID NO: 2977439 - RNA, 23 nt, Human
cuugucaauaaaauccauacauu

SEQ ID NO: 2977440 - RNA, 23 nt, Human
cuugugguuauaacuuaaugaaa

SEQ ID NO: 2977441 - RNA, 17 nt, Human
gaaaaggccuucuuccc

SEQ ID NO: 2977442 - RNA, 15 nt, Human
gaaaaguugaauuuu

SEQ ID NO: 2977443 - RNA, 14 nt, Human
gaaaaguugaauuu

SEQ ID NO: 2977444 - RNA, 20 nt, Human
gaaaacguggcugcuucaag

SEQ ID NO: 2977445 - RNA, 22 nt, Human
gaaaacguggcugcuucaagga

SEQ ID NO: 2977446 - RNA, 19 nt, Human
gaaaacguggcugcuucaa

SEQ ID NO: 2977447 - RNA, 19 nt, Human
gaaaagcugcugacagugu

SEQ ID NO: 2977448 - RNA, 22 nt, Human
gaaaacacuguucucugcccuc

SEQ ID NO: 2977449 - RNA, 24 nt, Human
gaaaacacuguucucugcccucca

SEQ ID NO: 2977450 - RNA, 20 nt, Human
gaaaaucagccugcuccagc

SEQ ID NO: 2977451 - RNA, 22 nt, Human
gaaaaucagccugcuccagcug

SEQ ID NO: 2977452 - RNA, 22 nt, Human
gaaaaucuacacuccagugaga

SEQ ID NO: 2977453 - RNA, 18 nt, Human
gaaaaucuuauaauuuaa

SEQ ID NO: 2977454 - RNA, 18 nt, Human
gaaaauauuuguaucaca

SEQ ID NO: 2977455 - RNA, 14 nt, Human
gaaaaguuuauaaa

SEQ ID NO: 2977456 - RNA, 13 nt, Human
gaaaaguuuauaa

SEQ ID NO: 2977457 - RNA, 21 nt, Human
cuuuuuggguuuauuuggaaa

SEQ ID NO: 2977458 - RNA, 20 nt, Human
cuuuuuuggcugcugaaggc

SEQ ID NO: 2977459 - RNA, 22 nt, Human
cuuuuuuggcugcugaaggcuc

SEQ ID NO: 2977460 - RNA, 17 nt, Human
cuuuuuuggcugcugaa

SEQ ID NO: 2977461 - RNA, 19 nt, Human
gaaaacacauuuuucuuag

SEQ ID NO: 2977462 - RNA, 18 nt, Human
gaaaacacauuuuucuua

SEQ ID NO: 2977463 - RNA, 14 nt, Human
gaaaacacauuuuu

SEQ ID NO: 2977464 - RNA, 12 nt, Human
gaaaaaggagga

SEQ ID NO: 2977465 - RNA, 15 nt, Human
gaaaaaggaggaaga

SEQ ID NO: 2977466 - RNA, 16 nt, Human
cuuuuuuggcugcuga

SEQ ID NO: 2977467 - RNA, 18 nt, Human
cuuuguuaguuucuccaa

SEQ ID NO: 2977468 - RNA, 12 nt, Human
cuuuuguucuug

SEQ ID NO: 2977469 - RNA, 11 nt, Human
cuuuuguucuu

SEQ ID NO: 2977470 - RNA, 16 nt, Human
gaaacacaacuauauu

SEQ ID NO: 2977471 - RNA, 11 nt, Human
gaaacauuugg

SEQ ID NO: 2977472 - RNA, 21 nt, Human
gaaacaagucagucauucaga

SEQ ID NO: 2977473 - RNA, 15 nt, Human
gaaacccagcucugg

SEQ ID NO: 2977474 - RNA, 16 nt, Human
gaaacccagcucuggu

SEQ ID NO: 2977475 - RNA, 18 nt, Human
gaaacccagcucuggucc

SEQ ID NO: 2977476 - RNA, 19 nt, Human
gaaacccagcucuggucca

SEQ ID NO: 2977477 - RNA, 13 nt, Human
gaaacccagcucu

SEQ ID NO: 2977478 - RNA, 14 nt, Human
gaaacccagcucug

SEQ ID NO: 2977479 - RNA, 23 nt, Human
gaaacucguuaauuuguaguguu

SEQ ID NO: 2977480 - RNA, 14 nt, Human
gaaacccugucucu

SEQ ID NO: 2977481 - RNA, 23 nt, Human
gaaacccagcucugguccauaga

SEQ ID NO: 2977482 - RNA, 22 nt, Human
gaaacccgucucuacuaaaaau

SEQ ID NO: 2977483 - RNA, 19 nt, Human
gaaagacuuuuccaacccu

SEQ ID NO: 2977484 - RNA, 17 nt, Human
gaaagagaacuuccaga

SEQ ID NO: 2977485 - RNA, 17 nt, Human
gaaagacuguacaaagu

SEQ ID NO: 2977486 - RNA, 22 nt, Human
gaaagacuucucuacccaucuu

SEQ ID NO: 2977487 - RNA, 20 nt, Human
gaaagaggcagcuugaaacu

SEQ ID NO: 2977488 - RNA, 21 nt, Human
gaaagaggaaugaaguacuca

SEQ ID NO: 2977489 - RNA, 15 nt, Human
gaaagaguaggaaga

SEQ ID NO: 2977490 - RNA, 16 nt, Human
gaaagaguaggaagac

SEQ ID NO: 2977491 - RNA, 17 nt, Human
gaaagcagaacagugau

SEQ ID NO: 2977492 - RNA, 14 nt, Human
gaaagcagaacagu

SEQ ID NO: 2977493 - RNA, 22 nt, Human
gaaagcagaacagugauuacca

SEQ ID NO: 2977494 - RNA, 14 nt, Human
gaaagcagggacuu

SEQ ID NO: 2977495 - RNA, 21 nt, Human
gaaagcccugagcuuucugcu

SEQ ID NO: 2977496 - RNA, 22 nt, Human
gaaagcccugagcuuucugcua

SEQ ID NO: 2977497 - RNA, 17 nt, Human
gaaagcccugagcuuuc

SEQ ID NO: 2977498 - RNA, 13 nt, Human
cuaccaauauuua

SEQ ID NO: 2977499 - RNA, 15 nt, Human
cuaccaauauuuaau

SEQ ID NO: 2977500 - RNA, 21 nt, Human
cuaccaauauuuaaucuuuua

SEQ ID NO: 2977501 - RNA, 18 nt, Human
cuaccauccccuguagag

SEQ ID NO: 2977502 - RNA, 17 nt, Human
cuacauuagguugugaa

SEQ ID NO: 2977503 - RNA, 18 nt, Human
cuacauuagguugugaau

SEQ ID NO: 2977504 - RNA, 22 nt, Human
cuacauuauaaaugucucuuua

SEQ ID NO: 2977505 - RNA, 17 nt, Human
cuacauugacagauuga

SEQ ID NO: 2977506 - RNA, 14 nt, Human
cuacauucuguuaa

SEQ ID NO: 2977507 - RNA, 13 nt, Human
cuacauucuguua

SEQ ID NO: 2977508 - RNA, 17 nt, Human
cuacccagcgagcccug

SEQ ID NO: 2977509 - RNA, 15 nt, Human
cuacccagcgagccc

SEQ ID NO: 2977510 - RNA, 12 nt, Human
cuacccaggugc

SEQ ID NO: 2977511 - RNA, 13 nt, Human
cuacccaggugcu

SEQ ID NO: 2977512 - RNA, 18 nt, Human
cuacccagcgagcccugg

SEQ ID NO: 2977513 - RNA, 17 nt, Human
cuacccucuuagaaaaa

SEQ ID NO: 2977514 - RNA, 13 nt, Human
cuacacugugcug

SEQ ID NO: 2977515 - RNA, 14 nt, Human
cuacacugugcuga

SEQ ID NO: 2977516 - RNA, 17 nt, Human
cuacacugugcugaguc

SEQ ID NO: 2977517 - RNA, 17 nt, Human
cuacagaggccaugggc

SEQ ID NO: 2977518 - RNA, 20 nt, Human
cuacagaggccaugggccuc

SEQ ID NO: 2977519 - RNA, 18 nt, Human
cuacagaggccaugggcc

SEQ ID NO: 2977520 - RNA, 22 nt, Human
cuacagaggccaugggccuccu

SEQ ID NO: 2977521 - RNA, 19 nt, Human
cuacagcuugaccgugagg

SEQ ID NO: 2977522 - RNA, 22 nt, Human
cuacagcuugaccgugaggcca

SEQ ID NO: 2977523 - RNA, 23 nt, Human
cuacagcuugaccgugaggccag

SEQ ID NO: 2977524 - RNA, 16 nt, Human
cuacaggagugagcac

SEQ ID NO: 2977525 - RNA, 15 nt, Human
cuacaggagugagca

SEQ ID NO: 2977526 - RNA, 14 nt, Human
cuacaggagugagc

SEQ ID NO: 2977527 - RNA, 17 nt, Human
cuacaggcacccaccau

SEQ ID NO: 2977528 - RNA, 15 nt, Human
cuacaggcacccacc

SEQ ID NO: 2977529 - RNA, 20 nt, Human
cuacauggaguauaugucaa

SEQ ID NO: 2977530 - RNA, 18 nt, Human
cuacauggaguauauguc

SEQ ID NO: 2977531 - RNA, 13 nt, Human
cuacaguccuccc

SEQ ID NO: 2977532 - RNA, 14 nt, Human
cuacaggugugagu

SEQ ID NO: 2977533 - RNA, 16 nt, Human
cuacaggugugaguca

SEQ ID NO: 2977534 - RNA, 13 nt, Human
cuacaguaauaaa

SEQ ID NO: 2977535 - RNA, 21 nt, Human
cuaauaugaugacuguuuuua

SEQ ID NO: 2977536 - RNA, 19 nt, Human
cuaauaugaugacuguuuu

SEQ ID NO: 2977537 - RNA, 13 nt, Human
cuaaugggacacu

SEQ ID NO: 2977538 - RNA, 12 nt, Human
cuaaugggacac

SEQ ID NO: 2977539 - RNA, 23 nt, Human
cuacacgagauacagaauuuuau

SEQ ID NO: 2977540 - RNA, 14 nt, Human
cuacacuaagagag

SEQ ID NO: 2977541 - RNA, 21 nt, Human
cuacacaggggaaaagaggag

SEQ ID NO: 2977542 - RNA, 21 nt, Human
cuacacacugcauguuuguga

SEQ ID NO: 2977543 - RNA, 14 nt, Human
cuaaguaaaaccac

SEQ ID NO: 2977544 - RNA, 18 nt, Human
cuaaguaaaaccacagca

SEQ ID NO: 2977545 - RNA, 19 nt, Human
cuaaguaaaaccacagcag

SEQ ID NO: 2977546 - RNA, 23 nt, Human
cuaauagacaauuuauuauggca

SEQ ID NO: 2977547 - RNA, 19 nt, Human
cuaauagacaauuuauuau

SEQ ID NO: 2977548 - RNA, 17 nt, Human
cuaauagacaauuuauu

SEQ ID NO: 2977549 - RNA, 21 nt, Human
cuaagcuucacuguaaaauaa

SEQ ID NO: 2977550 - RNA, 22 nt, Human
cuaagcuauucaguaauaacuc

SEQ ID NO: 2977551 - RNA, 20 nt, Human
cuaacagcaacacaaagcuu

SEQ ID NO: 2977552 - RNA, 14 nt, Human
cuaaccacgcugga

SEQ ID NO: 2977553 - RNA, 12 nt, Human
cuaaccacgcug

SEQ ID NO: 2977554 - RNA, 16 nt, Human
cuaaauucaugcugcu

SEQ ID NO: 2977555 - RNA, 19 nt, Human
cuaaauugacacuuaaaaa

SEQ ID NO: 2977556 - RNA, 19 nt, Human
cuaaauucuuucauuuuag

SEQ ID NO: 2977557 - RNA, 15 nt, Human
cuaagagagaaugag

SEQ ID NO: 2977558 - RNA, 14 nt, Human
cuaagagagaauga

SEQ ID NO: 2977559 - RNA, 15 nt, Human
cuaagagggagggag

SEQ ID NO: 2977560 - RNA, 22 nt, Human
cuaagagggagggagggcucca

SEQ ID NO: 2977561 - RNA, 13 nt, Human
cuaagagggaggg

SEQ ID NO: 2977562 - RNA, 23 nt, Human
cuaagagggagggagggcuccag

SEQ ID NO: 2977563 - RNA, 20 nt, Human
cgggaggcagagguugcagu

SEQ ID NO: 2977564 - RNA, 21 nt, Human
cgggaggauguucugggacac

SEQ ID NO: 2977565 - RNA, 23 nt, Human
cgggaggauguucugggacacag

SEQ ID NO: 2977566 - RNA, 21 nt, Human
cuaaaucuccaaaauaaaacu

SEQ ID NO: 2977567 - RNA, 22 nt, Human
cuaaaugaaaaucgugacaaca

SEQ ID NO: 2977568 - RNA, 12 nt, Human
cuauuuauuuau

SEQ ID NO: 2977569 - RNA, 19 nt, Human
cuauuuauuuauuuauuca

SEQ ID NO: 2977570 - RNA, 16 nt, Human
cuauuuauuuacaaau

SEQ ID NO: 2977571 - RNA, 15 nt, Human
cuauuuauuuacaaa

SEQ ID NO: 2977572 - RNA, 14 nt, Human
cucaaauuucuaaa

SEQ ID NO: 2977573 - RNA, 14 nt, Human
cucaacucuccucc

SEQ ID NO: 2977574 - RNA, 17 nt, Human
cucaaauuucuaaaucu

SEQ ID NO: 2977575 - RNA, 15 nt, Human
cucaaauuucuaaau

SEQ ID NO: 2977576 - RNA, 13 nt, Human
cucaaauuucuaa

SEQ ID NO: 2977577 - RNA, 15 nt, Human
cucacagaagaugaa

SEQ ID NO: 2977578 - RNA, 23 nt, Human
cucacacggacacucaaaagcug

SEQ ID NO: 2977579 - RNA, 16 nt, Human
cucaacucuccuccag

SEQ ID NO: 2977580 - RNA, 18 nt, Human
cucaacucuccuccagag

SEQ ID NO: 2977581 - RNA, 18 nt, Human
cuauuguuagucucuuga

SEQ ID NO: 2977582 - RNA, 14 nt, Human
cuauuuauuuacaa

SEQ ID NO: 2977583 - RNA, 16 nt, Human
cuauugcugcuugagg

SEQ ID NO: 2977584 - RNA, 16 nt, Human
cuauucugagaugacu

SEQ ID NO: 2977585 - RNA, 15 nt, Human
cuauucugagaugac

SEQ ID NO: 2977586 - RNA, 18 nt, Human
cuauucugagaugacuau

SEQ ID NO: 2977587 - RNA, 23 nt, Human
cuauucaguaauaacucuacccu

SEQ ID NO: 2977588 - RNA, 23 nt, Human
cuauucagcacaaggaaauaaaa

SEQ ID NO: 2977589 - RNA, 17 nt, Human
cuauucaguaauaacuc

SEQ ID NO: 2977590 - RNA, 13 nt, Human
cuauguaucaaug

SEQ ID NO: 2977591 - RNA, 18 nt, Human
cuauauaauuccuguuuu

SEQ ID NO: 2977592 - RNA, 20 nt, Human
cuauauaauuccuguuuuua

SEQ ID NO: 2977593 - RNA, 19 nt, Human
cuaugaaauauuauguuaa

SEQ ID NO: 2977594 - RNA, 18 nt, Human
cuaugaaauauuauguua

SEQ ID NO: 2977595 - RNA, 21 nt, Human
cuaugcauuugaaaauuuuga

SEQ ID NO: 2977596 - RNA, 15 nt, Human
cuaggaaaauuauuc

SEQ ID NO: 2977597 - RNA, 20 nt, Human
cuaggaacacuccuucacag

SEQ ID NO: 2977598 - RNA, 15 nt, Human
cuaggaagacuuugg

SEQ ID NO: 2977599 - RNA, 17 nt, Human
cuaggaagacuuuggaa

SEQ ID NO: 2977600 - RNA, 12 nt, Human
cuauaauuuaaa

SEQ ID NO: 2977601 - RNA, 21 nt, Human
cuauagccuaggugacagagu

SEQ ID NO: 2977602 - RNA, 20 nt, Human
cuauagccuaggugacagag

SEQ ID NO: 2977603 - RNA, 18 nt, Human
cuauagccuaggugacag

SEQ ID NO: 2977604 - RNA, 19 nt, Human
cuauagccuaggugacaga

SEQ ID NO: 2977605 - RNA, 15 nt, Human
cuagagguucaaaga

SEQ ID NO: 2977606 - RNA, 18 nt, Human
cuagaguuuagcuggaaa

SEQ ID NO: 2977607 - RNA, 19 nt, Human
cuagaguuuagcuggaaaa

SEQ ID NO: 2977608 - RNA, 21 nt, Human
cuagagguucaaagauauuuu

SEQ ID NO: 2977609 - RNA, 18 nt, Human
cuagagguucaaagauau

SEQ ID NO: 2977610 - RNA, 17 nt, Human
cuagagguucaaagaua

SEQ ID NO: 2977611 - RNA, 20 nt, Human
cuacuguccuacccacccuc

SEQ ID NO: 2977612 - RNA, 16 nt, Human
cuacucgaguuacaga

SEQ ID NO: 2977613 - RNA, 19 nt, Human
cuacucgaguuacagacaa

SEQ ID NO: 2977614 - RNA, 15 nt, Human
cuacucgaguuacag

SEQ ID NO: 2977615 - RNA, 12 nt, Human
cuacucuguguc

SEQ ID NO: 2977616 - RNA, 17 nt, Human
cuacucgggaggcugag

SEQ ID NO: 2977617 - RNA, 21 nt, Human
cuacuguaauuugugauacaa

SEQ ID NO: 2977618 - RNA, 19 nt, Human
cuacuguccuacccacccu

SEQ ID NO: 2977619 - RNA, 23 nt, Human
cuacugccauccuggcccagggc

SEQ ID NO: 2977620 - RNA, 22 nt, Human
cuacugccauccuggcccaggg

SEQ ID NO: 2977621 - RNA, 20 nt, Human
cuacugccauccuggcccag

SEQ ID NO: 2977622 - RNA, 19 nt, Human
cuacugccauccuggccca

SEQ ID NO: 2977623 - RNA, 18 nt, Human
cuacugccauccuggccc

SEQ ID NO: 2977624 - RNA, 17 nt, Human
cuacugccauccuggcc

SEQ ID NO: 2977625 - RNA, 16 nt, Human
cuacugccauccuggc

SEQ ID NO: 2977626 - RNA, 15 nt, Human
cuacugccauccugg

SEQ ID NO: 2977627 - RNA, 14 nt, Human
cuacugccauccug

SEQ ID NO: 2977628 - RNA, 19 nt, Human
cuagccugugccucuggga

SEQ ID NO: 2977629 - RNA, 21 nt, Human
cuagccugugccucugggacu

SEQ ID NO: 2977630 - RNA, 22 nt, Human
cuagccugugccucugggacug

SEQ ID NO: 2977631 - RNA, 21 nt, Human
cuagccuuagaagucacacag

SEQ ID NO: 2977632 - RNA, 16 nt, Human
cuagauacuguaucau

SEQ ID NO: 2977633 - RNA, 13 nt, Human
cuagauacuguau

SEQ ID NO: 2977634 - RNA, 24 nt, Human
cuagauacuguaucaugacaaaga

SEQ ID NO: 2977635 - RNA, 23 nt, Human
cuagccuuagaagucacacagua

SEQ ID NO: 2977636 - RNA, 22 nt, Human
cuagccuuagaagucacacagu

SEQ ID NO: 2977637 - RNA, 20 nt, Human
cuaggaaauauuuauuuuaa

SEQ ID NO: 2977638 - RNA, 19 nt, Human
cuaggaaauauuuauuuua

SEQ ID NO: 2977639 - RNA, 15 nt, Human
cuaggaaauauuuau

SEQ ID NO: 2977640 - RNA, 14 nt, Human
cuaggaaauauuua

SEQ ID NO: 2977641 - RNA, 23 nt, Human
cucauuuuuauaaugucccuuca

SEQ ID NO: 2977642 - RNA, 18 nt, Human
cuccaaaauaaaacuuuu

SEQ ID NO: 2977643 - RNA, 17 nt, Human
cuccaagcucccaggca

SEQ ID NO: 2977644 - RNA, 12 nt, Human
cucauuuccaag

SEQ ID NO: 2977645 - RNA, 14 nt, Human
cucauuuccaagca

SEQ ID NO: 2977646 - RNA, 13 nt, Human
cucauuuccaagc

SEQ ID NO: 2977647 - RNA, 17 nt, Human
cucauuuccaagcaagu

SEQ ID NO: 2977648 - RNA, 18 nt, Human
cucauuugucacacacuu

SEQ ID NO: 2977649 - RNA, 21 nt, Human
cucauuugucacacacuuugg

SEQ ID NO: 2977650 - RNA, 17 nt, Human
cucauugaccugaggcc

SEQ ID NO: 2977651 - RNA, 22 nt, Human
cucauucuccuuguguuacuaa

SEQ ID NO: 2977652 - RNA, 18 nt, Human
cucauucuccuuguguua

SEQ ID NO: 2977653 - RNA, 19 nt, Human
cucauugaccugaggcccu

SEQ ID NO: 2977654 - RNA, 21 nt, Human
cucauugaccugaggcccuuc

SEQ ID NO: 2977655 - RNA, 21 nt, Human
cuccagagccccacagcccca

SEQ ID NO: 2977656 - RNA, 18 nt, Human
cuccagagccccacagcc

SEQ ID NO: 2977657 - RNA, 16 nt, Human
cuccagagucagaagu

SEQ ID NO: 2977658 - RNA, 16 nt, Human
cuccagagccccacag

SEQ ID NO: 2977659 - RNA, 13 nt, Human
cuccagccccugg

SEQ ID NO: 2977660 - RNA, 14 nt, Human
cuccagccccugga

SEQ ID NO: 2977661 - RNA, 11 nt, Human
cuccagccccu

SEQ ID NO: 2977662 - RNA, 18 nt, Human
cuccagcucaccagcccc

SEQ ID NO: 2977663 - RNA, 16 nt, Human
cuccagcucaccagcc

SEQ ID NO: 2977664 - RNA, 15 nt, Human
cuccagcucaccagc

SEQ ID NO: 2977665 - RNA, 14 nt, Human
cuccagcucaccag

SEQ ID NO: 2977666 - RNA, 14 nt, Human
cuccccucggagaa

SEQ ID NO: 2977667 - RNA, 14 nt, Human
cuccccugcugggu

SEQ ID NO: 2977668 - RNA, 21 nt, Human
cuccccugcuggguguggcgc

SEQ ID NO: 2977669 - RNA, 23 nt, Human
cuccccugcuggguguggcgcag

SEQ ID NO: 2977670 - RNA, 15 nt, Human
cucccuucauccuuc

SEQ ID NO: 2977671 - RNA, 17 nt, Human
cucccugcugcuccuag

SEQ ID NO: 2977672 - RNA, 16 nt, Human
cucccugcugcuccua

SEQ ID NO: 2977673 - RNA, 14 nt, Human
cucccugcugcucc

SEQ ID NO: 2977674 - RNA, 19 nt, Human
cucccgaauagcugggacu

SEQ ID NO: 2977675 - RNA, 23 nt, Human
cucccgaauagcugggacuacag

SEQ ID NO: 2977676 - RNA, 20 nt, Human
cucccgaauagcugggacua

SEQ ID NO: 2977677 - RNA, 14 nt, Human
cuccagcugcugag

SEQ ID NO: 2977678 - RNA, 20 nt, Human
cuccagcugcugagauccug

SEQ ID NO: 2977679 - RNA, 23 nt, Human
cuccagcugcugagauccuggac

SEQ ID NO: 2977680 - RNA, 21 nt, Human
cuccagcugcugagauccugg

SEQ ID NO: 2977681 - RNA, 23 nt, Human
cucccaaagugcugggauuacag

SEQ ID NO: 2977682 - RNA, 16 nt, Human
cucccaaagugcuggg

SEQ ID NO: 2977683 - RNA, 14 nt, Human
cucccaacucaccc

SEQ ID NO: 2977684 - RNA, 15 nt, Human
cucccaacucacccc

SEQ ID NO: 2977685 - RNA, 15 nt, Human
cucccacaaaggaga

SEQ ID NO: 2977686 - RNA, 16 nt, Human
cucccaucacuucccu

SEQ ID NO: 2977687 - RNA, 14 nt, Human
cucccaucacccgc

SEQ ID NO: 2977688 - RNA, 24 nt, Human
cucccaugagggagaugccaugag

SEQ ID NO: 2977689 - RNA, 21 nt, Human
cucagaugcacaugagcuggc

SEQ ID NO: 2977690 - RNA, 16 nt, Human
cucagaucuucugugg

SEQ ID NO: 2977691 - RNA, 19 nt, Human
cucacuguugcccaggcug

SEQ ID NO: 2977692 - RNA, 18 nt, Human
cucacuguugcccaggcu

SEQ ID NO: 2977693 - RNA, 17 nt, Human
cucacuguugcccaggc

SEQ ID NO: 2977694 - RNA, 16 nt, Human
cucacuguugcccagg

SEQ ID NO: 2977695 - RNA, 23 nt, Human
cucagagagggugggagugggcc

SEQ ID NO: 2977696 - RNA, 19 nt, Human
cucagagagggugggagug

SEQ ID NO: 2977697 - RNA, 18 nt, Human
cucagagagggugggagu

SEQ ID NO: 2977698 - RNA, 15 nt, Human
cucacuguugcccag

SEQ ID NO: 2977699 - RNA, 14 nt, Human
cucacuguugccca

SEQ ID NO: 2977700 - RNA, 18 nt, Human
cucacagcagugagacug

SEQ ID NO: 2977701 - RNA, 14 nt, Human
cucacugcagccuc

SEQ ID NO: 2977702 - RNA, 16 nt, Human
cucacugcagccucaa

SEQ ID NO: 2977703 - RNA, 15 nt, Human
cucacugcagccuca

SEQ ID NO: 2977704 - RNA, 14 nt, Human
cucacagcagugag

SEQ ID NO: 2977705 - RNA, 21 nt, Human
cucagcggggacagcuccuuc

SEQ ID NO: 2977706 - RNA, 20 nt, Human
cucagcggggacagcuccuu

SEQ ID NO: 2977707 - RNA, 19 nt, Human
cucagcggggacagcuccu

SEQ ID NO: 2977708 - RNA, 18 nt, Human
cucagcggggacagcucc

SEQ ID NO: 2977709 - RNA, 16 nt, Human
cucagcggggacagcu

SEQ ID NO: 2977710 - RNA, 15 nt, Human
cucagcggggacagc

SEQ ID NO: 2977711 - RNA, 14 nt, Human
cucagcggggacag

SEQ ID NO: 2977712 - RNA, 23 nt, Human
cucagcggggacagcuccuucug

SEQ ID NO: 2977713 - RNA, 13 nt, Human
cucagcggggaca

SEQ ID NO: 2977714 - RNA, 19 nt, Human
cucagcaaaagaugcuucu

SEQ ID NO: 2977715 - RNA, 20 nt, Human
cucagcaaaagaugcuucuc

SEQ ID NO: 2977716 - RNA, 16 nt, Human
cucagcaggggagggu

SEQ ID NO: 2977717 - RNA, 22 nt, Human
cucagcauccuggcacccggcc

SEQ ID NO: 2977718 - RNA, 21 nt, Human
cucagcauccuggcacccggc

SEQ ID NO: 2977719 - RNA, 13 nt, Human
cucagcauccugg

SEQ ID NO: 2977720 - RNA, 19 nt, Human
cucagggccuggcucaggu

SEQ ID NO: 2977721 - RNA, 20 nt, Human
cucagggccuggcucaggug

SEQ ID NO: 2977722 - RNA, 18 nt, Human
cucagggccuggcucagg

SEQ ID NO: 2977723 - RNA, 18 nt, Human
cucaggcaggugggaugg

SEQ ID NO: 2977724 - RNA, 15 nt, Human
cucaggcagguggga

SEQ ID NO: 2977725 - RNA, 23 nt, Human
cucaggugauccacccaccucag

SEQ ID NO: 2977726 - RNA, 22 nt, Human
cucaggugauccacccaccuca

SEQ ID NO: 2977727 - RNA, 19 nt, Human
cucagguggggucacucug

SEQ ID NO: 2977728 - RNA, 20 nt, Human
cucagguggggucacucugg

SEQ ID NO: 2977729 - RNA, 21 nt, Human
cucagguggggucacucuggc

SEQ ID NO: 2977730 - RNA, 14 nt, Human
cucagggccugguc

SEQ ID NO: 2977731 - RNA, 20 nt, Human
cucagggucccugguggcag

SEQ ID NO: 2977732 - RNA, 21 nt, Human
cucagggucccugguggcagc

SEQ ID NO: 2977733 - RNA, 22 nt, Human
cucagggucccugguggcagcu

SEQ ID NO: 2977734 - RNA, 24 nt, Human
cucagggucccugguggcagcuca

SEQ ID NO: 2977735 - RNA, 18 nt, Human
cucagggucccugguggc

SEQ ID NO: 2977736 - RNA, 22 nt, Human
cucaggaaaucaaauaugcaaa

SEQ ID NO: 2977737 - RNA, 22 nt, Human
ccugccuguugggccaggagcc

SEQ ID NO: 2977738 - RNA, 17 nt, Human
ccugccccugagcccau

SEQ ID NO: 2977739 - RNA, 16 nt, Human
ccugcccggcugcgga

SEQ ID NO: 2977740 - RNA, 14 nt, Human
ccugcccggcugcg

SEQ ID NO: 2977741 - RNA, 12 nt, Human
ccugccaggcau

SEQ ID NO: 2977742 - RNA, 22 nt, Human
ccugccagggacagagggggug

SEQ ID NO: 2977743 - RNA, 15 nt, Human
ccugcccugugggcc

SEQ ID NO: 2977744 - RNA, 19 nt, Human
ccugcccuuaccugccagg

SEQ ID NO: 2977745 - RNA, 21 nt, Human
ccugcccuuaccugccaggaa

SEQ ID NO: 2977746 - RNA, 22 nt, Human
ccugcccuuaccugccaggaag

SEQ ID NO: 2977747 - RNA, 14 nt, Human
ccugccuguugggc

SEQ ID NO: 2977748 - RNA, 11 nt, Human
ccugccucagc

SEQ ID NO: 2977749 - RNA, 12 nt, Human
ccugccucagcc

SEQ ID NO: 2977750 - RNA, 14 nt, Human
ccugccucagccuc

SEQ ID NO: 2977751 - RNA, 13 nt, Human
ccugccucagccu

SEQ ID NO: 2977752 - RNA, 12 nt, Human
ccugcccugugg

SEQ ID NO: 2977753 - RNA, 14 nt, Human
ccugcccugugggc

SEQ ID NO: 2977754 - RNA, 11 nt, Human
ccugcccugug

SEQ ID NO: 2977755 - RNA, 15 nt, Human
ccugagcugggauga

SEQ ID NO: 2977756 - RNA, 22 nt, Human
ccugaaggccccgcccaggcuu

SEQ ID NO: 2977757 - RNA, 20 nt, Human
ccugaaggccccgcccaggc

SEQ ID NO: 2977758 - RNA, 21 nt, Human
ccugaaggccccgcccaggcu

SEQ ID NO: 2977759 - RNA, 18 nt, Human
ccugaaggccccgcccag

SEQ ID NO: 2977760 - RNA, 19 nt, Human
ccugaaggccccgcccagg

SEQ ID NO: 2977761 - RNA, 14 nt, Human
ccugaaggccccgc

SEQ ID NO: 2977762 - RNA, 21 nt, Human
ccugaagacucauucuucugu

SEQ ID NO: 2977763 - RNA, 18 nt, Human
ccugaaagcccugagcuu

SEQ ID NO: 2977764 - RNA, 13 nt, Human
ccugaaagcccug

SEQ ID NO: 2977765 - RNA, 14 nt, Human
ccugaaagcccuga

SEQ ID NO: 2977766 - RNA, 13 nt, Human
ccugccacccugg

SEQ ID NO: 2977767 - RNA, 12 nt, Human
ccugccacccug

SEQ ID NO: 2977768 - RNA, 14 nt, Human
ccugccacccuggg

SEQ ID NO: 2977769 - RNA, 22 nt, Human
ccugccacccuggggagaaagu

SEQ ID NO: 2977770 - RNA, 16 nt, Human
ccugccacccugggga

SEQ ID NO: 2977771 - RNA, 19 nt, Human
ccugccaauggacuaacuu

SEQ ID NO: 2977772 - RNA, 21 nt, Human
ccugcacagcaggcugccagu

SEQ ID NO: 2977773 - RNA, 20 nt, Human
ccugcacagcaggcugccag

SEQ ID NO: 2977774 - RNA, 19 nt, Human
ccugcacagcaggcugcca

SEQ ID NO: 2977775 - RNA, 17 nt, Human
ccugcacagcaggcugc

SEQ ID NO: 2977776 - RNA, 14 nt, Human
ccugcacagcaggc

SEQ ID NO: 2977777 - RNA, 23 nt, Human
ccugcacagcaggcugccagugc

SEQ ID NO: 2977778 - RNA, 15 nt, Human
ccugaggcccagagg

SEQ ID NO: 2977779 - RNA, 16 nt, Human
ccugaggcccagaggg

SEQ ID NO: 2977780 - RNA, 17 nt, Human
ccugaggcccagagggc

SEQ ID NO: 2977781 - RNA, 18 nt, Human
ccugaggcccagagggcc

SEQ ID NO: 2977782 - RNA, 12 nt, Human
ccugagcuggga

SEQ ID NO: 2977783 - RNA, 14 nt, Human
ccugaggcuccacu

SEQ ID NO: 2977784 - RNA, 13 nt, Human
ccugaggcuccac

SEQ ID NO: 2977785 - RNA, 13 nt, Human
ccugaggcugggc

SEQ ID NO: 2977786 - RNA, 14 nt, Human
ccugaggcugggcu

SEQ ID NO: 2977787 - RNA, 15 nt, Human
ccugaggcugggcuc

SEQ ID NO: 2977788 - RNA, 15 nt, Human
ccugagccagauuuc

SEQ ID NO: 2977789 - RNA, 12 nt, Human
ccugagccagau

SEQ ID NO: 2977790 - RNA, 16 nt, Human
ccugagccagauuuca

SEQ ID NO: 2977791 - RNA, 18 nt, Human
ccugagccagauuucacu

SEQ ID NO: 2977792 - RNA, 19 nt, Human
ccugaagucacacagugag

SEQ ID NO: 2977793 - RNA, 20 nt, Human
ccugaagucacacagugagu

SEQ ID NO: 2977794 - RNA, 22 nt, Human
ccugaagucuuuguacagacaa

SEQ ID NO: 2977795 - RNA, 18 nt, Human
ccugguggcagcugcggu

SEQ ID NO: 2977796 - RNA, 17 nt, Human
ccugguggcagcugcgg

SEQ ID NO: 2977797 - RNA, 16 nt, Human
ccugguggcagcugcg

SEQ ID NO: 2977798 - RNA, 15 nt, Human
ccugguggcagcugc

SEQ ID NO: 2977799 - RNA, 19 nt, Human
ccugguggcagcucaccuc

SEQ ID NO: 2977800 - RNA, 21 nt, Human
ccugguggcagcucaccucuc

SEQ ID NO: 2977801 - RNA, 22 nt, Human
ccugguggcagcucaccucucc

SEQ ID NO: 2977802 - RNA, 14 nt, Human
ccugguggcagcug

SEQ ID NO: 2977803 - RNA, 13 nt, Human
ccugucccccuga

SEQ ID NO: 2977804 - RNA, 14 nt, Human
ccugucccccugac

SEQ ID NO: 2977805 - RNA, 15 nt, Human
ccugucccccugaca

SEQ ID NO: 2977806 - RNA, 12 nt, Human
ccugucccccug

SEQ ID NO: 2977807 - RNA, 13 nt, Human
ccuguagcccuaa

SEQ ID NO: 2977808 - RNA, 15 nt, Human
ccuguagagugggag

SEQ ID NO: 2977809 - RNA, 16 nt, Human
ccuguagagugggagc

SEQ ID NO: 2977810 - RNA, 14 nt, Human
ccugguggcagugg

SEQ ID NO: 2977811 - RNA, 13 nt, Human
ccugguggcagug

SEQ ID NO: 2977812 - RNA, 10 nt, Human
ccuguaccuc

SEQ ID NO: 2977813 - RNA, 20 nt, Human
ccugggggcugggcagagga

SEQ ID NO: 2977814 - RNA, 21 nt, Human
ccugggggcugggcagaggaa

SEQ ID NO: 2977815 - RNA, 19 nt, Human
ccugggggcugggcagagg

SEQ ID NO: 2977816 - RNA, 14 nt, Human
ccugggcagcugcc

SEQ ID NO: 2977817 - RNA, 13 nt, Human
ccugggcagcugc

SEQ ID NO: 2977818 - RNA, 18 nt, Human
ccugggggcugggcagag

SEQ ID NO: 2977819 - RNA, 15 nt, Human
ccugggcagaaggaa

SEQ ID NO: 2977820 - RNA, 18 nt, Human
ccugggagugagcugguu

SEQ ID NO: 2977821 - RNA, 16 nt, Human
ccugggcagaaggaag

SEQ ID NO: 2977822 - RNA, 22 nt, Human
ccugggaggucaaggcugcagu

SEQ ID NO: 2977823 - RNA, 16 nt, Human
ccugggagugagcugg

SEQ ID NO: 2977824 - RNA, 16 nt, Human
ccuggcccacugcauc

SEQ ID NO: 2977825 - RNA, 12 nt, Human
ccuggcccaggg

SEQ ID NO: 2977826 - RNA, 15 nt, Human
ccuggcccagggcau

SEQ ID NO: 2977827 - RNA, 14 nt, Human
ccuggcccagggca

SEQ ID NO: 2977828 - RNA, 13 nt, Human
ccuggcccagggc

SEQ ID NO: 2977829 - RNA, 21 nt, Human
ccuggcccagggcaucuggga

SEQ ID NO: 2977830 - RNA, 16 nt, Human
ccuggcccagggcauc

SEQ ID NO: 2977831 - RNA, 13 nt, Human
ccuggcacugcuu

SEQ ID NO: 2977832 - RNA, 16 nt, Human
ccuggcacugcuucca

SEQ ID NO: 2977833 - RNA, 13 nt, Human
ccuggcaugggaa

SEQ ID NO: 2977834 - RNA, 23 nt, Human
ccuggcaugggaaugaaugucag

SEQ ID NO: 2977835 - RNA, 20 nt, Human
ccuggccagaugcaccagcc

SEQ ID NO: 2977836 - RNA, 23 nt, Human
ccuggccagaugcaccagcccuu

SEQ ID NO: 2977837 - RNA, 21 nt, Human
ccuggccagaugcaccagccc

SEQ ID NO: 2977838 - RNA, 13 nt, Human
ccuggcccacugc

SEQ ID NO: 2977839 - RNA, 14 nt, Human
ccuggcccacugca

SEQ ID NO: 2977840 - RNA, 12 nt, Human
ccuggcacugcu

SEQ ID NO: 2977841 - RNA, 22 nt, Human
ccuggcacuauaauguaagcuc

SEQ ID NO: 2977842 - RNA, 18 nt, Human
ccuggcacccggccccug

SEQ ID NO: 2977843 - RNA, 21 nt, Human
ccuggcacccggccccugcug

SEQ ID NO: 2977844 - RNA, 20 nt, Human
ccuggcacccggccccugcu

SEQ ID NO: 2977845 - RNA, 19 nt, Human
ccuggcacccggccccugc

SEQ ID NO: 2977846 - RNA, 18 nt, Human
ccugccuguugggccagg

SEQ ID NO: 2977847 - RNA, 19 nt, Human
ccugccuguugggccagga

SEQ ID NO: 2977848 - RNA, 20 nt, Human
ccugccuguugggccaggag

SEQ ID NO: 2977849 - RNA, 21 nt, Human
ccugcuaauuccccagauugc

SEQ ID NO: 2977850 - RNA, 17 nt, Human
ccugcuaauuccccaga

SEQ ID NO: 2977851 - RNA, 17 nt, Human
cgcuacccgggaagggg

SEQ ID NO: 2977852 - RNA, 18 nt, Human
cgcuacccgggaaggggg

SEQ ID NO: 2977853 - RNA, 21 nt, Human
cgcuacccgggaagggggcug

SEQ ID NO: 2977854 - RNA, 24 nt, Human
cgcuacccgggaagggggcuggga

SEQ ID NO: 2977855 - RNA, 19 nt, Human
cgcgguggcucacgccugu

SEQ ID NO: 2977856 - RNA, 14 nt, Human
cgcgacaaugcaaa

SEQ ID NO: 2977857 - RNA, 19 nt, Human
cgccuugcccagccuggau

SEQ ID NO: 2977858 - RNA, 16 nt, Human
cgccuugcccagccug

SEQ ID NO: 2977859 - RNA, 15 nt, Human
cgccuugcccagccu

SEQ ID NO: 2977860 - RNA, 12 nt, Human
cgcccagucugg

SEQ ID NO: 2977861 - RNA, 17 nt, Human
cgcccaaggccuucccc

SEQ ID NO: 2977862 - RNA, 21 nt, Human
cgcccagucuggaaugcagug

SEQ ID NO: 2977863 - RNA, 19 nt, Human
cgcccagucuggaaugcag

SEQ ID NO: 2977864 - RNA, 13 nt, Human
cgcccagucugga

SEQ ID NO: 2977865 - RNA, 12 nt, Human
cgcccaaggccu

SEQ ID NO: 2977866 - RNA, 18 nt, Human
cgcagcccugcagagggc

SEQ ID NO: 2977867 - RNA, 19 nt, Human
cgcagcccugcagagggca

SEQ ID NO: 2977868 - RNA, 13 nt, Human
cgcugugcugccc

SEQ ID NO: 2977869 - RNA, 14 nt, Human
cgcugugcugcccu

SEQ ID NO: 2977870 - RNA, 11 nt, Human
cgcugugcugc

SEQ ID NO: 2977871 - RNA, 21 nt, Human
cgcugugcugcccugcccacc

SEQ ID NO: 2977872 - RNA, 23 nt, Human
cgcugugcugcccugcccaccug

SEQ ID NO: 2977873 - RNA, 19 nt, Human
cgcugugcugcccugccca

SEQ ID NO: 2977874 - RNA, 22 nt, Human
cggacagccacggccaggccag

SEQ ID NO: 2977875 - RNA, 21 nt, Human
cggacagccacggccaggcca

SEQ ID NO: 2977876 - RNA, 17 nt, Human
cggagaaaggaagggcu

SEQ ID NO: 2977877 - RNA, 15 nt, Human
cggagaaaggaaggg

SEQ ID NO: 2977878 - RNA, 17 nt, Human
cggaauaguuggcuagg

SEQ ID NO: 2977879 - RNA, 16 nt, Human
cggaauaguuggcuag

SEQ ID NO: 2977880 - RNA, 14 nt, Human
cggaauaguuggcu

SEQ ID NO: 2977881 - RNA, 20 nt, Human
cggacagccacggccaggcc

SEQ ID NO: 2977882 - RNA, 16 nt, Human
cgcuuucuacccagcg

SEQ ID NO: 2977883 - RNA, 14 nt, Human
cgcuuucuacccag

SEQ ID NO: 2977884 - RNA, 19 nt, Human
cgggaagggggcugggaca

SEQ ID NO: 2977885 - RNA, 20 nt, Human
cgggaagggggcugggacau

SEQ ID NO: 2977886 - RNA, 16 nt, Human
cgggaagggggcuggg

SEQ ID NO: 2977887 - RNA, 23 nt, Human
cggcuggcagcccaccccucaac

SEQ ID NO: 2977888 - RNA, 13 nt, Human
cggcuggccuggc

SEQ ID NO: 2977889 - RNA, 14 nt, Human
cggcuggcagccca

SEQ ID NO: 2977890 - RNA, 20 nt, Human
cggcccuccagagccccaca

SEQ ID NO: 2977891 - RNA, 16 nt, Human
cggcccuccagagccc

SEQ ID NO: 2977892 - RNA, 11 nt, Human
cggccaggcca

SEQ ID NO: 2977893 - RNA, 20 nt, Human
cggccaggccagagggagug

SEQ ID NO: 2977894 - RNA, 12 nt, Human
cggccaggccag

SEQ ID NO: 2977895 - RNA, 13 nt, Human
cggcccuccagag

SEQ ID NO: 2977896 - RNA, 19 nt, Human
cgcagcauauucaggaagc

SEQ ID NO: 2977897 - RNA, 20 nt, Human
cgcagcauauucaggaagcu

SEQ ID NO: 2977898 - RNA, 15 nt, Human
cgcagcccugcagag

SEQ ID NO: 2977899 - RNA, 17 nt, Human
cgcagcccugcagaggg

SEQ ID NO: 2977900 - RNA, 17 nt, Human
cgcacugggcuugggga

SEQ ID NO: 2977901 - RNA, 13 nt, Human
cgcacugggcuug

SEQ ID NO: 2977902 - RNA, 23 nt, Human
cgauggaggacuccaggcagcag

SEQ ID NO: 2977903 - RNA, 19 nt, Human
cgagcccugguggcagugg

SEQ ID NO: 2977904 - RNA, 14 nt, Human
cgaggacagggagg

SEQ ID NO: 2977905 - RNA, 18 nt, Human
cgagcccugguggcagug

SEQ ID NO: 2977906 - RNA, 16 nt, Human
cgaggacagggaggug

SEQ ID NO: 2977907 - RNA, 23 nt, Human
ccuugucggccccaccagugccu

SEQ ID NO: 2977908 - RNA, 16 nt, Human
ccuuuguccccaccgc

SEQ ID NO: 2977909 - RNA, 18 nt, Human
ccuuuguccccaccgcag

SEQ ID NO: 2977910 - RNA, 14 nt, Human
ccuuuguccccacc

SEQ ID NO: 2977911 - RNA, 23 nt, Human
ccuuuguauucucuccuguaccu

SEQ ID NO: 2977912 - RNA, 22 nt, Human
ccuuuguauucucuccuguacc

SEQ ID NO: 2977913 - RNA, 24 nt, Human
ccuuuguauucucuccuguaccuc

SEQ ID NO: 2977914 - RNA, 15 nt, Human
ccuuugugaggaagc

SEQ ID NO: 2977915 - RNA, 16 nt, Human
ccuuugugaggaagcc

SEQ ID NO: 2977916 - RNA, 17 nt, Human
ccuuugugaggaagccg

SEQ ID NO: 2977917 - RNA, 23 nt, Human
ccuuugugaggaagccgcugggg

SEQ ID NO: 2977918 - RNA, 22 nt, Human
ccuuuguccccaccgcagacag

SEQ ID NO: 2977919 - RNA, 23 nt, Human
ccuuuguccccaccgcagacagg

SEQ ID NO: 2977920 - RNA, 14 nt, Human
ccuuugugaggaag

SEQ ID NO: 2977921 - RNA, 15 nt, Human
ccuuuuuuggcugcu

SEQ ID NO: 2977922 - RNA, 19 nt, Human
ccuuuuuuauacauaaaca

SEQ ID NO: 2977923 - RNA, 12 nt, Human
cgaauauugcug

SEQ ID NO: 2977924 - RNA, 14 nt, Human
cgaauauugcugau

SEQ ID NO: 2977925 - RNA, 11 nt, Human
cgaauauugcu

SEQ ID NO: 2977926 - RNA, 16 nt, Human
cgaauagcugggacua

SEQ ID NO: 2977927 - RNA, 15 nt, Human
cgaauagcugggacu

SEQ ID NO: 2977928 - RNA, 15 nt, Human
cgaauauugcugaug

SEQ ID NO: 2977929 - RNA, 17 nt, Human
cgaauauugcugauggu

SEQ ID NO: 2977930 - RNA, 23 nt, Human
cgaacauguuuuucuucucccuc

SEQ ID NO: 2977931 - RNA, 21 nt, Human
cgaacauguuuuucuucuccc

SEQ ID NO: 2977932 - RNA, 17 nt, Human
ccuuuuuuggcugcuga

SEQ ID NO: 2977933 - RNA, 18 nt, Human
ccuuuuuuggcugcugaa

SEQ ID NO: 2977934 - RNA, 20 nt, Human
ccuuuuuuggcugcugaagg

SEQ ID NO: 2977935 - RNA, 22 nt, Human
ccuuuuuuggcugcugaaggcu

SEQ ID NO: 2977936 - RNA, 23 nt, Human
cgaaagggacuuggaagcuccgc

SEQ ID NO: 2977937 - RNA, 19 nt, Human
ccuucucuccagccccugg

SEQ ID NO: 2977938 - RNA, 15 nt, Human
ccuuggauugucccc

SEQ ID NO: 2977939 - RNA, 15 nt, Human
ccuuggacucauuuu

SEQ ID NO: 2977940 - RNA, 22 nt, Human
ccuuggcucaaguccucuuuuc

SEQ ID NO: 2977941 - RNA, 17 nt, Human
ccuucucuccagccccu

SEQ ID NO: 2977942 - RNA, 18 nt, Human
ccuucucuccagccccug

SEQ ID NO: 2977943 - RNA, 21 nt, Human
ccuugacagggcacaccgggc

SEQ ID NO: 2977944 - RNA, 18 nt, Human
ccuugacagggcacaccg

SEQ ID NO: 2977945 - RNA, 14 nt, Human
ccuuggggagcagg

SEQ ID NO: 2977946 - RNA, 16 nt, Human
ccuuggcugcagggag

SEQ ID NO: 2977947 - RNA, 14 nt, Human
ccuuggcugcaggg

SEQ ID NO: 2977948 - RNA, 19 nt, Human
ccuuggugucgggcaugac

SEQ ID NO: 2977949 - RNA, 20 nt, Human
ccuuggugucgggcaugaca

SEQ ID NO: 2977950 - RNA, 18 nt, Human
ccuucggccuccauccug

SEQ ID NO: 2977951 - RNA, 17 nt, Human
ccuucggccuccauccu

SEQ ID NO: 2977952 - RNA, 16 nt, Human
ccuucggccuccaucc

SEQ ID NO: 2977953 - RNA, 17 nt, Human
ccuuccauggacuuugu

SEQ ID NO: 2977954 - RNA, 13 nt, Human
ccuuccaggggug

SEQ ID NO: 2977955 - RNA, 12 nt, Human
ccuucucuccag

SEQ ID NO: 2977956 - RNA, 13 nt, Human
ccuucucuccagc

SEQ ID NO: 2977957 - RNA, 15 nt, Human
ccuucucuccagccc

SEQ ID NO: 2977958 - RNA, 16 nt, Human
ccuucucuccagcccc

SEQ ID NO: 2977959 - RNA, 20 nt, Human
ccuguggaugauaaaacaca

SEQ ID NO: 2977960 - RNA, 19 nt, Human
ccuguggaugcugcugccc

SEQ ID NO: 2977961 - RNA, 17 nt, Human
ccuguggaugcugcugc

SEQ ID NO: 2977962 - RNA, 20 nt, Human
ccugugggcccccaaaugga

SEQ ID NO: 2977963 - RNA, 20 nt, Human
ccugugccucugggacugga

SEQ ID NO: 2977964 - RNA, 18 nt, Human
ccagugacagucagggaa

SEQ ID NO: 2977965 - RNA, 13 nt, Human
ccagugagacugu

SEQ ID NO: 2977966 - RNA, 12 nt, Human
ccaggugccagu

SEQ ID NO: 2977967 - RNA, 21 nt, Human
ccaggugcuaggaacacuccu

SEQ ID NO: 2977968 - RNA, 22 nt, Human
ccaguaaaugggggugcauuug

SEQ ID NO: 2977969 - RNA, 21 nt, Human
ccaguaaaugggggugcauuu

SEQ ID NO: 2977970 - RNA, 20 nt, Human
ccaguaaaugggggugcauu

SEQ ID NO: 2977971 - RNA, 13 nt, Human
ccagguuuaagcu

SEQ ID NO: 2977972 - RNA, 16 nt, Human
ccagguuucuaugugu

SEQ ID NO: 2977973 - RNA, 14 nt, Human
ccaucauugaaauc

SEQ ID NO: 2977974 - RNA, 16 nt, Human
ccaucauugaaaucuu

SEQ ID NO: 2977975 - RNA, 17 nt, Human
ccaucauugaaaucuuu

SEQ ID NO: 2977976 - RNA, 18 nt, Human
ccauccugaggcuccacu

SEQ ID NO: 2977977 - RNA, 20 nt, Human
ccauccugaggcuccacuug

SEQ ID NO: 2977978 - RNA, 16 nt, Human
ccauccugaggcucca

SEQ ID NO: 2977979 - RNA, 13 nt, Human
ccaucuacccucc

SEQ ID NO: 2977980 - RNA, 14 nt, Human
ccaucucacacaug

SEQ ID NO: 2977981 - RNA, 15 nt, Human
ccaucucacacauga

SEQ ID NO: 2977982 - RNA, 17 nt, Human
ccaucucacacaugagc

SEQ ID NO: 2977983 - RNA, 18 nt, Human
ccaucucacacaugagca

SEQ ID NO: 2977984 - RNA, 20 nt, Human
ccaucucacacaugagcauc

SEQ ID NO: 2977985 - RNA, 21 nt, Human
ccaucucacacaugagcauca

SEQ ID NO: 2977986 - RNA, 15 nt, Human
ccaucucuccuccuu

SEQ ID NO: 2977987 - RNA, 23 nt, Human
ccagugugacaaggauugcuacu

SEQ ID NO: 2977988 - RNA, 14 nt, Human
ccagugugacaagg

SEQ ID NO: 2977989 - RNA, 13 nt, Human
ccauaugccuggg

SEQ ID NO: 2977990 - RNA, 12 nt, Human
ccaucaagccac

SEQ ID NO: 2977991 - RNA, 15 nt, Human
ccauaugccugggca

SEQ ID NO: 2977992 - RNA, 16 nt, Human
ccaucaagccaccaac

SEQ ID NO: 2977993 - RNA, 13 nt, Human
ccaucaagccacc

SEQ ID NO: 2977994 - RNA, 14 nt, Human
ccaucaagccacca

SEQ ID NO: 2977995 - RNA, 12 nt, Human
ccaucauugaaa

SEQ ID NO: 2977996 - RNA, 13 nt, Human
ccaucaugucugg

SEQ ID NO: 2977997 - RNA, 12 nt, Human
ccaucaugucug

SEQ ID NO: 2977998 - RNA, 20 nt, Human
ccagguagaggguguguaag

SEQ ID NO: 2977999 - RNA, 24 nt, Human
ccaggguggccacaccucuauccc

SEQ ID NO: 2978000 - RNA, 18 nt, Human
ccaggguggccacaccuc

SEQ ID NO: 2978001 - RNA, 15 nt, Human
ccaggcccucugccc

SEQ ID NO: 2978002 - RNA, 23 nt, Human
ccaggcugggagagccuuccagg

SEQ ID NO: 2978003 - RNA, 22 nt, Human
ccaggcuuagucacugagacag

SEQ ID NO: 2978004 - RNA, 23 nt, Human
ccaggcuuagucacugagacagc

SEQ ID NO: 2978005 - RNA, 21 nt, Human
ccaggcuuagucacugagaca

SEQ ID NO: 2978006 - RNA, 22 nt, Human
ccaggaggcggaccuuguagug

SEQ ID NO: 2978007 - RNA, 21 nt, Human
ccaggccacaagacccuugug

SEQ ID NO: 2978008 - RNA, 20 nt, Human
ccaggaggccagccuugacc

SEQ ID NO: 2978009 - RNA, 15 nt, Human
ccaggaggccagccu

SEQ ID NO: 2978010 - RNA, 18 nt, Human
ccaggaggccagccuuga

SEQ ID NO: 2978011 - RNA, 14 nt, Human
ccaggaggccagcc

SEQ ID NO: 2978012 - RNA, 16 nt, Human
ccaggccccugccacc

SEQ ID NO: 2978013 - RNA, 15 nt, Human
ccaggccccugccac

SEQ ID NO: 2978014 - RNA, 14 nt, Human
ccaggccccugcca

SEQ ID NO: 2978015 - RNA, 12 nt, Human
ccaggccagagg

SEQ ID NO: 2978016 - RNA, 13 nt, Human
ccaggcccucugc

SEQ ID NO: 2978017 - RNA, 14 nt, Human
ccaggcccucugcc

SEQ ID NO: 2978018 - RNA, 15 nt, Human
cccaccuuggcugca

SEQ ID NO: 2978019 - RNA, 14 nt, Human
cccaccuuggcugc

SEQ ID NO: 2978020 - RNA, 22 nt, Human
cccaccuuggcucaaguccucu

SEQ ID NO: 2978021 - RNA, 15 nt, Human
cccaccuuggcucaa

SEQ ID NO: 2978022 - RNA, 17 nt, Human
cccacgcccccacuggu

SEQ ID NO: 2978023 - RNA, 19 nt, Human
cccacgcccccacugguga

SEQ ID NO: 2978024 - RNA, 14 nt, Human
cccaccucucucac

SEQ ID NO: 2978025 - RNA, 17 nt, Human
cccaccucucucacucc

SEQ ID NO: 2978026 - RNA, 13 nt, Human
cccaccucucuca

SEQ ID NO: 2978027 - RNA, 21 nt, Human
cccaccucagccucccaaagu

SEQ ID NO: 2978028 - RNA, 12 nt, Human
cccaccuuggcu

SEQ ID NO: 2978029 - RNA, 19 nt, Human
cccaccucucucacuccuu

SEQ ID NO: 2978030 - RNA, 14 nt, Human
cccaccuggcucug

SEQ ID NO: 2978031 - RNA, 15 nt, Human
cccaccucagccucc

SEQ ID NO: 2978032 - RNA, 14 nt, Human
cccaccucagccuc

SEQ ID NO: 2978033 - RNA, 12 nt, Human
cccaccucagcc

SEQ ID NO: 2978034 - RNA, 13 nt, Human
cccacaggaucag

SEQ ID NO: 2978035 - RNA, 17 nt, Human
cccacaggaucagucug

SEQ ID NO: 2978036 - RNA, 16 nt, Human
cccacagccccaucug

SEQ ID NO: 2978037 - RNA, 16 nt, Human
cccaagggccuggccu

SEQ ID NO: 2978038 - RNA, 15 nt, Human
cccaagugccaaaga

SEQ ID NO: 2978039 - RNA, 13 nt, Human
cccaagugccaaa

SEQ ID NO: 2978040 - RNA, 20 nt, Human
ccauuuugcugucccuuuuc

SEQ ID NO: 2978041 - RNA, 21 nt, Human
ccauuuuguauuuuacuaaua

SEQ ID NO: 2978042 - RNA, 12 nt, Human
cccaagggccug

SEQ ID NO: 2978043 - RNA, 14 nt, Human
cccaagggccuggc

SEQ ID NO: 2978044 - RNA, 18 nt, Human
ccauguuuuguuuacggu

SEQ ID NO: 2978045 - RNA, 16 nt, Human
ccaucuuaaaaacaac

SEQ ID NO: 2978046 - RNA, 13 nt, Human
ccauuugcuccuu

SEQ ID NO: 2978047 - RNA, 15 nt, Human
ccauucugccugccc

SEQ ID NO: 2978048 - RNA, 14 nt, Human
ccagcacaaagcag

SEQ ID NO: 2978049 - RNA, 19 nt, Human
ccagcaagugagagcuggg

SEQ ID NO: 2978050 - RNA, 18 nt, Human
ccagcaagugagagcugg

SEQ ID NO: 2978051 - RNA, 17 nt, Human
ccagcaagugagagcug

SEQ ID NO: 2978052 - RNA, 17 nt, Human
ccagcaggcucucaggc

SEQ ID NO: 2978053 - RNA, 18 nt, Human
ccagcaggcucucaggcc

SEQ ID NO: 2978054 - RNA, 16 nt, Human
ccagcaggcucucagg

SEQ ID NO: 2978055 - RNA, 17 nt, Human
ccagcaccaucucuccu

SEQ ID NO: 2978056 - RNA, 18 nt, Human
ccagcaccaucucuccuc

SEQ ID NO: 2978057 - RNA, 18 nt, Human
ccagauuucacucuccuu

SEQ ID NO: 2978058 - RNA, 19 nt, Human
ccagauuucacucuccuug

SEQ ID NO: 2978059 - RNA, 15 nt, Human
ccagauuucacucuc

SEQ ID NO: 2978060 - RNA, 22 nt, Human
ccagauugcaacaggcugggcu

SEQ ID NO: 2978061 - RNA, 23 nt, Human
ccagauugcaacaggcugggcuu

SEQ ID NO: 2978062 - RNA, 13 nt, Human
ccagagccccaca

SEQ ID NO: 2978063 - RNA, 16 nt, Human
ccagagccccacagcc

SEQ ID NO: 2978064 - RNA, 14 nt, Human
ccagagcccaccuu

SEQ ID NO: 2978065 - RNA, 16 nt, Human
ccagauugcaacaggc

SEQ ID NO: 2978066 - RNA, 14 nt, Human
ccagauugcaacag

SEQ ID NO: 2978067 - RNA, 23 nt, Human
ccagagccccacagccccaucug

SEQ ID NO: 2978068 - RNA, 17 nt, Human
ccagagccccacagccc

SEQ ID NO: 2978069 - RNA, 19 nt, Human
ccagccugagcgacaguga

SEQ ID NO: 2978070 - RNA, 13 nt, Human
ccagcgagcccug

SEQ ID NO: 2978071 - RNA, 23 nt, Human
ccagccuugaccauucuccaccu

SEQ ID NO: 2978072 - RNA, 13 nt, Human
ccagccuggguga

SEQ ID NO: 2978073 - RNA, 20 nt, Human
ccagccgagauagccaaggc

SEQ ID NO: 2978074 - RNA, 22 nt, Human
ccagccgagauagccaaggcca

SEQ ID NO: 2978075 - RNA, 17 nt, Human
ccagccgagauagccaa

SEQ ID NO: 2978076 - RNA, 19 nt, Human
ccagccccaaaacucuccu

SEQ ID NO: 2978077 - RNA, 19 nt, Human
ccagcaggcucucaggcca

SEQ ID NO: 2978078 - RNA, 20 nt, Human
ccagcaggcucucaggccag

SEQ ID NO: 2978079 - RNA, 21 nt, Human
ccagcaggcucucaggccagc

SEQ ID NO: 2978080 - RNA, 23 nt, Human
ccagcaggcucucaggccagcug

SEQ ID NO: 2978081 - RNA, 17 nt, Human
ccagcccacuucugcca

SEQ ID NO: 2978082 - RNA, 16 nt, Human
ccagcccacuucugcc

SEQ ID NO: 2978083 - RNA, 21 nt, Human
ccaccucccugcaauaaaaug

SEQ ID NO: 2978084 - RNA, 19 nt, Human
ccaccucccugcaauaaaa

SEQ ID NO: 2978085 - RNA, 14 nt, Human
ccaccucccugcaa

SEQ ID NO: 2978086 - RNA, 15 nt, Human
ccaccucccugcaau

SEQ ID NO: 2978087 - RNA, 12 nt, Human
ccacccugcucu

SEQ ID NO: 2978088 - RNA, 11 nt, Human
ccacccugcuc

SEQ ID NO: 2978089 - RNA, 14 nt, Human
ccaccucucucacu

SEQ ID NO: 2978090 - RNA, 16 nt, Human
ccaccucucucacucc

SEQ ID NO: 2978091 - RNA, 19 nt, Human
ccaccucucucacuccuug

SEQ ID NO: 2978092 - RNA, 20 nt, Human
ccaccucucucacuccuuga

SEQ ID NO: 2978093 - RNA, 13 nt, Human
ccaccuggccucu

SEQ ID NO: 2978094 - RNA, 18 nt, Human
ccaccuggccucugcacu

SEQ ID NO: 2978095 - RNA, 20 nt, Human
ccaccuggccucugcacucc

SEQ ID NO: 2978096 - RNA, 12 nt, Human
ccaccuggcucu

SEQ ID NO: 2978097 - RNA, 13 nt, Human
ccaccuggcucug

SEQ ID NO: 2978098 - RNA, 16 nt, Human
ccaccuggcucugugg

SEQ ID NO: 2978099 - RNA, 14 nt, Human
ccaccuggcucugu

SEQ ID NO: 2978100 - RNA, 13 nt, Human
ccaccugccaggg

SEQ ID NO: 2978101 - RNA, 14 nt, Human
ccaccugccaggga

SEQ ID NO: 2978102 - RNA, 12 nt, Human
ccaccugccagg

SEQ ID NO: 2978103 - RNA, 15 nt, Human
ccaccugccagggac

SEQ ID NO: 2978104 - RNA, 19 nt, Human
ccacccccacccaagggcc

SEQ ID NO: 2978105 - RNA, 12 nt, Human
ccacccccuagg

SEQ ID NO: 2978106 - RNA, 19 nt, Human
ccaccccucaacaccucug

SEQ ID NO: 2978107 - RNA, 14 nt, Human
ccacccuccuuuca

SEQ ID NO: 2978108 - RNA, 14 nt, Human
ccagacaucaacag

SEQ ID NO: 2978109 - RNA, 17 nt, Human
ccagacacauguccaag

SEQ ID NO: 2978110 - RNA, 20 nt, Human
ccagacacauguccaagaag

SEQ ID NO: 2978111 - RNA, 22 nt, Human
ccagacacauguccaagaagcc

SEQ ID NO: 2978112 - RNA, 15 nt, Human
ccagacccggcugcg

SEQ ID NO: 2978113 - RNA, 14 nt, Human
ccagacccggcugc

SEQ ID NO: 2978114 - RNA, 22 nt, Human
ccagaagaaaauagugguguga

SEQ ID NO: 2978115 - RNA, 16 nt, Human
ccacugugccaugugc

SEQ ID NO: 2978116 - RNA, 15 nt, Human
ccacugugccaugug

SEQ ID NO: 2978117 - RNA, 19 nt, Human
ccacugugccaugugccag

SEQ ID NO: 2978118 - RNA, 20 nt, Human
ccacugugcuccagccuggg

SEQ ID NO: 2978119 - RNA, 21 nt, Human
ccacugcaucguuucaucuuc

SEQ ID NO: 2978120 - RNA, 23 nt, Human
ccacugcaucguuucaucuucca

SEQ ID NO: 2978121 - RNA, 15 nt, Human
ccacugcucugguua

SEQ ID NO: 2978122 - RNA, 13 nt, Human
ccacugcucuggu

SEQ ID NO: 2978123 - RNA, 12 nt, Human
ccacugcucugg

SEQ ID NO: 2978124 - RNA, 11 nt, Human
ccacugcucug

SEQ ID NO: 2978125 - RNA, 20 nt, Human
ccacugcuuuuggucugugu

SEQ ID NO: 2978126 - RNA, 22 nt, Human
ccacugcuuuuggucuguguga

SEQ ID NO: 2978127 - RNA, 23 nt, Human
ccacuggugacaugucuuuucuu

SEQ ID NO: 2978128 - RNA, 15 nt, Human
ccacugguucuucuu

SEQ ID NO: 2978129 - RNA, 19 nt, Human
ccacuggguguaaacacau

SEQ ID NO: 2978130 - RNA, 14 nt, Human
ccacugugaagaga

SEQ ID NO: 2978131 - RNA, 15 nt, Human
ccacugugaagagaa

SEQ ID NO: 2978132 - RNA, 15 nt, Human
cccucugcccacucc

SEQ ID NO: 2978133 - RNA, 18 nt, Human
cccucugcccacucccug

SEQ ID NO: 2978134 - RNA, 11 nt, Human
cccucugccca

SEQ ID NO: 2978135 - RNA, 23 nt, Human
cccucuccugggcagcugccucc

SEQ ID NO: 2978136 - RNA, 19 nt, Human
cccucugcccacucccugc

SEQ ID NO: 2978137 - RNA, 22 nt, Human
cccucuccugggcagcugccuc

SEQ ID NO: 2978138 - RNA, 21 nt, Human
cccucuccugggcagcugccu

SEQ ID NO: 2978139 - RNA, 15 nt, Human
cccucuccugggcag

SEQ ID NO: 2978140 - RNA, 20 nt, Human
cccucuccugggcagcugcc

SEQ ID NO: 2978141 - RNA, 20 nt, Human
cccucuuucccucccuuccu

SEQ ID NO: 2978142 - RNA, 17 nt, Human
cccucuuucccucccuu

SEQ ID NO: 2978143 - RNA, 12 nt, Human
cccucuuucccu

SEQ ID NO: 2978144 - RNA, 23 nt, Human
cccucccucuuucccucccuucc

SEQ ID NO: 2978145 - RNA, 12 nt, Human
cccuuccaugga

SEQ ID NO: 2978146 - RNA, 15 nt, Human
cccuuacgugagucc

SEQ ID NO: 2978147 - RNA, 17 nt, Human
cccuuacgugaguccug

SEQ ID NO: 2978148 - RNA, 14 nt, Human
cccuuagcagggaa

SEQ ID NO: 2978149 - RNA, 23 nt, Human
cccuuagcagggaaacagcuaau

SEQ ID NO: 2978150 - RNA, 20 nt, Human
cccuuaccugccaggaagcc

SEQ ID NO: 2978151 - RNA, 23 nt, Human
cccuuaccugccaggaagccagc

SEQ ID NO: 2978152 - RNA, 17 nt, Human
cccuuaccugccaggaa

SEQ ID NO: 2978153 - RNA, 19 nt, Human
cccuuaccucggugccuuc

SEQ ID NO: 2978154 - RNA, 19 nt, Human
cccuguuuguuucugaaag

SEQ ID NO: 2978155 - RNA, 16 nt, Human
cccuguuuguuucuga

SEQ ID NO: 2978156 - RNA, 13 nt, Human
cccuguucuggca

SEQ ID NO: 2978157 - RNA, 14 nt, Human
cccuguucuggcag

SEQ ID NO: 2978158 - RNA, 21 nt, Human
cccuggugaccagcaccaucu

SEQ ID NO: 2978159 - RNA, 21 nt, Human
cccugguggcagcucaccucu

SEQ ID NO: 2978160 - RNA, 13 nt, Human
cccugguggcagu

SEQ ID NO: 2978161 - RNA, 21 nt, Human
cccuguagagugggagcugag

SEQ ID NO: 2978162 - RNA, 14 nt, Human
cccugguggcagug

SEQ ID NO: 2978163 - RNA, 21 nt, Human
cccugcucuccgaccagacac

SEQ ID NO: 2978164 - RNA, 22 nt, Human
cccugcucuccgaccagacacc

SEQ ID NO: 2978165 - RNA, 14 nt, Human
cccugcugcuccua

SEQ ID NO: 2978166 - RNA, 12 nt, Human
cccugcugcucc

SEQ ID NO: 2978167 - RNA, 11 nt, Human
cccugccuccu

SEQ ID NO: 2978168 - RNA, 12 nt, Human
cccugaggccca

SEQ ID NO: 2978169 - RNA, 20 nt, Human
cccugcagagggcacagaaa

SEQ ID NO: 2978170 - RNA, 18 nt, Human
ccuacaggagugagcacu

SEQ ID NO: 2978171 - RNA, 18 nt, Human
ccuaggugacagagugag

SEQ ID NO: 2978172 - RNA, 23 nt, Human
ccuaggcauuugcugaauacaga

SEQ ID NO: 2978173 - RNA, 21 nt, Human
ccuacaguugaaaaacagcug

SEQ ID NO: 2978174 - RNA, 14 nt, Human
ccgcuggggccagu

SEQ ID NO: 2978175 - RNA, 11 nt, Human
ccgcuggggcc

SEQ ID NO: 2978176 - RNA, 13 nt, Human
ccgggccacagag

SEQ ID NO: 2978177 - RNA, 22 nt, Human
ccgggcacucagaagacacuga

SEQ ID NO: 2978178 - RNA, 20 nt, Human
ccgggcacucagaagacacu

SEQ ID NO: 2978179 - RNA, 21 nt, Human
ccggcuccaggcuccuuuagc

SEQ ID NO: 2978180 - RNA, 16 nt, Human
ccggcuccaggcuccu

SEQ ID NO: 2978181 - RNA, 18 nt, Human
ccgggcucugccucccau

SEQ ID NO: 2978182 - RNA, 13 nt, Human
ccgggcucugccu

SEQ ID NO: 2978183 - RNA, 14 nt, Human
ccgggcucugccuc

SEQ ID NO: 2978184 - RNA, 15 nt, Human
ccgggcucugccucc

SEQ ID NO: 2978185 - RNA, 18 nt, Human
ccgugaggccagagacac

SEQ ID NO: 2978186 - RNA, 15 nt, Human
ccgagauugcaccac

SEQ ID NO: 2978187 - RNA, 19 nt, Human
ccgagauugcaccacugca

SEQ ID NO: 2978188 - RNA, 21 nt, Human
ccgagauugcaccacugcacu

SEQ ID NO: 2978189 - RNA, 23 nt, Human
ccgcacugggcuuggggaccaga

SEQ ID NO: 2978190 - RNA, 19 nt, Human
ccgcacugggcuuggggac

SEQ ID NO: 2978191 - RNA, 14 nt, Human
ccgaguagcuggga

SEQ ID NO: 2978192 - RNA, 19 nt, Human
ccgagcuuugaaaauucag

SEQ ID NO: 2978193 - RNA, 15 nt, Human
ccccucggagaagag

SEQ ID NO: 2978194 - RNA, 17 nt, Human
ccccuccucugcuugcc

SEQ ID NO: 2978195 - RNA, 14 nt, Human
ccccuccucugcuu

SEQ ID NO: 2978196 - RNA, 13 nt, Human
ccccuccucugcu

SEQ ID NO: 2978197 - RNA, 16 nt, Human
ccccucagggucccug

SEQ ID NO: 2978198 - RNA, 22 nt, Human
ccccucagggucccugguggca

SEQ ID NO: 2978199 - RNA, 12 nt, Human
ccccuccaugug

SEQ ID NO: 2978200 - RNA, 15 nt, Human
ccccucaacaccucu

SEQ ID NO: 2978201 - RNA, 16 nt, Human
ccccucaacaccucug

SEQ ID NO: 2978202 - RNA, 23 nt, Human
ccccucaacucuccuccagaguc

SEQ ID NO: 2978203 - RNA, 12 nt, Human
cccccagccugc

SEQ ID NO: 2978204 - RNA, 19 nt, Human
cccccugacaacacucauu

SEQ ID NO: 2978205 - RNA, 17 nt, Human
cccccugacaacacuca

SEQ ID NO: 2978206 - RNA, 20 nt, Human
ccccagugcccacaggauca

SEQ ID NO: 2978207 - RNA, 16 nt, Human
ccccagugcccacagg

SEQ ID NO: 2978208 - RNA, 15 nt, Human
ccccagugcccacag

SEQ ID NO: 2978209 - RNA, 14 nt, Human
ccccagugcccaca

SEQ ID NO: 2978210 - RNA, 15 nt, Human
cccccacuggugaca

SEQ ID NO: 2978211 - RNA, 11 nt, Human
cccccacuggu

SEQ ID NO: 2978212 - RNA, 13 nt, Human
cccccacugguga

SEQ ID NO: 2978213 - RNA, 14 nt, Human
ccccauccucugua

SEQ ID NO: 2978214 - RNA, 13 nt, Human
cccccacccaagg

SEQ ID NO: 2978215 - RNA, 24 nt, Human
cccccacccaagggccuggccuga

SEQ ID NO: 2978216 - RNA, 20 nt, Human
ccccugcugguucaggguug

SEQ ID NO: 2978217 - RNA, 15 nt, Human
ccccugcugguucag

SEQ ID NO: 2978218 - RNA, 13 nt, Human
ccccugcugguuc

SEQ ID NO: 2978219 - RNA, 11 nt, Human
ccccugcuggu

SEQ ID NO: 2978220 - RNA, 14 nt, Human
ccccugcugggugu

SEQ ID NO: 2978221 - RNA, 17 nt, Human
ccccugcuggguguggc

SEQ ID NO: 2978222 - RNA, 18 nt, Human
ccccuggaugcagccuca

SEQ ID NO: 2978223 - RNA, 19 nt, Human
ccccuggaugcagccucac

SEQ ID NO: 2978224 - RNA, 16 nt, Human
ccccuggcacuggcaa

SEQ ID NO: 2978225 - RNA, 14 nt, Human
ccccuggcacuggc

SEQ ID NO: 2978226 - RNA, 15 nt, Human
ccccuggaugcagcc

SEQ ID NO: 2978227 - RNA, 19 nt, Human
ccccugcccggcugcggaa

SEQ ID NO: 2978228 - RNA, 17 nt, Human
ccccugcccggcugcgg

SEQ ID NO: 2978229 - RNA, 20 nt, Human
cccgcccaggcuuagucacu

SEQ ID NO: 2978230 - RNA, 22 nt, Human
cccgcccaggcuuagucacuga

SEQ ID NO: 2978231 - RNA, 23 nt, Human
cccgcuaagagggagggagggcu

SEQ ID NO: 2978232 - RNA, 13 nt, Human
ccccuuccaugga

SEQ ID NO: 2978233 - RNA, 20 nt, Human
ccccuuccauggacuuuguu

SEQ ID NO: 2978234 - RNA, 22 nt, Human
cccgaauagcugggacuacagg

SEQ ID NO: 2978235 - RNA, 22 nt, Human
ccccuguggaugcugcugcccc

SEQ ID NO: 2978236 - RNA, 20 nt, Human
ccccuguggaugcugcugcc

SEQ ID NO: 2978237 - RNA, 19 nt, Human
ccccuguggaugcugcugc

SEQ ID NO: 2978238 - RNA, 21 nt, Human
ccccacccaagggccuggccu

SEQ ID NO: 2978239 - RNA, 15 nt, Human
ccccaccgcagacag

SEQ ID NO: 2978240 - RNA, 19 nt, Human
ccccaccgcagacaggacc

SEQ ID NO: 2978241 - RNA, 14 nt, Human
ccccacuggugaca

SEQ ID NO: 2978242 - RNA, 20 nt, Human
ccccacuccggcccuccaga

SEQ ID NO: 2978243 - RNA, 16 nt, Human
ccccacuccggcccuc

SEQ ID NO: 2978244 - RNA, 14 nt, Human
cccaguugggugga

SEQ ID NO: 2978245 - RNA, 19 nt, Human
cccaucucuacaaaaagca

SEQ ID NO: 2978246 - RNA, 17 nt, Human
cccaucugcagggcccc

SEQ ID NO: 2978247 - RNA, 21 nt, Human
cccaucugcgggggcagugcu

SEQ ID NO: 2978248 - RNA, 22 nt, Human
cccaucugcgggggcagugcuc

SEQ ID NO: 2978249 - RNA, 22 nt, Human
cccaugagccucagcauccugg

SEQ ID NO: 2978250 - RNA, 21 nt, Human
cccaugagggagaugccauga

SEQ ID NO: 2978251 - RNA, 20 nt, Human
cccaugagggagaugccaug

SEQ ID NO: 2978252 - RNA, 14 nt, Human
cccaugagccucag

SEQ ID NO: 2978253 - RNA, 19 nt, Human
aaaaauuuacuuuaaacua

SEQ ID NO: 2978254 - RNA, 18 nt, Human
aaaaauuuacuuuaaacu

SEQ ID NO: 2978255 - RNA, 13 nt, Human
aaaaauuuacuuu

SEQ ID NO: 2978256 - RNA, 14 nt, Human
aaaacaaggaugaa

SEQ ID NO: 2978257 - RNA, 12 nt, Human
aaaacacagcaa

SEQ ID NO: 2978258 - RNA, 13 nt, Human
aaaacacagcaag

SEQ ID NO: 2978259 - RNA, 12 nt, Human
aaaacacauuuu

SEQ ID NO: 2978260 - RNA, 18 nt, Human
aaaacacagcaaggguga

SEQ ID NO: 2978261 - RNA, 17 nt, Human
aaaacaaggaugaauua

SEQ ID NO: 2978262 - RNA, 12 nt, Human
aaaaagaggcua

SEQ ID NO: 2978263 - RNA, 13 nt, Human
aaaaacugauuuu

SEQ ID NO: 2978264 - RNA, 14 nt, Human
aaaaacauggccuu

SEQ ID NO: 2978265 - RNA, 15 nt, Human
aaaaacugauuuuuu

SEQ ID NO: 2978266 - RNA, 14 nt, Human
aaaaacacaaaagu

SEQ ID NO: 2978267 - RNA, 19 nt, Human
agccccacccucagaugca

SEQ ID NO: 2978268 - RNA, 20 nt, Human
agccgagaucacgccacugc

SEQ ID NO: 2978269 - RNA, 19 nt, Human
agccgagaucacgccacug

SEQ ID NO: 2978270 - RNA, 15 nt, Human
agcccugagcuuucu

SEQ ID NO: 2978271 - RNA, 18 nt, Human
agcccugaacauuucaug

SEQ ID NO: 2978272 - RNA, 20 nt, Human
agccccaucccaaacccuuc

SEQ ID NO: 2978273 - RNA, 11 nt, Human
agccccauccu

SEQ ID NO: 2978274 - RNA, 16 nt, Human
agccccagugcccaca

SEQ ID NO: 2978275 - RNA, 21 nt, Human
agccgggcgugguggugagug

SEQ ID NO: 2978276 - RNA, 19 nt, Human
agccucccaaagugcuggg

SEQ ID NO: 2978277 - RNA, 18 nt, Human
agccucccaaagugcugg

SEQ ID NO: 2978278 - RNA, 14 nt, Human
agccgcuggggcca

SEQ ID NO: 2978279 - RNA, 22 nt, Human
agccgcuggggccaguuggucc

SEQ ID NO: 2978280 - RNA, 20 nt, Human
agccgagauugcaccacugc

SEQ ID NO: 2978281 - RNA, 19 nt, Human
agccgagauugcaccacug

SEQ ID NO: 2978282 - RNA, 21 nt, Human
agccgagaucacgccacugca

SEQ ID NO: 2978283 - RNA, 17 nt, Human
agccucccgaguagcug

SEQ ID NO: 2978284 - RNA, 22 nt, Human
agccucccgaauagcugggacu

SEQ ID NO: 2978285 - RNA, 20 nt, Human
agccucccgaauagcuggga

SEQ ID NO: 2978286 - RNA, 19 nt, Human
agccucccgaauagcuggg

SEQ ID NO: 2978287 - RNA, 18 nt, Human
agccucccgaauagcugg

SEQ ID NO: 2978288 - RNA, 20 nt, Human
agccucccaaagugcuggga

SEQ ID NO: 2978289 - RNA, 17 nt, Human
agccucccaaagugcug

SEQ ID NO: 2978290 - RNA, 22 nt, Human
agccucccgaguagcugggacu

SEQ ID NO: 2978291 - RNA, 20 nt, Human
agauguagacaguuggguuu

SEQ ID NO: 2978292 - RNA, 18 nt, Human
agauguacgacuugcaua

SEQ ID NO: 2978293 - RNA, 14 nt, Human
agauguagaggaga

SEQ ID NO: 2978294 - RNA, 21 nt, Human
agaugggagaaucacuugaac

SEQ ID NO: 2978295 - RNA, 20 nt, Human
agcagcccucaauugugaaa

SEQ ID NO: 2978296 - RNA, 15 nt, Human
agcagccacauuccu

SEQ ID NO: 2978297 - RNA, 18 nt, Human
agcaguucagagcugccc

SEQ ID NO: 2978298 - RNA, 17 nt, Human
agcaguucagagcugcc

SEQ ID NO: 2978299 - RNA, 15 nt, Human
agcaguucagagcug

SEQ ID NO: 2978300 - RNA, 16 nt, Human
agcaguucagagcugc

SEQ ID NO: 2978301 - RNA, 23 nt, Human
agcaguugaaaagacuccaaaga

SEQ ID NO: 2978302 - RNA, 21 nt, Human
agcaguugaaaagacuccaaa

SEQ ID NO: 2978303 - RNA, 19 nt, Human
agcacuaaggugugcucug

SEQ ID NO: 2978304 - RNA, 21 nt, Human
agcagccacauuccugaugcu

SEQ ID NO: 2978305 - RNA, 12 nt, Human
agcaugaagaca

SEQ ID NO: 2978306 - RNA, 12 nt, Human
agcaugccugga

SEQ ID NO: 2978307 - RNA, 23 nt, Human
agccaaagcuaggccuggccaga

SEQ ID NO: 2978308 - RNA, 20 nt, Human
agccaaagcuaggccuggcc

SEQ ID NO: 2978309 - RNA, 19 nt, Human
agccaaagcuaggccuggc

SEQ ID NO: 2978310 - RNA, 18 nt, Human
agccaaagcuaggccugg

SEQ ID NO: 2978311 - RNA, 23 nt, Human
agccaaggccaaaggaagcacau

SEQ ID NO: 2978312 - RNA, 22 nt, Human
agccaaggccaaaggaagcaca

SEQ ID NO: 2978313 - RNA, 20 nt, Human
agccaaggccaaaggaagca

SEQ ID NO: 2978314 - RNA, 20 nt, Human
agccagaggagagaggaccc

SEQ ID NO: 2978315 - RNA, 19 nt, Human
agccagauuuuccugaaaa

SEQ ID NO: 2978316 - RNA, 15 nt, Human
agccagauuuuccug

SEQ ID NO: 2978317 - RNA, 14 nt, Human
agccauuuguccca

SEQ ID NO: 2978318 - RNA, 17 nt, Human
agccauuugucccaagu

SEQ ID NO: 2978319 - RNA, 18 nt, Human
agccauuugucccaagug

SEQ ID NO: 2978320 - RNA, 19 nt, Human
agcaguucagagcugcccu

SEQ ID NO: 2978321 - RNA, 16 nt, Human
agagguacacuuguga

SEQ ID NO: 2978322 - RNA, 17 nt, Human
agagguacacuugugaa

SEQ ID NO: 2978323 - RNA, 23 nt, Human
agaggguggugaccucugccuga

SEQ ID NO: 2978324 - RNA, 22 nt, Human
agauacuuggggggcugaggug

SEQ ID NO: 2978325 - RNA, 13 nt, Human
agauagccaaggc

SEQ ID NO: 2978326 - RNA, 16 nt, Human
agaggggaagagacuu

SEQ ID NO: 2978327 - RNA, 22 nt, Human
agaggggaacagacuggaagca

SEQ ID NO: 2978328 - RNA, 13 nt, Human
agaggagaggggc

SEQ ID NO: 2978329 - RNA, 15 nt, Human
agauagccaaggcca

SEQ ID NO: 2978330 - RNA, 16 nt, Human
agauagccaaggccaa

SEQ ID NO: 2978331 - RNA, 21 nt, Human
agauaggucagugcaaauacu

SEQ ID NO: 2978332 - RNA, 17 nt, Human
agacugcauuauauuua

SEQ ID NO: 2978333 - RNA, 10 nt, Human
agagaagaga

SEQ ID NO: 2978334 - RNA, 21 nt, Human
agagaagagauugugguuuca

SEQ ID NO: 2978335 - RNA, 23 nt, Human
agagaggguggugaccucugccu

SEQ ID NO: 2978336 - RNA, 15 nt, Human
agagccccacagccc

SEQ ID NO: 2978337 - RNA, 13 nt, Human
agagccccacagc

SEQ ID NO: 2978338 - RNA, 23 nt, Human
agacugaguacguugugcauuug

SEQ ID NO: 2978339 - RNA, 19 nt, Human
agacggagucccaccuugg

SEQ ID NO: 2978340 - RNA, 18 nt, Human
agacgggggcagagaggg

SEQ ID NO: 2978341 - RNA, 18 nt, Human
agacagcccgggcucugc

SEQ ID NO: 2978342 - RNA, 20 nt, Human
agacagcccgggcucugccu

SEQ ID NO: 2978343 - RNA, 17 nt, Human
agacagcccgggcucug

SEQ ID NO: 2978344 - RNA, 16 nt, Human
agacagcccgggcucu

SEQ ID NO: 2978345 - RNA, 14 nt, Human
agaccaucccugaa

SEQ ID NO: 2978346 - RNA, 17 nt, Human
agaccaucccugaaggc

SEQ ID NO: 2978347 - RNA, 18 nt, Human
agaccaucccugaaggcc

SEQ ID NO: 2978348 - RNA, 21 nt, Human
agaccaucccugaaggccccg

SEQ ID NO: 2978349 - RNA, 13 nt, Human
agaccaucccuga

SEQ ID NO: 2978350 - RNA, 15 nt, Human
agacaauuuauuaug

SEQ ID NO: 2978351 - RNA, 19 nt, Human
agacaaugacuuacuguac

SEQ ID NO: 2978352 - RNA, 21 nt, Human
agacaauuuauuauggcacau

SEQ ID NO: 2978353 - RNA, 17 nt, Human
agacaaugacuuacugu

SEQ ID NO: 2978354 - RNA, 13 nt, Human
agacaaugacuua

SEQ ID NO: 2978355 - RNA, 14 nt, Human
agguacacuuguga

SEQ ID NO: 2978356 - RNA, 17 nt, Human
agguaaggaauaccugu

SEQ ID NO: 2978357 - RNA, 16 nt, Human
agguacacuugugaau

SEQ ID NO: 2978358 - RNA, 17 nt, Human
agguacacuugugaaua

SEQ ID NO: 2978359 - RNA, 14 nt, Human
aggucgaggcagga

SEQ ID NO: 2978360 - RNA, 16 nt, Human
aggugcugccauccag

SEQ ID NO: 2978361 - RNA, 17 nt, Human
aggugcugccauccagg

SEQ ID NO: 2978362 - RNA, 13 nt, Human
agguucagcuugu

SEQ ID NO: 2978363 - RNA, 15 nt, Human
agguuaauaaaguaa

SEQ ID NO: 2978364 - RNA, 14 nt, Human
agguuaauguucau

SEQ ID NO: 2978365 - RNA, 17 nt, Human
agguucaaagauauuuu

SEQ ID NO: 2978366 - RNA, 15 nt, Human
agguucaaagauauu

SEQ ID NO: 2978367 - RNA, 12 nt, Human
agggacagaggg

SEQ ID NO: 2978368 - RNA, 13 nt, Human
agggacagagggg

SEQ ID NO: 2978369 - RNA, 20 nt, Human
agggacagaggggguggccu

SEQ ID NO: 2978370 - RNA, 21 nt, Human
agggacgcuacccgggaaggg

SEQ ID NO: 2978371 - RNA, 17 nt, Human
agggacgcuacccggga

SEQ ID NO: 2978372 - RNA, 18 nt, Human
aggcugccucucccauca

SEQ ID NO: 2978373 - RNA, 16 nt, Human
aggcugccagugccug

SEQ ID NO: 2978374 - RNA, 15 nt, Human
aggcugccagugccu

SEQ ID NO: 2978375 - RNA, 14 nt, Human
aggcugccagugcc

SEQ ID NO: 2978376 - RNA, 20 nt, Human
aggcugccagugccugggug

SEQ ID NO: 2978377 - RNA, 19 nt, Human
aggcugccagugccugggu

SEQ ID NO: 2978378 - RNA, 23 nt, Human
aggcuagugugguguuuccuggc

SEQ ID NO: 2978379 - RNA, 13 nt, Human
aggcugccagugc

SEQ ID NO: 2978380 - RNA, 15 nt, Human
aggggcacagggucu

SEQ ID NO: 2978381 - RNA, 21 nt, Human
aggggauagagagagaccacu

SEQ ID NO: 2978382 - RNA, 16 nt, Human
aggggauagagagaga

SEQ ID NO: 2978383 - RNA, 19 nt, Human
agggcgggaggauguucug

SEQ ID NO: 2978384 - RNA, 15 nt, Human
agggccuggccugag

SEQ ID NO: 2978385 - RNA, 16 nt, Human
agggccuggccugagc

SEQ ID NO: 2978386 - RNA, 17 nt, Human
agggccuggccugagcu

SEQ ID NO: 2978387 - RNA, 22 nt, Human
agggcacagaaaauggaagaca

SEQ ID NO: 2978388 - RNA, 21 nt, Human
agggcacaccgggcacucaga

SEQ ID NO: 2978389 - RNA, 20 nt, Human
agggcacaccgggcacucag

SEQ ID NO: 2978390 - RNA, 17 nt, Human
agggcacaccgggcacu

SEQ ID NO: 2978391 - RNA, 20 nt, Human
aggaccccuccaugugggcu

SEQ ID NO: 2978392 - RNA, 14 nt, Human
aggaccucagguga

SEQ ID NO: 2978393 - RNA, 20 nt, Human
aggaccucaggugagaagca

SEQ ID NO: 2978394 - RNA, 15 nt, Human
aggagagcuagcagc

SEQ ID NO: 2978395 - RNA, 14 nt, Human
aggagaggggcaca

SEQ ID NO: 2978396 - RNA, 16 nt, Human
aggagaggggcacagg

SEQ ID NO: 2978397 - RNA, 18 nt, Human
aggagaggggcacagggu

SEQ ID NO: 2978398 - RNA, 12 nt, Human
aggauucuuccu

SEQ ID NO: 2978399 - RNA, 14 nt, Human
aggauguugaaaaa

SEQ ID NO: 2978400 - RNA, 20 nt, Human
aggauguucugggacacagu

SEQ ID NO: 2978401 - RNA, 18 nt, Human
aggauguucugggacaca

SEQ ID NO: 2978402 - RNA, 17 nt, Human
aggaggggauagagaga

SEQ ID NO: 2978403 - RNA, 19 nt, Human
agcuggucccacucagucc

SEQ ID NO: 2978404 - RNA, 21 nt, Human
agcuggucccacucaguccau

SEQ ID NO: 2978405 - RNA, 22 nt, Human
agcugggugucaagagggucug

SEQ ID NO: 2978406 - RNA, 17 nt, Human
agcugggugucaagagg

SEQ ID NO: 2978407 - RNA, 18 nt, Human
agcuucacuguaaaauaa

SEQ ID NO: 2978408 - RNA, 13 nt, Human
aggaaaaacugau

SEQ ID NO: 2978409 - RNA, 15 nt, Human
aggaaaaacugauuu

SEQ ID NO: 2978410 - RNA, 22 nt, Human
augcuugcugcugauuuaaaca

SEQ ID NO: 2978411 - RNA, 16 nt, Human
augcuugcugcugauu

SEQ ID NO: 2978412 - RNA, 23 nt, Human
augcuugcugcugauuuaaacac

SEQ ID NO: 2978413 - RNA, 19 nt, Human
auggaaaugggcagagcag

SEQ ID NO: 2978414 - RNA, 20 nt, Human
auggaaaugggcagagcaga

SEQ ID NO: 2978415 - RNA, 22 nt, Human
augcuucuucagagacuccugc

SEQ ID NO: 2978416 - RNA, 23 nt, Human
auggcugccaaugggagcucaug

SEQ ID NO: 2978417 - RNA, 15 nt, Human
augggaaugaauguc

SEQ ID NO: 2978418 - RNA, 21 nt, Human
augccuggauggggcugcacc

SEQ ID NO: 2978419 - RNA, 23 nt, Human
augccuggauggggcugcaccgg

SEQ ID NO: 2978420 - RNA, 17 nt, Human
augccugggcagaagga

SEQ ID NO: 2978421 - RNA, 17 nt, Human
augccugguggcagcug

SEQ ID NO: 2978422 - RNA, 16 nt, Human
augccugguggcagcu

SEQ ID NO: 2978423 - RNA, 15 nt, Human
augccugguggcagc

SEQ ID NO: 2978424 - RNA, 12 nt, Human
augcauuugaaa

SEQ ID NO: 2978425 - RNA, 10 nt, Human
augcauuuga

SEQ ID NO: 2978426 - RNA, 18 nt, Human
augcauuugaaaauuuug

SEQ ID NO: 2978427 - RNA, 23 nt, Human
augcaugaaguaauaugcacaca

SEQ ID NO: 2978428 - RNA, 20 nt, Human
augcaugaaguaauaugcac

SEQ ID NO: 2978429 - RNA, 22 nt, Human
augcacacauuuuuuaaaugca

SEQ ID NO: 2978430 - RNA, 19 nt, Human
augcacacauuuuuuaaau

SEQ ID NO: 2978431 - RNA, 17 nt, Human
augcacacauuuuuuaa

SEQ ID NO: 2978432 - RNA, 23 nt, Human
augcacagaguuguuacauuuuu

SEQ ID NO: 2978433 - RNA, 14 nt, Human
augcacagcuaaca

SEQ ID NO: 2978434 - RNA, 21 nt, Human
augcacagcuaacauggaagu

SEQ ID NO: 2978435 - RNA, 21 nt, Human
auuaaaugacucuucccucaa

SEQ ID NO: 2978436 - RNA, 11 nt, Human
auuaaauuaug

SEQ ID NO: 2978437 - RNA, 16 nt, Human
auuaaaugcccagccc

SEQ ID NO: 2978438 - RNA, 13 nt, Human
auuaaauucuugc

SEQ ID NO: 2978439 - RNA, 14 nt, Human
auuaaaugacucuu

SEQ ID NO: 2978440 - RNA, 17 nt, Human
auuaaaugacucuuccc

SEQ ID NO: 2978441 - RNA, 14 nt, Human
auuaaaugcccagc

SEQ ID NO: 2978442 - RNA, 15 nt, Human
auuaaaugcccagcc

SEQ ID NO: 2978443 - RNA, 18 nt, Human
auguuuuaagaggcaggg

SEQ ID NO: 2978444 - RNA, 16 nt, Human
auguuuuaagaggcag

SEQ ID NO: 2978445 - RNA, 14 nt, Human
auguucuuaauucu

SEQ ID NO: 2978446 - RNA, 22 nt, Human
auguucugacccugcuucaaau

SEQ ID NO: 2978447 - RNA, 20 nt, Human
auguucuuaguggauguucu

SEQ ID NO: 2978448 - RNA, 15 nt, Human
auguucuuaauucuu

SEQ ID NO: 2978449 - RNA, 20 nt, Human
auguucuuucacccuuuucu

SEQ ID NO: 2978450 - RNA, 18 nt, Human
auguucucugaggacacu

SEQ ID NO: 2978451 - RNA, 20 nt, Human
augugggcuaguugggcuuc

SEQ ID NO: 2978452 - RNA, 14 nt, Human
auguguaaguauuc

SEQ ID NO: 2978453 - RNA, 22 nt, Human
auguguaauaaauauguuucac

SEQ ID NO: 2978454 - RNA, 17 nt, Human
auguguaauaaauaugu

SEQ ID NO: 2978455 - RNA, 13 nt, Human
auguguaauaaau

SEQ ID NO: 2978456 - RNA, 21 nt, Human
auguaagggaaacugccagca

SEQ ID NO: 2978457 - RNA, 22 nt, Human
auguaagggaaacugccagcaa

SEQ ID NO: 2978458 - RNA, 17 nt, Human
auguaagcucuacugag

SEQ ID NO: 2978459 - RNA, 20 nt, Human
auguaagggaaacugccagc

SEQ ID NO: 2978460 - RNA, 16 nt, Human
auguaaguaaacgguc

SEQ ID NO: 2978461 - RNA, 15 nt, Human
auggucggaaaacau

SEQ ID NO: 2978462 - RNA, 16 nt, Human
augucacaggcagguc

SEQ ID NO: 2978463 - RNA, 14 nt, Human
augucacaggcagg

SEQ ID NO: 2978464 - RNA, 15 nt, Human
augucacaggcaggu

SEQ ID NO: 2978465 - RNA, 20 nt, Human
augucagacacagauuggcc

SEQ ID NO: 2978466 - RNA, 15 nt, Human
augucagacacagau

SEQ ID NO: 2978467 - RNA, 13 nt, Human
augucagacacag

SEQ ID NO: 2978468 - RNA, 18 nt, Human
augucacuucuggauaua

SEQ ID NO: 2978469 - RNA, 15 nt, Human
augucacuucuggau

SEQ ID NO: 2978470 - RNA, 21 nt, Human
augucagacacagauuggcca

SEQ ID NO: 2978471 - RNA, 18 nt, Human
augacucuucccucaaau

SEQ ID NO: 2978472 - RNA, 12 nt, Human
augagccuggca

SEQ ID NO: 2978473 - RNA, 17 nt, Human
augacuccagaauuucc

SEQ ID NO: 2978474 - RNA, 12 nt, Human
augacuccagaa

SEQ ID NO: 2978475 - RNA, 16 nt, Human
augacuccagaauuuc

SEQ ID NO: 2978476 - RNA, 18 nt, Human
augacuauucaguggcua

SEQ ID NO: 2978477 - RNA, 12 nt, Human
augacccagugg

SEQ ID NO: 2978478 - RNA, 17 nt, Human
augaaaagccucuguuu

SEQ ID NO: 2978479 - RNA, 17 nt, Human
augaaaauaaucucuga

SEQ ID NO: 2978480 - RNA, 19 nt, Human
augaaaauaaucucugauu

SEQ ID NO: 2978481 - RNA, 13 nt, Human
augagccuggcaa

SEQ ID NO: 2978482 - RNA, 14 nt, Human
augagccuggcaag

SEQ ID NO: 2978483 - RNA, 23 nt, Human
aucuucuauauaauuccuguuuu

SEQ ID NO: 2978484 - RNA, 23 nt, Human
aucuucauggaauucacaaagua

SEQ ID NO: 2978485 - RNA, 22 nt, Human
aucuucauggaauucacaaagu

SEQ ID NO: 2978486 - RNA, 19 nt, Human
aucuuccaacucaaacucu

SEQ ID NO: 2978487 - RNA, 22 nt, Human
aucuuauaauuuaaaauaugcu

SEQ ID NO: 2978488 - RNA, 22 nt, Human
aucucucgugauugauaagaac

SEQ ID NO: 2978489 - RNA, 17 nt, Human
aucuugaagacuuuucu

SEQ ID NO: 2978490 - RNA, 17 nt, Human
aucuucuuuauaauucu

SEQ ID NO: 2978491 - RNA, 23 nt, Human
aucagcugcuacuacuccuguag

SEQ ID NO: 2978492 - RNA, 13 nt, Human
aucagcugcuacu

SEQ ID NO: 2978493 - RNA, 20 nt, Human
aucagccugcuccagcuguu

SEQ ID NO: 2978494 - RNA, 17 nt, Human
aucagcugcugaaacaa

SEQ ID NO: 2978495 - RNA, 19 nt, Human
aucauggagguuugaagau

SEQ ID NO: 2978496 - RNA, 11 nt, Human
aucagccuggg

SEQ ID NO: 2978497 - RNA, 20 nt, Human
aucagccugggcaaugugau

SEQ ID NO: 2978498 - RNA, 21 nt, Human
aucagccugggcaaugugaua

SEQ ID NO: 2978499 - RNA, 12 nt, Human
aucagcugcuac

SEQ ID NO: 2978500 - RNA, 16 nt, Human
auccacccaccucagc

SEQ ID NO: 2978501 - RNA, 20 nt, Human
auccacccaccucagccucc

SEQ ID NO: 2978502 - RNA, 18 nt, Human
auccacccaccucagccu

SEQ ID NO: 2978503 - RNA, 18 nt, Human
auccucauacccaccccc

SEQ ID NO: 2978504 - RNA, 19 nt, Human
auccucauacccaccccca

SEQ ID NO: 2978505 - RNA, 22 nt, Human
auccucauacccacccccaccc

SEQ ID NO: 2978506 - RNA, 15 nt, Human
aucccuacuguaauu

SEQ ID NO: 2978507 - RNA, 13 nt, Human
auccuccaggugc

SEQ ID NO: 2978508 - RNA, 14 nt, Human
auccuccaggugca

SEQ ID NO: 2978509 - RNA, 19 nt, Human
auccuccaggugcacaagc

SEQ ID NO: 2978510 - RNA, 22 nt, Human
auccuccaggugcacaagcucc

SEQ ID NO: 2978511 - RNA, 11 nt, Human
auccuccucag

SEQ ID NO: 2978512 - RNA, 14 nt, Human
auccuccucagauc

SEQ ID NO: 2978513 - RNA, 13 nt, Human
aucgaugcagugc

SEQ ID NO: 2978514 - RNA, 14 nt, Human
agucaaggcuuaga

SEQ ID NO: 2978515 - RNA, 16 nt, Human
agucaaggcuuagacc

SEQ ID NO: 2978516 - RNA, 16 nt, Human
agucaagugaaaaagg

SEQ ID NO: 2978517 - RNA, 17 nt, Human
agucaaauugugugaaa

SEQ ID NO: 2978518 - RNA, 15 nt, Human
agucaaauuguguga

SEQ ID NO: 2978519 - RNA, 13 nt, Human
agucaaauugugu

SEQ ID NO: 2978520 - RNA, 20 nt, Human
agucaagugaaaaaggagga

SEQ ID NO: 2978521 - RNA, 14 nt, Human
agucauucuucccu

SEQ ID NO: 2978522 - RNA, 13 nt, Human
agucauucuuuaa

SEQ ID NO: 2978523 - RNA, 11 nt, Human
aguccaagcau

SEQ ID NO: 2978524 - RNA, 16 nt, Human
aguccaagcauuuaga

SEQ ID NO: 2978525 - RNA, 21 nt, Human
aguccaagcauuuagauguau

SEQ ID NO: 2978526 - RNA, 18 nt, Human
agucauuauguuaauauu

SEQ ID NO: 2978527 - RNA, 23 nt, Human
agucauucagauaugauucaaau

SEQ ID NO: 2978528 - RNA, 20 nt, Human
agucauucagauaugauuca

SEQ ID NO: 2978529 - RNA, 15 nt, Human
agucauucagauaug

SEQ ID NO: 2978530 - RNA, 12 nt, Human
agucauuauguu

SEQ ID NO: 2978531 - RNA, 13 nt, Human
agugauccuccca

SEQ ID NO: 2978532 - RNA, 13 nt, Human
aguccugcccgcc

SEQ ID NO: 2978533 - RNA, 16 nt, Human
aguuguuacauuuuua

SEQ ID NO: 2978534 - RNA, 15 nt, Human
aguuguuacauuuuu

SEQ ID NO: 2978535 - RNA, 13 nt, Human
aguuguuacauuu

SEQ ID NO: 2978536 - RNA, 15 nt, Human
aguugaauuuuacau

SEQ ID NO: 2978537 - RNA, 18 nt, Human
aguuguaccgcaauguga

SEQ ID NO: 2978538 - RNA, 19 nt, Human
aguuguaccgcaaugugac

SEQ ID NO: 2978539 - RNA, 17 nt, Human
aguuacagacaaagcgu

SEQ ID NO: 2978540 - RNA, 18 nt, Human
aguuacagacaaagcgug

SEQ ID NO: 2978541 - RNA, 15 nt, Human
agugauuaccaggga

SEQ ID NO: 2978542 - RNA, 18 nt, Human
agugauuaccagggacug

SEQ ID NO: 2978543 - RNA, 21 nt, Human
agugucuuaauuaaaagaaua

SEQ ID NO: 2978544 - RNA, 23 nt, Human
agugugacaaggauugcuacugu

SEQ ID NO: 2978545 - RNA, 16 nt, Human
auauaauuccuguuuu

SEQ ID NO: 2978546 - RNA, 22 nt, Human
auauaauuccuguuuuuauuau

SEQ ID NO: 2978547 - RNA, 16 nt, Human
auaguaugguggcugg

SEQ ID NO: 2978548 - RNA, 21 nt, Human
auacuuauuuaaauagaugac

SEQ ID NO: 2978549 - RNA, 15 nt, Human
auacuuauuuaaaua

SEQ ID NO: 2978550 - RNA, 22 nt, Human
auacuuauuuaaauagaugaca

SEQ ID NO: 2978551 - RNA, 15 nt, Human
auaguaugguggcug

SEQ ID NO: 2978552 - RNA, 17 nt, Human
auauagcaagacauuau

SEQ ID NO: 2978553 - RNA, 23 nt, Human
auauagcuaggugacauauacau

SEQ ID NO: 2978554 - RNA, 22 nt, Human
auauacauacuuacaugugugu

SEQ ID NO: 2978555 - RNA, 15 nt, Human
auauacauacuuaca

SEQ ID NO: 2978556 - RNA, 16 nt, Human
auauaggaacuuaaau

SEQ ID NO: 2978557 - RNA, 11 nt, Human
auaucacuucc

SEQ ID NO: 2978558 - RNA, 18 nt, Human
auaucacuugucaauaaa

SEQ ID NO: 2978559 - RNA, 19 nt, Human
auaucccuuggacauuuua

SEQ ID NO: 2978560 - RNA, 23 nt, Human
auauccuaauaaaaaggugacca

SEQ ID NO: 2978561 - RNA, 15 nt, Human
auaucaauuuaaaaa

SEQ ID NO: 2978562 - RNA, 16 nt, Human
auaugcuuauacacuu

SEQ ID NO: 2978563 - RNA, 14 nt, Human
auaugcuuauacac

SEQ ID NO: 2978564 - RNA, 19 nt, Human
auaugcuuauacacuuaca

SEQ ID NO: 2978565 - RNA, 23 nt, Human
auaugcuucuguuuuauaauuuu

SEQ ID NO: 2978566 - RNA, 22 nt, Human
auaugccugggcagaaggaaga

SEQ ID NO: 2978567 - RNA, 19 nt, Human
auauccuaggagguaauga

SEQ ID NO: 2978568 - RNA, 19 nt, Human
auauuuauuacuguaagaa

SEQ ID NO: 2978569 - RNA, 14 nt, Human
auauuuauuacugu

SEQ ID NO: 2978570 - RNA, 18 nt, Human
auauuuauuuuaauaaug

SEQ ID NO: 2978571 - RNA, 14 nt, Human
auauucaggaagcu

SEQ ID NO: 2978572 - RNA, 16 nt, Human
auauucaggaagcuca

SEQ ID NO: 2978573 - RNA, 13 nt, Human
auauucaggaagc

SEQ ID NO: 2978574 - RNA, 13 nt, Human
auacuuauuuaaa

SEQ ID NO: 2978575 - RNA, 22 nt, Human
auacuuacauguguguauaugu

SEQ ID NO: 2978576 - RNA, 14 nt, Human
auaauuacuauguc

SEQ ID NO: 2978577 - RNA, 12 nt, Human
auaccugucccc

SEQ ID NO: 2978578 - RNA, 18 nt, Human
auaaugugaaacuggauu

SEQ ID NO: 2978579 - RNA, 21 nt, Human
auaaugugaaacuggauuaaa

SEQ ID NO: 2978580 - RNA, 19 nt, Human
auaaugugaaacuggauua

SEQ ID NO: 2978581 - RNA, 21 nt, Human
auaaguguauuuugaaauugu

SEQ ID NO: 2978582 - RNA, 13 nt, Human
auaaguguauuuu

SEQ ID NO: 2978583 - RNA, 14 nt, Human
auaagucugauuua

SEQ ID NO: 2978584 - RNA, 13 nt, Human
auaagucugauuu

SEQ ID NO: 2978585 - RNA, 11 nt, Human
auaagucugau

SEQ ID NO: 2978586 - RNA, 22 nt, Human
auaaguccucuagugaauguag

SEQ ID NO: 2978587 - RNA, 17 nt, Human
auaacagaagaaaauag

SEQ ID NO: 2978588 - RNA, 14 nt, Human
auaacagaagaaaa

SEQ ID NO: 2978589 - RNA, 21 nt, Human
auaacagaagaaaauagaauu

SEQ ID NO: 2978590 - RNA, 16 nt, Human
acgugcacgcacacug

SEQ ID NO: 2978591 - RNA, 18 nt, Human
acgcugugcugcccugcc

SEQ ID NO: 2978592 - RNA, 15 nt, Human
acgcugugcugcccu

SEQ ID NO: 2978593 - RNA, 16 nt, Human
acgcugugcugcccug

SEQ ID NO: 2978594 - RNA, 17 nt, Human
acgcugugcugcccugc

SEQ ID NO: 2978595 - RNA, 13 nt, Human
acguggcugcuuc

SEQ ID NO: 2978596 - RNA, 14 nt, Human
acguggcugcuuca

SEQ ID NO: 2978597 - RNA, 15 nt, Human
acguggcugcuucaa

SEQ ID NO: 2978598 - RNA, 11 nt, Human
acguggcugcu

SEQ ID NO: 2978599 - RNA, 16 nt, Human
acuaagagagaaugag

SEQ ID NO: 2978600 - RNA, 15 nt, Human
acuaagagagaauga

SEQ ID NO: 2978601 - RNA, 22 nt, Human
acuaaguuuuuauggcuuuugu

SEQ ID NO: 2978602 - RNA, 15 nt, Human
acuaaguuuuuaugg

SEQ ID NO: 2978603 - RNA, 17 nt, Human
acgauuucuguuuagau

SEQ ID NO: 2978604 - RNA, 14 nt, Human
acgauuucuguuua

SEQ ID NO: 2978605 - RNA, 18 nt, Human
acgccacugcacuauagc

SEQ ID NO: 2978606 - RNA, 13 nt, Human
acgauuucuguuu

SEQ ID NO: 2978607 - RNA, 12 nt, Human
acgauuucuguu

SEQ ID NO: 2978608 - RNA, 12 nt, Human
accuuggcugca

SEQ ID NO: 2978609 - RNA, 14 nt, Human
accuuggcucaagu

SEQ ID NO: 2978610 - RNA, 12 nt, Human
accuuggcucaa

SEQ ID NO: 2978611 - RNA, 16 nt, Human
accuuucaauaggaaa

SEQ ID NO: 2978612 - RNA, 14 nt, Human
accuuggcugcagg

SEQ ID NO: 2978613 - RNA, 17 nt, Human
accuuucaauaggaaaa

SEQ ID NO: 2978614 - RNA, 21 nt, Human
accuuucaauaggaaaaacug

SEQ ID NO: 2978615 - RNA, 23 nt, Human
accuuucaauaggaaaaacugau

SEQ ID NO: 2978616 - RNA, 16 nt, Human
accucugcacaagcug

SEQ ID NO: 2978617 - RNA, 18 nt, Human
accucugcacaagcugca

SEQ ID NO: 2978618 - RNA, 21 nt, Human
accucugcacaagcugcaccc

SEQ ID NO: 2978619 - RNA, 23 nt, Human
accugccccucaacucuccucca

SEQ ID NO: 2978620 - RNA, 20 nt, Human
accugccccucaacucuccu

SEQ ID NO: 2978621 - RNA, 16 nt, Human
acucuaccugcacacu

SEQ ID NO: 2978622 - RNA, 21 nt, Human
acucuacccucuuagaaaaac

SEQ ID NO: 2978623 - RNA, 13 nt, Human
acucuacccucuu

SEQ ID NO: 2978624 - RNA, 18 nt, Human
acucuacccucuuagaaa

SEQ ID NO: 2978625 - RNA, 22 nt, Human
acucuauaacaaaggauacuua

SEQ ID NO: 2978626 - RNA, 14 nt, Human
acucuaucaaguau

SEQ ID NO: 2978627 - RNA, 16 nt, Human
acucuaucaaguauua

SEQ ID NO: 2978628 - RNA, 16 nt, Human
acucugugucaggugg

SEQ ID NO: 2978629 - RNA, 11 nt, Human
acucuuaaaac

SEQ ID NO: 2978630 - RNA, 18 nt, Human
acucuuaaaacccaagug

SEQ ID NO: 2978631 - RNA, 13 nt, Human
acucccuuucaac

SEQ ID NO: 2978632 - RNA, 12 nt, Human
acucccuuucaa

SEQ ID NO: 2978633 - RNA, 14 nt, Human
acuagcuauggugu

SEQ ID NO: 2978634 - RNA, 13 nt, Human
acuccccugcugg

SEQ ID NO: 2978635 - RNA, 17 nt, Human
acuccccugcugggugu

SEQ ID NO: 2978636 - RNA, 14 nt, Human
acucccccaggugg

SEQ ID NO: 2978637 - RNA, 17 nt, Human
acucaaacucuuaaaac

SEQ ID NO: 2978638 - RNA, 16 nt, Human
acucaaacucuuaaaa

SEQ ID NO: 2978639 - RNA, 11 nt, Human
acuauaaugua

SEQ ID NO: 2978640 - RNA, 18 nt, Human
acucaaaagcugggcagg

SEQ ID NO: 2978641 - RNA, 13 nt, Human
acuuauuuaaaua

SEQ ID NO: 2978642 - RNA, 18 nt, Human
acuuauuuaaauagauga

SEQ ID NO: 2978643 - RNA, 19 nt, Human
acuucacauauugauuucc

SEQ ID NO: 2978644 - RNA, 20 nt, Human
acuuauuguagcauccugga

SEQ ID NO: 2978645 - RNA, 23 nt, Human
acuuauuguagcauccuggaaua

SEQ ID NO: 2978646 - RNA, 14 nt, Human
acuguuuagaugaa

SEQ ID NO: 2978647 - RNA, 19 nt, Human
acuuguaaaggaauuuaaa

SEQ ID NO: 2978648 - RNA, 20 nt, Human
acuuguaaaggaauuuaaaa

SEQ ID NO: 2978649 - RNA, 18 nt, Human
acuuguaaaggaauuuaa

SEQ ID NO: 2978650 - RNA, 15 nt, Human
acuuggucugugaga

SEQ ID NO: 2978651 - RNA, 13 nt, Human
acuuggucuguga

SEQ ID NO: 2978652 - RNA, 14 nt, Human
acuuggucugugag

SEQ ID NO: 2978653 - RNA, 18 nt, Human
acuucugccauauucugu

SEQ ID NO: 2978654 - RNA, 12 nt, Human
acugucuucagu

SEQ ID NO: 2978655 - RNA, 12 nt, Human
acuggaacucuc

SEQ ID NO: 2978656 - RNA, 14 nt, Human
acuggaagcacagc

SEQ ID NO: 2978657 - RNA, 15 nt, Human
acuggaagcacagcu

SEQ ID NO: 2978658 - RNA, 14 nt, Human
acuggagaaaaugg

SEQ ID NO: 2978659 - RNA, 16 nt, Human
acuggguguaaacaca

SEQ ID NO: 2978660 - RNA, 17 nt, Human
acuggguguaaacacau

SEQ ID NO: 2978661 - RNA, 22 nt, Human
acuuuuauaaacuuuaccuuuu

SEQ ID NO: 2978662 - RNA, 19 nt, Human
acuuuuauaaacuuuaccu

SEQ ID NO: 2978663 - RNA, 15 nt, Human
acuuuuauaaacuuu

SEQ ID NO: 2978664 - RNA, 20 nt, Human
acuuuuccguuucagcggaa

SEQ ID NO: 2978665 - RNA, 21 nt, Human
agaaaaguugaauuuuacaug

SEQ ID NO: 2978666 - RNA, 18 nt, Human
agaaaaguugaauuuuac

SEQ ID NO: 2978667 - RNA, 15 nt, Human
agaaaaguuuauaaa

SEQ ID NO: 2978668 - RNA, 22 nt, Human
agaaaauggacguguuaugacu

SEQ ID NO: 2978669 - RNA, 23 nt, Human
agaaaauggacguguuaugacuc

SEQ ID NO: 2978670 - RNA, 15 nt, Human
agaaaauggacgugu

SEQ ID NO: 2978671 - RNA, 20 nt, Human
agaaaauggacguguuauga

SEQ ID NO: 2978672 - RNA, 23 nt, Human
agaaaauggaagacagcucuuau

SEQ ID NO: 2978673 - RNA, 23 nt, Human
acuuuccuucauucaacccaccu

SEQ ID NO: 2978674 - RNA, 23 nt, Human
acuuuguucuggcucuuccaggc

SEQ ID NO: 2978675 - RNA, 18 nt, Human
agaaauaaaguuucuguu

SEQ ID NO: 2978676 - RNA, 15 nt, Human
agaaauaaaguuucu

SEQ ID NO: 2978677 - RNA, 23 nt, Human
agaaaggaggggauagagagaga

SEQ ID NO: 2978678 - RNA, 20 nt, Human
agaaaggaggggauagagag

SEQ ID NO: 2978679 - RNA, 11 nt, Human
acauuaaauga

SEQ ID NO: 2978680 - RNA, 12 nt, Human
acauuaaaugac

SEQ ID NO: 2978681 - RNA, 13 nt, Human
acauuaaagguac

SEQ ID NO: 2978682 - RNA, 13 nt, Human
acauguuacaaca

SEQ ID NO: 2978683 - RNA, 21 nt, Human
acauguuuuucuucucccuca

SEQ ID NO: 2978684 - RNA, 18 nt, Human
acaugcaaggucauuuuu

SEQ ID NO: 2978685 - RNA, 19 nt, Human
acaugcaaggucauuuuuu

SEQ ID NO: 2978686 - RNA, 20 nt, Human
acaugcacagcuaacaugga

SEQ ID NO: 2978687 - RNA, 23 nt, Human
acauaaacaagaccacguuucua

SEQ ID NO: 2978688 - RNA, 19 nt, Human
acaucagcacgauuucugu

SEQ ID NO: 2978689 - RNA, 21 nt, Human
acaucagcacgauuucuguuu

SEQ ID NO: 2978690 - RNA, 20 nt, Human
acaucagcacgauuucuguu

SEQ ID NO: 2978691 - RNA, 22 nt, Human
acaucagcacgauuucuguuua

SEQ ID NO: 2978692 - RNA, 16 nt, Human
acauuugcucauggaa

SEQ ID NO: 2978693 - RNA, 18 nt, Human
acauuugcucauggaauu

SEQ ID NO: 2978694 - RNA, 14 nt, Human
acauuuguauaaaa

SEQ ID NO: 2978695 - RNA, 21 nt, Human
acauuuggguuacuauuucuu

SEQ ID NO: 2978696 - RNA, 18 nt, Human
acauuuggguuacuauuu

SEQ ID NO: 2978697 - RNA, 14 nt, Human
accacuacauucug

SEQ ID NO: 2978698 - RNA, 19 nt, Human
accacguuucuaaaggcua

SEQ ID NO: 2978699 - RNA, 15 nt, Human
accacguuucuaaag

SEQ ID NO: 2978700 - RNA, 13 nt, Human
accagcagccugg

SEQ ID NO: 2978701 - RNA, 14 nt, Human
accagcagccugga

SEQ ID NO: 2978702 - RNA, 17 nt, Human
accagcagccuggaccc

SEQ ID NO: 2978703 - RNA, 15 nt, Human
acccacaagaaauga

SEQ ID NO: 2978704 - RNA, 14 nt, Human
acccaucuuaaaaa

SEQ ID NO: 2978705 - RNA, 13 nt, Human
acccaagggccug

SEQ ID NO: 2978706 - RNA, 16 nt, Human
acccaagggccuggcc

SEQ ID NO: 2978707 - RNA, 16 nt, Human
acccaaguccaagcau

SEQ ID NO: 2978708 - RNA, 17 nt, Human
acccaugcugcccugug

SEQ ID NO: 2978709 - RNA, 18 nt, Human
acccaugcugcccuguga

SEQ ID NO: 2978710 - RNA, 19 nt, Human
acccaugcugcccugugag

SEQ ID NO: 2978711 - RNA, 16 nt, Human
acccaugcugcccugu

SEQ ID NO: 2978712 - RNA, 15 nt, Human
accccggccaccugc

SEQ ID NO: 2978713 - RNA, 14 nt, Human
accaucaugucugg

SEQ ID NO: 2978714 - RNA, 18 nt, Human
accaucccugaaggcccc

SEQ ID NO: 2978715 - RNA, 16 nt, Human
accaucccugaaggcc

SEQ ID NO: 2978716 - RNA, 17 nt, Human
accaucaugucuggcua

SEQ ID NO: 2978717 - RNA, 16 nt, Human
accaucaugucuggcu

SEQ ID NO: 2978718 - RNA, 21 nt, Human
accaucccugaaggccccgcc

SEQ ID NO: 2978719 - RNA, 22 nt, Human
accaucccugaaggccccgccc

SEQ ID NO: 2978720 - RNA, 20 nt, Human
accccucaacaccucugcac

SEQ ID NO: 2978721 - RNA, 18 nt, Human
acacuguccuauuauauu

SEQ ID NO: 2978722 - RNA, 13 nt, Human
acagccagacugg

SEQ ID NO: 2978723 - RNA, 15 nt, Human
acagccagacuggca

SEQ ID NO: 2978724 - RNA, 16 nt, Human
acagccagacuggcac

SEQ ID NO: 2978725 - RNA, 19 nt, Human
acagccacggccaggccag

SEQ ID NO: 2978726 - RNA, 15 nt, Human
acagccaugauucuu

SEQ ID NO: 2978727 - RNA, 15 nt, Human
acagcaguugaaaag

SEQ ID NO: 2978728 - RNA, 18 nt, Human
acagcaguugaaaagacu

SEQ ID NO: 2978729 - RNA, 21 nt, Human
acagcagugagacuggggcca

SEQ ID NO: 2978730 - RNA, 14 nt, Human
acagcagugagacu

SEQ ID NO: 2978731 - RNA, 19 nt, Human
acagagucucacuguugcc

SEQ ID NO: 2978732 - RNA, 17 nt, Human
acagagucucacuguug

SEQ ID NO: 2978733 - RNA, 15 nt, Human
acagcaggcugccag

SEQ ID NO: 2978734 - RNA, 20 nt, Human
acagcaggcugccagugccu

SEQ ID NO: 2978735 - RNA, 18 nt, Human
acagcaggcugccagugc

SEQ ID NO: 2978736 - RNA, 16 nt, Human
acagcaggcugccagu

SEQ ID NO: 2978737 - RNA, 14 nt, Human
acagagucucacug

SEQ ID NO: 2978738 - RNA, 12 nt, Human
acagagucucac

SEQ ID NO: 2978739 - RNA, 22 nt, Human
acagaggggguggccucccaac

SEQ ID NO: 2978740 - RNA, 21 nt, Human
acagaggggguggccucccaa

SEQ ID NO: 2978741 - RNA, 20 nt, Human
acagcucugcauacucauua

SEQ ID NO: 2978742 - RNA, 14 nt, Human
acagcugccuggga

SEQ ID NO: 2978743 - RNA, 13 nt, Human
acagcugccuggg

SEQ ID NO: 2978744 - RNA, 23 nt, Human
acagcugccugggaucccucauc

SEQ ID NO: 2978745 - RNA, 14 nt, Human
acagcuccuucugu

SEQ ID NO: 2978746 - RNA, 13 nt, Human
acagcuccuucug

SEQ ID NO: 2978747 - RNA, 12 nt, Human
acagcuccuucu

SEQ ID NO: 2978748 - RNA, 16 nt, Human
acaggcaagcaccucc

SEQ ID NO: 2978749 - RNA, 15 nt, Human
acaggcaagcaccuc

SEQ ID NO: 2978750 - RNA, 18 nt, Human
acaggcaagcaccuccug

SEQ ID NO: 2978751 - RNA, 23 nt, Human
acaggugugaaccaccacaccca

SEQ ID NO: 2978752 - RNA, 20 nt, Human
acaggugugaaccaccacac

SEQ ID NO: 2978753 - RNA, 13 nt, Human
acacaaagcuuuu

SEQ ID NO: 2978754 - RNA, 18 nt, Human
acacaaacgggcucagca

SEQ ID NO: 2978755 - RNA, 15 nt, Human
acaauuuauuauggc

SEQ ID NO: 2978756 - RNA, 16 nt, Human
acaauuuauuauggca

SEQ ID NO: 2978757 - RNA, 12 nt, Human
acaccagagccc

SEQ ID NO: 2978758 - RNA, 21 nt, Human
acaccacuacauucuguuaau

SEQ ID NO: 2978759 - RNA, 12 nt, Human
acacagcucugu

SEQ ID NO: 2978760 - RNA, 11 nt, Human
acacagcucug

SEQ ID NO: 2978761 - RNA, 15 nt, Human
acacuaaccacgcug

SEQ ID NO: 2978762 - RNA, 14 nt, Human
acacuaaccacgcu

SEQ ID NO: 2978763 - RNA, 15 nt, Human
acacggacacucaaa

SEQ ID NO: 2978764 - RNA, 20 nt, Human
acaagucagucauucagaua

SEQ ID NO: 2978765 - RNA, 19 nt, Human
acaaaauggaauacucuua

SEQ ID NO: 2978766 - RNA, 15 nt, Human
acaaaauggaauacu

SEQ ID NO: 2978767 - RNA, 20 nt, Human
acaaaauguaggguuauaau

SEQ ID NO: 2978768 - RNA, 20 nt, Human
acaaaauggaauacucuuau

SEQ ID NO: 2978769 - RNA, 15 nt, Human
acaaacgggcucagc

SEQ ID NO: 2978770 - RNA, 21 nt, Human
acaaaccuguuucugcagcca

SEQ ID NO: 2978771 - RNA, 13 nt, Human
acaacuauauugu

SEQ ID NO: 2978772 - RNA, 13 nt, Human
acaaagacugagu

SEQ ID NO: 2978773 - RNA, 18 nt, Human
aaagaugaaggucuguuu

SEQ ID NO: 2978774 - RNA, 17 nt, Human
aaagaugaaaauauuug

SEQ ID NO: 2978775 - RNA, 13 nt, Human
aaagaugaaaaua

SEQ ID NO: 2978776 - RNA, 16 nt, Human
aaagaugaaaauauuu

SEQ ID NO: 2978777 - RNA, 19 nt, Human
aaacugccagcaacgcagg

SEQ ID NO: 2978778 - RNA, 16 nt, Human
aaacugacucuuaaga

SEQ ID NO: 2978779 - RNA, 14 nt, Human
aaacugccagcaac

SEQ ID NO: 2978780 - RNA, 15 nt, Human
aaacugccagcaacg

SEQ ID NO: 2978781 - RNA, 17 nt, Human
aaacugacucuuaagaa

SEQ ID NO: 2978782 - RNA, 11 nt, Human
aaagagguuuu

SEQ ID NO: 2978783 - RNA, 18 nt, Human
aaacacuguucucugccc

SEQ ID NO: 2978784 - RNA, 13 nt, Human
aaaauucagugga

SEQ ID NO: 2978785 - RNA, 15 nt, Human
aaaacacauuuuucu

SEQ ID NO: 2978786 - RNA, 13 nt, Human
aaaacacauuuuu

SEQ ID NO: 2978787 - RNA, 19 nt, Human
aaacacuguucucugcccu

SEQ ID NO: 2978788 - RNA, 22 nt, Human
aaacacuguucucugcccucca

SEQ ID NO: 2978789 - RNA, 17 nt, Human
aaacagaugaaaagccu

SEQ ID NO: 2978790 - RNA, 14 nt, Human
aaacagaugaaaag

SEQ ID NO: 2978791 - RNA, 18 nt, Human
aaaucaaauaugcaaagc

SEQ ID NO: 2978792 - RNA, 19 nt, Human
aaaucaaauaugcaaagca

SEQ ID NO: 2978793 - RNA, 16 nt, Human
aaaucaaauaugcaaa

SEQ ID NO: 2978794 - RNA, 22 nt, Human
aaaucuucauggaauucacaaa

SEQ ID NO: 2978795 - RNA, 20 nt, Human
aaaucuucauggaauucaca

SEQ ID NO: 2978796 - RNA, 16 nt, Human
aaaucuucauggaauu

SEQ ID NO: 2978797 - RNA, 21 nt, Human
aaauggacguguuaugacucc

SEQ ID NO: 2978798 - RNA, 22 nt, Human
aaauggacguguuaugacucca

SEQ ID NO: 2978799 - RNA, 20 nt, Human
aaauggacguguuaugacuc

SEQ ID NO: 2978800 - RNA, 16 nt, Human
aaauggaaaugggcag

SEQ ID NO: 2978801 - RNA, 18 nt, Human
aaauggaagacagcucuu

SEQ ID NO: 2978802 - RNA, 20 nt, Human
aaauagaauugacauugaaa

SEQ ID NO: 2978803 - RNA, 16 nt, Human
aaauagaaaguugcaa

SEQ ID NO: 2978804 - RNA, 22 nt, Human
aaauagaaaguugcaaggcaaa

SEQ ID NO: 2978805 - RNA, 12 nt, Human
aaauaacaauga

SEQ ID NO: 2978806 - RNA, 17 nt, Human
aaauaaacgucuuaaau

SEQ ID NO: 2978807 - RNA, 11 nt, Human
aaagugcuggg

SEQ ID NO: 2978808 - RNA, 14 nt, Human
aaagugcugggauu

SEQ ID NO: 2978809 - RNA, 15 nt, Human
aacaaaggauacuua

SEQ ID NO: 2978810 - RNA, 19 nt, Human
aacaaaggauacuuauuua

SEQ ID NO: 2978811 - RNA, 14 nt, Human
aacaacgaaagaag

SEQ ID NO: 2978812 - RNA, 15 nt, Human
aacacgagcaggcua

SEQ ID NO: 2978813 - RNA, 19 nt, Human
aacaccucugcacaagcug

SEQ ID NO: 2978814 - RNA, 19 nt, Human
aacacauuuuucuuaggga

SEQ ID NO: 2978815 - RNA, 15 nt, Human
aacaaaauagaaagu

SEQ ID NO: 2978816 - RNA, 14 nt, Human
aacccuggugacca

SEQ ID NO: 2978817 - RNA, 21 nt, Human
aacauguaauuaaguacuaug

SEQ ID NO: 2978818 - RNA, 14 nt, Human
aacauguaauuaag

SEQ ID NO: 2978819 - RNA, 23 nt, Human
aacauguaauuaaguacuaugua

SEQ ID NO: 2978820 - RNA, 22 nt, Human
aaccacucuaucaaguauuaua

SEQ ID NO: 2978821 - RNA, 16 nt, Human
aacuuuuuauauucuc

SEQ ID NO: 2978822 - RNA, 19 nt, Human
aacuuuuauaaacuuuacc

SEQ ID NO: 2978823 - RNA, 16 nt, Human
aacuuuuauaaacuuu

SEQ ID NO: 2978824 - RNA, 13 nt, Human
aagaaauguaagg

SEQ ID NO: 2978825 - RNA, 14 nt, Human
aagaaauguaaggg

SEQ ID NO: 2978826 - RNA, 17 nt, Human
aacuuugaccucugcag

SEQ ID NO: 2978827 - RNA, 14 nt, Human
aacuuugaccucug

SEQ ID NO: 2978828 - RNA, 13 nt, Human
aacuuugaccucu

SEQ ID NO: 2978829 - RNA, 20 nt, Human
aacuuugaccucugcagcaa

SEQ ID NO: 2978830 - RNA, 19 nt, Human
aacuuugaccucugcagca

SEQ ID NO: 2978831 - RNA, 15 nt, Human
aacuuuuauaaacuu

SEQ ID NO: 2978832 - RNA, 12 nt, Human
aacuuuuauaaa

SEQ ID NO: 2978833 - RNA, 23 nt, Human
aacugacacaugcugaacaucac

SEQ ID NO: 2978834 - RNA, 23 nt, Human
aacugaucauguuuaugagaaac

SEQ ID NO: 2978835 - RNA, 20 nt, Human
aacugaucauguuuaugaga

SEQ ID NO: 2978836 - RNA, 18 nt, Human
aacugaucauguuuauga

SEQ ID NO: 2978837 - RNA, 16 nt, Human
aacugaucauguuuau

SEQ ID NO: 2978838 - RNA, 14 nt, Human
aacugaucauguuu

SEQ ID NO: 2978839 - RNA, 17 nt, Human
aacugauuuuuuuuucc

SEQ ID NO: 2978840 - RNA, 19 nt, Human
aacugauuuuuuuuuccuu

SEQ ID NO: 2978841 - RNA, 19 nt, Human
aacuuauggggccaaaaua

SEQ ID NO: 2978842 - RNA, 17 nt, Human
aacuuaaauaaugugaa

SEQ ID NO: 2978843 - RNA, 20 nt, Human
aacucaccuggcaucuuaca

SEQ ID NO: 2978844 - RNA, 16 nt, Human
aacucaccugccccuc

SEQ ID NO: 2978845 - RNA, 15 nt, Human
aacucaccugccccu

SEQ ID NO: 2978846 - RNA, 12 nt, Human
aacucaccccag

SEQ ID NO: 2978847 - RNA, 15 nt, Human
aacugaacuucagag

SEQ ID NO: 2978848 - RNA, 13 nt, Human
aacuucacauauu

SEQ ID NO: 2978849 - RNA, 19 nt, Human
aaucacacugucuucugau

SEQ ID NO: 2978850 - RNA, 13 nt, Human
aaucacaauacau

SEQ ID NO: 2978851 - RNA, 15 nt, Human
aaucaagaaacuuaa

SEQ ID NO: 2978852 - RNA, 16 nt, Human
aauauuauguuaaaac

SEQ ID NO: 2978853 - RNA, 21 nt, Human
aauauaggaacuuaaauaaug

SEQ ID NO: 2978854 - RNA, 20 nt, Human
aauauaggaacuuaaauaau

SEQ ID NO: 2978855 - RNA, 18 nt, Human
aauauaggaacuuaaaua

SEQ ID NO: 2978856 - RNA, 12 nt, Human
aaugaagauacu

SEQ ID NO: 2978857 - RNA, 17 nt, Human
aaugauaacuggaaacu

SEQ ID NO: 2978858 - RNA, 20 nt, Human
aaugauaacuggaaacuuca

SEQ ID NO: 2978859 - RNA, 17 nt, Human
aaugaagauacugaaau

SEQ ID NO: 2978860 - RNA, 21 nt, Human
aaugaugauccuaggcauuug

SEQ ID NO: 2978861 - RNA, 23 nt, Human
aaugaaccacaucuugcucugcu

SEQ ID NO: 2978862 - RNA, 17 nt, Human
aaugaaccacaucuugc

SEQ ID NO: 2978863 - RNA, 16 nt, Human
aaugaaccacaucuug

SEQ ID NO: 2978864 - RNA, 22 nt, Human
aaucugcuuuuuaaagaaugcu

SEQ ID NO: 2978865 - RNA, 13 nt, Human
aauccauacauuu

SEQ ID NO: 2978866 - RNA, 13 nt, Human
aaucuccaaaaua

SEQ ID NO: 2978867 - RNA, 14 nt, Human
aaucuccaaaauaa

SEQ ID NO: 2978868 - RNA, 19 nt, Human
aaugaugccaugaggaaca

SEQ ID NO: 2978869 - RNA, 19 nt, Human
aaugucaguuguuauuuau

SEQ ID NO: 2978870 - RNA, 20 nt, Human
aaugucaguuguuauuuauu

SEQ ID NO: 2978871 - RNA, 23 nt, Human
aaugucaguucugauauggaagc

SEQ ID NO: 2978872 - RNA, 18 nt, Human
aaugucaguucugauaug

SEQ ID NO: 2978873 - RNA, 22 nt, Human
aaugucuaguuguaacaccaug

SEQ ID NO: 2978874 - RNA, 17 nt, Human
aaugucagugugacuga

SEQ ID NO: 2978875 - RNA, 21 nt, Human
aaugucagugugacugaucuc

SEQ ID NO: 2978876 - RNA, 22 nt, Human
aaugucaguuguuauuuauuga

SEQ ID NO: 2978877 - RNA, 20 nt, Human
aaugucucuuuaaugucaca

SEQ ID NO: 2978878 - RNA, 15 nt, Human
aaugucagugugacu

SEQ ID NO: 2978879 - RNA, 16 nt, Human
aaugucagugugacug

SEQ ID NO: 2978880 - RNA, 13 nt, Human
aaugucaguguga

SEQ ID NO: 2978881 - RNA, 14 nt, Human
aaugguaguuuuac

SEQ ID NO: 2978882 - RNA, 14 nt, Human
aaugguagcauuuu

SEQ ID NO: 2978883 - RNA, 21 nt, Human
aaugguagcauuuuaaacaaa

SEQ ID NO: 2978884 - RNA, 19 nt, Human
aaugguagcauuuuaaaca

SEQ ID NO: 2978885 - RNA, 16 nt, Human
aaugguagcauuuuaa

SEQ ID NO: 2978886 - RNA, 15 nt, Human
aaugggcagagcaga

SEQ ID NO: 2978887 - RNA, 13 nt, Human
aaugggcagagca

SEQ ID NO: 2978888 - RNA, 18 nt, Human
aauguuugccucugccuc

SEQ ID NO: 2978889 - RNA, 19 nt, Human
aauguuugccucugccucu

SEQ ID NO: 2978890 - RNA, 18 nt, Human
aauuaaaacacaacaucu

SEQ ID NO: 2978891 - RNA, 18 nt, Human
aauuaguggcacuugcuu

SEQ ID NO: 2978892 - RNA, 20 nt, Human
aauuaguuuuauaugcuucu

SEQ ID NO: 2978893 - RNA, 17 nt, Human
aauuaguuuuauaugcu

SEQ ID NO: 2978894 - RNA, 14 nt, Human
aauuaguuuuauau

SEQ ID NO: 2978895 - RNA, 20 nt, Human
aaguccccucuccuccacau

SEQ ID NO: 2978896 - RNA, 21 nt, Human
aaguccccucuccuccacauu

SEQ ID NO: 2978897 - RNA, 16 nt, Human
aagucuuagauguaua

SEQ ID NO: 2978898 - RNA, 16 nt, Human
aaguaucccuacugua

SEQ ID NO: 2978899 - RNA, 11 nt, Human
aaguacuucuu

SEQ ID NO: 2978900 - RNA, 19 nt, Human
aaguaucaaguauagaaaa

SEQ ID NO: 2978901 - RNA, 18 nt, Human
aaguaucaaguauagaaa

SEQ ID NO: 2978902 - RNA, 17 nt, Human
aaguaucaaguauagaa

SEQ ID NO: 2978903 - RNA, 21 nt, Human
aaguaucaaguauagaaaauc

SEQ ID NO: 2978904 - RNA, 11 nt, Human
aaggugggagg

SEQ ID NO: 2978905 - RNA, 16 nt, Human
aagguuaauaaaguaa

SEQ ID NO: 2978906 - RNA, 15 nt, Human
aagguuaauaaagua

SEQ ID NO: 2978907 - RNA, 20 nt, Human
aagguuaauguucaucaucc

SEQ ID NO: 2978908 - RNA, 22 nt, Human
aagugcugggauuacaggugug

SEQ ID NO: 2978909 - RNA, 19 nt, Human
aauaaaauggguuuuacug

SEQ ID NO: 2978910 - RNA, 16 nt, Human
aauaaacgucuuaaau

SEQ ID NO: 2978911 - RNA, 17 nt, Human
aauaaacgucuuaaaua

SEQ ID NO: 2978912 - RNA, 14 nt, Human
aauaaguguauuuu

SEQ ID NO: 2978913 - RNA, 14 nt, Human
aauaaaauggguuu

SEQ ID NO: 2978914 - RNA, 22 nt, Human
aaguuguaggcauaaagucagg

SEQ ID NO: 2978915 - RNA, 21 nt, Human
aauaauccuaaacauaugaau

SEQ ID NO: 2978916 - RNA, 16 nt, Human
aauaaugugaaacugg

SEQ ID NO: 2978917 - RNA, 13 nt, Human
aagaaauuugugg

SEQ ID NO: 2978918 - RNA, 16 nt, Human
aagauuuaccacuugu

SEQ ID NO: 2978919 - RNA, 13 nt, Human
aagccagauuuuc

SEQ ID NO: 2978920 - RNA, 22 nt, Human
aagcagaccauuggggcuccca

SEQ ID NO: 2978921 - RNA, 23 nt, Human
aagcagaccauuggggcucccag

SEQ ID NO: 2978922 - RNA, 14 nt, Human
aagcagaggaagga

SEQ ID NO: 2978923 - RNA, 18 nt, Human
aagccauaauuguucuua

SEQ ID NO: 2978924 - RNA, 12 nt, Human
aagcguggugga

SEQ ID NO: 2978925 - RNA, 22 nt, Human
aagcugcacccucaggcaggug

SEQ ID NO: 2978926 - RNA, 21 nt, Human
aagcugcacccucaggcaggu

SEQ ID NO: 2978927 - RNA, 20 nt, Human
aagcugcacccucaggcagg

SEQ ID NO: 2978928 - RNA, 18 nt, Human
aaggacauugcggacagc

SEQ ID NO: 2978929 - RNA, 13 nt, Human
aagcugggcaggu

SEQ ID NO: 2978930 - RNA, 11 nt, Human
aagcugggcag

SEQ ID NO: 2978931 - RNA, 17 nt, Human
aaggcaaggcugucaau

SEQ ID NO: 2978932 - RNA, 18 nt, Human
aaggcaaggcugucaauu

SEQ ID NO: 2978933 - RNA, 16 nt, Human
aaggcaaggcugucaa

SEQ ID NO: 2978934 - RNA, 17 nt, Human
auucucagcagagugcu

SEQ ID NO: 2978935 - RNA, 19 nt, Human
auucuccaccugccaggga

SEQ ID NO: 2978936 - RNA, 20 nt, Human
auucuccaccugccagggac

SEQ ID NO: 2978937 - RNA, 15 nt, Human
auucuauguuaauau

SEQ ID NO: 2978938 - RNA, 18 nt, Human
auucuauguuaauauuuu

SEQ ID NO: 2978939 - RNA, 12 nt, Human
auucuauaauuu

SEQ ID NO: 2978940 - RNA, 21 nt, Human
auucuccaccugccagggaca

SEQ ID NO: 2978941 - RNA, 13 nt, Human
auucuccugccuc

SEQ ID NO: 2978942 - RNA, 14 nt, Human
auucuccugccuca

SEQ ID NO: 2978943 - RNA, 11 nt, Human
auucuccugcc

SEQ ID NO: 2978944 - RNA, 17 nt, Human
auucuccugccucagcc

SEQ ID NO: 2978945 - RNA, 15 nt, Human
auucuccugccucag

SEQ ID NO: 2978946 - RNA, 19 nt, Human
auucuccugccucagccuc

SEQ ID NO: 2978947 - RNA, 20 nt, Human
auucuccugccucagccucc

SEQ ID NO: 2978948 - RNA, 16 nt, Human
auucuccuuguguuac

SEQ ID NO: 2978949 - RNA, 17 nt, Human
auuauauagcaguaaaa

SEQ ID NO: 2978950 - RNA, 14 nt, Human
auucaggaagcuca

SEQ ID NO: 2978951 - RNA, 17 nt, Human
auucaggaagcucaggg

SEQ ID NO: 2978952 - RNA, 19 nt, Human
auucaggaagcucagggcc

SEQ ID NO: 2978953 - RNA, 20 nt, Human
auucaggaagcucagggccu

SEQ ID NO: 2978954 - RNA, 18 nt, Human
auucagauaugauucaaa

SEQ ID NO: 2978955 - RNA, 19 nt, Human
auucaguaauaacucuacc

SEQ ID NO: 2978956 - RNA, 15 nt, Human
auucaguaauaacuc

SEQ ID NO: 2978957 - RNA, 15 nt, Human
auucccaagcucugc

SEQ ID NO: 2978958 - RNA, 14 nt, Human
auucccaagcucug

SEQ ID NO: 2978959 - RNA, 16 nt, Human
auucccaagcucugcu

SEQ ID NO: 2978960 - RNA, 17 nt, Human
auucccugauuuaauau

SEQ ID NO: 2978961 - RNA, 20 nt, Human
auucagauaugauucaaaug

SEQ ID NO: 2978962 - RNA, 16 nt, Human
uuuugccaauuugcac

SEQ ID NO: 2978963 - RNA, 19 nt, Human
uuuugccaauuugcacauu

SEQ ID NO: 2978964 - RNA, 18 nt, Human
uuuugccaauuugcacau

SEQ ID NO: 2978965 - RNA, 23 nt, Human
uuuugccauguuggccaggcugg

SEQ ID NO: 2978966 - RNA, 15 nt, Human
uuuugcauauugcau

SEQ ID NO: 2978967 - RNA, 18 nt, Human
uuuugcauauugcauacu

SEQ ID NO: 2978968 - RNA, 18 nt, Human
uuuugcaaauaaguguau

SEQ ID NO: 2978969 - RNA, 17 nt, Human
uuuugauccaagcuggu

SEQ ID NO: 2978970 - RNA, 17 nt, Human
uuuugagugccuuacac

SEQ ID NO: 2978971 - RNA, 17 nt, Human
uuuuuauauuugaaaua

SEQ ID NO: 2978972 - RNA, 19 nt, Human
uuuuuauauuugaaauauu

SEQ ID NO: 2978973 - RNA, 20 nt, Human
uuuuuaucgucacugcuuaa

SEQ ID NO: 2978974 - RNA, 12 nt, Human
uuuuuauggcuu

SEQ ID NO: 2978975 - RNA, 11 nt, Human
uuuuuacuaau

SEQ ID NO: 2978976 - RNA, 22 nt, Human
uuuuuagacagagucucacugu

SEQ ID NO: 2978977 - RNA, 21 nt, Human
uuuuguuccacaaguuaaaua

SEQ ID NO: 2978978 - RNA, 15 nt, Human
uuuuguuccacaagu

SEQ ID NO: 2978979 - RNA, 20 nt, Human
uuuugugcauuaucuagaua

SEQ ID NO: 2978980 - RNA, 17 nt, Human
uuuugugcauuaucuag

SEQ ID NO: 2978981 - RNA, 19 nt, Human
uuuuugugaaaagcuccau

SEQ ID NO: 2978982 - RNA, 20 nt, Human
uuuuuguagagccagggucu

SEQ ID NO: 2978983 - RNA, 19 nt, Human
uuuuuguagagccaggguc

SEQ ID NO: 2978984 - RNA, 23 nt, Human
auuaaguaaugauaacuggaaac

SEQ ID NO: 2978985 - RNA, 21 nt, Human
auuaaguaaugauaacuggaa

SEQ ID NO: 2978986 - RNA, 21 nt, Human
uuuuuauggcuuuugugcauu

SEQ ID NO: 2978987 - RNA, 20 nt, Human
uuuuuauggcuuuugugcau

SEQ ID NO: 2978988 - RNA, 22 nt, Human
uuuuuauggcuuuugugcauua

SEQ ID NO: 2978989 - RNA, 14 nt, Human
auuaaguacuaugu

SEQ ID NO: 2978990 - RNA, 21 nt, Human
auuacaguggggaaugaagau

SEQ ID NO: 2978991 - RNA, 18 nt, Human
auuacauuuguauaaaau

SEQ ID NO: 2978992 - RNA, 17 nt, Human
auuacauuuguauaaaa

SEQ ID NO: 2978993 - RNA, 12 nt, Human
auuaccagggac

SEQ ID NO: 2978994 - RNA, 16 nt, Human
auuacauuuguauaaa

SEQ ID NO: 2978995 - RNA, 14 nt, Human
auguguucuauuca

SEQ ID NO: 2978996 - RNA, 13 nt, Human
auguuaauauuuc

SEQ ID NO: 2978997 - RNA, 13 nt, Human
auguuaauauuuu

SEQ ID NO: 2978998 - RNA, 22 nt, Human
auguuaauauuuuagguguaaa

SEQ ID NO: 2978999 - RNA, 18 nt, Human
auguucaucaaugaauga

SEQ ID NO: 2979000 - RNA, 12 nt, Human
auguugcccagg

SEQ ID NO: 2979001 - RNA, 17 nt, Human
auguugcccaggcaggu

SEQ ID NO: 2979002 - RNA, 16 nt, Human
auguugcccaggcagg

SEQ ID NO: 2979003 - RNA, 20 nt, Human
auguugcccaggcaggucuu

SEQ ID NO: 2979004 - RNA, 20 nt, Human
auguggaguucaucuugaau

SEQ ID NO: 2979005 - RNA, 24 nt, Human
auguggaguucaucuugaauugua

SEQ ID NO: 2979006 - RNA, 14 nt, Human
uuuuaauaauguuu

SEQ ID NO: 2979007 - RNA, 13 nt, Human
uuuuaauaauguu

SEQ ID NO: 2979008 - RNA, 12 nt, Human
uuuuaauaaugu

SEQ ID NO: 2979009 - RNA, 20 nt, Human
auggggcccugccuccuuug

SEQ ID NO: 2979010 - RNA, 16 nt, Human
uuuuaauaauguuuca

SEQ ID NO: 2979011 - RNA, 22 nt, Human
augugccagguuuuuggucuga

SEQ ID NO: 2979012 - RNA, 21 nt, Human
augugccagguuuuuggucug

SEQ ID NO: 2979013 - RNA, 19 nt, Human
augugcuaguaauuggaaa

SEQ ID NO: 2979014 - RNA, 16 nt, Human
auuaaacaugcuguac

SEQ ID NO: 2979015 - RNA, 22 nt, Human
auuaaaaaucucaaauuucuaa

SEQ ID NO: 2979016 - RNA, 20 nt, Human
auuaaaaaucucaaauuucu

SEQ ID NO: 2979017 - RNA, 23 nt, Human
auuaaaacacaacaucuuuuucu

SEQ ID NO: 2979018 - RNA, 19 nt, Human
auuaaaaaucucaaauuuc

SEQ ID NO: 2979019 - RNA, 15 nt, Human
auuaaaaaucucaaa

SEQ ID NO: 2979020 - RNA, 21 nt, Human
auguuuucaggcuagauguau

SEQ ID NO: 2979021 - RNA, 17 nt, Human
auguuuucaggcuagau

SEQ ID NO: 2979022 - RNA, 15 nt, Human
auguuuucaggcuag

SEQ ID NO: 2979023 - RNA, 13 nt, Human
uuuuauuaugcau

SEQ ID NO: 2979024 - RNA, 11 nt, Human
uuuuauuuuau

SEQ ID NO: 2979025 - RNA, 14 nt, Human
uuuucaguguacau

SEQ ID NO: 2979026 - RNA, 15 nt, Human
uuuucugagaaagac

SEQ ID NO: 2979027 - RNA, 18 nt, Human
uuuucugagaaagacuau

SEQ ID NO: 2979028 - RNA, 14 nt, Human
uuuucucuaggaaa

SEQ ID NO: 2979029 - RNA, 20 nt, Human
uuuucauuuaggugaggaag

SEQ ID NO: 2979030 - RNA, 14 nt, Human
auuuuacuuuuugg

SEQ ID NO: 2979031 - RNA, 17 nt, Human
auuuuacuuuuuggaaa

SEQ ID NO: 2979032 - RNA, 21 nt, Human
auuuuacuuuaaaaggagcca

SEQ ID NO: 2979033 - RNA, 15 nt, Human
auuuuaauucaguug

SEQ ID NO: 2979034 - RNA, 17 nt, Human
auuuuacauaaauuuag

SEQ ID NO: 2979035 - RNA, 16 nt, Human
auuuuacauaaauuua

SEQ ID NO: 2979036 - RNA, 13 nt, Human
auuuuacauaaau

SEQ ID NO: 2979037 - RNA, 22 nt, Human
auuuuaaaagaaugauuaugaa

SEQ ID NO: 2979038 - RNA, 18 nt, Human
auuuuaaaagaaugauua

SEQ ID NO: 2979039 - RNA, 15 nt, Human
auuuuaaacaaaaua

SEQ ID NO: 2979040 - RNA, 21 nt, Human
auuuuaaacaaaauagaaagu

SEQ ID NO: 2979041 - RNA, 21 nt, Human
auuuuaaacauauccaaguuu

SEQ ID NO: 2979042 - RNA, 18 nt, Human
auuugaagguagaauguu

SEQ ID NO: 2979043 - RNA, 23 nt, Human
auuugaagguagaauguuuucaa

SEQ ID NO: 2979044 - RNA, 18 nt, Human
auuuguauaaaauaauuu

SEQ ID NO: 2979045 - RNA, 15 nt, Human
auuuguauaaaauaa

SEQ ID NO: 2979046 - RNA, 19 nt, Human
auuuguauaaaauaauuuu

SEQ ID NO: 2979047 - RNA, 23 nt, Human
auuuguuuugccaauuugcacau

SEQ ID NO: 2979048 - RNA, 21 nt, Human
auuuguuuugccaauuugcac

SEQ ID NO: 2979049 - RNA, 17 nt, Human
auuuuaaaagaaugauu

SEQ ID NO: 2979050 - RNA, 14 nt, Human
auuugugagacugu

SEQ ID NO: 2979051 - RNA, 14 nt, Human
auuugugauacaau

SEQ ID NO: 2979052 - RNA, 12 nt, Human
auuugugagacu

SEQ ID NO: 2979053 - RNA, 22 nt, Human
auuuucaguuauuauauuuaca

SEQ ID NO: 2979054 - RNA, 23 nt, Human
auugggcacaucauuucaagaag

SEQ ID NO: 2979055 - RNA, 21 nt, Human
auugggcacaucauuucaaga

SEQ ID NO: 2979056 - RNA, 19 nt, Human
auugggcacaucauuucaa

SEQ ID NO: 2979057 - RNA, 18 nt, Human
auugggcacaucauuuca

SEQ ID NO: 2979058 - RNA, 17 nt, Human
auugggcacaucauuuc

SEQ ID NO: 2979059 - RNA, 21 nt, Human
auugggcacuauuuauuuaca

SEQ ID NO: 2979060 - RNA, 15 nt, Human
auuggggcucccagc

SEQ ID NO: 2979061 - RNA, 23 nt, Human
auuggggcucccagccaggcccu

SEQ ID NO: 2979062 - RNA, 22 nt, Human
auuggggcucccagccaggccc

SEQ ID NO: 2979063 - RNA, 21 nt, Human
auuggggcucccagccaggcc

SEQ ID NO: 2979064 - RNA, 20 nt, Human
auuggggcucccagccaggc

SEQ ID NO: 2979065 - RNA, 16 nt, Human
auucuuuuugaaaugu

SEQ ID NO: 2979066 - RNA, 15 nt, Human
auugaaaaaccauuu

SEQ ID NO: 2979067 - RNA, 18 nt, Human
auugacccacaagaaaug

SEQ ID NO: 2979068 - RNA, 22 nt, Human
auugacauugaaaucuaggaaa

SEQ ID NO: 2979069 - RNA, 18 nt, Human
auugacauugaaaucuag

SEQ ID NO: 2979070 - RNA, 17 nt, Human
auugacauugaaaucua

SEQ ID NO: 2979071 - RNA, 15 nt, Human
auugacauugaaauc

SEQ ID NO: 2979072 - RNA, 17 nt, Human
auugaaaucuaggaaaa

SEQ ID NO: 2979073 - RNA, 22 nt, Human
auucuuccucccucccucuuuc

SEQ ID NO: 2979074 - RNA, 13 nt, Human
auucuuccucccu

SEQ ID NO: 2979075 - RNA, 13 nt, Human
auucuucuccacu

SEQ ID NO: 2979076 - RNA, 18 nt, Human
auucuuauuuaaugaaag

SEQ ID NO: 2979077 - RNA, 14 nt, Human
auucuuauuuaaug

SEQ ID NO: 2979078 - RNA, 13 nt, Human
auucuuauuuaau

SEQ ID NO: 2979079 - RNA, 18 nt, Human
auugugucucuugguccu

SEQ ID NO: 2979080 - RNA, 14 nt, Human
auugugucucuugg

SEQ ID NO: 2979081 - RNA, 17 nt, Human
auuguccccgacccuug

SEQ ID NO: 2979082 - RNA, 19 nt, Human
auuguccccgacccuugcc

SEQ ID NO: 2979083 - RNA, 20 nt, Human
auuguccccgacccuugccg

SEQ ID NO: 2979084 - RNA, 15 nt, Human
auuguauuacaaauc

SEQ ID NO: 2979085 - RNA, 14 nt, Human
auuuauuuauucau

SEQ ID NO: 2979086 - RNA, 17 nt, Human
auuuauuuuaauaaugu

SEQ ID NO: 2979087 - RNA, 18 nt, Human
auuuauuuacaaauguuu

SEQ ID NO: 2979088 - RNA, 14 nt, Human
auuuauucauuagu

SEQ ID NO: 2979089 - RNA, 13 nt, Human
auuuauucugcuc

SEQ ID NO: 2979090 - RNA, 16 nt, Human
auuuauuuacaaaugu

SEQ ID NO: 2979091 - RNA, 15 nt, Human
auuuauuuacaaaug

SEQ ID NO: 2979092 - RNA, 13 nt, Human
auuuauuuacaaa

SEQ ID NO: 2979093 - RNA, 23 nt, Human
auuucaaacagucucccuuccua

SEQ ID NO: 2979094 - RNA, 20 nt, Human
auuuauuuuaauaauguuuc

SEQ ID NO: 2979095 - RNA, 19 nt, Human
auuuauuuuaauaauguuu

SEQ ID NO: 2979096 - RNA, 12 nt, Human
auuucauuucuu

SEQ ID NO: 2979097 - RNA, 17 nt, Human
auuuccagccaaagccu

SEQ ID NO: 2979098 - RNA, 14 nt, Human
auuugaaauauuga

SEQ ID NO: 2979099 - RNA, 14 nt, Human
auuugaaaauuuug

SEQ ID NO: 2979100 - RNA, 16 nt, Human
auuuccguuaaaauac

SEQ ID NO: 2979101 - RNA, 15 nt, Human
auuuccguuaaaaua

SEQ ID NO: 2979102 - RNA, 14 nt, Human
auuuauucugcuca

SEQ ID NO: 2979103 - RNA, 19 nt, Human
auuuacuuaagacuuaaug

SEQ ID NO: 2979104 - RNA, 15 nt, Human
auuuagaaauauaau

SEQ ID NO: 2979105 - RNA, 16 nt, Human
auuuacuucuuauaca

SEQ ID NO: 2979106 - RNA, 14 nt, Human
auuuacuucuuaua

SEQ ID NO: 2979107 - RNA, 17 nt, Human
auuuacuucuuauacau

SEQ ID NO: 2979108 - RNA, 13 nt, Human
auuuacuuaagac

SEQ ID NO: 2979109 - RNA, 14 nt, Human
auuuaacagaaaug

SEQ ID NO: 2979110 - RNA, 12 nt, Human
auuuaacagaaa

SEQ ID NO: 2979111 - RNA, 13 nt, Human
auuuagauguaua

SEQ ID NO: 2979112 - RNA, 18 nt, Human
auuuaguauuuuguuuca

SEQ ID NO: 2979113 - RNA, 22 nt, Human
auuuauuaaaugcccagccccu

SEQ ID NO: 2979114 - RNA, 13 nt, Human
aucuuuuaugauu

SEQ ID NO: 2979115 - RNA, 20 nt, Human
augaaauauuauguuaaaac

SEQ ID NO: 2979116 - RNA, 21 nt, Human
augaaauauuauguuaaaacu

SEQ ID NO: 2979117 - RNA, 20 nt, Human
augaaagacuguacaaagua

SEQ ID NO: 2979118 - RNA, 23 nt, Human
uuggccugucuuuggauuguuaa

SEQ ID NO: 2979119 - RNA, 18 nt, Human
uuggaaagaguaggaaga

SEQ ID NO: 2979120 - RNA, 11 nt, Human
uuggcugcuga

SEQ ID NO: 2979121 - RNA, 15 nt, Human
uuggcugcugaaggc

SEQ ID NO: 2979122 - RNA, 14 nt, Human
uuggcugcagggag

SEQ ID NO: 2979123 - RNA, 13 nt, Human
uuggcugcaggga

SEQ ID NO: 2979124 - RNA, 22 nt, Human
uuggcuagagguucaaagauau

SEQ ID NO: 2979125 - RNA, 22 nt, Human
uuggcuaggaccccuccaugug

SEQ ID NO: 2979126 - RNA, 21 nt, Human
uuggcuagagguucaaagaua

SEQ ID NO: 2979127 - RNA, 12 nt, Human
uugcucauggaa

SEQ ID NO: 2979128 - RNA, 11 nt, Human
uugcucaugga

SEQ ID NO: 2979129 - RNA, 19 nt, Human
uugcugaauacagaggcaa

SEQ ID NO: 2979130 - RNA, 20 nt, Human
uugcuaagugaggaugaaaa

SEQ ID NO: 2979131 - RNA, 17 nt, Human
uugcugauggugcaaug

SEQ ID NO: 2979132 - RNA, 18 nt, Human
uugcugauggugcaauga

SEQ ID NO: 2979133 - RNA, 17 nt, Human
uuggaaagaguaggaag

SEQ ID NO: 2979134 - RNA, 22 nt, Human
uuguaacuguuuagaugaaugu

SEQ ID NO: 2979135 - RNA, 21 nt, Human
uuguaacuguuuagaugaaug

SEQ ID NO: 2979136 - RNA, 14 nt, Human
uuguaaggaaugau

SEQ ID NO: 2979137 - RNA, 19 nt, Human
uugguuaggcauuguggga

SEQ ID NO: 2979138 - RNA, 22 nt, Human
uugggguacccacugcucuggu

SEQ ID NO: 2979139 - RNA, 19 nt, Human
augaauuacauuuguauaa

SEQ ID NO: 2979140 - RNA, 18 nt, Human
augaauuacauuuguaua

SEQ ID NO: 2979141 - RNA, 17 nt, Human
augaauuacauuuguau

SEQ ID NO: 2979142 - RNA, 20 nt, Human
augaaccacaucuugcucug

SEQ ID NO: 2979143 - RNA, 13 nt, Human
augaaccacaucu

SEQ ID NO: 2979144 - RNA, 19 nt, Human
uuggggaagaacgaagcca

SEQ ID NO: 2979145 - RNA, 17 nt, Human
uugggguacccacugcu

SEQ ID NO: 2979146 - RNA, 16 nt, Human
uugggcacuauuuauu

SEQ ID NO: 2979147 - RNA, 23 nt, Human
uugggcacuauuuauuuacaaau

SEQ ID NO: 2979148 - RNA, 19 nt, Human
augacacgaauauugcuga

SEQ ID NO: 2979149 - RNA, 20 nt, Human
augacacgaauauugcugau

SEQ ID NO: 2979150 - RNA, 21 nt, Human
augaauuaguuuuauaugcuu

SEQ ID NO: 2979151 - RNA, 22 nt, Human
augaauuacauuuguauaaaau

SEQ ID NO: 2979152 - RNA, 23 nt, Human
augaauuaguuuuauaugcuucu

SEQ ID NO: 2979153 - RNA, 23 nt, Human
uuguaguguuggagaagaacuga

SEQ ID NO: 2979154 - RNA, 20 nt, Human
uuguaaggaaugauuaauua

SEQ ID NO: 2979155 - RNA, 19 nt, Human
uuguauaaaauaauuuuua

SEQ ID NO: 2979156 - RNA, 13 nt, Human
uuguauaaaauaa

SEQ ID NO: 2979157 - RNA, 16 nt, Human
uuguuuuuauuaaaag

SEQ ID NO: 2979158 - RNA, 19 nt, Human
augcaccuggaauauauaa

SEQ ID NO: 2979159 - RNA, 20 nt, Human
uuuaaaaaagaaacauuugg

SEQ ID NO: 2979160 - RNA, 18 nt, Human
augaucuucuuuauaauu

SEQ ID NO: 2979161 - RNA, 15 nt, Human
augaucuucuuuaua

SEQ ID NO: 2979162 - RNA, 16 nt, Human
augcaaaccaucauug

SEQ ID NO: 2979163 - RNA, 18 nt, Human
augcaaaccaucauugaa

SEQ ID NO: 2979164 - RNA, 19 nt, Human
augcaaaccaucauugaaa

SEQ ID NO: 2979165 - RNA, 20 nt, Human
augcaaaccaucauugaaau

SEQ ID NO: 2979166 - RNA, 21 nt, Human
augcaaaccaucauugaaauc

SEQ ID NO: 2979167 - RNA, 22 nt, Human
augcaaaccaucauugaaaucu

SEQ ID NO: 2979168 - RNA, 16 nt, Human
augcaaggucauuuuu

SEQ ID NO: 2979169 - RNA, 14 nt, Human
augcaaggucauuu

SEQ ID NO: 2979170 - RNA, 14 nt, Human
augcaccuggaaua

SEQ ID NO: 2979171 - RNA, 16 nt, Human
augcaccuggaauaua

SEQ ID NO: 2979172 - RNA, 22 nt, Human
augcaaggucauuuuuuuuaag

SEQ ID NO: 2979173 - RNA, 22 nt, Human
uuguucccugugucauuucaaa

SEQ ID NO: 2979174 - RNA, 19 nt, Human
uuguugaggguauguuuua

SEQ ID NO: 2979175 - RNA, 14 nt, Human
uugugaauaaagag

SEQ ID NO: 2979176 - RNA, 22 nt, Human
uugugaaggcaggggaauguau

SEQ ID NO: 2979177 - RNA, 18 nt, Human
uugugaagcaaaauuuuu

SEQ ID NO: 2979178 - RNA, 14 nt, Human
augaucuucuuuau

SEQ ID NO: 2979179 - RNA, 16 nt, Human
augauccuaggcauuu

SEQ ID NO: 2979180 - RNA, 23 nt, Human
augaucacggcucacugcagccu

SEQ ID NO: 2979181 - RNA, 15 nt, Human
augaucacggcucac

SEQ ID NO: 2979182 - RNA, 19 nt, Human
augaucacggcucacugca

SEQ ID NO: 2979183 - RNA, 18 nt, Human
augaucacggcucacugc

SEQ ID NO: 2979184 - RNA, 14 nt, Human
augauaacuggaaa

SEQ ID NO: 2979185 - RNA, 18 nt, Human
uugucacacacuuuggcu

SEQ ID NO: 2979186 - RNA, 15 nt, Human
augauaaaacacaaa

SEQ ID NO: 2979187 - RNA, 18 nt, Human
augagccucagcauccug

SEQ ID NO: 2979188 - RNA, 17 nt, Human
augagccucagcauccu

SEQ ID NO: 2979189 - RNA, 22 nt, Human
augaggucagagccugcaguua

SEQ ID NO: 2979190 - RNA, 21 nt, Human
uugucggccccaccagugccu

SEQ ID NO: 2979191 - RNA, 12 nt, Human
augagaggaaau

SEQ ID NO: 2979192 - RNA, 13 nt, Human
augagaggaaauc

SEQ ID NO: 2979193 - RNA, 23 nt, Human
augagagacacacugaagaagca

SEQ ID NO: 2979194 - RNA, 14 nt, Human
augagaggaaauca

SEQ ID NO: 2979195 - RNA, 15 nt, Human
augagaggaaaucac

SEQ ID NO: 2979196 - RNA, 16 nt, Human
augagaggaaaucacc

SEQ ID NO: 2979197 - RNA, 16 nt, Human
augagccucagcaucc

SEQ ID NO: 2979198 - RNA, 15 nt, Human
augagccucagcauc

SEQ ID NO: 2979199 - RNA, 12 nt, Human
augagccucagc

SEQ ID NO: 2979200 - RNA, 22 nt, Human
augagccgcccaaggccuuccc

SEQ ID NO: 2979201 - RNA, 21 nt, Human
augagccgcccaaggccuucc

SEQ ID NO: 2979202 - RNA, 19 nt, Human
augagccgcccaaggccuu

SEQ ID NO: 2979203 - RNA, 18 nt, Human
augagccgcccaaggccu

SEQ ID NO: 2979204 - RNA, 16 nt, Human
augagccgcccaaggc

SEQ ID NO: 2979205 - RNA, 22 nt, Human
augagcaucaggccaggcccuc

SEQ ID NO: 2979206 - RNA, 15 nt, Human
augagccgcccaagg

SEQ ID NO: 2979207 - RNA, 18 nt, Human
augagcaucaggccaggc

SEQ ID NO: 2979208 - RNA, 19 nt, Human
augagcaucaggccaggcc

SEQ ID NO: 2979209 - RNA, 20 nt, Human
augagcaucaggccaggccc

SEQ ID NO: 2979210 - RNA, 21 nt, Human
augagcaucaggccaggcccu

SEQ ID NO: 2979211 - RNA, 16 nt, Human
augagcaucaggccag

SEQ ID NO: 2979212 - RNA, 17 nt, Human
augagcaucaggccagg

SEQ ID NO: 2979213 - RNA, 15 nt, Human
augagcaucaggcca

SEQ ID NO: 2979214 - RNA, 22 nt, Human
uuuauauagcaagacauuauau

SEQ ID NO: 2979215 - RNA, 18 nt, Human
uuuauauagcaagacauu

SEQ ID NO: 2979216 - RNA, 16 nt, Human
uuuagcccugaacauu

SEQ ID NO: 2979217 - RNA, 15 nt, Human
uuuagauaauacacc

SEQ ID NO: 2979218 - RNA, 13 nt, Human
uuuagauaauaca

SEQ ID NO: 2979219 - RNA, 18 nt, Human
uuuagaguugauacuaca

SEQ ID NO: 2979220 - RNA, 16 nt, Human
uuuauuacuguaagaa

SEQ ID NO: 2979221 - RNA, 19 nt, Human
uuuauuaaaugcccagccc

SEQ ID NO: 2979222 - RNA, 17 nt, Human
uuuauaugcuucuguuu

SEQ ID NO: 2979223 - RNA, 16 nt, Human
augccuaccaauauuu

SEQ ID NO: 2979224 - RNA, 17 nt, Human
augccuaccaauauuua

SEQ ID NO: 2979225 - RNA, 23 nt, Human
augccuaccaauauuuaaucuuu

SEQ ID NO: 2979226 - RNA, 13 nt, Human
augcuaagugaaa

SEQ ID NO: 2979227 - RNA, 14 nt, Human
augcgcuguggcca

SEQ ID NO: 2979228 - RNA, 16 nt, Human
uuuaaagcuuccauug

SEQ ID NO: 2979229 - RNA, 24 nt, Human
uuuaaagcuuauuaaaacucauuu

SEQ ID NO: 2979230 - RNA, 21 nt, Human
uuuaccuuuuuuauacauaaa

SEQ ID NO: 2979231 - RNA, 17 nt, Human
uuuacuaauagacaauu

SEQ ID NO: 2979232 - RNA, 14 nt, Human
uuuacuaauagaca

SEQ ID NO: 2979233 - RNA, 18 nt, Human
uuuacuaauagacaauuu

SEQ ID NO: 2979234 - RNA, 18 nt, Human
augcuacacacugcaugu

SEQ ID NO: 2979235 - RNA, 22 nt, Human
uuuaccugaagucuuuguacag

SEQ ID NO: 2979236 - RNA, 17 nt, Human
augcuacacacugcaug

SEQ ID NO: 2979237 - RNA, 20 nt, Human
uuuaccuuuuuuauacauaa

SEQ ID NO: 2979238 - RNA, 19 nt, Human
uuuaccuuuuuuauacaua

SEQ ID NO: 2979239 - RNA, 14 nt, Human
uuuaccuuuuuuau

SEQ ID NO: 2979240 - RNA, 23 nt, Human
auggaauuggagcucgugggaca

SEQ ID NO: 2979241 - RNA, 19 nt, Human
uuuccagguuuaagcuguu

SEQ ID NO: 2979242 - RNA, 15 nt, Human
uuucacucuccuugg

SEQ ID NO: 2979243 - RNA, 24 nt, Human
uuucacucuuauugcccacgcugg

SEQ ID NO: 2979244 - RNA, 14 nt, Human
uuucacucuccuug

SEQ ID NO: 2979245 - RNA, 15 nt, Human
auggaauaacaugua

SEQ ID NO: 2979246 - RNA, 14 nt, Human
auggaauaacaugu

SEQ ID NO: 2979247 - RNA, 16 nt, Human
uuuauuuuaauaaugu

SEQ ID NO: 2979248 - RNA, 16 nt, Human
auggaacauaaaauac

SEQ ID NO: 2979249 - RNA, 21 nt, Human
auggaaguacuauaauuuacc

SEQ ID NO: 2979250 - RNA, 18 nt, Human
auggaacacucugagacu

SEQ ID NO: 2979251 - RNA, 17 nt, Human
auggaacacucugagac

SEQ ID NO: 2979252 - RNA, 19 nt, Human
uuuauuacuguaagaaaau

SEQ ID NO: 2979253 - RNA, 22 nt, Human
augcuggcuguuggcugggggc

SEQ ID NO: 2979254 - RNA, 19 nt, Human
augcugugcccuaaagugu

SEQ ID NO: 2979255 - RNA, 14 nt, Human
augcuguauuuuaa

SEQ ID NO: 2979256 - RNA, 23 nt, Human
augcugucuacacuaagagagaa

SEQ ID NO: 2979257 - RNA, 23 nt, Human
uuugaaacacugguuuuaaauau

SEQ ID NO: 2979258 - RNA, 14 nt, Human
uuugaaauauugac

SEQ ID NO: 2979259 - RNA, 23 nt, Human
augggcuggguucuacccaggug

SEQ ID NO: 2979260 - RNA, 14 nt, Human
auggggcccugccu

SEQ ID NO: 2979261 - RNA, 13 nt, Human
auggggcccugcc

SEQ ID NO: 2979262 - RNA, 13 nt, Human
uuucuuuguggcu

SEQ ID NO: 2979263 - RNA, 13 nt, Human
uuucucauguuga

SEQ ID NO: 2979264 - RNA, 15 nt, Human
uuucucauguugaaa

SEQ ID NO: 2979265 - RNA, 14 nt, Human
uuucugcaucagcu

SEQ ID NO: 2979266 - RNA, 14 nt, Human
uuucugccgcagcc

SEQ ID NO: 2979267 - RNA, 16 nt, Human
uuucugccgcagcccu

SEQ ID NO: 2979268 - RNA, 22 nt, Human
uuucucacagaagaugaagcac

SEQ ID NO: 2979269 - RNA, 18 nt, Human
uuucucacagaagaugaa

SEQ ID NO: 2979270 - RNA, 20 nt, Human
uuucuaugaaauauuauguu

SEQ ID NO: 2979271 - RNA, 14 nt, Human
uuucuaugaaauau

SEQ ID NO: 2979272 - RNA, 13 nt, Human
uuucuaugaaaua

SEQ ID NO: 2979273 - RNA, 21 nt, Human
uuucuaugacacaugcaaggu

SEQ ID NO: 2979274 - RNA, 15 nt, Human
uuucuaugacacaug

SEQ ID NO: 2979275 - RNA, 17 nt, Human
uuucuaggacugaauua

SEQ ID NO: 2979276 - RNA, 21 nt, Human
uuucuaggacugaauuaugaa

SEQ ID NO: 2979277 - RNA, 22 nt, Human
uuucuaggacugaauuaugaaa

SEQ ID NO: 2979278 - RNA, 20 nt, Human
uuuccuucaagaaugcagua

SEQ ID NO: 2979279 - RNA, 11 nt, Human
uuuccuucagu

SEQ ID NO: 2979280 - RNA, 12 nt, Human
uuuccuucagug

SEQ ID NO: 2979281 - RNA, 15 nt, Human
uuuccuucagugccu

SEQ ID NO: 2979282 - RNA, 12 nt, Human
uuuccugugucu

SEQ ID NO: 2979283 - RNA, 17 nt, Human
augggccuccugugugu

SEQ ID NO: 2979284 - RNA, 22 nt, Human
augggccaccgccuugcccagc

SEQ ID NO: 2979285 - RNA, 21 nt, Human
uuuccuucauucaacccaccu

SEQ ID NO: 2979286 - RNA, 22 nt, Human
uuuccuucagugccuuauggaa

SEQ ID NO: 2979287 - RNA, 18 nt, Human
uuuccuucagugccuuau

SEQ ID NO: 2979288 - RNA, 21 nt, Human
uuuccuucagugccuuaugga

SEQ ID NO: 2979289 - RNA, 23 nt, Human
uuuccuucauucaacccaccugc

SEQ ID NO: 2979290 - RNA, 18 nt, Human
uuucgcaggauucuuccu

SEQ ID NO: 2979291 - RNA, 22 nt, Human
uuucgcaggauucuuccucccu

SEQ ID NO: 2979292 - RNA, 18 nt, Human
auggccucuucagaucuc

SEQ ID NO: 2979293 - RNA, 16 nt, Human
auggcuauaggugcua

SEQ ID NO: 2979294 - RNA, 19 nt, Human
auggcuauaggugcuacaa

SEQ ID NO: 2979295 - RNA, 21 nt, Human
augggacauuugcucauggaa

SEQ ID NO: 2979296 - RNA, 22 nt, Human
augggacauuugcucauggaau

SEQ ID NO: 2979297 - RNA, 21 nt, Human
auggcuauaggugcuacaaaa

SEQ ID NO: 2979298 - RNA, 17 nt, Human
auggaauuucucccagu

SEQ ID NO: 2979299 - RNA, 19 nt, Human
auggacaugaucuucuuua

SEQ ID NO: 2979300 - RNA, 21 nt, Human
auggacccaauauuuaccaga

SEQ ID NO: 2979301 - RNA, 13 nt, Human
augggcagagcag

SEQ ID NO: 2979302 - RNA, 14 nt, Human
augggcagagcaga

SEQ ID NO: 2979303 - RNA, 15 nt, Human
augggcagagcagag

SEQ ID NO: 2979304 - RNA, 15 nt, Human
augggccuccugugu

SEQ ID NO: 2979305 - RNA, 18 nt, Human
augggccaccgccuugcc

SEQ ID NO: 2979306 - RNA, 17 nt, Human
augggccaccgccuugc

SEQ ID NO: 2979307 - RNA, 21 nt, Human
augggcaacccccagccugcu

SEQ ID NO: 2979308 - RNA, 19 nt, Human
augggcaacccccagccug

SEQ ID NO: 2979309 - RNA, 18 nt, Human
augggcaacccccagccu

SEQ ID NO: 2979310 - RNA, 13 nt, Human
augggagcucaug

SEQ ID NO: 2979311 - RNA, 19 nt, Human
uucauuaguuuugaagauu

SEQ ID NO: 2979312 - RNA, 14 nt, Human
uucauuaucucaaa

SEQ ID NO: 2979313 - RNA, 14 nt, Human
uucauuaguuuuga

SEQ ID NO: 2979314 - RNA, 19 nt, Human
uucauucuuuuugaaaugu

SEQ ID NO: 2979315 - RNA, 22 nt, Human
uuccaauuuacauacucugcuu

SEQ ID NO: 2979316 - RNA, 16 nt, Human
uuccaguaaugagcuu

SEQ ID NO: 2979317 - RNA, 18 nt, Human
uuccagguuuaagcuguu

SEQ ID NO: 2979318 - RNA, 17 nt, Human
uuccagguuuaagcugu

SEQ ID NO: 2979319 - RNA, 13 nt, Human
uuccaggcuggga

SEQ ID NO: 2979320 - RNA, 15 nt, Human
uuccaggcugggaga

SEQ ID NO: 2979321 - RNA, 17 nt, Human
uuccaggcugggagagc

SEQ ID NO: 2979322 - RNA, 21 nt, Human
uuccacaagagcccaggccuc

SEQ ID NO: 2979323 - RNA, 23 nt, Human
auauguaccuaacgaaguauccu

SEQ ID NO: 2979324 - RNA, 16 nt, Human
auauggguaguauuuu

SEQ ID NO: 2979325 - RNA, 20 nt, Human
auauguggaguucaucuuga

SEQ ID NO: 2979326 - RNA, 21 nt, Human
auauguggaguucaucuugaa

SEQ ID NO: 2979327 - RNA, 23 nt, Human
auauguagauguaugcacacaca

SEQ ID NO: 2979328 - RNA, 20 nt, Human
auauguagauguaugcacac

SEQ ID NO: 2979329 - RNA, 18 nt, Human
auauguagauguaugcac

SEQ ID NO: 2979330 - RNA, 16 nt, Human
auauguagauguaugc

SEQ ID NO: 2979331 - RNA, 22 nt, Human
uucaugcuguucaugaaagauu

SEQ ID NO: 2979332 - RNA, 20 nt, Human
uucaugcuguucaugaaaga

SEQ ID NO: 2979333 - RNA, 13 nt, Human
auaugcaaagcac

SEQ ID NO: 2979334 - RNA, 14 nt, Human
auaugcaaagcacu

SEQ ID NO: 2979335 - RNA, 14 nt, Human
uucaguaagccgug

SEQ ID NO: 2979336 - RNA, 17 nt, Human
uucagguaacaggcaga

SEQ ID NO: 2979337 - RNA, 22 nt, Human
auauauguuuuaagaggcaggg

SEQ ID NO: 2979338 - RNA, 21 nt, Human
auauauguuuuaagaggcagg

SEQ ID NO: 2979339 - RNA, 13 nt, Human
auauaugcuaagu

SEQ ID NO: 2979340 - RNA, 15 nt, Human
uucaucaaugaauga

SEQ ID NO: 2979341 - RNA, 19 nt, Human
uucagauaugauucaaaug

SEQ ID NO: 2979342 - RNA, 18 nt, Human
uucagauaugauucaaau

SEQ ID NO: 2979343 - RNA, 17 nt, Human
uucagauaugauucaaa

SEQ ID NO: 2979344 - RNA, 16 nt, Human
uucagauaugauucaa

SEQ ID NO: 2979345 - RNA, 16 nt, Human
uucagaaauguguuau

SEQ ID NO: 2979346 - RNA, 17 nt, Human
uucagcgguuuauauaa

SEQ ID NO: 2979347 - RNA, 16 nt, Human
uucagguaacaggcag

SEQ ID NO: 2979348 - RNA, 15 nt, Human
uucagguaacaggca

SEQ ID NO: 2979349 - RNA, 22 nt, Human
uucaggguuggccccugcccgg

SEQ ID NO: 2979350 - RNA, 19 nt, Human
uucaggguuggccccugcc

SEQ ID NO: 2979351 - RNA, 17 nt, Human
uucaggguuggccccug

SEQ ID NO: 2979352 - RNA, 16 nt, Human
uucaggguuggccccu

SEQ ID NO: 2979353 - RNA, 14 nt, Human
uucaggguuggccc

SEQ ID NO: 2979354 - RNA, 22 nt, Human
uuccuguuuuuauuauuaacaa

SEQ ID NO: 2979355 - RNA, 20 nt, Human
uuccuggcacugcuuccagu

SEQ ID NO: 2979356 - RNA, 22 nt, Human
uuccuggcacugcuuccaguga

SEQ ID NO: 2979357 - RNA, 22 nt, Human
uuccucuuuuuauuuaguuccu

SEQ ID NO: 2979358 - RNA, 19 nt, Human
uuccuggcacugcuuccag

SEQ ID NO: 2979359 - RNA, 12 nt, Human
uuccugaacagg

SEQ ID NO: 2979360 - RNA, 14 nt, Human
aucaauuuuucuua

SEQ ID NO: 2979361 - RNA, 17 nt, Human
aucacgccacugcacua

SEQ ID NO: 2979362 - RNA, 15 nt, Human
aucacgccacugcac

SEQ ID NO: 2979363 - RNA, 14 nt, Human
aucacgccacugca

SEQ ID NO: 2979364 - RNA, 13 nt, Human
aucaauuuaaaaa

SEQ ID NO: 2979365 - RNA, 21 nt, Human
aucaaggguacacugccuucu

SEQ ID NO: 2979366 - RNA, 16 nt, Human
aucaaauaugcaaagc

SEQ ID NO: 2979367 - RNA, 17 nt, Human
aucaaauaugcaaagca

SEQ ID NO: 2979368 - RNA, 18 nt, Human
aucaaauaugcaaagcac

SEQ ID NO: 2979369 - RNA, 23 nt, Human
auauuuuuuaaaauaagucugau

SEQ ID NO: 2979370 - RNA, 16 nt, Human
aucaaggguacacugc

SEQ ID NO: 2979371 - RNA, 21 nt, Human
aucaacugcaucaagauguga

SEQ ID NO: 2979372 - RNA, 17 nt, Human
auauuuuuuaaaauaag

SEQ ID NO: 2979373 - RNA, 15 nt, Human
auauuuuuuaaaaua

SEQ ID NO: 2979374 - RNA, 15 nt, Human
aucaaauaugcaaag

SEQ ID NO: 2979375 - RNA, 19 nt, Human
auauugguugggaugacuu

SEQ ID NO: 2979376 - RNA, 22 nt, Human
auauugcugauggugcaaugac

SEQ ID NO: 2979377 - RNA, 20 nt, Human
auauugguugggaugacuug

SEQ ID NO: 2979378 - RNA, 18 nt, Human
auauucucacagcuccaa

SEQ ID NO: 2979379 - RNA, 15 nt, Human
auauugauaugcuua

SEQ ID NO: 2979380 - RNA, 13 nt, Human
auauuuaaucuuu

SEQ ID NO: 2979381 - RNA, 13 nt, Human
auauuuacaaaug

SEQ ID NO: 2979382 - RNA, 13 nt, Human
auauuguuuucag

SEQ ID NO: 2979383 - RNA, 14 nt, Human
auauuguuugcuaa

SEQ ID NO: 2979384 - RNA, 22 nt, Human
auauuaagaaagacuaucuaaa

SEQ ID NO: 2979385 - RNA, 17 nt, Human
auauuaagaaagacuau

SEQ ID NO: 2979386 - RNA, 15 nt, Human
auauuaagaaagacu

SEQ ID NO: 2979387 - RNA, 16 nt, Human
auauuaagaaagacua

SEQ ID NO: 2979388 - RNA, 17 nt, Human
auauuaccacagacaua

SEQ ID NO: 2979389 - RNA, 15 nt, Human
uuccagugaggcucu

SEQ ID NO: 2979390 - RNA, 16 nt, Human
uuccagugaggcucug

SEQ ID NO: 2979391 - RNA, 14 nt, Human
uucugaagaagaug

SEQ ID NO: 2979392 - RNA, 21 nt, Human
uucucuaguuugauuaaauuc

SEQ ID NO: 2979393 - RNA, 20 nt, Human
uucucuaguuugauuaaauu

SEQ ID NO: 2979394 - RNA, 19 nt, Human
uucugcagccacuauuguu

SEQ ID NO: 2979395 - RNA, 12 nt, Human
aucauugaaauc

SEQ ID NO: 2979396 - RNA, 14 nt, Human
aucacuuccaugac

SEQ ID NO: 2979397 - RNA, 23 nt, Human
aucacuugaacccgggaggcaga

SEQ ID NO: 2979398 - RNA, 15 nt, Human
aucaggugcugccau

SEQ ID NO: 2979399 - RNA, 19 nt, Human
aucaggugcugccauccag

SEQ ID NO: 2979400 - RNA, 17 nt, Human
aucaggugcugccaucc

SEQ ID NO: 2979401 - RNA, 19 nt, Human
aucagucugauucccaagc

SEQ ID NO: 2979402 - RNA, 14 nt, Human
aucaggugcugcca

SEQ ID NO: 2979403 - RNA, 23 nt, Human
aucauccacugugccaugugcca

SEQ ID NO: 2979404 - RNA, 21 nt, Human
aucauccacugugccaugugc

SEQ ID NO: 2979405 - RNA, 16 nt, Human
aucauuaggugugacu

SEQ ID NO: 2979406 - RNA, 15 nt, Human
aucauaaaacuugau

SEQ ID NO: 2979407 - RNA, 23 nt, Human
aucauaguggcuuaaaacaacac

SEQ ID NO: 2979408 - RNA, 16 nt, Human
auccaauugcugcuug

SEQ ID NO: 2979409 - RNA, 16 nt, Human
uucugccugcccaggc

SEQ ID NO: 2979410 - RNA, 15 nt, Human
uucugccugcccagg

SEQ ID NO: 2979411 - RNA, 14 nt, Human
auccaguaucuuga

SEQ ID NO: 2979412 - RNA, 17 nt, Human
auccagguucagcuugu

SEQ ID NO: 2979413 - RNA, 18 nt, Human
aucccucccuccaccucc

SEQ ID NO: 2979414 - RNA, 17 nt, Human
aucccucccuccaccuc

SEQ ID NO: 2979415 - RNA, 16 nt, Human
aucccucccuccaccu

SEQ ID NO: 2979416 - RNA, 14 nt, Human
aucccucccuccac

SEQ ID NO: 2979417 - RNA, 18 nt, Human
aucccaugagccucagca

SEQ ID NO: 2979418 - RNA, 17 nt, Human
aucccaugagccucagc

SEQ ID NO: 2979419 - RNA, 17 nt, Human
aucccugaaggccccgc

SEQ ID NO: 2979420 - RNA, 20 nt, Human
aucccucccuccaccucccu

SEQ ID NO: 2979421 - RNA, 22 nt, Human
aucccugaaggccccgcccagg

SEQ ID NO: 2979422 - RNA, 16 nt, Human
aucccaugagccucag

SEQ ID NO: 2979423 - RNA, 13 nt, Human
aucccaugagccu

SEQ ID NO: 2979424 - RNA, 11 nt, Human
aucccagcccc

SEQ ID NO: 2979425 - RNA, 20 nt, Human
uucuuucuggcuaugcauuu

SEQ ID NO: 2979426 - RNA, 17 nt, Human
uucuuucuggcuaugca

SEQ ID NO: 2979427 - RNA, 12 nt, Human
uucuuucuggcu

SEQ ID NO: 2979428 - RNA, 22 nt, Human
uucuucuccacuuucuagccag

SEQ ID NO: 2979429 - RNA, 18 nt, Human
uucuguuuagauaauaca

SEQ ID NO: 2979430 - RNA, 13 nt, Human
uucuguuuagaua

SEQ ID NO: 2979431 - RNA, 21 nt, Human
uucuguuggccagugugacaa

SEQ ID NO: 2979432 - RNA, 16 nt, Human
uucuguuuuauaauuu

SEQ ID NO: 2979433 - RNA, 17 nt, Human
uucuguuuuauaauuuu

SEQ ID NO: 2979434 - RNA, 14 nt, Human
uugaaggaugcugu

SEQ ID NO: 2979435 - RNA, 16 nt, Human
uugaaggaugcugucu

SEQ ID NO: 2979436 - RNA, 14 nt, Human
uugaaguaaaaugu

SEQ ID NO: 2979437 - RNA, 16 nt, Human
uugaagguagaauguu

SEQ ID NO: 2979438 - RNA, 19 nt, Human
uugaagguagaauguuuuc

SEQ ID NO: 2979439 - RNA, 15 nt, Human
uugaagguagaaugu

SEQ ID NO: 2979440 - RNA, 17 nt, Human
uugacacuuaaaaaugg

SEQ ID NO: 2979441 - RNA, 14 nt, Human
aucgucacugcuua

SEQ ID NO: 2979442 - RNA, 18 nt, Human
aucgucacugcuuaacuu

SEQ ID NO: 2979443 - RNA, 15 nt, Human
aucgugacaacacuu

SEQ ID NO: 2979444 - RNA, 14 nt, Human
aucgugacaacacu

SEQ ID NO: 2979445 - RNA, 19 nt, Human
aucuaaauggaaccacucu

SEQ ID NO: 2979446 - RNA, 15 nt, Human
aucuaaauguugaaa

SEQ ID NO: 2979447 - RNA, 16 nt, Human
uugaggucuguucuuu

SEQ ID NO: 2979448 - RNA, 15 nt, Human
uugaggucuguucuu

SEQ ID NO: 2979449 - RNA, 12 nt, Human
uugauaaaguaa

SEQ ID NO: 2979450 - RNA, 19 nt, Human
uugacacuuaaaaaugguu

SEQ ID NO: 2979451 - RNA, 19 nt, Human
uugacagggcacaccgggc

SEQ ID NO: 2979452 - RNA, 18 nt, Human
uugaccauucuccaccug

SEQ ID NO: 2979453 - RNA, 19 nt, Human
uugaccauucuccaccugc

SEQ ID NO: 2979454 - RNA, 17 nt, Human
uugaccauucuccaccu

SEQ ID NO: 2979455 - RNA, 24 nt, Human
uugaccauucuccaccugccaggg

SEQ ID NO: 2979456 - RNA, 14 nt, Human
auccugagccagau

SEQ ID NO: 2979457 - RNA, 15 nt, Human
auccugagccagauu

SEQ ID NO: 2979458 - RNA, 17 nt, Human
auccugagccagauuuc

SEQ ID NO: 2979459 - RNA, 21 nt, Human
auccugagccagauuucacuc

SEQ ID NO: 2979460 - RNA, 18 nt, Human
auccugaggcuccacuug

SEQ ID NO: 2979461 - RNA, 16 nt, Human
auccugaggcuccacu

SEQ ID NO: 2979462 - RNA, 13 nt, Human
auccugaggcucc

SEQ ID NO: 2979463 - RNA, 11 nt, Human
auccugaggcu

SEQ ID NO: 2979464 - RNA, 16 nt, Human
auccugcaauuccacu

SEQ ID NO: 2979465 - RNA, 22 nt, Human
auccugaggcuccacuuggucu

SEQ ID NO: 2979466 - RNA, 13 nt, Human
auccugccccuga

SEQ ID NO: 2979467 - RNA, 18 nt, Human
auccucuguacagagccc

SEQ ID NO: 2979468 - RNA, 20 nt, Human
auccucuguacagagcccac

SEQ ID NO: 2979469 - RNA, 13 nt, Human
auccucuguugau

SEQ ID NO: 2979470 - RNA, 20 nt, Human
uucuuuugccguuauuaaaa

SEQ ID NO: 2979471 - RNA, 17 nt, Human
auccucuuugagugaag

SEQ ID NO: 2979472 - RNA, 12 nt, Human
auccugagccag

SEQ ID NO: 2979473 - RNA, 13 nt, Human
auccugagccaga

SEQ ID NO: 2979474 - RNA, 11 nt, Human
auccugagcca

SEQ ID NO: 2979475 - RNA, 21 nt, Human
auccuggcacccggccccugc

SEQ ID NO: 2979476 - RNA, 20 nt, Human
auccuggcacccggccccug

SEQ ID NO: 2979477 - RNA, 19 nt, Human
auccuggcacccggccccu

SEQ ID NO: 2979478 - RNA, 17 nt, Human
auccuggcacccggccc

SEQ ID NO: 2979479 - RNA, 15 nt, Human
auccuggaguucugg

SEQ ID NO: 2979480 - RNA, 16 nt, Human
auccuggacugagggg

SEQ ID NO: 2979481 - RNA, 23 nt, Human
auccuggcacccggccccugcug

SEQ ID NO: 2979482 - RNA, 22 nt, Human
auccuggcacccggccccugcu

SEQ ID NO: 2979483 - RNA, 17 nt, Human
auccuggcccagggcau

SEQ ID NO: 2979484 - RNA, 23 nt, Human
auccuggacugagggggccugga

SEQ ID NO: 2979485 - RNA, 21 nt, Human
auccuggcccagggcaucugg

SEQ ID NO: 2979486 - RNA, 18 nt, Human
auccuggcccagggcauc

SEQ ID NO: 2979487 - RNA, 22 nt, Human
uggaguuauugaagcagagugg

SEQ ID NO: 2979488 - RNA, 15 nt, Human
aggccacaagacccu

SEQ ID NO: 2979489 - RNA, 19 nt, Human
uggaugccugguggcagcu

SEQ ID NO: 2979490 - RNA, 18 nt, Human
uggaugccugguggcagc

SEQ ID NO: 2979491 - RNA, 16 nt, Human
uggaguucaucuugaa

SEQ ID NO: 2979492 - RNA, 17 nt, Human
uggaguucaucuugaau

SEQ ID NO: 2979493 - RNA, 20 nt, Human
uggaguucaucuugaauugu

SEQ ID NO: 2979494 - RNA, 15 nt, Human
uggaugccugguggc

SEQ ID NO: 2979495 - RNA, 18 nt, Human
uggacgagaaaacaauaa

SEQ ID NO: 2979496 - RNA, 16 nt, Human
aggccaaacucaccug

SEQ ID NO: 2979497 - RNA, 18 nt, Human
aggcauuuguuugaacug

SEQ ID NO: 2979498 - RNA, 14 nt, Human
aggccaaaggaagc

SEQ ID NO: 2979499 - RNA, 20 nt, Human
aggccaaacucaccugcccc

SEQ ID NO: 2979500 - RNA, 23 nt, Human
aggccaaaggaagcacaugccuc

SEQ ID NO: 2979501 - RNA, 20 nt, Human
aggccaaaggaagcacaugc

SEQ ID NO: 2979502 - RNA, 18 nt, Human
aggccaaggugggaggau

SEQ ID NO: 2979503 - RNA, 18 nt, Human
uggcaccagcagccugga

SEQ ID NO: 2979504 - RNA, 20 nt, Human
uggcacaucagcacgauuuc

SEQ ID NO: 2979505 - RNA, 22 nt, Human
uggcacaguuuucugagaaaga

SEQ ID NO: 2979506 - RNA, 22 nt, Human
uggauuaaacuuaaucuaaaug

SEQ ID NO: 2979507 - RNA, 20 nt, Human
uggcacaguuuucugagaaa

SEQ ID NO: 2979508 - RNA, 12 nt, Human
uggauguucuga

SEQ ID NO: 2979509 - RNA, 21 nt, Human
uggcagaguugaagacagagc

SEQ ID NO: 2979510 - RNA, 15 nt, Human
uggcacccggccccu

SEQ ID NO: 2979511 - RNA, 22 nt, Human
uggcagaguugaagacagagcu

SEQ ID NO: 2979512 - RNA, 12 nt, Human
aggccagagaca

SEQ ID NO: 2979513 - RNA, 20 nt, Human
aggccacaagacccuugugg

SEQ ID NO: 2979514 - RNA, 12 nt, Human
uggcagccccug

SEQ ID NO: 2979515 - RNA, 13 nt, Human
aggcccucugccc

SEQ ID NO: 2979516 - RNA, 14 nt, Human
aggcccucugccca

SEQ ID NO: 2979517 - RNA, 12 nt, Human
uggcaugggaau

SEQ ID NO: 2979518 - RNA, 15 nt, Human
uggcaugggaaugaa

SEQ ID NO: 2979519 - RNA, 17 nt, Human
uggccaggcuggucuca

SEQ ID NO: 2979520 - RNA, 15 nt, Human
uggccaggcuggucu

SEQ ID NO: 2979521 - RNA, 14 nt, Human
uggccucugcacuc

SEQ ID NO: 2979522 - RNA, 15 nt, Human
uggccucugcacucc

SEQ ID NO: 2979523 - RNA, 17 nt, Human
uggccucugcacucccc

SEQ ID NO: 2979524 - RNA, 13 nt, Human
uggccucugcacu

SEQ ID NO: 2979525 - RNA, 21 nt, Human
aggccuggccagaugcaccag

SEQ ID NO: 2979526 - RNA, 17 nt, Human
aggccuggccagaugca

SEQ ID NO: 2979527 - RNA, 16 nt, Human
aggccuggccagaugc

SEQ ID NO: 2979528 - RNA, 15 nt, Human
aggccuggccagaug

SEQ ID NO: 2979529 - RNA, 23 nt, Human
aggccugggggcugggcagagga

SEQ ID NO: 2979530 - RNA, 23 nt, Human
aggccuggccagaugcaccagcc

SEQ ID NO: 2979531 - RNA, 22 nt, Human
aggccuggccagaugcaccagc

SEQ ID NO: 2979532 - RNA, 20 nt, Human
uggccccugcccggcugcgg

SEQ ID NO: 2979533 - RNA, 21 nt, Human
uggccccugcccggcugcgga

SEQ ID NO: 2979534 - RNA, 20 nt, Human
ugggaaagggauuuucagcc

SEQ ID NO: 2979535 - RNA, 16 nt, Human
ugggaaaggggaaguu

SEQ ID NO: 2979536 - RNA, 21 nt, Human
ugggaaagcauuguaaaugug

SEQ ID NO: 2979537 - RNA, 17 nt, Human
uggcuuaaaacaacacu

SEQ ID NO: 2979538 - RNA, 15 nt, Human
uggcuguuggcuggg

SEQ ID NO: 2979539 - RNA, 14 nt, Human
uggcugugucuccc

SEQ ID NO: 2979540 - RNA, 13 nt, Human
uggcuguuggcug

SEQ ID NO: 2979541 - RNA, 22 nt, Human
uggcuucacggaagagccuugc

SEQ ID NO: 2979542 - RNA, 23 nt, Human
uggcuucacggaagagccuugcg

SEQ ID NO: 2979543 - RNA, 18 nt, Human
uggcugccaaugggagcu

SEQ ID NO: 2979544 - RNA, 20 nt, Human
uggcugccaaugggagcuca

SEQ ID NO: 2979545 - RNA, 14 nt, Human
uggcugcagggagu

SEQ ID NO: 2979546 - RNA, 13 nt, Human
uggcugcagggag

SEQ ID NO: 2979547 - RNA, 15 nt, Human
uggcugcagggaguc

SEQ ID NO: 2979548 - RNA, 20 nt, Human
uggcucuuccaggcugggag

SEQ ID NO: 2979549 - RNA, 21 nt, Human
uggcucuuccaggcugggaga

SEQ ID NO: 2979550 - RNA, 19 nt, Human
uggcucuuccaggcuggga

SEQ ID NO: 2979551 - RNA, 18 nt, Human
uggcucaaguccucuuuu

SEQ ID NO: 2979552 - RNA, 12 nt, Human
uggcugcaaagg

SEQ ID NO: 2979553 - RNA, 20 nt, Human
aggcuggcgugcaguggugc

SEQ ID NO: 2979554 - RNA, 18 nt, Human
aggcuggcgugcaguggu

SEQ ID NO: 2979555 - RNA, 17 nt, Human
aggcuggcuuucagagu

SEQ ID NO: 2979556 - RNA, 22 nt, Human
uggcuagagguucaaagauauu

SEQ ID NO: 2979557 - RNA, 14 nt, Human
aggcugggagagcc

SEQ ID NO: 2979558 - RNA, 19 nt, Human
aggcuggcuuucagaguag

SEQ ID NO: 2979559 - RNA, 14 nt, Human
uggcuaugcauuug

SEQ ID NO: 2979560 - RNA, 17 nt, Human
uggcuaugcauuugaaa

SEQ ID NO: 2979561 - RNA, 15 nt, Human
uggcuaugcauuuga

SEQ ID NO: 2979562 - RNA, 19 nt, Human
uggcuaugcauuugaaaau

SEQ ID NO: 2979563 - RNA, 22 nt, Human
uggcuauuagagaucaaccccu

SEQ ID NO: 2979564 - RNA, 12 nt, Human
aggcucgagcau

SEQ ID NO: 2979565 - RNA, 19 nt, Human
aggcuccuuuagcgcccag

SEQ ID NO: 2979566 - RNA, 15 nt, Human
aggcucgagcaugcc

SEQ ID NO: 2979567 - RNA, 17 nt, Human
aggcucgagcaugccug

SEQ ID NO: 2979568 - RNA, 18 nt, Human
aggcucgagcaugccugg

SEQ ID NO: 2979569 - RNA, 19 nt, Human
aggcucgagcaugccugga

SEQ ID NO: 2979570 - RNA, 21 nt, Human
aggcucgagcaugccuggaug

SEQ ID NO: 2979571 - RNA, 11 nt, Human
aggcucucagg

SEQ ID NO: 2979572 - RNA, 12 nt, Human
aggcucucaggc

SEQ ID NO: 2979573 - RNA, 14 nt, Human
aggcucucaggcca

SEQ ID NO: 2979574 - RNA, 15 nt, Human
aggcucucaggccag

SEQ ID NO: 2979575 - RNA, 16 nt, Human
aggcucucaggccagc

SEQ ID NO: 2979576 - RNA, 18 nt, Human
aggcucucaggccagcug

SEQ ID NO: 2979577 - RNA, 19 nt, Human
aggcucucaggccagcugc

SEQ ID NO: 2979578 - RNA, 20 nt, Human
aggcucucaggccagcugcu

SEQ ID NO: 2979579 - RNA, 14 nt, Human
aggcucugcccuug

SEQ ID NO: 2979580 - RNA, 15 nt, Human
aggcucugcccuugg

SEQ ID NO: 2979581 - RNA, 13 nt, Human
aggcucugcccuu

SEQ ID NO: 2979582 - RNA, 12 nt, Human
aggcucugcccu

SEQ ID NO: 2979583 - RNA, 11 nt, Human
aggcucugccc

SEQ ID NO: 2979584 - RNA, 21 nt, Human
aggcucucaggccagcugcuu

SEQ ID NO: 2979585 - RNA, 16 nt, Human
aggcucugcccuuggu

SEQ ID NO: 2979586 - RNA, 17 nt, Human
aggcuggcgugcagugg

SEQ ID NO: 2979587 - RNA, 13 nt, Human
aggcuggcgugca

SEQ ID NO: 2979588 - RNA, 17 nt, Human
aggaagcuuacaugccu

SEQ ID NO: 2979589 - RNA, 18 nt, Human
aggaagcugugagagcag

SEQ ID NO: 2979590 - RNA, 18 nt, Human
aggaaggaaacccagcuc

SEQ ID NO: 2979591 - RNA, 17 nt, Human
aggaagccagcaggcuc

SEQ ID NO: 2979592 - RNA, 13 nt, Human
aggaagccagcag

SEQ ID NO: 2979593 - RNA, 19 nt, Human
aggaaggaaacccagcucu

SEQ ID NO: 2979594 - RNA, 15 nt, Human
aggaaggagaggaga

SEQ ID NO: 2979595 - RNA, 11 nt, Human
aggaauuuaaa

SEQ ID NO: 2979596 - RNA, 23 nt, Human
aggaauugacccacaagaaauga

SEQ ID NO: 2979597 - RNA, 16 nt, Human
ugcugagucugaaggc

SEQ ID NO: 2979598 - RNA, 17 nt, Human
ugcugagucugaaggcu

SEQ ID NO: 2979599 - RNA, 18 nt, Human
ugcugagucugaaggcug

SEQ ID NO: 2979600 - RNA, 21 nt, Human
ugcugagucugaaggcugggu

SEQ ID NO: 2979601 - RNA, 22 nt, Human
ugcugagucugaaggcuggguu

SEQ ID NO: 2979602 - RNA, 23 nt, Human
ugcugagucugaaggcuggguuc

SEQ ID NO: 2979603 - RNA, 13 nt, Human
aggaagacuucau

SEQ ID NO: 2979604 - RNA, 19 nt, Human
aggaagacuucaucccucu

SEQ ID NO: 2979605 - RNA, 13 nt, Human
aggaagacuuugg

SEQ ID NO: 2979606 - RNA, 14 nt, Human
aggaagacuuugga

SEQ ID NO: 2979607 - RNA, 23 nt, Human
aggaagcacaugccucucucagg

SEQ ID NO: 2979608 - RNA, 24 nt, Human
aggaagcacaugccucucucaggc

SEQ ID NO: 2979609 - RNA, 14 nt, Human
aggaagccagcagg

SEQ ID NO: 2979610 - RNA, 15 nt, Human
aggaagccagcaggc

SEQ ID NO: 2979611 - RNA, 22 nt, Human
aggaagcacaugccucucucag

SEQ ID NO: 2979612 - RNA, 18 nt, Human
agcugggacuacaggcac

SEQ ID NO: 2979613 - RNA, 16 nt, Human
agcugggacuacaggc

SEQ ID NO: 2979614 - RNA, 19 nt, Human
agcugggacuacaggcacc

SEQ ID NO: 2979615 - RNA, 17 nt, Human
ugcucccaccuggcucu

SEQ ID NO: 2979616 - RNA, 18 nt, Human
ugcucccaccuggcucug

SEQ ID NO: 2979617 - RNA, 16 nt, Human
ugcucccaccuggcuc

SEQ ID NO: 2979618 - RNA, 16 nt, Human
ugcuccagcuguucag

SEQ ID NO: 2979619 - RNA, 19 nt, Human
ugcuccagcuguucagcug

SEQ ID NO: 2979620 - RNA, 13 nt, Human
ugcuccagccugg

SEQ ID NO: 2979621 - RNA, 15 nt, Human
ugcugagucugaagg

SEQ ID NO: 2979622 - RNA, 14 nt, Human
ugcugagucugaag

SEQ ID NO: 2979623 - RNA, 16 nt, Human
ugcucugcugacagac

SEQ ID NO: 2979624 - RNA, 22 nt, Human
ugcucugcugacagacacaggc

SEQ ID NO: 2979625 - RNA, 21 nt, Human
ugcucugcugacagacacagg

SEQ ID NO: 2979626 - RNA, 11 nt, Human
ugcuguacaua

SEQ ID NO: 2979627 - RNA, 18 nt, Human
ugcuguaacuuucugaaa

SEQ ID NO: 2979628 - RNA, 22 nt, Human
ugcuguacauacuuuuuggguu

SEQ ID NO: 2979629 - RNA, 17 nt, Human
ugcuguacauacuuuuu

SEQ ID NO: 2979630 - RNA, 15 nt, Human
ugcuguacauacuuu

SEQ ID NO: 2979631 - RNA, 23 nt, Human
ugcuguauuuuaaaagaaugauu

SEQ ID NO: 2979632 - RNA, 14 nt, Human
ugcuggagcucugc

SEQ ID NO: 2979633 - RNA, 13 nt, Human
ugcuggagcucug

SEQ ID NO: 2979634 - RNA, 15 nt, Human
ugcugcccugugagu

SEQ ID NO: 2979635 - RNA, 13 nt, Human
ugcugcccuguga

SEQ ID NO: 2979636 - RNA, 14 nt, Human
ugcugcccugugag

SEQ ID NO: 2979637 - RNA, 12 nt, Human
ugcugcccugug

SEQ ID NO: 2979638 - RNA, 16 nt, Human
ugcuggcugguuagag

SEQ ID NO: 2979639 - RNA, 14 nt, Human
aggacacugauaug

SEQ ID NO: 2979640 - RNA, 19 nt, Human
aggacacuaaccacgcugg

SEQ ID NO: 2979641 - RNA, 23 nt, Human
aggacacuaaccacgcuggaccu

SEQ ID NO: 2979642 - RNA, 23 nt, Human
aggacagcccuucuuuccacaga

SEQ ID NO: 2979643 - RNA, 22 nt, Human
aggacagggaggugaccccagg

SEQ ID NO: 2979644 - RNA, 16 nt, Human
ugcuucaaggauccug

SEQ ID NO: 2979645 - RNA, 18 nt, Human
ugcuucaaggauccugag

SEQ ID NO: 2979646 - RNA, 19 nt, Human
ugcuucaaggauccugagc

SEQ ID NO: 2979647 - RNA, 14 nt, Human
ugcuucagccuccc

SEQ ID NO: 2979648 - RNA, 13 nt, Human
ugcuucagccucc

SEQ ID NO: 2979649 - RNA, 12 nt, Human
ugcuucaaggau

SEQ ID NO: 2979650 - RNA, 13 nt, Human
ugcuuauacacuu

SEQ ID NO: 2979651 - RNA, 18 nt, Human
ugcuuggcccaggaguuu

SEQ ID NO: 2979652 - RNA, 23 nt, Human
ugcuuggcccaggaguuuggcca

SEQ ID NO: 2979653 - RNA, 12 nt, Human
ugcuugggcuuc

SEQ ID NO: 2979654 - RNA, 16 nt, Human
ugcuugggcuucaucc

SEQ ID NO: 2979655 - RNA, 15 nt, Human
ugcuuggcccaggag

SEQ ID NO: 2979656 - RNA, 16 nt, Human
ugcuuggcccaggagu

SEQ ID NO: 2979657 - RNA, 12 nt, Human
ugcuuggcccag

SEQ ID NO: 2979658 - RNA, 21 nt, Human
ugcuuggaggaaggaaaccca

SEQ ID NO: 2979659 - RNA, 16 nt, Human
ugcuugccaucccucc

SEQ ID NO: 2979660 - RNA, 15 nt, Human
ugcuugccaucccuc

SEQ ID NO: 2979661 - RNA, 22 nt, Human
uggaaaggaaugcaaagaugaa

SEQ ID NO: 2979662 - RNA, 21 nt, Human
uggaaaggaaugcaaagauga

SEQ ID NO: 2979663 - RNA, 15 nt, Human
uggaaaggaaugcaa

SEQ ID NO: 2979664 - RNA, 12 nt, Human
uggaaaggaaug

SEQ ID NO: 2979665 - RNA, 15 nt, Human
uggaaauauuaagaa

SEQ ID NO: 2979666 - RNA, 19 nt, Human
ugcuugggcuucauccucc

SEQ ID NO: 2979667 - RNA, 17 nt, Human
ugcuuuuaaaaaaaaau

SEQ ID NO: 2979668 - RNA, 18 nt, Human
aggacauugcggacagcc

SEQ ID NO: 2979669 - RNA, 17 nt, Human
aggacauugcggacagc

SEQ ID NO: 2979670 - RNA, 15 nt, Human
aggacauugcggaca

SEQ ID NO: 2979671 - RNA, 23 nt, Human
aggacauugcggacagccacggc

SEQ ID NO: 2979672 - RNA, 19 nt, Human
aggacauugcggacagcca

SEQ ID NO: 2979673 - RNA, 20 nt, Human
aggacugaauuaugaaacuu

SEQ ID NO: 2979674 - RNA, 19 nt, Human
aggacugaauuaugaaacu

SEQ ID NO: 2979675 - RNA, 11 nt, Human
aggagaaacug

SEQ ID NO: 2979676 - RNA, 23 nt, Human
aggacuuuucuuuguggcuuccu

SEQ ID NO: 2979677 - RNA, 17 nt, Human
aggagauuggaaggaac

SEQ ID NO: 2979678 - RNA, 22 nt, Human
aggagccccgaggccuucucug

SEQ ID NO: 2979679 - RNA, 14 nt, Human
aggagcagccacau

SEQ ID NO: 2979680 - RNA, 15 nt, Human
aggaguuuggccaga

SEQ ID NO: 2979681 - RNA, 16 nt, Human
aggaguuuggccagaa

SEQ ID NO: 2979682 - RNA, 17 nt, Human
aggaguuuggccagaag

SEQ ID NO: 2979683 - RNA, 18 nt, Human
aggaguuuggccagaagu

SEQ ID NO: 2979684 - RNA, 14 nt, Human
aggaguuuggccag

SEQ ID NO: 2979685 - RNA, 15 nt, Human
aggauccugagccag

SEQ ID NO: 2979686 - RNA, 16 nt, Human
aggauccugagccaga

SEQ ID NO: 2979687 - RNA, 21 nt, Human
aggauacaaaagcaugugaga

SEQ ID NO: 2979688 - RNA, 21 nt, Human
aggaucucuugagccugggag

SEQ ID NO: 2979689 - RNA, 22 nt, Human
aggaucucuugagccugggagg

SEQ ID NO: 2979690 - RNA, 17 nt, Human
aggauccugagccagau

SEQ ID NO: 2979691 - RNA, 18 nt, Human
aggauccugagccagauu

SEQ ID NO: 2979692 - RNA, 16 nt, Human
aggaugaucuaggaag

SEQ ID NO: 2979693 - RNA, 17 nt, Human
aggaugaucuaggaaga

SEQ ID NO: 2979694 - RNA, 21 nt, Human
uggaaauuagguugaaacaua

SEQ ID NO: 2979695 - RNA, 20 nt, Human
uggaaauuagguugaaacau

SEQ ID NO: 2979696 - RNA, 19 nt, Human
uggaaauuagguugaaaca

SEQ ID NO: 2979697 - RNA, 23 nt, Human
uggaaaugggcagagcagagacc

SEQ ID NO: 2979698 - RNA, 20 nt, Human
uggaaauauuaagaaagacu

SEQ ID NO: 2979699 - RNA, 22 nt, Human
uggaaauuagguugaaacauau

SEQ ID NO: 2979700 - RNA, 18 nt, Human
uggaauuggagcucgugg

SEQ ID NO: 2979701 - RNA, 17 nt, Human
aggcaacucaucuuagg

SEQ ID NO: 2979702 - RNA, 14 nt, Human
aggcaaauguuuau

SEQ ID NO: 2979703 - RNA, 20 nt, Human
aggaugaucuaggaagacuu

SEQ ID NO: 2979704 - RNA, 14 nt, Human
aggaugcccaaaga

SEQ ID NO: 2979705 - RNA, 19 nt, Human
aggaugcccaaagaugcag

SEQ ID NO: 2979706 - RNA, 19 nt, Human
aggauuuugauccaagcug

SEQ ID NO: 2979707 - RNA, 14 nt, Human
uggacccugaggcc

SEQ ID NO: 2979708 - RNA, 12 nt, Human
uggacccugagg

SEQ ID NO: 2979709 - RNA, 13 nt, Human
uggacccugaggc

SEQ ID NO: 2979710 - RNA, 16 nt, Human
uggacacagcucuucu

SEQ ID NO: 2979711 - RNA, 15 nt, Human
uggacacagcucuuc

SEQ ID NO: 2979712 - RNA, 18 nt, Human
uggacacagcucuucucc

SEQ ID NO: 2979713 - RNA, 13 nt, Human
ugaugacuguuuu

SEQ ID NO: 2979714 - RNA, 15 nt, Human
ugaugacauucccug

SEQ ID NO: 2979715 - RNA, 18 nt, Human
ugaugacauucccugcua

SEQ ID NO: 2979716 - RNA, 12 nt, Human
ugaugaagaagu

SEQ ID NO: 2979717 - RNA, 11 nt, Human
ugaugaagaag

SEQ ID NO: 2979718 - RNA, 16 nt, Human
ugauccuaguuccacc

SEQ ID NO: 2979719 - RNA, 15 nt, Human
ugauccucccaccuc

SEQ ID NO: 2979720 - RNA, 21 nt, Human
ugauccucccaccucagccuc

SEQ ID NO: 2979721 - RNA, 22 nt, Human
ugauccucccaccucagccucc

SEQ ID NO: 2979722 - RNA, 14 nt, Human
ugauggggcccugc

SEQ ID NO: 2979723 - RNA, 15 nt, Human
ugauggggcccugcc

SEQ ID NO: 2979724 - RNA, 16 nt, Human
ugauggggcccugccu

SEQ ID NO: 2979725 - RNA, 19 nt, Human
ugauggggcccugccuccu

SEQ ID NO: 2979726 - RNA, 19 nt, Human
ugaugggaaagcauuguaa

SEQ ID NO: 2979727 - RNA, 13 nt, Human
ugaugagaggaaa

SEQ ID NO: 2979728 - RNA, 14 nt, Human
ugaugagaggaaau

SEQ ID NO: 2979729 - RNA, 15 nt, Human
ugaugagaggaaauc

SEQ ID NO: 2979730 - RNA, 16 nt, Human
ugaugagaggaaauca

SEQ ID NO: 2979731 - RNA, 14 nt, Human
ugaugggaaagcau

SEQ ID NO: 2979732 - RNA, 23 nt, Human
ugaugcuucuucagagacuccug

SEQ ID NO: 2979733 - RNA, 23 nt, Human
ugauuaaguaaugauaacuggaa

SEQ ID NO: 2979734 - RNA, 16 nt, Human
agccacugcaccgggc

SEQ ID NO: 2979735 - RNA, 19 nt, Human
ugauuaaccacuucagcug

SEQ ID NO: 2979736 - RNA, 18 nt, Human
ugauuaaguaaugauaac

SEQ ID NO: 2979737 - RNA, 20 nt, Human
ugauuaaauucuugcaaagu

SEQ ID NO: 2979738 - RNA, 19 nt, Human
ugauuaaauucuugcaaag

SEQ ID NO: 2979739 - RNA, 15 nt, Human
ugauggugcaaugac

SEQ ID NO: 2979740 - RNA, 13 nt, Human
ugauggugcaaug

SEQ ID NO: 2979741 - RNA, 21 nt, Human
agccagcaguucagagcugcc

SEQ ID NO: 2979742 - RNA, 20 nt, Human
agccagcaguucagagcugc

SEQ ID NO: 2979743 - RNA, 22 nt, Human
agccagcaguucagagcugccc

SEQ ID NO: 2979744 - RNA, 10 nt, Human
agccagagga

SEQ ID NO: 2979745 - RNA, 11 nt, Human
agccagaggag

SEQ ID NO: 2979746 - RNA, 19 nt, Human
agccagcaguucagagcug

SEQ ID NO: 2979747 - RNA, 17 nt, Human
agccagcaguucagagc

SEQ ID NO: 2979748 - RNA, 15 nt, Human
agccagcaguucaga

SEQ ID NO: 2979749 - RNA, 19 nt, Human
agccacugcaccgggccac

SEQ ID NO: 2979750 - RNA, 18 nt, Human
agccacugcaccgggcca

SEQ ID NO: 2979751 - RNA, 19 nt, Human
agccagacuggcacaguuu

SEQ ID NO: 2979752 - RNA, 20 nt, Human
ugauuuagcaggaagcugug

SEQ ID NO: 2979753 - RNA, 17 nt, Human
ugauuuagcaggaagcu

SEQ ID NO: 2979754 - RNA, 22 nt, Human
ugauuuccguuaaaauaccagc

SEQ ID NO: 2979755 - RNA, 18 nt, Human
ugauuuccguuaaaauac

SEQ ID NO: 2979756 - RNA, 17 nt, Human
ugauuuggggauauuuu

SEQ ID NO: 2979757 - RNA, 14 nt, Human
agcccaggaaaggc

SEQ ID NO: 2979758 - RNA, 15 nt, Human
ugauucauaaugacu

SEQ ID NO: 2979759 - RNA, 16 nt, Human
ugauucauaaugacuu

SEQ ID NO: 2979760 - RNA, 21 nt, Human
ugauucauaaugacuuaagca

SEQ ID NO: 2979761 - RNA, 23 nt, Human
ugauucccaagcucugcuccucu

SEQ ID NO: 2979762 - RNA, 22 nt, Human
ugauucccaagcucugcuccuc

SEQ ID NO: 2979763 - RNA, 16 nt, Human
ugauucccugauuuaa

SEQ ID NO: 2979764 - RNA, 15 nt, Human
ugauucccugauuua

SEQ ID NO: 2979765 - RNA, 15 nt, Human
agcccacuucugcca

SEQ ID NO: 2979766 - RNA, 14 nt, Human
agcccacuucugcc

SEQ ID NO: 2979767 - RNA, 13 nt, Human
agcccacuucugc

SEQ ID NO: 2979768 - RNA, 13 nt, Human
agccaguaaaugg

SEQ ID NO: 2979769 - RNA, 21 nt, Human
agccaguaaaugggggugcau

SEQ ID NO: 2979770 - RNA, 11 nt, Human
agcccugucuc

SEQ ID NO: 2979771 - RNA, 18 nt, Human
agcccugucuccucucuc

SEQ ID NO: 2979772 - RNA, 16 nt, Human
agcccuuagcagggaa

SEQ ID NO: 2979773 - RNA, 17 nt, Human
ugcagacucuacagagg

SEQ ID NO: 2979774 - RNA, 16 nt, Human
ugcagacucuacagag

SEQ ID NO: 2979775 - RNA, 20 nt, Human
agccgagauagccaaggcca

SEQ ID NO: 2979776 - RNA, 21 nt, Human
agccgagauagccaaggccaa

SEQ ID NO: 2979777 - RNA, 17 nt, Human
agccgagaucacgccac

SEQ ID NO: 2979778 - RNA, 21 nt, Human
agcccuuagcagggaaacagc

SEQ ID NO: 2979779 - RNA, 14 nt, Human
ugcagaagacagua

SEQ ID NO: 2979780 - RNA, 15 nt, Human
ugcagaagacaguau

SEQ ID NO: 2979781 - RNA, 22 nt, Human
ugcagacaggcaagcaccuccu

SEQ ID NO: 2979782 - RNA, 15 nt, Human
ugcacacauuuuuua

SEQ ID NO: 2979783 - RNA, 13 nt, Human
ugcacacauuuuu

SEQ ID NO: 2979784 - RNA, 12 nt, Human
ugcacacauuuu

SEQ ID NO: 2979785 - RNA, 11 nt, Human
ugcacacauuu

SEQ ID NO: 2979786 - RNA, 16 nt, Human
ugcacuccccugcugg

SEQ ID NO: 2979787 - RNA, 17 nt, Human
ugcacuccccugcuggg

SEQ ID NO: 2979788 - RNA, 19 nt, Human
ugcacuccccugcugggug

SEQ ID NO: 2979789 - RNA, 18 nt, Human
agccgagaucacgccacu

SEQ ID NO: 2979790 - RNA, 19 nt, Human
agccucaaccuccugggcu

SEQ ID NO: 2979791 - RNA, 20 nt, Human
agccucaaccuccugggcua

SEQ ID NO: 2979792 - RNA, 18 nt, Human
agccucacagcagugaga

SEQ ID NO: 2979793 - RNA, 14 nt, Human
agccucacagcagu

SEQ ID NO: 2979794 - RNA, 17 nt, Human
agccucacaguccuuac

SEQ ID NO: 2979795 - RNA, 18 nt, Human
agccucacaguccuuacc

SEQ ID NO: 2979796 - RNA, 22 nt, Human
agccucacagcagugagacugg

SEQ ID NO: 2979797 - RNA, 23 nt, Human
agccucugaaaaccaauguucuc

SEQ ID NO: 2979798 - RNA, 21 nt, Human
ugcagccucaaccuccugggc

SEQ ID NO: 2979799 - RNA, 20 nt, Human
ugcagccucaaccuccuggg

SEQ ID NO: 2979800 - RNA, 22 nt, Human
ugcagccucaaccuccugggcu

SEQ ID NO: 2979801 - RNA, 18 nt, Human
ugcacacaccagagccca

SEQ ID NO: 2979802 - RNA, 17 nt, Human
ugcacacaccagagccc

SEQ ID NO: 2979803 - RNA, 21 nt, Human
ugcacacaccagagcccaccu

SEQ ID NO: 2979804 - RNA, 16 nt, Human
agcccugguggcagug

SEQ ID NO: 2979805 - RNA, 15 nt, Human
agcccugguggcagu

SEQ ID NO: 2979806 - RNA, 14 nt, Human
agcccugguggcag

SEQ ID NO: 2979807 - RNA, 22 nt, Human
agccccauucugccugcccagg

SEQ ID NO: 2979808 - RNA, 21 nt, Human
agccccauucugccugcccag

SEQ ID NO: 2979809 - RNA, 18 nt, Human
agccccaaaacucuccuc

SEQ ID NO: 2979810 - RNA, 20 nt, Human
agccccauucugccugccca

SEQ ID NO: 2979811 - RNA, 16 nt, Human
agccccaaaacucucc

SEQ ID NO: 2979812 - RNA, 17 nt, Human
agccccaaaacucuccu

SEQ ID NO: 2979813 - RNA, 21 nt, Human
agcccaggccuccuacagcuu

SEQ ID NO: 2979814 - RNA, 21 nt, Human
ugcaaaccaucauugaaaucu

SEQ ID NO: 2979815 - RNA, 22 nt, Human
ugcagcucuccccuucucugua

SEQ ID NO: 2979816 - RNA, 20 nt, Human
ugcagcucuccccuucucug

SEQ ID NO: 2979817 - RNA, 18 nt, Human
agccuuccagggguggga

SEQ ID NO: 2979818 - RNA, 15 nt, Human
agccuugaacuuuga

SEQ ID NO: 2979819 - RNA, 22 nt, Human
agccuugaacuuugaccucugc

SEQ ID NO: 2979820 - RNA, 16 nt, Human
agccuugaacuuugac

SEQ ID NO: 2979821 - RNA, 13 nt, Human
agccuugaacuuu

SEQ ID NO: 2979822 - RNA, 22 nt, Human
agccuugaccauucuccaccug

SEQ ID NO: 2979823 - RNA, 23 nt, Human
agccuugaccauucuccaccugc

SEQ ID NO: 2979824 - RNA, 22 nt, Human
agcgauucuucugcuucagccu

SEQ ID NO: 2979825 - RNA, 20 nt, Human
ugcauuuaaaagauacaguu

SEQ ID NO: 2979826 - RNA, 18 nt, Human
ugcauuugaggucuguuc

SEQ ID NO: 2979827 - RNA, 19 nt, Human
ugcauuugaggucuguucu

SEQ ID NO: 2979828 - RNA, 17 nt, Human
ugccagccacugugaua

SEQ ID NO: 2979829 - RNA, 21 nt, Human
ugcauuugaggucuguucuuu

SEQ ID NO: 2979830 - RNA, 20 nt, Human
ugcauuugaggucuguucuu

SEQ ID NO: 2979831 - RNA, 20 nt, Human
agcggggacagcuccuucug

SEQ ID NO: 2979832 - RNA, 19 nt, Human
agcggggacagcuccuucu

SEQ ID NO: 2979833 - RNA, 23 nt, Human
agcggcuggcagcccaccccuca

SEQ ID NO: 2979834 - RNA, 22 nt, Human
agcggggacagcuccuucuguc

SEQ ID NO: 2979835 - RNA, 15 nt, Human
ugccagugccugggu

SEQ ID NO: 2979836 - RNA, 12 nt, Human
ugccagugccug

SEQ ID NO: 2979837 - RNA, 16 nt, Human
ugccagugccugggug

SEQ ID NO: 2979838 - RNA, 13 nt, Human
agcggcuggcagc

SEQ ID NO: 2979839 - RNA, 18 nt, Human
ugccagcuuaucucaggg

SEQ ID NO: 2979840 - RNA, 16 nt, Human
ugccccauucaacauc

SEQ ID NO: 2979841 - RNA, 20 nt, Human
ugcccuaaaguguauuuuuu

SEQ ID NO: 2979842 - RNA, 23 nt, Human
ugccccgaacauguuuuucuucu

SEQ ID NO: 2979843 - RNA, 18 nt, Human
ugcccaggccccugccac

SEQ ID NO: 2979844 - RNA, 17 nt, Human
ugcccaggccccugcca

SEQ ID NO: 2979845 - RNA, 15 nt, Human
ugcccaggccccugc

SEQ ID NO: 2979846 - RNA, 14 nt, Human
ugcccaggccccug

SEQ ID NO: 2979847 - RNA, 13 nt, Human
ugcccagccccuu

SEQ ID NO: 2979848 - RNA, 12 nt, Human
ugcccagccccu

SEQ ID NO: 2979849 - RNA, 16 nt, Human
ugcccagccccuucug

SEQ ID NO: 2979850 - RNA, 17 nt, Human
ugcccagccccuucuga

SEQ ID NO: 2979851 - RNA, 17 nt, Human
ugcccaaagaugcagcc

SEQ ID NO: 2979852 - RNA, 20 nt, Human
ugcccaaagaugcagccggu

SEQ ID NO: 2979853 - RNA, 22 nt, Human
ugccauuuaaagcuuauuaaaa

SEQ ID NO: 2979854 - RNA, 18 nt, Human
agcuccaagaauuucuag

SEQ ID NO: 2979855 - RNA, 15 nt, Human
agcuccaagcuccca

SEQ ID NO: 2979856 - RNA, 15 nt, Human
agcuccaagaauuuc

SEQ ID NO: 2979857 - RNA, 20 nt, Human
agcucagggccuggcucagg

SEQ ID NO: 2979858 - RNA, 18 nt, Human
agcucagggccuggcuca

SEQ ID NO: 2979859 - RNA, 19 nt, Human
agcucagggccuggcucag

SEQ ID NO: 2979860 - RNA, 12 nt, Human
agcucagggccu

SEQ ID NO: 2979861 - RNA, 13 nt, Human
agcucagggccug

SEQ ID NO: 2979862 - RNA, 19 nt, Human
agcuauucaguaauaacuc

SEQ ID NO: 2979863 - RNA, 19 nt, Human
agcuauggugucauaggcu

SEQ ID NO: 2979864 - RNA, 21 nt, Human
agcuaggccuggccagaugca

SEQ ID NO: 2979865 - RNA, 20 nt, Human
agcuaggugacauauacaua

SEQ ID NO: 2979866 - RNA, 19 nt, Human
agcuaggugacauauacau

SEQ ID NO: 2979867 - RNA, 14 nt, Human
agcuaggugacaua

SEQ ID NO: 2979868 - RNA, 18 nt, Human
ugccucagaaaacaagga

SEQ ID NO: 2979869 - RNA, 22 nt, Human
ugccucccaucacccgcuaaga

SEQ ID NO: 2979870 - RNA, 17 nt, Human
ugccucucucaggccaa

SEQ ID NO: 2979871 - RNA, 16 nt, Human
ugccucucucaggcca

SEQ ID NO: 2979872 - RNA, 15 nt, Human
ugccuccccuccucu

SEQ ID NO: 2979873 - RNA, 14 nt, Human
ugccuccccuccuc

SEQ ID NO: 2979874 - RNA, 13 nt, Human
ugccuccccuccu

SEQ ID NO: 2979875 - RNA, 12 nt, Human
ugccuccccucc

SEQ ID NO: 2979876 - RNA, 11 nt, Human
ugccuccccuc

SEQ ID NO: 2979877 - RNA, 15 nt, Human
ugccucaccccuugc

SEQ ID NO: 2979878 - RNA, 20 nt, Human
ugccgcagcccugcagaggg

SEQ ID NO: 2979879 - RNA, 19 nt, Human
ugcccuuaccugccaggaa

SEQ ID NO: 2979880 - RNA, 23 nt, Human
ugcccugugaguacuacaguccu

SEQ ID NO: 2979881 - RNA, 16 nt, Human
agcucuucuccaggcu

SEQ ID NO: 2979882 - RNA, 15 nt, Human
agcucuucuccaggc

SEQ ID NO: 2979883 - RNA, 15 nt, Human
ugcccugugggcccc

SEQ ID NO: 2979884 - RNA, 18 nt, Human
ugcccugugggcccccaa

SEQ ID NO: 2979885 - RNA, 22 nt, Human
ugcccuuaccugccaggaagcc

SEQ ID NO: 2979886 - RNA, 18 nt, Human
agcugcccucuccugggc

SEQ ID NO: 2979887 - RNA, 17 nt, Human
agcugcccucuccuggg

SEQ ID NO: 2979888 - RNA, 20 nt, Human
agcugcccucuccugggcag

SEQ ID NO: 2979889 - RNA, 19 nt, Human
agcugcccucuccugggca

SEQ ID NO: 2979890 - RNA, 21 nt, Human
agcugcccucuccugggcagc

SEQ ID NO: 2979891 - RNA, 10 nt, Human
agcugccugu

SEQ ID NO: 2979892 - RNA, 16 nt, Human
agcugcccucuccugg

SEQ ID NO: 2979893 - RNA, 22 nt, Human
agcugcuuuugucuaugggacu

SEQ ID NO: 2979894 - RNA, 13 nt, Human
agcugccuguuca

SEQ ID NO: 2979895 - RNA, 24 nt, Human
agcugcuuuugucuaugggacuca

SEQ ID NO: 2979896 - RNA, 23 nt, Human
agcugcuuuugucuaugggacuc

SEQ ID NO: 2979897 - RNA, 15 nt, Human
agcugggacuacagg

SEQ ID NO: 2979898 - RNA, 11 nt, Human
ugccucugccu

SEQ ID NO: 2979899 - RNA, 16 nt, Human
ugccucugacacacag

SEQ ID NO: 2979900 - RNA, 14 nt, Human
ugccucugacacac

SEQ ID NO: 2979901 - RNA, 19 nt, Human
ugccugcccaggccccugc

SEQ ID NO: 2979902 - RNA, 18 nt, Human
ugccugcccaggccccug

SEQ ID NO: 2979903 - RNA, 17 nt, Human
ugccugcccaggccccu

SEQ ID NO: 2979904 - RNA, 23 nt, Human
agcucugcccauccugccccuga

SEQ ID NO: 2979905 - RNA, 23 nt, Human
agcucuguccugggagugagcug

SEQ ID NO: 2979906 - RNA, 19 nt, Human
agcuccagcucaccagccc

SEQ ID NO: 2979907 - RNA, 18 nt, Human
agcuccagcucaccagcc

SEQ ID NO: 2979908 - RNA, 21 nt, Human
agcuccagcucaccagcccca

SEQ ID NO: 2979909 - RNA, 23 nt, Human
agcuccuucuguccuacucugug

SEQ ID NO: 2979910 - RNA, 22 nt, Human
agcuccuucuguccuacucugu

SEQ ID NO: 2979911 - RNA, 12 nt, Human
ugcccucuccug

SEQ ID NO: 2979912 - RNA, 15 nt, Human
ugcccucuccugggc

SEQ ID NO: 2979913 - RNA, 14 nt, Human
ugcccucuccuggg

SEQ ID NO: 2979914 - RNA, 13 nt, Human
ugcccucuccugg

SEQ ID NO: 2979915 - RNA, 20 nt, Human
ugcccucuccugggcagcug

SEQ ID NO: 2979916 - RNA, 18 nt, Human
ugcccucuccugggcagc

SEQ ID NO: 2979917 - RNA, 17 nt, Human
ugcccucuccugggcag

SEQ ID NO: 2979918 - RNA, 16 nt, Human
ugcccucuccugggca

SEQ ID NO: 2979919 - RNA, 23 nt, Human
ugcccucuccugggcagcugccu

SEQ ID NO: 2979920 - RNA, 22 nt, Human
ugcccucuccugggcagcugcc

SEQ ID NO: 2979921 - RNA, 17 nt, Human
agcuccaagcucccagg

SEQ ID NO: 2979922 - RNA, 16 nt, Human
agcuccaagcucccag

SEQ ID NO: 2979923 - RNA, 18 nt, Human
agcuccaagcucccaggc

SEQ ID NO: 2979924 - RNA, 19 nt, Human
agcuccaagcucccaggca

SEQ ID NO: 2979925 - RNA, 17 nt, Human
agcuccagcucaccagc

SEQ ID NO: 2979926 - RNA, 13 nt, Human
agcuccagcucac

SEQ ID NO: 2979927 - RNA, 13 nt, Human
aguuuggccagaa

SEQ ID NO: 2979928 - RNA, 14 nt, Human
aguuuggccagaag

SEQ ID NO: 2979929 - RNA, 16 nt, Human
aguuugguuucuagca

SEQ ID NO: 2979930 - RNA, 22 nt, Human
aguuuucacucuuauugcccac

SEQ ID NO: 2979931 - RNA, 12 nt, Human
aguuuggccaga

SEQ ID NO: 2979932 - RNA, 21 nt, Human
aguuucuccaagcaggacaug

SEQ ID NO: 2979933 - RNA, 13 nt, Human
aguuucuccaagc

SEQ ID NO: 2979934 - RNA, 15 nt, Human
aguuucuccaagcag

SEQ ID NO: 2979935 - RNA, 13 nt, Human
uuaaauucuugca

SEQ ID NO: 2979936 - RNA, 16 nt, Human
uuaaauucuugcaaag

SEQ ID NO: 2979937 - RNA, 17 nt, Human
uuaaaccgccaaggcug

SEQ ID NO: 2979938 - RNA, 21 nt, Human
uuaaauaaugugaaacuggau

SEQ ID NO: 2979939 - RNA, 20 nt, Human
uuaaauaaugugaaacugga

SEQ ID NO: 2979940 - RNA, 22 nt, Human
uuaaauaaugugaaacuggauu

SEQ ID NO: 2979941 - RNA, 19 nt, Human
uuaaauaaugugaaacugg

SEQ ID NO: 2979942 - RNA, 15 nt, Human
uuaaauaaaucauaa

SEQ ID NO: 2979943 - RNA, 13 nt, Human
uuaaauaaaucau

SEQ ID NO: 2979944 - RNA, 18 nt, Human
uuaaaaaagaaacauuug

SEQ ID NO: 2979945 - RNA, 15 nt, Human
uuaaaaaagaaacau

SEQ ID NO: 2979946 - RNA, 20 nt, Human
aguugccagucaccccggcc

SEQ ID NO: 2979947 - RNA, 22 nt, Human
aguugcauagguuuaauaauuu

SEQ ID NO: 2979948 - RNA, 20 nt, Human
uuaaaaaugguuuaaauggu

SEQ ID NO: 2979949 - RNA, 17 nt, Human
uuaaaacaacacucaca

SEQ ID NO: 2979950 - RNA, 18 nt, Human
uuaaaaaguggaaaaaua

SEQ ID NO: 2979951 - RNA, 13 nt, Human
uguuuucaaaugu

SEQ ID NO: 2979952 - RNA, 14 nt, Human
uguuuucaaauguu

SEQ ID NO: 2979953 - RNA, 18 nt, Human
uguuuucaauuuuaaaca

SEQ ID NO: 2979954 - RNA, 21 nt, Human
uguuuucaauuuuaaacauau

SEQ ID NO: 2979955 - RNA, 15 nt, Human
uguuuucaguguaca

SEQ ID NO: 2979956 - RNA, 17 nt, Human
uguuuuauauagcaaga

SEQ ID NO: 2979957 - RNA, 14 nt, Human
uguuuuaggagcau

SEQ ID NO: 2979958 - RNA, 20 nt, Human
uguuuuauaauuuugugaag

SEQ ID NO: 2979959 - RNA, 13 nt, Human
uguuuuauaauuu

SEQ ID NO: 2979960 - RNA, 16 nt, Human
aguucucuccuucuuc

SEQ ID NO: 2979961 - RNA, 13 nt, Human
aguucucuccuuc

SEQ ID NO: 2979962 - RNA, 12 nt, Human
aguucucuccuu

SEQ ID NO: 2979963 - RNA, 15 nt, Human
uguuuucucuugaga

SEQ ID NO: 2979964 - RNA, 17 nt, Human
uguuuucaguguacaug

SEQ ID NO: 2979965 - RNA, 15 nt, Human
uguuugcuaagcauu

SEQ ID NO: 2979966 - RNA, 16 nt, Human
uguuugccucugccuc

SEQ ID NO: 2979967 - RNA, 14 nt, Human
uguuugccucugcc

SEQ ID NO: 2979968 - RNA, 14 nt, Human
uguugucagcugaa

SEQ ID NO: 2979969 - RNA, 19 nt, Human
uguuugcuaagcauuccaa

SEQ ID NO: 2979970 - RNA, 15 nt, Human
uguuuggggaugaga

SEQ ID NO: 2979971 - RNA, 22 nt, Human
aguucuugccuuggcugcaguu

SEQ ID NO: 2979972 - RNA, 14 nt, Human
aguugauagcacag

SEQ ID NO: 2979973 - RNA, 15 nt, Human
aguugauagcacaga

SEQ ID NO: 2979974 - RNA, 19 nt, Human
aguugauagcacagacccu

SEQ ID NO: 2979975 - RNA, 20 nt, Human
aguugauagcacagacccug

SEQ ID NO: 2979976 - RNA, 21 nt, Human
aguugauagcacagacccugc

SEQ ID NO: 2979977 - RNA, 14 nt, Human
aguucugaagaaga

SEQ ID NO: 2979978 - RNA, 13 nt, Human
aguucugaagaag

SEQ ID NO: 2979979 - RNA, 15 nt, Human
aguucugaagaagau

SEQ ID NO: 2979980 - RNA, 22 nt, Human
aguugauagcacagacccugcc

SEQ ID NO: 2979981 - RNA, 23 nt, Human
aguugauagcacagacccugccc

SEQ ID NO: 2979982 - RNA, 21 nt, Human
aguugauaugccuuuucccaa

SEQ ID NO: 2979983 - RNA, 13 nt, Human
aguugauucagcu

SEQ ID NO: 2979984 - RNA, 14 nt, Human
aguugauucagcuc

SEQ ID NO: 2979985 - RNA, 15 nt, Human
aguugauucagcucu

SEQ ID NO: 2979986 - RNA, 17 nt, Human
aguugauucagcucugc

SEQ ID NO: 2979987 - RNA, 18 nt, Human
aguugauucagcucugca

SEQ ID NO: 2979988 - RNA, 23 nt, Human
aguugauucagcucugcaagaau

SEQ ID NO: 2979989 - RNA, 20 nt, Human
aguugcaaggcaaauguuua

SEQ ID NO: 2979990 - RNA, 19 nt, Human
aguugcaaggcaaauguuu

SEQ ID NO: 2979991 - RNA, 23 nt, Human
aguggcagucuucaguuugcaga

SEQ ID NO: 2979992 - RNA, 19 nt, Human
agugggggaguggccacag

SEQ ID NO: 2979993 - RNA, 20 nt, Human
agugggggaguggccacaga

SEQ ID NO: 2979994 - RNA, 13 nt, Human
agugggugaauaa

SEQ ID NO: 2979995 - RNA, 18 nt, Human
agugggugaauaauacag

SEQ ID NO: 2979996 - RNA, 20 nt, Human
aguggcagcugcuuuugucu

SEQ ID NO: 2979997 - RNA, 14 nt, Human
aguggcagcugcuu

SEQ ID NO: 2979998 - RNA, 13 nt, Human
aguggcagcugcu

SEQ ID NO: 2979999 - RNA, 12 nt, Human
aguggcagcugc

SEQ ID NO: 2980000 - RNA, 11 nt, Human
aguggcagcug

SEQ ID NO: 2980001 - RNA, 22 nt, Human
aguguacauggaauaacaugua

SEQ ID NO: 2980002 - RNA, 21 nt, Human
aguguacauggaauaacaugu

SEQ ID NO: 2980003 - RNA, 21 nt, Human
agugguuccuaauccucuagg

SEQ ID NO: 2980004 - RNA, 19 nt, Human
agugggugaauaauacagu

SEQ ID NO: 2980005 - RNA, 13 nt, Human
uguucugggacac

SEQ ID NO: 2980006 - RNA, 12 nt, Human
uguucugggaca

SEQ ID NO: 2980007 - RNA, 16 nt, Human
uguucuuaauucuuag

SEQ ID NO: 2980008 - RNA, 14 nt, Human
uguucuuaauucuu

SEQ ID NO: 2980009 - RNA, 15 nt, Human
uguucugggacacag

SEQ ID NO: 2980010 - RNA, 14 nt, Human
uguucugggacaca

SEQ ID NO: 2980011 - RNA, 18 nt, Human
uguucuugguuuguaaau

SEQ ID NO: 2980012 - RNA, 17 nt, Human
uguucuugguuuguaaa

SEQ ID NO: 2980013 - RNA, 14 nt, Human
uguucuuuccaaag

SEQ ID NO: 2980014 - RNA, 13 nt, Human
uguucuuuccaaa

SEQ ID NO: 2980015 - RNA, 19 nt, Human
uguucuugguuuguaaauu

SEQ ID NO: 2980016 - RNA, 23 nt, Human
aguguacauggaauaacauguaa

SEQ ID NO: 2980017 - RNA, 14 nt, Human
aguuauugaagcag

SEQ ID NO: 2980018 - RNA, 21 nt, Human
aguuauuaagagguaagacuu

SEQ ID NO: 2980019 - RNA, 18 nt, Human
aguuauugaagcagagug

SEQ ID NO: 2980020 - RNA, 17 nt, Human
aguuauugaagcagagu

SEQ ID NO: 2980021 - RNA, 16 nt, Human
aguuauugaagcagag

SEQ ID NO: 2980022 - RNA, 23 nt, Human
aguuauugaagcagaguggcagu

SEQ ID NO: 2980023 - RNA, 19 nt, Human
aguuauugaagcagagugg

SEQ ID NO: 2980024 - RNA, 19 nt, Human
aguuauggcuauaggugcu

SEQ ID NO: 2980025 - RNA, 20 nt, Human
aguuauuauauuuacaaaug

SEQ ID NO: 2980026 - RNA, 18 nt, Human
uguucuuuccaaaguaca

SEQ ID NO: 2980027 - RNA, 17 nt, Human
aguuacccaaauuaaga

SEQ ID NO: 2980028 - RNA, 18 nt, Human
aguuacccaaauuaagag

SEQ ID NO: 2980029 - RNA, 13 nt, Human
uguugucagcuga

SEQ ID NO: 2980030 - RNA, 13 nt, Human
uguugggccagga

SEQ ID NO: 2980031 - RNA, 16 nt, Human
uguugggccaggagcc

SEQ ID NO: 2980032 - RNA, 18 nt, Human
aguucagagcugcccucu

SEQ ID NO: 2980033 - RNA, 17 nt, Human
aguucagagcugcccuc

SEQ ID NO: 2980034 - RNA, 16 nt, Human
aguucagagcugcccu

SEQ ID NO: 2980035 - RNA, 15 nt, Human
aguucagagcugccc

SEQ ID NO: 2980036 - RNA, 14 nt, Human
aguucagagcugcc

SEQ ID NO: 2980037 - RNA, 21 nt, Human
aguuauuuuuauuuauuuaaa

SEQ ID NO: 2980038 - RNA, 20 nt, Human
aguucggugagcuacaaaug

SEQ ID NO: 2980039 - RNA, 20 nt, Human
auacuauuaaacaugcugua

SEQ ID NO: 2980040 - RNA, 20 nt, Human
auacuacaguuuguuaguau

SEQ ID NO: 2980041 - RNA, 16 nt, Human
auacuacaguuuguua

SEQ ID NO: 2980042 - RNA, 15 nt, Human
auacuacaguuuguu

SEQ ID NO: 2980043 - RNA, 13 nt, Human
auacuacaguuug

SEQ ID NO: 2980044 - RNA, 19 nt, Human
auaccagccaguaaauggg

SEQ ID NO: 2980045 - RNA, 17 nt, Human
auaccagccaguaaaug

SEQ ID NO: 2980046 - RNA, 21 nt, Human
auacuaaccagcagaaaugcc

SEQ ID NO: 2980047 - RNA, 15 nt, Human
uuaucagaacuaugu

SEQ ID NO: 2980048 - RNA, 20 nt, Human
auacaucccuuaccugggaa

SEQ ID NO: 2980049 - RNA, 16 nt, Human
auacauuugauaaagu

SEQ ID NO: 2980050 - RNA, 21 nt, Human
auacaguucggugagcuacaa

SEQ ID NO: 2980051 - RNA, 20 nt, Human
auacaggaaaagcugcugac

SEQ ID NO: 2980052 - RNA, 19 nt, Human
auacaggaaaagcugcuga

SEQ ID NO: 2980053 - RNA, 14 nt, Human
auacaggaaaagcu

SEQ ID NO: 2980054 - RNA, 13 nt, Human
uuauauagcaaga

SEQ ID NO: 2980055 - RNA, 18 nt, Human
uuauauaagcuuguauuc

SEQ ID NO: 2980056 - RNA, 19 nt, Human
uuauauagcaagacauuau

SEQ ID NO: 2980057 - RNA, 22 nt, Human
uuauauauauuuuuuucugaaa

SEQ ID NO: 2980058 - RNA, 20 nt, Human
auaauuuugugaagcaaaau

SEQ ID NO: 2980059 - RNA, 15 nt, Human
auaauuuugugaagc

SEQ ID NO: 2980060 - RNA, 14 nt, Human
auaauuuugugaag

SEQ ID NO: 2980061 - RNA, 13 nt, Human
auaauuuugugaa

SEQ ID NO: 2980062 - RNA, 19 nt, Human
auaauuuuuauauuugaaa

SEQ ID NO: 2980063 - RNA, 16 nt, Human
auaauuuuuauauuug

SEQ ID NO: 2980064 - RNA, 14 nt, Human
auaauuuuuauauu

SEQ ID NO: 2980065 - RNA, 15 nt, Human
auacaaaagcaugug

SEQ ID NO: 2980066 - RNA, 13 nt, Human
auacaaaagcaug

SEQ ID NO: 2980067 - RNA, 12 nt, Human
auacaaaagcau

SEQ ID NO: 2980068 - RNA, 22 nt, Human
auacaaaaaaaaaaaaaaauua

SEQ ID NO: 2980069 - RNA, 22 nt, Human
auaauuuuuauauuugaaauau

SEQ ID NO: 2980070 - RNA, 21 nt, Human
auaauuuuuauauuugaaaua

SEQ ID NO: 2980071 - RNA, 16 nt, Human
uuauaacuuuuuauau

SEQ ID NO: 2980072 - RNA, 14 nt, Human
uuauaacuuuuuau

SEQ ID NO: 2980073 - RNA, 15 nt, Human
uuauaacuuaaugaa

SEQ ID NO: 2980074 - RNA, 21 nt, Human
uuauaacuuaaugaaaacaau

SEQ ID NO: 2980075 - RNA, 21 nt, Human
uuagccguggugauuuagcag

SEQ ID NO: 2980076 - RNA, 16 nt, Human
uuagcccugaacauuu

SEQ ID NO: 2980077 - RNA, 15 nt, Human
uuagcccugaacauu

SEQ ID NO: 2980078 - RNA, 15 nt, Human
auaaacucauuucua

SEQ ID NO: 2980079 - RNA, 16 nt, Human
auaaacgucuuaaaua

SEQ ID NO: 2980080 - RNA, 15 nt, Human
auaaacgucuuaaau

SEQ ID NO: 2980081 - RNA, 18 nt, Human
auaaacgucuuaaauauu

SEQ ID NO: 2980082 - RNA, 15 nt, Human
auaaacuuuaccuuu

SEQ ID NO: 2980083 - RNA, 13 nt, Human
auaaacuuuaccu

SEQ ID NO: 2980084 - RNA, 16 nt, Human
auaaaccgaacugaug

SEQ ID NO: 2980085 - RNA, 12 nt, Human
aguuuucugaga

SEQ ID NO: 2980086 - RNA, 13 nt, Human
aguuuucugagaa

SEQ ID NO: 2980087 - RNA, 14 nt, Human
aguuuucugagaaa

SEQ ID NO: 2980088 - RNA, 17 nt, Human
aguuuucugagaaagac

SEQ ID NO: 2980089 - RNA, 23 nt, Human
auaacuggaacacucuauaacaa

SEQ ID NO: 2980090 - RNA, 21 nt, Human
auaacuggaacacucuauaac

SEQ ID NO: 2980091 - RNA, 15 nt, Human
uuacaggaaguacug

SEQ ID NO: 2980092 - RNA, 16 nt, Human
uuacaggaaguacugg

SEQ ID NO: 2980093 - RNA, 18 nt, Human
uuacaggaaguacuggag

SEQ ID NO: 2980094 - RNA, 22 nt, Human
uuacaggaaguacuggagaaaa

SEQ ID NO: 2980095 - RNA, 23 nt, Human
uuaccauuuugggguacccacug

SEQ ID NO: 2980096 - RNA, 18 nt, Human
auaacuggaacacucuau

SEQ ID NO: 2980097 - RNA, 16 nt, Human
auaacuggaacacucu

SEQ ID NO: 2980098 - RNA, 12 nt, Human
auaacuggaaac

SEQ ID NO: 2980099 - RNA, 19 nt, Human
auaaaugugccuucauuuu

SEQ ID NO: 2980100 - RNA, 18 nt, Human
uuagcaggaagcugugag

SEQ ID NO: 2980101 - RNA, 22 nt, Human
uuagaugcaguucugaagaaga

SEQ ID NO: 2980102 - RNA, 23 nt, Human
uuagaugcaguucugaagaagau

SEQ ID NO: 2980103 - RNA, 14 nt, Human
auaaugaauacuuu

SEQ ID NO: 2980104 - RNA, 14 nt, Human
auaauucuacuuug

SEQ ID NO: 2980105 - RNA, 21 nt, Human
auaaucuuucacaggggacag

SEQ ID NO: 2980106 - RNA, 19 nt, Human
auaauacaguaucucaggg

SEQ ID NO: 2980107 - RNA, 21 nt, Human
auaauacaccacuacauucug

SEQ ID NO: 2980108 - RNA, 23 nt, Human
auaauacaccacuacauucuguu

SEQ ID NO: 2980109 - RNA, 22 nt, Human
auaaguuaacuuccaauuuaca

SEQ ID NO: 2980110 - RNA, 22 nt, Human
auaagaaccuuuugagugccuu

SEQ ID NO: 2980111 - RNA, 17 nt, Human
auaaguuaacuuccaau

SEQ ID NO: 2980112 - RNA, 23 nt, Human
auaagaaccuuuugagugccuua

SEQ ID NO: 2980113 - RNA, 21 nt, Human
aguccccucuccuccacauuu

SEQ ID NO: 2980114 - RNA, 14 nt, Human
aguccccuguuugu

SEQ ID NO: 2980115 - RNA, 19 nt, Human
aguccccuguuuguuucug

SEQ ID NO: 2980116 - RNA, 20 nt, Human
agucccaccuuggcugcagg

SEQ ID NO: 2980117 - RNA, 23 nt, Human
agucccaccuuggcugcagggag

SEQ ID NO: 2980118 - RNA, 21 nt, Human
agucccaccuuggcugcaggg

SEQ ID NO: 2980119 - RNA, 19 nt, Human
agucagggguucccuuuuu

SEQ ID NO: 2980120 - RNA, 21 nt, Human
agucagucauucagauaugau

SEQ ID NO: 2980121 - RNA, 15 nt, Human
agucagucauucaga

SEQ ID NO: 2980122 - RNA, 20 nt, Human
ugucagcuccccucggagaa

SEQ ID NO: 2980123 - RNA, 21 nt, Human
ugucagcuccccucggagaag

SEQ ID NO: 2980124 - RNA, 23 nt, Human
ugucagcuccccucggagaagag

SEQ ID NO: 2980125 - RNA, 16 nt, Human
ugucagccauuccugu

SEQ ID NO: 2980126 - RNA, 20 nt, Human
ugucagcuaaagaaguuuga

SEQ ID NO: 2980127 - RNA, 12 nt, Human
ugucccuuuucc

SEQ ID NO: 2980128 - RNA, 20 nt, Human
ugucaaccccaaguuaguuc

SEQ ID NO: 2980129 - RNA, 16 nt, Human
ugucaaaguggugaga

SEQ ID NO: 2980130 - RNA, 19 nt, Human
ugucaaaguggugagaggc

SEQ ID NO: 2980131 - RNA, 14 nt, Human
aguagcugggacua

SEQ ID NO: 2980132 - RNA, 13 nt, Human
aguagcugggacu

SEQ ID NO: 2980133 - RNA, 14 nt, Human
ugucaaagugguga

SEQ ID NO: 2980134 - RNA, 15 nt, Human
ugucaaaguggugag

SEQ ID NO: 2980135 - RNA, 17 nt, Human
uguauguguaauaaaua

SEQ ID NO: 2980136 - RNA, 16 nt, Human
uguauguguaauaaau

SEQ ID NO: 2980137 - RNA, 14 nt, Human
uguauguguaagua

SEQ ID NO: 2980138 - RNA, 15 nt, Human
uguaucccaugagcc

SEQ ID NO: 2980139 - RNA, 15 nt, Human
uguagagccaggguc

SEQ ID NO: 2980140 - RNA, 12 nt, Human
uguagagccagg

SEQ ID NO: 2980141 - RNA, 23 nt, Human
agguuuggacaaaauggaauacu

SEQ ID NO: 2980142 - RNA, 21 nt, Human
aguauguuagugcaaauuguc

SEQ ID NO: 2980143 - RNA, 18 nt, Human
aguauguuagugcaaauu

SEQ ID NO: 2980144 - RNA, 21 nt, Human
aguauuagaauaccacaggaa

SEQ ID NO: 2980145 - RNA, 21 nt, Human
aguagcugggacuacaggcac

SEQ ID NO: 2980146 - RNA, 19 nt, Human
aguagcugggacuacaggc

SEQ ID NO: 2980147 - RNA, 22 nt, Human
aguagcugggacuacaggcacc

SEQ ID NO: 2980148 - RNA, 14 nt, Human
aguauuauaccuuu

SEQ ID NO: 2980149 - RNA, 15 nt, Human
aguauuauaccuuuu

SEQ ID NO: 2980150 - RNA, 15 nt, Human
ugucagcauagaagu

SEQ ID NO: 2980151 - RNA, 17 nt, Human
agucacugagacagccc

SEQ ID NO: 2980152 - RNA, 15 nt, Human
agucacugagacagc

SEQ ID NO: 2980153 - RNA, 16 nt, Human
agucacugagacagcc

SEQ ID NO: 2980154 - RNA, 20 nt, Human
agucacauuccaagccucau

SEQ ID NO: 2980155 - RNA, 16 nt, Human
aguauuguccaggucu

SEQ ID NO: 2980156 - RNA, 15 nt, Human
aguauuguccagguc

SEQ ID NO: 2980157 - RNA, 22 nt, Human
aguccccucuccuccacauuug

SEQ ID NO: 2980158 - RNA, 15 nt, Human
ugucuccucucucug

SEQ ID NO: 2980159 - RNA, 23 nt, Human
aguccccuguuuguuucugaaag

SEQ ID NO: 2980160 - RNA, 13 nt, Human
agucccugccaau

SEQ ID NO: 2980161 - RNA, 14 nt, Human
agucccugccaaug

SEQ ID NO: 2980162 - RNA, 16 nt, Human
agucccugccaaugga

SEQ ID NO: 2980163 - RNA, 17 nt, Human
ugucucuacuaaaaaua

SEQ ID NO: 2980164 - RNA, 13 nt, Human
ugucucugagagu

SEQ ID NO: 2980165 - RNA, 14 nt, Human
ugucuuaauuaaaa

SEQ ID NO: 2980166 - RNA, 12 nt, Human
ugucuuaauuaa

SEQ ID NO: 2980167 - RNA, 22 nt, Human
ugucucuugguccugcugcagu

SEQ ID NO: 2980168 - RNA, 21 nt, Human
ugucucuuuaaugucacaggc

SEQ ID NO: 2980169 - RNA, 22 nt, Human
ugucucuuuaaugucacaggca

SEQ ID NO: 2980170 - RNA, 18 nt, Human
ugucucuugguccugcug

SEQ ID NO: 2980171 - RNA, 19 nt, Human
ugucucuugguccugcugc

SEQ ID NO: 2980172 - RNA, 20 nt, Human
ugucucuugguccugcugca

SEQ ID NO: 2980173 - RNA, 21 nt, Human
ugucucuugguccugcugcag

SEQ ID NO: 2980174 - RNA, 15 nt, Human
ugugaaccaccacac

SEQ ID NO: 2980175 - RNA, 22 nt, Human
ugugaacaguuguguuugaagc

SEQ ID NO: 2980176 - RNA, 23 nt, Human
ugugaaccaccacacccagccca

SEQ ID NO: 2980177 - RNA, 22 nt, Human
ugugaaccaccacacccagccc

SEQ ID NO: 2980178 - RNA, 16 nt, Human
ugugaaccaccacacc

SEQ ID NO: 2980179 - RNA, 21 nt, Human
ugucuugcaauggcagccuug

SEQ ID NO: 2980180 - RNA, 20 nt, Human
ugucuugcaauggcagccuu

SEQ ID NO: 2980181 - RNA, 18 nt, Human
ugucuugcaauggcagcc

SEQ ID NO: 2980182 - RNA, 17 nt, Human
ugucuugcaauggcagc

SEQ ID NO: 2980183 - RNA, 15 nt, Human
ugucuugcaauggca

SEQ ID NO: 2980184 - RNA, 14 nt, Human
ugucuucacaacag

SEQ ID NO: 2980185 - RNA, 20 nt, Human
ugugauuuuugguauuugaa

SEQ ID NO: 2980186 - RNA, 21 nt, Human
ugugauuuuugguauuugaaa

SEQ ID NO: 2980187 - RNA, 19 nt, Human
ugugauuuuugguauuuga

SEQ ID NO: 2980188 - RNA, 17 nt, Human
ugugauggggcccugcc

SEQ ID NO: 2980189 - RNA, 21 nt, Human
agugagcagucaggaaagaga

SEQ ID NO: 2980190 - RNA, 14 nt, Human
agugagagcugggu

SEQ ID NO: 2980191 - RNA, 15 nt, Human
ugugauggggcccug

SEQ ID NO: 2980192 - RNA, 16 nt, Human
ugugauggggcccugc

SEQ ID NO: 2980193 - RNA, 16 nt, Human
agugagccgagauugu

SEQ ID NO: 2980194 - RNA, 22 nt, Human
agugaaagaggcagcuugaaac

SEQ ID NO: 2980195 - RNA, 14 nt, Human
agugagacagcucu

SEQ ID NO: 2980196 - RNA, 16 nt, Human
agugaaagaggcagcu

SEQ ID NO: 2980197 - RNA, 17 nt, Human
agugaaagaaaauaaca

SEQ ID NO: 2980198 - RNA, 17 nt, Human
agugagacucugucuca

SEQ ID NO: 2980199 - RNA, 16 nt, Human
agugagacucugucuc

SEQ ID NO: 2980200 - RNA, 22 nt, Human
agugagacucugucucaaaaaa

SEQ ID NO: 2980201 - RNA, 22 nt, Human
agugagacuggggccacuacau

SEQ ID NO: 2980202 - RNA, 17 nt, Human
agugagacccugucuca

SEQ ID NO: 2980203 - RNA, 21 nt, Human
agugagacccugucucaaaaa

SEQ ID NO: 2980204 - RNA, 13 nt, Human
agugagacucugu

SEQ ID NO: 2980205 - RNA, 14 nt, Human
agucuucuauuuau

SEQ ID NO: 2980206 - RNA, 11 nt, Human
agugaaaaagg

SEQ ID NO: 2980207 - RNA, 17 nt, Human
agugaaaaaggaggaag

SEQ ID NO: 2980208 - RNA, 20 nt, Human
agugaaaaaggaggaagaga

SEQ ID NO: 2980209 - RNA, 23 nt, Human
agugaaaaaggaggaagagaaaa

SEQ ID NO: 2980210 - RNA, 22 nt, Human
ugugagaugcuagaacucccuu

SEQ ID NO: 2980211 - RNA, 19 nt, Human
ugugagcacaaagguagcu

SEQ ID NO: 2980212 - RNA, 14 nt, Human
ugugaagcaaaauu

SEQ ID NO: 2980213 - RNA, 14 nt, Human
ugugaagagaacca

SEQ ID NO: 2980214 - RNA, 14 nt, Human
aggguuuaaagaug

SEQ ID NO: 2980215 - RNA, 20 nt, Human
aggguuuauguuuaggaugu

SEQ ID NO: 2980216 - RNA, 17 nt, Human
aggguugggcugguguc

SEQ ID NO: 2980217 - RNA, 17 nt, Human
agguaugcaaucaaauc

SEQ ID NO: 2980218 - RNA, 21 nt, Human
aggucaaggcugcagugagcc

SEQ ID NO: 2980219 - RNA, 15 nt, Human
aggucagugcaaaua

SEQ ID NO: 2980220 - RNA, 23 nt, Human
aggucauuuuuuuuaagaaaaag

SEQ ID NO: 2980221 - RNA, 22 nt, Human
aggucauuuuuuuuaagaaaaa

SEQ ID NO: 2980222 - RNA, 21 nt, Human
aggucuugaacuccuggccuc

SEQ ID NO: 2980223 - RNA, 20 nt, Human
aggucuugaacuccuggccu

SEQ ID NO: 2980224 - RNA, 22 nt, Human
aggucuugaacuccuggccuca

SEQ ID NO: 2980225 - RNA, 18 nt, Human
aggucuugaacuccuggc

SEQ ID NO: 2980226 - RNA, 22 nt, Human
ugguccaugggccauaugaaaa

SEQ ID NO: 2980227 - RNA, 19 nt, Human
ugguccauagagagcaaga

SEQ ID NO: 2980228 - RNA, 16 nt, Human
uggucuuauuuguaaa

SEQ ID NO: 2980229 - RNA, 22 nt, Human
uggucugugagaugcuagaacu

SEQ ID NO: 2980230 - RNA, 12 nt, Human
uggucuguguga

SEQ ID NO: 2980231 - RNA, 18 nt, Human
uggucugacccacugcuu

SEQ ID NO: 2980232 - RNA, 17 nt, Human
aggguuaugauuaagua

SEQ ID NO: 2980233 - RNA, 19 nt, Human
aggguggugaccucugccu

SEQ ID NO: 2980234 - RNA, 18 nt, Human
aggguggugaccucugcc

SEQ ID NO: 2980235 - RNA, 17 nt, Human
aggguggugaccucugc

SEQ ID NO: 2980236 - RNA, 19 nt, Human
uggugaacagaacaaaagg

SEQ ID NO: 2980237 - RNA, 15 nt, Human
aggguugggcuggug

SEQ ID NO: 2980238 - RNA, 13 nt, Human
aggguugggcugg

SEQ ID NO: 2980239 - RNA, 14 nt, Human
aggguuggccccug

SEQ ID NO: 2980240 - RNA, 13 nt, Human
aggguuggccccu

SEQ ID NO: 2980241 - RNA, 21 nt, Human
aggggcuuaauuauugauguu

SEQ ID NO: 2980242 - RNA, 13 nt, Human
agggggcugggac

SEQ ID NO: 2980243 - RNA, 16 nt, Human
aggggaauugaggaca

SEQ ID NO: 2980244 - RNA, 19 nt, Human
aggguacuaaggaaucuuu

SEQ ID NO: 2980245 - RNA, 16 nt, Human
aggguaucaggugcug

SEQ ID NO: 2980246 - RNA, 15 nt, Human
ugguccauagagagc

SEQ ID NO: 2980247 - RNA, 16 nt, Human
ugguccauagagagca

SEQ ID NO: 2980248 - RNA, 21 nt, Human
uggucaccaaaucagcugcua

SEQ ID NO: 2980249 - RNA, 23 nt, Human
uggucaccaaaucagcugcuacu

SEQ ID NO: 2980250 - RNA, 20 nt, Human
uggucaccaaaucagcugcu

SEQ ID NO: 2980251 - RNA, 23 nt, Human
uggguggaugccugguggcagcu

SEQ ID NO: 2980252 - RNA, 14 nt, Human
uggguggaugccug

SEQ ID NO: 2980253 - RNA, 21 nt, Human
agggugaugggaaagcauugu

SEQ ID NO: 2980254 - RNA, 22 nt, Human
agggugaugggaaagcauugua

SEQ ID NO: 2980255 - RNA, 18 nt, Human
ugguuauuuuacuuuuug

SEQ ID NO: 2980256 - RNA, 15 nt, Human
ugguuauuuuacuuu

SEQ ID NO: 2980257 - RNA, 16 nt, Human
ugguuauuuuacuuuu

SEQ ID NO: 2980258 - RNA, 15 nt, Human
ugguguuuccuggca

SEQ ID NO: 2980259 - RNA, 17 nt, Human
ugguguuuccuggcacu

SEQ ID NO: 2980260 - RNA, 23 nt, Human
ugguucaggguuggccccugccc

SEQ ID NO: 2980261 - RNA, 22 nt, Human
ugguucaggguuggccccugcc

SEQ ID NO: 2980262 - RNA, 20 nt, Human
ugguucaggguuggccccug

SEQ ID NO: 2980263 - RNA, 15 nt, Human
ugguggcagagugga

SEQ ID NO: 2980264 - RNA, 12 nt, Human
ugguggcagcuc

SEQ ID NO: 2980265 - RNA, 16 nt, Human
ugguggcagcucaccu

SEQ ID NO: 2980266 - RNA, 19 nt, Human
ugguggcagcucaccucuc

SEQ ID NO: 2980267 - RNA, 20 nt, Human
ugguggcagcucaccucucc

SEQ ID NO: 2980268 - RNA, 23 nt, Human
ugguggcagcucaccucucccuu

SEQ ID NO: 2980269 - RNA, 23 nt, Human
uggugugaccacugcagaagaca

SEQ ID NO: 2980270 - RNA, 12 nt, Human
ugguggcagcug

SEQ ID NO: 2980271 - RNA, 15 nt, Human
ugguuucuagcauga

SEQ ID NO: 2980272 - RNA, 15 nt, Human
ugguuucagaaaugu

SEQ ID NO: 2980273 - RNA, 14 nt, Human
ugguuucagaaaug

SEQ ID NO: 2980274 - RNA, 15 nt, Human
ugguuuguucccugu

SEQ ID NO: 2980275 - RNA, 21 nt, Human
ugguuuguaaauuaacuuuua

SEQ ID NO: 2980276 - RNA, 12 nt, Human
ugguuuucuguu

SEQ ID NO: 2980277 - RNA, 23 nt, Human
aggugauccacccaccucagccu

SEQ ID NO: 2980278 - RNA, 21 nt, Human
aggugauccacccaccucagc

SEQ ID NO: 2980279 - RNA, 15 nt, Human
ugguuuucuguucuu

SEQ ID NO: 2980280 - RNA, 13 nt, Human
ugguuuucuguuc

SEQ ID NO: 2980281 - RNA, 12 nt, Human
agguugugaaug

SEQ ID NO: 2980282 - RNA, 22 nt, Human
uguaagcucuacugaggugcua

SEQ ID NO: 2980283 - RNA, 18 nt, Human
uguaagaaaauaucacuu

SEQ ID NO: 2980284 - RNA, 17 nt, Human
uguaagaaaauaucacu

SEQ ID NO: 2980285 - RNA, 14 nt, Human
uguaaggaaugauu

SEQ ID NO: 2980286 - RNA, 15 nt, Human
uguaaggaaugauua

SEQ ID NO: 2980287 - RNA, 13 nt, Human
uguaaggaaugau

SEQ ID NO: 2980288 - RNA, 20 nt, Human
aggugugagucaccaagccc

SEQ ID NO: 2980289 - RNA, 14 nt, Human
aggugugagucacc

SEQ ID NO: 2980290 - RNA, 20 nt, Human
aggugugacugaauuucuuu

SEQ ID NO: 2980291 - RNA, 22 nt, Human
aggugugaaccaccacacccag

SEQ ID NO: 2980292 - RNA, 18 nt, Human
aggugugacugaauuucu

SEQ ID NO: 2980293 - RNA, 23 nt, Human
aggugugaaccaccacacccagc

SEQ ID NO: 2980294 - RNA, 13 nt, Human
agguggggcagcu

SEQ ID NO: 2980295 - RNA, 23 nt, Human
agguggggucacucuggcagcuc

SEQ ID NO: 2980296 - RNA, 14 nt, Human
agguggggcagcuu

SEQ ID NO: 2980297 - RNA, 17 nt, Human
uguagacaguuggguuu

SEQ ID NO: 2980298 - RNA, 21 nt, Human
uguagaagucacauuccugaa

SEQ ID NO: 2980299 - RNA, 18 nt, Human
uguacaugaaaacacauu

SEQ ID NO: 2980300 - RNA, 17 nt, Human
uguacaugaaaacacau

SEQ ID NO: 2980301 - RNA, 19 nt, Human
uguacaugaaaacacauuu

SEQ ID NO: 2980302 - RNA, 23 nt, Human
uguacaaaguagaagucuuagau

SEQ ID NO: 2980303 - RNA, 19 nt, Human
uguacaaaguagaagucuu

SEQ ID NO: 2980304 - RNA, 18 nt, Human
uguaaggaaugauuaauu

SEQ ID NO: 2980305 - RNA, 16 nt, Human
uguaauuugugauaca

SEQ ID NO: 2980306 - RNA, 21 nt, Human
uguaauuugugauacaaugcu

SEQ ID NO: 2980307 - RNA, 17 nt, Human
uguaauuugugauacaa

SEQ ID NO: 2980308 - RNA, 18 nt, Human
ugaaguaaaauguggcag

SEQ ID NO: 2980309 - RNA, 19 nt, Human
ugaaguaaaauguggcagg

SEQ ID NO: 2980310 - RNA, 15 nt, Human
ugaaguaauaugcac

SEQ ID NO: 2980311 - RNA, 22 nt, Human
ugaaguaauaugcacacauuuu

SEQ ID NO: 2980312 - RNA, 21 nt, Human
ugaaguaauaugcacacauuu

SEQ ID NO: 2980313 - RNA, 20 nt, Human
ugaaguaauaugcacacauu

SEQ ID NO: 2980314 - RNA, 16 nt, Human
ugaaguaauaugcaca

SEQ ID NO: 2980315 - RNA, 20 nt, Human
ugaagauuuaccacuugugu

SEQ ID NO: 2980316 - RNA, 17 nt, Human
ugaagauuuaccacuug

SEQ ID NO: 2980317 - RNA, 13 nt, Human
ugaauaauacagu

SEQ ID NO: 2980318 - RNA, 21 nt, Human
ugaauaaccugaggauucuau

SEQ ID NO: 2980319 - RNA, 12 nt, Human
ugaauaauacag

SEQ ID NO: 2980320 - RNA, 13 nt, Human
ugaagucacacag

SEQ ID NO: 2980321 - RNA, 17 nt, Human
ugaaguacucauacaug

SEQ ID NO: 2980322 - RNA, 18 nt, Human
agagcuguucacagccag

SEQ ID NO: 2980323 - RNA, 23 nt, Human
agaggcagccccauucugccugc

SEQ ID NO: 2980324 - RNA, 21 nt, Human
agaggcagggucucacucugu

SEQ ID NO: 2980325 - RNA, 22 nt, Human
agaggcagccccauucugccug

SEQ ID NO: 2980326 - RNA, 21 nt, Human
agaggcagccccauucugccu

SEQ ID NO: 2980327 - RNA, 22 nt, Human
agaggcugccucucccaucacu

SEQ ID NO: 2980328 - RNA, 13 nt, Human
agagguucaaaga

SEQ ID NO: 2980329 - RNA, 20 nt, Human
agagggagugacagaggcag

SEQ ID NO: 2980330 - RNA, 15 nt, Human
agagggagugacaga

SEQ ID NO: 2980331 - RNA, 15 nt, Human
agagggagguaagga

SEQ ID NO: 2980332 - RNA, 19 nt, Human
agagguucaaagauauuuu

SEQ ID NO: 2980333 - RNA, 16 nt, Human
agagguucaaagauau

SEQ ID NO: 2980334 - RNA, 20 nt, Human
agagguucaaagauauuuug

SEQ ID NO: 2980335 - RNA, 18 nt, Human
agagcugcccucuccugg

SEQ ID NO: 2980336 - RNA, 17 nt, Human
agagcugcccucuccug

SEQ ID NO: 2980337 - RNA, 16 nt, Human
agagcugcccucuccu

SEQ ID NO: 2980338 - RNA, 20 nt, Human
agagcugcccucuccugggc

SEQ ID NO: 2980339 - RNA, 19 nt, Human
agagcugcccucuccuggg

SEQ ID NO: 2980340 - RNA, 15 nt, Human
agagcugcccucucc

SEQ ID NO: 2980341 - RNA, 16 nt, Human
ugaaauaacauggccu

SEQ ID NO: 2980342 - RNA, 17 nt, Human
ugaaauaacauggccuu

SEQ ID NO: 2980343 - RNA, 23 nt, Human
ugaaauaaacgucuuaaauauuc

SEQ ID NO: 2980344 - RNA, 22 nt, Human
ugaaauaaacgucuuaaauauu

SEQ ID NO: 2980345 - RNA, 18 nt, Human
ugaaauaaacgucuuaaa

SEQ ID NO: 2980346 - RNA, 13 nt, Human
ugaaauaaacguc

SEQ ID NO: 2980347 - RNA, 20 nt, Human
ugaaauuuuuauuaaauuau

SEQ ID NO: 2980348 - RNA, 21 nt, Human
ugaaauuuccugggagcuuuu

SEQ ID NO: 2980349 - RNA, 19 nt, Human
ugaaauuuuuauuaaauua

SEQ ID NO: 2980350 - RNA, 15 nt, Human
ugaaauuuccuggga

SEQ ID NO: 2980351 - RNA, 18 nt, Human
ugaacccgggaggcagag

SEQ ID NO: 2980352 - RNA, 22 nt, Human
ugaacccauauuuguacaccaa

SEQ ID NO: 2980353 - RNA, 13 nt, Human
ugaacaaauuuac

SEQ ID NO: 2980354 - RNA, 21 nt, Human
ugaaccaccacacccagccca

SEQ ID NO: 2980355 - RNA, 22 nt, Human
ugaaccaccacacccagcccac

SEQ ID NO: 2980356 - RNA, 21 nt, Human
ugaagacaaugacuuacugua

SEQ ID NO: 2980357 - RNA, 23 nt, Human
ugaagacaaugacuuacuguaca

SEQ ID NO: 2980358 - RNA, 22 nt, Human
ugaagacaaugacuuacuguac

SEQ ID NO: 2980359 - RNA, 13 nt, Human
ugaagacagagcu

SEQ ID NO: 2980360 - RNA, 22 nt, Human
ugaagaagcaccaaucaugaau

SEQ ID NO: 2980361 - RNA, 23 nt, Human
agacuuugguuauuuuacuuuuu

SEQ ID NO: 2980362 - RNA, 17 nt, Human
agacuuugguuauuuua

SEQ ID NO: 2980363 - RNA, 15 nt, Human
agagacacaagccuu

SEQ ID NO: 2980364 - RNA, 16 nt, Human
agagacacaagccuuc

SEQ ID NO: 2980365 - RNA, 19 nt, Human
agagacacaagccuucggc

SEQ ID NO: 2980366 - RNA, 15 nt, Human
agacuuuuccaaccc

SEQ ID NO: 2980367 - RNA, 19 nt, Human
agacuuuggaaagaguagg

SEQ ID NO: 2980368 - RNA, 20 nt, Human
agacugguuccauggccucu

SEQ ID NO: 2980369 - RNA, 14 nt, Human
agacuggggccacu

SEQ ID NO: 2980370 - RNA, 17 nt, Human
agacuuuggaaagacuu

SEQ ID NO: 2980371 - RNA, 15 nt, Human
agacuuuggaaagag

SEQ ID NO: 2980372 - RNA, 15 nt, Human
agacuuuggaaagac

SEQ ID NO: 2980373 - RNA, 14 nt, Human
ucuuuguacagaca

SEQ ID NO: 2980374 - RNA, 15 nt, Human
ucuuuguacagacaa

SEQ ID NO: 2980375 - RNA, 20 nt, Human
ucuuuguacagacaacaaac

SEQ ID NO: 2980376 - RNA, 16 nt, Human
agagacacacugaaga

SEQ ID NO: 2980377 - RNA, 14 nt, Human
agagacagaaagca

SEQ ID NO: 2980378 - RNA, 14 nt, Human
ucuuuguggcuucc

SEQ ID NO: 2980379 - RNA, 22 nt, Human
agacuccaaagaaauguaaggg

SEQ ID NO: 2980380 - RNA, 20 nt, Human
agacaggcaagcaccuccug

SEQ ID NO: 2980381 - RNA, 15 nt, Human
ucuuuaaugucacag

SEQ ID NO: 2980382 - RNA, 19 nt, Human
ucuuuaaugucacaggcag

SEQ ID NO: 2980383 - RNA, 18 nt, Human
ucuuuaaugucacaggca

SEQ ID NO: 2980384 - RNA, 20 nt, Human
agacuggcacaguuuucuga

SEQ ID NO: 2980385 - RNA, 21 nt, Human
agacuggcacaguuuucugag

SEQ ID NO: 2980386 - RNA, 18 nt, Human
agacuggcacaguuuucu

SEQ ID NO: 2980387 - RNA, 23 nt, Human
agacuggcacaguuuucugagaa

SEQ ID NO: 2980388 - RNA, 22 nt, Human
agacuggcgugaacccaggagg

SEQ ID NO: 2980389 - RNA, 18 nt, Human
agacuggcgugaacccag

SEQ ID NO: 2980390 - RNA, 17 nt, Human
agacuggcgugaaccca

SEQ ID NO: 2980391 - RNA, 23 nt, Human
agacuggcgugaacccaggaggc

SEQ ID NO: 2980392 - RNA, 13 nt, Human
agacuccugcagg

SEQ ID NO: 2980393 - RNA, 16 nt, Human
agacuccauaguuugg

SEQ ID NO: 2980394 - RNA, 14 nt, Human
agacuccauaguuu

SEQ ID NO: 2980395 - RNA, 16 nt, Human
agacucccaugaggga

SEQ ID NO: 2980396 - RNA, 22 nt, Human
ugaaagaaaauaccaaggaaca

SEQ ID NO: 2980397 - RNA, 12 nt, Human
ugaaacuuuugg

SEQ ID NO: 2980398 - RNA, 16 nt, Human
ugaaagacuguacaaa

SEQ ID NO: 2980399 - RNA, 19 nt, Human
ugaaagacuguacaaagua

SEQ ID NO: 2980400 - RNA, 18 nt, Human
ugaaagacuguacaaagu

SEQ ID NO: 2980401 - RNA, 22 nt, Human
ugaaagacuguacaaaguagaa

SEQ ID NO: 2980402 - RNA, 17 nt, Human
ugaaagaggaaugaagu

SEQ ID NO: 2980403 - RNA, 19 nt, Human
agagaccaucccugaaggc

SEQ ID NO: 2980404 - RNA, 21 nt, Human
agagaccaucccugaaggccc

SEQ ID NO: 2980405 - RNA, 18 nt, Human
ugaaagaggaaugaagua

SEQ ID NO: 2980406 - RNA, 18 nt, Human
agagaccaucccugaagg

SEQ ID NO: 2980407 - RNA, 22 nt, Human
agagaccaucccugaaggcccc

SEQ ID NO: 2980408 - RNA, 23 nt, Human
agagaccaucccugaaggccccg

SEQ ID NO: 2980409 - RNA, 13 nt, Human
agagacuccugca

SEQ ID NO: 2980410 - RNA, 14 nt, Human
agagacuccugcag

SEQ ID NO: 2980411 - RNA, 12 nt, Human
agagacuccugc

SEQ ID NO: 2980412 - RNA, 11 nt, Human
agagacuccug

SEQ ID NO: 2980413 - RNA, 18 nt, Human
ugaaacuggauuaaacuu

SEQ ID NO: 2980414 - RNA, 17 nt, Human
ugaaacuggauuaaacu

SEQ ID NO: 2980415 - RNA, 13 nt, Human
ugaaagaaaauaa

SEQ ID NO: 2980416 - RNA, 22 nt, Human
ugaaacugagaugugaacacau

SEQ ID NO: 2980417 - RNA, 21 nt, Human
ugaaaauauuuguaucacaaa

SEQ ID NO: 2980418 - RNA, 22 nt, Human
ugaaaauauuuguaucacaaau

SEQ ID NO: 2980419 - RNA, 20 nt, Human
ugaaaaucuuauaauuuaaa

SEQ ID NO: 2980420 - RNA, 19 nt, Human
ugaaaacacauuuuucuua

SEQ ID NO: 2980421 - RNA, 17 nt, Human
ugaaaacacauuuuucu

SEQ ID NO: 2980422 - RNA, 15 nt, Human
ugaaaacacauuuuu

SEQ ID NO: 2980423 - RNA, 22 nt, Human
ugaaaauaaucucugauucccu

SEQ ID NO: 2980424 - RNA, 18 nt, Human
ugaaaauaaucucugauu

SEQ ID NO: 2980425 - RNA, 17 nt, Human
ugaaaauauuuguauca

SEQ ID NO: 2980426 - RNA, 17 nt, Human
ugaaaauaaucucugau

SEQ ID NO: 2980427 - RNA, 13 nt, Human
ugaaaacacauuu

SEQ ID NO: 2980428 - RNA, 12 nt, Human
ugaaaacacauu

SEQ ID NO: 2980429 - RNA, 14 nt, Human
ugaaaacacauuuu

SEQ ID NO: 2980430 - RNA, 21 nt, Human
ugagagcaguuugguuucuag

SEQ ID NO: 2980431 - RNA, 23 nt, Human
ugagagcaguuugguuucuagca

SEQ ID NO: 2980432 - RNA, 22 nt, Human
ugagagacacacugaagaagca

SEQ ID NO: 2980433 - RNA, 21 nt, Human
ugagagacacacugaagaagc

SEQ ID NO: 2980434 - RNA, 11 nt, Human
ugagaggaaau

SEQ ID NO: 2980435 - RNA, 12 nt, Human
ugagaggaaauc

SEQ ID NO: 2980436 - RNA, 13 nt, Human
ugagaggaaauca

SEQ ID NO: 2980437 - RNA, 14 nt, Human
ugagaggaaaucac

SEQ ID NO: 2980438 - RNA, 16 nt, Human
ugagagcugcaugugu

SEQ ID NO: 2980439 - RNA, 10 nt, Human
ugagaggaaa

SEQ ID NO: 2980440 - RNA, 14 nt, Human
ugagagcugggugu

SEQ ID NO: 2980441 - RNA, 13 nt, Human
ugagaugugaaca

SEQ ID NO: 2980442 - RNA, 17 nt, Human
ugagaggaaaucaccga

SEQ ID NO: 2980443 - RNA, 23 nt, Human
ugagaggacuuuucuuuguggcu

SEQ ID NO: 2980444 - RNA, 18 nt, Human
ugagaugugaacacauca

SEQ ID NO: 2980445 - RNA, 19 nt, Human
ugagaugugaacacaucag

SEQ ID NO: 2980446 - RNA, 24 nt, Human
ugagaugugaacacaucagcuugc

SEQ ID NO: 2980447 - RNA, 17 nt, Human
ugagacagcccgggcuc

SEQ ID NO: 2980448 - RNA, 18 nt, Human
ugagacagcccgggcucu

SEQ ID NO: 2980449 - RNA, 19 nt, Human
ugagacagcccgggcucug

SEQ ID NO: 2980450 - RNA, 20 nt, Human
ugagacagcccgggcucugc

SEQ ID NO: 2980451 - RNA, 22 nt, Human
ugagacagcccgggcucugccu

SEQ ID NO: 2980452 - RNA, 20 nt, Human
ugagacucugucucagucca

SEQ ID NO: 2980453 - RNA, 20 nt, Human
ugagacucugucucaaaaaa

SEQ ID NO: 2980454 - RNA, 20 nt, Human
ugagagacacacugaagaag

SEQ ID NO: 2980455 - RNA, 19 nt, Human
ugagagacacacugaagaa

SEQ ID NO: 2980456 - RNA, 17 nt, Human
ugagagacacacugaag

SEQ ID NO: 2980457 - RNA, 16 nt, Human
ugagagacacacugaa

SEQ ID NO: 2980458 - RNA, 23 nt, Human
ugagacuggggccacuacauuug

SEQ ID NO: 2980459 - RNA, 22 nt, Human
ugagacuggggccacuacauuu

SEQ ID NO: 2980460 - RNA, 13 nt, Human
ugagacuuuaaaa

SEQ ID NO: 2980461 - RNA, 12 nt, Human
ugagacuuuaaa

SEQ ID NO: 2980462 - RNA, 18 nt, Human
ugagacuuuaaaagcauu

SEQ ID NO: 2980463 - RNA, 14 nt, Human
ugagacuuuaaaag

SEQ ID NO: 2980464 - RNA, 20 nt, Human
ugagacuuuaaaagcauuuu

SEQ ID NO: 2980465 - RNA, 13 nt, Human
ugagacagcccgg

SEQ ID NO: 2980466 - RNA, 21 nt, Human
ugagacagaguuuucacucuu

SEQ ID NO: 2980467 - RNA, 11 nt, Human
ugagacagagu

SEQ ID NO: 2980468 - RNA, 14 nt, Human
agauuuuccugaaa

SEQ ID NO: 2980469 - RNA, 15 nt, Human
agauuuuccugaaaa

SEQ ID NO: 2980470 - RNA, 20 nt, Human
ugagaagcagaggaaggaga

SEQ ID NO: 2980471 - RNA, 16 nt, Human
agauuuuccugaaaac

SEQ ID NO: 2980472 - RNA, 16 nt, Human
agcaagggugauggga

SEQ ID NO: 2980473 - RNA, 19 nt, Human
agcaaggagauuuacaacu

SEQ ID NO: 2980474 - RNA, 17 nt, Human
agcaaggagauuuacaa

SEQ ID NO: 2980475 - RNA, 14 nt, Human
agcaaggagauuua

SEQ ID NO: 2980476 - RNA, 20 nt, Human
agcaagggugaugggaaagc

SEQ ID NO: 2980477 - RNA, 22 nt, Human
agcaagggugaugggaaagcau

SEQ ID NO: 2980478 - RNA, 16 nt, Human
agcaagugagagcugg

SEQ ID NO: 2980479 - RNA, 15 nt, Human
agcaagugagagcug

SEQ ID NO: 2980480 - RNA, 16 nt, Human
agcaagugagacccug

SEQ ID NO: 2980481 - RNA, 18 nt, Human
ugagccagauuucacucu

SEQ ID NO: 2980482 - RNA, 19 nt, Human
ugagccagauuucacucuc

SEQ ID NO: 2980483 - RNA, 14 nt, Human
ugagccacugcacc

SEQ ID NO: 2980484 - RNA, 20 nt, Human
ugagccagauuucacucucc

SEQ ID NO: 2980485 - RNA, 21 nt, Human
ugagccagauuucacucuccu

SEQ ID NO: 2980486 - RNA, 13 nt, Human
ugagccacugcac

SEQ ID NO: 2980487 - RNA, 12 nt, Human
ugagccacugca

SEQ ID NO: 2980488 - RNA, 16 nt, Human
agcaccuccugccucg

SEQ ID NO: 2980489 - RNA, 14 nt, Human
agcaccuccugccu

SEQ ID NO: 2980490 - RNA, 13 nt, Human
agcaccuccugcc

SEQ ID NO: 2980491 - RNA, 16 nt, Human
agcaccaucucuccuc

SEQ ID NO: 2980492 - RNA, 23 nt, Human
agcacaugccucucucaggccaa

SEQ ID NO: 2980493 - RNA, 19 nt, Human
agcacaugccucucucagg

SEQ ID NO: 2980494 - RNA, 20 nt, Human
agcacaugccucucucaggc

SEQ ID NO: 2980495 - RNA, 21 nt, Human
agcacaugccucucucaggcc

SEQ ID NO: 2980496 - RNA, 22 nt, Human
agcacaugccucucucaggcca

SEQ ID NO: 2980497 - RNA, 18 nt, Human
agcacaugccucucucag

SEQ ID NO: 2980498 - RNA, 16 nt, Human
agcacaugccucucuc

SEQ ID NO: 2980499 - RNA, 21 nt, Human
agcacagcuucauuuccugug

SEQ ID NO: 2980500 - RNA, 17 nt, Human
agcaagugagagcuggg

SEQ ID NO: 2980501 - RNA, 16 nt, Human
agaugcacaugagcug

SEQ ID NO: 2980502 - RNA, 20 nt, Human
agaugcaguucugaagaaga

SEQ ID NO: 2980503 - RNA, 13 nt, Human
agaugcacaugag

SEQ ID NO: 2980504 - RNA, 19 nt, Human
agaugcuagaacucccuuu

SEQ ID NO: 2980505 - RNA, 21 nt, Human
agaugcaguucugaagaagau

SEQ ID NO: 2980506 - RNA, 15 nt, Human
agaugcuagaacucc

SEQ ID NO: 2980507 - RNA, 21 nt, Human
agaugcuagaacucccuuuca

SEQ ID NO: 2980508 - RNA, 13 nt, Human
agauguaugcaca

SEQ ID NO: 2980509 - RNA, 13 nt, Human
agauccuggaaau

SEQ ID NO: 2980510 - RNA, 18 nt, Human
agaucucuaacuucacca

SEQ ID NO: 2980511 - RNA, 14 nt, Human
ugacagauugaauu

SEQ ID NO: 2980512 - RNA, 15 nt, Human
ugacacuuaaaaaug

SEQ ID NO: 2980513 - RNA, 22 nt, Human
ugacagagugagacucugucuc

SEQ ID NO: 2980514 - RNA, 19 nt, Human
ugacacgaauauugcugau

SEQ ID NO: 2980515 - RNA, 16 nt, Human
ugacacgaauauugcu

SEQ ID NO: 2980516 - RNA, 20 nt, Human
ugaaugcccagugagacugu

SEQ ID NO: 2980517 - RNA, 13 nt, Human
ugacauucccugc

SEQ ID NO: 2980518 - RNA, 13 nt, Human
ugacauguuuuau

SEQ ID NO: 2980519 - RNA, 19 nt, Human
ugacaggcaaugcuggcug

SEQ ID NO: 2980520 - RNA, 17 nt, Human
ugacaggcaaugcuggc

SEQ ID NO: 2980521 - RNA, 22 nt, Human
ugacagggcacaccgggcacuc

SEQ ID NO: 2980522 - RNA, 21 nt, Human
ugacagggcacaccgggcacu

SEQ ID NO: 2980523 - RNA, 22 nt, Human
ugacuauucugagaugacuauu

SEQ ID NO: 2980524 - RNA, 21 nt, Human
ugacuauucugagaugacuau

SEQ ID NO: 2980525 - RNA, 19 nt, Human
ugacuauucugagaugacu

SEQ ID NO: 2980526 - RNA, 16 nt, Human
ugacuauaaccuuguu

SEQ ID NO: 2980527 - RNA, 12 nt, Human
ugaccuuucaau

SEQ ID NO: 2980528 - RNA, 11 nt, Human
ugacuguuuuu

SEQ ID NO: 2980529 - RNA, 21 nt, Human
ugacuguuuucucuugagagg

SEQ ID NO: 2980530 - RNA, 22 nt, Human
ugacuauuuuuguuuuuauuaa

SEQ ID NO: 2980531 - RNA, 18 nt, Human
ugacuauuuuuguuuuua

SEQ ID NO: 2980532 - RNA, 20 nt, Human
agauguaugcacacacauau

SEQ ID NO: 2980533 - RNA, 18 nt, Human
agauguaugcacacacau

SEQ ID NO: 2980534 - RNA, 14 nt, Human
agauguaugcacac

SEQ ID NO: 2980535 - RNA, 23 nt, Human
agauguaugcacacacauauauu

SEQ ID NO: 2980536 - RNA, 22 nt, Human
agauguauguacuucaugcugu

SEQ ID NO: 2980537 - RNA, 17 nt, Human
agaugugaacacaucag

SEQ ID NO: 2980538 - RNA, 22 nt, Human
agaugugaacacaucagcuugc

SEQ ID NO: 2980539 - RNA, 15 nt, Human
ugaccuuuaagagaa

SEQ ID NO: 2980540 - RNA, 20 nt, Human
ugacuuacuguacaugaaaa

SEQ ID NO: 2980541 - RNA, 12 nt, Human
ugacuuacugua

SEQ ID NO: 2980542 - RNA, 16 nt, Human
agauucauauuuacuu

SEQ ID NO: 2980543 - RNA, 13 nt, Human
agauucauauuua

SEQ ID NO: 2980544 - RNA, 21 nt, Human
agauugugccccugcacucca

SEQ ID NO: 2980545 - RNA, 19 nt, Human
agauuucacucuccuuggu

SEQ ID NO: 2980546 - RNA, 17 nt, Human
agauuucacucuccuug

SEQ ID NO: 2980547 - RNA, 14 nt, Human
ucugagugcaaacu

SEQ ID NO: 2980548 - RNA, 21 nt, Human
ucugagacucgcgacaaugca

SEQ ID NO: 2980549 - RNA, 23 nt, Human
ucugagugcaaacuucagaguuc

SEQ ID NO: 2980550 - RNA, 22 nt, Human
ucugagugcaaacuucagaguu

SEQ ID NO: 2980551 - RNA, 17 nt, Human
ucugaucauccacugug

SEQ ID NO: 2980552 - RNA, 21 nt, Human
ucugaucauccacugugccau

SEQ ID NO: 2980553 - RNA, 15 nt, Human
ucugcagauaaacag

SEQ ID NO: 2980554 - RNA, 18 nt, Human
ucugcagauaaacaguag

SEQ ID NO: 2980555 - RNA, 17 nt, Human
ucugcagcaauaaagca

SEQ ID NO: 2980556 - RNA, 14 nt, Human
ucugcacuccccug

SEQ ID NO: 2980557 - RNA, 15 nt, Human
ucugcacuccccugc

SEQ ID NO: 2980558 - RNA, 16 nt, Human
ucugcacuccccugcu

SEQ ID NO: 2980559 - RNA, 15 nt, Human
agaaauguacagcaa

SEQ ID NO: 2980560 - RNA, 14 nt, Human
agaaauguacagca

SEQ ID NO: 2980561 - RNA, 14 nt, Human
agaaaugaaagcag

SEQ ID NO: 2980562 - RNA, 21 nt, Human
ucugaaggacauugcggacag

SEQ ID NO: 2980563 - RNA, 14 nt, Human
ucugacacacagcu

SEQ ID NO: 2980564 - RNA, 13 nt, Human
ucugacacacagc

SEQ ID NO: 2980565 - RNA, 12 nt, Human
ucugacacacag

SEQ ID NO: 2980566 - RNA, 15 nt, Human
ucugacacacagcuc

SEQ ID NO: 2980567 - RNA, 13 nt, Human
agaagaacugaaa

SEQ ID NO: 2980568 - RNA, 14 nt, Human
agaagaacugaaau

SEQ ID NO: 2980569 - RNA, 18 nt, Human
agaagaugguaccaccag

SEQ ID NO: 2980570 - RNA, 12 nt, Human
agaagcccagga

SEQ ID NO: 2980571 - RNA, 16 nt, Human
agaagcccaggaaagg

SEQ ID NO: 2980572 - RNA, 18 nt, Human
agaagcccaggaaaggcu

SEQ ID NO: 2980573 - RNA, 20 nt, Human
agaagcccaggaaaggcucc

SEQ ID NO: 2980574 - RNA, 21 nt, Human
agaagcccaggaaaggcucca

SEQ ID NO: 2980575 - RNA, 22 nt, Human
agaagcccaggaaaggcuccag

SEQ ID NO: 2980576 - RNA, 16 nt, Human
ucugcccacucccugc

SEQ ID NO: 2980577 - RNA, 17 nt, Human
ucugcccacucccugca

SEQ ID NO: 2980578 - RNA, 18 nt, Human
agaagauuuugaaauuuu

SEQ ID NO: 2980579 - RNA, 16 nt, Human
ucugcuugccaucccu

SEQ ID NO: 2980580 - RNA, 20 nt, Human
ucugcuugccaucccucccu

SEQ ID NO: 2980581 - RNA, 17 nt, Human
ucugcuugccaucccuc

SEQ ID NO: 2980582 - RNA, 23 nt, Human
ucugcuugccaucccucccucca

SEQ ID NO: 2980583 - RNA, 14 nt, Human
ucugcuugccaucc

SEQ ID NO: 2980584 - RNA, 15 nt, Human
ucugcuucagccucc

SEQ ID NO: 2980585 - RNA, 14 nt, Human
ucugcuucagccuc

SEQ ID NO: 2980586 - RNA, 13 nt, Human
ucugcuucagccu

SEQ ID NO: 2980587 - RNA, 20 nt, Human
ucugcucacauaucugucau

SEQ ID NO: 2980588 - RNA, 19 nt, Human
ucugcucacauaucuguca

SEQ ID NO: 2980589 - RNA, 17 nt, Human
ucugcucacauaucugu

SEQ ID NO: 2980590 - RNA, 22 nt, Human
ucugccgcagcccugcagaggg

SEQ ID NO: 2980591 - RNA, 22 nt, Human
ucugccugcccaggccccugcc

SEQ ID NO: 2980592 - RNA, 21 nt, Human
ucugccugcccaggccccugc

SEQ ID NO: 2980593 - RNA, 14 nt, Human
ucugcggagcacac

SEQ ID NO: 2980594 - RNA, 21 nt, Human
ucugcggagcacacuggcuca

SEQ ID NO: 2980595 - RNA, 22 nt, Human
ucugcggagcacacuggcucac

SEQ ID NO: 2980596 - RNA, 20 nt, Human
ucugcgggggcagugcucac

SEQ ID NO: 2980597 - RNA, 18 nt, Human
ucugcgggggcagugcuc

SEQ ID NO: 2980598 - RNA, 18 nt, Human
ucugcccacucccugcaa

SEQ ID NO: 2980599 - RNA, 21 nt, Human
ucugcccacucccugcaaccu

SEQ ID NO: 2980600 - RNA, 18 nt, Human
ucugcccuccaagaccuu

SEQ ID NO: 2980601 - RNA, 19 nt, Human
ucugcccuccaagaccuuc

SEQ ID NO: 2980602 - RNA, 14 nt, Human
ucugccgcagcccu

SEQ ID NO: 2980603 - RNA, 15 nt, Human
ucugccgcagcccug

SEQ ID NO: 2980604 - RNA, 24 nt, Human
agaauugauugggcacaucauuuc

SEQ ID NO: 2980605 - RNA, 21 nt, Human
agaauuugauaugugaacagu

SEQ ID NO: 2980606 - RNA, 22 nt, Human
agaauuugauaugugaacaguu

SEQ ID NO: 2980607 - RNA, 23 nt, Human
agaauugauugggcacaucauuu

SEQ ID NO: 2980608 - RNA, 22 nt, Human
agaauugauugggcacaucauu

SEQ ID NO: 2980609 - RNA, 16 nt, Human
agaauugauugggcac

SEQ ID NO: 2980610 - RNA, 19 nt, Human
agaauugacauugaaaucu

SEQ ID NO: 2980611 - RNA, 18 nt, Human
agaauugacauugaaauc

SEQ ID NO: 2980612 - RNA, 17 nt, Human
agaauugacauugaaau

SEQ ID NO: 2980613 - RNA, 16 nt, Human
agaauugacauugaaa

SEQ ID NO: 2980614 - RNA, 15 nt, Human
agaauugacauugaa

SEQ ID NO: 2980615 - RNA, 12 nt, Human
agacacacauga

SEQ ID NO: 2980616 - RNA, 13 nt, Human
agacacaggcccg

SEQ ID NO: 2980617 - RNA, 12 nt, Human
agacacaggccc

SEQ ID NO: 2980618 - RNA, 16 nt, Human
agacacaggcccggcu

SEQ ID NO: 2980619 - RNA, 22 nt, Human
agacagagccccacccucagau

SEQ ID NO: 2980620 - RNA, 24 nt, Human
agacagagccccacccucagaugc

SEQ ID NO: 2980621 - RNA, 16 nt, Human
agacaggaccagggau

SEQ ID NO: 2980622 - RNA, 13 nt, Human
agacagagaccug

SEQ ID NO: 2980623 - RNA, 21 nt, Human
agacacaugccagggccaugu

SEQ ID NO: 2980624 - RNA, 14 nt, Human
agacacaugccagg

SEQ ID NO: 2980625 - RNA, 16 nt, Human
agacacauguccaaga

SEQ ID NO: 2980626 - RNA, 20 nt, Human
agacacauguccaagaagcc

SEQ ID NO: 2980627 - RNA, 18 nt, Human
agacaccuugacagggca

SEQ ID NO: 2980628 - RNA, 17 nt, Human
agacaccuugacagggc

SEQ ID NO: 2980629 - RNA, 13 nt, Human
ucuguucuuucca

SEQ ID NO: 2980630 - RNA, 22 nt, Human
ucuguucuuuccaaaguacacu

SEQ ID NO: 2980631 - RNA, 17 nt, Human
ucuguuggccaguguga

SEQ ID NO: 2980632 - RNA, 12 nt, Human
ucuguuggccag

SEQ ID NO: 2980633 - RNA, 22 nt, Human
ucugugagaugcuagaacuccc

SEQ ID NO: 2980634 - RNA, 17 nt, Human
ucugugagaugcuagaa

SEQ ID NO: 2980635 - RNA, 23 nt, Human
ucugugagaugcuagaacucccu

SEQ ID NO: 2980636 - RNA, 14 nt, Human
ucugugagaugcua

SEQ ID NO: 2980637 - RNA, 22 nt, Human
ucugugaaaggaaagagggagg

SEQ ID NO: 2980638 - RNA, 15 nt, Human
agaauguuuucaaau

SEQ ID NO: 2980639 - RNA, 21 nt, Human
agaauguuuucaaauguucuc

SEQ ID NO: 2980640 - RNA, 15 nt, Human
agaauuaacacauga

SEQ ID NO: 2980641 - RNA, 19 nt, Human
agaaggcauggacuucugg

SEQ ID NO: 2980642 - RNA, 21 nt, Human
agaaguuucugccgcagcccu

SEQ ID NO: 2980643 - RNA, 22 nt, Human
agaaguuucugccgcagcccug

SEQ ID NO: 2980644 - RNA, 23 nt, Human
agaaguuucugccgcagcccugc

SEQ ID NO: 2980645 - RNA, 23 nt, Human
ucuauaacaaaggauacuuauuu

SEQ ID NO: 2980646 - RNA, 22 nt, Human
ucuauaacaaaggauacuuauu

SEQ ID NO: 2980647 - RNA, 13 nt, Human
ucuauaaaccgaa

SEQ ID NO: 2980648 - RNA, 21 nt, Human
ucuaguuugauuaaauucuug

SEQ ID NO: 2980649 - RNA, 23 nt, Human
ucuaguuguuugauucagacagc

SEQ ID NO: 2980650 - RNA, 22 nt, Human
ucuaguuguuugauucagacag

SEQ ID NO: 2980651 - RNA, 12 nt, Human
ucuaggaagacu

SEQ ID NO: 2980652 - RNA, 13 nt, Human
ucuagccagagga

SEQ ID NO: 2980653 - RNA, 16 nt, Human
ucuaggaaauauuuau

SEQ ID NO: 2980654 - RNA, 17 nt, Human
ucuaggaaauauuuauu

SEQ ID NO: 2980655 - RNA, 16 nt, Human
acuucaucccucuggg

SEQ ID NO: 2980656 - RNA, 18 nt, Human
ucuagcauggcugccaau

SEQ ID NO: 2980657 - RNA, 13 nt, Human
ucuagauacugua

SEQ ID NO: 2980658 - RNA, 14 nt, Human
ucuauguuaauauu

SEQ ID NO: 2980659 - RNA, 16 nt, Human
ucuauguuaauauuuu

SEQ ID NO: 2980660 - RNA, 23 nt, Human
ucuaugggacucaaugcacugac

SEQ ID NO: 2980661 - RNA, 13 nt, Human
ucuauuuauuuau

SEQ ID NO: 2980662 - RNA, 14 nt, Human
ucuauuuauuuauu

SEQ ID NO: 2980663 - RNA, 16 nt, Human
ucucacuauguugccc

SEQ ID NO: 2980664 - RNA, 19 nt, Human
ucucacuauguugcccagg

SEQ ID NO: 2980665 - RNA, 17 nt, Human
ucucacuauguugccca

SEQ ID NO: 2980666 - RNA, 12 nt, Human
uccugggcagcu

SEQ ID NO: 2980667 - RNA, 13 nt, Human
uccugggcagcug

SEQ ID NO: 2980668 - RNA, 18 nt, Human
uccugggagugagcuggu

SEQ ID NO: 2980669 - RNA, 14 nt, Human
ucuaaguaaaacca

SEQ ID NO: 2980670 - RNA, 15 nt, Human
ucuaaguaaaaccac

SEQ ID NO: 2980671 - RNA, 19 nt, Human
ucuaaguaaaaccacagca

SEQ ID NO: 2980672 - RNA, 19 nt, Human
ucuacccagcgagcccugg

SEQ ID NO: 2980673 - RNA, 21 nt, Human
ucuacagaggccaugggccuc

SEQ ID NO: 2980674 - RNA, 14 nt, Human
ucuacccuggcacu

SEQ ID NO: 2980675 - RNA, 19 nt, Human
ucuacccuggcacuauaau

SEQ ID NO: 2980676 - RNA, 14 nt, Human
ucuacccaggugcu

SEQ ID NO: 2980677 - RNA, 20 nt, Human
ucuacccagcgagcccuggu

SEQ ID NO: 2980678 - RNA, 21 nt, Human
ucuacccuggcacuauaaugu

SEQ ID NO: 2980679 - RNA, 16 nt, Human
acuguucucugcccuc

SEQ ID NO: 2980680 - RNA, 17 nt, Human
acuguucucugcccucc

SEQ ID NO: 2980681 - RNA, 18 nt, Human
acuguucucugcccucca

SEQ ID NO: 2980682 - RNA, 16 nt, Human
acuuacuguacaugaa

SEQ ID NO: 2980683 - RNA, 21 nt, Human
acuuacuguacaugaaaacac

SEQ ID NO: 2980684 - RNA, 17 nt, Human
acuuacacuuuaugcac

SEQ ID NO: 2980685 - RNA, 19 nt, Human
acuuaaugagacuuuaaaa

SEQ ID NO: 2980686 - RNA, 22 nt, Human
acuuacuguacaugaaaacaca

SEQ ID NO: 2980687 - RNA, 15 nt, Human
acuuagguguggggg

SEQ ID NO: 2980688 - RNA, 16 nt, Human
acuuacacuuuaugca

SEQ ID NO: 2980689 - RNA, 22 nt, Human
acuuaaucuaaauggaaccacu

SEQ ID NO: 2980690 - RNA, 15 nt, Human
acuuaaugaaaacaa

SEQ ID NO: 2980691 - RNA, 18 nt, Human
acuuaaugaaaacaaugc

SEQ ID NO: 2980692 - RNA, 16 nt, Human
acuuaaugaaaacaau

SEQ ID NO: 2980693 - RNA, 16 nt, Human
acuuaaugagacuuua

SEQ ID NO: 2980694 - RNA, 19 nt, Human
acuuaaucuaaauggaacc

SEQ ID NO: 2980695 - RNA, 17 nt, Human
acuuaaucuaaauggaa

SEQ ID NO: 2980696 - RNA, 13 nt, Human
acuuaagcacacu

SEQ ID NO: 2980697 - RNA, 11 nt, Human
acuuaagacuu

SEQ ID NO: 2980698 - RNA, 20 nt, Human
acuuaaauaaugugaaacug

SEQ ID NO: 2980699 - RNA, 14 nt, Human
ucucagcagagugc

SEQ ID NO: 2980700 - RNA, 13 nt, Human
ucucagcagagug

SEQ ID NO: 2980701 - RNA, 12 nt, Human
ucucagcagagu

SEQ ID NO: 2980702 - RNA, 12 nt, Human
ucucaggaaauc

SEQ ID NO: 2980703 - RNA, 14 nt, Human
ucucaggaaaucaa

SEQ ID NO: 2980704 - RNA, 21 nt, Human
ucucaggaaaucaaauaugca

SEQ ID NO: 2980705 - RNA, 23 nt, Human
ucucaggaaaucaaauaugcaaa

SEQ ID NO: 2980706 - RNA, 12 nt, Human
ucucaggccagc

SEQ ID NO: 2980707 - RNA, 13 nt, Human
ucucaggccagcu

SEQ ID NO: 2980708 - RNA, 12 nt, Human
ucucaggccaaa

SEQ ID NO: 2980709 - RNA, 10 nt, Human
ucucaggcca

SEQ ID NO: 2980710 - RNA, 15 nt, Human
ucucauuuccaagca

SEQ ID NO: 2980711 - RNA, 14 nt, Human
ucucauuugucaca

SEQ ID NO: 2980712 - RNA, 15 nt, Human
ucuccaagcaggaca

SEQ ID NO: 2980713 - RNA, 16 nt, Human
ucuccaagcaggacau

SEQ ID NO: 2980714 - RNA, 16 nt, Human
ucucauuugucacaca

SEQ ID NO: 2980715 - RNA, 17 nt, Human
ucucaggccagcugcuu

SEQ ID NO: 2980716 - RNA, 18 nt, Human
ucucaggccagcugcuug

SEQ ID NO: 2980717 - RNA, 21 nt, Human
ucucaggccagcugcuugggc

SEQ ID NO: 2980718 - RNA, 15 nt, Human
acuugugaauaaaga

SEQ ID NO: 2980719 - RNA, 21 nt, Human
acuugucuuuggacccugagg

SEQ ID NO: 2980720 - RNA, 20 nt, Human
acuugucuuuggacccugag

SEQ ID NO: 2980721 - RNA, 18 nt, Human
acuugucuuuggacccug

SEQ ID NO: 2980722 - RNA, 22 nt, Human
acuuguggacacagcucuucuc

SEQ ID NO: 2980723 - RNA, 19 nt, Human
acuuguggacacagcucuu

SEQ ID NO: 2980724 - RNA, 15 nt, Human
acuugucaauaaaau

SEQ ID NO: 2980725 - RNA, 22 nt, Human
acuugcagacucuacagaggcc

SEQ ID NO: 2980726 - RNA, 19 nt, Human
acuugcagacucuacagag

SEQ ID NO: 2980727 - RNA, 23 nt, Human
acuugcagacucuacagaggcca

SEQ ID NO: 2980728 - RNA, 23 nt, Human
ucucacuauguugcccaggcagg

SEQ ID NO: 2980729 - RNA, 22 nt, Human
ucucacuauguugcccaggcag

SEQ ID NO: 2980730 - RNA, 21 nt, Human
ucucacuauguugcccaggca

SEQ ID NO: 2980731 - RNA, 20 nt, Human
ucucacuauguugcccaggc

SEQ ID NO: 2980732 - RNA, 21 nt, Human
acuuugguuauuuuacuuuuu

SEQ ID NO: 2980733 - RNA, 13 nt, Human
acuuugguuauuu

SEQ ID NO: 2980734 - RNA, 10 nt, Human
acuuugguua

SEQ ID NO: 2980735 - RNA, 13 nt, Human
acuuugaccucug

SEQ ID NO: 2980736 - RNA, 12 nt, Human
acuuugaccucu

SEQ ID NO: 2980737 - RNA, 23 nt, Human
acuuugguuauuuuacuuuuugg

SEQ ID NO: 2980738 - RNA, 22 nt, Human
acuuugguuauuuuacuuuuug

SEQ ID NO: 2980739 - RNA, 20 nt, Human
acuuuguuaguuucuccaag

SEQ ID NO: 2980740 - RNA, 18 nt, Human
acuuuguguucaccuugu

SEQ ID NO: 2980741 - RNA, 13 nt, Human
acuuuuguucuug

SEQ ID NO: 2980742 - RNA, 12 nt, Human
acuuuuguucuu

SEQ ID NO: 2980743 - RNA, 21 nt, Human
acuuuguuaguuucuccaagc

SEQ ID NO: 2980744 - RNA, 14 nt, Human
acuuuguucuggcu

SEQ ID NO: 2980745 - RNA, 16 nt, Human
acuuuuuauauucuca

SEQ ID NO: 2980746 - RNA, 15 nt, Human
acuuuuuauauucuc

SEQ ID NO: 2980747 - RNA, 12 nt, Human
acuuuuuauauu

SEQ ID NO: 2980748 - RNA, 22 nt, Human
acuuuuuauauucucagcagag

SEQ ID NO: 2980749 - RNA, 23 nt, Human
acuuuuguucuugguuuguaaau

SEQ ID NO: 2980750 - RNA, 15 nt, Human
acuuuuguucuuggu

SEQ ID NO: 2980751 - RNA, 21 nt, Human
ucuccuuguguuacuaaguuu

SEQ ID NO: 2980752 - RNA, 13 nt, Human
ucuccuuguguua

SEQ ID NO: 2980753 - RNA, 16 nt, Human
ucuccuucaccuuugu

SEQ ID NO: 2980754 - RNA, 14 nt, Human
ucuccuucaccuuu

SEQ ID NO: 2980755 - RNA, 15 nt, Human
ucuccuucaccuuug

SEQ ID NO: 2980756 - RNA, 17 nt, Human
agaaaaaauauuuuccc

SEQ ID NO: 2980757 - RNA, 23 nt, Human
ucuccgaccagacaccuugacag

SEQ ID NO: 2980758 - RNA, 17 nt, Human
ucuccgaccagacaccu

SEQ ID NO: 2980759 - RNA, 21 nt, Human
ucucccuuggauuguccccga

SEQ ID NO: 2980760 - RNA, 23 nt, Human
ucuccccagcaagugagagcugg

SEQ ID NO: 2980761 - RNA, 18 nt, Human
ucuccaagcaggacaugg

SEQ ID NO: 2980762 - RNA, 19 nt, Human
ucuccaagcaggacaugga

SEQ ID NO: 2980763 - RNA, 12 nt, Human
acuuuaccuuuu

SEQ ID NO: 2980764 - RNA, 20 nt, Human
acuuucugaaauaacauggc

SEQ ID NO: 2980765 - RNA, 14 nt, Human
acuuucugaaauaa

SEQ ID NO: 2980766 - RNA, 17 nt, Human
ucuccucugcugcuggc

SEQ ID NO: 2980767 - RNA, 18 nt, Human
ucuccucugcugcuggcu

SEQ ID NO: 2980768 - RNA, 15 nt, Human
ucuccucugcugcug

SEQ ID NO: 2980769 - RNA, 16 nt, Human
ucuccucugcugcugg

SEQ ID NO: 2980770 - RNA, 15 nt, Human
ucuccuccagaguca

SEQ ID NO: 2980771 - RNA, 14 nt, Human
uccagucauuaugu

SEQ ID NO: 2980772 - RNA, 15 nt, Human
uccagucauuauguu

SEQ ID NO: 2980773 - RNA, 21 nt, Human
uccagucauuauguuaauauu

SEQ ID NO: 2980774 - RNA, 23 nt, Human
uccagucauuauguuaauauuuc

SEQ ID NO: 2980775 - RNA, 16 nt, Human
uccaguaucuugaaga

SEQ ID NO: 2980776 - RNA, 18 nt, Human
uccaguaucuugaagacu

SEQ ID NO: 2980777 - RNA, 15 nt, Human
uccagugaggcucug

SEQ ID NO: 2980778 - RNA, 18 nt, Human
uccagugagacagcucug

SEQ ID NO: 2980779 - RNA, 16 nt, Human
uccagugaggcucugc

SEQ ID NO: 2980780 - RNA, 22 nt, Human
uccagugaggcucugcccuugg

SEQ ID NO: 2980781 - RNA, 23 nt, Human
uccagugaggcucugcccuuggu

SEQ ID NO: 2980782 - RNA, 12 nt, Human
acggccaggcca

SEQ ID NO: 2980783 - RNA, 18 nt, Human
acggcucacugcagccuc

SEQ ID NO: 2980784 - RNA, 17 nt, Human
acggcucacugcagccu

SEQ ID NO: 2980785 - RNA, 15 nt, Human
acggcucacugcagc

SEQ ID NO: 2980786 - RNA, 16 nt, Human
acggcucacugcagcc

SEQ ID NO: 2980787 - RNA, 18 nt, Human
acggcuuuuacuuaaacc

SEQ ID NO: 2980788 - RNA, 14 nt, Human
uccaguaucuugaa

SEQ ID NO: 2980789 - RNA, 15 nt, Human
uccaguaucuugaag

SEQ ID NO: 2980790 - RNA, 11 nt, Human
acgcucucugg

SEQ ID NO: 2980791 - RNA, 13 nt, Human
acgcuggaccuug

SEQ ID NO: 2980792 - RNA, 16 nt, Human
acgcuggagugcagug

SEQ ID NO: 2980793 - RNA, 15 nt, Human
acgcuggagugcagu

SEQ ID NO: 2980794 - RNA, 23 nt, Human
acgcuggaccuugaacuggguac

SEQ ID NO: 2980795 - RNA, 20 nt, Human
acgcuggaccuugaacuggg

SEQ ID NO: 2980796 - RNA, 17 nt, Human
acgcuggagugcaguga

SEQ ID NO: 2980797 - RNA, 21 nt, Human
acggagucccaccuuggcugc

SEQ ID NO: 2980798 - RNA, 23 nt, Human
acggagucccaccuuggcugcag

SEQ ID NO: 2980799 - RNA, 21 nt, Human
acgaauauugcugauggugca

SEQ ID NO: 2980800 - RNA, 14 nt, Human
acgaauauugcuga

SEQ ID NO: 2980801 - RNA, 21 nt, Human
acgcuacccgggaagggggcu

SEQ ID NO: 2980802 - RNA, 20 nt, Human
uccaggcugggagagccuuc

SEQ ID NO: 2980803 - RNA, 21 nt, Human
uccaggcugggagagccuucc

SEQ ID NO: 2980804 - RNA, 12 nt, Human
uccaggcuccuu

SEQ ID NO: 2980805 - RNA, 10 nt, Human
uccaggcucc

SEQ ID NO: 2980806 - RNA, 23 nt, Human
uccaggcugggagagccuuccag

SEQ ID NO: 2980807 - RNA, 13 nt, Human
acgaaagaaggca

SEQ ID NO: 2980808 - RNA, 13 nt, Human
acgaaaaaauggu

SEQ ID NO: 2980809 - RNA, 22 nt, Human
accuuuuuuauacauaaacaag

SEQ ID NO: 2980810 - RNA, 15 nt, Human
acgaauauugcugau

SEQ ID NO: 2980811 - RNA, 18 nt, Human
acgaauauugcugauggu

SEQ ID NO: 2980812 - RNA, 14 nt, Human
uccagaauuuccca

SEQ ID NO: 2980813 - RNA, 15 nt, Human
uccagaauuucccaa

SEQ ID NO: 2980814 - RNA, 13 nt, Human
uccagacacaugu

SEQ ID NO: 2980815 - RNA, 19 nt, Human
accuugaaaacuuuaugcu

SEQ ID NO: 2980816 - RNA, 20 nt, Human
accuugaacuggguacuugu

SEQ ID NO: 2980817 - RNA, 17 nt, Human
accuuuguccccaccgc

SEQ ID NO: 2980818 - RNA, 18 nt, Human
accuuuguccccaccgca

SEQ ID NO: 2980819 - RNA, 20 nt, Human
accuuuuggucuggagggaa

SEQ ID NO: 2980820 - RNA, 13 nt, Human
accuuuuuuauac

SEQ ID NO: 2980821 - RNA, 22 nt, Human
uccacugguucuucuuggucuc

SEQ ID NO: 2980822 - RNA, 21 nt, Human
uccacugugccaugugccagg

SEQ ID NO: 2980823 - RNA, 17 nt, Human
uccacuggguguaaaca

SEQ ID NO: 2980824 - RNA, 20 nt, Human
uccacuggguguaaacacau

SEQ ID NO: 2980825 - RNA, 11 nt, Human
uccauccugag

SEQ ID NO: 2980826 - RNA, 15 nt, Human
uccauccugaggcuc

SEQ ID NO: 2980827 - RNA, 12 nt, Human
uccauccugagg

SEQ ID NO: 2980828 - RNA, 19 nt, Human
acguggcugcuucaaggau

SEQ ID NO: 2980829 - RNA, 21 nt, Human
acguggcugcuucaaggaucc

SEQ ID NO: 2980830 - RNA, 17 nt, Human
acguggcugcuucaagg

SEQ ID NO: 2980831 - RNA, 18 nt, Human
acguggcugcuucaagga

SEQ ID NO: 2980832 - RNA, 15 nt, Human
acguugugcauuugg

SEQ ID NO: 2980833 - RNA, 14 nt, Human
acguugugcauuug

SEQ ID NO: 2980834 - RNA, 16 nt, Human
acguuucuaaaggcua

SEQ ID NO: 2980835 - RNA, 15 nt, Human
acguuucuaaaggcu

SEQ ID NO: 2980836 - RNA, 13 nt, Human
acguugugcauuu

SEQ ID NO: 2980837 - RNA, 15 nt, Human
acuaauuuuaaaaug

SEQ ID NO: 2980838 - RNA, 22 nt, Human
acguuucuaaaggcuaccuuug

SEQ ID NO: 2980839 - RNA, 16 nt, Human
ucccagauacuugggg

SEQ ID NO: 2980840 - RNA, 18 nt, Human
ucccagauacuugggggg

SEQ ID NO: 2980841 - RNA, 17 nt, Human
acuaucucauuuccaag

SEQ ID NO: 2980842 - RNA, 16 nt, Human
acuaucucauuuccaa

SEQ ID NO: 2980843 - RNA, 21 nt, Human
acuaucuaaauguugaaagau

SEQ ID NO: 2980844 - RNA, 16 nt, Human
acuaucuaaauguuga

SEQ ID NO: 2980845 - RNA, 15 nt, Human
acuaucucauuucca

SEQ ID NO: 2980846 - RNA, 22 nt, Human
acuauauuguuugcuaagcauu

SEQ ID NO: 2980847 - RNA, 17 nt, Human
acuauauuguuugcuaa

SEQ ID NO: 2980848 - RNA, 18 nt, Human
acuauagccuaggugaca

SEQ ID NO: 2980849 - RNA, 22 nt, Human
acuauagccuaggugacagagu

SEQ ID NO: 2980850 - RNA, 20 nt, Human
acuauagccuaggugacaga

SEQ ID NO: 2980851 - RNA, 16 nt, Human
acucaaugcacugaca

SEQ ID NO: 2980852 - RNA, 16 nt, Human
acuauguugcccaggc

SEQ ID NO: 2980853 - RNA, 15 nt, Human
acuauguugcccagg

SEQ ID NO: 2980854 - RNA, 22 nt, Human
acuauggcccuggccuagcaua

SEQ ID NO: 2980855 - RNA, 14 nt, Human
acuauguugcccag

SEQ ID NO: 2980856 - RNA, 23 nt, Human
uccccacccugaaagcccugagc

SEQ ID NO: 2980857 - RNA, 15 nt, Human
uccccaccgcagaca

SEQ ID NO: 2980858 - RNA, 16 nt, Human
uccccaccgcagacag

SEQ ID NO: 2980859 - RNA, 18 nt, Human
uccccaggaggccagccu

SEQ ID NO: 2980860 - RNA, 12 nt, Human
uccccacccuga

SEQ ID NO: 2980861 - RNA, 23 nt, Human
ucccagcuacucgggaggcugag

SEQ ID NO: 2980862 - RNA, 22 nt, Human
ucccagcuacucgggaggcuga

SEQ ID NO: 2980863 - RNA, 17 nt, Human
uccccaggaggccagcc

SEQ ID NO: 2980864 - RNA, 20 nt, Human
uccccaggaggccagccuug

SEQ ID NO: 2980865 - RNA, 21 nt, Human
uccccaggaggccagccuuga

SEQ ID NO: 2980866 - RNA, 11 nt, Human
ucccccagccc

SEQ ID NO: 2980867 - RNA, 13 nt, Human
ucccccagcccca

SEQ ID NO: 2980868 - RNA, 15 nt, Human
ucccccagccccauc

SEQ ID NO: 2980869 - RNA, 16 nt, Human
ucccccagccccaucc

SEQ ID NO: 2980870 - RNA, 15 nt, Human
acugaacaguaacau

SEQ ID NO: 2980871 - RNA, 21 nt, Human
acugaacaguaacauagcugu

SEQ ID NO: 2980872 - RNA, 22 nt, Human
uccucuuuggucuacacugugc

SEQ ID NO: 2980873 - RNA, 22 nt, Human
uccugaaaacccuugccaugug

SEQ ID NO: 2980874 - RNA, 12 nt, Human
uccucuuuccau

SEQ ID NO: 2980875 - RNA, 11 nt, Human
uccucuuucca

SEQ ID NO: 2980876 - RNA, 14 nt, Human
uccucccucccucu

SEQ ID NO: 2980877 - RNA, 11 nt, Human
uccucccuccc

SEQ ID NO: 2980878 - RNA, 19 nt, Human
uccucuuuggucuacacug

SEQ ID NO: 2980879 - RNA, 21 nt, Human
uccucuuuggucuacacugug

SEQ ID NO: 2980880 - RNA, 19 nt, Human
uccucuuuccaucuacccu

SEQ ID NO: 2980881 - RNA, 22 nt, Human
acugagacagcccgggcucugc

SEQ ID NO: 2980882 - RNA, 23 nt, Human
acugagacagcccgggcucugcc

SEQ ID NO: 2980883 - RNA, 18 nt, Human
acugagagugaacaaauu

SEQ ID NO: 2980884 - RNA, 17 nt, Human
acugagaugugaacaca

SEQ ID NO: 2980885 - RNA, 22 nt, Human
acugagaugugaacacaucagc

SEQ ID NO: 2980886 - RNA, 15 nt, Human
acugagacagcccgg

SEQ ID NO: 2980887 - RNA, 18 nt, Human
acugagacagcccgggcu

SEQ ID NO: 2980888 - RNA, 21 nt, Human
acugagacagcccgggcucug

SEQ ID NO: 2980889 - RNA, 20 nt, Human
acugacucuuaagaagacug

SEQ ID NO: 2980890 - RNA, 18 nt, Human
acugacucuuaagaagac

SEQ ID NO: 2980891 - RNA, 17 nt, Human
acugacucuuaagaaga

SEQ ID NO: 2980892 - RNA, 13 nt, Human
acugacuucuaag

SEQ ID NO: 2980893 - RNA, 15 nt, Human
acugacuucuaagua

SEQ ID NO: 2980894 - RNA, 16 nt, Human
acugacuucuaaguaa

SEQ ID NO: 2980895 - RNA, 22 nt, Human
acugacuucuaaguaaaaccac

SEQ ID NO: 2980896 - RNA, 16 nt, Human
acugacucuuaagaag

SEQ ID NO: 2980897 - RNA, 15 nt, Human
acugacucuuaagaa

SEQ ID NO: 2980898 - RNA, 14 nt, Human
acugacucuuaaga

SEQ ID NO: 2980899 - RNA, 13 nt, Human
acugacucuuaag

SEQ ID NO: 2980900 - RNA, 15 nt, Human
uccuggaaauauuaa

SEQ ID NO: 2980901 - RNA, 16 nt, Human
uccuggaaaucagggu

SEQ ID NO: 2980902 - RNA, 22 nt, Human
uccuggaauaucuccgucaacu

SEQ ID NO: 2980903 - RNA, 17 nt, Human
uccugggagugagcugg

SEQ ID NO: 2980904 - RNA, 14 nt, Human
uccugggagugagc

SEQ ID NO: 2980905 - RNA, 12 nt, Human
uccugggaguga

SEQ ID NO: 2980906 - RNA, 15 nt, Human
uccugggagcuuuug

SEQ ID NO: 2980907 - RNA, 21 nt, Human
uccugcugcaguugccaguca

SEQ ID NO: 2980908 - RNA, 12 nt, Human
uccugcaggcag

SEQ ID NO: 2980909 - RNA, 13 nt, Human
uccugcaggcagc

SEQ ID NO: 2980910 - RNA, 14 nt, Human
uccugcaggcagcc

SEQ ID NO: 2980911 - RNA, 21 nt, Human
uccugccucgaacuggcugca

SEQ ID NO: 2980912 - RNA, 19 nt, Human
acugcacuccagccugggu

SEQ ID NO: 2980913 - RNA, 20 nt, Human
acugcacuccagccugggug

SEQ ID NO: 2980914 - RNA, 18 nt, Human
acugcacuccagccuggg

SEQ ID NO: 2980915 - RNA, 17 nt, Human
acugcacuccagccugg

SEQ ID NO: 2980916 - RNA, 14 nt, Human
acugcacuccagcc

SEQ ID NO: 2980917 - RNA, 21 nt, Human
acugcacuauagccuagguga

SEQ ID NO: 2980918 - RNA, 20 nt, Human
uccugaugcuucuucagaga

SEQ ID NO: 2980919 - RNA, 21 nt, Human
uccugaugcuucuucagagac

SEQ ID NO: 2980920 - RNA, 19 nt, Human
uccugaugcuucuucagag

SEQ ID NO: 2980921 - RNA, 20 nt, Human
acugcacuauagccuaggug

SEQ ID NO: 2980922 - RNA, 16 nt, Human
acugcaccgggccaca

SEQ ID NO: 2980923 - RNA, 14 nt, Human
acugcaccgggcca

SEQ ID NO: 2980924 - RNA, 21 nt, Human
acugauaaagaugagugagca

SEQ ID NO: 2980925 - RNA, 13 nt, Human
acugauaaagaug

SEQ ID NO: 2980926 - RNA, 15 nt, Human
acugagcauaagucc

SEQ ID NO: 2980927 - RNA, 22 nt, Human
acucugagugcaaacuucagag

SEQ ID NO: 2980928 - RNA, 11 nt, Human
acucugagacu

SEQ ID NO: 2980929 - RNA, 22 nt, Human
acucugagacucgcgacaaugc

SEQ ID NO: 2980930 - RNA, 16 nt, Human
acucuccuuggugucg

SEQ ID NO: 2980931 - RNA, 23 nt, Human
acucuccuuggugucgggcauga

SEQ ID NO: 2980932 - RNA, 17 nt, Human
acucugccacuuuauuu

SEQ ID NO: 2980933 - RNA, 16 nt, Human
acucugccacuuuauu

SEQ ID NO: 2980934 - RNA, 13 nt, Human
acucuggcagcuc

SEQ ID NO: 2980935 - RNA, 15 nt, Human
acucuggcagcucag

SEQ ID NO: 2980936 - RNA, 23 nt, Human
acuccuugaaaacacuguucucu

SEQ ID NO: 2980937 - RNA, 24 nt, Human
acuccuugaaaacacuguucucug

SEQ ID NO: 2980938 - RNA, 14 nt, Human
acucuccuccagag

SEQ ID NO: 2980939 - RNA, 17 nt, Human
acucuccuccagaguca

SEQ ID NO: 2980940 - RNA, 18 nt, Human
acucuccuggaaauauua

SEQ ID NO: 2980941 - RNA, 15 nt, Human
acucuccuugguguc

SEQ ID NO: 2980942 - RNA, 16 nt, Human
acucuccucugcugcu

SEQ ID NO: 2980943 - RNA, 21 nt, Human
acucuccucugcugcuggcug

SEQ ID NO: 2980944 - RNA, 13 nt, Human
acucuccucugcu

SEQ ID NO: 2980945 - RNA, 14 nt, Human
acucuccucugcug

SEQ ID NO: 2980946 - RNA, 12 nt, Human
acucuccucugc

SEQ ID NO: 2980947 - RNA, 22 nt, Human
uccucauaguaugguggcuggg

SEQ ID NO: 2980948 - RNA, 23 nt, Human
uccucauacccacccccacccaa

SEQ ID NO: 2980949 - RNA, 16 nt, Human
acucuugaccucaggu

SEQ ID NO: 2980950 - RNA, 15 nt, Human
acucuugaccucagg

SEQ ID NO: 2980951 - RNA, 19 nt, Human
acucuuauaucuauauuuu

SEQ ID NO: 2980952 - RNA, 14 nt, Human
acucuugaccucag

SEQ ID NO: 2980953 - RNA, 18 nt, Human
acucuuauaucuauauuu

SEQ ID NO: 2980954 - RNA, 17 nt, Human
acucuuauaucuauauu

SEQ ID NO: 2980955 - RNA, 16 nt, Human
acucuuauaucuauau

SEQ ID NO: 2980956 - RNA, 21 nt, Human
acucuuaagaagacugcauua

SEQ ID NO: 2980957 - RNA, 19 nt, Human
acuccagugagacagcucu

SEQ ID NO: 2980958 - RNA, 14 nt, Human
acucaccccagccc

SEQ ID NO: 2980959 - RNA, 15 nt, Human
acucaccccagcccc

SEQ ID NO: 2980960 - RNA, 16 nt, Human
acucaccccagcccca

SEQ ID NO: 2980961 - RNA, 13 nt, Human
acucaccccagcc

SEQ ID NO: 2980962 - RNA, 18 nt, Human
ucccugguggcagcucac

SEQ ID NO: 2980963 - RNA, 19 nt, Human
ucccugguggcagcucacc

SEQ ID NO: 2980964 - RNA, 20 nt, Human
ucccugguggcagcucaccu

SEQ ID NO: 2980965 - RNA, 21 nt, Human
ucccugguggcagcucaccuc

SEQ ID NO: 2980966 - RNA, 16 nt, Human
ucccugguggcagcuc

SEQ ID NO: 2980967 - RNA, 17 nt, Human
ucccugguggcagcuca

SEQ ID NO: 2980968 - RNA, 11 nt, Human
acuccuggccu

SEQ ID NO: 2980969 - RNA, 15 nt, Human
acuccugcaggcagc

SEQ ID NO: 2980970 - RNA, 16 nt, Human
acuccugcaggcagcc

SEQ ID NO: 2980971 - RNA, 22 nt, Human
acuccugcaggcagccaggcca

SEQ ID NO: 2980972 - RNA, 12 nt, Human
acuccugcaggc

SEQ ID NO: 2980973 - RNA, 14 nt, Human
acuccugcaggcag

SEQ ID NO: 2980974 - RNA, 14 nt, Human
uccuacucuguguc

SEQ ID NO: 2980975 - RNA, 13 nt, Human
uccuacucugugu

SEQ ID NO: 2980976 - RNA, 12 nt, Human
uccuacucugug

SEQ ID NO: 2980977 - RNA, 15 nt, Human
uccuacucuguguca

SEQ ID NO: 2980978 - RNA, 20 nt, Human
uccuaggagguaaugaccau

SEQ ID NO: 2980979 - RNA, 18 nt, Human
uccuaggagguaaugacc

SEQ ID NO: 2980980 - RNA, 20 nt, Human
uccuaggacccgucuccagc

SEQ ID NO: 2980981 - RNA, 14 nt, Human
acuccuggccucaa

SEQ ID NO: 2980982 - RNA, 13 nt, Human
acuccuggccuca

SEQ ID NO: 2980983 - RNA, 13 nt, Human
uccuaggcauuug

SEQ ID NO: 2980984 - RNA, 12 nt, Human
acuccuggccuc

SEQ ID NO: 2980985 - RNA, 23 nt, Human
ucccuuuuuuggcugcugaaggc

SEQ ID NO: 2980986 - RNA, 20 nt, Human
ucccuuuuuuggcugcugaa

SEQ ID NO: 2980987 - RNA, 22 nt, Human
ucccuuuuuuggcugcugaagg

SEQ ID NO: 2980988 - RNA, 19 nt, Human
ucccuuugacgccauccca

SEQ ID NO: 2980989 - RNA, 17 nt, Human
ucccuuuuuuggcugcu

SEQ ID NO: 2980990 - RNA, 19 nt, Human
ucccuuuuuuggcugcuga

SEQ ID NO: 2980991 - RNA, 22 nt, Human
ucccugguggcagcucaccucu

SEQ ID NO: 2980992 - RNA, 19 nt, Human
ucccuuggauuguccccga

SEQ ID NO: 2980993 - RNA, 20 nt, Human
ucccuuggauuguccccgac

SEQ ID NO: 2980994 - RNA, 16 nt, Human
ucccuuugacgccauc

SEQ ID NO: 2980995 - RNA, 18 nt, Human
ucccuuugacgccauccc

SEQ ID NO: 2980996 - RNA, 14 nt, Human
ucagcccucagaau

SEQ ID NO: 2980997 - RNA, 23 nt, Human
acccaggagccccgaggccuucu

SEQ ID NO: 2980998 - RNA, 19 nt, Human
acccaggagccccgaggcc

SEQ ID NO: 2980999 - RNA, 12 nt, Human
acccaggaggcg

SEQ ID NO: 2981000 - RNA, 13 nt, Human
accccagccccaa

SEQ ID NO: 2981001 - RNA, 20 nt, Human
accccagcaauuaugaaaau

SEQ ID NO: 2981002 - RNA, 22 nt, Human
accccagccccaaaacucuccu

SEQ ID NO: 2981003 - RNA, 17 nt, Human
accccacacacgccaga

SEQ ID NO: 2981004 - RNA, 15 nt, Human
ucagcaaaagaugcu

SEQ ID NO: 2981005 - RNA, 18 nt, Human
accaguguuguggauuua

SEQ ID NO: 2981006 - RNA, 16 nt, Human
accauaagcuacugcc

SEQ ID NO: 2981007 - RNA, 18 nt, Human
accauaagcuacugccau

SEQ ID NO: 2981008 - RNA, 17 nt, Human
accauaagcuacugcca

SEQ ID NO: 2981009 - RNA, 22 nt, Human
accauaagcuacugccauccug

SEQ ID NO: 2981010 - RNA, 21 nt, Human
ucagauuugaacucuucaauc

SEQ ID NO: 2981011 - RNA, 12 nt, Human
ucagauuugaac

SEQ ID NO: 2981012 - RNA, 15 nt, Human
accccaucaucccuu

SEQ ID NO: 2981013 - RNA, 18 nt, Human
accccaucucuacaaaaa

SEQ ID NO: 2981014 - RNA, 18 nt, Human
ucagcggggacagcuccu

SEQ ID NO: 2981015 - RNA, 23 nt, Human
ucagcggggacagcuccuucugu

SEQ ID NO: 2981016 - RNA, 21 nt, Human
ucagcggggacagcuccuucu

SEQ ID NO: 2981017 - RNA, 20 nt, Human
ucagcggggacagcuccuuc

SEQ ID NO: 2981018 - RNA, 19 nt, Human
ucagcggggacagcuccuu

SEQ ID NO: 2981019 - RNA, 12 nt, Human
ucagcuccagcu

SEQ ID NO: 2981020 - RNA, 18 nt, Human
ucagcuaaagaaguuuga

SEQ ID NO: 2981021 - RNA, 15 nt, Human
ucagcuaaagaaguu

SEQ ID NO: 2981022 - RNA, 23 nt, Human
ucagcuaaagaaguuugaacauu

SEQ ID NO: 2981023 - RNA, 14 nt, Human
acccucucaaacua

SEQ ID NO: 2981024 - RNA, 16 nt, Human
acccgucuccagcugc

SEQ ID NO: 2981025 - RNA, 14 nt, Human
acccgucuccagcu

SEQ ID NO: 2981026 - RNA, 13 nt, Human
acccugaggccca

SEQ ID NO: 2981027 - RNA, 14 nt, Human
acccugaggcccag

SEQ ID NO: 2981028 - RNA, 16 nt, Human
acccugaaagcccuga

SEQ ID NO: 2981029 - RNA, 18 nt, Human
acccugaaagcccugagc

SEQ ID NO: 2981030 - RNA, 20 nt, Human
acccuuguggucccacccca

SEQ ID NO: 2981031 - RNA, 23 nt, Human
acccuuguggucccaccccacac

SEQ ID NO: 2981032 - RNA, 17 nt, Human
acccuugccgucuaccu

SEQ ID NO: 2981033 - RNA, 15 nt, Human
accgaaaacguggcu

SEQ ID NO: 2981034 - RNA, 15 nt, Human
acccugaggcccaga

SEQ ID NO: 2981035 - RNA, 16 nt, Human
acccugaggcccagag

SEQ ID NO: 2981036 - RNA, 15 nt, Human
acccugcccuguggg

SEQ ID NO: 2981037 - RNA, 14 nt, Human
acccugcccugugg

SEQ ID NO: 2981038 - RNA, 17 nt, Human
acccugcccugugggcc

SEQ ID NO: 2981039 - RNA, 22 nt, Human
acccugcccugugggcccccaa

SEQ ID NO: 2981040 - RNA, 12 nt, Human
acccgggaaggg

SEQ ID NO: 2981041 - RNA, 13 nt, Human
acccgggaagggg

SEQ ID NO: 2981042 - RNA, 17 nt, Human
acccgggaggcagaggu

SEQ ID NO: 2981043 - RNA, 15 nt, Human
acccgggaggcagag

SEQ ID NO: 2981044 - RNA, 20 nt, Human
acccggccccugcugguuca

SEQ ID NO: 2981045 - RNA, 17 nt, Human
acccggccccugcuggu

SEQ ID NO: 2981046 - RNA, 22 nt, Human
acccggccccugcugguucagg

SEQ ID NO: 2981047 - RNA, 16 nt, Human
acccggccccugcugg

SEQ ID NO: 2981048 - RNA, 15 nt, Human
acccggccccugcug

SEQ ID NO: 2981049 - RNA, 14 nt, Human
acccggccccugcu

SEQ ID NO: 2981050 - RNA, 22 nt, Human
ucagguaacaggcagauacagg

SEQ ID NO: 2981051 - RNA, 21 nt, Human
ucagguaacaggcagauacag

SEQ ID NO: 2981052 - RNA, 23 nt, Human
ucagguaacaggcagauacagga

SEQ ID NO: 2981053 - RNA, 22 nt, Human
ucagcuuguaaauagcucaggu

SEQ ID NO: 2981054 - RNA, 21 nt, Human
ucagcuuguaaauagcucagg

SEQ ID NO: 2981055 - RNA, 14 nt, Human
ucagcuccagcuca

SEQ ID NO: 2981056 - RNA, 21 nt, Human
ucaggccaggcccucugccca

SEQ ID NO: 2981057 - RNA, 22 nt, Human
ucaggccaggcccucugcccac

SEQ ID NO: 2981058 - RNA, 20 nt, Human
ucaggccaggcccucugccc

SEQ ID NO: 2981059 - RNA, 23 nt, Human
ucaggccaggcccucugcccacu

SEQ ID NO: 2981060 - RNA, 19 nt, Human
ucagggucccugguggcag

SEQ ID NO: 2981061 - RNA, 16 nt, Human
ucaggguuggccccug

SEQ ID NO: 2981062 - RNA, 15 nt, Human
ucauauggauaaaua

SEQ ID NO: 2981063 - RNA, 23 nt, Human
ucauauuuacuucuuauacauuu

SEQ ID NO: 2981064 - RNA, 15 nt, Human
ucauauuuacuucuu

SEQ ID NO: 2981065 - RNA, 15 nt, Human
ucauauuuucaugcu

SEQ ID NO: 2981066 - RNA, 20 nt, Human
accgagggggcugcucccac

SEQ ID NO: 2981067 - RNA, 19 nt, Human
accgagggggcugcuccca

SEQ ID NO: 2981068 - RNA, 21 nt, Human
ucauaguaugguggcuggguu

SEQ ID NO: 2981069 - RNA, 18 nt, Human
ucauauaagauucauauu

SEQ ID NO: 2981070 - RNA, 14 nt, Human
ucauaaccuagccu

SEQ ID NO: 2981071 - RNA, 19 nt, Human
ucauaguaugguggcuggg

SEQ ID NO: 2981072 - RNA, 18 nt, Human
ucauaguaugguggcugg

SEQ ID NO: 2981073 - RNA, 15 nt, Human
ucauaguaugguggc

SEQ ID NO: 2981074 - RNA, 17 nt, Human
ucaguuuuugugaaaag

SEQ ID NO: 2981075 - RNA, 15 nt, Human
ucaguuuuugugaaa

SEQ ID NO: 2981076 - RNA, 16 nt, Human
ucagugccuuauggaa

SEQ ID NO: 2981077 - RNA, 11 nt, Human
ucaguggcagc

SEQ ID NO: 2981078 - RNA, 12 nt, Human
ucaguggcagcu

SEQ ID NO: 2981079 - RNA, 16 nt, Human
ucagugccaaaaacaa

SEQ ID NO: 2981080 - RNA, 12 nt, Human
ucagugccacua

SEQ ID NO: 2981081 - RNA, 17 nt, Human
accgaaaacguggcugc

SEQ ID NO: 2981082 - RNA, 19 nt, Human
accgaaaacguggcugcuu

SEQ ID NO: 2981083 - RNA, 11 nt, Human
ucagugccuua

SEQ ID NO: 2981084 - RNA, 12 nt, Human
ucagugccuuau

SEQ ID NO: 2981085 - RNA, 14 nt, Human
ucagugccuuaugg

SEQ ID NO: 2981086 - RNA, 15 nt, Human
ucagugccuuaugga

SEQ ID NO: 2981087 - RNA, 9 nt, Human
ucagugccu

SEQ ID NO: 2981088 - RNA, 10 nt, Human
ucagugccuu

SEQ ID NO: 2981089 - RNA, 20 nt, Human
accucccacaaaggagagcu

SEQ ID NO: 2981090 - RNA, 12 nt, Human
accgcagacagg

SEQ ID NO: 2981091 - RNA, 16 nt, Human
accgcagacaggacca

SEQ ID NO: 2981092 - RNA, 17 nt, Human
ucaugaaagauucaaug

SEQ ID NO: 2981093 - RNA, 16 nt, Human
ucaugaaagauucaau

SEQ ID NO: 2981094 - RNA, 15 nt, Human
ucaugaaagauucaa

SEQ ID NO: 2981095 - RNA, 17 nt, Human
ucauguuuaugagaaac

SEQ ID NO: 2981096 - RNA, 19 nt, Human
ucaaucuggauucauauuu

SEQ ID NO: 2981097 - RNA, 15 nt, Human
ucaauauuucagaua

SEQ ID NO: 2981098 - RNA, 19 nt, Human
ucaauauuucagauaauca

SEQ ID NO: 2981099 - RNA, 23 nt, Human
ucaaugaaugaaugaauggcuaa

SEQ ID NO: 2981100 - RNA, 23 nt, Human
acauugaaaucuaggaaaauuau

SEQ ID NO: 2981101 - RNA, 20 nt, Human
acauugaaaucuaggaaaau

SEQ ID NO: 2981102 - RNA, 19 nt, Human
acauugaaaucuaggaaaa

SEQ ID NO: 2981103 - RNA, 17 nt, Human
acauugaaaucuaggaa

SEQ ID NO: 2981104 - RNA, 13 nt, Human
acauugaaaucua

SEQ ID NO: 2981105 - RNA, 22 nt, Human
ucaauaucuuuuuuuuaauaaa

SEQ ID NO: 2981106 - RNA, 22 nt, Human
ucaaguccucuuuucugagagg

SEQ ID NO: 2981107 - RNA, 14 nt, Human
acauugacuauuuu

SEQ ID NO: 2981108 - RNA, 17 nt, Human
acauugacuauuuuugu

SEQ ID NO: 2981109 - RNA, 20 nt, Human
acauuuuauuuuauuaugca

SEQ ID NO: 2981110 - RNA, 19 nt, Human
acauuuuauuuuauuaugc

SEQ ID NO: 2981111 - RNA, 14 nt, Human
acauuuuauuuuau

SEQ ID NO: 2981112 - RNA, 18 nt, Human
acauuuuauuuuauuaug

SEQ ID NO: 2981113 - RNA, 19 nt, Human
acauuuuuaagugcugcau

SEQ ID NO: 2981114 - RNA, 23 nt, Human
acauuuuuaagugcugcauuuaa

SEQ ID NO: 2981115 - RNA, 22 nt, Human
acauuuuuaagugcugcauuua

SEQ ID NO: 2981116 - RNA, 21 nt, Human
acauuuuuaagugcugcauuu

SEQ ID NO: 2981117 - RNA, 16 nt, Human
acauuuuuuaaaugca

SEQ ID NO: 2981118 - RNA, 14 nt, Human
acauuuuuuaaaug

SEQ ID NO: 2981119 - RNA, 17 nt, Human
acauuuuuuaaaugcac

SEQ ID NO: 2981120 - RNA, 23 nt, Human
accaaaaaucucaauauuucaga

SEQ ID NO: 2981121 - RNA, 11 nt, Human
acauucccugc

SEQ ID NO: 2981122 - RNA, 15 nt, Human
acauguccaagaagc

SEQ ID NO: 2981123 - RNA, 23 nt, Human
acauguaauuaaguacuauguau

SEQ ID NO: 2981124 - RNA, 18 nt, Human
ucaaauugugugaaaggu

SEQ ID NO: 2981125 - RNA, 15 nt, Human
ucaaauugugugaaa

SEQ ID NO: 2981126 - RNA, 14 nt, Human
acauuccugaugcu

SEQ ID NO: 2981127 - RNA, 15 nt, Human
acauuccugaacagg

SEQ ID NO: 2981128 - RNA, 14 nt, Human
acauuccugaacag

SEQ ID NO: 2981129 - RNA, 17 nt, Human
ucaacauuucucauguu

SEQ ID NO: 2981130 - RNA, 13 nt, Human
ucaaauuucuaaa

SEQ ID NO: 2981131 - RNA, 14 nt, Human
ucaaccagcagaug

SEQ ID NO: 2981132 - RNA, 20 nt, Human
ucaacugcaucaagauguga

SEQ ID NO: 2981133 - RNA, 21 nt, Human
acaugcuguacauacuuuuug

SEQ ID NO: 2981134 - RNA, 20 nt, Human
acaugcuguacauacuuuuu

SEQ ID NO: 2981135 - RNA, 21 nt, Human
acaugcuacacacugcauguu

SEQ ID NO: 2981136 - RNA, 15 nt, Human
acaugcuacacacug

SEQ ID NO: 2981137 - RNA, 23 nt, Human
acaugagguacugagagugaaca

SEQ ID NO: 2981138 - RNA, 20 nt, Human
acaugagguacugagaguga

SEQ ID NO: 2981139 - RNA, 16 nt, Human
acaugagguacugaga

SEQ ID NO: 2981140 - RNA, 16 nt, Human
acaugaaguccaagca

SEQ ID NO: 2981141 - RNA, 20 nt, Human
acaugggacauuugcucaug

SEQ ID NO: 2981142 - RNA, 15 nt, Human
acaugggacauuugc

SEQ ID NO: 2981143 - RNA, 21 nt, Human
acaugggacauuugcucaugg

SEQ ID NO: 2981144 - RNA, 14 nt, Human
acaugggacauuug

SEQ ID NO: 2981145 - RNA, 11 nt, Human
acaugggacau

SEQ ID NO: 2981146 - RNA, 22 nt, Human
acauggcuggagcuagaauuug

SEQ ID NO: 2981147 - RNA, 22 nt, Human
acauguaauuaaguacuaugua

SEQ ID NO: 2981148 - RNA, 21 nt, Human
acauguaauuaaguacuaugu

SEQ ID NO: 2981149 - RNA, 19 nt, Human
acauguaauuaaguacuau

SEQ ID NO: 2981150 - RNA, 17 nt, Human
acauguaauuaaguacu

SEQ ID NO: 2981151 - RNA, 15 nt, Human
acauguaauuaagua

SEQ ID NO: 2981152 - RNA, 16 nt, Human
ucacacugucuucuga

SEQ ID NO: 2981153 - RNA, 20 nt, Human
ucacagaugggugcuuggag

SEQ ID NO: 2981154 - RNA, 16 nt, Human
ucacaguucucuccuu

SEQ ID NO: 2981155 - RNA, 20 nt, Human
ucacaguucucuccuucuuc

SEQ ID NO: 2981156 - RNA, 13 nt, Human
ucacagccucuga

SEQ ID NO: 2981157 - RNA, 12 nt, Human
ucaauugugaaa

SEQ ID NO: 2981158 - RNA, 16 nt, Human
ucaauucuugccaaau

SEQ ID NO: 2981159 - RNA, 17 nt, Human
ucacaaaggaugcccaa

SEQ ID NO: 2981160 - RNA, 21 nt, Human
ucacaacagauuauuaccuua

SEQ ID NO: 2981161 - RNA, 16 nt, Human
ucaauuuuaaacauau

SEQ ID NO: 2981162 - RNA, 15 nt, Human
ucaauuuuaaacaua

SEQ ID NO: 2981163 - RNA, 14 nt, Human
ucaauuuuaaacau

SEQ ID NO: 2981164 - RNA, 13 nt, Human
ucaauuuuaaaca

SEQ ID NO: 2981165 - RNA, 20 nt, Human
accaccacacccagcccacu

SEQ ID NO: 2981166 - RNA, 15 nt, Human
accaccacacccagc

SEQ ID NO: 2981167 - RNA, 16 nt, Human
accacaucuugcucug

SEQ ID NO: 2981168 - RNA, 18 nt, Human
accacaugugcacaugca

SEQ ID NO: 2981169 - RNA, 19 nt, Human
accacaucuugcucugcug

SEQ ID NO: 2981170 - RNA, 18 nt, Human
accacaucuugcucugcu

SEQ ID NO: 2981171 - RNA, 17 nt, Human
accacaucuugcucugc

SEQ ID NO: 2981172 - RNA, 13 nt, Human
ucaccucauggaa

SEQ ID NO: 2981173 - RNA, 12 nt, Human
ucaccucaugga

SEQ ID NO: 2981174 - RNA, 14 nt, Human
ucaccucauggaau

SEQ ID NO: 2981175 - RNA, 15 nt, Human
accacuacauucugu

SEQ ID NO: 2981176 - RNA, 16 nt, Human
accacuacauucuguu

SEQ ID NO: 2981177 - RNA, 17 nt, Human
accacuacauucuguua

SEQ ID NO: 2981178 - RNA, 22 nt, Human
accagcgugugacuacuccccc

SEQ ID NO: 2981179 - RNA, 17 nt, Human
ucacugagacagcccgg

SEQ ID NO: 2981180 - RNA, 21 nt, Human
ucacugagacagcccgggcuc

SEQ ID NO: 2981181 - RNA, 22 nt, Human
ucacugagacagcccgggcucu

SEQ ID NO: 2981182 - RNA, 14 nt, Human
ucacugcagccuca

SEQ ID NO: 2981183 - RNA, 16 nt, Human
ucacugagacagcccg

SEQ ID NO: 2981184 - RNA, 13 nt, Human
ucacugcagccuc

SEQ ID NO: 2981185 - RNA, 15 nt, Human
ucacugcagccucaa

SEQ ID NO: 2981186 - RNA, 19 nt, Human
ucacuguugcccaggcugg

SEQ ID NO: 2981187 - RNA, 23 nt, Human
ucacuguugcccaggcuggcgug

SEQ ID NO: 2981188 - RNA, 14 nt, Human
accagucugacugu

SEQ ID NO: 2981189 - RNA, 17 nt, Human
accaguguuguggauuu

SEQ ID NO: 2981190 - RNA, 15 nt, Human
accaguguuguggau

SEQ ID NO: 2981191 - RNA, 10 nt, Human
ucacuugagu

SEQ ID NO: 2981192 - RNA, 23 nt, Human
ucacuugaacccgggaggcagag

SEQ ID NO: 2981193 - RNA, 16 nt, Human
aaucuggauucauauu

SEQ ID NO: 2981194 - RNA, 17 nt, Human
aaucuggauucauauuu

SEQ ID NO: 2981195 - RNA, 19 nt, Human
aaucuacacuccagugaga

SEQ ID NO: 2981196 - RNA, 18 nt, Human
aaucuggauucauauuua

SEQ ID NO: 2981197 - RNA, 19 nt, Human
aaucuggauucauauuuaa

SEQ ID NO: 2981198 - RNA, 19 nt, Human
aaucuuauaauuuaaaaua

SEQ ID NO: 2981199 - RNA, 23 nt, Human
aaucgcuccaccuugcagcucuc

SEQ ID NO: 2981200 - RNA, 23 nt, Human
aaucauuaggugugacugaauuu

SEQ ID NO: 2981201 - RNA, 17 nt, Human
aaucauuaggugugacu

SEQ ID NO: 2981202 - RNA, 15 nt, Human
aaucauuagguguga

SEQ ID NO: 2981203 - RNA, 12 nt, Human
uaauaaacucau

SEQ ID NO: 2981204 - RNA, 15 nt, Human
aaucaugaauuaguu

SEQ ID NO: 2981205 - RNA, 12 nt, Human
aaucaugaauua

SEQ ID NO: 2981206 - RNA, 19 nt, Human
uaaguaaugauaacuggaa

SEQ ID NO: 2981207 - RNA, 19 nt, Human
uaaguaaaaccacagcagu

SEQ ID NO: 2981208 - RNA, 16 nt, Human
uaagcuuguauuccuu

SEQ ID NO: 2981209 - RNA, 16 nt, Human
uaaguacuauguauca

SEQ ID NO: 2981210 - RNA, 13 nt, Human
uaaguacuaugua

SEQ ID NO: 2981211 - RNA, 17 nt, Human
uaaguacuauguaucaa

SEQ ID NO: 2981212 - RNA, 20 nt, Human
uaaguauucuuauuuaauga

SEQ ID NO: 2981213 - RNA, 19 nt, Human
uaaguauucuuauuuaaug

SEQ ID NO: 2981214 - RNA, 11 nt, Human
uaaucuuuuau

SEQ ID NO: 2981215 - RNA, 13 nt, Human
uaaucuuucacag

SEQ ID NO: 2981216 - RNA, 17 nt, Human
uaaugaaugaaacauuu

SEQ ID NO: 2981217 - RNA, 16 nt, Human
uaaugaaaacaaugca

SEQ ID NO: 2981218 - RNA, 13 nt, Human
uaaugaaaacaau

SEQ ID NO: 2981219 - RNA, 16 nt, Human
uaauagacaauuuauu

SEQ ID NO: 2981220 - RNA, 14 nt, Human
uaauagacaauuua

SEQ ID NO: 2981221 - RNA, 19 nt, Human
uaauacaccacuacauucu

SEQ ID NO: 2981222 - RNA, 18 nt, Human
uaauacaccacuacauuc

SEQ ID NO: 2981223 - RNA, 14 nt, Human
uaauacaccacuac

SEQ ID NO: 2981224 - RNA, 16 nt, Human
uaauacaccacuacau

SEQ ID NO: 2981225 - RNA, 16 nt, Human
aaucuuauaauuuaaa

SEQ ID NO: 2981226 - RNA, 22 nt, Human
uaauagacaauuuauuauggca

SEQ ID NO: 2981227 - RNA, 18 nt, Human
uaauagacaauuuauuau

SEQ ID NO: 2981228 - RNA, 17 nt, Human
uaaugucaguauuucaa

SEQ ID NO: 2981229 - RNA, 18 nt, Human
uaaugucacaggcagguc

SEQ ID NO: 2981230 - RNA, 13 nt, Human
uaauguacugcau

SEQ ID NO: 2981231 - RNA, 22 nt, Human
aaugaauggcuaagcaaaaugu

SEQ ID NO: 2981232 - RNA, 13 nt, Human
aaugaaugucagu

SEQ ID NO: 2981233 - RNA, 13 nt, Human
aaugaaugucacu

SEQ ID NO: 2981234 - RNA, 22 nt, Human
aaugaaugucagugugacugau

SEQ ID NO: 2981235 - RNA, 15 nt, Human
aaugaccuuucaaua

SEQ ID NO: 2981236 - RNA, 17 nt, Human
aaugaaagacuguacaa

SEQ ID NO: 2981237 - RNA, 16 nt, Human
aaugaaagacuguaca

SEQ ID NO: 2981238 - RNA, 17 nt, Human
aaugaaaccugugucuc

SEQ ID NO: 2981239 - RNA, 17 nt, Human
aaugaaacauuuuguca

SEQ ID NO: 2981240 - RNA, 13 nt, Human
aauauuuaaucuu

SEQ ID NO: 2981241 - RNA, 18 nt, Human
aauauuuauuuuaauaau

SEQ ID NO: 2981242 - RNA, 19 nt, Human
aauauuuauuuuaauaaug

SEQ ID NO: 2981243 - RNA, 15 nt, Human
aauauuuauuuuaau

SEQ ID NO: 2981244 - RNA, 24 nt, Human
aauaugccccauucaacaucuagu

SEQ ID NO: 2981245 - RNA, 21 nt, Human
aauaugccccauucaacaucu

SEQ ID NO: 2981246 - RNA, 15 nt, Human
uaagagaaaugagcu

SEQ ID NO: 2981247 - RNA, 21 nt, Human
uaagacuuaguacuaucugug

SEQ ID NO: 2981248 - RNA, 17 nt, Human
aauaugcacacauuuuu

SEQ ID NO: 2981249 - RNA, 16 nt, Human
aauaugcacacauuuu

SEQ ID NO: 2981250 - RNA, 22 nt, Human
aauaugcacacauuuuuuaaau

SEQ ID NO: 2981251 - RNA, 22 nt, Human
aaucaggguuaguauuguccag

SEQ ID NO: 2981252 - RNA, 21 nt, Human
aaucaggguuaguauugucca

SEQ ID NO: 2981253 - RNA, 16 nt, Human
aaucaggguuaguauu

SEQ ID NO: 2981254 - RNA, 22 nt, Human
uaagcuguuacugucuucagua

SEQ ID NO: 2981255 - RNA, 18 nt, Human
uaagcacacuugacauca

SEQ ID NO: 2981256 - RNA, 21 nt, Human
uaagcaaaaugugauauguac

SEQ ID NO: 2981257 - RNA, 20 nt, Human
aauaucacuugucaauaaaa

SEQ ID NO: 2981258 - RNA, 22 nt, Human
aauaucacuugucaauaaaauc

SEQ ID NO: 2981259 - RNA, 23 nt, Human
uaacauggacaugaucuucuuua

SEQ ID NO: 2981260 - RNA, 18 nt, Human
uaacauggacaugaucuu

SEQ ID NO: 2981261 - RNA, 16 nt, Human
uaacauggaaguacua

SEQ ID NO: 2981262 - RNA, 16 nt, Human
aauagucaaauugugu

SEQ ID NO: 2981263 - RNA, 16 nt, Human
aauaguggugugauuu

SEQ ID NO: 2981264 - RNA, 22 nt, Human
aauaguggugugauuuggggau

SEQ ID NO: 2981265 - RNA, 13 nt, Human
aauaguuggcuag

SEQ ID NO: 2981266 - RNA, 21 nt, Human
aauaguucagguaacaggcag

SEQ ID NO: 2981267 - RNA, 18 nt, Human
uaagaagugaaaaucuac

SEQ ID NO: 2981268 - RNA, 13 nt, Human
uaagacagagacc

SEQ ID NO: 2981269 - RNA, 16 nt, Human
uaacuuucugaaauaa

SEQ ID NO: 2981270 - RNA, 20 nt, Human
uaacgauaaaagacagugaa

SEQ ID NO: 2981271 - RNA, 17 nt, Human
uaacuuccaauuuacau

SEQ ID NO: 2981272 - RNA, 14 nt, Human
uaacuucaccauau

SEQ ID NO: 2981273 - RNA, 21 nt, Human
uaacuucacauauugauuucc

SEQ ID NO: 2981274 - RNA, 13 nt, Human
uaacuucacauau

SEQ ID NO: 2981275 - RNA, 21 nt, Human
aauuaaugucaguauuucaac

SEQ ID NO: 2981276 - RNA, 13 nt, Human
uacauucuguuaa

SEQ ID NO: 2981277 - RNA, 18 nt, Human
uaccaccagucugacugu

SEQ ID NO: 2981278 - RNA, 16 nt, Human
uacauguguguauaug

SEQ ID NO: 2981279 - RNA, 20 nt, Human
uacauguguguauauguaga

SEQ ID NO: 2981280 - RNA, 11 nt, Human
aauuaacuuuu

SEQ ID NO: 2981281 - RNA, 21 nt, Human
aauguucucucuucuccaccu

SEQ ID NO: 2981282 - RNA, 22 nt, Human
aauguauuacaguggggaauga

SEQ ID NO: 2981283 - RNA, 17 nt, Human
aaugugaaaagaaaaau

SEQ ID NO: 2981284 - RNA, 20 nt, Human
aauguauguguaaguauucu

SEQ ID NO: 2981285 - RNA, 19 nt, Human
aauguauguguaaguauuc

SEQ ID NO: 2981286 - RNA, 19 nt, Human
aaugugaaaagaaaaauga

SEQ ID NO: 2981287 - RNA, 14 nt, Human
aaugugaaacugga

SEQ ID NO: 2981288 - RNA, 15 nt, Human
aaugugaaacuggau

SEQ ID NO: 2981289 - RNA, 20 nt, Human
uacaucccuuaccugggaaa

SEQ ID NO: 2981290 - RNA, 23 nt, Human
uacauaaugcgugcauaccacuu

SEQ ID NO: 2981291 - RNA, 21 nt, Human
uacauaaugcgugcauaccac

SEQ ID NO: 2981292 - RNA, 24 nt, Human
uacauaaugcgugcauaccacuuu

SEQ ID NO: 2981293 - RNA, 16 nt, Human
uacaggugugagucac

SEQ ID NO: 2981294 - RNA, 16 nt, Human
aaugcuguauuuuaaa

SEQ ID NO: 2981295 - RNA, 11 nt, Human
aaugcccagcc

SEQ ID NO: 2981296 - RNA, 12 nt, Human
aaugcccagccc

SEQ ID NO: 2981297 - RNA, 20 nt, Human
aauggaaaugggcagagcag

SEQ ID NO: 2981298 - RNA, 21 nt, Human
aauggaaaugggcagagcaga

SEQ ID NO: 2981299 - RNA, 23 nt, Human
aauggacguguuaugacuccaga

SEQ ID NO: 2981300 - RNA, 20 nt, Human
aauggacuaacuugucuuug

SEQ ID NO: 2981301 - RNA, 14 nt, Human
aauggaaccacucu

SEQ ID NO: 2981302 - RNA, 21 nt, Human
aauggacguguuaugacucca

SEQ ID NO: 2981303 - RNA, 22 nt, Human
aaugcacuuuguucuggcucuu

SEQ ID NO: 2981304 - RNA, 21 nt, Human
uacaaugcugugcccuaaagu

SEQ ID NO: 2981305 - RNA, 18 nt, Human
aaugaccuuucaauagga

SEQ ID NO: 2981306 - RNA, 16 nt, Human
aaugaccuuucaauag

SEQ ID NO: 2981307 - RNA, 17 nt, Human
aaugaccuuucaauagg

SEQ ID NO: 2981308 - RNA, 21 nt, Human
aaugcacuuuguucuggcucu

SEQ ID NO: 2981309 - RNA, 15 nt, Human
uacacuaaaagguga

SEQ ID NO: 2981310 - RNA, 23 nt, Human
uacacauuuuauuuuauuaugca

SEQ ID NO: 2981311 - RNA, 14 nt, Human
uacacuaagagaga

SEQ ID NO: 2981312 - RNA, 22 nt, Human
uacacauuuuauuuuauuaugc

SEQ ID NO: 2981313 - RNA, 21 nt, Human
uacacauuuuauuuuauuaug

SEQ ID NO: 2981314 - RNA, 19 nt, Human
uacacauuuuauuuuauua

SEQ ID NO: 2981315 - RNA, 22 nt, Human
uacagacaacaaaccuguuucu

SEQ ID NO: 2981316 - RNA, 19 nt, Human
uacagacaaagcguggugg

SEQ ID NO: 2981317 - RNA, 20 nt, Human
uacagaguggaauaagacag

SEQ ID NO: 2981318 - RNA, 22 nt, Human
uacagaguggaauaagacagag

SEQ ID NO: 2981319 - RNA, 18 nt, Human
uacagaggccaugggccu

SEQ ID NO: 2981320 - RNA, 16 nt, Human
aauggcagccuuggca

SEQ ID NO: 2981321 - RNA, 12 nt, Human
aauggcagccuu

SEQ ID NO: 2981322 - RNA, 17 nt, Human
aauuauugauguuuuca

SEQ ID NO: 2981323 - RNA, 23 nt, Human
aauuauucuauaauuuccauuua

SEQ ID NO: 2981324 - RNA, 20 nt, Human
aauuauucuauaauuuccau

SEQ ID NO: 2981325 - RNA, 14 nt, Human
aauuagguugaaac

SEQ ID NO: 2981326 - RNA, 18 nt, Human
aauuagguugaaacauau

SEQ ID NO: 2981327 - RNA, 17 nt, Human
aauuagguugaaacaua

SEQ ID NO: 2981328 - RNA, 15 nt, Human
aauuagguugaaaca

SEQ ID NO: 2981329 - RNA, 22 nt, Human
aauuagguugaaacauaucucu

SEQ ID NO: 2981330 - RNA, 22 nt, Human
aauuccacuuauaggaauugac

SEQ ID NO: 2981331 - RNA, 14 nt, Human
aauuccccacccug

SEQ ID NO: 2981332 - RNA, 12 nt, Human
aauuccccagau

SEQ ID NO: 2981333 - RNA, 18 nt, Human
aauuccaagugauugaaa

SEQ ID NO: 2981334 - RNA, 17 nt, Human
aauucacaaaguaauuu

SEQ ID NO: 2981335 - RNA, 13 nt, Human
aauucacaaagua

SEQ ID NO: 2981336 - RNA, 15 nt, Human
aauuagccaagugug

SEQ ID NO: 2981337 - RNA, 11 nt, Human
aauuacaggaa

SEQ ID NO: 2981338 - RNA, 13 nt, Human
uaccugucccccu

SEQ ID NO: 2981339 - RNA, 14 nt, Human
uaccugucccccug

SEQ ID NO: 2981340 - RNA, 16 nt, Human
uaccugucccccugac

SEQ ID NO: 2981341 - RNA, 17 nt, Human
uaccugucccccugaca

SEQ ID NO: 2981342 - RNA, 10 nt, Human
uaccuguccc

SEQ ID NO: 2981343 - RNA, 18 nt, Human
uaccugccaggaagccag

SEQ ID NO: 2981344 - RNA, 20 nt, Human
uaccugccaggaagccagca

SEQ ID NO: 2981345 - RNA, 23 nt, Human
uaccugccaggaagccagcaggc

SEQ ID NO: 2981346 - RNA, 20 nt, Human
uacucugccacuuuauuucu

SEQ ID NO: 2981347 - RNA, 16 nt, Human
uacuggagaaaaugga

SEQ ID NO: 2981348 - RNA, 12 nt, Human
uacucuguguca

SEQ ID NO: 2981349 - RNA, 18 nt, Human
uacuguaauuugugauac

SEQ ID NO: 2981350 - RNA, 20 nt, Human
uacuguaauuugugauacaa

SEQ ID NO: 2981351 - RNA, 19 nt, Human
uacuguaauuugugauaca

SEQ ID NO: 2981352 - RNA, 14 nt, Human
uacuguaagaaaau

SEQ ID NO: 2981353 - RNA, 13 nt, Human
uacuguaagaaaa

SEQ ID NO: 2981354 - RNA, 21 nt, Human
aauugacccacaagaaaugaa

SEQ ID NO: 2981355 - RNA, 22 nt, Human
aauugacccacaagaaaugaaa

SEQ ID NO: 2981356 - RNA, 21 nt, Human
uacuguacaugaaaacacauu

SEQ ID NO: 2981357 - RNA, 22 nt, Human
uacuguacaugaaaacacauuu

SEQ ID NO: 2981358 - RNA, 18 nt, Human
uacuguacaugaaaacac

SEQ ID NO: 2981359 - RNA, 15 nt, Human
aauuccuaaaauuau

SEQ ID NO: 2981360 - RNA, 22 nt, Human
uacgccaggggaaaaucagccu

SEQ ID NO: 2981361 - RNA, 16 nt, Human
uacguugugcauuugg

SEQ ID NO: 2981362 - RNA, 15 nt, Human
uacguugugcauuug

SEQ ID NO: 2981363 - RNA, 13 nt, Human
uacguacacauuu

SEQ ID NO: 2981364 - RNA, 12 nt, Human
uacguacacauu

SEQ ID NO: 2981365 - RNA, 18 nt, Human
uacgggaggguaaggcug

SEQ ID NO: 2981366 - RNA, 23 nt, Human
uacucuccuggaaauauuaagaa

SEQ ID NO: 2981367 - RNA, 22 nt, Human
uacucuccuggaaauauuaaga

SEQ ID NO: 2981368 - RNA, 14 nt, Human
uacuauguaucaau

SEQ ID NO: 2981369 - RNA, 13 nt, Human
uacuauguaucaa

SEQ ID NO: 2981370 - RNA, 12 nt, Human
uacuauguauca

SEQ ID NO: 2981371 - RNA, 23 nt, Human
uacuauggcccuggccuagcaua

SEQ ID NO: 2981372 - RNA, 17 nt, Human
uacuacuccuguaggaa

SEQ ID NO: 2981373 - RNA, 13 nt, Human
uacuacuccugua

SEQ ID NO: 2981374 - RNA, 23 nt, Human
uauguuuuuguucaguuuaucug

SEQ ID NO: 2981375 - RNA, 16 nt, Human
uauuaaaacucauuuu

SEQ ID NO: 2981376 - RNA, 21 nt, Human
uauguuuucaggcuagaugua

SEQ ID NO: 2981377 - RNA, 16 nt, Human
uauguguaauaaauau

SEQ ID NO: 2981378 - RNA, 13 nt, Human
uauguguaauaaa

SEQ ID NO: 2981379 - RNA, 22 nt, Human
uaugugaacaguuguguuugaa

SEQ ID NO: 2981380 - RNA, 12 nt, Human
uaugugaacagu

SEQ ID NO: 2981381 - RNA, 20 nt, Human
uauguggaguucaucuugaa

SEQ ID NO: 2981382 - RNA, 20 nt, Human
acaggcauguucucugagga

SEQ ID NO: 2981383 - RNA, 19 nt, Human
acaggcauguucucugagg

SEQ ID NO: 2981384 - RNA, 18 nt, Human
acaggcauguucucugag

SEQ ID NO: 2981385 - RNA, 15 nt, Human
acaggcauguucucu

SEQ ID NO: 2981386 - RNA, 22 nt, Human
acaggcauguucucugaggaca

SEQ ID NO: 2981387 - RNA, 23 nt, Human
acaggaccagggauuuccaugau

SEQ ID NO: 2981388 - RNA, 17 nt, Human
acaggacauauauuuuu

SEQ ID NO: 2981389 - RNA, 14 nt, Human
acaggacauauauu

SEQ ID NO: 2981390 - RNA, 13 nt, Human
acaggcaggucca

SEQ ID NO: 2981391 - RNA, 14 nt, Human
acaggaucagucug

SEQ ID NO: 2981392 - RNA, 16 nt, Human
acaggagugagcacua

SEQ ID NO: 2981393 - RNA, 16 nt, Human
acaggcagguccaggg

SEQ ID NO: 2981394 - RNA, 14 nt, Human
acaggcagguccag

SEQ ID NO: 2981395 - RNA, 14 nt, Human
acaggcauguucuc

SEQ ID NO: 2981396 - RNA, 13 nt, Human
acagcuaacaugg

SEQ ID NO: 2981397 - RNA, 22 nt, Human
acaggaaccacaagacugcaca

SEQ ID NO: 2981398 - RNA, 17 nt, Human
acaggaaaagcugcuga

SEQ ID NO: 2981399 - RNA, 16 nt, Human
acaggaaaagcugcug

SEQ ID NO: 2981400 - RNA, 15 nt, Human
acaggaaaagcugcu

SEQ ID NO: 2981401 - RNA, 13 nt, Human
acaggaaguacug

SEQ ID NO: 2981402 - RNA, 17 nt, Human
acaggaaguagaggagg

SEQ ID NO: 2981403 - RNA, 18 nt, Human
uauucaguggcuaacuug

SEQ ID NO: 2981404 - RNA, 20 nt, Human
uauucaguaauaacucuacc

SEQ ID NO: 2981405 - RNA, 14 nt, Human
uauucaggaagcuc

SEQ ID NO: 2981406 - RNA, 14 nt, Human
uauuacuguaagaa

SEQ ID NO: 2981407 - RNA, 14 nt, Human
uauuacuucugcua

SEQ ID NO: 2981408 - RNA, 13 nt, Human
uauuacuucugcu

SEQ ID NO: 2981409 - RNA, 15 nt, Human
uauucaaacagucuc

SEQ ID NO: 2981410 - RNA, 23 nt, Human
uauucaaacagucucaggaaauc

SEQ ID NO: 2981411 - RNA, 14 nt, Human
acaggcuuagugau

SEQ ID NO: 2981412 - RNA, 23 nt, Human
acaggcugggcuucaguggcagc

SEQ ID NO: 2981413 - RNA, 22 nt, Human
acaggcugggcuucaguggcag

SEQ ID NO: 2981414 - RNA, 20 nt, Human
acaggcuuagugauguaauu

SEQ ID NO: 2981415 - RNA, 19 nt, Human
acaggcuuagugauguaau

SEQ ID NO: 2981416 - RNA, 21 nt, Human
acagggaggacgcucucuggc

SEQ ID NO: 2981417 - RNA, 20 nt, Human
acagggaggacgcucucugg

SEQ ID NO: 2981418 - RNA, 18 nt, Human
acagucaccucauggaau

SEQ ID NO: 2981419 - RNA, 17 nt, Human
acagucaccucauggaa

SEQ ID NO: 2981420 - RNA, 16 nt, Human
acagucaccucaugga

SEQ ID NO: 2981421 - RNA, 12 nt, Human
acagggcacacc

SEQ ID NO: 2981422 - RNA, 13 nt, Human
acaguaauaaaug

SEQ ID NO: 2981423 - RNA, 12 nt, Human
acagauugaauu

SEQ ID NO: 2981424 - RNA, 18 nt, Human
acagauugaauuugccua

SEQ ID NO: 2981425 - RNA, 12 nt, Human
acagaugaaaag

SEQ ID NO: 2981426 - RNA, 17 nt, Human
acagcaaggagauuuac

SEQ ID NO: 2981427 - RNA, 18 nt, Human
acagagcccacgccccca

SEQ ID NO: 2981428 - RNA, 19 nt, Human
acagagcccacgcccccac

SEQ ID NO: 2981429 - RNA, 15 nt, Human
acagagcccacgccc

SEQ ID NO: 2981430 - RNA, 14 nt, Human
acagagcccacgcc

SEQ ID NO: 2981431 - RNA, 21 nt, Human
uaugaaauauuauguuaaaac

SEQ ID NO: 2981432 - RNA, 18 nt, Human
acagcccgggcucugccu

SEQ ID NO: 2981433 - RNA, 19 nt, Human
acagcccgggcucugccuc

SEQ ID NO: 2981434 - RNA, 17 nt, Human
acagcccgggcucugcc

SEQ ID NO: 2981435 - RNA, 21 nt, Human
acagcaaggagauuuacaacu

SEQ ID NO: 2981436 - RNA, 16 nt, Human
acagcaaggagauuua

SEQ ID NO: 2981437 - RNA, 16 nt, Human
acagccucuuagaugc

SEQ ID NO: 2981438 - RNA, 13 nt, Human
uauggguuuggcu

SEQ ID NO: 2981439 - RNA, 17 nt, Human
uauggcuuuugugcauu

SEQ ID NO: 2981440 - RNA, 21 nt, Human
uauggcuuuugugcauuaucu

SEQ ID NO: 2981441 - RNA, 18 nt, Human
uauggcuuuugugcauua

SEQ ID NO: 2981442 - RNA, 15 nt, Human
uaugcuuauacacuu

SEQ ID NO: 2981443 - RNA, 15 nt, Human
uaugccccauucaac

SEQ ID NO: 2981444 - RNA, 19 nt, Human
uaugccccauucaacaucu

SEQ ID NO: 2981445 - RNA, 17 nt, Human
uaugccugggcagaagg

SEQ ID NO: 2981446 - RNA, 24 nt, Human
uaugcauuugaaaauuuugauguu

SEQ ID NO: 2981447 - RNA, 23 nt, Human
uaugcauuugaaaauuuugaugu

SEQ ID NO: 2981448 - RNA, 11 nt, Human
uaugcauuuga

SEQ ID NO: 2981449 - RNA, 21 nt, Human
uaugauuaaguaaugauaacu

SEQ ID NO: 2981450 - RNA, 20 nt, Human
uaugauuaaguaaugauaac

SEQ ID NO: 2981451 - RNA, 16 nt, Human
uaugauuaaguaauga

SEQ ID NO: 2981452 - RNA, 22 nt, Human
uauccuaauaaaaaggugacca

SEQ ID NO: 2981453 - RNA, 15 nt, Human
uaucuauauuuuaca

SEQ ID NO: 2981454 - RNA, 19 nt, Human
uauccuaauaaaaagguga

SEQ ID NO: 2981455 - RNA, 15 nt, Human
uauccuaauaaaaag

SEQ ID NO: 2981456 - RNA, 18 nt, Human
uauccuaauaaaaaggug

SEQ ID NO: 2981457 - RNA, 12 nt, Human
uauccuaauaaa

SEQ ID NO: 2981458 - RNA, 18 nt, Human
uaucccuuggacauuuua

SEQ ID NO: 2981459 - RNA, 19 nt, Human
uaucccuuggacauuuuau

SEQ ID NO: 2981460 - RNA, 17 nt, Human
uaucccuuggacauuuu

SEQ ID NO: 2981461 - RNA, 19 nt, Human
uaucaaguauagaaaaucu

SEQ ID NO: 2981462 - RNA, 16 nt, Human
uaucaaguauagaaaa

SEQ ID NO: 2981463 - RNA, 15 nt, Human
uaucaaguauagaaa

SEQ ID NO: 2981464 - RNA, 23 nt, Human
uaucuauauuuuacauaaauuua

SEQ ID NO: 2981465 - RNA, 14 nt, Human
uaucucccccagcc

SEQ ID NO: 2981466 - RNA, 13 nt, Human
uaucucccccagc

SEQ ID NO: 2981467 - RNA, 18 nt, Human
acagagaaaguacuucuc

SEQ ID NO: 2981468 - RNA, 11 nt, Human
acagagaaagu

SEQ ID NO: 2981469 - RNA, 19 nt, Human
uauaauuuugugaagcaaa

SEQ ID NO: 2981470 - RNA, 20 nt, Human
acagaaaauggaagacagcu

SEQ ID NO: 2981471 - RNA, 13 nt, Human
acagaaauguaca

SEQ ID NO: 2981472 - RNA, 17 nt, Human
acagaaaauucuucucc

SEQ ID NO: 2981473 - RNA, 16 nt, Human
acagaaauguacagca

SEQ ID NO: 2981474 - RNA, 14 nt, Human
acagaaauguacag

SEQ ID NO: 2981475 - RNA, 17 nt, Human
acagaaauguacagcaa

SEQ ID NO: 2981476 - RNA, 15 nt, Human
uauauuguuugcuaa

SEQ ID NO: 2981477 - RNA, 13 nt, Human
acagacccugccc

SEQ ID NO: 2981478 - RNA, 14 nt, Human
acagacccugcccu

SEQ ID NO: 2981479 - RNA, 15 nt, Human
acagacccugcccug

SEQ ID NO: 2981480 - RNA, 17 nt, Human
uauaacuuuuuauauuc

SEQ ID NO: 2981481 - RNA, 12 nt, Human
uauaacuuuuua

SEQ ID NO: 2981482 - RNA, 20 nt, Human
uauaacuuuuuauauucuca

SEQ ID NO: 2981483 - RNA, 18 nt, Human
acacucaaaucaagaaac

SEQ ID NO: 2981484 - RNA, 20 nt, Human
acacucacauuuauucugcu

SEQ ID NO: 2981485 - RNA, 19 nt, Human
uauaacuuaaugaaaacaa

SEQ ID NO: 2981486 - RNA, 18 nt, Human
uauaacuuaaugaaaaca

SEQ ID NO: 2981487 - RNA, 14 nt, Human
uauaacuuaaugaa

SEQ ID NO: 2981488 - RNA, 16 nt, Human
uauaacuuaaugaaaa

SEQ ID NO: 2981489 - RNA, 15 nt, Human
acacucaaaagcugg

SEQ ID NO: 2981490 - RNA, 19 nt, Human
acacucaaaucaagaaacu

SEQ ID NO: 2981491 - RNA, 13 nt, Human
acacuaagagaga

SEQ ID NO: 2981492 - RNA, 20 nt, Human
acacuaaccacgcuggaccu

SEQ ID NO: 2981493 - RNA, 19 nt, Human
acacccugugauggggccc

SEQ ID NO: 2981494 - RNA, 16 nt, Human
acaccgggcacucaga

SEQ ID NO: 2981495 - RNA, 19 nt, Human
acaccucugcacaagcugc

SEQ ID NO: 2981496 - RNA, 21 nt, Human
acaccucugcacaagcugcac

SEQ ID NO: 2981497 - RNA, 20 nt, Human
acacauuuuauuuuauuaug

SEQ ID NO: 2981498 - RNA, 19 nt, Human
acacauuuuauuuuauuau

SEQ ID NO: 2981499 - RNA, 14 nt, Human
acacauuuuauuuu

SEQ ID NO: 2981500 - RNA, 13 nt, Human
acacauuuuauuu

SEQ ID NO: 2981501 - RNA, 15 nt, Human
acacaucagcuugcc

SEQ ID NO: 2981502 - RNA, 15 nt, Human
acacaugaaguccaa

SEQ ID NO: 2981503 - RNA, 21 nt, Human
acacaugagcaucaggccagg

SEQ ID NO: 2981504 - RNA, 18 nt, Human
acacaugauccugcaauu

SEQ ID NO: 2981505 - RNA, 22 nt, Human
acaccauaagcuacugccaucc

SEQ ID NO: 2981506 - RNA, 21 nt, Human
acaccauaagcuacugccauc

SEQ ID NO: 2981507 - RNA, 23 nt, Human
acaccauaagcuacugccauccu

SEQ ID NO: 2981508 - RNA, 20 nt, Human
uaguuccaccaucaagccac

SEQ ID NO: 2981509 - RNA, 18 nt, Human
uaguucagguaacaggca

SEQ ID NO: 2981510 - RNA, 22 nt, Human
uagugaaacucguuaauuugua

SEQ ID NO: 2981511 - RNA, 17 nt, Human
uaguguuggagaagaac

SEQ ID NO: 2981512 - RNA, 21 nt, Human
uaguguuuucaauuuuaaaca

SEQ ID NO: 2981513 - RNA, 23 nt, Human
uaguguuuucaauuuuaaacaua

SEQ ID NO: 2981514 - RNA, 22 nt, Human
uaguguuuucaauuuuaaacau

SEQ ID NO: 2981515 - RNA, 23 nt, Human
uaguguuggagaagaacugaaau

SEQ ID NO: 2981516 - RNA, 16 nt, Human
acacaguauuacuucu

SEQ ID NO: 2981517 - RNA, 18 nt, Human
acacaguauuacuucugc

SEQ ID NO: 2981518 - RNA, 17 nt, Human
acacacuguacacauaa

SEQ ID NO: 2981519 - RNA, 20 nt, Human
acacacuguacacauaagcc

SEQ ID NO: 2981520 - RNA, 19 nt, Human
acacaguauuacuucugcu

SEQ ID NO: 2981521 - RNA, 13 nt, Human
acacagugagucg

SEQ ID NO: 2981522 - RNA, 19 nt, Human
acacauaagccaaaacuga

SEQ ID NO: 2981523 - RNA, 15 nt, Human
acacacucaaaucaa

SEQ ID NO: 2981524 - RNA, 21 nt, Human
acacacugcauguuugugauu

SEQ ID NO: 2981525 - RNA, 21 nt, Human
acacacgcgugcacacaccag

SEQ ID NO: 2981526 - RNA, 20 nt, Human
acacaccagagcccaccuug

SEQ ID NO: 2981527 - RNA, 15 nt, Human
acacaccagagccca

SEQ ID NO: 2981528 - RNA, 14 nt, Human
acacaccagagccc

SEQ ID NO: 2981529 - RNA, 14 nt, Human
acacacagcucugu

SEQ ID NO: 2981530 - RNA, 13 nt, Human
acacacagcucug

SEQ ID NO: 2981531 - RNA, 17 nt, Human
acacacagcucuguccu

SEQ ID NO: 2981532 - RNA, 22 nt, Human
acacacacgcgugcacacacca

SEQ ID NO: 2981533 - RNA, 24 nt, Human
acaaugcugugcccuaaaguguau

SEQ ID NO: 2981534 - RNA, 23 nt, Human
acaaugcugugcccuaaagugua

SEQ ID NO: 2981535 - RNA, 22 nt, Human
acaaugcugugcccuaaagugu

SEQ ID NO: 2981536 - RNA, 21 nt, Human
acaaugcugugcccuaaagug

SEQ ID NO: 2981537 - RNA, 22 nt, Human
acaaugcuguauuuuaaaagaa

SEQ ID NO: 2981538 - RNA, 18 nt, Human
acaaugcuguauuuuaaa

SEQ ID NO: 2981539 - RNA, 14 nt, Human
acacacacauacac

SEQ ID NO: 2981540 - RNA, 19 nt, Human
acaaugugaaaagaaaaau

SEQ ID NO: 2981541 - RNA, 17 nt, Human
acaaugugaaaagaaaa

SEQ ID NO: 2981542 - RNA, 12 nt, Human
uaggagcaugag

SEQ ID NO: 2981543 - RNA, 20 nt, Human
uaggagaagucuucuauuua

SEQ ID NO: 2981544 - RNA, 18 nt, Human
uaggaaauauuuauuuua

SEQ ID NO: 2981545 - RNA, 19 nt, Human
uaggaaauauuuauuuuaa

SEQ ID NO: 2981546 - RNA, 14 nt, Human
uagggagagaagau

SEQ ID NO: 2981547 - RNA, 15 nt, Human
uagggagagaagaua

SEQ ID NO: 2981548 - RNA, 21 nt, Human
uagggaaggauacaaaagcau

SEQ ID NO: 2981549 - RNA, 16 nt, Human
uaggcauuugcugaau

SEQ ID NO: 2981550 - RNA, 20 nt, Human
uaggcauuugcugaauacag

SEQ ID NO: 2981551 - RNA, 14 nt, Human
uaggcauuguggga

SEQ ID NO: 2981552 - RNA, 16 nt, Human
uaggcacuuuaaaaca

SEQ ID NO: 2981553 - RNA, 17 nt, Human
uaggcacuuuaaaacac

SEQ ID NO: 2981554 - RNA, 23 nt, Human
acaauacaucccuuaccugggaa

SEQ ID NO: 2981555 - RNA, 14 nt, Human
acaagacugcacau

SEQ ID NO: 2981556 - RNA, 13 nt, Human
acaagacugcaca

SEQ ID NO: 2981557 - RNA, 18 nt, Human
acaagaccacguuucuaa

SEQ ID NO: 2981558 - RNA, 17 nt, Human
uagcuaggugacauaua

SEQ ID NO: 2981559 - RNA, 15 nt, Human
uagcuaggugacaua

SEQ ID NO: 2981560 - RNA, 18 nt, Human
acaaugacuuacuguaca

SEQ ID NO: 2981561 - RNA, 17 nt, Human
acaaugacuuacuguac

SEQ ID NO: 2981562 - RNA, 12 nt, Human
acaaugacuuac

SEQ ID NO: 2981563 - RNA, 18 nt, Human
uagcauguccuaaugcuu

SEQ ID NO: 2981564 - RNA, 19 nt, Human
uagcauuuguguugaagag

SEQ ID NO: 2981565 - RNA, 23 nt, Human
uagcauuuuaaacaaaauagaaa

SEQ ID NO: 2981566 - RNA, 18 nt, Human
uagcauuuuaaacaaaau

SEQ ID NO: 2981567 - RNA, 16 nt, Human
uagcauuuuaaacaaa

SEQ ID NO: 2981568 - RNA, 15 nt, Human
uagcauuuuaaacaa

SEQ ID NO: 2981569 - RNA, 14 nt, Human
uagcauuuuaaaca

SEQ ID NO: 2981570 - RNA, 16 nt, Human
uagcauuuugcuaaau

SEQ ID NO: 2981571 - RNA, 21 nt, Human
uagccaaggccaaaggaagca

SEQ ID NO: 2981572 - RNA, 22 nt, Human
uagcauuuugcuaaaugugaau

SEQ ID NO: 2981573 - RNA, 14 nt, Human
uagccaaggccaaa

SEQ ID NO: 2981574 - RNA, 15 nt, Human
uagaugcaguucuga

SEQ ID NO: 2981575 - RNA, 19 nt, Human
uagcauggcugccaauggg

SEQ ID NO: 2981576 - RNA, 19 nt, Human
acaaauuuacagagacaga

SEQ ID NO: 2981577 - RNA, 18 nt, Human
acaaauuuacagagacag

SEQ ID NO: 2981578 - RNA, 11 nt, Human
uagccagagga

SEQ ID NO: 2981579 - RNA, 15 nt, Human
uagccagaggagaga

SEQ ID NO: 2981580 - RNA, 23 nt, Human
acaacacucauugaccugaggcc

SEQ ID NO: 2981581 - RNA, 21 nt, Human
acaacacucauugaccugagg

SEQ ID NO: 2981582 - RNA, 19 nt, Human
acaagacccuugugguccc

SEQ ID NO: 2981583 - RNA, 20 nt, Human
acaagacccaaaaggcagaa

SEQ ID NO: 2981584 - RNA, 19 nt, Human
acaagaccacguuucuaaa

SEQ ID NO: 2981585 - RNA, 19 nt, Human
uagaugacauugacuauuu

SEQ ID NO: 2981586 - RNA, 18 nt, Human
uagaugacauugacuauu

SEQ ID NO: 2981587 - RNA, 19 nt, Human
uagauauaugcucugcaug

SEQ ID NO: 2981588 - RNA, 22 nt, Human
uagaggagaaacuggaacucuc

SEQ ID NO: 2981589 - RNA, 15 nt, Human
uagauauaugcucug

SEQ ID NO: 2981590 - RNA, 19 nt, Human
uagaggagaaacuggaacu

SEQ ID NO: 2981591 - RNA, 24 nt, Human
acaaaggauacuuauuuaaauaga

SEQ ID NO: 2981592 - RNA, 22 nt, Human
acaaaggaugcccaaagaugca

SEQ ID NO: 2981593 - RNA, 17 nt, Human
acaaaggggcuuaauua

SEQ ID NO: 2981594 - RNA, 22 nt, Human
acaaaagcaugugagacugguu

SEQ ID NO: 2981595 - RNA, 11 nt, Human
acaaaagcaug

SEQ ID NO: 2981596 - RNA, 14 nt, Human
aacuucagaguucu

SEQ ID NO: 2981597 - RNA, 13 nt, Human
aacuucagacaua

SEQ ID NO: 2981598 - RNA, 22 nt, Human
aacuuccuuggacucauuuuaa

SEQ ID NO: 2981599 - RNA, 18 nt, Human
aacuucagcgguuuauau

SEQ ID NO: 2981600 - RNA, 23 nt, Human
aacuuccuuggacucauuuuaaa

SEQ ID NO: 2981601 - RNA, 22 nt, Human
aacuucaccauauuaccacaga

SEQ ID NO: 2981602 - RNA, 22 nt, Human
aacuucacauauugauuuccgu

SEQ ID NO: 2981603 - RNA, 14 nt, Human
aacuucacauauug

SEQ ID NO: 2981604 - RNA, 18 nt, Human
gugcacgcacacugucug

SEQ ID NO: 2981605 - RNA, 19 nt, Human
gugcauuugaggucuguuc

SEQ ID NO: 2981606 - RNA, 17 nt, Human
gugcauuugaggucugu

SEQ ID NO: 2981607 - RNA, 21 nt, Human
gugcauuuggugguuucagaa

SEQ ID NO: 2981608 - RNA, 23 nt, Human
gugccaaaaacaacaacaaaaug

SEQ ID NO: 2981609 - RNA, 18 nt, Human
gugcaaugaccuuucaau

SEQ ID NO: 2981610 - RNA, 13 nt, Human
gugcacaagcucc

SEQ ID NO: 2981611 - RNA, 16 nt, Human
gugcacaagcuccaag

SEQ ID NO: 2981612 - RNA, 21 nt, Human
gugcacaagcuccaagcuccc

SEQ ID NO: 2981613 - RNA, 21 nt, Human
gugcacaugcacgugugugca

SEQ ID NO: 2981614 - RNA, 17 nt, Human
gugcacaucuguuuugu

SEQ ID NO: 2981615 - RNA, 16 nt, Human
gugauuaccagggacu

SEQ ID NO: 2981616 - RNA, 11 nt, Human
gugauuaccag

SEQ ID NO: 2981617 - RNA, 17 nt, Human
gugauuaccagggacug

SEQ ID NO: 2981618 - RNA, 23 nt, Human
gugauccucccaccucagccucc

SEQ ID NO: 2981619 - RNA, 19 nt, Human
gugauguauguguaauaaa

SEQ ID NO: 2981620 - RNA, 15 nt, Human
gugcuaucuccccca

SEQ ID NO: 2981621 - RNA, 18 nt, Human
gugcuaucucccccagcc

SEQ ID NO: 2981622 - RNA, 18 nt, Human
gugcuaguaauuggaaag

SEQ ID NO: 2981623 - RNA, 21 nt, Human
gugcuacaaaaacacagcaag

SEQ ID NO: 2981624 - RNA, 22 nt, Human
gugcuacaaaaacacagcaagg

SEQ ID NO: 2981625 - RNA, 12 nt, Human
gugcugcccugc

SEQ ID NO: 2981626 - RNA, 13 nt, Human
gugcugcccugcc

SEQ ID NO: 2981627 - RNA, 14 nt, Human
gugcugcccugccc

SEQ ID NO: 2981628 - RNA, 15 nt, Human
gugcugcccugccca

SEQ ID NO: 2981629 - RNA, 14 nt, Human
gugcucuggacagg

SEQ ID NO: 2981630 - RNA, 13 nt, Human
gugcucuggacag

SEQ ID NO: 2981631 - RNA, 16 nt, Human
gugcucugaucaucca

SEQ ID NO: 2981632 - RNA, 16 nt, Human
aagaaagaaaaucagg

SEQ ID NO: 2981633 - RNA, 13 nt, Human
aagaaagaaaauc

SEQ ID NO: 2981634 - RNA, 14 nt, Human
aagaaagaaaauca

SEQ ID NO: 2981635 - RNA, 22 nt, Human
aagaaaauaguggugugauuug

SEQ ID NO: 2981636 - RNA, 21 nt, Human
aagaaaauaguggugugauuu

SEQ ID NO: 2981637 - RNA, 16 nt, Human
aagaaaauaccaagga

SEQ ID NO: 2981638 - RNA, 15 nt, Human
aagaaaauaguggug

SEQ ID NO: 2981639 - RNA, 11 nt, Human
aagaaacauuu

SEQ ID NO: 2981640 - RNA, 23 nt, Human
aacuuuaccuuuuuuauacauaa

SEQ ID NO: 2981641 - RNA, 22 nt, Human
aacuuuaccuuuuuuauacaua

SEQ ID NO: 2981642 - RNA, 21 nt, Human
aacuuuaccuuuuuuauacau

SEQ ID NO: 2981643 - RNA, 13 nt, Human
aagaaaaagaaaa

SEQ ID NO: 2981644 - RNA, 18 nt, Human
aagaaaaagaaaaagaaa

SEQ ID NO: 2981645 - RNA, 19 nt, Human
aagaaaaaauauuuucccu

SEQ ID NO: 2981646 - RNA, 17 nt, Human
aagaaaaaugagccugg

SEQ ID NO: 2981647 - RNA, 18 nt, Human
aagaaaaaugagccuggc

SEQ ID NO: 2981648 - RNA, 15 nt, Human
aacuaaaauguucua

SEQ ID NO: 2981649 - RNA, 17 nt, Human
aacuagggaagauaaua

SEQ ID NO: 2981650 - RNA, 12 nt, Human
aacguggcugcu

SEQ ID NO: 2981651 - RNA, 13 nt, Human
aacguggcugcuu

SEQ ID NO: 2981652 - RNA, 21 nt, Human
aacucauuuuuguuuucauua

SEQ ID NO: 2981653 - RNA, 24 nt, Human
aacucauuuuuguuuucauuaucu

SEQ ID NO: 2981654 - RNA, 15 nt, Human
aacgucuuaaauauu

SEQ ID NO: 2981655 - RNA, 14 nt, Human
aacgucuuaaauau

SEQ ID NO: 2981656 - RNA, 12 nt, Human
aacgucuuaaau

SEQ ID NO: 2981657 - RNA, 13 nt, Human
aacgucugugcca

SEQ ID NO: 2981658 - RNA, 14 nt, Human
gucuuaauuaaaag

SEQ ID NO: 2981659 - RNA, 19 nt, Human
gucuuauauauuguagaua

SEQ ID NO: 2981660 - RNA, 16 nt, Human
gucuggaaugcagugg

SEQ ID NO: 2981661 - RNA, 15 nt, Human
gucuggaaugcagug

SEQ ID NO: 2981662 - RNA, 13 nt, Human
gucugcuuagaaa

SEQ ID NO: 2981663 - RNA, 14 nt, Human
gucugacaggcaau

SEQ ID NO: 2981664 - RNA, 13 nt, Human
gucugacaggcaa

SEQ ID NO: 2981665 - RNA, 12 nt, Human
gucugacaggca

SEQ ID NO: 2981666 - RNA, 18 nt, Human
gucugacaggcaaugcug

SEQ ID NO: 2981667 - RNA, 15 nt, Human
gucugacaggcaaug

SEQ ID NO: 2981668 - RNA, 20 nt, Human
gucugacaggcaaugcuggc

SEQ ID NO: 2981669 - RNA, 14 nt, Human
gucugcuuagaaau

SEQ ID NO: 2981670 - RNA, 23 nt, Human
gucucuuuaaugucacaggcagg

SEQ ID NO: 2981671 - RNA, 17 nt, Human
gucucaaaaaaagaaaa

SEQ ID NO: 2981672 - RNA, 14 nt, Human
gucucaaaaaaaca

SEQ ID NO: 2981673 - RNA, 14 nt, Human
gugaggcucugccc

SEQ ID NO: 2981674 - RNA, 15 nt, Human
gugaggcucugcccu

SEQ ID NO: 2981675 - RNA, 16 nt, Human
gugaggcucugcccuu

SEQ ID NO: 2981676 - RNA, 17 nt, Human
gugaggcucugcccuug

SEQ ID NO: 2981677 - RNA, 12 nt, Human
gugaggcucugc

SEQ ID NO: 2981678 - RNA, 13 nt, Human
gugaggcucugcc

SEQ ID NO: 2981679 - RNA, 18 nt, Human
gugagacucugucucaaa

SEQ ID NO: 2981680 - RNA, 19 nt, Human
aacucuccucugcugcugg

SEQ ID NO: 2981681 - RNA, 21 nt, Human
aacucuccucugcugcuggcu

SEQ ID NO: 2981682 - RNA, 21 nt, Human
gugaguacuacaguccuccca

SEQ ID NO: 2981683 - RNA, 17 nt, Human
aacucuccucugcugcu

SEQ ID NO: 2981684 - RNA, 19 nt, Human
gugagucaccaagcccagu

SEQ ID NO: 2981685 - RNA, 23 nt, Human
gugaguacuacaguccucccauc

SEQ ID NO: 2981686 - RNA, 17 nt, Human
gugagucaccaagccca

SEQ ID NO: 2981687 - RNA, 18 nt, Human
gugaggcucugcccuugg

SEQ ID NO: 2981688 - RNA, 22 nt, Human
aacucuccucugcugcuggcug

SEQ ID NO: 2981689 - RNA, 23 nt, Human
aacucuccucugcugcuggcugg

SEQ ID NO: 2981690 - RNA, 20 nt, Human
aacugauuuuuuuuuccuuc

SEQ ID NO: 2981691 - RNA, 21 nt, Human
aacugauuuuuuuuuccuuca

SEQ ID NO: 2981692 - RNA, 22 nt, Human
aacugauuuuuuuuuccuucag

SEQ ID NO: 2981693 - RNA, 23 nt, Human
aacugauuuuuuuuuccuucagu

SEQ ID NO: 2981694 - RNA, 16 nt, Human
aacugcauuggcuuug

SEQ ID NO: 2981695 - RNA, 19 nt, Human
gugacaugucuuuucuugc

SEQ ID NO: 2981696 - RNA, 16 nt, Human
gugagacucugucuca

SEQ ID NO: 2981697 - RNA, 14 nt, Human
gugagacucugucu

SEQ ID NO: 2981698 - RNA, 22 nt, Human
gugagacccugucucaaaaaaa

SEQ ID NO: 2981699 - RNA, 23 nt, Human
gugaauaauacaguaucucaggg

SEQ ID NO: 2981700 - RNA, 22 nt, Human
gugacagagugagacucugucu

SEQ ID NO: 2981701 - RNA, 20 nt, Human
gugacagagugagacucugu

SEQ ID NO: 2981702 - RNA, 23 nt, Human
gugacagaggcagccccauucug

SEQ ID NO: 2981703 - RNA, 18 nt, Human
gugaauaaccugaggauu

SEQ ID NO: 2981704 - RNA, 20 nt, Human
aacacaaagcuuuugcauau

SEQ ID NO: 2981705 - RNA, 19 nt, Human
aacacaaagcuuuugcaua

SEQ ID NO: 2981706 - RNA, 18 nt, Human
aacacaaagcuuuugcau

SEQ ID NO: 2981707 - RNA, 12 nt, Human
aacacaaagcuu

SEQ ID NO: 2981708 - RNA, 17 nt, Human
aacacaacuauauuguu

SEQ ID NO: 2981709 - RNA, 18 nt, Human
aacacagcaagggugaug

SEQ ID NO: 2981710 - RNA, 20 nt, Human
aacacagcaagggugauggg

SEQ ID NO: 2981711 - RNA, 19 nt, Human
aaauuucuaaaucuccaaa

SEQ ID NO: 2981712 - RNA, 19 nt, Human
aacacaaacgggcucagca

SEQ ID NO: 2981713 - RNA, 16 nt, Human
aacacugguuuuaaau

SEQ ID NO: 2981714 - RNA, 16 nt, Human
aacacuguucucugcc

SEQ ID NO: 2981715 - RNA, 17 nt, Human
aacacuguucucugccc

SEQ ID NO: 2981716 - RNA, 18 nt, Human
aacacuguucucugcccu

SEQ ID NO: 2981717 - RNA, 19 nt, Human
aacacuguucucugcccuc

SEQ ID NO: 2981718 - RNA, 17 nt, Human
gucauuugagcagggcu

SEQ ID NO: 2981719 - RNA, 21 nt, Human
aacacucacauuuauucugcu

SEQ ID NO: 2981720 - RNA, 22 nt, Human
guccaugaagauguagaggaga

SEQ ID NO: 2981721 - RNA, 19 nt, Human
gucauuugagcagggcuca

SEQ ID NO: 2981722 - RNA, 18 nt, Human
guccccaccgcagacagg

SEQ ID NO: 2981723 - RNA, 22 nt, Human
guccccaccgcagacaggacca

SEQ ID NO: 2981724 - RNA, 15 nt, Human
gucccaccccacaca

SEQ ID NO: 2981725 - RNA, 14 nt, Human
gucccaagugccaa

SEQ ID NO: 2981726 - RNA, 13 nt, Human
gucccaagugcca

SEQ ID NO: 2981727 - RNA, 19 nt, Human
gucccugguggcagcucac

SEQ ID NO: 2981728 - RNA, 18 nt, Human
gucccugguggcagcuca

SEQ ID NO: 2981729 - RNA, 18 nt, Human
gucccuuacgugaguccu

SEQ ID NO: 2981730 - RNA, 19 nt, Human
gucccuuacgugaguccug

SEQ ID NO: 2981731 - RNA, 22 nt, Human
guccccuguuuguuucugaaag

SEQ ID NO: 2981732 - RNA, 18 nt, Human
guccccuguuuguuucug

SEQ ID NO: 2981733 - RNA, 15 nt, Human
aacauagcugugauu

SEQ ID NO: 2981734 - RNA, 12 nt, Human
aacauauauaac

SEQ ID NO: 2981735 - RNA, 14 nt, Human
aacauaaaauacaa

SEQ ID NO: 2981736 - RNA, 14 nt, Human
aacagucucaggaa

SEQ ID NO: 2981737 - RNA, 18 nt, Human
aacaguccauugaaaggg

SEQ ID NO: 2981738 - RNA, 13 nt, Human
aacagucucagga

SEQ ID NO: 2981739 - RNA, 14 nt, Human
gucuaccugagggg

SEQ ID NO: 2981740 - RNA, 13 nt, Human
gucuaccugaggg

SEQ ID NO: 2981741 - RNA, 15 nt, Human
gucuaccugaggggc

SEQ ID NO: 2981742 - RNA, 16 nt, Human
gucuaccugaggggcc

SEQ ID NO: 2981743 - RNA, 22 nt, Human
gucuaugggacucaaugcacug

SEQ ID NO: 2981744 - RNA, 15 nt, Human
gucuaugggacucaa

SEQ ID NO: 2981745 - RNA, 20 nt, Human
gucuauuuacggaacucaaa

SEQ ID NO: 2981746 - RNA, 16 nt, Human
gucgaggacagggagg

SEQ ID NO: 2981747 - RNA, 12 nt, Human
gucgaggcagga

SEQ ID NO: 2981748 - RNA, 19 nt, Human
guccugcugcaguugccag

SEQ ID NO: 2981749 - RNA, 17 nt, Human
guccugcugcaguugcc

SEQ ID NO: 2981750 - RNA, 16 nt, Human
guccuggcaugggaau

SEQ ID NO: 2981751 - RNA, 14 nt, Human
guccucuuuucuga

SEQ ID NO: 2981752 - RNA, 17 nt, Human
gucacugagacagcccg

SEQ ID NO: 2981753 - RNA, 18 nt, Human
gucacugagacagcccgg

SEQ ID NO: 2981754 - RNA, 21 nt, Human
gucacugagacagcccgggcu

SEQ ID NO: 2981755 - RNA, 23 nt, Human
gucacugagacagcccgggcucu

SEQ ID NO: 2981756 - RNA, 10 nt, Human
gucacugcuu

SEQ ID NO: 2981757 - RNA, 22 nt, Human
gucacucuggcagcucagagag

SEQ ID NO: 2981758 - RNA, 14 nt, Human
gucacugagacagc

SEQ ID NO: 2981759 - RNA, 15 nt, Human
gucacugagacagcc

SEQ ID NO: 2981760 - RNA, 16 nt, Human
gucacugagacagccc

SEQ ID NO: 2981761 - RNA, 23 nt, Human
gucacucuggcagcucagagagg

SEQ ID NO: 2981762 - RNA, 15 nt, Human
gucaccaagcccagu

SEQ ID NO: 2981763 - RNA, 12 nt, Human
gucaccaagccc

SEQ ID NO: 2981764 - RNA, 15 nt, Human
gucacaggaaguaga

SEQ ID NO: 2981765 - RNA, 13 nt, Human
gucacaggaagua

SEQ ID NO: 2981766 - RNA, 21 nt, Human
gucaauuuuguuauguauauu

SEQ ID NO: 2981767 - RNA, 22 nt, Human
gucaauuacaggaaguacugga

SEQ ID NO: 2981768 - RNA, 21 nt, Human
gucaauuaccagaaagauaac

SEQ ID NO: 2981769 - RNA, 20 nt, Human
gucaauuaccagaaagauaa

SEQ ID NO: 2981770 - RNA, 20 nt, Human
gucacaggaaguagaggagg

SEQ ID NO: 2981771 - RNA, 12 nt, Human
gucacaggcagg

SEQ ID NO: 2981772 - RNA, 22 nt, Human
gucaccaaaucagcugcuacua

SEQ ID NO: 2981773 - RNA, 18 nt, Human
gucacauuccugaacagg

SEQ ID NO: 2981774 - RNA, 15 nt, Human
aaauuucuaaaucuc

SEQ ID NO: 2981775 - RNA, 13 nt, Human
aaauuucuaaauc

SEQ ID NO: 2981776 - RNA, 12 nt, Human
aaauuucuaaau

SEQ ID NO: 2981777 - RNA, 19 nt, Human
gucagucugcuuagaaaua

SEQ ID NO: 2981778 - RNA, 22 nt, Human
gucagguggggcagcuugaggg

SEQ ID NO: 2981779 - RNA, 18 nt, Human
gucagguggggcagcuug

SEQ ID NO: 2981780 - RNA, 17 nt, Human
gucagguggggcagcuu

SEQ ID NO: 2981781 - RNA, 16 nt, Human
gucagguggggcagcu

SEQ ID NO: 2981782 - RNA, 21 nt, Human
gucacugcuuaacuucacaua

SEQ ID NO: 2981783 - RNA, 15 nt, Human
gucacugcuuaacuu

SEQ ID NO: 2981784 - RNA, 13 nt, Human
gucaggaaagaga

SEQ ID NO: 2981785 - RNA, 14 nt, Human
gucaggaaagagaa

SEQ ID NO: 2981786 - RNA, 21 nt, Human
gucagaaguuucugccgcagc

SEQ ID NO: 2981787 - RNA, 21 nt, Human
aaaugucucuuuaaugucaca

SEQ ID NO: 2981788 - RNA, 24 nt, Human
aaaugucuaguuguaacaccauga

SEQ ID NO: 2981789 - RNA, 18 nt, Human
guauucucuccuguaccu

SEQ ID NO: 2981790 - RNA, 18 nt, Human
aaaugugccuucauuuuu

SEQ ID NO: 2981791 - RNA, 15 nt, Human
aaaugugcuuuuaaa

SEQ ID NO: 2981792 - RNA, 21 nt, Human
aaauuauggaaacagaugaaa

SEQ ID NO: 2981793 - RNA, 14 nt, Human
aaauuauggaaaca

SEQ ID NO: 2981794 - RNA, 17 nt, Human
aaauuguauuacaaauc

SEQ ID NO: 2981795 - RNA, 23 nt, Human
aaauuguuugacggcaagguuua

SEQ ID NO: 2981796 - RNA, 17 nt, Human
aaauuccaagugauuga

SEQ ID NO: 2981797 - RNA, 19 nt, Human
aagcuuuugcauauugcau

SEQ ID NO: 2981798 - RNA, 15 nt, Human
aagcuuuugcauauu

SEQ ID NO: 2981799 - RNA, 22 nt, Human
aagcuuuugcauauugcauacu

SEQ ID NO: 2981800 - RNA, 13 nt, Human
aagcuuuugcaua

SEQ ID NO: 2981801 - RNA, 18 nt, Human
guucccuugaugaagaag

SEQ ID NO: 2981802 - RNA, 21 nt, Human
guucccuuuuuuggcugcuga

SEQ ID NO: 2981803 - RNA, 22 nt, Human
guucccuuuuuuggcugcugaa

SEQ ID NO: 2981804 - RNA, 17 nt, Human
aagcucugcuccucucc

SEQ ID NO: 2981805 - RNA, 13 nt, Human
guucuuaauucuu

SEQ ID NO: 2981806 - RNA, 17 nt, Human
guucucugcccuccaag

SEQ ID NO: 2981807 - RNA, 18 nt, Human
guucucugcccuccaaga

SEQ ID NO: 2981808 - RNA, 17 nt, Human
guucuuaauucuuagcu

SEQ ID NO: 2981809 - RNA, 14 nt, Human
guucuuaauucuua

SEQ ID NO: 2981810 - RNA, 19 nt, Human
guucuagcauggcugccaa

SEQ ID NO: 2981811 - RNA, 17 nt, Human
guucuaguguuuucaau

SEQ ID NO: 2981812 - RNA, 13 nt, Human
guucucuccuucu

SEQ ID NO: 2981813 - RNA, 14 nt, Human
guucuaguguuuuc

SEQ ID NO: 2981814 - RNA, 13 nt, Human
guucucugcccuc

SEQ ID NO: 2981815 - RNA, 15 nt, Human
guucucugcccucca

SEQ ID NO: 2981816 - RNA, 15 nt, Human
guucucucuucucca

SEQ ID NO: 2981817 - RNA, 12 nt, Human
guucucugagga

SEQ ID NO: 2981818 - RNA, 14 nt, Human
guucuugguuugua

SEQ ID NO: 2981819 - RNA, 18 nt, Human
guucuugguuuguaaauu

SEQ ID NO: 2981820 - RNA, 15 nt, Human
guucuugguuuguaa

SEQ ID NO: 2981821 - RNA, 14 nt, Human
guugauagcacaga

SEQ ID NO: 2981822 - RNA, 19 nt, Human
guugauagcacagacccug

SEQ ID NO: 2981823 - RNA, 19 nt, Human
aaggaaaaaauaacaauga

SEQ ID NO: 2981824 - RNA, 15 nt, Human
guuauuuuacuuuuu

SEQ ID NO: 2981825 - RNA, 16 nt, Human
guuauuuuacuuuuug

SEQ ID NO: 2981826 - RNA, 21 nt, Human
guuauuuuauugauuauuacu

SEQ ID NO: 2981827 - RNA, 17 nt, Human
guuauuauauuuacaaa

SEQ ID NO: 2981828 - RNA, 19 nt, Human
guuauuauauuuacaaaug

SEQ ID NO: 2981829 - RNA, 19 nt, Human
guuagagguucccuuugac

SEQ ID NO: 2981830 - RNA, 18 nt, Human
guuaaucauuagguguga

SEQ ID NO: 2981831 - RNA, 21 nt, Human
aagccuuggggcugaugcagu

SEQ ID NO: 2981832 - RNA, 15 nt, Human
aagccuccuccagcc

SEQ ID NO: 2981833 - RNA, 16 nt, Human
aagccucccacgacug

SEQ ID NO: 2981834 - RNA, 18 nt, Human
guucagguaacaggcaga

SEQ ID NO: 2981835 - RNA, 17 nt, Human
guucagguaacaggcag

SEQ ID NO: 2981836 - RNA, 21 nt, Human
aagccgugauuuucauugcug

SEQ ID NO: 2981837 - RNA, 22 nt, Human
guucaggguuggccccugcccg

SEQ ID NO: 2981838 - RNA, 21 nt, Human
guucaggguuggccccugccc

SEQ ID NO: 2981839 - RNA, 20 nt, Human
guucaggguuggccccugcc

SEQ ID NO: 2981840 - RNA, 23 nt, Human
guucagcuuguaaauagcucagg

SEQ ID NO: 2981841 - RNA, 17 nt, Human
aagagggugggugggua

SEQ ID NO: 2981842 - RNA, 22 nt, Human
aagagggucugaggaauccaga

SEQ ID NO: 2981843 - RNA, 15 nt, Human
aagauagcagggcau

SEQ ID NO: 2981844 - RNA, 14 nt, Human
aagauagcagggca

SEQ ID NO: 2981845 - RNA, 21 nt, Human
aagagggagggagggcuccag

SEQ ID NO: 2981846 - RNA, 22 nt, Human
aagagggagggagggcuccaga

SEQ ID NO: 2981847 - RNA, 11 nt, Human
aagaggcaggg

SEQ ID NO: 2981848 - RNA, 14 nt, Human
aagaggcagggucu

SEQ ID NO: 2981849 - RNA, 23 nt, Human
gugcugcccugcccaccuggccu

SEQ ID NO: 2981850 - RNA, 15 nt, Human
gugguuucagaaaug

SEQ ID NO: 2981851 - RNA, 14 nt, Human
guguaaacacaucu

SEQ ID NO: 2981852 - RNA, 15 nt, Human
guguaaacacaucua

SEQ ID NO: 2981853 - RNA, 22 nt, Human
gugucuuaauuaaaagaauauu

SEQ ID NO: 2981854 - RNA, 19 nt, Human
gugucagguggggcagcuu

SEQ ID NO: 2981855 - RNA, 23 nt, Human
gugugaaccaccacacccagccc

SEQ ID NO: 2981856 - RNA, 14 nt, Human
gugucaccugaaga

SEQ ID NO: 2981857 - RNA, 18 nt, Human
gugucagguggggcagcu

SEQ ID NO: 2981858 - RNA, 14 nt, Human
gugucagguggggc

SEQ ID NO: 2981859 - RNA, 22 nt, Human
gugucaccugaagacucauucu

SEQ ID NO: 2981860 - RNA, 20 nt, Human
aagaucaaaagguuaauaaa

SEQ ID NO: 2981861 - RNA, 23 nt, Human
aagaucaaaagguuaauaaagua

SEQ ID NO: 2981862 - RNA, 17 nt, Human
aagcaacccaaauguuc

SEQ ID NO: 2981863 - RNA, 19 nt, Human
aagcauuguaaaugugcuu

SEQ ID NO: 2981864 - RNA, 18 nt, Human
aagccaaagcuaggccug

SEQ ID NO: 2981865 - RNA, 17 nt, Human
aagccaaagcuaggccu

SEQ ID NO: 2981866 - RNA, 19 nt, Human
aagcacugacuucuaagua

SEQ ID NO: 2981867 - RNA, 20 nt, Human
aagcacugacuucuaaguaa

SEQ ID NO: 2981868 - RNA, 12 nt, Human
aagcaugugaga

SEQ ID NO: 2981869 - RNA, 18 nt, Human
aagcauuguaaaugugcu

SEQ ID NO: 2981870 - RNA, 16 nt, Human
aagcacuaaacaaaga

SEQ ID NO: 2981871 - RNA, 17 nt, Human
aagcaccuccugccucg

SEQ ID NO: 2981872 - RNA, 16 nt, Human
aagcacugacuucuaa

SEQ ID NO: 2981873 - RNA, 17 nt, Human
aagcacugacuucuaag

SEQ ID NO: 2981874 - RNA, 16 nt, Human
aagcaccuccugccuc

SEQ ID NO: 2981875 - RNA, 15 nt, Human
aagcaccuccugccu

SEQ ID NO: 2981876 - RNA, 14 nt, Human
aagcaccuccugcc

SEQ ID NO: 2981877 - RNA, 13 nt, Human
aagcaccuccugc

SEQ ID NO: 2981878 - RNA, 21 nt, Human
aagcacaugccucucucaggc

SEQ ID NO: 2981879 - RNA, 12 nt, Human
guguuugaagca

SEQ ID NO: 2981880 - RNA, 16 nt, Human
aagcacacuugacauc

SEQ ID NO: 2981881 - RNA, 17 nt, Human
gugugaauaccccaaga

SEQ ID NO: 2981882 - RNA, 15 nt, Human
aagcacaugccucuc

SEQ ID NO: 2981883 - RNA, 16 nt, Human
aagcacaugccucucu

SEQ ID NO: 2981884 - RNA, 19 nt, Human
aagcacaugccucucucag

SEQ ID NO: 2981885 - RNA, 20 nt, Human
aagcacaugccucucucagg

SEQ ID NO: 2981886 - RNA, 14 nt, Human
aagcacaugccucu

SEQ ID NO: 2981887 - RNA, 13 nt, Human
uaaaaaggugacc

SEQ ID NO: 2981888 - RNA, 15 nt, Human
uaaaaaggugaccau

SEQ ID NO: 2981889 - RNA, 21 nt, Human
uaaaaaaaaaccugagcccca

SEQ ID NO: 2981890 - RNA, 22 nt, Human
uaaaaaugagguacucuccugg

SEQ ID NO: 2981891 - RNA, 14 nt, Human
uaaaaccacagcag

SEQ ID NO: 2981892 - RNA, 15 nt, Human
uaaaaccacagcagu

SEQ ID NO: 2981893 - RNA, 13 nt, Human
uaaaaccacagca

SEQ ID NO: 2981894 - RNA, 23 nt, Human
uaaaaaucucaaauuucuaaauc

SEQ ID NO: 2981895 - RNA, 15 nt, Human
uaaaaaugagguacu

SEQ ID NO: 2981896 - RNA, 15 nt, Human
uaaaacuuuuuaaaa

SEQ ID NO: 2981897 - RNA, 12 nt, Human
uaaaacuuuuua

SEQ ID NO: 2981898 - RNA, 13 nt, Human
uaaaacccaagug

SEQ ID NO: 2981899 - RNA, 21 nt, Human
uaaaauacacacucaaaucaa

SEQ ID NO: 2981900 - RNA, 22 nt, Human
uaaaauaauuuuuauauuugaa

SEQ ID NO: 2981901 - RNA, 19 nt, Human
uaaaauaagucugauuuaa

SEQ ID NO: 2981902 - RNA, 18 nt, Human
uaaaauaagucugauuua

SEQ ID NO: 2981903 - RNA, 17 nt, Human
uaaaauaagucugauuu

SEQ ID NO: 2981904 - RNA, 15 nt, Human
uaaaauaagucugau

SEQ ID NO: 2981905 - RNA, 20 nt, Human
uaaaauaauuuuuauauuug

SEQ ID NO: 2981906 - RNA, 14 nt, Human
uaaaauaagucuga

SEQ ID NO: 2981907 - RNA, 19 nt, Human
uaaaaggugaccaaugaug

SEQ ID NO: 2981908 - RNA, 13 nt, Human
uaaaagaauauuu

SEQ ID NO: 2981909 - RNA, 13 nt, Human
uaaaagucuugug

SEQ ID NO: 2981910 - RNA, 20 nt, Human
aagugauccucccaccucag

SEQ ID NO: 2981911 - RNA, 19 nt, Human
aagugauccucccaccuca

SEQ ID NO: 2981912 - RNA, 13 nt, Human
aagugauccuccc

SEQ ID NO: 2981913 - RNA, 20 nt, Human
aagugauucuccugccucag

SEQ ID NO: 2981914 - RNA, 23 nt, Human
aagugauccucccaccucagccu

SEQ ID NO: 2981915 - RNA, 23 nt, Human
aaguguauuuuuuuacuaauaga

SEQ ID NO: 2981916 - RNA, 13 nt, Human
aagugugguagag

SEQ ID NO: 2981917 - RNA, 22 nt, Human
aaguuauuaagagguaagacuu

SEQ ID NO: 2981918 - RNA, 21 nt, Human
aaguuauuaagagguaagacu

SEQ ID NO: 2981919 - RNA, 23 nt, Human
aaguuauuaagagguaagacuua

SEQ ID NO: 2981920 - RNA, 21 nt, Human
aaguuugaauuccuaaaauua

SEQ ID NO: 2981921 - RNA, 13 nt, Human
aaguuugaacauu

SEQ ID NO: 2981922 - RNA, 19 nt, Human
aaguuucugccgcagcccu

SEQ ID NO: 2981923 - RNA, 21 nt, Human
aaguuucugccgcagcccugc

SEQ ID NO: 2981924 - RNA, 19 nt, Human
aaguuauuuuuaauuuggu

SEQ ID NO: 2981925 - RNA, 9 nt, Human
uaaaauggu

SEQ ID NO: 2981926 - RNA, 20 nt, Human
aaguuugagaucagccuggg

SEQ ID NO: 2981927 - RNA, 14 nt, Human
aagguagaauguuu

SEQ ID NO: 2981928 - RNA, 13 nt, Human
aagguagaauguu

SEQ ID NO: 2981929 - RNA, 12 nt, Human
aagggggcuggg

SEQ ID NO: 2981930 - RNA, 23 nt, Human
aagggggcugggacaugggaaag

SEQ ID NO: 2981931 - RNA, 13 nt, Human
aaggggagaguaa

SEQ ID NO: 2981932 - RNA, 17 nt, Human
aaggggaauugaggaca

SEQ ID NO: 2981933 - RNA, 17 nt, Human
aagggcuguuauaaucu

SEQ ID NO: 2981934 - RNA, 15 nt, Human
aagggcuguuauaau

SEQ ID NO: 2981935 - RNA, 16 nt, Human
aaggcugggggaagaa

SEQ ID NO: 2981936 - RNA, 14 nt, Human
aaggcugggggaag

SEQ ID NO: 2981937 - RNA, 13 nt, Human
guuucagaaaugu

SEQ ID NO: 2981938 - RNA, 11 nt, Human
guuucagaaau

SEQ ID NO: 2981939 - RNA, 19 nt, Human
aaggcugggggaagaagcu

SEQ ID NO: 2981940 - RNA, 22 nt, Human
aaggcugggggaagaagcucuc

SEQ ID NO: 2981941 - RNA, 20 nt, Human
aaggcugucaauuacaggaa

SEQ ID NO: 2981942 - RNA, 14 nt, Human
guuuaugauuccac

SEQ ID NO: 2981943 - RNA, 16 nt, Human
guuuaugagaaacugg

SEQ ID NO: 2981944 - RNA, 17 nt, Human
guuucaaacuuuacuau

SEQ ID NO: 2981945 - RNA, 15 nt, Human
guuucacacaaacaa

SEQ ID NO: 2981946 - RNA, 21 nt, Human
guuuaagugacugauggcuaa

SEQ ID NO: 2981947 - RNA, 17 nt, Human
aaggaaacccagcucug

SEQ ID NO: 2981948 - RNA, 22 nt, Human
aaggaaacccagcucuggucca

SEQ ID NO: 2981949 - RNA, 23 nt, Human
guuguuugauucagacagcugcc

SEQ ID NO: 2981950 - RNA, 20 nt, Human
guuguuugauucagacagcu

SEQ ID NO: 2981951 - RNA, 16 nt, Human
aaggaaacccagcucu

SEQ ID NO: 2981952 - RNA, 19 nt, Human
aaguauguuagugcaaauu

SEQ ID NO: 2981953 - RNA, 18 nt, Human
aaguauguuagugcaaau

SEQ ID NO: 2981954 - RNA, 15 nt, Human
aaguauuauaccuuu

SEQ ID NO: 2981955 - RNA, 18 nt, Human
aaguacuucuccacccug

SEQ ID NO: 2981956 - RNA, 19 nt, Human
aaguacuucuccacccugc

SEQ ID NO: 2981957 - RNA, 19 nt, Human
aaguaaugauaacuggaaa

SEQ ID NO: 2981958 - RNA, 16 nt, Human
aaguaauuuggaaauu

SEQ ID NO: 2981959 - RNA, 13 nt, Human
aaguacuauguau

SEQ ID NO: 2981960 - RNA, 17 nt, Human
aaguacuauaauuuacc

SEQ ID NO: 2981961 - RNA, 14 nt, Human
aaguacuauaauuu

SEQ ID NO: 2981962 - RNA, 19 nt, Human
aaguauuauaccuuuuuua

SEQ ID NO: 2981963 - RNA, 16 nt, Human
aaguauuauaccuuuu

SEQ ID NO: 2981964 - RNA, 21 nt, Human
aaguauucuuauuuaaugaaa

SEQ ID NO: 2981965 - RNA, 23 nt, Human
aaguauucuuauuuaaugaaaga

SEQ ID NO: 2981966 - RNA, 22 nt, Human
guuuuaaggaugcuuguacaua

SEQ ID NO: 2981967 - RNA, 18 nt, Human
guuuuaaggaugcuugua

SEQ ID NO: 2981968 - RNA, 16 nt, Human
guuuucuguucuuucu

SEQ ID NO: 2981969 - RNA, 15 nt, Human
guuuucuguucuuuc

SEQ ID NO: 2981970 - RNA, 14 nt, Human
guuuucuguucuuu

SEQ ID NO: 2981971 - RNA, 12 nt, Human
guuuucuguucu

SEQ ID NO: 2981972 - RNA, 17 nt, Human
aaguaauaugcacacau

SEQ ID NO: 2981973 - RNA, 20 nt, Human
aaguaauaugcacacauuuu

SEQ ID NO: 2981974 - RNA, 18 nt, Human
aaguaauaugcacacauu

SEQ ID NO: 2981975 - RNA, 21 nt, Human
aaguaauaugcacacauuuuu

SEQ ID NO: 2981976 - RNA, 19 nt, Human
guuuggacaaaauggaaua

SEQ ID NO: 2981977 - RNA, 15 nt, Human
guuuuaaagcuucca

SEQ ID NO: 2981978 - RNA, 22 nt, Human
cuucucuguauuccuagaaacu

SEQ ID NO: 2981979 - RNA, 15 nt, Human
cuucugacccaugcu

SEQ ID NO: 2981980 - RNA, 22 nt, Human
cuucugaacuuggcgcugcccc

SEQ ID NO: 2981981 - RNA, 19 nt, Human
cuucugaacuuggcgcugc

SEQ ID NO: 2981982 - RNA, 16 nt, Human
cuucuauuuauuuauu

SEQ ID NO: 2981983 - RNA, 14 nt, Human
cuucuauauaauuc

SEQ ID NO: 2981984 - RNA, 14 nt, Human
cuuccucccucccu

SEQ ID NO: 2981985 - RNA, 13 nt, Human
cuuccucccuccc

SEQ ID NO: 2981986 - RNA, 12 nt, Human
cuuccucccucc

SEQ ID NO: 2981987 - RNA, 18 nt, Human
cuucugacccaugcugcc

SEQ ID NO: 2981988 - RNA, 16 nt, Human
cuucugacccaugcug

SEQ ID NO: 2981989 - RNA, 17 nt, Human
cuucugacccaugcugc

SEQ ID NO: 2981990 - RNA, 16 nt, Human
cuucuuauacauuuga

SEQ ID NO: 2981991 - RNA, 13 nt, Human
cuucuuauacauu

SEQ ID NO: 2981992 - RNA, 15 nt, Human
cuuuaagaacuaaaa

SEQ ID NO: 2981993 - RNA, 21 nt, Human
cuugucuuuggacccugaggc

SEQ ID NO: 2981994 - RNA, 22 nt, Human
cuugucuuuggacccugaggcc

SEQ ID NO: 2981995 - RNA, 20 nt, Human
cuuuaaugucacaggcaggu

SEQ ID NO: 2981996 - RNA, 19 nt, Human
cuuuaaugucacaggcagg

SEQ ID NO: 2981997 - RNA, 18 nt, Human
cuuuaaugucacaggcag

SEQ ID NO: 2981998 - RNA, 17 nt, Human
cuuuaaugucacaggca

SEQ ID NO: 2981999 - RNA, 14 nt, Human
cuuucaauaggaaa

SEQ ID NO: 2982000 - RNA, 15 nt, Human
cuuucaauaggaaaa

SEQ ID NO: 2982001 - RNA, 22 nt, Human
cuuuaaugucacaggcaggucc

SEQ ID NO: 2982002 - RNA, 17 nt, Human
cuuucaauaggaaaaac

SEQ ID NO: 2982003 - RNA, 20 nt, Human
cuugguucccauuugcuccu

SEQ ID NO: 2982004 - RNA, 16 nt, Human
cuugguucccauuugc

SEQ ID NO: 2982005 - RNA, 22 nt, Human
cuugguccugcugcaguugcca

SEQ ID NO: 2982006 - RNA, 23 nt, Human
cuuggucucagugucaaugcagc

SEQ ID NO: 2982007 - RNA, 20 nt, Human
cuuggugucgggcaugacac

SEQ ID NO: 2982008 - RNA, 19 nt, Human
cuugucuuuggacccugag

SEQ ID NO: 2982009 - RNA, 20 nt, Human
cuugucuuuggacccugagg

SEQ ID NO: 2982010 - RNA, 13 nt, Human
cuugucuguagau

SEQ ID NO: 2982011 - RNA, 16 nt, Human
cuugguccugcugcag

SEQ ID NO: 2982012 - RNA, 17 nt, Human
cuugguccugcugcagu

SEQ ID NO: 2982013 - RNA, 18 nt, Human
cuugguccugcugcaguu

SEQ ID NO: 2982014 - RNA, 20 nt, Human
cuugguccugcugcaguugc

SEQ ID NO: 2982015 - RNA, 15 nt, Human
cuugguccugcugca

SEQ ID NO: 2982016 - RNA, 16 nt, Human
cuuggcccaggaguuu

SEQ ID NO: 2982017 - RNA, 20 nt, Human
cuuggcccaggaguuuggcc

SEQ ID NO: 2982018 - RNA, 22 nt, Human
cuuggcccaggaguuuggccag

SEQ ID NO: 2982019 - RNA, 23 nt, Human
cuuggcccaggaguuuggccaga

SEQ ID NO: 2982020 - RNA, 23 nt, Human
cuuggcgcugccccuggcagccc

SEQ ID NO: 2982021 - RNA, 21 nt, Human
cuuggcgcugccccuggcagc

SEQ ID NO: 2982022 - RNA, 22 nt, Human
cuuggcgcugccccuggcagcc

SEQ ID NO: 2982023 - RNA, 14 nt, Human
cuuggcccaggagu

SEQ ID NO: 2982024 - RNA, 15 nt, Human
cuuggcccaggaguu

SEQ ID NO: 2982025 - RNA, 18 nt, Human
cuuggauuguccccgacc

SEQ ID NO: 2982026 - RNA, 20 nt, Human
cuuggauuguccccgacccu

SEQ ID NO: 2982027 - RNA, 15 nt, Human
cuuggauuguccccg

SEQ ID NO: 2982028 - RNA, 18 nt, Human
cuugccgucuaccugagg

SEQ ID NO: 2982029 - RNA, 19 nt, Human
cuugccgucuaccugaggg

SEQ ID NO: 2982030 - RNA, 19 nt, Human
cuugauucauaaugacuua

SEQ ID NO: 2982031 - RNA, 15 nt, Human
cuugauguguuaucu

SEQ ID NO: 2982032 - RNA, 19 nt, Human
gaaaaaauauuuuccugcc

SEQ ID NO: 2982033 - RNA, 21 nt, Human
cuuuuuuuuuuuuuuugacaa

SEQ ID NO: 2982034 - RNA, 18 nt, Human
cuuuugugcauuaucuag

SEQ ID NO: 2982035 - RNA, 14 nt, Human
cuuuugugcauuau

SEQ ID NO: 2982036 - RNA, 19 nt, Human
cuuuuguagaagucacauu

SEQ ID NO: 2982037 - RNA, 17 nt, Human
cuuuugucuaugggacu

SEQ ID NO: 2982038 - RNA, 16 nt, Human
cuuuuggucuguguga

SEQ ID NO: 2982039 - RNA, 15 nt, Human
cuuuuggucugugug

SEQ ID NO: 2982040 - RNA, 16 nt, Human
cuuuugccguuauuaa

SEQ ID NO: 2982041 - RNA, 18 nt, Human
cuuuugccguuauuaaaa

SEQ ID NO: 2982042 - RNA, 20 nt, Human
gaaaagacuccaaagaaaug

SEQ ID NO: 2982043 - RNA, 18 nt, Human
gaaaagacuccaaagaaa

SEQ ID NO: 2982044 - RNA, 21 nt, Human
gaaaagacuccaaagaaaugu

SEQ ID NO: 2982045 - RNA, 22 nt, Human
gaaaaaaugguagcauuuuaaa

SEQ ID NO: 2982046 - RNA, 19 nt, Human
gaaaaaaugguagcauuuu

SEQ ID NO: 2982047 - RNA, 17 nt, Human
gaaaaaaugguagcauu

SEQ ID NO: 2982048 - RNA, 15 nt, Human
gaaaagccucuguuu

SEQ ID NO: 2982049 - RNA, 19 nt, Human
gaaaagccucuguuuugau

SEQ ID NO: 2982050 - RNA, 14 nt, Human
gaaaauuuuaaaaa

SEQ ID NO: 2982051 - RNA, 18 nt, Human
gaaaauuuugauguuuua

SEQ ID NO: 2982052 - RNA, 21 nt, Human
gaaaucaaauaugcaaagcac

SEQ ID NO: 2982053 - RNA, 16 nt, Human
gaaaucaaauaugcaa

SEQ ID NO: 2982054 - RNA, 21 nt, Human
gaaaguacuucuccacccugc

SEQ ID NO: 2982055 - RNA, 17 nt, Human
gaaaggcuccaggagca

SEQ ID NO: 2982056 - RNA, 18 nt, Human
gaaaggcuccaggagcag

SEQ ID NO: 2982057 - RNA, 19 nt, Human
gaaaggcuccaggagcagc

SEQ ID NO: 2982058 - RNA, 16 nt, Human
gaaaggcuccaggagc

SEQ ID NO: 2982059 - RNA, 18 nt, Human
gaaagacuaucuaaaugu

SEQ ID NO: 2982060 - RNA, 17 nt, Human
gaaaucaccgaaaacgu

SEQ ID NO: 2982061 - RNA, 17 nt, Human
gaaaugaaagcagggac

SEQ ID NO: 2982062 - RNA, 23 nt, Human
gaaaucaaauaugcaaagcacug

SEQ ID NO: 2982063 - RNA, 18 nt, Human
gaaaugaaagcagggacu

SEQ ID NO: 2982064 - RNA, 18 nt, Human
gaaauuuuuauuaaauua

SEQ ID NO: 2982065 - RNA, 18 nt, Human
gaacaaauuuacagagac

SEQ ID NO: 2982066 - RNA, 17 nt, Human
gaacaaauuuacagaga

SEQ ID NO: 2982067 - RNA, 19 nt, Human
gaaauuuuuauuaaauuau

SEQ ID NO: 2982068 - RNA, 23 nt, Human
gaacaaauuuacagagacagaaa

SEQ ID NO: 2982069 - RNA, 23 nt, Human
gaaacuucagcgguuuauauaag

SEQ ID NO: 2982070 - RNA, 14 nt, Human
gaacaaggcaaggc

SEQ ID NO: 2982071 - RNA, 15 nt, Human
gaacaaggcaaggcu

SEQ ID NO: 2982072 - RNA, 17 nt, Human
gaacaaggcaaggcugu

SEQ ID NO: 2982073 - RNA, 18 nt, Human
gaacaaggcaaggcuguc

SEQ ID NO: 2982074 - RNA, 21 nt, Human
gaacaaggcaaggcugucaau

SEQ ID NO: 2982075 - RNA, 24 nt, Human
cuggaguuauugaagcagaguggc

SEQ ID NO: 2982076 - RNA, 23 nt, Human
cuggaguuauugaagcagagugg

SEQ ID NO: 2982077 - RNA, 21 nt, Human
cuggaguuauugaagcagagu

SEQ ID NO: 2982078 - RNA, 22 nt, Human
cuggaguuauugaagcagagug

SEQ ID NO: 2982079 - RNA, 21 nt, Human
cuggagaaaauggacguguua

SEQ ID NO: 2982080 - RNA, 23 nt, Human
cuggaaaaguauguuagugcaaa

SEQ ID NO: 2982081 - RNA, 14 nt, Human
cugcuuccagugag

SEQ ID NO: 2982082 - RNA, 23 nt, Human
cugcuucagccucccgaguagcu

SEQ ID NO: 2982083 - RNA, 19 nt, Human
cugcuucaaggauccugag

SEQ ID NO: 2982084 - RNA, 14 nt, Human
cugcuucaaggauc

SEQ ID NO: 2982085 - RNA, 16 nt, Human
cugcuucaaggauccu

SEQ ID NO: 2982086 - RNA, 16 nt, Human
cuggaugcagccucac

SEQ ID NO: 2982087 - RNA, 17 nt, Human
cuggaugcagccucaca

SEQ ID NO: 2982088 - RNA, 18 nt, Human
cuggaugcagccucacag

SEQ ID NO: 2982089 - RNA, 15 nt, Human
cuggaugcagccuca

SEQ ID NO: 2982090 - RNA, 13 nt, Human
cuggcagccccug

SEQ ID NO: 2982091 - RNA, 22 nt, Human
cuggcagaguugaagacagagc

SEQ ID NO: 2982092 - RNA, 23 nt, Human
cuggcagccccuguucuggcaga

SEQ ID NO: 2982093 - RNA, 20 nt, Human
cuggcagaguugaagacaga

SEQ ID NO: 2982094 - RNA, 21 nt, Human
cuggcagaguugaagacagag

SEQ ID NO: 2982095 - RNA, 19 nt, Human
cuggcagaguugaagacag

SEQ ID NO: 2982096 - RNA, 17 nt, Human
cuggcagcucagagagg

SEQ ID NO: 2982097 - RNA, 19 nt, Human
cuggcagcucagagagggu

SEQ ID NO: 2982098 - RNA, 16 nt, Human
cuggcagcucagagag

SEQ ID NO: 2982099 - RNA, 17 nt, Human
cugggacuacaggugug

SEQ ID NO: 2982100 - RNA, 21 nt, Human
cugggacuacaggcacccacc

SEQ ID NO: 2982101 - RNA, 17 nt, Human
cugggacuacaggcacc

SEQ ID NO: 2982102 - RNA, 16 nt, Human
cugggacuacaggcac

SEQ ID NO: 2982103 - RNA, 23 nt, Human
cuggcucuguggcgagccauuug

SEQ ID NO: 2982104 - RNA, 14 nt, Human
cuggcucuguggcg

SEQ ID NO: 2982105 - RNA, 13 nt, Human
cuggcucuguggc

SEQ ID NO: 2982106 - RNA, 14 nt, Human
cuggcucuuccagg

SEQ ID NO: 2982107 - RNA, 15 nt, Human
cuggcucuuccaggc

SEQ ID NO: 2982108 - RNA, 13 nt, Human
cuggcucuuccag

SEQ ID NO: 2982109 - RNA, 12 nt, Human
cuggcucugugg

SEQ ID NO: 2982110 - RNA, 24 nt, Human
cugcugaaggcucgagcaugccug

SEQ ID NO: 2982111 - RNA, 23 nt, Human
cugcugaaggcucgagcaugccu

SEQ ID NO: 2982112 - RNA, 18 nt, Human
cugcugaaggcucgagca

SEQ ID NO: 2982113 - RNA, 17 nt, Human
cugcuaucaaagagguu

SEQ ID NO: 2982114 - RNA, 23 nt, Human
cugccuguucagcuccagcucac

SEQ ID NO: 2982115 - RNA, 20 nt, Human
cugccuguucagcuccagcu

SEQ ID NO: 2982116 - RNA, 22 nt, Human
cugcugagccucacagcaguga

SEQ ID NO: 2982117 - RNA, 23 nt, Human
cugcugagauccuggacugaggg

SEQ ID NO: 2982118 - RNA, 19 nt, Human
cugcugagauccuggacug

SEQ ID NO: 2982119 - RNA, 18 nt, Human
cugcugagauccuggacu

SEQ ID NO: 2982120 - RNA, 17 nt, Human
cugcugagauccuggac

SEQ ID NO: 2982121 - RNA, 16 nt, Human
cugcugagauccugga

SEQ ID NO: 2982122 - RNA, 20 nt, Human
cugccuccccuccucugcuu

SEQ ID NO: 2982123 - RNA, 19 nt, Human
cugccuccccuccucugcu

SEQ ID NO: 2982124 - RNA, 14 nt, Human
cugccuccuuugug

SEQ ID NO: 2982125 - RNA, 17 nt, Human
cugccuccuuugugagg

SEQ ID NO: 2982126 - RNA, 21 nt, Human
cugccuccuuugugaggaagc

SEQ ID NO: 2982127 - RNA, 23 nt, Human
cugccuccuuugugaggaagccg

SEQ ID NO: 2982128 - RNA, 14 nt, Human
cugccucgaacugg

SEQ ID NO: 2982129 - RNA, 20 nt, Human
cugccucgaacuggcugcaa

SEQ ID NO: 2982130 - RNA, 19 nt, Human
cugccucgaacuggcugca

SEQ ID NO: 2982131 - RNA, 14 nt, Human
cugccuccccuccu

SEQ ID NO: 2982132 - RNA, 18 nt, Human
cugccuccccuccucugc

SEQ ID NO: 2982133 - RNA, 17 nt, Human
cugccuccccuccucug

SEQ ID NO: 2982134 - RNA, 24 nt, Human
cugcccugugaguacuacaguccu

SEQ ID NO: 2982135 - RNA, 19 nt, Human
cugcccuuaccugccagga

SEQ ID NO: 2982136 - RNA, 12 nt, Human
cugcccuguggg

SEQ ID NO: 2982137 - RNA, 11 nt, Human
cugcccugugg

SEQ ID NO: 2982138 - RNA, 22 nt, Human
cugcccuuaccugccaggaagc

SEQ ID NO: 2982139 - RNA, 23 nt, Human
cugcccuuaccugccaggaagcc

SEQ ID NO: 2982140 - RNA, 23 nt, Human
cugucggagcccugucuccucuc

SEQ ID NO: 2982141 - RNA, 22 nt, Human
cugucuaaugaaaccugugucu

SEQ ID NO: 2982142 - RNA, 14 nt, Human
cugucauuugagca

SEQ ID NO: 2982143 - RNA, 14 nt, Human
cuguccugggagug

SEQ ID NO: 2982144 - RNA, 13 nt, Human
cuguccugggagu

SEQ ID NO: 2982145 - RNA, 20 nt, Human
cuguccugggagugagcugg

SEQ ID NO: 2982146 - RNA, 20 nt, Human
cuguaagaaaauaucacuug

SEQ ID NO: 2982147 - RNA, 15 nt, Human
cuguagagugggagc

SEQ ID NO: 2982148 - RNA, 22 nt, Human
cuggugacaugucuuuucuugc

SEQ ID NO: 2982149 - RNA, 18 nt, Human
cuggucuuauuuguaaag

SEQ ID NO: 2982150 - RNA, 12 nt, Human
cuuaaaaauggu

SEQ ID NO: 2982151 - RNA, 20 nt, Human
cuuaaaaaugguuuaaaugg

SEQ ID NO: 2982152 - RNA, 13 nt, Human
cuuaaaaaugguu

SEQ ID NO: 2982153 - RNA, 19 nt, Human
cuuaaauaaugugaaacug

SEQ ID NO: 2982154 - RNA, 16 nt, Human
cuuaaauaaugugaaa

SEQ ID NO: 2982155 - RNA, 14 nt, Human
cuuaaauaauguga

SEQ ID NO: 2982156 - RNA, 13 nt, Human
cuuaaauaaugug

SEQ ID NO: 2982157 - RNA, 12 nt, Human
cuguuggccagu

SEQ ID NO: 2982158 - RNA, 15 nt, Human
cuguuggccagugug

SEQ ID NO: 2982159 - RNA, 18 nt, Human
cuguugcccaggcuggcg

SEQ ID NO: 2982160 - RNA, 21 nt, Human
cugugagaugcuagaacuccc

SEQ ID NO: 2982161 - RNA, 23 nt, Human
cugugagaugcuagaacucccuu

SEQ ID NO: 2982162 - RNA, 15 nt, Human
cugugcucuggacag

SEQ ID NO: 2982163 - RNA, 17 nt, Human
cugugcucuggacaggc

SEQ ID NO: 2982164 - RNA, 19 nt, Human
cuguuauaaucuuucacag

SEQ ID NO: 2982165 - RNA, 13 nt, Human
cuguuacugucuu

SEQ ID NO: 2982166 - RNA, 17 nt, Human
cuguuacugucuucagu

SEQ ID NO: 2982167 - RNA, 22 nt, Human
cugugucagguggggcagcuug

SEQ ID NO: 2982168 - RNA, 19 nt, Human
cugugcucuggacaggcau

SEQ ID NO: 2982169 - RNA, 18 nt, Human
cugugcucuggacaggca

SEQ ID NO: 2982170 - RNA, 12 nt, Human
cuguucacagcc

SEQ ID NO: 2982171 - RNA, 19 nt, Human
cuguucacagccagacugg

SEQ ID NO: 2982172 - RNA, 22 nt, Human
cuguucacagccagacuggcac

SEQ ID NO: 2982173 - RNA, 15 nt, Human
cuguucagcuccagc

SEQ ID NO: 2982174 - RNA, 14 nt, Human
cuguucagcuccag

SEQ ID NO: 2982175 - RNA, 22 nt, Human
cuguucagcuccagcucaccag

SEQ ID NO: 2982176 - RNA, 19 nt, Human
cuguucagcuccagcucac

SEQ ID NO: 2982177 - RNA, 18 nt, Human
cuguucagcuccagcuca

SEQ ID NO: 2982178 - RNA, 16 nt, Human
cuguucagcuccagcu

SEQ ID NO: 2982179 - RNA, 12 nt, Human
cuguucagcugg

SEQ ID NO: 2982180 - RNA, 19 nt, Human
gacacuucacgcccuuggc

SEQ ID NO: 2982181 - RNA, 14 nt, Human
gacagcccgggcuc

SEQ ID NO: 2982182 - RNA, 18 nt, Human
gacagcuccuucuguccu

SEQ ID NO: 2982183 - RNA, 17 nt, Human
gacagcuccuucugucc

SEQ ID NO: 2982184 - RNA, 16 nt, Human
gacagcccgggcucug

SEQ ID NO: 2982185 - RNA, 16 nt, Human
gacagcuccuucuguc

SEQ ID NO: 2982186 - RNA, 12 nt, Human
gacagcucugca

SEQ ID NO: 2982187 - RNA, 19 nt, Human
gacagcuccuucuguccua

SEQ ID NO: 2982188 - RNA, 10 nt, Human
gacagcucuu

SEQ ID NO: 2982189 - RNA, 11 nt, Human
gacagcucuua

SEQ ID NO: 2982190 - RNA, 18 nt, Human
gacagucaccucauggaa

SEQ ID NO: 2982191 - RNA, 12 nt, Human
gacagucccugc

SEQ ID NO: 2982192 - RNA, 14 nt, Human
gacagucccugcca

SEQ ID NO: 2982193 - RNA, 15 nt, Human
gacagucccugccaa

SEQ ID NO: 2982194 - RNA, 16 nt, Human
gacagucccugccaau

SEQ ID NO: 2982195 - RNA, 20 nt, Human
gacagucccugccaauggac

SEQ ID NO: 2982196 - RNA, 16 nt, Human
gacauuuuaugucuuu

SEQ ID NO: 2982197 - RNA, 20 nt, Human
gacauuuuaugucuuucuug

SEQ ID NO: 2982198 - RNA, 23 nt, Human
gacauugcggacagccacggcca

SEQ ID NO: 2982199 - RNA, 17 nt, Human
gacauugcggacagcca

SEQ ID NO: 2982200 - RNA, 18 nt, Human
gacccucaugcugccaau

SEQ ID NO: 2982201 - RNA, 21 nt, Human
gacccucaugcugccaauauc

SEQ ID NO: 2982202 - RNA, 22 nt, Human
gacccucaugcugccaauaucc

SEQ ID NO: 2982203 - RNA, 23 nt, Human
gacccucaugcugccaauauccu

SEQ ID NO: 2982204 - RNA, 14 nt, Human
gaccucaggccugg

SEQ ID NO: 2982205 - RNA, 18 nt, Human
gaccucaggugagaagca

SEQ ID NO: 2982206 - RNA, 19 nt, Human
gaccucaggugagaagcag

SEQ ID NO: 2982207 - RNA, 19 nt, Human
gaccucaggccugggggcu

SEQ ID NO: 2982208 - RNA, 21 nt, Human
gaccucaggugauccacccac

SEQ ID NO: 2982209 - RNA, 20 nt, Human
gaccucaggugauccaccca

SEQ ID NO: 2982210 - RNA, 21 nt, Human
gaccucaggugagaagcagag

SEQ ID NO: 2982211 - RNA, 19 nt, Human
gaccucaggugauccaccc

SEQ ID NO: 2982212 - RNA, 12 nt, Human
gacccucaugcu

SEQ ID NO: 2982213 - RNA, 14 nt, Human
gacccucaugcugc

SEQ ID NO: 2982214 - RNA, 16 nt, Human
gacccucaugcugcca

SEQ ID NO: 2982215 - RNA, 17 nt, Human
gacccucaugcugccaa

SEQ ID NO: 2982216 - RNA, 22 nt, Human
gaccucugcagcaauaaagcag

SEQ ID NO: 2982217 - RNA, 18 nt, Human
gaccucugcagcaauaaa

SEQ ID NO: 2982218 - RNA, 16 nt, Human
gaccucugcagcaaua

SEQ ID NO: 2982219 - RNA, 12 nt, Human
gacgccauccca

SEQ ID NO: 2982220 - RNA, 13 nt, Human
gacgccaucccag

SEQ ID NO: 2982221 - RNA, 19 nt, Human
gacgccaucccagccccaa

SEQ ID NO: 2982222 - RNA, 21 nt, Human
gacgccaucccagccccaaug

SEQ ID NO: 2982223 - RNA, 22 nt, Human
gacgcuacccgggaagggggcu

SEQ ID NO: 2982224 - RNA, 23 nt, Human
gacgcuacccgggaagggggcug

SEQ ID NO: 2982225 - RNA, 14 nt, Human
gacgcucucuggcc

SEQ ID NO: 2982226 - RNA, 16 nt, Human
gacgcugugcugcccu

SEQ ID NO: 2982227 - RNA, 17 nt, Human
gacgcugugcugcccug

SEQ ID NO: 2982228 - RNA, 18 nt, Human
gacgcugugcugcccugc

SEQ ID NO: 2982229 - RNA, 15 nt, Human
gacgcugugcugccc

SEQ ID NO: 2982230 - RNA, 17 nt, Human
gaauguuuucaaauguu

SEQ ID NO: 2982231 - RNA, 15 nt, Human
gaauuaacacaugau

SEQ ID NO: 2982232 - RNA, 14 nt, Human
gaauuaacacauga

SEQ ID NO: 2982233 - RNA, 19 nt, Human
gaauguuugccucugccuc

SEQ ID NO: 2982234 - RNA, 18 nt, Human
gaauguuugccucugccu

SEQ ID NO: 2982235 - RNA, 13 nt, Human
gaauuacauuugu

SEQ ID NO: 2982236 - RNA, 18 nt, Human
gaauuacauuuguauaaa

SEQ ID NO: 2982237 - RNA, 15 nt, Human
gaauuacauuuguau

SEQ ID NO: 2982238 - RNA, 20 nt, Human
gaauuacauuuguauaaaau

SEQ ID NO: 2982239 - RNA, 22 nt, Human
gaaugauuaugaauuacauuug

SEQ ID NO: 2982240 - RNA, 18 nt, Human
gaaugcacaaacagaggc

SEQ ID NO: 2982241 - RNA, 17 nt, Human
gaauguuugccucugcc

SEQ ID NO: 2982242 - RNA, 16 nt, Human
gaauguuugccucugc

SEQ ID NO: 2982243 - RNA, 19 nt, Human
gaaugcacaaacagaggcc

SEQ ID NO: 2982244 - RNA, 15 nt, Human
gaauguuugccucug

SEQ ID NO: 2982245 - RNA, 20 nt, Human
gaaugaugauccuaggcauu

SEQ ID NO: 2982246 - RNA, 14 nt, Human
gaaugaugccauga

SEQ ID NO: 2982247 - RNA, 14 nt, Human
gaaugauuaauuaa

SEQ ID NO: 2982248 - RNA, 14 nt, Human
gaaugauuaugaau

SEQ ID NO: 2982249 - RNA, 15 nt, Human
gaaugaauggcuaag

SEQ ID NO: 2982250 - RNA, 19 nt, Human
gacaaacugcauauguacu

SEQ ID NO: 2982251 - RNA, 14 nt, Human
gaauuaugaaacuu

SEQ ID NO: 2982252 - RNA, 20 nt, Human
gacacagcucuucuccaggc

SEQ ID NO: 2982253 - RNA, 19 nt, Human
gacacagcucuucuccagg

SEQ ID NO: 2982254 - RNA, 12 nt, Human
gacacagcucuu

SEQ ID NO: 2982255 - RNA, 15 nt, Human
gacacagauuggcca

SEQ ID NO: 2982256 - RNA, 21 nt, Human
gacacagcucuucuccaggcu

SEQ ID NO: 2982257 - RNA, 17 nt, Human
gacacagcucuucucca

SEQ ID NO: 2982258 - RNA, 14 nt, Human
gaaugaauggcuaa

SEQ ID NO: 2982259 - RNA, 22 nt, Human
gaauauugcugauggugcaaug

SEQ ID NO: 2982260 - RNA, 23 nt, Human
gaauauugcugauggugcaauga

SEQ ID NO: 2982261 - RNA, 24 nt, Human
gaauauugcugauggugcaaugac

SEQ ID NO: 2982262 - RNA, 22 nt, Human
gaauaucuccgucaacucauau

SEQ ID NO: 2982263 - RNA, 12 nt, Human
gaauauugcuga

SEQ ID NO: 2982264 - RNA, 13 nt, Human
gaauauugcugau

SEQ ID NO: 2982265 - RNA, 11 nt, Human
gaauauugcug

SEQ ID NO: 2982266 - RNA, 13 nt, Human
gaauauugccaau

SEQ ID NO: 2982267 - RNA, 15 nt, Human
gaauauauaaccagu

SEQ ID NO: 2982268 - RNA, 16 nt, Human
gagccccacccucaga

SEQ ID NO: 2982269 - RNA, 14 nt, Human
gagccccacagccc

SEQ ID NO: 2982270 - RNA, 13 nt, Human
gagccccacagcc

SEQ ID NO: 2982271 - RNA, 12 nt, Human
gagccccacagc

SEQ ID NO: 2982272 - RNA, 14 nt, Human
gagccccgaggccu

SEQ ID NO: 2982273 - RNA, 13 nt, Human
gagccccgaggcc

SEQ ID NO: 2982274 - RNA, 17 nt, Human
gagccccacccucagau

SEQ ID NO: 2982275 - RNA, 20 nt, Human
gagccccacagccccaucug

SEQ ID NO: 2982276 - RNA, 17 nt, Human
gagccccgaggccuucu

SEQ ID NO: 2982277 - RNA, 14 nt, Human
gagcagucaggaaa

SEQ ID NO: 2982278 - RNA, 14 nt, Human
gagcaucaggccag

SEQ ID NO: 2982279 - RNA, 21 nt, Human
gagcagggcucagcggggaca

SEQ ID NO: 2982280 - RNA, 13 nt, Human
gagcaugccugga

SEQ ID NO: 2982281 - RNA, 15 nt, Human
gagcaucaggccagg

SEQ ID NO: 2982282 - RNA, 16 nt, Human
gagcaucaggccaggc

SEQ ID NO: 2982283 - RNA, 13 nt, Human
gagcaucaggcca

SEQ ID NO: 2982284 - RNA, 17 nt, Human
gagcuguucacagccag

SEQ ID NO: 2982285 - RNA, 20 nt, Human
gagcuguucacagccagacu

SEQ ID NO: 2982286 - RNA, 14 nt, Human
gagcccugguggca

SEQ ID NO: 2982287 - RNA, 13 nt, Human
gagcccugguggc

SEQ ID NO: 2982288 - RNA, 22 nt, Human
gagcuguucacagccagacugg

SEQ ID NO: 2982289 - RNA, 14 nt, Human
gaggagaaacugga

SEQ ID NO: 2982290 - RNA, 12 nt, Human
gaggagaaacug

SEQ ID NO: 2982291 - RNA, 14 nt, Human
gaggagagaggacc

SEQ ID NO: 2982292 - RNA, 15 nt, Human
gaggagagaggaccc

SEQ ID NO: 2982293 - RNA, 12 nt, Human
gaggagagagga

SEQ ID NO: 2982294 - RNA, 20 nt, Human
gaggcagggucucacucugu

SEQ ID NO: 2982295 - RNA, 19 nt, Human
gaggcagggucucacucug

SEQ ID NO: 2982296 - RNA, 18 nt, Human
gaggcagggucucacucu

SEQ ID NO: 2982297 - RNA, 23 nt, Human
gaggacuuuucuuuguggcuucc

SEQ ID NO: 2982298 - RNA, 20 nt, Human
gaggacuuuucuuuguggcu

SEQ ID NO: 2982299 - RNA, 16 nt, Human
gaggacuuuucuuugu

SEQ ID NO: 2982300 - RNA, 18 nt, Human
gaggacuccaggcagcag

SEQ ID NO: 2982301 - RNA, 23 nt, Human
gaggacuccaggcagcagacaca

SEQ ID NO: 2982302 - RNA, 20 nt, Human
gaggacgcucucuggccuuc

SEQ ID NO: 2982303 - RNA, 21 nt, Human
gaggacgcucucuggccuucg

SEQ ID NO: 2982304 - RNA, 17 nt, Human
gaggcuccacuuggucu

SEQ ID NO: 2982305 - RNA, 18 nt, Human
gaggcugagaugggagaa

SEQ ID NO: 2982306 - RNA, 13 nt, Human
gaggcugaggcag

SEQ ID NO: 2982307 - RNA, 19 nt, Human
gaggcauuuguuugaacug

SEQ ID NO: 2982308 - RNA, 22 nt, Human
gaggcaugugaugagaggaaau

SEQ ID NO: 2982309 - RNA, 20 nt, Human
gaggcaugugaugagaggaa

SEQ ID NO: 2982310 - RNA, 21 nt, Human
gaggcaugugaugagaggaaa

SEQ ID NO: 2982311 - RNA, 12 nt, Human
gaggcuccacuu

SEQ ID NO: 2982312 - RNA, 15 nt, Human
gaggcuccacuuggu

SEQ ID NO: 2982313 - RNA, 21 nt, Human
gaggcauuuguuugaacugau

SEQ ID NO: 2982314 - RNA, 17 nt, Human
gagggccugcaagggag

SEQ ID NO: 2982315 - RNA, 21 nt, Human
gagggccugcaagggagugag

SEQ ID NO: 2982316 - RNA, 14 nt, Human
gagggccugcaagg

SEQ ID NO: 2982317 - RNA, 14 nt, Human
gagacggaguccca

SEQ ID NO: 2982318 - RNA, 19 nt, Human
gagacggagucccaccuug

SEQ ID NO: 2982319 - RNA, 16 nt, Human
gagacggagucccacc

SEQ ID NO: 2982320 - RNA, 18 nt, Human
gagacgggggcagagagg

SEQ ID NO: 2982321 - RNA, 18 nt, Human
gagaccugcccucaagag

SEQ ID NO: 2982322 - RNA, 21 nt, Human
gagacccugucucaaaaaaag

SEQ ID NO: 2982323 - RNA, 23 nt, Human
gagaaugaaagggcccagagagg

SEQ ID NO: 2982324 - RNA, 15 nt, Human
gagaaugaaagggcc

SEQ ID NO: 2982325 - RNA, 19 nt, Human
gacuuuuccaacccucauc

SEQ ID NO: 2982326 - RNA, 22 nt, Human
gacuuuuuauggcacuaguauu

SEQ ID NO: 2982327 - RNA, 14 nt, Human
gacuuuuccaaccc

SEQ ID NO: 2982328 - RNA, 13 nt, Human
gagacuccugcag

SEQ ID NO: 2982329 - RNA, 14 nt, Human
gagacuccugcagg

SEQ ID NO: 2982330 - RNA, 15 nt, Human
gagagccuuccaggg

SEQ ID NO: 2982331 - RNA, 16 nt, Human
gagagccuuccagggg

SEQ ID NO: 2982332 - RNA, 15 nt, Human
gagacuccauaguuu

SEQ ID NO: 2982333 - RNA, 18 nt, Human
gagagccuuccaggggug

SEQ ID NO: 2982334 - RNA, 20 nt, Human
gagagccuuccagggguggg

SEQ ID NO: 2982335 - RNA, 15 nt, Human
gagagcuagcagcag

SEQ ID NO: 2982336 - RNA, 21 nt, Human
gagagcuagcagcagggaggg

SEQ ID NO: 2982337 - RNA, 13 nt, Human
gagagcugggugu

SEQ ID NO: 2982338 - RNA, 20 nt, Human
gagagcugggugucaagagg

SEQ ID NO: 2982339 - RNA, 12 nt, Human
gagaggaaauca

SEQ ID NO: 2982340 - RNA, 15 nt, Human
gagaggacccccuga

SEQ ID NO: 2982341 - RNA, 16 nt, Human
gagaugcuagaacucc

SEQ ID NO: 2982342 - RNA, 20 nt, Human
gagaugcuagaacucccuuu

SEQ ID NO: 2982343 - RNA, 21 nt, Human
gagauugcaccacugcacucc

SEQ ID NO: 2982344 - RNA, 14 nt, Human
gagauuggaaggaa

SEQ ID NO: 2982345 - RNA, 21 nt, Human
gagauugugccccugcacucc

SEQ ID NO: 2982346 - RNA, 15 nt, Human
gcagcucuccccuuc

SEQ ID NO: 2982347 - RNA, 15 nt, Human
gcagccacauuccug

SEQ ID NO: 2982348 - RNA, 16 nt, Human
gcagccaggccacaag

SEQ ID NO: 2982349 - RNA, 18 nt, Human
gcagcccaccccucaaca

SEQ ID NO: 2982350 - RNA, 22 nt, Human
gcagaacagugauuaccaggga

SEQ ID NO: 2982351 - RNA, 18 nt, Human
gcagaacagugauuacca

SEQ ID NO: 2982352 - RNA, 13 nt, Human
gcagaggaaagca

SEQ ID NO: 2982353 - RNA, 14 nt, Human
gcagaggaaagcaa

SEQ ID NO: 2982354 - RNA, 18 nt, Human
gcagaggaaagcaaagga

SEQ ID NO: 2982355 - RNA, 20 nt, Human
gcagaggaaagcaaaggaga

SEQ ID NO: 2982356 - RNA, 21 nt, Human
gcagaggaaagcaaaggagau

SEQ ID NO: 2982357 - RNA, 14 nt, Human
gcagagggcacaga

SEQ ID NO: 2982358 - RNA, 17 nt, Human
gcagcauauucaggaag

SEQ ID NO: 2982359 - RNA, 18 nt, Human
gcagcauauucaggaagc

SEQ ID NO: 2982360 - RNA, 19 nt, Human
gcagcauauucaggaagcu

SEQ ID NO: 2982361 - RNA, 23 nt, Human
gcagcauauucaggaagcucagg

SEQ ID NO: 2982362 - RNA, 13 nt, Human
gcagaacagugau

SEQ ID NO: 2982363 - RNA, 12 nt, Human
gcagaacaguga

SEQ ID NO: 2982364 - RNA, 22 nt, Human
gcacuuuguucuggcucuucca

SEQ ID NO: 2982365 - RNA, 12 nt, Human
gcacuccccugc

SEQ ID NO: 2982366 - RNA, 15 nt, Human
gcacuccccugcugg

SEQ ID NO: 2982367 - RNA, 18 nt, Human
gcacuuuguucuggcucu

SEQ ID NO: 2982368 - RNA, 19 nt, Human
gcacuuuguucuggcucuu

SEQ ID NO: 2982369 - RNA, 13 nt, Human
gcacuccccugcu

SEQ ID NO: 2982370 - RNA, 14 nt, Human
gcacuccccugcug

SEQ ID NO: 2982371 - RNA, 14 nt, Human
gcacuccagccugg

SEQ ID NO: 2982372 - RNA, 18 nt, Human
gcaagugagagcugggug

SEQ ID NO: 2982373 - RNA, 17 nt, Human
gcacucagaagacacug

SEQ ID NO: 2982374 - RNA, 20 nt, Human
gcacucagaagacacugaug

SEQ ID NO: 2982375 - RNA, 14 nt, Human
gcagucuucaguuu

SEQ ID NO: 2982376 - RNA, 13 nt, Human
gcagugagacugg

SEQ ID NO: 2982377 - RNA, 14 nt, Human
gcagugagacuggg

SEQ ID NO: 2982378 - RNA, 22 nt, Human
gcaguuguugcccacagcugua

SEQ ID NO: 2982379 - RNA, 13 nt, Human
gcagugaugucac

SEQ ID NO: 2982380 - RNA, 17 nt, Human
gcauacguacacauuuu

SEQ ID NO: 2982381 - RNA, 16 nt, Human
gcauacguacacauuu

SEQ ID NO: 2982382 - RNA, 15 nt, Human
gcauacguacacauu

SEQ ID NO: 2982383 - RNA, 17 nt, Human
gcauuuaaaagauacag

SEQ ID NO: 2982384 - RNA, 16 nt, Human
gcauuuaaaagauaca

SEQ ID NO: 2982385 - RNA, 16 nt, Human
gcauugugggaagggg

SEQ ID NO: 2982386 - RNA, 18 nt, Human
gcauugugggaaggggag

SEQ ID NO: 2982387 - RNA, 22 nt, Human
gcauuuaaaagauacaguuacu

SEQ ID NO: 2982388 - RNA, 18 nt, Human
gcauuuaaaagauacagu

SEQ ID NO: 2982389 - RNA, 15 nt, Human
gcauuuacuuugugu

SEQ ID NO: 2982390 - RNA, 13 nt, Human
gcauugugggaag

SEQ ID NO: 2982391 - RNA, 15 nt, Human
gcauugugggaaggg

SEQ ID NO: 2982392 - RNA, 21 nt, Human
gcaugugaugagaggaaauca

SEQ ID NO: 2982393 - RNA, 18 nt, Human
gcaugugaugagaggaaa

SEQ ID NO: 2982394 - RNA, 19 nt, Human
gcaugugaugagaggaaau

SEQ ID NO: 2982395 - RNA, 16 nt, Human
gcaugguuuggagcug

SEQ ID NO: 2982396 - RNA, 21 nt, Human
gcauggcugccaaugggagcu

SEQ ID NO: 2982397 - RNA, 13 nt, Human
gcauccuggcacc

SEQ ID NO: 2982398 - RNA, 14 nt, Human
gcauccaguaucuu

SEQ ID NO: 2982399 - RNA, 17 nt, Human
gcauccaguaucuugaa

SEQ ID NO: 2982400 - RNA, 18 nt, Human
gcauccaguaucuugaag

SEQ ID NO: 2982401 - RNA, 21 nt, Human
gauuuuuuuuuccuucagugc

SEQ ID NO: 2982402 - RNA, 14 nt, Human
gcaaaaaggcagga

SEQ ID NO: 2982403 - RNA, 22 nt, Human
gcaaaagaugcuucucacugcc

SEQ ID NO: 2982404 - RNA, 17 nt, Human
gcaaaagaugcuucuca

SEQ ID NO: 2982405 - RNA, 16 nt, Human
gauuuuuuuuuccuuc

SEQ ID NO: 2982406 - RNA, 12 nt, Human
gauuucacucuc

SEQ ID NO: 2982407 - RNA, 17 nt, Human
gauuuuuuuuuccuuca

SEQ ID NO: 2982408 - RNA, 18 nt, Human
gauuuuuuuuuccuucag

SEQ ID NO: 2982409 - RNA, 11 nt, Human
gauuucacucu

SEQ ID NO: 2982410 - RNA, 18 nt, Human
gauuuaacagaaauguac

SEQ ID NO: 2982411 - RNA, 17 nt, Human
gauuuaacagaaaugua

SEQ ID NO: 2982412 - RNA, 16 nt, Human
gauuuaacagaaaugu

SEQ ID NO: 2982413 - RNA, 20 nt, Human
gauucuucugcuucagccuc

SEQ ID NO: 2982414 - RNA, 19 nt, Human
gauuuaacagaaauguaca

SEQ ID NO: 2982415 - RNA, 14 nt, Human
gauuuaauaugcaa

SEQ ID NO: 2982416 - RNA, 15 nt, Human
gauucuucugcuuca

SEQ ID NO: 2982417 - RNA, 13 nt, Human
gauucuucugcuu

SEQ ID NO: 2982418 - RNA, 12 nt, Human
gauucuucugcu

SEQ ID NO: 2982419 - RNA, 13 nt, Human
gcaacaggcuggg

SEQ ID NO: 2982420 - RNA, 15 nt, Human
gcaacaggcugggcu

SEQ ID NO: 2982421 - RNA, 14 nt, Human
gcaacaggcugggc

SEQ ID NO: 2982422 - RNA, 19 nt, Human
gcaacaggcugggcuucag

SEQ ID NO: 2982423 - RNA, 16 nt, Human
gcaacaggcugggcuu

SEQ ID NO: 2982424 - RNA, 16 nt, Human
gcaaccaccaccaacc

SEQ ID NO: 2982425 - RNA, 18 nt, Human
gcaaccaccaccaaccac

SEQ ID NO: 2982426 - RNA, 13 nt, Human
gcaaccaccacca

SEQ ID NO: 2982427 - RNA, 19 nt, Human
gcaaccuccgccucuuggg

SEQ ID NO: 2982428 - RNA, 16 nt, Human
gcaacccccagccugc

SEQ ID NO: 2982429 - RNA, 15 nt, Human
gcaacccccagccug

SEQ ID NO: 2982430 - RNA, 14 nt, Human
gcaacccccagccu

SEQ ID NO: 2982431 - RNA, 20 nt, Human
gcaaccuccgccucuugggu

SEQ ID NO: 2982432 - RNA, 15 nt, Human
gcaagugagagcugg

SEQ ID NO: 2982433 - RNA, 16 nt, Human
gcaagugagagcuggg

SEQ ID NO: 2982434 - RNA, 20 nt, Human
gaucaaaagguuaauaaagu

SEQ ID NO: 2982435 - RNA, 17 nt, Human
gauauuuuuuucuuuuc

SEQ ID NO: 2982436 - RNA, 23 nt, Human
gaucaaaagguuaauaaaguaau

SEQ ID NO: 2982437 - RNA, 19 nt, Human
gauccacccaccucagccu

SEQ ID NO: 2982438 - RNA, 18 nt, Human
gauccacccaccucagcc

SEQ ID NO: 2982439 - RNA, 21 nt, Human
gauccaagcuggucccacuca

SEQ ID NO: 2982440 - RNA, 21 nt, Human
gauccacccaccucagccucc

SEQ ID NO: 2982441 - RNA, 20 nt, Human
gauccacccaccucagccuc

SEQ ID NO: 2982442 - RNA, 22 nt, Human
gauccacccaccucagccuccc

SEQ ID NO: 2982443 - RNA, 19 nt, Human
gauccaagcuggucccacu

SEQ ID NO: 2982444 - RNA, 17 nt, Human
gauccaagcugguccca

SEQ ID NO: 2982445 - RNA, 16 nt, Human
gauccaagcugguccc

SEQ ID NO: 2982446 - RNA, 12 nt, Human
gauccaagcugg

SEQ ID NO: 2982447 - RNA, 21 nt, Human
gauacuguaucaugacaaaga

SEQ ID NO: 2982448 - RNA, 17 nt, Human
gauacuguaucaugaca

SEQ ID NO: 2982449 - RNA, 12 nt, Human
gauacugaaaua

SEQ ID NO: 2982450 - RNA, 23 nt, Human
gauacaguuacucagaauucucu

SEQ ID NO: 2982451 - RNA, 19 nt, Human
gauacaguuacucagaauu

SEQ ID NO: 2982452 - RNA, 16 nt, Human
gauacaguuacucaga

SEQ ID NO: 2982453 - RNA, 17 nt, Human
gaugcuucuucagagac

SEQ ID NO: 2982454 - RNA, 20 nt, Human
gaugcuucuucagagacucc

SEQ ID NO: 2982455 - RNA, 21 nt, Human
gaugcuucuucagagacuccu

SEQ ID NO: 2982456 - RNA, 23 nt, Human
gaugcuucucacugccaugccag

SEQ ID NO: 2982457 - RNA, 22 nt, Human
gaugauuggaggggggaggugg

SEQ ID NO: 2982458 - RNA, 13 nt, Human
gaugauccuaggc

SEQ ID NO: 2982459 - RNA, 14 nt, Human
gaugauccuaggca

SEQ ID NO: 2982460 - RNA, 15 nt, Human
gaucucuaacuucac

SEQ ID NO: 2982461 - RNA, 18 nt, Human
gaucucuugagccuggga

SEQ ID NO: 2982462 - RNA, 19 nt, Human
gaucucuugagccugggag

SEQ ID NO: 2982463 - RNA, 20 nt, Human
ggaaugauauaagguuuuuu

SEQ ID NO: 2982464 - RNA, 12 nt, Human
ggacacagcucu

SEQ ID NO: 2982465 - RNA, 19 nt, Human
ggaaugaaugucaguguga

SEQ ID NO: 2982466 - RNA, 12 nt, Human
ggacacccugug

SEQ ID NO: 2982467 - RNA, 13 nt, Human
ggacacagcucuu

SEQ ID NO: 2982468 - RNA, 16 nt, Human
ggaagcucagggccug

SEQ ID NO: 2982469 - RNA, 17 nt, Human
ggaagcucagggccugg

SEQ ID NO: 2982470 - RNA, 21 nt, Human
ggaagcucagggccuggcuca

SEQ ID NO: 2982471 - RNA, 15 nt, Human
ggaauaccugucccc

SEQ ID NO: 2982472 - RNA, 16 nt, Human
ggaauaccuguccccc

SEQ ID NO: 2982473 - RNA, 19 nt, Human
ggaauaccugucccccuga

SEQ ID NO: 2982474 - RNA, 19 nt, Human
ggaauacucuuauaucuau

SEQ ID NO: 2982475 - RNA, 16 nt, Human
ggaauauauaaccagu

SEQ ID NO: 2982476 - RNA, 18 nt, Human
ggacagucaccucaugga

SEQ ID NO: 2982477 - RNA, 17 nt, Human
ggacagucaccucaugg

SEQ ID NO: 2982478 - RNA, 21 nt, Human
ggacagucaccucauggaauu

SEQ ID NO: 2982479 - RNA, 17 nt, Human
ggacagggaggugaccc

SEQ ID NO: 2982480 - RNA, 23 nt, Human
ggacaggcauguucucugaggac

SEQ ID NO: 2982481 - RNA, 13 nt, Human
ggacacccuguga

SEQ ID NO: 2982482 - RNA, 23 nt, Human
ggacacccugugauggggcccug

SEQ ID NO: 2982483 - RNA, 19 nt, Human
ggacauauauuuuuuaaaa

SEQ ID NO: 2982484 - RNA, 13 nt, Human
ggacauggacaag

SEQ ID NO: 2982485 - RNA, 18 nt, Human
ggaagccgcuggggccag

SEQ ID NO: 2982486 - RNA, 22 nt, Human
ggaagccagcaggcucucaggc

SEQ ID NO: 2982487 - RNA, 23 nt, Human
ggaagccagcaggcucucaggcc

SEQ ID NO: 2982488 - RNA, 21 nt, Human
ggaagccagcaggcucucagg

SEQ ID NO: 2982489 - RNA, 23 nt, Human
ggaaaucaccgaaaacguggcug

SEQ ID NO: 2982490 - RNA, 19 nt, Human
ggaaaucaggguuaguauu

SEQ ID NO: 2982491 - RNA, 13 nt, Human
ggaaaggaaugca

SEQ ID NO: 2982492 - RNA, 24 nt, Human
ggaaaggaagugggacuggcacua

SEQ ID NO: 2982493 - RNA, 17 nt, Human
ggaaaggaaugcaaaga

SEQ ID NO: 2982494 - RNA, 19 nt, Human
ggaaagcaaaggagauugg

SEQ ID NO: 2982495 - RNA, 16 nt, Human
ggaaagaguaggaaga

SEQ ID NO: 2982496 - RNA, 17 nt, Human
ggaaagaguaggaagac

SEQ ID NO: 2982497 - RNA, 20 nt, Human
ggaaagacuuuuccaacccu

SEQ ID NO: 2982498 - RNA, 14 nt, Human
ggaaagaggcucug

SEQ ID NO: 2982499 - RNA, 16 nt, Human
ggaaaaaauaacaaug

SEQ ID NO: 2982500 - RNA, 19 nt, Human
gcuuuugugcauuaucuag

SEQ ID NO: 2982501 - RNA, 13 nt, Human
gcuuuugugcauu

SEQ ID NO: 2982502 - RNA, 15 nt, Human
gcuuuuuaauauuga

SEQ ID NO: 2982503 - RNA, 13 nt, Human
ggaaacugccagc

SEQ ID NO: 2982504 - RNA, 15 nt, Human
ggaaacccagcucug

SEQ ID NO: 2982505 - RNA, 20 nt, Human
ggaaacagcuaaugggacac

SEQ ID NO: 2982506 - RNA, 17 nt, Human
ggaaacagaugaaaagc

SEQ ID NO: 2982507 - RNA, 13 nt, Human
gcuuuugcauauu

SEQ ID NO: 2982508 - RNA, 19 nt, Human
gcuucuucagagacuccug

SEQ ID NO: 2982509 - RNA, 21 nt, Human
gcuucuucagagacuccugca

SEQ ID NO: 2982510 - RNA, 16 nt, Human
gcuugaccgugaggcc

SEQ ID NO: 2982511 - RNA, 17 nt, Human
gcuugaccgugaggcca

SEQ ID NO: 2982512 - RNA, 18 nt, Human
gcuugaccgugaggccag

SEQ ID NO: 2982513 - RNA, 19 nt, Human
gcuugaccgugaggccaga

SEQ ID NO: 2982514 - RNA, 23 nt, Human
gcuugggcuucauccuccucaga

SEQ ID NO: 2982515 - RNA, 16 nt, Human
gcuuggggaccagagc

SEQ ID NO: 2982516 - RNA, 16 nt, Human
gcuuaacuucacauau

SEQ ID NO: 2982517 - RNA, 16 nt, Human
gcuucuucagagacuc

SEQ ID NO: 2982518 - RNA, 17 nt, Human
gcuuaacuucacauauu

SEQ ID NO: 2982519 - RNA, 14 nt, Human
gcuuaacuucacau

SEQ ID NO: 2982520 - RNA, 22 nt, Human
gcuuucuacccagcgagcccug

SEQ ID NO: 2982521 - RNA, 19 nt, Human
gcuuucuacccagcgagcc

SEQ ID NO: 2982522 - RNA, 13 nt, Human
gcuuucuacccag

SEQ ID NO: 2982523 - RNA, 17 nt, Human
gcuuggggaccagagcu

SEQ ID NO: 2982524 - RNA, 18 nt, Human
gcuuggggaccagagcug

SEQ ID NO: 2982525 - RNA, 20 nt, Human
gcuuggggaccagagcugcc

SEQ ID NO: 2982526 - RNA, 21 nt, Human
gcuuggggaccagagcugcca

SEQ ID NO: 2982527 - RNA, 22 nt, Human
gcuuggggaccagagcugccac

SEQ ID NO: 2982528 - RNA, 19 nt, Human
gcuugggcuucauccuccu

SEQ ID NO: 2982529 - RNA, 15 nt, Human
gcugugcugcccugc

SEQ ID NO: 2982530 - RNA, 16 nt, Human
gcugugcugcccugcc

SEQ ID NO: 2982531 - RNA, 17 nt, Human
gcugugcugcccugccc

SEQ ID NO: 2982532 - RNA, 15 nt, Human
gcuguuggcuggggg

SEQ ID NO: 2982533 - RNA, 20 nt, Human
gcuguuggcugggggccuca

SEQ ID NO: 2982534 - RNA, 16 nt, Human
gcuguuggcugggggc

SEQ ID NO: 2982535 - RNA, 14 nt, Human
gcuguuggcugggg

SEQ ID NO: 2982536 - RNA, 16 nt, Human
gcugugcucuggacag

SEQ ID NO: 2982537 - RNA, 15 nt, Human
gcugugcucuggaca

SEQ ID NO: 2982538 - RNA, 14 nt, Human
gcugugcugcccug

SEQ ID NO: 2982539 - RNA, 13 nt, Human
gcugugcucugga

SEQ ID NO: 2982540 - RNA, 18 nt, Human
gcuguauuuuaaaagaau

SEQ ID NO: 2982541 - RNA, 20 nt, Human
gcuguauuuuaaaagaauga

SEQ ID NO: 2982542 - RNA, 21 nt, Human
gcuguauuuuaaaagaaugau

SEQ ID NO: 2982543 - RNA, 17 nt, Human
gcuguaucccaugagcc

SEQ ID NO: 2982544 - RNA, 12 nt, Human
gcugcugaaggc

SEQ ID NO: 2982545 - RNA, 13 nt, Human
gcugcugaaacaa

SEQ ID NO: 2982546 - RNA, 19 nt, Human
gcuggcuguuggcuggggg

SEQ ID NO: 2982547 - RNA, 18 nt, Human
gcuggcuguuggcugggg

SEQ ID NO: 2982548 - RNA, 18 nt, Human
gcuggcgugcaguggugc

SEQ ID NO: 2982549 - RNA, 15 nt, Human
gcuggcgugcagugg

SEQ ID NO: 2982550 - RNA, 14 nt, Human
gcuggcgugcagug

SEQ ID NO: 2982551 - RNA, 17 nt, Human
gcugggguggggaccuc

SEQ ID NO: 2982552 - RNA, 19 nt, Human
gcugggguggggaccucag

SEQ ID NO: 2982553 - RNA, 23 nt, Human
gcuggcuguuggcugggggccuc

SEQ ID NO: 2982554 - RNA, 20 nt, Human
gcuggcuguuggcugggggc

SEQ ID NO: 2982555 - RNA, 17 nt, Human
gcuggcuguuggcuggg

SEQ ID NO: 2982556 - RNA, 14 nt, Human
gcugggcagguugg

SEQ ID NO: 2982557 - RNA, 22 nt, Human
gcugggguggggaccucaggcc

SEQ ID NO: 2982558 - RNA, 23 nt, Human
gcugggguggggaccucaggccu

SEQ ID NO: 2982559 - RNA, 18 nt, Human
gcuggguucuacccaggu

SEQ ID NO: 2982560 - RNA, 17 nt, Human
gcuggguucuacccagg

SEQ ID NO: 2982561 - RNA, 20 nt, Human
gcuggguucuacccaggugc

SEQ ID NO: 2982562 - RNA, 21 nt, Human
gcuggguucuacccaggugcu

SEQ ID NO: 2982563 - RNA, 16 nt, Human
gcugccucucccauca

SEQ ID NO: 2982564 - RNA, 20 nt, Human
gcugccugggaucccucauc

SEQ ID NO: 2982565 - RNA, 13 nt, Human
gcugccuguucag

SEQ ID NO: 2982566 - RNA, 12 nt, Human
gcugccuguuca

SEQ ID NO: 2982567 - RNA, 17 nt, Human
gcugccuguucagcucc

SEQ ID NO: 2982568 - RNA, 21 nt, Human
gcugccugggaucccucaucc

SEQ ID NO: 2982569 - RNA, 17 nt, Human
gcugccccuggcagccc

SEQ ID NO: 2982570 - RNA, 20 nt, Human
gcugccccuggcagccccug

SEQ ID NO: 2982571 - RNA, 18 nt, Human
gcugccccuggcagcccc

SEQ ID NO: 2982572 - RNA, 19 nt, Human
gcugccccuggcagccccu

SEQ ID NO: 2982573 - RNA, 16 nt, Human
gcugccccugcacagc

SEQ ID NO: 2982574 - RNA, 18 nt, Human
gcugcacccucaggcagg

SEQ ID NO: 2982575 - RNA, 19 nt, Human
gcugcacccucaggcaggu

SEQ ID NO: 2982576 - RNA, 13 nt, Human
gcugcaccggcug

SEQ ID NO: 2982577 - RNA, 16 nt, Human
gcugcacccucaggca

SEQ ID NO: 2982578 - RNA, 18 nt, Human
gcugagggugagugggug

SEQ ID NO: 2982579 - RNA, 23 nt, Human
gcugagggugagugggugaauaa

SEQ ID NO: 2982580 - RNA, 14 nt, Human
gcugaggugggagg

SEQ ID NO: 2982581 - RNA, 13 nt, Human
gcugaggcaggag

SEQ ID NO: 2982582 - RNA, 14 nt, Human
gcugaggcaggaga

SEQ ID NO: 2982583 - RNA, 21 nt, Human
gcugaggcaggagacuggcgu

SEQ ID NO: 2982584 - RNA, 16 nt, Human
gcugaggcaggagacu

SEQ ID NO: 2982585 - RNA, 22 nt, Human
gcugagauccuggacugagggg

SEQ ID NO: 2982586 - RNA, 14 nt, Human
gcugagauccugga

SEQ ID NO: 2982587 - RNA, 16 nt, Human
gcugagauccuggacu

SEQ ID NO: 2982588 - RNA, 19 nt, Human
gcccaggaguuuggccaga

SEQ ID NO: 2982589 - RNA, 20 nt, Human
gcccaggaguuuggccagaa

SEQ ID NO: 2982590 - RNA, 11 nt, Human
gcccaggcagg

SEQ ID NO: 2982591 - RNA, 18 nt, Human
gcccaggaguuuggccag

SEQ ID NO: 2982592 - RNA, 12 nt, Human
gcccaggccccu

SEQ ID NO: 2982593 - RNA, 11 nt, Human
gcccaggcccc

SEQ ID NO: 2982594 - RNA, 21 nt, Human
gcccaggccccugccacccug

SEQ ID NO: 2982595 - RNA, 20 nt, Human
gcccaggccccugccacccu

SEQ ID NO: 2982596 - RNA, 22 nt, Human
gcccaggccccugccacccugg

SEQ ID NO: 2982597 - RNA, 18 nt, Human
gcccaggccccugccacc

SEQ ID NO: 2982598 - RNA, 13 nt, Human
gcauuuagaugua

SEQ ID NO: 2982599 - RNA, 19 nt, Human
gcauuuaggccaugggaca

SEQ ID NO: 2982600 - RNA, 12 nt, Human
gcauuuagaugu

SEQ ID NO: 2982601 - RNA, 18 nt, Human
gcauuuacuuuguguuca

SEQ ID NO: 2982602 - RNA, 15 nt, Human
gcccacgcccccacu

SEQ ID NO: 2982603 - RNA, 16 nt, Human
gcccacgcccccacug

SEQ ID NO: 2982604 - RNA, 17 nt, Human
gcccacgcccccacugg

SEQ ID NO: 2982605 - RNA, 21 nt, Human
gcccacgcccccacuggugac

SEQ ID NO: 2982606 - RNA, 24 nt, Human
gcccaggaaaggcuccaggagcag

SEQ ID NO: 2982607 - RNA, 22 nt, Human
gcccaggaaaggcuccaggagc

SEQ ID NO: 2982608 - RNA, 23 nt, Human
gcccaggaaaggcuccaggagca

SEQ ID NO: 2982609 - RNA, 13 nt, Human
gcccacuucugcc

SEQ ID NO: 2982610 - RNA, 21 nt, Human
gcccacgcuggagugcaguga

SEQ ID NO: 2982611 - RNA, 19 nt, Human
gcccacgcuggagugcagu

SEQ ID NO: 2982612 - RNA, 23 nt, Human
gcccacgcuggagugcagugagc

SEQ ID NO: 2982613 - RNA, 12 nt, Human
gccccuggcagc

SEQ ID NO: 2982614 - RNA, 15 nt, Human
gccccuggcagcccc

SEQ ID NO: 2982615 - RNA, 16 nt, Human
gccccugcugguucag

SEQ ID NO: 2982616 - RNA, 15 nt, Human
gccccugcugguuca

SEQ ID NO: 2982617 - RNA, 12 nt, Human
gccccugcuggu

SEQ ID NO: 2982618 - RNA, 18 nt, Human
gccccacagccccaucug

SEQ ID NO: 2982619 - RNA, 15 nt, Human
gccccaccagugccu

SEQ ID NO: 2982620 - RNA, 14 nt, Human
gccccaccagugcc

SEQ ID NO: 2982621 - RNA, 13 nt, Human
gccccaccagugc

SEQ ID NO: 2982622 - RNA, 22 nt, Human
gccccaccagugccucucccug

SEQ ID NO: 2982623 - RNA, 18 nt, Human
gccccaccagugccucuc

SEQ ID NO: 2982624 - RNA, 17 nt, Human
gccccaccagugccucu

SEQ ID NO: 2982625 - RNA, 16 nt, Human
gccccaccagugccuc

SEQ ID NO: 2982626 - RNA, 20 nt, Human
gccccaaaacucuccucugc

SEQ ID NO: 2982627 - RNA, 21 nt, Human
gccccaaaacucuccucugcu

SEQ ID NO: 2982628 - RNA, 11 nt, Human
gccccaaaagg

SEQ ID NO: 2982629 - RNA, 14 nt, Human
gccuccauccugag

SEQ ID NO: 2982630 - RNA, 13 nt, Human
gccuccauccuga

SEQ ID NO: 2982631 - RNA, 22 nt, Human
gccuccuuugugaggaagccgc

SEQ ID NO: 2982632 - RNA, 13 nt, Human
gccucgaacuggc

SEQ ID NO: 2982633 - RNA, 16 nt, Human
gccucgaacuggcugc

SEQ ID NO: 2982634 - RNA, 14 nt, Human
gccucugggacugg

SEQ ID NO: 2982635 - RNA, 12 nt, Human
gccuccauccug

SEQ ID NO: 2982636 - RNA, 22 nt, Human
gccucauguccacugguucuuc

SEQ ID NO: 2982637 - RNA, 17 nt, Human
gccuacaggagugagca

SEQ ID NO: 2982638 - RNA, 19 nt, Human
gccuagcauacguacacau

SEQ ID NO: 2982639 - RNA, 12 nt, Human
gccuagcauacg

SEQ ID NO: 2982640 - RNA, 16 nt, Human
gccuacaggagugagc

SEQ ID NO: 2982641 - RNA, 16 nt, Human
gcccugugggccccca

SEQ ID NO: 2982642 - RNA, 17 nt, Human
gcccugugggcccccaa

SEQ ID NO: 2982643 - RNA, 21 nt, Human
gcccuuaccugccaggaagcc

SEQ ID NO: 2982644 - RNA, 22 nt, Human
gcccuuaccugccaggaagcca

SEQ ID NO: 2982645 - RNA, 23 nt, Human
gcccuuaccugccaggaagccag

SEQ ID NO: 2982646 - RNA, 14 nt, Human
gcccugcccaccug

SEQ ID NO: 2982647 - RNA, 15 nt, Human
gcccugcccaccugg

SEQ ID NO: 2982648 - RNA, 16 nt, Human
gccccuggcagccccu

SEQ ID NO: 2982649 - RNA, 17 nt, Human
gccccuggcagccccug

SEQ ID NO: 2982650 - RNA, 16 nt, Human
gcuaguugggcuuccu

SEQ ID NO: 2982651 - RNA, 14 nt, Human
gcuaguugggcuuc

SEQ ID NO: 2982652 - RNA, 22 nt, Human
gcuaggugacauauacauacuu

SEQ ID NO: 2982653 - RNA, 20 nt, Human
gcuaggaccccuccaugugg

SEQ ID NO: 2982654 - RNA, 22 nt, Human
gcuaagugauccucccaccuca

SEQ ID NO: 2982655 - RNA, 18 nt, Human
gcuaagugauccucccac

SEQ ID NO: 2982656 - RNA, 18 nt, Human
gcucagggccuggcucag

SEQ ID NO: 2982657 - RNA, 19 nt, Human
gcucagggccuggcucagg

SEQ ID NO: 2982658 - RNA, 13 nt, Human
gcucaggaguuug

SEQ ID NO: 2982659 - RNA, 17 nt, Human
gcucagggccuggcuca

SEQ ID NO: 2982660 - RNA, 20 nt, Human
gcucagggccuggcucaggu

SEQ ID NO: 2982661 - RNA, 23 nt, Human
gccuucggccuccauccugaggc

SEQ ID NO: 2982662 - RNA, 16 nt, Human
gccuucucugaaggac

SEQ ID NO: 2982663 - RNA, 15 nt, Human
gccuucucugaagga

SEQ ID NO: 2982664 - RNA, 17 nt, Human
gccuguucagcuccagc

SEQ ID NO: 2982665 - RNA, 16 nt, Human
gccuguucagcuccag

SEQ ID NO: 2982666 - RNA, 14 nt, Human
gccuguucagcucc

SEQ ID NO: 2982667 - RNA, 15 nt, Human
gccuguucagcucca

SEQ ID NO: 2982668 - RNA, 14 nt, Human
gccuugaacuuuga

SEQ ID NO: 2982669 - RNA, 19 nt, Human
gccugugccucugggacug

SEQ ID NO: 2982670 - RNA, 23 nt, Human
gccugggaucccucauccucaua

SEQ ID NO: 2982671 - RNA, 21 nt, Human
gccugggaucccucauccuca

SEQ ID NO: 2982672 - RNA, 11 nt, Human
gccugggcaga

SEQ ID NO: 2982673 - RNA, 21 nt, Human
gccugggcaacagagcaagac

SEQ ID NO: 2982674 - RNA, 20 nt, Human
gccugggcaacagagcaaga

SEQ ID NO: 2982675 - RNA, 18 nt, Human
gccugggcaacagagcaa

SEQ ID NO: 2982676 - RNA, 16 nt, Human
gccuugaccauucucc

SEQ ID NO: 2982677 - RNA, 21 nt, Human
gccuugaccauucuccaccug

SEQ ID NO: 2982678 - RNA, 22 nt, Human
gccuugaccauucuccaccugc

SEQ ID NO: 2982679 - RNA, 23 nt, Human
gccuugaacuuugaccucugcag

SEQ ID NO: 2982680 - RNA, 17 nt, Human
gcgauucuucugcuuca

SEQ ID NO: 2982681 - RNA, 22 nt, Human
gcgauucuucugcuucagccuc

SEQ ID NO: 2982682 - RNA, 23 nt, Human
gccuugaccauucuccaccugcc

SEQ ID NO: 2982683 - RNA, 23 nt, Human
gcgauucuucugcuucagccucc

SEQ ID NO: 2982684 - RNA, 20 nt, Human
gcgcagcauauucaggaagc

SEQ ID NO: 2982685 - RNA, 21 nt, Human
gcgcagcauauucaggaagcu

SEQ ID NO: 2982686 - RNA, 15 nt, Human
gcggcuggcagccca

SEQ ID NO: 2982687 - RNA, 16 nt, Human
gcggccuuuggcuuca

SEQ ID NO: 2982688 - RNA, 19 nt, Human
aaaauaauuagguauuuuc

SEQ ID NO: 2982689 - RNA, 14 nt, Human
aaaauaaucucuga

SEQ ID NO: 2982690 - RNA, 11 nt, Human
aaaauaauuuu

SEQ ID NO: 2982691 - RNA, 13 nt, Human
aaaauaagucuga

SEQ ID NO: 2982692 - RNA, 17 nt, Human
aaaauaauuuuuauauu

SEQ ID NO: 2982693 - RNA, 16 nt, Human
aaaauaauuuuuauau

SEQ ID NO: 2982694 - RNA, 14 nt, Human
aaaauacacacuca

SEQ ID NO: 2982695 - RNA, 13 nt, Human
aaaauaccaagga

SEQ ID NO: 2982696 - RNA, 21 nt, Human
aaaaggaagcuuacaugccua

SEQ ID NO: 2982697 - RNA, 13 nt, Human
aaaaggaugcaca

SEQ ID NO: 2982698 - RNA, 22 nt, Human
aaaaggagccaauuuaaagaaa

SEQ ID NO: 2982699 - RNA, 22 nt, Human
aaaaggaugcacagaguuguua

SEQ ID NO: 2982700 - RNA, 19 nt, Human
aaaaggaugcacagaguug

SEQ ID NO: 2982701 - RNA, 15 nt, Human
aaaaggaugcacaga

SEQ ID NO: 2982702 - RNA, 14 nt, Human
aaaaggaugcacag

SEQ ID NO: 2982703 - RNA, 16 nt, Human
aaaagguuaauaaagu

SEQ ID NO: 2982704 - RNA, 17 nt, Human
aaaagguuaauaaagua

SEQ ID NO: 2982705 - RNA, 11 nt, Human
aaaaggcagga

SEQ ID NO: 2982706 - RNA, 19 nt, Human
aaaagguaugcaaucaaau

SEQ ID NO: 2982707 - RNA, 16 nt, Human
aaaauauuuuccugcc

SEQ ID NO: 2982708 - RNA, 17 nt, Human
aaaaucucaauauuuca

SEQ ID NO: 2982709 - RNA, 13 nt, Human
aaaauagaaaguu

SEQ ID NO: 2982710 - RNA, 17 nt, Human
aaaauagaauugacauu

SEQ ID NO: 2982711 - RNA, 20 nt, Human
aaaaugguguuuuaucuucu

SEQ ID NO: 2982712 - RNA, 22 nt, Human
aaaaugguagcauuuuaaacaa

SEQ ID NO: 2982713 - RNA, 18 nt, Human
aaaaugguuuaaaugguc

SEQ ID NO: 2982714 - RNA, 16 nt, Human
aaaaugguuuaaaugg

SEQ ID NO: 2982715 - RNA, 22 nt, Human
gggcugggccucggaccccacu

SEQ ID NO: 2982716 - RNA, 17 nt, Human
gggcuggguucuaccca

SEQ ID NO: 2982717 - RNA, 16 nt, Human
aaaauggguuuuacug

SEQ ID NO: 2982718 - RNA, 12 nt, Human
gggcugggcaga

SEQ ID NO: 2982719 - RNA, 15 nt, Human
gggcugggcagagga

SEQ ID NO: 2982720 - RNA, 23 nt, Human
gggcugcucccaccuggcucugu

SEQ ID NO: 2982721 - RNA, 22 nt, Human
gggcugcucccaccuggcucug

SEQ ID NO: 2982722 - RNA, 21 nt, Human
gggcugcucccaccuggcucu

SEQ ID NO: 2982723 - RNA, 18 nt, Human
gggcugcucccaccuggc

SEQ ID NO: 2982724 - RNA, 20 nt, Human
gggcugcaccggcuggccug

SEQ ID NO: 2982725 - RNA, 21 nt, Human
gggcugcaccggcuggccugg

SEQ ID NO: 2982726 - RNA, 13 nt, Human
gggcugcucccac

SEQ ID NO: 2982727 - RNA, 19 nt, Human
gggcucagcggggacagcu

SEQ ID NO: 2982728 - RNA, 17 nt, Human
gggcucagcggggacag

SEQ ID NO: 2982729 - RNA, 15 nt, Human
gggcuaguugggcuu

SEQ ID NO: 2982730 - RNA, 22 nt, Human
gggcucagcaaaagaugcuucu

SEQ ID NO: 2982731 - RNA, 10 nt, Human
gggcuccaga

SEQ ID NO: 2982732 - RNA, 13 nt, Human
gggcuccagacac

SEQ ID NO: 2982733 - RNA, 21 nt, Human
gggcucagcggggacagcucc

SEQ ID NO: 2982734 - RNA, 17 nt, Human
gggcugcaccggcuggc

SEQ ID NO: 2982735 - RNA, 19 nt, Human
gggcugcaccggcuggccu

SEQ ID NO: 2982736 - RNA, 19 nt, Human
gggcucccagccaggcccu

SEQ ID NO: 2982737 - RNA, 17 nt, Human
gggcucccagccaggcc

SEQ ID NO: 2982738 - RNA, 15 nt, Human
gggcucccagccagg

SEQ ID NO: 2982739 - RNA, 22 nt, Human
gggccucgguguggagaagcgg

SEQ ID NO: 2982740 - RNA, 23 nt, Human
gggccucugcggagcacacuggc

SEQ ID NO: 2982741 - RNA, 21 nt, Human
gggccucugcggagcacacug

SEQ ID NO: 2982742 - RNA, 18 nt, Human
gggccucuuaugggcugg

SEQ ID NO: 2982743 - RNA, 15 nt, Human
gggccucagugccac

SEQ ID NO: 2982744 - RNA, 14 nt, Human
gggccucagugcca

SEQ ID NO: 2982745 - RNA, 13 nt, Human
gggccucagugcc

SEQ ID NO: 2982746 - RNA, 21 nt, Human
gggcggugagaggggaacaga

SEQ ID NO: 2982747 - RNA, 15 nt, Human
gggcgugguggcagg

SEQ ID NO: 2982748 - RNA, 12 nt, Human
gggccaggagcc

SEQ ID NO: 2982749 - RNA, 13 nt, Human
gggccaggagccu

SEQ ID NO: 2982750 - RNA, 14 nt, Human
gggccaggagccuc

SEQ ID NO: 2982751 - RNA, 17 nt, Human
gggccaugucagacaca

SEQ ID NO: 2982752 - RNA, 16 nt, Human
gggguaaggugcaucu

SEQ ID NO: 2982753 - RNA, 13 nt, Human
ggggguggccucc

SEQ ID NO: 2982754 - RNA, 15 nt, Human
gggggcugggcagag

SEQ ID NO: 2982755 - RNA, 21 nt, Human
ggggucacucuggcagcucag

SEQ ID NO: 2982756 - RNA, 11 nt, Human
gggggcuggga

SEQ ID NO: 2982757 - RNA, 14 nt, Human
gggggcugcuccca

SEQ ID NO: 2982758 - RNA, 21 nt, Human
gggggcagugcucacccacac

SEQ ID NO: 2982759 - RNA, 17 nt, Human
gggggaucacagccucu

SEQ ID NO: 2982760 - RNA, 19 nt, Human
ggggccaguuggucccccu

SEQ ID NO: 2982761 - RNA, 14 nt, Human
ggggaccagagcug

SEQ ID NO: 2982762 - RNA, 18 nt, Human
aaaauguauguguaagua

SEQ ID NO: 2982763 - RNA, 12 nt, Human
ggggaccagagc

SEQ ID NO: 2982764 - RNA, 13 nt, Human
ggggaccagagcu

SEQ ID NO: 2982765 - RNA, 15 nt, Human
aaacauuucauuucc

SEQ ID NO: 2982766 - RNA, 19 nt, Human
aaacauuuugucauauaag

SEQ ID NO: 2982767 - RNA, 14 nt, Human
gggucacucuggca

SEQ ID NO: 2982768 - RNA, 20 nt, Human
gggucacucuggcagcucag

SEQ ID NO: 2982769 - RNA, 22 nt, Human
aaaccugugucucugagaguag

SEQ ID NO: 2982770 - RNA, 16 nt, Human
gguauagauguugcua

SEQ ID NO: 2982771 - RNA, 20 nt, Human
gguaggguaagugagagagg

SEQ ID NO: 2982772 - RNA, 14 nt, Human
gguaucaggugcug

SEQ ID NO: 2982773 - RNA, 20 nt, Human
gguaaggaauaccugucccc

SEQ ID NO: 2982774 - RNA, 14 nt, Human
ggucagugcaaaua

SEQ ID NO: 2982775 - RNA, 19 nt, Human
gguaucaggugcugccauc

SEQ ID NO: 2982776 - RNA, 22 nt, Human
aaacuugauguguuaucucuua

SEQ ID NO: 2982777 - RNA, 18 nt, Human
aaacuuuacuauggcccu

SEQ ID NO: 2982778 - RNA, 19 nt, Human
aaacuuaaucuaaauggaa

SEQ ID NO: 2982779 - RNA, 15 nt, Human
gggugggacacccug

SEQ ID NO: 2982780 - RNA, 18 nt, Human
gggugggacacccuguga

SEQ ID NO: 2982781 - RNA, 19 nt, Human
aaacuguuaauaguucagg

SEQ ID NO: 2982782 - RNA, 20 nt, Human
aaacguggcugcuucaagga

SEQ ID NO: 2982783 - RNA, 21 nt, Human
aaacguggcugcuucaaggau

SEQ ID NO: 2982784 - RNA, 20 nt, Human
ggguuuuauuguuuaaaauc

SEQ ID NO: 2982785 - RNA, 20 nt, Human
ggguuuugccauguuggcca

SEQ ID NO: 2982786 - RNA, 23 nt, Human
ggguuuugccauguuggccaggc

SEQ ID NO: 2982787 - RNA, 18 nt, Human
gguaacuagggaagauaa

SEQ ID NO: 2982788 - RNA, 22 nt, Human
aaauaucccuuggacauuuuau

SEQ ID NO: 2982789 - RNA, 23 nt, Human
aaauaucccuuggacauuuuaug

SEQ ID NO: 2982790 - RNA, 22 nt, Human
aaauaucacuugucaauaaaau

SEQ ID NO: 2982791 - RNA, 18 nt, Human
aaauauaugcuaagucuu

SEQ ID NO: 2982792 - RNA, 21 nt, Human
aaauaccagccaguaaauggg

SEQ ID NO: 2982793 - RNA, 20 nt, Human
aaauaccagccaguaaaugg

SEQ ID NO: 2982794 - RNA, 21 nt, Human
aaauaccaugccauuuaaagc

SEQ ID NO: 2982795 - RNA, 19 nt, Human
aaauaccagccaguaaaug

SEQ ID NO: 2982796 - RNA, 16 nt, Human
guacacacacauacac

SEQ ID NO: 2982797 - RNA, 21 nt, Human
aaauacgugggcauucaaaug

SEQ ID NO: 2982798 - RNA, 20 nt, Human
aaauacgugggcauucaaau

SEQ ID NO: 2982799 - RNA, 15 nt, Human
aaauauaggaacuua

SEQ ID NO: 2982800 - RNA, 21 nt, Human
aaauauugguugggaugacuu

SEQ ID NO: 2982801 - RNA, 19 nt, Human
aaaucagccugcuccagcu

SEQ ID NO: 2982802 - RNA, 21 nt, Human
aaaucagccugcuccagcugu

SEQ ID NO: 2982803 - RNA, 23 nt, Human
aaaucagccugcuccagcuguuc

SEQ ID NO: 2982804 - RNA, 22 nt, Human
aaauauguuucacacaaacaag

SEQ ID NO: 2982805 - RNA, 14 nt, Human
aaauauguuucaca

SEQ ID NO: 2982806 - RNA, 23 nt, Human
aaauaucugaaaauguaugugua

SEQ ID NO: 2982807 - RNA, 22 nt, Human
aaauaucugaaaauguaugugu

SEQ ID NO: 2982808 - RNA, 21 nt, Human
aaauaucugaaaauguaugug

SEQ ID NO: 2982809 - RNA, 19 nt, Human
aaauaucugaaaauguaug

SEQ ID NO: 2982810 - RNA, 18 nt, Human
aaauaucugaaaauguau

SEQ ID NO: 2982811 - RNA, 17 nt, Human
aaauaucugaaaaugua

SEQ ID NO: 2982812 - RNA, 14 nt, Human
aaauaucugaaaau

SEQ ID NO: 2982813 - RNA, 12 nt, Human
aaauaucugaaa

SEQ ID NO: 2982814 - RNA, 13 nt, Human
aaauaugcaaagc

SEQ ID NO: 2982815 - RNA, 15 nt, Human
aaauaugcaaagcac

SEQ ID NO: 2982816 - RNA, 16 nt, Human
aaauaugcaaagcacu

SEQ ID NO: 2982817 - RNA, 17 nt, Human
aaauaugcaaagcacug

SEQ ID NO: 2982818 - RNA, 17 nt, Human
guaacauagcugugauu

SEQ ID NO: 2982819 - RNA, 16 nt, Human
guaacaagccacccca

SEQ ID NO: 2982820 - RNA, 19 nt, Human
guaacaggaaaauuuuaaa

SEQ ID NO: 2982821 - RNA, 17 nt, Human
aaauaauuagguauuuu

SEQ ID NO: 2982822 - RNA, 13 nt, Human
guaaacacaucua

SEQ ID NO: 2982823 - RNA, 22 nt, Human
aaaguguauuuuuuuacuaaua

SEQ ID NO: 2982824 - RNA, 22 nt, Human
aaauaaugugaaacuggauuaa

SEQ ID NO: 2982825 - RNA, 14 nt, Human
aaauaaugugaaac

SEQ ID NO: 2982826 - RNA, 13 nt, Human
guaauaaacucau

SEQ ID NO: 2982827 - RNA, 21 nt, Human
guaauuuuuuuaucgucacug

SEQ ID NO: 2982828 - RNA, 20 nt, Human
guaauuugugauacaaugcu

SEQ ID NO: 2982829 - RNA, 17 nt, Human
guaauuugugauacaau

SEQ ID NO: 2982830 - RNA, 15 nt, Human
guaauuugugauaca

SEQ ID NO: 2982831 - RNA, 23 nt, Human
guaauccuagcacuuugggaggc

SEQ ID NO: 2982832 - RNA, 21 nt, Human
aaagggguaggguuuaaagau

SEQ ID NO: 2982833 - RNA, 22 nt, Human
aaagggcuguuauaaucuuuca

SEQ ID NO: 2982834 - RNA, 20 nt, Human
aaagggcuguuauaaucuuu

SEQ ID NO: 2982835 - RNA, 20 nt, Human
aaagggcccagagagggugg

SEQ ID NO: 2982836 - RNA, 20 nt, Human
aaagggauggcaagaugugg

SEQ ID NO: 2982837 - RNA, 12 nt, Human
gguggcuggguu

SEQ ID NO: 2982838 - RNA, 18 nt, Human
gguggcuggguuggaggg

SEQ ID NO: 2982839 - RNA, 17 nt, Human
ggugggacacccuguga

SEQ ID NO: 2982840 - RNA, 13 nt, Human
ggugggacacccu

SEQ ID NO: 2982841 - RNA, 16 nt, Human
ggugggacacccugug

SEQ ID NO: 2982842 - RNA, 19 nt, Human
gguggggaccucaggccug

SEQ ID NO: 2982843 - RNA, 22 nt, Human
aaagcugccagccgagauagcc

SEQ ID NO: 2982844 - RNA, 12 nt, Human
aaagcugccagc

SEQ ID NO: 2982845 - RNA, 13 nt, Human
aaagcugccagcc

SEQ ID NO: 2982846 - RNA, 13 nt, Human
aaagcagugcaug

SEQ ID NO: 2982847 - RNA, 16 nt, Human
aaagcuaggccuggcc

SEQ ID NO: 2982848 - RNA, 14 nt, Human
aaagcuaggccugg

SEQ ID NO: 2982849 - RNA, 19 nt, Human
aaacuuuaugcuaagugaa

SEQ ID NO: 2982850 - RNA, 12 nt, Human
aaacuuuaugcu

SEQ ID NO: 2982851 - RNA, 21 nt, Human
ggugcugccauccagguucag

SEQ ID NO: 2982852 - RNA, 14 nt, Human
gguggcaccagcag

SEQ ID NO: 2982853 - RNA, 20 nt, Human
gguggcaccagcagccugga

SEQ ID NO: 2982854 - RNA, 16 nt, Human
aaagcagaacagugau

SEQ ID NO: 2982855 - RNA, 11 nt, Human
gguguggggga

SEQ ID NO: 2982856 - RNA, 13 nt, Human
ggugugggggaag

SEQ ID NO: 2982857 - RNA, 14 nt, Human
gguguggagaagcg

SEQ ID NO: 2982858 - RNA, 23 nt, Human
gguguggagaagcggcuggcagc

SEQ ID NO: 2982859 - RNA, 12 nt, Human
gguguggagaag

SEQ ID NO: 2982860 - RNA, 13 nt, Human
ggugggggccucg

SEQ ID NO: 2982861 - RNA, 17 nt, Human
gguguuuccuggcacug

SEQ ID NO: 2982862 - RNA, 19 nt, Human
gguguuuccuggcacugcu

SEQ ID NO: 2982863 - RNA, 17 nt, Human
gguucccauuugcuccu

SEQ ID NO: 2982864 - RNA, 22 nt, Human
gguucccuuuuuuggcugcuga

SEQ ID NO: 2982865 - RNA, 23 nt, Human
gguucccuuugacgccaucccag

SEQ ID NO: 2982866 - RNA, 22 nt, Human
gguucccuuugacgccauccca

SEQ ID NO: 2982867 - RNA, 19 nt, Human
aaaguacacuguuucaaac

SEQ ID NO: 2982868 - RNA, 18 nt, Human
aaaguacacuguuucaaa

SEQ ID NO: 2982869 - RNA, 22 nt, Human
aaaguaauuuggaaauuagguu

SEQ ID NO: 2982870 - RNA, 14 nt, Human
aaaguaauuuggaa

SEQ ID NO: 2982871 - RNA, 22 nt, Human
aaaguagaagucuuagauguau

SEQ ID NO: 2982872 - RNA, 20 nt, Human
aaaguagaagucuuagaugu

SEQ ID NO: 2982873 - RNA, 21 nt, Human
aaaguaucccuacuguaauuu

SEQ ID NO: 2982874 - RNA, 22 nt, Human
aaaguagaucaugcauagagug

SEQ ID NO: 2982875 - RNA, 21 nt, Human
aaaguguauuuuuuuacuaau

SEQ ID NO: 2982876 - RNA, 14 nt, Human
aaaguguauuuuuu

SEQ ID NO: 2982877 - RNA, 15 nt, Human
gguuucagaaaugug

SEQ ID NO: 2982878 - RNA, 16 nt, Human
gguuucuaaagcugcc

SEQ ID NO: 2982879 - RNA, 22 nt, Human
gguuucuaaagcugccagccga

SEQ ID NO: 2982880 - RNA, 19 nt, Human
gguuuuauuguuuaaaauc

SEQ ID NO: 2982881 - RNA, 17 nt, Human
gguuuucacauuggaaa

SEQ ID NO: 2982882 - RNA, 20 nt, Human
gguuuguaaauuaacuuuua

SEQ ID NO: 2982883 - RNA, 15 nt, Human
ggcacaucauuucaa

SEQ ID NO: 2982884 - RNA, 14 nt, Human
ggcacaucauuuca

SEQ ID NO: 2982885 - RNA, 18 nt, Human
ggcacaucagcacgauuu

SEQ ID NO: 2982886 - RNA, 16 nt, Human
ggcacugcuuccagug

SEQ ID NO: 2982887 - RNA, 18 nt, Human
ggcacaccgggcacucag

SEQ ID NO: 2982888 - RNA, 15 nt, Human
ggcaaaaaggcagga

SEQ ID NO: 2982889 - RNA, 20 nt, Human
ggcacugcuuccagugaggc

SEQ ID NO: 2982890 - RNA, 13 nt, Human
ggcagccaggcca

SEQ ID NO: 2982891 - RNA, 22 nt, Human
ggcagccccauucugccugccc

SEQ ID NO: 2982892 - RNA, 21 nt, Human
ggcagccccauucugccugcc

SEQ ID NO: 2982893 - RNA, 20 nt, Human
ggcagccccauucugccugc

SEQ ID NO: 2982894 - RNA, 16 nt, Human
ggcagccccauucugc

SEQ ID NO: 2982895 - RNA, 18 nt, Human
ggcaggaggaucacuuga

SEQ ID NO: 2982896 - RNA, 17 nt, Human
ggccagagacacaagcc

SEQ ID NO: 2982897 - RNA, 18 nt, Human
ggccagagacacaagccu

SEQ ID NO: 2982898 - RNA, 19 nt, Human
ggccagagggagugacaga

SEQ ID NO: 2982899 - RNA, 17 nt, Human
ggccagagggagugaca

SEQ ID NO: 2982900 - RNA, 13 nt, Human
ggccaaaggaagc

SEQ ID NO: 2982901 - RNA, 17 nt, Human
ggcauuuguuugaacug

SEQ ID NO: 2982902 - RNA, 14 nt, Human
ggccaaaggaagca

SEQ ID NO: 2982903 - RNA, 16 nt, Human
ggccaaaggaagcaca

SEQ ID NO: 2982904 - RNA, 19 nt, Human
ggccaaaggaagcacaugc

SEQ ID NO: 2982905 - RNA, 14 nt, Human
ggcauuugcugaau

SEQ ID NO: 2982906 - RNA, 23 nt, Human
ggauugugccuaauguguuugag

SEQ ID NO: 2982907 - RNA, 12 nt, Human
ggauuuaacaga

SEQ ID NO: 2982908 - RNA, 16 nt, Human
ggauuguccccgaccc

SEQ ID NO: 2982909 - RNA, 20 nt, Human
ggauuguccccgacccuugc

SEQ ID NO: 2982910 - RNA, 17 nt, Human
ggauuuaacagaaaugu

SEQ ID NO: 2982911 - RNA, 16 nt, Human
ggauuuaacagaaaug

SEQ ID NO: 2982912 - RNA, 22 nt, Human
ggauuuaacagaaauguacagc

SEQ ID NO: 2982913 - RNA, 13 nt, Human
ggauuguccccga

SEQ ID NO: 2982914 - RNA, 14 nt, Human
ggaugaaaaaauaa

SEQ ID NO: 2982915 - RNA, 16 nt, Human
ggaguucaucuugaau

SEQ ID NO: 2982916 - RNA, 15 nt, Human
ggauccugagccaga

SEQ ID NO: 2982917 - RNA, 16 nt, Human
ggauccugagccagau

SEQ ID NO: 2982918 - RNA, 18 nt, Human
ggauccugagccagauuu

SEQ ID NO: 2982919 - RNA, 19 nt, Human
ggauccugagccagauuuc

SEQ ID NO: 2982920 - RNA, 20 nt, Human
ggauccugagccagauuuca

SEQ ID NO: 2982921 - RNA, 23 nt, Human
ggauccugagccagauuucacuc

SEQ ID NO: 2982922 - RNA, 18 nt, Human
ggaucucuugagccuggg

SEQ ID NO: 2982923 - RNA, 19 nt, Human
ggaguuauugaagcagagu

SEQ ID NO: 2982924 - RNA, 16 nt, Human
ggaguggccacagaaa

SEQ ID NO: 2982925 - RNA, 12 nt, Human
ggagugggccca

SEQ ID NO: 2982926 - RNA, 22 nt, Human
ggagugggcccaaugcacuuug

SEQ ID NO: 2982927 - RNA, 15 nt, Human
ggaguggccacagaa

SEQ ID NO: 2982928 - RNA, 13 nt, Human
ggaggggggaggu

SEQ ID NO: 2982929 - RNA, 14 nt, Human
ggaggggggaggug

SEQ ID NO: 2982930 - RNA, 20 nt, Human
ggaggcggaccuuguaguga

SEQ ID NO: 2982931 - RNA, 22 nt, Human
ggaggugggauccuccaggugc

SEQ ID NO: 2982932 - RNA, 23 nt, Human
ggaggugggauccuccaggugca

SEQ ID NO: 2982933 - RNA, 21 nt, Human
ggagggugacgggggugaacu

SEQ ID NO: 2982934 - RNA, 22 nt, Human
ggagguaaggaauaccuguccc

SEQ ID NO: 2982935 - RNA, 15 nt, Human
ggcuaacuuggguua

SEQ ID NO: 2982936 - RNA, 20 nt, Human
ggcuaagcuucacuguaaaa

SEQ ID NO: 2982937 - RNA, 15 nt, Human
ggcgugaacccagga

SEQ ID NO: 2982938 - RNA, 14 nt, Human
ggccuuccccuggc

SEQ ID NO: 2982939 - RNA, 16 nt, Human
ggccuucggccuccau

SEQ ID NO: 2982940 - RNA, 18 nt, Human
ggccuucggccuccaucc

SEQ ID NO: 2982941 - RNA, 20 nt, Human
ggccuuccccuggcacuggc

SEQ ID NO: 2982942 - RNA, 21 nt, Human
ggcgagccauuugucccaagu

SEQ ID NO: 2982943 - RNA, 14 nt, Human
ggcuaccuuuguau

SEQ ID NO: 2982944 - RNA, 13 nt, Human
ggcuaccuuugua

SEQ ID NO: 2982945 - RNA, 16 nt, Human
ggcuaauguacugcau

SEQ ID NO: 2982946 - RNA, 20 nt, Human
ggcuaagugauccucccacc

SEQ ID NO: 2982947 - RNA, 15 nt, Human
ggccuggccagaugc

SEQ ID NO: 2982948 - RNA, 12 nt, Human
ggccuggccaga

SEQ ID NO: 2982949 - RNA, 16 nt, Human
ggccuggccagaugca

SEQ ID NO: 2982950 - RNA, 20 nt, Human
ggccuggaugcccccugugg

SEQ ID NO: 2982951 - RNA, 11 nt, Human
ggccuggaugc

SEQ ID NO: 2982952 - RNA, 16 nt, Human
ggccugcaagggagug

SEQ ID NO: 2982953 - RNA, 16 nt, Human
ggccagaugcaccagc

SEQ ID NO: 2982954 - RNA, 15 nt, Human
ggccagaugcaccag

SEQ ID NO: 2982955 - RNA, 18 nt, Human
ggccucccaacucacccc

SEQ ID NO: 2982956 - RNA, 19 nt, Human
ggccucccaacucacccca

SEQ ID NO: 2982957 - RNA, 17 nt, Human
ggccucccaacucaccc

SEQ ID NO: 2982958 - RNA, 13 nt, Human
ggccucagugcca

SEQ ID NO: 2982959 - RNA, 20 nt, Human
ggccucccaacucaccccag

SEQ ID NO: 2982960 - RNA, 22 nt, Human
ggccucccaacucaccccagcc

SEQ ID NO: 2982961 - RNA, 23 nt, Human
ggccucccaacucaccccagccc

SEQ ID NO: 2982962 - RNA, 13 nt, Human
aaaaauacaaaaa

SEQ ID NO: 2982963 - RNA, 22 nt, Human
ggcuggguucuacccaggugcu

SEQ ID NO: 2982964 - RNA, 14 nt, Human
ggcuggguuggagg

SEQ ID NO: 2982965 - RNA, 12 nt, Human
aaaaaggcagga

SEQ ID NO: 2982966 - RNA, 21 nt, Human
aaaaaggaugcacagaguugu

SEQ ID NO: 2982967 - RNA, 14 nt, Human
aaaaaggaggaaga

SEQ ID NO: 2982968 - RNA, 22 nt, Human
aaaaaacugcugacuguuuucu

SEQ ID NO: 2982969 - RNA, 14 nt, Human
ggcuggccuggccc

SEQ ID NO: 2982970 - RNA, 15 nt, Human
ggcuggccuggcccc

SEQ ID NO: 2982971 - RNA, 13 nt, Human
ggcuggccuggcc

SEQ ID NO: 2982972 - RNA, 13 nt, Human
ggcucccuuccca

SEQ ID NO: 2982973 - RNA, 17 nt, Human
ggcucuuccaggcuggg

SEQ ID NO: 2982974 - RNA, 18 nt, Human
ggcucuuccaggcuggga

SEQ ID NO: 2982975 - RNA, 15 nt, Human
ggcucuuccaggcug

SEQ ID NO: 2982976 - RNA, 14 nt, Human
ggcucuuccaggcu

SEQ ID NO: 2982977 - RNA, 15 nt, Human
ggcucacugcagccu

SEQ ID NO: 2982978 - RNA, 14 nt, Human
ggcucacugcagcc

SEQ ID NO: 2982979 - RNA, 13 nt, Human
ggcucacugcagc

SEQ ID NO: 2982980 - RNA, 19 nt, Human
caauaaacauuucauuucc

SEQ ID NO: 2982981 - RNA, 14 nt, Human
caaguauuagaaua

SEQ ID NO: 2982982 - RNA, 20 nt, Human
caaguauuagaauaccacag

SEQ ID NO: 2982983 - RNA, 20 nt, Human
caauauuucagauaaucaca

SEQ ID NO: 2982984 - RNA, 12 nt, Human
caauauuucaga

SEQ ID NO: 2982985 - RNA, 23 nt, Human
caaugcuguauuuuaaaagaaug

SEQ ID NO: 2982986 - RNA, 14 nt, Human
caaugcuguauuuu

SEQ ID NO: 2982987 - RNA, 23 nt, Human
caaugcuggcuguuggcuggggg

SEQ ID NO: 2982988 - RNA, 22 nt, Human
caaugcuggcuguuggcugggg

SEQ ID NO: 2982989 - RNA, 22 nt, Human
caaugcugugcccuaaagugua

SEQ ID NO: 2982990 - RNA, 14 nt, Human
cacaagacccuugu

SEQ ID NO: 2982991 - RNA, 16 nt, Human
cacaagacccuugugg

SEQ ID NO: 2982992 - RNA, 12 nt, Human
caauuuaaaaaa

SEQ ID NO: 2982993 - RNA, 16 nt, Human
cacaagacugcacauc

SEQ ID NO: 2982994 - RNA, 14 nt, Human
cacaagccuucggc

SEQ ID NO: 2982995 - RNA, 19 nt, Human
cacaguauuacuucugcua

SEQ ID NO: 2982996 - RNA, 18 nt, Human
cacaguauuacuucugcu

SEQ ID NO: 2982997 - RNA, 16 nt, Human
cacaguauuacuucug

SEQ ID NO: 2982998 - RNA, 20 nt, Human
cacagacccugcccuguggg

SEQ ID NO: 2982999 - RNA, 21 nt, Human
cacagacccugcccugugggc

SEQ ID NO: 2983000 - RNA, 19 nt, Human
cacagacccugcccugugg

SEQ ID NO: 2983001 - RNA, 15 nt, Human
cacagcuaacaugga

SEQ ID NO: 2983002 - RNA, 16 nt, Human
cacagcuaacauggaa

SEQ ID NO: 2983003 - RNA, 19 nt, Human
cacagcucuguccugggag

SEQ ID NO: 2983004 - RNA, 10 nt, Human
cacagcucuu

SEQ ID NO: 2983005 - RNA, 23 nt, Human
cacagcucuguccugggagugag

SEQ ID NO: 2983006 - RNA, 20 nt, Human
cacagcucuguccugggagu

SEQ ID NO: 2983007 - RNA, 22 nt, Human
cacagcuaacauggaaguacua

SEQ ID NO: 2983008 - RNA, 17 nt, Human
cacccagcccacuucug

SEQ ID NO: 2983009 - RNA, 16 nt, Human
cacccagcccacuucu

SEQ ID NO: 2983010 - RNA, 23 nt, Human
caccaacauacucccaucuguga

SEQ ID NO: 2983011 - RNA, 14 nt, Human
caccagcagccugg

SEQ ID NO: 2983012 - RNA, 12 nt, Human
caccagcagccu

SEQ ID NO: 2983013 - RNA, 15 nt, Human
caccagcagccugga

SEQ ID NO: 2983014 - RNA, 21 nt, Human
caccagcccuuagcagggaaa

SEQ ID NO: 2983015 - RNA, 23 nt, Human
cacccaggagccccgaggccuuc

SEQ ID NO: 2983016 - RNA, 20 nt, Human
cacccaggagccccgaggcc

SEQ ID NO: 2983017 - RNA, 19 nt, Human
cacccagcccacuucugcc

SEQ ID NO: 2983018 - RNA, 24 nt, Human
cacccaggagccccgaggccuucu

SEQ ID NO: 2983019 - RNA, 21 nt, Human
cacauuuuuuaaaugcaccug

SEQ ID NO: 2983020 - RNA, 17 nt, Human
cacauuuuuuaaaugca

SEQ ID NO: 2983021 - RNA, 14 nt, Human
cacauuuuucuuag

SEQ ID NO: 2983022 - RNA, 13 nt, Human
cacauuuuucuua

SEQ ID NO: 2983023 - RNA, 20 nt, Human
caccaacauacucccaucug

SEQ ID NO: 2983024 - RNA, 21 nt, Human
caccaacauacucccaucugu

SEQ ID NO: 2983025 - RNA, 17 nt, Human
caccaacauacucccau

SEQ ID NO: 2983026 - RNA, 15 nt, Human
cacauuuuauuuuau

SEQ ID NO: 2983027 - RNA, 18 nt, Human
cacaucuugcucugcuga

SEQ ID NO: 2983028 - RNA, 21 nt, Human
cacaucagcacgauuucuguu

SEQ ID NO: 2983029 - RNA, 20 nt, Human
cacaucagcacgauuucugu

SEQ ID NO: 2983030 - RNA, 22 nt, Human
cacaucagcacgauuucuguuu

SEQ ID NO: 2983031 - RNA, 17 nt, Human
cacaucuugcucugcug

SEQ ID NO: 2983032 - RNA, 16 nt, Human
cacaucuugcucugcu

SEQ ID NO: 2983033 - RNA, 13 nt, Human
caccuugcagcuc

SEQ ID NO: 2983034 - RNA, 15 nt, Human
caccuugcagcucuc

SEQ ID NO: 2983035 - RNA, 18 nt, Human
caccuugacagggcacac

SEQ ID NO: 2983036 - RNA, 17 nt, Human
caccugccagggacaga

SEQ ID NO: 2983037 - RNA, 19 nt, Human
caccuugacagggcacacc

SEQ ID NO: 2983038 - RNA, 22 nt, Human
caccuugcagcucuccccuucu

SEQ ID NO: 2983039 - RNA, 13 nt, Human
caccuuggcucaa

SEQ ID NO: 2983040 - RNA, 14 nt, Human
caccuuugucccca

SEQ ID NO: 2983041 - RNA, 15 nt, Human
caccuuuguccccac

SEQ ID NO: 2983042 - RNA, 17 nt, Human
caccuuuguccccaccg

SEQ ID NO: 2983043 - RNA, 14 nt, Human
caccuuugaagaag

SEQ ID NO: 2983044 - RNA, 16 nt, Human
caccguuaucgguguc

SEQ ID NO: 2983045 - RNA, 21 nt, Human
caccuacaugagguacugaga

SEQ ID NO: 2983046 - RNA, 14 nt, Human
caccugccagggac

SEQ ID NO: 2983047 - RNA, 16 nt, Human
caccugccagggacag

SEQ ID NO: 2983048 - RNA, 23 nt, Human
caccucaaaauaccaugccauuu

SEQ ID NO: 2983049 - RNA, 13 nt, Human
caccugccaggga

SEQ ID NO: 2983050 - RNA, 19 nt, Human
cacucuuauugcccacgcu

SEQ ID NO: 2983051 - RNA, 18 nt, Human
cacucuuauugcccacgc

SEQ ID NO: 2983052 - RNA, 17 nt, Human
cacucuuauugcccacg

SEQ ID NO: 2983053 - RNA, 23 nt, Human
cacuacggaauaguuggcuagga

SEQ ID NO: 2983054 - RNA, 16 nt, Human
cacggccaggccagag

SEQ ID NO: 2983055 - RNA, 15 nt, Human
cacggccaggccaga

SEQ ID NO: 2983056 - RNA, 14 nt, Human
cacggccaggccag

SEQ ID NO: 2983057 - RNA, 20 nt, Human
cacggagggugacgggggug

SEQ ID NO: 2983058 - RNA, 12 nt, Human
cacuugugaaua

SEQ ID NO: 2983059 - RNA, 11 nt, Human
cacuugugaau

SEQ ID NO: 2983060 - RNA, 20 nt, Human
cacuuggucugugagaugcu

SEQ ID NO: 2983061 - RNA, 17 nt, Human
cacuuggucugugagau

SEQ ID NO: 2983062 - RNA, 19 nt, Human
cacuguuucaaacuuuacu

SEQ ID NO: 2983063 - RNA, 17 nt, Human
cacuguugcccaggcug

SEQ ID NO: 2983064 - RNA, 22 nt, Human
cacugggcuuggggaccagagc

SEQ ID NO: 2983065 - RNA, 20 nt, Human
cacugggcuuggggaccaga

SEQ ID NO: 2983066 - RNA, 23 nt, Human
cacugggcuuggggaccagagcu

SEQ ID NO: 2983067 - RNA, 16 nt, Human
cacuguugcccaggcu

SEQ ID NO: 2983068 - RNA, 15 nt, Human
cacuguugcccaggc

SEQ ID NO: 2983069 - RNA, 14 nt, Human
cacuguugcccagg

SEQ ID NO: 2983070 - RNA, 17 nt, Human
cacuggugacaugucuu

SEQ ID NO: 2983071 - RNA, 22 nt, Human
cagaaguuucugccgcagcccu

SEQ ID NO: 2983072 - RNA, 20 nt, Human
cagaaguuucugccgcagcc

SEQ ID NO: 2983073 - RNA, 21 nt, Human
cagaaguuucugccgcagccc

SEQ ID NO: 2983074 - RNA, 17 nt, Human
cagaaauguguuaucac

SEQ ID NO: 2983075 - RNA, 19 nt, Human
cagaaguuucugccgcagc

SEQ ID NO: 2983076 - RNA, 20 nt, Human
caagaaguccccucuccucc

SEQ ID NO: 2983077 - RNA, 20 nt, Human
caagaauuucuaggacugaa

SEQ ID NO: 2983078 - RNA, 16 nt, Human
caacucaccccagccc

SEQ ID NO: 2983079 - RNA, 13 nt, Human
caacucaccccag

SEQ ID NO: 2983080 - RNA, 15 nt, Human
caacucaccccagcc

SEQ ID NO: 2983081 - RNA, 23 nt, Human
caagaauuucuaggacugaauua

SEQ ID NO: 2983082 - RNA, 18 nt, Human
caagacccuugugguccc

SEQ ID NO: 2983083 - RNA, 19 nt, Human
caagacccuugugguccca

SEQ ID NO: 2983084 - RNA, 22 nt, Human
caagacccuuguggucccaccc

SEQ ID NO: 2983085 - RNA, 19 nt, Human
caacccaaauguucaucaa

SEQ ID NO: 2983086 - RNA, 21 nt, Human
caacuaucucauuuccaagca

SEQ ID NO: 2983087 - RNA, 17 nt, Human
caacccccagccugcua

SEQ ID NO: 2983088 - RNA, 16 nt, Human
caacccccagccugcu

SEQ ID NO: 2983089 - RNA, 15 nt, Human
caacccccagccugc

SEQ ID NO: 2983090 - RNA, 18 nt, Human
caaccacugcgaccacaa

SEQ ID NO: 2983091 - RNA, 22 nt, Human
caacaccucugcacaagcugca

SEQ ID NO: 2983092 - RNA, 20 nt, Human
caacaccuuguuucccucuc

SEQ ID NO: 2983093 - RNA, 15 nt, Human
caaauccuugaagau

SEQ ID NO: 2983094 - RNA, 23 nt, Human
caaaucagguuuucuuuuaagaa

SEQ ID NO: 2983095 - RNA, 17 nt, Human
caaaucagcugcuacua

SEQ ID NO: 2983096 - RNA, 20 nt, Human
caaaguacacuguuucaaac

SEQ ID NO: 2983097 - RNA, 16 nt, Human
caaaguacacuguuuc

SEQ ID NO: 2983098 - RNA, 21 nt, Human
caaaguacacuguuucaaacu

SEQ ID NO: 2983099 - RNA, 13 nt, Human
caaagaugcagcc

SEQ ID NO: 2983100 - RNA, 14 nt, Human
caaagaugcagccg

SEQ ID NO: 2983101 - RNA, 20 nt, Human
caaaguaauuuggaaauuag

SEQ ID NO: 2983102 - RNA, 18 nt, Human
caaaguaauuuggaaauu

SEQ ID NO: 2983103 - RNA, 23 nt, Human
caacaaaccuguuucugcagcca

SEQ ID NO: 2983104 - RNA, 13 nt, Human
auuuguuugaacu

SEQ ID NO: 2983105 - RNA, 16 nt, Human
auuuguuugaacugau

SEQ ID NO: 2983106 - RNA, 14 nt, Human
auuuguuugaacug

SEQ ID NO: 2983107 - RNA, 15 nt, Human
caaaagcugggcagg

SEQ ID NO: 2983108 - RNA, 17 nt, Human
auuuuuuuuuccuucag

SEQ ID NO: 2983109 - RNA, 18 nt, Human
caaaaaaaauuagccggg

SEQ ID NO: 2983110 - RNA, 13 nt, Human
caaaaaaaauuag

SEQ ID NO: 2983111 - RNA, 13 nt, Human
auuuuuaagugcu

SEQ ID NO: 2983112 - RNA, 13 nt, Human
auuuuuuuuuccu

SEQ ID NO: 2983113 - RNA, 16 nt, Human
auuuuuuuuuccuuca

SEQ ID NO: 2983114 - RNA, 12 nt, Human
auuuuuuuuucc

SEQ ID NO: 2983115 - RNA, 19 nt, Human
auucugagaugacuauuca

SEQ ID NO: 2983116 - RNA, 17 nt, Human
auucuugccaaauauaa

SEQ ID NO: 2983117 - RNA, 16 nt, Human
auucucuccuguaccu

SEQ ID NO: 2983118 - RNA, 13 nt, Human
auuccugaacagg

SEQ ID NO: 2983119 - RNA, 21 nt, Human
auucucuccuguaccucuuga

SEQ ID NO: 2983120 - RNA, 19 nt, Human
auucucuccuguaccucuu

SEQ ID NO: 2983121 - RNA, 21 nt, Human
auuccugaugcuucuucagag

SEQ ID NO: 2983122 - RNA, 17 nt, Human
auucuuuccugaggcug

SEQ ID NO: 2983123 - RNA, 22 nt, Human
auucuuuccugaggcugggcuc

SEQ ID NO: 2983124 - RNA, 13 nt, Human
auucuuuccugag

SEQ ID NO: 2983125 - RNA, 18 nt, Human
auugacuuuuuauggcac

SEQ ID NO: 2983126 - RNA, 18 nt, Human
auucacaagacccaaaag

SEQ ID NO: 2983127 - RNA, 16 nt, Human
auucacaaaguaauuu

SEQ ID NO: 2983128 - RNA, 18 nt, Human
auuaaauucuugcaaagu

SEQ ID NO: 2983129 - RNA, 14 nt, Human
auuaaauucuugca

SEQ ID NO: 2983130 - RNA, 20 nt, Human
auuaaauucuugcaaaguau

SEQ ID NO: 2983131 - RNA, 21 nt, Human
auucacaaaguaauuuggaaa

SEQ ID NO: 2983132 - RNA, 17 nt, Human
auucacaaaguaauuug

SEQ ID NO: 2983133 - RNA, 19 nt, Human
auucauauuuacuucuuau

SEQ ID NO: 2983134 - RNA, 18 nt, Human
auucauauuuacuucuua

SEQ ID NO: 2983135 - RNA, 20 nt, Human
auucauauuuacuucuuaua

SEQ ID NO: 2983136 - RNA, 15 nt, Human
auuucucauguugaa

SEQ ID NO: 2983137 - RNA, 20 nt, Human
auuucuaugaaauauuaugu

SEQ ID NO: 2983138 - RNA, 18 nt, Human
auuucuaugaaauauuau

SEQ ID NO: 2983139 - RNA, 15 nt, Human
auuucuaugaaauau

SEQ ID NO: 2983140 - RNA, 12 nt, Human
auuucuguuuag

SEQ ID NO: 2983141 - RNA, 16 nt, Human
auuucuguuuagauaa

SEQ ID NO: 2983142 - RNA, 14 nt, Human
auuucuguuuagau

SEQ ID NO: 2983143 - RNA, 12 nt, Human
auuucaagaagu

SEQ ID NO: 2983144 - RNA, 23 nt, Human
auuucaagaaguccccucuccuc

SEQ ID NO: 2983145 - RNA, 14 nt, Human
auuuaaucuuuuau

SEQ ID NO: 2983146 - RNA, 17 nt, Human
auuuaaucuuuuaugau

SEQ ID NO: 2983147 - RNA, 14 nt, Human
auuuaaugaaagac

SEQ ID NO: 2983148 - RNA, 16 nt, Human
auuuaauaugcaaagu

SEQ ID NO: 2983149 - RNA, 15 nt, Human
auuuaauaugcaaag

SEQ ID NO: 2983150 - RNA, 14 nt, Human
auuuaauaugcaaa

SEQ ID NO: 2983151 - RNA, 19 nt, Human
auuguuuaaaaucauuucu

SEQ ID NO: 2983152 - RNA, 19 nt, Human
auuguucuuaguuugcagu

SEQ ID NO: 2983153 - RNA, 15 nt, Human
auuguaaggaaugau

SEQ ID NO: 2983154 - RNA, 16 nt, Human
auuguaaggaaugauu

SEQ ID NO: 2983155 - RNA, 14 nt, Human
auuguaaaugugcu

SEQ ID NO: 2983156 - RNA, 15 nt, Human
auuguaaaugugcuu

SEQ ID NO: 2983157 - RNA, 17 nt, Human
auuguaaaugugcuuuu

SEQ ID NO: 2983158 - RNA, 20 nt, Human
cauuauauagcaguaaaaaa

SEQ ID NO: 2983159 - RNA, 16 nt, Human
cauuaguuuugaagau

SEQ ID NO: 2983160 - RNA, 17 nt, Human
cauuauauagcaguaaa

SEQ ID NO: 2983161 - RNA, 14 nt, Human
cauuaguuuugaag

SEQ ID NO: 2983162 - RNA, 15 nt, Human
cauuaguuuugaaga

SEQ ID NO: 2983163 - RNA, 14 nt, Human
cauucuccaccugc

SEQ ID NO: 2983164 - RNA, 16 nt, Human
cauucuccaccugcca

SEQ ID NO: 2983165 - RNA, 13 nt, Human
cauucuccaccug

SEQ ID NO: 2983166 - RNA, 15 nt, Human
cauguuggccaggcu

SEQ ID NO: 2983167 - RNA, 14 nt, Human
cauguuggccaggc

SEQ ID NO: 2983168 - RNA, 16 nt, Human
cauguuggccaggcug

SEQ ID NO: 2983169 - RNA, 19 nt, Human
cauguuggccaggcugguc

SEQ ID NO: 2983170 - RNA, 14 nt, Human
caugauguuuagaa

SEQ ID NO: 2983171 - RNA, 23 nt, Human
caugcuacacacugcauguuugu

SEQ ID NO: 2983172 - RNA, 20 nt, Human
caugcuacacacugcauguu

SEQ ID NO: 2983173 - RNA, 14 nt, Human
caugcuacacacug

SEQ ID NO: 2983174 - RNA, 13 nt, Human
caugauguuuucc

SEQ ID NO: 2983175 - RNA, 20 nt, Human
caugcuccuggcccacugca

SEQ ID NO: 2983176 - RNA, 14 nt, Human
caugggaaugaaug

SEQ ID NO: 2983177 - RNA, 15 nt, Human
caugggaaugaaugu

SEQ ID NO: 2983178 - RNA, 16 nt, Human
caugggaaugaauguc

SEQ ID NO: 2983179 - RNA, 17 nt, Human
caugggaaugaauguca

SEQ ID NO: 2983180 - RNA, 18 nt, Human
caucuguuacacaaagaa

SEQ ID NO: 2983181 - RNA, 14 nt, Human
caucuuaaaaacaa

SEQ ID NO: 2983182 - RNA, 15 nt, Human
cauccuggcacccgg

SEQ ID NO: 2983183 - RNA, 14 nt, Human
caucacuucccuac

SEQ ID NO: 2983184 - RNA, 12 nt, Human
caucacuucccu

SEQ ID NO: 2983185 - RNA, 21 nt, Human
cauccccuguagagugggagc

SEQ ID NO: 2983186 - RNA, 12 nt, Human
cauccuggaaua

SEQ ID NO: 2983187 - RNA, 22 nt, Human
cauccuggcacccggccccugc

SEQ ID NO: 2983188 - RNA, 14 nt, Human
cauauggauaaaua

SEQ ID NO: 2983189 - RNA, 22 nt, Human
caguggugguuuucuguucuuu

SEQ ID NO: 2983190 - RNA, 21 nt, Human
caguggugguuuucuguucuu

SEQ ID NO: 2983191 - RNA, 20 nt, Human
caguggugguuuucuguucu

SEQ ID NO: 2983192 - RNA, 19 nt, Human
caguggugguuuucuguuc

SEQ ID NO: 2983193 - RNA, 18 nt, Human
cauauucuguuggccagu

SEQ ID NO: 2983194 - RNA, 17 nt, Human
cauauucuguuggccag

SEQ ID NO: 2983195 - RNA, 22 nt, Human
cauauucaggaagcucagggcc

SEQ ID NO: 2983196 - RNA, 23 nt, Human
ccaaauggaaaugggcagagcag

SEQ ID NO: 2983197 - RNA, 14 nt, Human
ccaacucaccccag

SEQ ID NO: 2983198 - RNA, 17 nt, Human
ccaaauguucaucaaug

SEQ ID NO: 2983199 - RNA, 16 nt, Human
ccaacucaccccagcc

SEQ ID NO: 2983200 - RNA, 17 nt, Human
ccaacucaccccagccc

SEQ ID NO: 2983201 - RNA, 18 nt, Human
ccaacucaccccagcccc

SEQ ID NO: 2983202 - RNA, 13 nt, Human
ccaagcucugcuc

SEQ ID NO: 2983203 - RNA, 17 nt, Human
ccaagcucugcuccucu

SEQ ID NO: 2983204 - RNA, 12 nt, Human
ccaagcucugcu

SEQ ID NO: 2983205 - RNA, 18 nt, Human
ccaagcucugcuccucuc

SEQ ID NO: 2983206 - RNA, 14 nt, Human
ccaaugcacuuugu

SEQ ID NO: 2983207 - RNA, 15 nt, Human
ccaaugauggucacc

SEQ ID NO: 2983208 - RNA, 17 nt, Human
ccaauauuuaccagacc

SEQ ID NO: 2983209 - RNA, 21 nt, Human
ccaauauuuaaucuuuuauga

SEQ ID NO: 2983210 - RNA, 17 nt, Human
ccaaugggagcucaugg

SEQ ID NO: 2983211 - RNA, 14 nt, Human
ccaaugggagcuca

SEQ ID NO: 2983212 - RNA, 17 nt, Human
cauuuguauaaaauaau

SEQ ID NO: 2983213 - RNA, 20 nt, Human
cauuuguauaaaauaauuuu

SEQ ID NO: 2983214 - RNA, 19 nt, Human
cauuuguauaaaauaauuu

SEQ ID NO: 2983215 - RNA, 16 nt, Human
cauuuguguugaagag

SEQ ID NO: 2983216 - RNA, 22 nt, Human
cauuuuuuuuaagaaaaaggau

SEQ ID NO: 2983217 - RNA, 20 nt, Human
ccaaaacucuccucugcugc

SEQ ID NO: 2983218 - RNA, 21 nt, Human
ccaaaacucuccucugcugcu

SEQ ID NO: 2983219 - RNA, 17 nt, Human
ccaaaacugagcauaag

SEQ ID NO: 2983220 - RNA, 12 nt, Human
ccacagcaguug

SEQ ID NO: 2983221 - RNA, 17 nt, Human
ccacagcaguugaaaag

SEQ ID NO: 2983222 - RNA, 18 nt, Human
ccacagcaguugaaaaga

SEQ ID NO: 2983223 - RNA, 23 nt, Human
ccacagcaguugaaaagacucca

SEQ ID NO: 2983224 - RNA, 13 nt, Human
ccaccaucaagcc

SEQ ID NO: 2983225 - RNA, 14 nt, Human
ccaccaucaagcca

SEQ ID NO: 2983226 - RNA, 24 nt, Human
ccaccagugccucucccugcugcu

SEQ ID NO: 2983227 - RNA, 20 nt, Human
ccaccagugccucucccugc

SEQ ID NO: 2983228 - RNA, 17 nt, Human
ccaccaccaauugccaa

SEQ ID NO: 2983229 - RNA, 17 nt, Human
ccaccacacccagccca

SEQ ID NO: 2983230 - RNA, 15 nt, Human
ccaccaucaagccac

SEQ ID NO: 2983231 - RNA, 22 nt, Human
ccaccgcagacaggaccaggga

SEQ ID NO: 2983232 - RNA, 19 nt, Human
ccaccgcagacaggaccag

SEQ ID NO: 2983233 - RNA, 21 nt, Human
ccaccuuugaagaaguaagga

SEQ ID NO: 2983234 - RNA, 16 nt, Human
ccacgcccccacuggu

SEQ ID NO: 2983235 - RNA, 17 nt, Human
ccacgcccccacuggug

SEQ ID NO: 2983236 - RNA, 18 nt, Human
ccacgcccccacugguga

SEQ ID NO: 2983237 - RNA, 19 nt, Human
ccacgcccccacuggugac

SEQ ID NO: 2983238 - RNA, 13 nt, Human
ccacgcccccacu

SEQ ID NO: 2983239 - RNA, 17 nt, Human
ccacucccugcaaccug

SEQ ID NO: 2983240 - RNA, 20 nt, Human
ccacuccggcccuccagagc

SEQ ID NO: 2983241 - RNA, 21 nt, Human
ccacuccggcccuccagagcc

SEQ ID NO: 2983242 - RNA, 22 nt, Human
ccacuccggcccuccagagccc

SEQ ID NO: 2983243 - RNA, 21 nt, Human
cagcuccccucggagaagagc

SEQ ID NO: 2983244 - RNA, 22 nt, Human
cagcuccccucggagaagagcu

SEQ ID NO: 2983245 - RNA, 20 nt, Human
cagcuccccucggagaagag

SEQ ID NO: 2983246 - RNA, 19 nt, Human
cagcuguucagcugguuga

SEQ ID NO: 2983247 - RNA, 24 nt, Human
cagcugugcucuggacaggcaugu

SEQ ID NO: 2983248 - RNA, 20 nt, Human
cagcugugcucuggacaggc

SEQ ID NO: 2983249 - RNA, 19 nt, Human
cagcugugcucuggacagg

SEQ ID NO: 2983250 - RNA, 13 nt, Human
cagcugccuggga

SEQ ID NO: 2983251 - RNA, 14 nt, Human
cagcugccugggau

SEQ ID NO: 2983252 - RNA, 12 nt, Human
cagcugccuggg

SEQ ID NO: 2983253 - RNA, 19 nt, Human
cagcugagggugagugggu

SEQ ID NO: 2983254 - RNA, 16 nt, Human
caggaaaagcugcuga

SEQ ID NO: 2983255 - RNA, 15 nt, Human
caggaaaagcugcug

SEQ ID NO: 2983256 - RNA, 18 nt, Human
caggaaaagcugcugaca

SEQ ID NO: 2983257 - RNA, 17 nt, Human
cagccucugaaaaccaa

SEQ ID NO: 2983258 - RNA, 19 nt, Human
cagccgagauagccaaggc

SEQ ID NO: 2983259 - RNA, 12 nt, Human
cagccugcucca

SEQ ID NO: 2983260 - RNA, 19 nt, Human
cagccugcuaauuccccag

SEQ ID NO: 2983261 - RNA, 21 nt, Human
cagcggggacagcuccuucug

SEQ ID NO: 2983262 - RNA, 19 nt, Human
cagcggggacagcuccuuc

SEQ ID NO: 2983263 - RNA, 18 nt, Human
cagcggggacagcuccuu

SEQ ID NO: 2983264 - RNA, 15 nt, Human
cagauucuuuccuga

SEQ ID NO: 2983265 - RNA, 17 nt, Human
cagauucuuuccugagg

SEQ ID NO: 2983266 - RNA, 18 nt, Human
cagauucuuuccugaggc

SEQ ID NO: 2983267 - RNA, 19 nt, Human
cagauucuuuccugaggcu

SEQ ID NO: 2983268 - RNA, 12 nt, Human
cagauccuggaa

SEQ ID NO: 2983269 - RNA, 16 nt, Human
cagagguugcagugag

SEQ ID NO: 2983270 - RNA, 17 nt, Human
cagagguugcagugagc

SEQ ID NO: 2983271 - RNA, 22 nt, Human
cagaggggguggccucccaacu

SEQ ID NO: 2983272 - RNA, 23 nt, Human
cagaggggguggccucccaacuc

SEQ ID NO: 2983273 - RNA, 22 nt, Human
cagcaguugaaaagacuccaaa

SEQ ID NO: 2983274 - RNA, 13 nt, Human
cagcaguucagag

SEQ ID NO: 2983275 - RNA, 16 nt, Human
cagcagugagacuggg

SEQ ID NO: 2983276 - RNA, 15 nt, Human
cagcagugagacugg

SEQ ID NO: 2983277 - RNA, 19 nt, Human
cagcacgauuucuguuuag

SEQ ID NO: 2983278 - RNA, 18 nt, Human
cagcacgauuucuguuua

SEQ ID NO: 2983279 - RNA, 16 nt, Human
cagcacgauuucuguu

SEQ ID NO: 2983280 - RNA, 20 nt, Human
cagauucuuuccugaggcug

SEQ ID NO: 2983281 - RNA, 22 nt, Human
cagauucuuuccugaggcuggg

SEQ ID NO: 2983282 - RNA, 17 nt, Human
cagauugcaacaggcug

SEQ ID NO: 2983283 - RNA, 20 nt, Human
cagcaucauggagguuugaa

SEQ ID NO: 2983284 - RNA, 20 nt, Human
cagucugacuguuuccauca

SEQ ID NO: 2983285 - RNA, 17 nt, Human
cagucuggaaugcagug

SEQ ID NO: 2983286 - RNA, 16 nt, Human
cagucugcuuagaaau

SEQ ID NO: 2983287 - RNA, 15 nt, Human
cagucugcuuagaaa

SEQ ID NO: 2983288 - RNA, 17 nt, Human
cagucugcuuagaaaua

SEQ ID NO: 2983289 - RNA, 14 nt, Human
cagucugcuuagaa

SEQ ID NO: 2983290 - RNA, 15 nt, Human
cagucuggaaugcag

SEQ ID NO: 2983291 - RNA, 13 nt, Human
cagugcaugcugu

SEQ ID NO: 2983292 - RNA, 14 nt, Human
cagugcaugcuguc

SEQ ID NO: 2983293 - RNA, 23 nt, Human
cagugggagcugccuguucagcu

SEQ ID NO: 2983294 - RNA, 20 nt, Human
cagugggagcugccuguuca

SEQ ID NO: 2983295 - RNA, 17 nt, Human
cagugcccacaggauca

SEQ ID NO: 2983296 - RNA, 16 nt, Human
cagugcaugcuguccc

SEQ ID NO: 2983297 - RNA, 17 nt, Human
cagugcaugcugucccu

SEQ ID NO: 2983298 - RNA, 15 nt, Human
cagugcccacaggau

SEQ ID NO: 2983299 - RNA, 13 nt, Human
cagugcccacagg

SEQ ID NO: 2983300 - RNA, 14 nt, Human
caguggggaaugaa

SEQ ID NO: 2983301 - RNA, 18 nt, Human
caguggugguuuucuguu

SEQ ID NO: 2983302 - RNA, 21 nt, Human
caguggugcgaucuggguuca

SEQ ID NO: 2983303 - RNA, 20 nt, Human
caguggugcgaucuggguuc

SEQ ID NO: 2983304 - RNA, 16 nt, Human
cagucaccucauggaa

SEQ ID NO: 2983305 - RNA, 15 nt, Human
cagucacauuccaag

SEQ ID NO: 2983306 - RNA, 19 nt, Human
cagucaccucauggaauug

SEQ ID NO: 2983307 - RNA, 15 nt, Human
cagucaccucaugga

SEQ ID NO: 2983308 - RNA, 21 nt, Human
caggugcacaagcuccaagcu

SEQ ID NO: 2983309 - RNA, 19 nt, Human
caggugccaguuauggcua

SEQ ID NO: 2983310 - RNA, 21 nt, Human
cagguuggugggggccucggu

SEQ ID NO: 2983311 - RNA, 14 nt, Human
cagguuuaagcugu

SEQ ID NO: 2983312 - RNA, 12 nt, Human
cagguuuuccug

SEQ ID NO: 2983313 - RNA, 18 nt, Human
cagguuuucuuuuaagaa

SEQ ID NO: 2983314 - RNA, 16 nt, Human
cagguuuuccugaaga

SEQ ID NO: 2983315 - RNA, 19 nt, Human
cagguuuucuuuuaagaau

SEQ ID NO: 2983316 - RNA, 20 nt, Human
caggugauccacccaccuca

SEQ ID NO: 2983317 - RNA, 21 nt, Human
caggugauccacccaccucag

SEQ ID NO: 2983318 - RNA, 17 nt, Human
caggugcacaagcucca

SEQ ID NO: 2983319 - RNA, 18 nt, Human
caggugcacaagcuccaa

SEQ ID NO: 2983320 - RNA, 19 nt, Human
caggugcacaagcuccaag

SEQ ID NO: 2983321 - RNA, 20 nt, Human
caggugcacaagcuccaagc

SEQ ID NO: 2983322 - RNA, 23 nt, Human
caggugauccacccaccucagcc

SEQ ID NO: 2983323 - RNA, 22 nt, Human
caggugauccacccaccucagc

SEQ ID NO: 2983324 - RNA, 15 nt, Human
caggugcacaagcuc

SEQ ID NO: 2983325 - RNA, 20 nt, Human
caggccaggcccucugccca

SEQ ID NO: 2983326 - RNA, 19 nt, Human
caggccaggcccucugccc

SEQ ID NO: 2983327 - RNA, 17 nt, Human
caggccaggcccucugc

SEQ ID NO: 2983328 - RNA, 18 nt, Human
caggccaggcccucugcc

SEQ ID NO: 2983329 - RNA, 17 nt, Human
caggccagcugcuuggg

SEQ ID NO: 2983330 - RNA, 19 nt, Human
caggccagcugcuugggcu

SEQ ID NO: 2983331 - RNA, 21 nt, Human
caggccagcugcuugggcuuc

SEQ ID NO: 2983332 - RNA, 23 nt, Human
caggccagcugcuugggcuucau

SEQ ID NO: 2983333 - RNA, 15 nt, Human
caggccagagggagu

SEQ ID NO: 2983334 - RNA, 13 nt, Human
caggccagaggga

SEQ ID NO: 2983335 - RNA, 18 nt, Human
caggcagauacaggaaaa

SEQ ID NO: 2983336 - RNA, 23 nt, Human
cagggcucagcggggacagcucc

SEQ ID NO: 2983337 - RNA, 21 nt, Human
cagggcucagcggggacagcu

SEQ ID NO: 2983338 - RNA, 19 nt, Human
caggggaaaaucagccugc

SEQ ID NO: 2983339 - RNA, 17 nt, Human
caggggaaaaucagccu

SEQ ID NO: 2983340 - RNA, 20 nt, Human
caggggaaaaucagccugcu

SEQ ID NO: 2983341 - RNA, 12 nt, Human
caggcugggaga

SEQ ID NO: 2983342 - RNA, 14 nt, Human
caggcugggagagc

SEQ ID NO: 2983343 - RNA, 15 nt, Human
caggcugggagagcc

SEQ ID NO: 2983344 - RNA, 20 nt, Human
caggcugggcuucaguggca

SEQ ID NO: 2983345 - RNA, 22 nt, Human
caggcugggcuucaguggcagc

SEQ ID NO: 2983346 - RNA, 21 nt, Human
caggcugggcuucaguggcag

SEQ ID NO: 2983347 - RNA, 20 nt, Human
ccaggauuauugucaaagaa

SEQ ID NO: 2983348 - RNA, 13 nt, Human
ccaggcugggaga

SEQ ID NO: 2983349 - RNA, 14 nt, Human
ccaggcugggagag

SEQ ID NO: 2983350 - RNA, 22 nt, Human
ccaggcugggagagccuuccag

SEQ ID NO: 2983351 - RNA, 15 nt, Human
ccaggcugggagagc

SEQ ID NO: 2983352 - RNA, 17 nt, Human
ccaggcugggagagccu

SEQ ID NO: 2983353 - RNA, 18 nt, Human
ccaggcugggagagccuu

SEQ ID NO: 2983354 - RNA, 21 nt, Human
ccaggcugggagagccuucca

SEQ ID NO: 2983355 - RNA, 12 nt, Human
ccagucaccccg

SEQ ID NO: 2983356 - RNA, 13 nt, Human
ccagucaccccgg

SEQ ID NO: 2983357 - RNA, 20 nt, Human
ccagucaccccggccaccug

SEQ ID NO: 2983358 - RNA, 21 nt, Human
ccagucaccccggccaccugc

SEQ ID NO: 2983359 - RNA, 19 nt, Human
ccagucaccccggccaccu

SEQ ID NO: 2983360 - RNA, 19 nt, Human
ccagcagccuggacccugu

SEQ ID NO: 2983361 - RNA, 20 nt, Human
ccagcagccuggacccugug

SEQ ID NO: 2983362 - RNA, 15 nt, Human
ccagcagccuggacc

SEQ ID NO: 2983363 - RNA, 14 nt, Human
ccagcagccuggac

SEQ ID NO: 2983364 - RNA, 10 nt, Human
ccagccccuu

SEQ ID NO: 2983365 - RNA, 21 nt, Human
ccagccccuggaugcagccuc

SEQ ID NO: 2983366 - RNA, 22 nt, Human
ccaggaaaggcuccaggagcag

SEQ ID NO: 2983367 - RNA, 23 nt, Human
ccaggaaaggcuccaggagcagc

SEQ ID NO: 2983368 - RNA, 21 nt, Human
ccaggaaaggcuccaggagca

SEQ ID NO: 2983369 - RNA, 16 nt, Human
ccagcuuaucucaggg

SEQ ID NO: 2983370 - RNA, 23 nt, Human
ccagcagagcaccuuagacaguc

SEQ ID NO: 2983371 - RNA, 19 nt, Human
ccagcagagcaccuuagac

SEQ ID NO: 2983372 - RNA, 22 nt, Human
ccauuuaaagcuuauuaaaacu

SEQ ID NO: 2983373 - RNA, 23 nt, Human
ccauuuacuuaagacuuaaugag

SEQ ID NO: 2983374 - RNA, 17 nt, Human
ccauuuacuuaagacuu

SEQ ID NO: 2983375 - RNA, 15 nt, Human
ccaugggccuccugu

SEQ ID NO: 2983376 - RNA, 14 nt, Human
ccaugggccuccug

SEQ ID NO: 2983377 - RNA, 14 nt, Human
ccauacauuugugu

SEQ ID NO: 2983378 - RNA, 13 nt, Human
ccauacauuugug

SEQ ID NO: 2983379 - RNA, 12 nt, Human
ccaucccagccc

SEQ ID NO: 2983380 - RNA, 23 nt, Human
ccaucccaaacccuucagugcca

SEQ ID NO: 2983381 - RNA, 14 nt, Human
ccaugaguccccug

SEQ ID NO: 2983382 - RNA, 15 nt, Human
ccaugaguccccugu

SEQ ID NO: 2983383 - RNA, 16 nt, Human
ccaugaguccccuguu

SEQ ID NO: 2983384 - RNA, 13 nt, Human
ccaugggccuccu

SEQ ID NO: 2983385 - RNA, 13 nt, Human
ccaugaguccccu

SEQ ID NO: 2983386 - RNA, 19 nt, Human
ccaugagccucagcauccu

SEQ ID NO: 2983387 - RNA, 18 nt, Human
ccaugagccucagcaucc

SEQ ID NO: 2983388 - RNA, 14 nt, Human
ccaugagccucagc

SEQ ID NO: 2983389 - RNA, 13 nt, Human
ccaugagccucag

SEQ ID NO: 2983390 - RNA, 16 nt, Human
ccauccccuguagagu

SEQ ID NO: 2983391 - RNA, 21 nt, Human
cccaggcuggcgugcaguggu

SEQ ID NO: 2983392 - RNA, 20 nt, Human
cccaggcuuagucacugaga

SEQ ID NO: 2983393 - RNA, 15 nt, Human
cccaggcuuagucac

SEQ ID NO: 2983394 - RNA, 19 nt, Human
cccaggaaaggcuccagga

SEQ ID NO: 2983395 - RNA, 23 nt, Human
cccagcugugcucuggacaggca

SEQ ID NO: 2983396 - RNA, 21 nt, Human
cccagcugugcucuggacagg

SEQ ID NO: 2983397 - RNA, 21 nt, Human
cccaggaaaggcuccaggagc

SEQ ID NO: 2983398 - RNA, 22 nt, Human
cccaggaaaggcuccaggagca

SEQ ID NO: 2983399 - RNA, 23 nt, Human
cccaggaaaggcuccaggagcag

SEQ ID NO: 2983400 - RNA, 14 nt, Human
cccagcccacuucu

SEQ ID NO: 2983401 - RNA, 20 nt, Human
cccagcacuuugggaggcug

SEQ ID NO: 2983402 - RNA, 22 nt, Human
cccauucugccugcccaggccc

SEQ ID NO: 2983403 - RNA, 21 nt, Human
cccauucugccugcccaggcc

SEQ ID NO: 2983404 - RNA, 20 nt, Human
cccauucugccugcccaggc

SEQ ID NO: 2983405 - RNA, 19 nt, Human
ccccauccucuguacagag

SEQ ID NO: 2983406 - RNA, 21 nt, Human
ccccauccucuguacagagcc

SEQ ID NO: 2983407 - RNA, 22 nt, Human
ccccauccucuguacagagccc

SEQ ID NO: 2983408 - RNA, 24 nt, Human
ccccaucugcgggggcagugcuca

SEQ ID NO: 2983409 - RNA, 17 nt, Human
ccccauccucuguacag

SEQ ID NO: 2983410 - RNA, 20 nt, Human
ccccagcaagugagagcugg

SEQ ID NO: 2983411 - RNA, 19 nt, Human
ccccagcaagugagagcug

SEQ ID NO: 2983412 - RNA, 17 nt, Human
ccccagcaagugagagc

SEQ ID NO: 2983413 - RNA, 23 nt, Human
ccccagauugcaacaggcugggc

SEQ ID NO: 2983414 - RNA, 22 nt, Human
ccccagauugcaacaggcuggg

SEQ ID NO: 2983415 - RNA, 21 nt, Human
ccccagauugcaacaggcugg

SEQ ID NO: 2983416 - RNA, 18 nt, Human
ccccugcacuccagccug

SEQ ID NO: 2983417 - RNA, 17 nt, Human
ccccuucgcuccugugu

SEQ ID NO: 2983418 - RNA, 15 nt, Human
ccccuucgcuccugu

SEQ ID NO: 2983419 - RNA, 14 nt, Human
ccccuucgcuccug

SEQ ID NO: 2983420 - RNA, 19 nt, Human
ccccuucgcuccugugucu

SEQ ID NO: 2983421 - RNA, 14 nt, Human
ccccauucugccug

SEQ ID NO: 2983422 - RNA, 13 nt, Human
ccccauucugccu

SEQ ID NO: 2983423 - RNA, 15 nt, Human
ccccauucugccugc

SEQ ID NO: 2983424 - RNA, 12 nt, Human
cccggcugcgga

SEQ ID NO: 2983425 - RNA, 18 nt, Human
cccggcuuuggugcgggg

SEQ ID NO: 2983426 - RNA, 16 nt, Human
ccccuucugacccaug

SEQ ID NO: 2983427 - RNA, 17 nt, Human
ccccuucugacccaugc

SEQ ID NO: 2983428 - RNA, 20 nt, Human
cccucaagagcaaaguagau

SEQ ID NO: 2983429 - RNA, 20 nt, Human
cccucaacucuccuccagag

SEQ ID NO: 2983430 - RNA, 20 nt, Human
ccucaugcugccaauauccu

SEQ ID NO: 2983431 - RNA, 21 nt, Human
ccucaugcugccaauauccua

SEQ ID NO: 2983432 - RNA, 23 nt, Human
ccucauggaauuggagcucgugg

SEQ ID NO: 2983433 - RNA, 21 nt, Human
ccucauuuuuauaaugucccu

SEQ ID NO: 2983434 - RNA, 17 nt, Human
ccucccaccucagccuc

SEQ ID NO: 2983435 - RNA, 15 nt, Human
ccucccaccucagcc

SEQ ID NO: 2983436 - RNA, 13 nt, Human
ccucccaucucac

SEQ ID NO: 2983437 - RNA, 16 nt, Human
ccucccaucucacaca

SEQ ID NO: 2983438 - RNA, 14 nt, Human
ccggccccugcugg

SEQ ID NO: 2983439 - RNA, 19 nt, Human
cccugucuccucucucugu

SEQ ID NO: 2983440 - RNA, 17 nt, Human
cccugugauggggcccu

SEQ ID NO: 2983441 - RNA, 18 nt, Human
cccugugauggggcccug

SEQ ID NO: 2983442 - RNA, 19 nt, Human
cccugugauggggcccugc

SEQ ID NO: 2983443 - RNA, 20 nt, Human
cccugugauggggcccugcc

SEQ ID NO: 2983444 - RNA, 13 nt, Human
cccuucgcuccug

SEQ ID NO: 2983445 - RNA, 20 nt, Human
cccugucucaaaaaaagaaa

SEQ ID NO: 2983446 - RNA, 23 nt, Human
cccugucucaaaaaaagaaaaag

SEQ ID NO: 2983447 - RNA, 16 nt, Human
cccugucuaaugaaac

SEQ ID NO: 2983448 - RNA, 13 nt, Human
cccugucuaauga

SEQ ID NO: 2983449 - RNA, 13 nt, Human
ccggccccugcug

SEQ ID NO: 2983450 - RNA, 22 nt, Human
cccuucucuccagccccuggau

SEQ ID NO: 2983451 - RNA, 21 nt, Human
cccuucucuccagccccugga

SEQ ID NO: 2983452 - RNA, 15 nt, Human
cccuucgcuccugug

SEQ ID NO: 2983453 - RNA, 14 nt, Human
cccuucgcuccugu

SEQ ID NO: 2983454 - RNA, 17 nt, Human
ccugucggagcccuguc

SEQ ID NO: 2983455 - RNA, 21 nt, Human
ccugucggagcccugucuccu

SEQ ID NO: 2983456 - RNA, 16 nt, Human
ccugucggagcccugu

SEQ ID NO: 2983457 - RNA, 15 nt, Human
ccuguaaucacagcu

SEQ ID NO: 2983458 - RNA, 21 nt, Human
ccugguggcagugggagcugc

SEQ ID NO: 2983459 - RNA, 22 nt, Human
ccugucggagcccugucuccuc

SEQ ID NO: 2983460 - RNA, 15 nt, Human
ccugucuaaugaaac

SEQ ID NO: 2983461 - RNA, 22 nt, Human
ccugucuaaugaaaccuguguc

SEQ ID NO: 2983462 - RNA, 16 nt, Human
ccuggccucugcacuc

SEQ ID NO: 2983463 - RNA, 22 nt, Human
ccuggccuagcauacguacaca

SEQ ID NO: 2983464 - RNA, 20 nt, Human
ccuggccucugcacuccccu

SEQ ID NO: 2983465 - RNA, 21 nt, Human
ccuggccucugcacuccccug

SEQ ID NO: 2983466 - RNA, 22 nt, Human
ccuggccucugcacuccccugc

SEQ ID NO: 2983467 - RNA, 11 nt, Human
ccucuuucccu

SEQ ID NO: 2983468 - RNA, 13 nt, Human
ccucuuucccucc

SEQ ID NO: 2983469 - RNA, 17 nt, Human
ccugcacuugcagacuc

SEQ ID NO: 2983470 - RNA, 16 nt, Human
ccugcacuugcagacu

SEQ ID NO: 2983471 - RNA, 14 nt, Human
ccugcagagggcac

SEQ ID NO: 2983472 - RNA, 18 nt, Human
ccugcacuugcagacucu

SEQ ID NO: 2983473 - RNA, 17 nt, Human
ccugcugcaguugccag

SEQ ID NO: 2983474 - RNA, 19 nt, Human
ccugcugcaguugccaguc

SEQ ID NO: 2983475 - RNA, 23 nt, Human
ccugccucgaacuggcugcaaag

SEQ ID NO: 2983476 - RNA, 21 nt, Human
ccugccucgaacuggcugcaa

SEQ ID NO: 2983477 - RNA, 19 nt, Human
ccugccucgaacuggcugc

SEQ ID NO: 2983478 - RNA, 17 nt, Human
ccugcugcuccuaggac

SEQ ID NO: 2983479 - RNA, 16 nt, Human
ccugcugcuccuagga

SEQ ID NO: 2983480 - RNA, 15 nt, Human
ccugcugcuccuagg

SEQ ID NO: 2983481 - RNA, 13 nt, Human
ccugcugcuccua

SEQ ID NO: 2983482 - RNA, 20 nt, Human
ccugcugcaguugccaguca

SEQ ID NO: 2983483 - RNA, 12 nt, Human
ccugcccaccug

SEQ ID NO: 2983484 - RNA, 14 nt, Human
ccugcccaccuggc

SEQ ID NO: 2983485 - RNA, 20 nt, Human
ccugcccaccuggccucugc

SEQ ID NO: 2983486 - RNA, 13 nt, Human
ccugcccaccugg

SEQ ID NO: 2983487 - RNA, 13 nt, Human
ccugcccaggccc

SEQ ID NO: 2983488 - RNA, 21 nt, Human
cuauuaaacaugcuguacaua

SEQ ID NO: 2983489 - RNA, 16 nt, Human
cuaucucccccagccc

SEQ ID NO: 2983490 - RNA, 17 nt, Human
cuaucucccccagcccc

SEQ ID NO: 2983491 - RNA, 21 nt, Human
cuauuuuuguuuuuauuaaaa

SEQ ID NO: 2983492 - RNA, 15 nt, Human
cuauuuuuguuuuua

SEQ ID NO: 2983493 - RNA, 18 nt, Human
cucaaaagcugggcaggu

SEQ ID NO: 2983494 - RNA, 23 nt, Human
cucaaaauaccaugccauuuaaa

SEQ ID NO: 2983495 - RNA, 17 nt, Human
cucaaaacugcacuguc

SEQ ID NO: 2983496 - RNA, 21 nt, Human
cucaaacuaacaggcuuagug

SEQ ID NO: 2983497 - RNA, 20 nt, Human
cucaaacucuugaccucagg

SEQ ID NO: 2983498 - RNA, 21 nt, Human
cucaauaaacauuucauuucc

SEQ ID NO: 2983499 - RNA, 17 nt, Human
cucaauaaacauuucau

SEQ ID NO: 2983500 - RNA, 13 nt, Human
cucaauugugaaa

SEQ ID NO: 2983501 - RNA, 12 nt, Human
cucaauugugaa

SEQ ID NO: 2983502 - RNA, 15 nt, Human
cucaaugcacugaca

SEQ ID NO: 2983503 - RNA, 13 nt, Human
cucaaugcacuga

SEQ ID NO: 2983504 - RNA, 14 nt, Human
cuaucuaaauguug

SEQ ID NO: 2983505 - RNA, 15 nt, Human
cuaucucccccagcc

SEQ ID NO: 2983506 - RNA, 22 nt, Human
cuaguuugauuaaauucuugca

SEQ ID NO: 2983507 - RNA, 21 nt, Human
cuaguuugauuaaauucuugc

SEQ ID NO: 2983508 - RNA, 13 nt, Human
cuaguuugauuaa

SEQ ID NO: 2983509 - RNA, 22 nt, Human
cuaguuguuugauucagacagc

SEQ ID NO: 2983510 - RNA, 23 nt, Human
cuaguuguuugauucagacagcu

SEQ ID NO: 2983511 - RNA, 13 nt, Human
cuagccagaggag

SEQ ID NO: 2983512 - RNA, 15 nt, Human
cuagccagaggagag

SEQ ID NO: 2983513 - RNA, 12 nt, Human
cuagccagagga

SEQ ID NO: 2983514 - RNA, 20 nt, Human
cgugugugugcguccugucg

SEQ ID NO: 2983515 - RNA, 20 nt, Human
cuaaguaaaaccacagcagu

SEQ ID NO: 2983516 - RNA, 15 nt, Human
cuaauaaaaagguga

SEQ ID NO: 2983517 - RNA, 14 nt, Human
cuaauaaaaaggug

SEQ ID NO: 2983518 - RNA, 13 nt, Human
cuaauaaaaaggu

SEQ ID NO: 2983519 - RNA, 11 nt, Human
cuaauaaaaag

SEQ ID NO: 2983520 - RNA, 23 nt, Human
cuaaguuuuuauggcuuuugugc

SEQ ID NO: 2983521 - RNA, 20 nt, Human
cuaaguuuuuauggcuuuug

SEQ ID NO: 2983522 - RNA, 21 nt, Human
cuaagugguacuaacuuuccu

SEQ ID NO: 2983523 - RNA, 22 nt, Human
cuaaguaaaaccacagcaguug

SEQ ID NO: 2983524 - RNA, 23 nt, Human
cuaaguaaaaccacagcaguuga

SEQ ID NO: 2983525 - RNA, 23 nt, Human
cuaagugauccucccaccucagc

SEQ ID NO: 2983526 - RNA, 16 nt, Human
cuacaaaaacacagca

SEQ ID NO: 2983527 - RNA, 17 nt, Human
cuacaaaaacacagcaa

SEQ ID NO: 2983528 - RNA, 19 nt, Human
cuacaguccucccaucuca

SEQ ID NO: 2983529 - RNA, 18 nt, Human
cuacaaaaacacagcaag

SEQ ID NO: 2983530 - RNA, 15 nt, Human
cuacaaaaacacagc

SEQ ID NO: 2983531 - RNA, 22 nt, Human
cuacaguugaaaaacagcugag

SEQ ID NO: 2983532 - RNA, 18 nt, Human
cuacauacuauggaauuu

SEQ ID NO: 2983533 - RNA, 19 nt, Human
cuacaguugaaaaacagcu

SEQ ID NO: 2983534 - RNA, 21 nt, Human
cuacaguugaaaaacagcuga

SEQ ID NO: 2983535 - RNA, 20 nt, Human
cuacaguccucccaucucac

SEQ ID NO: 2983536 - RNA, 18 nt, Human
cuacaugagguacugaga

SEQ ID NO: 2983537 - RNA, 20 nt, Human
cuacaugagguacugagagu

SEQ ID NO: 2983538 - RNA, 17 nt, Human
cuaccuuuguauucucu

SEQ ID NO: 2983539 - RNA, 13 nt, Human
cuagaacucccuu

SEQ ID NO: 2983540 - RNA, 12 nt, Human
cuagaacucccu

SEQ ID NO: 2983541 - RNA, 22 nt, Human
cuagaagauuuugaaauuuuua

SEQ ID NO: 2983542 - RNA, 23 nt, Human
cuagcauacguacacauuuuauu

SEQ ID NO: 2983543 - RNA, 21 nt, Human
cuagcauacguacacauuuua

SEQ ID NO: 2983544 - RNA, 23 nt, Human
cuagaauuugauaugugaacagu

SEQ ID NO: 2983545 - RNA, 16 nt, Human
ccuuuuucaauaacug

SEQ ID NO: 2983546 - RNA, 21 nt, Human
ccuuuuuauaacuuuuuauau

SEQ ID NO: 2983547 - RNA, 15 nt, Human
ccuuuuuauaacuuu

SEQ ID NO: 2983548 - RNA, 12 nt, Human
ccuuuuuauaac

SEQ ID NO: 2983549 - RNA, 21 nt, Human
ccuuuuuuagaguugauacua

SEQ ID NO: 2983550 - RNA, 12 nt, Human
cgacaaugcaaa

SEQ ID NO: 2983551 - RNA, 13 nt, Human
cgacaaugcaaac

SEQ ID NO: 2983552 - RNA, 19 nt, Human
cgacccuugccgucuaccu

SEQ ID NO: 2983553 - RNA, 20 nt, Human
cgacccuugccgucuaccug

SEQ ID NO: 2983554 - RNA, 17 nt, Human
cgacugcccggcagggu

SEQ ID NO: 2983555 - RNA, 14 nt, Human
ccuuuaagagaaau

SEQ ID NO: 2983556 - RNA, 16 nt, Human
ccuugccgucuaccug

SEQ ID NO: 2983557 - RNA, 15 nt, Human
ccuuuugagugccuu

SEQ ID NO: 2983558 - RNA, 17 nt, Human
ccuuuugagugccuuac

SEQ ID NO: 2983559 - RNA, 21 nt, Human
ccuuucaauaggaaaaacuga

SEQ ID NO: 2983560 - RNA, 18 nt, Human
ccuuucaauaggaaaaac

SEQ ID NO: 2983561 - RNA, 22 nt, Human
cgcaggauucuuccucccuccc

SEQ ID NO: 2983562 - RNA, 18 nt, Human
cgcaggcccccaggugcc

SEQ ID NO: 2983563 - RNA, 14 nt, Human
cgauagugguggug

SEQ ID NO: 2983564 - RNA, 16 nt, Human
cgaguagcugggacua

SEQ ID NO: 2983565 - RNA, 14 nt, Human
cgccuacaggagug

SEQ ID NO: 2983566 - RNA, 22 nt, Human
cguggugauuuagcaggaagcu

SEQ ID NO: 2983567 - RNA, 15 nt, Human
cguggugauuuagca

SEQ ID NO: 2983568 - RNA, 14 nt, Human
cgugguggcaggca

SEQ ID NO: 2983569 - RNA, 20 nt, Human
cguguaaccauggacccaau

SEQ ID NO: 2983570 - RNA, 17 nt, Human
cgugaggccagagacac

SEQ ID NO: 2983571 - RNA, 16 nt, Human
cgugaguccuggcaug

SEQ ID NO: 2983572 - RNA, 17 nt, Human
cgugaguccuggcaugg

SEQ ID NO: 2983573 - RNA, 16 nt, Human
cgugaggccagagaca

SEQ ID NO: 2983574 - RNA, 16 nt, Human
cgguuuuacugcagcu

SEQ ID NO: 2983575 - RNA, 11 nt, Human
cgggcucagca

SEQ ID NO: 2983576 - RNA, 14 nt, Human
cgggcucugccucc

SEQ ID NO: 2983577 - RNA, 16 nt, Human
cgggcucugccuccca

SEQ ID NO: 2983578 - RNA, 15 nt, Human
cgggcucagcaaaag

SEQ ID NO: 2983579 - RNA, 13 nt, Human
cgggcucugccuc

SEQ ID NO: 2983580 - RNA, 17 nt, Human
cgggcucugccucccau

SEQ ID NO: 2983581 - RNA, 14 nt, Human
cggggacagcuccu

SEQ ID NO: 2983582 - RNA, 18 nt, Human
cgguguggagaagcggcu

SEQ ID NO: 2983583 - RNA, 18 nt, Human
cgguguuauuccaaggga

SEQ ID NO: 2983584 - RNA, 13 nt, Human
cgguguggagaag

SEQ ID NO: 2983585 - RNA, 15 nt, Human
cggggacagcuccuu

SEQ ID NO: 2983586 - RNA, 14 nt, Human
cggcucacugcagc

SEQ ID NO: 2983587 - RNA, 15 nt, Human
cggcucacugcagcc

SEQ ID NO: 2983588 - RNA, 20 nt, Human
cggagucccaccuuggcugc

SEQ ID NO: 2983589 - RNA, 18 nt, Human
cggagucccaccuuggcu

SEQ ID NO: 2983590 - RNA, 16 nt, Human
cggcucacugcagccu

SEQ ID NO: 2983591 - RNA, 12 nt, Human
cggcuccaggcu

SEQ ID NO: 2983592 - RNA, 16 nt, Human
cggcuccaggcuccuu

SEQ ID NO: 2983593 - RNA, 15 nt, Human
cggcuccaggcuccu

SEQ ID NO: 2983594 - RNA, 14 nt, Human
cggcuccaggcucc

SEQ ID NO: 2983595 - RNA, 13 nt, Human
cggcuccaggcuc

SEQ ID NO: 2983596 - RNA, 14 nt, Human
cgggccacagagaa

SEQ ID NO: 2983597 - RNA, 12 nt, Human
cgggccacagag

SEQ ID NO: 2983598 - RNA, 16 nt, Human
cggagucccaccuugg

SEQ ID NO: 2983599 - RNA, 16 nt, Human
cucuccccuucucugu

SEQ ID NO: 2983600 - RNA, 21 nt, Human
cucugcacuccccugcugggu

SEQ ID NO: 2983601 - RNA, 20 nt, Human
cucugcacuccccugcuggg

SEQ ID NO: 2983602 - RNA, 18 nt, Human
cucugcacuccccugcug

SEQ ID NO: 2983603 - RNA, 18 nt, Human
cucugcuccucuccccag

SEQ ID NO: 2983604 - RNA, 13 nt, Human
cucugcuccucuc

SEQ ID NO: 2983605 - RNA, 14 nt, Human
cucugguccauaga

SEQ ID NO: 2983606 - RNA, 16 nt, Human
cucugcugacagacac

SEQ ID NO: 2983607 - RNA, 14 nt, Human
cucugcugacagac

SEQ ID NO: 2983608 - RNA, 13 nt, Human
cucugcugacaga

SEQ ID NO: 2983609 - RNA, 21 nt, Human
cucuuagaugcaguucugaag

SEQ ID NO: 2983610 - RNA, 22 nt, Human
cucuuagaugcaguucugaaga

SEQ ID NO: 2983611 - RNA, 13 nt, Human
cucuuauugccca

SEQ ID NO: 2983612 - RNA, 20 nt, Human
cucuuauugcccacgcugga

SEQ ID NO: 2983613 - RNA, 19 nt, Human
cucuuauugcccacgcugg

SEQ ID NO: 2983614 - RNA, 15 nt, Human
cucuuauugcccacg

SEQ ID NO: 2983615 - RNA, 14 nt, Human
cucuuauugcccac

SEQ ID NO: 2983616 - RNA, 19 nt, Human
cucuucagaucucuaacuu

SEQ ID NO: 2983617 - RNA, 18 nt, Human
cucuucagaucucuaacu

SEQ ID NO: 2983618 - RNA, 14 nt, Human
cucuucaaucucuu

SEQ ID NO: 2983619 - RNA, 15 nt, Human
cugaaacaacaaaua

SEQ ID NO: 2983620 - RNA, 23 nt, Human
cugaaggacauugcggacagcca

SEQ ID NO: 2983621 - RNA, 18 nt, Human
cugaaggccccgcccagg

SEQ ID NO: 2983622 - RNA, 19 nt, Human
cugaaggccccgcccaggc

SEQ ID NO: 2983623 - RNA, 21 nt, Human
cugaaggccccgcccaggcuu

SEQ ID NO: 2983624 - RNA, 22 nt, Human
cugacaacacucauugaccuga

SEQ ID NO: 2983625 - RNA, 23 nt, Human
cugacaacacucauugaccugag

SEQ ID NO: 2983626 - RNA, 17 nt, Human
cucuugagccuugaacu

SEQ ID NO: 2983627 - RNA, 16 nt, Human
cucuugagccuugaac

SEQ ID NO: 2983628 - RNA, 18 nt, Human
cucuugagccuugaacuu

SEQ ID NO: 2983629 - RNA, 23 nt, Human
cugagacagcccgggcucugccu

SEQ ID NO: 2983630 - RNA, 21 nt, Human
cugagacucgcgacaaugcaa

SEQ ID NO: 2983631 - RNA, 20 nt, Human
cugagacucgcgacaaugca

SEQ ID NO: 2983632 - RNA, 21 nt, Human
cugacccaugcugcccuguga

SEQ ID NO: 2983633 - RNA, 22 nt, Human
cugacccaugcugcccugugag

SEQ ID NO: 2983634 - RNA, 22 nt, Human
cugagacucgcgacaaugcaaa

SEQ ID NO: 2983635 - RNA, 17 nt, Human
cugagaguagagucacu

SEQ ID NO: 2983636 - RNA, 22 nt, Human
cugagaggacuuuucuuugugg

SEQ ID NO: 2983637 - RNA, 21 nt, Human
cugagaggacuuuucuuugug

SEQ ID NO: 2983638 - RNA, 20 nt, Human
cugaguacguugugcauuug

SEQ ID NO: 2983639 - RNA, 19 nt, Human
cugaguacguugugcauuu

SEQ ID NO: 2983640 - RNA, 17 nt, Human
cugaguacguugugcau

SEQ ID NO: 2983641 - RNA, 18 nt, Human
cugaguacguugugcauu

SEQ ID NO: 2983642 - RNA, 21 nt, Human
cugaguacguugugcauuugg

SEQ ID NO: 2983643 - RNA, 14 nt, Human
cugaggaauccaga

SEQ ID NO: 2983644 - RNA, 20 nt, Human
cugaggaauccagacccggc

SEQ ID NO: 2983645 - RNA, 17 nt, Human
cugaggaauccagaccc

SEQ ID NO: 2983646 - RNA, 20 nt, Human
cugaggacacuaaccacgcu

SEQ ID NO: 2983647 - RNA, 21 nt, Human
cugaggaauccagacccggcu

SEQ ID NO: 2983648 - RNA, 23 nt, Human
cugaggacacuaaccacgcugga

SEQ ID NO: 2983649 - RNA, 14 nt, Human
cugagcuuucugcu

SEQ ID NO: 2983650 - RNA, 15 nt, Human
cugagcuuucugcua

SEQ ID NO: 2983651 - RNA, 21 nt, Human
cugagaucaaaacgguuuuac

SEQ ID NO: 2983652 - RNA, 17 nt, Human
cugagauccuggacuga

SEQ ID NO: 2983653 - RNA, 15 nt, Human
cugagauccuggacu

SEQ ID NO: 2983654 - RNA, 13 nt, Human
cugagauccugga

SEQ ID NO: 2983655 - RNA, 21 nt, Human
cugagauccuggacugagggg

SEQ ID NO: 2983656 - RNA, 16 nt, Human
cuccacuuucuagcca

SEQ ID NO: 2983657 - RNA, 19 nt, Human
cuccacuuucuagccagag

SEQ ID NO: 2983658 - RNA, 23 nt, Human
cuccacuuggucugugagaugcu

SEQ ID NO: 2983659 - RNA, 19 nt, Human
cuccccaugauguuuagaa

SEQ ID NO: 2983660 - RNA, 14 nt, Human
cucccaccuggcuc

SEQ ID NO: 2983661 - RNA, 13 nt, Human
cucccaccuggcu

SEQ ID NO: 2983662 - RNA, 22 nt, Human
cucccaccuggcucuguggcga

SEQ ID NO: 2983663 - RNA, 15 nt, Human
cucccaccuggcucu

SEQ ID NO: 2983664 - RNA, 22 nt, Human
cuccacuuggucugugagaugc

SEQ ID NO: 2983665 - RNA, 21 nt, Human
cuccacuuggucugugagaug

SEQ ID NO: 2983666 - RNA, 17 nt, Human
cuccacuuggucuguga

SEQ ID NO: 2983667 - RNA, 16 nt, Human
cuccacuuggucugug

SEQ ID NO: 2983668 - RNA, 15 nt, Human
cuccacuuggucugu

SEQ ID NO: 2983669 - RNA, 13 nt, Human
cuccacuuggucu

SEQ ID NO: 2983670 - RNA, 13 nt, Human
cuccaagcuccca

SEQ ID NO: 2983671 - RNA, 14 nt, Human
cuccaagcucccag

SEQ ID NO: 2983672 - RNA, 15 nt, Human
cuccaagcucccagg

SEQ ID NO: 2983673 - RNA, 16 nt, Human
cuccaagcucccaggc

SEQ ID NO: 2983674 - RNA, 13 nt, Human
cuccaagcaggac

SEQ ID NO: 2983675 - RNA, 14 nt, Human
cuccaagcaggaca

SEQ ID NO: 2983676 - RNA, 22 nt, Human
cuccaagcaggacauggacaag

SEQ ID NO: 2983677 - RNA, 24 nt, Human
cuccaagcaggacauggacaagga

SEQ ID NO: 2983678 - RNA, 22 nt, Human
cuccaagaccuucuccuucacc

SEQ ID NO: 2983679 - RNA, 21 nt, Human
cuccaagaccuucuccuucac

SEQ ID NO: 2983680 - RNA, 14 nt, Human
cuccaagaauuucu

SEQ ID NO: 2983681 - RNA, 13 nt, Human
cuccaagaauuuc

SEQ ID NO: 2983682 - RNA, 15 nt, Human
cucccccagccccau

SEQ ID NO: 2983683 - RNA, 20 nt, Human
cucccccagccccauccucu

SEQ ID NO: 2983684 - RNA, 22 nt, Human
cucccccagccccauccucugu

SEQ ID NO: 2983685 - RNA, 20 nt, Human
cuccucugcuugccaucccu

SEQ ID NO: 2983686 - RNA, 17 nt, Human
cuccucugcuugccauc

SEQ ID NO: 2983687 - RNA, 16 nt, Human
cuccucugcuugccau

SEQ ID NO: 2983688 - RNA, 15 nt, Human
cuccucugcuugcca

SEQ ID NO: 2983689 - RNA, 21 nt, Human
cuccucugcuugccaucccuc

SEQ ID NO: 2983690 - RNA, 17 nt, Human
cuccugggcagcugccu

SEQ ID NO: 2983691 - RNA, 16 nt, Human
cuccugggcagcugcc

SEQ ID NO: 2983692 - RNA, 15 nt, Human
cuccugggcagcugc

SEQ ID NO: 2983693 - RNA, 14 nt, Human
cuccugggcagcug

SEQ ID NO: 2983694 - RNA, 19 nt, Human
cuccugggcagcugccucc

SEQ ID NO: 2983695 - RNA, 18 nt, Human
cuccugggcagcugccuc

SEQ ID NO: 2983696 - RNA, 18 nt, Human
cuccugggauuggcugug

SEQ ID NO: 2983697 - RNA, 23 nt, Human
cuccugggauuggcugugaacug

SEQ ID NO: 2983698 - RNA, 22 nt, Human
cuccugggcagcugccuccccu

SEQ ID NO: 2983699 - RNA, 16 nt, Human
cuccuggcccacugca

SEQ ID NO: 2983700 - RNA, 18 nt, Human
cuccuggcccacugcauc

SEQ ID NO: 2983701 - RNA, 12 nt, Human
cuccugggcagc

SEQ ID NO: 2983702 - RNA, 18 nt, Human
cuccucugcugcuggcug

SEQ ID NO: 2983703 - RNA, 14 nt, Human
cuccucugcuugcc

SEQ ID NO: 2983704 - RNA, 12 nt, Human
cuccucugcuug

SEQ ID NO: 2983705 - RNA, 16 nt, Human
cuccucugcugcuggc

SEQ ID NO: 2983706 - RNA, 13 nt, Human
cuccuaaaacaac

SEQ ID NO: 2983707 - RNA, 20 nt, Human
cuccuaaaacaacagaugua

SEQ ID NO: 2983708 - RNA, 12 nt, Human
cuccuaaaacaa

SEQ ID NO: 2983709 - RNA, 14 nt, Human
cucgaacuggcugc

SEQ ID NO: 2983710 - RNA, 13 nt, Human
cucgaacuggcug

SEQ ID NO: 2983711 - RNA, 15 nt, Human
cucgaacuggcugca

SEQ ID NO: 2983712 - RNA, 14 nt, Human
cucguuaauuugua

SEQ ID NO: 2983713 - RNA, 21 nt, Human
cacaguguguggucaacauuu

SEQ ID NO: 2983714 - RNA, 14 nt, Human
cacaguucucuccu

SEQ ID NO: 2983715 - RNA, 15 nt, Human
cacaguucucuccuu

SEQ ID NO: 2983716 - RNA, 13 nt, Human
cacaguccuuacc

SEQ ID NO: 2983717 - RNA, 15 nt, Human
cacaguccuuaccag

SEQ ID NO: 2983718 - RNA, 21 nt, Human
cacaguccuuaccagcagagc

SEQ ID NO: 2983719 - RNA, 22 nt, Human
cacaguccuuaccagcagagca

SEQ ID NO: 2983720 - RNA, 21 nt, Human
cacagugagucgaggacaggg

SEQ ID NO: 2983721 - RNA, 22 nt, Human
cacagugagucgaggacaggga

SEQ ID NO: 2983722 - RNA, 19 nt, Human
cacagugaucaaguuauuu

SEQ ID NO: 2983723 - RNA, 22 nt, Human
cacagcuucauuuccugugucu

SEQ ID NO: 2983724 - RNA, 21 nt, Human
cacagcuucauuuccuguguc

SEQ ID NO: 2983725 - RNA, 22 nt, Human
cacagcugggguggggaccuca

SEQ ID NO: 2983726 - RNA, 23 nt, Human
cacagcugggguggggaccucag

SEQ ID NO: 2983727 - RNA, 15 nt, Human
cacaggcagguccag

SEQ ID NO: 2983728 - RNA, 14 nt, Human
cacaggcaggucca

SEQ ID NO: 2983729 - RNA, 11 nt, Human
cacaggcaggu

SEQ ID NO: 2983730 - RNA, 16 nt, Human
cacaguuuucugagaa

SEQ ID NO: 2983731 - RNA, 17 nt, Human
cacaguuuucugagaaa

SEQ ID NO: 2983732 - RNA, 19 nt, Human
cacaguuuucugagaaaga

SEQ ID NO: 2983733 - RNA, 15 nt, Human
cacaguuuucugaga

SEQ ID NO: 2983734 - RNA, 14 nt, Human
cacauaucugucau

SEQ ID NO: 2983735 - RNA, 20 nt, Human
caaacuaacaggcuuaguga

SEQ ID NO: 2983736 - RNA, 16 nt, Human
caaacuaacaggcuua

SEQ ID NO: 2983737 - RNA, 17 nt, Human
caaacucaccugccccu

SEQ ID NO: 2983738 - RNA, 17 nt, Human
caaagccuccuccagcc

SEQ ID NO: 2983739 - RNA, 18 nt, Human
caaagccuccuccagccg

SEQ ID NO: 2983740 - RNA, 22 nt, Human
caaagccaaagcuaggccuggc

SEQ ID NO: 2983741 - RNA, 18 nt, Human
caaaggguaucaggugcu

SEQ ID NO: 2983742 - RNA, 16 nt, Human
caaaggguaucaggug

SEQ ID NO: 2983743 - RNA, 14 nt, Human
caaaggaagcacau

SEQ ID NO: 2983744 - RNA, 19 nt, Human
caaagcuaggccuggccag

SEQ ID NO: 2983745 - RNA, 14 nt, Human
caaagcuaggccug

SEQ ID NO: 2983746 - RNA, 13 nt, Human
caaagcuaggccu

SEQ ID NO: 2983747 - RNA, 12 nt, Human
caaaggaagcac

SEQ ID NO: 2983748 - RNA, 13 nt, Human
caaaggaagcaca

SEQ ID NO: 2983749 - RNA, 14 nt, Human
caaacuaacaggcu

SEQ ID NO: 2983750 - RNA, 14 nt, Human
caaacccuucagug

SEQ ID NO: 2983751 - RNA, 20 nt, Human
caaacccuucagugccaaaa

SEQ ID NO: 2983752 - RNA, 15 nt, Human
caaacacauacagga

SEQ ID NO: 2983753 - RNA, 22 nt, Human
caaaauuuuuucucuaggaaau

SEQ ID NO: 2983754 - RNA, 21 nt, Human
caaaauuuuuucucuaggaaa

SEQ ID NO: 2983755 - RNA, 16 nt, Human
caaaauuuuuucucua

SEQ ID NO: 2983756 - RNA, 15 nt, Human
caaaauguaggguua

SEQ ID NO: 2983757 - RNA, 12 nt, Human
caaaauaaaacu

SEQ ID NO: 2983758 - RNA, 14 nt, Human
caaauuucuaaauc

SEQ ID NO: 2983759 - RNA, 12 nt, Human
caaauuucuaaa

SEQ ID NO: 2983760 - RNA, 11 nt, Human
caaauuucuaa

SEQ ID NO: 2983761 - RNA, 14 nt, Human
caaaugucuauaaa

SEQ ID NO: 2983762 - RNA, 15 nt, Human
caaaugucuauaaac

SEQ ID NO: 2983763 - RNA, 19 nt, Human
caaauaugcaaagcacuga

SEQ ID NO: 2983764 - RNA, 21 nt, Human
caaauaugcaaagcacugacu

SEQ ID NO: 2983765 - RNA, 19 nt, Human
caaaggguaucaggugcug

SEQ ID NO: 2983766 - RNA, 19 nt, Human
caaagugcugggauuacag

SEQ ID NO: 2983767 - RNA, 23 nt, Human
caaagugcugggauuacaggugu

SEQ ID NO: 2983768 - RNA, 20 nt, Human
caaauacgugggcauucaaa

SEQ ID NO: 2983769 - RNA, 22 nt, Human
caaauacgugggcauucaaaug

SEQ ID NO: 2983770 - RNA, 21 nt, Human
caaauacgugggcauucaaau

SEQ ID NO: 2983771 - RNA, 23 nt, Human
caaaacuucagacauagaauuaa

SEQ ID NO: 2983772 - RNA, 17 nt, Human
caaaauaaaaaugaggu

SEQ ID NO: 2983773 - RNA, 20 nt, Human
caaaacucuccucugcugcu

SEQ ID NO: 2983774 - RNA, 21 nt, Human
caaaacucuccucugcugcug

SEQ ID NO: 2983775 - RNA, 22 nt, Human
caaaacucuccucugcugcugg

SEQ ID NO: 2983776 - RNA, 19 nt, Human
caaaaaucucaauauuuca

SEQ ID NO: 2983777 - RNA, 13 nt, Human
auuuuccugaaaa

SEQ ID NO: 2983778 - RNA, 21 nt, Human
auuuugggguacccacugcuc

SEQ ID NO: 2983779 - RNA, 16 nt, Human
caaaaaaugcuugcuu

SEQ ID NO: 2983780 - RNA, 23 nt, Human
auuuugggguacccacugcucug

SEQ ID NO: 2983781 - RNA, 22 nt, Human
auuuugggguacccacugcucu

SEQ ID NO: 2983782 - RNA, 15 nt, Human
caaaaacacagcaag

SEQ ID NO: 2983783 - RNA, 17 nt, Human
caaaaacacagcaaggg

SEQ ID NO: 2983784 - RNA, 20 nt, Human
caaaaacauggccuuugcuu

SEQ ID NO: 2983785 - RNA, 13 nt, Human
caaaaacacagca

SEQ ID NO: 2983786 - RNA, 14 nt, Human
caaaaacacagcaa

SEQ ID NO: 2983787 - RNA, 13 nt, Human
caaaaaggcagga

SEQ ID NO: 2983788 - RNA, 18 nt, Human
caaggcuuagacccucau

SEQ ID NO: 2983789 - RNA, 15 nt, Human
caaggcugugcaucu

SEQ ID NO: 2983790 - RNA, 21 nt, Human
caaggcugucaauuacaggaa

SEQ ID NO: 2983791 - RNA, 23 nt, Human
caaggcugucaauuacaggaagu

SEQ ID NO: 2983792 - RNA, 12 nt, Human
caaggcugcagu

SEQ ID NO: 2983793 - RNA, 15 nt, Human
caaggcugcagugag

SEQ ID NO: 2983794 - RNA, 15 nt, Human
caaggcuuagacccu

SEQ ID NO: 2983795 - RNA, 18 nt, Human
caaggggcccaaauucuu

SEQ ID NO: 2983796 - RNA, 14 nt, Human
caaggcuuagaccc

SEQ ID NO: 2983797 - RNA, 17 nt, Human
caaggggcccaaauucu

SEQ ID NO: 2983798 - RNA, 14 nt, Human
caaguccucuuuuc

SEQ ID NO: 2983799 - RNA, 20 nt, Human
caaggucauuuuuuuuaaga

SEQ ID NO: 2983800 - RNA, 14 nt, Human
caaggucauuuuuu

SEQ ID NO: 2983801 - RNA, 13 nt, Human
caaggucauuuuu

SEQ ID NO: 2983802 - RNA, 17 nt, Human
caagugagagcugggug

SEQ ID NO: 2983803 - RNA, 15 nt, Human
caagugagagcuggg

SEQ ID NO: 2983804 - RNA, 14 nt, Human
caagugagagcugg

SEQ ID NO: 2983805 - RNA, 21 nt, Human
caaguccucuuuucugagagg

SEQ ID NO: 2983806 - RNA, 18 nt, Human
caagugagagcugggugu

SEQ ID NO: 2983807 - RNA, 14 nt, Human
caaguuaaauaaau

SEQ ID NO: 2983808 - RNA, 17 nt, Human
caaggcugauuaaacca

SEQ ID NO: 2983809 - RNA, 19 nt, Human
caagcuggucccacucagu

SEQ ID NO: 2983810 - RNA, 17 nt, Human
caagcuggucccacuca

SEQ ID NO: 2983811 - RNA, 21 nt, Human
caagccagauuuuccugaaaa

SEQ ID NO: 2983812 - RNA, 22 nt, Human
caagccaccaacauacucccau

SEQ ID NO: 2983813 - RNA, 14 nt, Human
caagcaggacaugg

SEQ ID NO: 2983814 - RNA, 18 nt, Human
caagcaggacauggacaa

SEQ ID NO: 2983815 - RNA, 19 nt, Human
caagcgauucuucugcuuc

SEQ ID NO: 2983816 - RNA, 22 nt, Human
caagcgauucuucugcuucagc

SEQ ID NO: 2983817 - RNA, 20 nt, Human
caagcgauucuucugcuuca

SEQ ID NO: 2983818 - RNA, 20 nt, Human
caacacucauugaccugagg

SEQ ID NO: 2983819 - RNA, 22 nt, Human
caacacucauugaccugaggcc

SEQ ID NO: 2983820 - RNA, 18 nt, Human
caacacucauugaccuga

SEQ ID NO: 2983821 - RNA, 22 nt, Human
caacacucacauuuauucugcu

SEQ ID NO: 2983822 - RNA, 22 nt, Human
caaccccuucgcuccugugucu

SEQ ID NO: 2983823 - RNA, 14 nt, Human
caaccuccugggcu

SEQ ID NO: 2983824 - RNA, 15 nt, Human
caaccuccugggcua

SEQ ID NO: 2983825 - RNA, 13 nt, Human
caacgucugugcc

SEQ ID NO: 2983826 - RNA, 14 nt, Human
caacgucugugcca

SEQ ID NO: 2983827 - RNA, 17 nt, Human
caagaccuucuccuuca

SEQ ID NO: 2983828 - RNA, 18 nt, Human
caagaccuucuccuucac

SEQ ID NO: 2983829 - RNA, 16 nt, Human
caagacgcugugcugc

SEQ ID NO: 2983830 - RNA, 17 nt, Human
caagacgcugugcugcc

SEQ ID NO: 2983831 - RNA, 14 nt, Human
caagaccuucuccu

SEQ ID NO: 2983832 - RNA, 16 nt, Human
caagaccuucuccuuc

SEQ ID NO: 2983833 - RNA, 20 nt, Human
caagaacuuuccaggaaggc

SEQ ID NO: 2983834 - RNA, 17 nt, Human
caagcaccuccugccuc

SEQ ID NO: 2983835 - RNA, 16 nt, Human
caagcaccuccugccu

SEQ ID NO: 2983836 - RNA, 15 nt, Human
caagcaccuccugcc

SEQ ID NO: 2983837 - RNA, 16 nt, Human
caagagcccaggccuc

SEQ ID NO: 2983838 - RNA, 18 nt, Human
caagacucuuuggacacu

SEQ ID NO: 2983839 - RNA, 13 nt, Human
caagagcccaggc

SEQ ID NO: 2983840 - RNA, 14 nt, Human
caagagcccaggcc

SEQ ID NO: 2983841 - RNA, 15 nt, Human
caagagcccaggccu

SEQ ID NO: 2983842 - RNA, 14 nt, Human
caagacucccauga

SEQ ID NO: 2983843 - RNA, 23 nt, Human
caagacgcugugcugcccugccc

SEQ ID NO: 2983844 - RNA, 18 nt, Human
caagacucccaugaggga

SEQ ID NO: 2983845 - RNA, 18 nt, Human
caagacgcugugcugccc

SEQ ID NO: 2983846 - RNA, 19 nt, Human
caaugagaucauugugaag

SEQ ID NO: 2983847 - RNA, 17 nt, Human
caaugcacuuuguucug

SEQ ID NO: 2983848 - RNA, 20 nt, Human
caaugcacuuuguucuggcu

SEQ ID NO: 2983849 - RNA, 21 nt, Human
caaugcacuuuguucuggcuc

SEQ ID NO: 2983850 - RNA, 22 nt, Human
caaugugacuuaaugccacuaa

SEQ ID NO: 2983851 - RNA, 22 nt, Human
caauuugcacauuaaaugacuc

SEQ ID NO: 2983852 - RNA, 15 nt, Human
caauuugcacauuaa

SEQ ID NO: 2983853 - RNA, 14 nt, Human
caauuugcacauua

SEQ ID NO: 2983854 - RNA, 16 nt, Human
caauuacaggaaguac

SEQ ID NO: 2983855 - RNA, 23 nt, Human
caauucucauuugucacacacuu

SEQ ID NO: 2983856 - RNA, 15 nt, Human
caaugugauaaaacc

SEQ ID NO: 2983857 - RNA, 17 nt, Human
caaugugauaaaacccc

SEQ ID NO: 2983858 - RNA, 16 nt, Human
caaguuaguucaaucu

SEQ ID NO: 2983859 - RNA, 23 nt, Human
caauacaucccuuaccugggaaa

SEQ ID NO: 2983860 - RNA, 12 nt, Human
caauaggaaaaa

SEQ ID NO: 2983861 - RNA, 13 nt, Human
caauaggaaaaac

SEQ ID NO: 2983862 - RNA, 23 nt, Human
caaucugugaugacauucccugc

SEQ ID NO: 2983863 - RNA, 23 nt, Human
caaugaccuuucaauaggaaaaa

SEQ ID NO: 2983864 - RNA, 20 nt, Human
caaucuggauucauauuuaa

SEQ ID NO: 2983865 - RNA, 16 nt, Human
caaucuggauucauau

SEQ ID NO: 2983866 - RNA, 21 nt, Human
caaugaccuuucaauaggaaa

SEQ ID NO: 2983867 - RNA, 15 nt, Human
caaugacuuacugua

SEQ ID NO: 2983868 - RNA, 18 nt, Human
caaugacuuacuguacau

SEQ ID NO: 2983869 - RNA, 17 nt, Human
caaugacuuacuguaca

SEQ ID NO: 2983870 - RNA, 17 nt, Human
caauauucgcuguguca

SEQ ID NO: 2983871 - RNA, 14 nt, Human
caauaggaaaaacu

SEQ ID NO: 2983872 - RNA, 20 nt, Human
uucuucccaauagcaaggcu

SEQ ID NO: 2983873 - RNA, 21 nt, Human
uucuuccacaagagcccaggc

SEQ ID NO: 2983874 - RNA, 21 nt, Human
uucuuauacauuugauaaagu

SEQ ID NO: 2983875 - RNA, 14 nt, Human
uucuuguguguuua

SEQ ID NO: 2983876 - RNA, 13 nt, Human
uucuuccucccuc

SEQ ID NO: 2983877 - RNA, 21 nt, Human
uucuuguguguuuauugucaa

SEQ ID NO: 2983878 - RNA, 14 nt, Human
uucuuuccaaagua

SEQ ID NO: 2983879 - RNA, 12 nt, Human
uucuuucagcca

SEQ ID NO: 2983880 - RNA, 22 nt, Human
uugaaaacacuguucucugccc

SEQ ID NO: 2983881 - RNA, 23 nt, Human
uugaaaacacuguucucugcccu

SEQ ID NO: 2983882 - RNA, 20 nt, Human
uugaaaaaccauuuugcugu

SEQ ID NO: 2983883 - RNA, 21 nt, Human
uucuuuccaaaguacacuguu

SEQ ID NO: 2983884 - RNA, 16 nt, Human
uugaacuccuggccuc

SEQ ID NO: 2983885 - RNA, 15 nt, Human
uugaacuccuggccu

SEQ ID NO: 2983886 - RNA, 15 nt, Human
uucuggacuaaaacu

SEQ ID NO: 2983887 - RNA, 14 nt, Human
uucugcuucagccu

SEQ ID NO: 2983888 - RNA, 16 nt, Human
uucugcuucagccucc

SEQ ID NO: 2983889 - RNA, 15 nt, Human
uucugcuucagccuc

SEQ ID NO: 2983890 - RNA, 19 nt, Human
uucugcuucagccucccga

SEQ ID NO: 2983891 - RNA, 18 nt, Human
uucuguauuuuguuuuug

SEQ ID NO: 2983892 - RNA, 15 nt, Human
uucuggauauagcua

SEQ ID NO: 2983893 - RNA, 19 nt, Human
uucuguccuacucuguguc

SEQ ID NO: 2983894 - RNA, 17 nt, Human
uucugucuucacaacag

SEQ ID NO: 2983895 - RNA, 22 nt, Human
uugauugggcacaucauuucaa

SEQ ID NO: 2983896 - RNA, 17 nt, Human
uugauugggcacaucau

SEQ ID NO: 2983897 - RNA, 16 nt, Human
uugauugggcacauca

SEQ ID NO: 2983898 - RNA, 16 nt, Human
uugaugaucuuugcag

SEQ ID NO: 2983899 - RNA, 21 nt, Human
uugcaaaguaucccuacugua

SEQ ID NO: 2983900 - RNA, 22 nt, Human
uugcaaauaaguguauuuugaa

SEQ ID NO: 2983901 - RNA, 14 nt, Human
uugaugaagaaguu

SEQ ID NO: 2983902 - RNA, 13 nt, Human
uugaugaagaagu

SEQ ID NO: 2983903 - RNA, 23 nt, Human
uugaugaagaaguugauaugccu

SEQ ID NO: 2983904 - RNA, 23 nt, Human
uugauauccucuuugagugaagc

SEQ ID NO: 2983905 - RNA, 23 nt, Human
uugauagcacagacccugcccug

SEQ ID NO: 2983906 - RNA, 16 nt, Human
uugaggguugggcugg

SEQ ID NO: 2983907 - RNA, 13 nt, Human
uugaggguugggc

SEQ ID NO: 2983908 - RNA, 11 nt, Human
uugagccuggg

SEQ ID NO: 2983909 - RNA, 19 nt, Human
uugacuauuuuuguuuuua

SEQ ID NO: 2983910 - RNA, 15 nt, Human
uugacgccaucccag

SEQ ID NO: 2983911 - RNA, 21 nt, Human
uugacuauuuuuguuuuuauu

SEQ ID NO: 2983912 - RNA, 16 nt, Human
uugaccucugcagcaa

SEQ ID NO: 2983913 - RNA, 17 nt, Human
uugacgccaucccagcc

SEQ ID NO: 2983914 - RNA, 18 nt, Human
uugacgccaucccagccc

SEQ ID NO: 2983915 - RNA, 19 nt, Human
uugacgccaucccagcccc

SEQ ID NO: 2983916 - RNA, 17 nt, Human
uugaccgugaggccaga

SEQ ID NO: 2983917 - RNA, 17 nt, Human
uugacccacaagaaaug

SEQ ID NO: 2983918 - RNA, 14 nt, Human
uugacccacaagaa

SEQ ID NO: 2983919 - RNA, 15 nt, Human
uugaccucugcagca

SEQ ID NO: 2983920 - RNA, 14 nt, Human
uugaccucugcagc

SEQ ID NO: 2983921 - RNA, 21 nt, Human
uugaccucaggugauccaccc

SEQ ID NO: 2983922 - RNA, 12 nt, Human
uugaauuuuaca

SEQ ID NO: 2983923 - RNA, 14 nt, Human
uugaauuguaagga

SEQ ID NO: 2983924 - RNA, 13 nt, Human
uugaacuuugacc

SEQ ID NO: 2983925 - RNA, 18 nt, Human
uugaacuggguacuugug

SEQ ID NO: 2983926 - RNA, 22 nt, Human
uucucauguugaaacuuuaaga

SEQ ID NO: 2983927 - RNA, 21 nt, Human
uucuaugaaauauuauguuaa

SEQ ID NO: 2983928 - RNA, 14 nt, Human
uucuaugaaauauu

SEQ ID NO: 2983929 - RNA, 16 nt, Human
uucuccacccugcucu

SEQ ID NO: 2983930 - RNA, 21 nt, Human
uucuccaccucccacaaagga

SEQ ID NO: 2983931 - RNA, 12 nt, Human
uucuccaccugc

SEQ ID NO: 2983932 - RNA, 14 nt, Human
uucuccaccugcca

SEQ ID NO: 2983933 - RNA, 15 nt, Human
uucuccaccugccag

SEQ ID NO: 2983934 - RNA, 16 nt, Human
uucuccaccugccagg

SEQ ID NO: 2983935 - RNA, 18 nt, Human
uucuccaccugccaggga

SEQ ID NO: 2983936 - RNA, 20 nt, Human
uucuccaccugccagggaca

SEQ ID NO: 2983937 - RNA, 23 nt, Human
uucucuccucuccccaugauguu

SEQ ID NO: 2983938 - RNA, 19 nt, Human
uucucuccuguaccucuug

SEQ ID NO: 2983939 - RNA, 14 nt, Human
uucucucaucuguu

SEQ ID NO: 2983940 - RNA, 11 nt, Human
uucucugcccu

SEQ ID NO: 2983941 - RNA, 12 nt, Human
uucucugcccuc

SEQ ID NO: 2983942 - RNA, 20 nt, Human
uucucugaggacacuaacca

SEQ ID NO: 2983943 - RNA, 14 nt, Human
uucucugaggacac

SEQ ID NO: 2983944 - RNA, 18 nt, Human
uucucuccuguaccucuu

SEQ ID NO: 2983945 - RNA, 14 nt, Human
uucucuccuguacc

SEQ ID NO: 2983946 - RNA, 15 nt, Human
uucucuccagccccu

SEQ ID NO: 2983947 - RNA, 16 nt, Human
uucucuccagccccug

SEQ ID NO: 2983948 - RNA, 13 nt, Human
uucucuccagccc

SEQ ID NO: 2983949 - RNA, 14 nt, Human
uucucuccagcccc

SEQ ID NO: 2983950 - RNA, 16 nt, Human
uucucugcccuccaag

SEQ ID NO: 2983951 - RNA, 17 nt, Human
uucucugcccuccaaga

SEQ ID NO: 2983952 - RNA, 23 nt, Human
uucugacccaugcugcccuguga

SEQ ID NO: 2983953 - RNA, 22 nt, Human
uucugacccaugcugcccugug

SEQ ID NO: 2983954 - RNA, 18 nt, Human
uucugacccugcuucaaa

SEQ ID NO: 2983955 - RNA, 16 nt, Human
uucugagaaagacuau

SEQ ID NO: 2983956 - RNA, 21 nt, Human
uucugagaaagacuauucaaa

SEQ ID NO: 2983957 - RNA, 19 nt, Human
uucugcucacauaucuguc

SEQ ID NO: 2983958 - RNA, 19 nt, Human
uucugauccuaguuccacc

SEQ ID NO: 2983959 - RNA, 21 nt, Human
uucuauauaauuccuguuuuu

SEQ ID NO: 2983960 - RNA, 21 nt, Human
uucuauaauuuccauuuacuu

SEQ ID NO: 2983961 - RNA, 22 nt, Human
uucuacucgaguuacagacaaa

SEQ ID NO: 2983962 - RNA, 14 nt, Human
uucuacccaggugc

SEQ ID NO: 2983963 - RNA, 21 nt, Human
uucuacccagcgagcccuggu

SEQ ID NO: 2983964 - RNA, 20 nt, Human
uucuacccagcgagcccugg

SEQ ID NO: 2983965 - RNA, 13 nt, Human
uucuacgccaggg

SEQ ID NO: 2983966 - RNA, 15 nt, Human
uucuacauacuaugg

SEQ ID NO: 2983967 - RNA, 19 nt, Human
uucuacccagcgagcccug

SEQ ID NO: 2983968 - RNA, 12 nt, Human
uucuacccagcg

SEQ ID NO: 2983969 - RNA, 18 nt, Human
uucggugagcuacaaaug

SEQ ID NO: 2983970 - RNA, 21 nt, Human
uuccuugaguugauucagcuc

SEQ ID NO: 2983971 - RNA, 14 nt, Human
uuccugcugagccu

SEQ ID NO: 2983972 - RNA, 23 nt, Human
uuccugaugcuucuucagagacu

SEQ ID NO: 2983973 - RNA, 20 nt, Human
uuccugaggcugggcucccu

SEQ ID NO: 2983974 - RNA, 15 nt, Human
uuccugaggcugggc

SEQ ID NO: 2983975 - RNA, 12 nt, Human
uuccauggccuc

SEQ ID NO: 2983976 - RNA, 16 nt, Human
uuccauggccucuuca

SEQ ID NO: 2983977 - RNA, 18 nt, Human
uuccugaagaauugaaaa

SEQ ID NO: 2983978 - RNA, 14 nt, Human
uucacgcccuuggc

SEQ ID NO: 2983979 - RNA, 13 nt, Human
uucacggaagagc

SEQ ID NO: 2983980 - RNA, 22 nt, Human
uucaccuuuguccccaccgcag

SEQ ID NO: 2983981 - RNA, 17 nt, Human
uucaccuccuaaaacaa

SEQ ID NO: 2983982 - RNA, 17 nt, Human
uucacggaagagccuug

SEQ ID NO: 2983983 - RNA, 14 nt, Human
uucagacagcugcc

SEQ ID NO: 2983984 - RNA, 15 nt, Human
uucagacagcugccu

SEQ ID NO: 2983985 - RNA, 16 nt, Human
uucagacagcugccug

SEQ ID NO: 2983986 - RNA, 20 nt, Human
uucagauaaucacaauacau

SEQ ID NO: 2983987 - RNA, 20 nt, Human
uucagagcugcccucuccug

SEQ ID NO: 2983988 - RNA, 19 nt, Human
uucagagcugcccucuccu

SEQ ID NO: 2983989 - RNA, 18 nt, Human
uucagagcugcccucucc

SEQ ID NO: 2983990 - RNA, 17 nt, Human
uucagacagcugccugg

SEQ ID NO: 2983991 - RNA, 17 nt, Human
uucagagcugcccucuc

SEQ ID NO: 2983992 - RNA, 15 nt, Human
uucagagcugcccuc

SEQ ID NO: 2983993 - RNA, 14 nt, Human
uucagagcugcccu

SEQ ID NO: 2983994 - RNA, 22 nt, Human
uucaauaggaaaaacugauuuu

SEQ ID NO: 2983995 - RNA, 21 nt, Human
uucaauaggaaaaacugauuu

SEQ ID NO: 2983996 - RNA, 18 nt, Human
uucacaaaguaauuugga

SEQ ID NO: 2983997 - RNA, 16 nt, Human
uucacaaaguaauuug

SEQ ID NO: 2983998 - RNA, 19 nt, Human
uucaccuuuguccccaccg

SEQ ID NO: 2983999 - RNA, 20 nt, Human
uucaccuuuguccccaccgc

SEQ ID NO: 2984000 - RNA, 14 nt, Human
uucaccuuuguccc

SEQ ID NO: 2984001 - RNA, 13 nt, Human
uucacccuuuucu

SEQ ID NO: 2984002 - RNA, 16 nt, Human
uuauuuggaaaggaau

SEQ ID NO: 2984003 - RNA, 22 nt, Human
uuauuugaguggaguuacugaa

SEQ ID NO: 2984004 - RNA, 20 nt, Human
uuauuuggaaaggaaugcaa

SEQ ID NO: 2984005 - RNA, 21 nt, Human
uuauuugcagugcaguauaga

SEQ ID NO: 2984006 - RNA, 18 nt, Human
uuauuuuauuaugcauga

SEQ ID NO: 2984007 - RNA, 20 nt, Human
uuauuuuaauaauguuucaa

SEQ ID NO: 2984008 - RNA, 19 nt, Human
uuauuuuaauaauguuuca

SEQ ID NO: 2984009 - RNA, 17 nt, Human
uuauuuuaauaauguuu

SEQ ID NO: 2984010 - RNA, 22 nt, Human
uucaauaacuggaacacucuau

SEQ ID NO: 2984011 - RNA, 16 nt, Human
uucaauaacuggaaca

SEQ ID NO: 2984012 - RNA, 12 nt, Human
uucaauaacugg

SEQ ID NO: 2984013 - RNA, 21 nt, Human
uucaacagguuuuccugaaga

SEQ ID NO: 2984014 - RNA, 18 nt, Human
uucaaauguauuacagug

SEQ ID NO: 2984015 - RNA, 18 nt, Human
uucaaaugcuguaacuuu

SEQ ID NO: 2984016 - RNA, 17 nt, Human
uucaaauccuugaagau

SEQ ID NO: 2984017 - RNA, 22 nt, Human
uuauuuuggaaaauaaauuauu

SEQ ID NO: 2984018 - RNA, 23 nt, Human
uucaguuauuauauuuacaaaug

SEQ ID NO: 2984019 - RNA, 15 nt, Human
uucauccuccucaga

SEQ ID NO: 2984020 - RNA, 19 nt, Human
uucauccuccucagaucuu

SEQ ID NO: 2984021 - RNA, 15 nt, Human
uucauaaccuagccu

SEQ ID NO: 2984022 - RNA, 16 nt, Human
uucaguggcagcugcu

SEQ ID NO: 2984023 - RNA, 15 nt, Human
uucaguggcagcugc

SEQ ID NO: 2984024 - RNA, 17 nt, Human
uucaguggcagcugcuu

SEQ ID NO: 2984025 - RNA, 12 nt, Human
uucaguguacau

SEQ ID NO: 2984026 - RNA, 13 nt, Human
uucaguguacaug

SEQ ID NO: 2984027 - RNA, 13 nt, Human
uucaguggcagcu

SEQ ID NO: 2984028 - RNA, 14 nt, Human
uucaguggcagcug

SEQ ID NO: 2984029 - RNA, 22 nt, Human
uucagcuuguaaauagcucagg

SEQ ID NO: 2984030 - RNA, 15 nt, Human
uucagcuccagcuca

SEQ ID NO: 2984031 - RNA, 12 nt, Human
uucagcuccagc

SEQ ID NO: 2984032 - RNA, 21 nt, Human
uucagcugguugagguuucaa

SEQ ID NO: 2984033 - RNA, 18 nt, Human
uuccagauccuggaaauc

SEQ ID NO: 2984034 - RNA, 19 nt, Human
uuccaacccucaucaccaa

SEQ ID NO: 2984035 - RNA, 14 nt, Human
uuccauggacuuug

SEQ ID NO: 2984036 - RNA, 15 nt, Human
uuccauggacuuugu

SEQ ID NO: 2984037 - RNA, 13 nt, Human
uuccaaaguacac

SEQ ID NO: 2984038 - RNA, 16 nt, Human
uuccaaaguacacugu

SEQ ID NO: 2984039 - RNA, 14 nt, Human
uuagugauguaauu

SEQ ID NO: 2984040 - RNA, 13 nt, Human
ugugaaaagaaaa

SEQ ID NO: 2984041 - RNA, 15 nt, Human
ugugaaaagaaaaau

SEQ ID NO: 2984042 - RNA, 17 nt, Human
ugugaaaagaaaaauga

SEQ ID NO: 2984043 - RNA, 17 nt, Human
uuauaacuuuuuauauu

SEQ ID NO: 2984044 - RNA, 12 nt, Human
uuauaauuuaaa

SEQ ID NO: 2984045 - RNA, 15 nt, Human
uuauaauuuugugaa

SEQ ID NO: 2984046 - RNA, 14 nt, Human
uuauaauuuuguga

SEQ ID NO: 2984047 - RNA, 15 nt, Human
uuauaaugaaugaaa

SEQ ID NO: 2984048 - RNA, 11 nt, Human
uuauaaucuuu

SEQ ID NO: 2984049 - RNA, 15 nt, Human
uuauaauaauguuaa

SEQ ID NO: 2984050 - RNA, 18 nt, Human
uuauaauaauguuaacau

SEQ ID NO: 2984051 - RNA, 21 nt, Human
uuauauucucagcagagugcu

SEQ ID NO: 2984052 - RNA, 20 nt, Human
uuauauucucagcagagugc

SEQ ID NO: 2984053 - RNA, 19 nt, Human
uuauauucucagcagagug

SEQ ID NO: 2984054 - RNA, 18 nt, Human
uuauauucucagcagagu

SEQ ID NO: 2984055 - RNA, 16 nt, Human
uuauauucucagcaga

SEQ ID NO: 2984056 - RNA, 17 nt, Human
uuauaauuuugugaagc

SEQ ID NO: 2984057 - RNA, 16 nt, Human
uuauaauuuugugaag

SEQ ID NO: 2984058 - RNA, 18 nt, Human
uuauaauuuugugaagca

SEQ ID NO: 2984059 - RNA, 11 nt, Human
uuauacauaaa

SEQ ID NO: 2984060 - RNA, 13 nt, Human
uuauacauaaaca

SEQ ID NO: 2984061 - RNA, 23 nt, Human
uuauaucuauauuuuacauaaau

SEQ ID NO: 2984062 - RNA, 19 nt, Human
uuauaucuauauuuuacau

SEQ ID NO: 2984063 - RNA, 15 nt, Human
uuaugauugccuuuu

SEQ ID NO: 2984064 - RNA, 22 nt, Human
uuaugauuaaguaaugauaacu

SEQ ID NO: 2984065 - RNA, 11 nt, Human
uuaucucaaaa

SEQ ID NO: 2984066 - RNA, 13 nt, Human
uuaucuuacgaaa

SEQ ID NO: 2984067 - RNA, 16 nt, Human
uuauauuuacaaaugg

SEQ ID NO: 2984068 - RNA, 20 nt, Human
uuauauuuauuacuguaaga

SEQ ID NO: 2984069 - RNA, 12 nt, Human
uuauauuugaaa

SEQ ID NO: 2984070 - RNA, 13 nt, Human
uuauauuugaaau

SEQ ID NO: 2984071 - RNA, 11 nt, Human
uuauccucugu

SEQ ID NO: 2984072 - RNA, 21 nt, Human
uuaugauugccuuuuuauaac

SEQ ID NO: 2984073 - RNA, 17 nt, Human
uuauggaacacucugag

SEQ ID NO: 2984074 - RNA, 18 nt, Human
uuauggaacacucugaga

SEQ ID NO: 2984075 - RNA, 20 nt, Human
uuauggaacacucugagacu

SEQ ID NO: 2984076 - RNA, 21 nt, Human
uuauggacaaugacccagugg

SEQ ID NO: 2984077 - RNA, 16 nt, Human
uuauggcuuuugugca

SEQ ID NO: 2984078 - RNA, 18 nt, Human
uuauggcuauaggugcua

SEQ ID NO: 2984079 - RNA, 14 nt, Human
uuauggcacaucag

SEQ ID NO: 2984080 - RNA, 17 nt, Human
uuauggcuuuugugcau

SEQ ID NO: 2984081 - RNA, 16 nt, Human
uuauuaacaaaacagu

SEQ ID NO: 2984082 - RNA, 18 nt, Human
uuauuaagagguaagacu

SEQ ID NO: 2984083 - RNA, 19 nt, Human
uuauuaagagguaagacuu

SEQ ID NO: 2984084 - RNA, 23 nt, Human
uuauuaaaaaucucaaauuucua

SEQ ID NO: 2984085 - RNA, 19 nt, Human
uuauuaaaugcccagcccc

SEQ ID NO: 2984086 - RNA, 21 nt, Human
uuauuaaaugcccagccccuu

SEQ ID NO: 2984087 - RNA, 20 nt, Human
uugugaaaaaauuuacuuua

SEQ ID NO: 2984088 - RNA, 20 nt, Human
uugugaaaggaaagaggcuc

SEQ ID NO: 2984089 - RNA, 17 nt, Human
uugugauuuuuguaauu

SEQ ID NO: 2984090 - RNA, 16 nt, Human
uugugauuuuuguaau

SEQ ID NO: 2984091 - RNA, 12 nt, Human
uugugauuuuug

SEQ ID NO: 2984092 - RNA, 15 nt, Human
uugucuagugaaacu

SEQ ID NO: 2984093 - RNA, 15 nt, Human
uugucuuaaaaagug

SEQ ID NO: 2984094 - RNA, 19 nt, Human
uuguauucucuccuguacc

SEQ ID NO: 2984095 - RNA, 16 nt, Human
uuguauucucuccugu

SEQ ID NO: 2984096 - RNA, 15 nt, Human
uuguauucucuccug

SEQ ID NO: 2984097 - RNA, 15 nt, Human
uugguauuugaaaca

SEQ ID NO: 2984098 - RNA, 15 nt, Human
uuggucugugagaug

SEQ ID NO: 2984099 - RNA, 16 nt, Human
uuggucugugagaugc

SEQ ID NO: 2984100 - RNA, 13 nt, Human
uuggucuguguga

SEQ ID NO: 2984101 - RNA, 18 nt, Human
uuggguuacuauuucuug

SEQ ID NO: 2984102 - RNA, 22 nt, Human
uuggguucaagcgauucuucug

SEQ ID NO: 2984103 - RNA, 17 nt, Human
uuguaaauagcucaggu

SEQ ID NO: 2984104 - RNA, 23 nt, Human
uuguaaauuaacuuuuauaaacu

SEQ ID NO: 2984105 - RNA, 18 nt, Human
uuguaaauuaacuuuuau

SEQ ID NO: 2984106 - RNA, 16 nt, Human
uuguaaauuaacuuuu

SEQ ID NO: 2984107 - RNA, 15 nt, Human
uuguaaauuaacuuu

SEQ ID NO: 2984108 - RNA, 14 nt, Human
uuguacauaaugcg

SEQ ID NO: 2984109 - RNA, 18 nt, Human
uuguacauaaugcgugca

SEQ ID NO: 2984110 - RNA, 15 nt, Human
uugugccuaaugugu

SEQ ID NO: 2984111 - RNA, 18 nt, Human
uugugccuaauguguuug

SEQ ID NO: 2984112 - RNA, 12 nt, Human
uugugccccugc

SEQ ID NO: 2984113 - RNA, 23 nt, Human
uugugcauuaucuagauacugua

SEQ ID NO: 2984114 - RNA, 22 nt, Human
uugugcauuaucuagauacugu

SEQ ID NO: 2984115 - RNA, 12 nt, Human
uugugcauuugg

SEQ ID NO: 2984116 - RNA, 17 nt, Human
uugugcauuaucuagau

SEQ ID NO: 2984117 - RNA, 16 nt, Human
uuguggacacagcucu

SEQ ID NO: 2984118 - RNA, 17 nt, Human
uuguggacacagcucuu

SEQ ID NO: 2984119 - RNA, 21 nt, Human
uuguggauuuaacagaaaugu

SEQ ID NO: 2984120 - RNA, 20 nt, Human
uuguggauuuaacagaaaug

SEQ ID NO: 2984121 - RNA, 21 nt, Human
uuguguuuauauauaagccaa

SEQ ID NO: 2984122 - RNA, 20 nt, Human
uuguguugaagagguuuuaa

SEQ ID NO: 2984123 - RNA, 23 nt, Human
uuguggauuuaacagaaauguac

SEQ ID NO: 2984124 - RNA, 22 nt, Human
uuguggauuuaacagaaaugua

SEQ ID NO: 2984125 - RNA, 13 nt, Human
uuguguucaccuu

SEQ ID NO: 2984126 - RNA, 18 nt, Human
uuguguuuugcaagccag

SEQ ID NO: 2984127 - RNA, 21 nt, Human
uuguuaguaugaggcauuugu

SEQ ID NO: 2984128 - RNA, 19 nt, Human
uuguuaguaugaggcauuu

SEQ ID NO: 2984129 - RNA, 14 nt, Human
uuguuacauuuuua

SEQ ID NO: 2984130 - RNA, 14 nt, Human
uuguuuaaaaucau

SEQ ID NO: 2984131 - RNA, 22 nt, Human
uuguuaguaugaggcauuuguu

SEQ ID NO: 2984132 - RNA, 20 nt, Human
uuguuagugugucuuagugu

SEQ ID NO: 2984133 - RNA, 13 nt, Human
uuuauaacuuuuu

SEQ ID NO: 2984134 - RNA, 16 nt, Human
uuuauaacuuuuuaua

SEQ ID NO: 2984135 - RNA, 22 nt, Human
uuuauaauuuugugaagcaaaa

SEQ ID NO: 2984136 - RNA, 16 nt, Human
uuuauggcuuuugugc

SEQ ID NO: 2984137 - RNA, 14 nt, Human
uuuauggcuuuugu

SEQ ID NO: 2984138 - RNA, 17 nt, Human
uuuauggcacuaguauu

SEQ ID NO: 2984139 - RNA, 13 nt, Human
uuuauuauggcac

SEQ ID NO: 2984140 - RNA, 13 nt, Human
uuuauuaugcaug

SEQ ID NO: 2984141 - RNA, 22 nt, Human
uuuauuguuuaaaaucauuucu

SEQ ID NO: 2984142 - RNA, 12 nt, Human
uuuauuuaaaag

SEQ ID NO: 2984143 - RNA, 16 nt, Human
uuuauuuacaaauguu

SEQ ID NO: 2984144 - RNA, 14 nt, Human
uuuauuuacaaaug

SEQ ID NO: 2984145 - RNA, 18 nt, Human
uuucaauuuuaaacauau

SEQ ID NO: 2984146 - RNA, 16 nt, Human
uuucaauuuuaaacau

SEQ ID NO: 2984147 - RNA, 21 nt, Human
uuucagauaaucacaauacau

SEQ ID NO: 2984148 - RNA, 15 nt, Human
uuucaauuuuaaaca

SEQ ID NO: 2984149 - RNA, 17 nt, Human
uuucaauaggaaaaacu

SEQ ID NO: 2984150 - RNA, 12 nt, Human
uuucaauaggaa

SEQ ID NO: 2984151 - RNA, 14 nt, Human
uuucaauaggaaaa

SEQ ID NO: 2984152 - RNA, 14 nt, Human
uuucaguguacaug

SEQ ID NO: 2984153 - RNA, 13 nt, Human
uuucaguguacau

SEQ ID NO: 2984154 - RNA, 18 nt, Human
uuucauuuaggugaggaa

SEQ ID NO: 2984155 - RNA, 14 nt, Human
uuucauuuagguga

SEQ ID NO: 2984156 - RNA, 14 nt, Human
uuuacuuuaaacua

SEQ ID NO: 2984157 - RNA, 15 nt, Human
uuuacuucuuauaca

SEQ ID NO: 2984158 - RNA, 22 nt, Human
uuuacuucuuauacauuugaua

SEQ ID NO: 2984159 - RNA, 19 nt, Human
uuuacuucuuauacauuug

SEQ ID NO: 2984160 - RNA, 14 nt, Human
uuuagaaauauaau

SEQ ID NO: 2984161 - RNA, 12 nt, Human
uuuagacagagu

SEQ ID NO: 2984162 - RNA, 13 nt, Human
uuuaccacuugug

SEQ ID NO: 2984163 - RNA, 13 nt, Human
uuuacauuuuaca

SEQ ID NO: 2984164 - RNA, 21 nt, Human
uuuaauagguuuggacaaaau

SEQ ID NO: 2984165 - RNA, 22 nt, Human
uuuacacacuguacacauaagc

SEQ ID NO: 2984166 - RNA, 21 nt, Human
uuuacacacuguacacauaag

SEQ ID NO: 2984167 - RNA, 23 nt, Human
uuuacacacuguacacauaagcc

SEQ ID NO: 2984168 - RNA, 19 nt, Human
uuuacacacuguacacaua

SEQ ID NO: 2984169 - RNA, 18 nt, Human
uuuacacacuguacacau

SEQ ID NO: 2984170 - RNA, 17 nt, Human
uuuaagaacuaaaaugu

SEQ ID NO: 2984171 - RNA, 16 nt, Human
uuuaagacccucucaa

SEQ ID NO: 2984172 - RNA, 22 nt, Human
uuuaagaaaaaggaugcacaga

SEQ ID NO: 2984173 - RNA, 18 nt, Human
uuuaagaaaaaggaugca

SEQ ID NO: 2984174 - RNA, 13 nt, Human
uuuaauaauguuu

SEQ ID NO: 2984175 - RNA, 16 nt, Human
uuuaaguuauuaagag

SEQ ID NO: 2984176 - RNA, 19 nt, Human
uuuaacucuauaauguguu

SEQ ID NO: 2984177 - RNA, 18 nt, Human
uuuaacagaaauguacag

SEQ ID NO: 2984178 - RNA, 21 nt, Human
uuuugaagauucuauguuaau

SEQ ID NO: 2984179 - RNA, 11 nt, Human
uuuuuaaaugc

SEQ ID NO: 2984180 - RNA, 23 nt, Human
uuuuuaagugcugcauuuaaaag

SEQ ID NO: 2984181 - RNA, 22 nt, Human
uuuuuaagugcugcauuuaaaa

SEQ ID NO: 2984182 - RNA, 19 nt, Human
uuuuuaagugcugcauuua

SEQ ID NO: 2984183 - RNA, 18 nt, Human
uuuuuaagugcugcauuu

SEQ ID NO: 2984184 - RNA, 17 nt, Human
uuuuuaagugcugcauu

SEQ ID NO: 2984185 - RNA, 16 nt, Human
uuuuuaagugcugcau

SEQ ID NO: 2984186 - RNA, 12 nt, Human
uuuuuaagaaaa

SEQ ID NO: 2984187 - RNA, 18 nt, Human
uuuuuuaaaauaagucug

SEQ ID NO: 2984188 - RNA, 12 nt, Human
uuuuuuuuaaga

SEQ ID NO: 2984189 - RNA, 11 nt, Human
uuuuuuuacua

SEQ ID NO: 2984190 - RNA, 13 nt, Human
uuugguauuugaa

SEQ ID NO: 2984191 - RNA, 18 nt, Human
uuuguauaaaauaauuuu

SEQ ID NO: 2984192 - RNA, 17 nt, Human
uuuggucuacacugugc

SEQ ID NO: 2984193 - RNA, 16 nt, Human
uuuguauaaaauaauu

SEQ ID NO: 2984194 - RNA, 17 nt, Human
uuuguauaaaauaauuu

SEQ ID NO: 2984195 - RNA, 15 nt, Human
uuuguauucucuccu

SEQ ID NO: 2984196 - RNA, 22 nt, Human
uuuguuaguaugaggcauuugu

SEQ ID NO: 2984197 - RNA, 15 nt, Human
uuuguugucagcuga

SEQ ID NO: 2984198 - RNA, 22 nt, Human
uuuuaaaauaagucugauuuaa

SEQ ID NO: 2984199 - RNA, 15 nt, Human
uuuuaaaauaagucu

SEQ ID NO: 2984200 - RNA, 18 nt, Human
uuuggaaaggaaugcaaa

SEQ ID NO: 2984201 - RNA, 17 nt, Human
uuuggaaaggaaugcaa

SEQ ID NO: 2984202 - RNA, 16 nt, Human
uuuggaaaggaaugca

SEQ ID NO: 2984203 - RNA, 19 nt, Human
uuuggaaaggaaugcaaag

SEQ ID NO: 2984204 - RNA, 12 nt, Human
uuuggaaaauaa

SEQ ID NO: 2984205 - RNA, 13 nt, Human
uuuggacccugag

SEQ ID NO: 2984206 - RNA, 19 nt, Human
uuuggacaaaauggaauac

SEQ ID NO: 2984207 - RNA, 15 nt, Human
uuugcaggaaauccu

SEQ ID NO: 2984208 - RNA, 19 nt, Human
uuugcagugcaguauagaa

SEQ ID NO: 2984209 - RNA, 22 nt, Human
uuugaguggaguuacugaacag

SEQ ID NO: 2984210 - RNA, 21 nt, Human
uuugagugccuuacacaaugg

SEQ ID NO: 2984211 - RNA, 15 nt, Human
uuuccguuaaaauac

SEQ ID NO: 2984212 - RNA, 13 nt, Human
uuugagugccuua

SEQ ID NO: 2984213 - RNA, 17 nt, Human
uuuccguuaaaauacca

SEQ ID NO: 2984214 - RNA, 15 nt, Human
uuuccacagaagcuc

SEQ ID NO: 2984215 - RNA, 13 nt, Human
uuuugaaauguca

SEQ ID NO: 2984216 - RNA, 16 nt, Human
uuuucuuucagccaag

SEQ ID NO: 2984217 - RNA, 22 nt, Human
uuuucuuguguguuuauuguca

SEQ ID NO: 2984218 - RNA, 13 nt, Human
uuuucuucucccu

SEQ ID NO: 2984219 - RNA, 20 nt, Human
uuuucuacucgaguuacaga

SEQ ID NO: 2984220 - RNA, 22 nt, Human
uuuucuacucgaguuacagaca

SEQ ID NO: 2984221 - RNA, 23 nt, Human
uuuucuacucgaguuacagacaa

SEQ ID NO: 2984222 - RNA, 13 nt, Human
uuuucuuauuuca

SEQ ID NO: 2984223 - RNA, 13 nt, Human
uuuucuacucgag

SEQ ID NO: 2984224 - RNA, 15 nt, Human
uuuucaaauguucuc

SEQ ID NO: 2984225 - RNA, 16 nt, Human
uuuucacauuggaaac

SEQ ID NO: 2984226 - RNA, 18 nt, Human
uuuucccuauuagagaag

SEQ ID NO: 2984227 - RNA, 22 nt, Human
uuuucccuauuagagaagagau

SEQ ID NO: 2984228 - RNA, 13 nt, Human
uuuuaucuucuau

SEQ ID NO: 2984229 - RNA, 19 nt, Human
uuuuaucgucacugcuuaa

SEQ ID NO: 2984230 - RNA, 18 nt, Human
uuuuauuuuuagacagag

SEQ ID NO: 2984231 - RNA, 17 nt, Human
uuuucaaaauaaaaaug

SEQ ID NO: 2984232 - RNA, 18 nt, Human
uuuuauauuugaaauauu

SEQ ID NO: 2984233 - RNA, 13 nt, Human
uuuuauauuugaa

SEQ ID NO: 2984234 - RNA, 21 nt, Human
uuuuauacauaaacaagacca

SEQ ID NO: 2984235 - RNA, 13 nt, Human
uuuuauacauaaa

SEQ ID NO: 2984236 - RNA, 15 nt, Human
uuuuacuaauagaca

SEQ ID NO: 2984237 - RNA, 21 nt, Human
uuuuauaauuuugugaagcaa

SEQ ID NO: 2984238 - RNA, 23 nt, Human
uuuuauaauuuugugaagcaaaa

SEQ ID NO: 2984239 - RNA, 21 nt, Human
uuuuaaaguaacccuacaaaa

SEQ ID NO: 2984240 - RNA, 13 nt, Human
uuuuuuuugacaa

SEQ ID NO: 2984241 - RNA, 21 nt, Human
ugcacugacauuguuggccaa

SEQ ID NO: 2984242 - RNA, 18 nt, Human
ugcacugacauuguuggc

SEQ ID NO: 2984243 - RNA, 16 nt, Human
ugcacugucaagauga

SEQ ID NO: 2984244 - RNA, 16 nt, Human
ugcacgcacacugucu

SEQ ID NO: 2984245 - RNA, 22 nt, Human
ugcaccuggaauauauaaccag

SEQ ID NO: 2984246 - RNA, 20 nt, Human
ugcaccuggaauauauaacc

SEQ ID NO: 2984247 - RNA, 17 nt, Human
ugcaccuggaauauaua

SEQ ID NO: 2984248 - RNA, 21 nt, Human
ugcaccggcuggccuggcccc

SEQ ID NO: 2984249 - RNA, 19 nt, Human
ugcaccggcuggccuggcc

SEQ ID NO: 2984250 - RNA, 20 nt, Human
ugcaccggcuggccuggccc

SEQ ID NO: 2984251 - RNA, 18 nt, Human
ugcaccggcuggccuggc

SEQ ID NO: 2984252 - RNA, 15 nt, Human
ugcacaaacagaggc

SEQ ID NO: 2984253 - RNA, 16 nt, Human
ugcacaaacagaggcc

SEQ ID NO: 2984254 - RNA, 17 nt, Human
ugcacaaacagaggccg

SEQ ID NO: 2984255 - RNA, 19 nt, Human
ugcacaaacagaggccgcc

SEQ ID NO: 2984256 - RNA, 20 nt, Human
ugcacaaacagaggccgcca

SEQ ID NO: 2984257 - RNA, 19 nt, Human
ugcacagaguuguuacauu

SEQ ID NO: 2984258 - RNA, 18 nt, Human
ugcacagaguuguuacau

SEQ ID NO: 2984259 - RNA, 17 nt, Human
ugcacagaguuguuaca

SEQ ID NO: 2984260 - RNA, 17 nt, Human
ugcaaugaccuuucaau

SEQ ID NO: 2984261 - RNA, 19 nt, Human
ugcaaugaccuuucaauag

SEQ ID NO: 2984262 - RNA, 22 nt, Human
ugcaaugaccuuucaauaggaa

SEQ ID NO: 2984263 - RNA, 23 nt, Human
ugcaaugaccuuucaauaggaaa

SEQ ID NO: 2984264 - RNA, 13 nt, Human
ugcaaugaccuuu

SEQ ID NO: 2984265 - RNA, 16 nt, Human
ugcaaugaccuuucaa

SEQ ID NO: 2984266 - RNA, 16 nt, Human
ugcaauggcagccuug

SEQ ID NO: 2984267 - RNA, 15 nt, Human
ugcaauggcagccuu

SEQ ID NO: 2984268 - RNA, 14 nt, Human
ugcaauggcagccu

SEQ ID NO: 2984269 - RNA, 13 nt, Human
ugcaauggcagcc

SEQ ID NO: 2984270 - RNA, 14 nt, Human
ugcaaccuccgccu

SEQ ID NO: 2984271 - RNA, 13 nt, Human
ugcaaccuccgcc

SEQ ID NO: 2984272 - RNA, 20 nt, Human
ugcaacaggcugggcuucag

SEQ ID NO: 2984273 - RNA, 19 nt, Human
ugcaacaggcugggcuuca

SEQ ID NO: 2984274 - RNA, 17 nt, Human
ugcaacaggcugggcuu

SEQ ID NO: 2984275 - RNA, 16 nt, Human
ugcaacaggcugggcu

SEQ ID NO: 2984276 - RNA, 15 nt, Human
ugcaacaggcugggc

SEQ ID NO: 2984277 - RNA, 14 nt, Human
ugcaacaggcuggg

SEQ ID NO: 2984278 - RNA, 21 nt, Human
ugcaaccuccgccucuugggu

SEQ ID NO: 2984279 - RNA, 20 nt, Human
ugcaaccuccgccucuuggg

SEQ ID NO: 2984280 - RNA, 18 nt, Human
ugcaaccuccgccucuug

SEQ ID NO: 2984281 - RNA, 19 nt, Human
ugcaaccugauugugucuc

SEQ ID NO: 2984282 - RNA, 20 nt, Human
ugcaaccugauugugucucu

SEQ ID NO: 2984283 - RNA, 22 nt, Human
ugcaaccugauugugucucuug

SEQ ID NO: 2984284 - RNA, 22 nt, Human
ugcaacucugaaggguaauuau

SEQ ID NO: 2984285 - RNA, 16 nt, Human
ugauuuuuuuuuccuu

SEQ ID NO: 2984286 - RNA, 17 nt, Human
ugauuuuuuuuuccuuc

SEQ ID NO: 2984287 - RNA, 19 nt, Human
ugauuuuuuuuuccuucag

SEQ ID NO: 2984288 - RNA, 20 nt, Human
ugauuuuuuuuuccuucagu

SEQ ID NO: 2984289 - RNA, 22 nt, Human
ugauuuuuuuuuccuucagugc

SEQ ID NO: 2984290 - RNA, 23 nt, Human
ugauuuuuuuuuccuucagugcc

SEQ ID NO: 2984291 - RNA, 15 nt, Human
ugcaaaaaaaauuag

SEQ ID NO: 2984292 - RNA, 20 nt, Human
ugcaaaaaaaauuagccggg

SEQ ID NO: 2984293 - RNA, 13 nt, Human
ugauuuucauugc

SEQ ID NO: 2984294 - RNA, 15 nt, Human
ugauuuucauugcug

SEQ ID NO: 2984295 - RNA, 22 nt, Human
ugcagaguaggggucugucuuu

SEQ ID NO: 2984296 - RNA, 19 nt, Human
ugcagauaaacaguaguga

SEQ ID NO: 2984297 - RNA, 17 nt, Human
ugcagauaaacaguagu

SEQ ID NO: 2984298 - RNA, 17 nt, Human
ugcaugguuuagaaagc

SEQ ID NO: 2984299 - RNA, 17 nt, Human
ugcaugguuuggagcug

SEQ ID NO: 2984300 - RNA, 15 nt, Human
ugcauguuugugauu

SEQ ID NO: 2984301 - RNA, 17 nt, Human
ugcauuaucuagauacu

SEQ ID NO: 2984302 - RNA, 12 nt, Human
ugcauuaucuag

SEQ ID NO: 2984303 - RNA, 21 nt, Human
ugcauuauauuuauuacugua

SEQ ID NO: 2984304 - RNA, 18 nt, Human
ugccaugagccgcccaag

SEQ ID NO: 2984305 - RNA, 19 nt, Human
ugccaugagccgcccaagg

SEQ ID NO: 2984306 - RNA, 20 nt, Human
ugccaugaggaacaaggcaa

SEQ ID NO: 2984307 - RNA, 23 nt, Human
ugccaugaggaacaaggcaaggc

SEQ ID NO: 2984308 - RNA, 21 nt, Human
ugccaugagccgcccaaggcc

SEQ ID NO: 2984309 - RNA, 20 nt, Human
ugccaugagccgcccaaggc

SEQ ID NO: 2984310 - RNA, 23 nt, Human
ugccaugagccgcccaaggccuu

SEQ ID NO: 2984311 - RNA, 14 nt, Human
ugccaugugccagg

SEQ ID NO: 2984312 - RNA, 15 nt, Human
ugccaugugccaggu

SEQ ID NO: 2984313 - RNA, 21 nt, Human
ugcccacucccugcaaccuga

SEQ ID NO: 2984314 - RNA, 19 nt, Human
ugcccaccuggccucugca

SEQ ID NO: 2984315 - RNA, 18 nt, Human
ugcccacgcuggagugca

SEQ ID NO: 2984316 - RNA, 20 nt, Human
ugcccaccuggccucugcac

SEQ ID NO: 2984317 - RNA, 16 nt, Human
ugccauguuggccagg

SEQ ID NO: 2984318 - RNA, 12 nt, Human
ugccauguuggc

SEQ ID NO: 2984319 - RNA, 15 nt, Human
ugccauguuggccag

SEQ ID NO: 2984320 - RNA, 12 nt, Human
ugccaggaagcc

SEQ ID NO: 2984321 - RNA, 16 nt, Human
ugccaggaagccagca

SEQ ID NO: 2984322 - RNA, 18 nt, Human
ugccaggaagccagcagg

SEQ ID NO: 2984323 - RNA, 19 nt, Human
ugccaggaagccagcaggc

SEQ ID NO: 2984324 - RNA, 23 nt, Human
ugccagggccaugucagacacag

SEQ ID NO: 2984325 - RNA, 17 nt, Human
ugccagguuuuuggucu

SEQ ID NO: 2984326 - RNA, 15 nt, Human
ugccauccagguuca

SEQ ID NO: 2984327 - RNA, 12 nt, Human
ugccauccaagu

SEQ ID NO: 2984328 - RNA, 12 nt, Human
ugccauccaggu

SEQ ID NO: 2984329 - RNA, 15 nt, Human
ugccgucuaccugag

SEQ ID NO: 2984330 - RNA, 16 nt, Human
ugccgucuaccugagg

SEQ ID NO: 2984331 - RNA, 17 nt, Human
ugccgucuaccugaggg

SEQ ID NO: 2984332 - RNA, 19 nt, Human
ugccgucuaccugaggggc

SEQ ID NO: 2984333 - RNA, 19 nt, Human
ugcccuaaaguguauuuuu

SEQ ID NO: 2984334 - RNA, 17 nt, Human
ugcccuaaaguguauuu

SEQ ID NO: 2984335 - RNA, 22 nt, Human
ugcccugcccaccuggccucug

SEQ ID NO: 2984336 - RNA, 23 nt, Human
ugcccugcccaccuggccucugc

SEQ ID NO: 2984337 - RNA, 21 nt, Human
ugcccugcccaccuggccucu

SEQ ID NO: 2984338 - RNA, 21 nt, Human
ugccuccuuugugaggaagcc

SEQ ID NO: 2984339 - RNA, 20 nt, Human
ugccuccuuugugaggaagc

SEQ ID NO: 2984340 - RNA, 22 nt, Human
ugccuccuuugugaggaagccg

SEQ ID NO: 2984341 - RNA, 13 nt, Human
ugccucugggacu

SEQ ID NO: 2984342 - RNA, 21 nt, Human
ugccucuucucuacucuaggg

SEQ ID NO: 2984343 - RNA, 19 nt, Human
ugccuggguggaugggcca

SEQ ID NO: 2984344 - RNA, 19 nt, Human
ugccugguggcagcugcgg

SEQ ID NO: 2984345 - RNA, 18 nt, Human
ugccugguggcagcugcg

SEQ ID NO: 2984346 - RNA, 17 nt, Human
ugccugguggcagcugc

SEQ ID NO: 2984347 - RNA, 16 nt, Human
ugauguaauuaugguu

SEQ ID NO: 2984348 - RNA, 18 nt, Human
ugaugcuucuucagagac

SEQ ID NO: 2984349 - RNA, 19 nt, Human
ugaugcuucuucagagacu

SEQ ID NO: 2984350 - RNA, 21 nt, Human
ugaugcuucuucagagacucc

SEQ ID NO: 2984351 - RNA, 22 nt, Human
ugaugcuucuucagagacuccu

SEQ ID NO: 2984352 - RNA, 20 nt, Human
ugaucuuugcagacaggcaa

SEQ ID NO: 2984353 - RNA, 19 nt, Human
ugaucuuugcagacaggca

SEQ ID NO: 2984354 - RNA, 23 nt, Human
ugaucuuugcagacaggcaagca

SEQ ID NO: 2984355 - RNA, 21 nt, Human
ugaucuuugcagacaggcaag

SEQ ID NO: 2984356 - RNA, 18 nt, Human
ugaucuuugcagacaggc

SEQ ID NO: 2984357 - RNA, 20 nt, Human
ugaugaugaaaugaggucag

SEQ ID NO: 2984358 - RNA, 23 nt, Human
ugaugaucuuugcagacaggcaa

SEQ ID NO: 2984359 - RNA, 22 nt, Human
ugaugaucuuugcagacaggca

SEQ ID NO: 2984360 - RNA, 14 nt, Human
ugaugccaugagga

SEQ ID NO: 2984361 - RNA, 20 nt, Human
ugauccacccaccucagccu

SEQ ID NO: 2984362 - RNA, 15 nt, Human
ugauccacccaccuc

SEQ ID NO: 2984363 - RNA, 21 nt, Human
ugauccaagcuggucccacuc

SEQ ID NO: 2984364 - RNA, 17 nt, Human
ugauccaagcugguccc

SEQ ID NO: 2984365 - RNA, 24 nt, Human
ugaucauccacugugccaugugcc

SEQ ID NO: 2984366 - RNA, 13 nt, Human
ugaucauccacug

SEQ ID NO: 2984367 - RNA, 19 nt, Human
ugaucuaggaagacuuugg

SEQ ID NO: 2984368 - RNA, 21 nt, Human
ugaucuaggaagacuuuggaa

SEQ ID NO: 2984369 - RNA, 22 nt, Human
ugauccacccaccucagccucc

SEQ ID NO: 2984370 - RNA, 21 nt, Human
ugauccacccaccucagccuc

SEQ ID NO: 2984371 - RNA, 22 nt, Human
ugaucacggcucacugcagccu

SEQ ID NO: 2984372 - RNA, 24 nt, Human
ugauaguuguaccgcaaugugacu

SEQ ID NO: 2984373 - RNA, 11 nt, Human
ugaggcugggc

SEQ ID NO: 2984374 - RNA, 15 nt, Human
ugaggucuguucuuu

SEQ ID NO: 2984375 - RNA, 14 nt, Human
ugaggucuguucuu

SEQ ID NO: 2984376 - RNA, 20 nt, Human
ugaggucuguucuuuccaaa

SEQ ID NO: 2984377 - RNA, 19 nt, Human
ugaguccuggcaugggaau

SEQ ID NO: 2984378 - RNA, 22 nt, Human
ugaguccuggcaugggaaugaa

SEQ ID NO: 2984379 - RNA, 14 nt, Human
ugagucgaggacag

SEQ ID NO: 2984380 - RNA, 11 nt, Human
ugaguccuggc

SEQ ID NO: 2984381 - RNA, 18 nt, Human
ugaguccuggcaugggaa

SEQ ID NO: 2984382 - RNA, 20 nt, Human
ugaguccccuguuuguuucu

SEQ ID NO: 2984383 - RNA, 15 nt, Human
ugaggugcuauguuc

SEQ ID NO: 2984384 - RNA, 16 nt, Human
ugaggugcuauguucu

SEQ ID NO: 2984385 - RNA, 19 nt, Human
ugagguuucaaaccucccu

SEQ ID NO: 2984386 - RNA, 21 nt, Human
ugaguccccuguuuguuucug

SEQ ID NO: 2984387 - RNA, 21 nt, Human
ugaguugauagcacagacccu

SEQ ID NO: 2984388 - RNA, 23 nt, Human
ugaguugauagcacagacccugc

SEQ ID NO: 2984389 - RNA, 16 nt, Human
ugagucgaggacaggg

SEQ ID NO: 2984390 - RNA, 15 nt, Human
ugagucgaggacagg

SEQ ID NO: 2984391 - RNA, 16 nt, Human
ugaguugauucagcuc

SEQ ID NO: 2984392 - RNA, 19 nt, Human
ugaguugauucagcucugc

SEQ ID NO: 2984393 - RNA, 17 nt, Human
ugauagcacagacccug

SEQ ID NO: 2984394 - RNA, 18 nt, Human
ugauagcacagacccugc

SEQ ID NO: 2984395 - RNA, 20 nt, Human
ugauagcacagacccugccc

SEQ ID NO: 2984396 - RNA, 21 nt, Human
ugauagcacagacccugcccu

SEQ ID NO: 2984397 - RNA, 15 nt, Human
ugauagcacagaccc

SEQ ID NO: 2984398 - RNA, 16 nt, Human
ugauagcacagacccu

SEQ ID NO: 2984399 - RNA, 22 nt, Human
ugauagcacagacccugcccug

SEQ ID NO: 2984400 - RNA, 23 nt, Human
ugauagcacagacccugcccugu

SEQ ID NO: 2984401 - RNA, 16 nt, Human
ugagaaagacuauuca

SEQ ID NO: 2984402 - RNA, 17 nt, Human
ugagaaagacuauucaa

SEQ ID NO: 2984403 - RNA, 18 nt, Human
ugagaaagacuauucaaa

SEQ ID NO: 2984404 - RNA, 16 nt, Human
ugagacagcucugcau

SEQ ID NO: 2984405 - RNA, 14 nt, Human
ugagacagcucugc

SEQ ID NO: 2984406 - RNA, 12 nt, Human
ugagacccuguc

SEQ ID NO: 2984407 - RNA, 12 nt, Human
ugagacagcucu

SEQ ID NO: 2984408 - RNA, 17 nt, Human
ugagaguagagucacug

SEQ ID NO: 2984409 - RNA, 19 nt, Human
ugagaggggaacagacugg

SEQ ID NO: 2984410 - RNA, 15 nt, Human
ugagaucagccuggg

SEQ ID NO: 2984411 - RNA, 23 nt, Human
ugagaggcauccaguaucuugaa

SEQ ID NO: 2984412 - RNA, 22 nt, Human
ugagaggcauccaguaucuuga

SEQ ID NO: 2984413 - RNA, 14 nt, Human
ugagacucugucuc

SEQ ID NO: 2984414 - RNA, 13 nt, Human
ugagacucugucu

SEQ ID NO: 2984415 - RNA, 12 nt, Human
ugagacucuguc

SEQ ID NO: 2984416 - RNA, 15 nt, Human
ugagcagucaggaaa

SEQ ID NO: 2984417 - RNA, 17 nt, Human
ugagcagucaggaaaga

SEQ ID NO: 2984418 - RNA, 13 nt, Human
ugagcaucaggcc

SEQ ID NO: 2984419 - RNA, 20 nt, Human
ugagcagucaggaaagagaa

SEQ ID NO: 2984420 - RNA, 20 nt, Human
ugagaugcuagaacucccuu

SEQ ID NO: 2984421 - RNA, 16 nt, Human
ugagaugcuagaacuc

SEQ ID NO: 2984422 - RNA, 14 nt, Human
ugagaugcuagaac

SEQ ID NO: 2984423 - RNA, 14 nt, Human
ugagcaucaggcca

SEQ ID NO: 2984424 - RNA, 15 nt, Human
ugagcaucaggccag

SEQ ID NO: 2984425 - RNA, 16 nt, Human
ugagccucacagcagu

SEQ ID NO: 2984426 - RNA, 15 nt, Human
ugagccucagcaucc

SEQ ID NO: 2984427 - RNA, 13 nt, Human
ugagccucagcau

SEQ ID NO: 2984428 - RNA, 15 nt, Human
ugagccucacagcag

SEQ ID NO: 2984429 - RNA, 14 nt, Human
ugagccucacagca

SEQ ID NO: 2984430 - RNA, 21 nt, Human
ugaccucugcagcaauaaagc

SEQ ID NO: 2984431 - RNA, 18 nt, Human
ugaccucugcagcaauaa

SEQ ID NO: 2984432 - RNA, 23 nt, Human
ugaccucugcagcaauaaagcag

SEQ ID NO: 2984433 - RNA, 12 nt, Human
ugaccucugccu

SEQ ID NO: 2984434 - RNA, 15 nt, Human
ugaccuuucaauagg

SEQ ID NO: 2984435 - RNA, 16 nt, Human
ugaccuuucaauagga

SEQ ID NO: 2984436 - RNA, 14 nt, Human
ugaccuuucaauag

SEQ ID NO: 2984437 - RNA, 13 nt, Human
ugaccuuucaaua

SEQ ID NO: 2984438 - RNA, 22 nt, Human
ugaccucaggugauccacccac

SEQ ID NO: 2984439 - RNA, 16 nt, Human
ugaccucugcagcaau

SEQ ID NO: 2984440 - RNA, 13 nt, Human
ugaccucugcagc

SEQ ID NO: 2984441 - RNA, 17 nt, Human
ucuugaauuguaaggaa

SEQ ID NO: 2984442 - RNA, 20 nt, Human
ugaccauucuccaccugcca

SEQ ID NO: 2984443 - RNA, 21 nt, Human
ugaccauucuccaccugccag

SEQ ID NO: 2984444 - RNA, 22 nt, Human
ugaccauucuccaccugccagg

SEQ ID NO: 2984445 - RNA, 15 nt, Human
ucuugaacuccuggc

SEQ ID NO: 2984446 - RNA, 19 nt, Human
ugaccauucuccaccugcc

SEQ ID NO: 2984447 - RNA, 13 nt, Human
ugacugaauuucu

SEQ ID NO: 2984448 - RNA, 12 nt, Human
ugacucuuaaga

SEQ ID NO: 2984449 - RNA, 15 nt, Human
ugacugaauuucuuu

SEQ ID NO: 2984450 - RNA, 14 nt, Human
ugacugaauuucuu

SEQ ID NO: 2984451 - RNA, 13 nt, Human
ugacgccauccca

SEQ ID NO: 2984452 - RNA, 14 nt, Human
ugacgccaucccag

SEQ ID NO: 2984453 - RNA, 15 nt, Human
ugacgccaucccagc

SEQ ID NO: 2984454 - RNA, 16 nt, Human
ugacgccaucccagcc

SEQ ID NO: 2984455 - RNA, 18 nt, Human
ugaccuuucaauaggaaa

SEQ ID NO: 2984456 - RNA, 22 nt, Human
ugaccuuucaauaggaaaaacu

SEQ ID NO: 2984457 - RNA, 17 nt, Human
ugacgccaucccagccc

SEQ ID NO: 2984458 - RNA, 18 nt, Human
ugacgccaucccagcccc

SEQ ID NO: 2984459 - RNA, 19 nt, Human
ugacgccaucccagcccca

SEQ ID NO: 2984460 - RNA, 20 nt, Human
ugacgccaucccagccccaa

SEQ ID NO: 2984461 - RNA, 16 nt, Human
uggacauuuuaugucu

SEQ ID NO: 2984462 - RNA, 17 nt, Human
uggacauuuuaugucuu

SEQ ID NO: 2984463 - RNA, 11 nt, Human
uggacauuuua

SEQ ID NO: 2984464 - RNA, 13 nt, Human
uggacauuuuaug

SEQ ID NO: 2984465 - RNA, 17 nt, Human
uggacaggcauguucuc

SEQ ID NO: 2984466 - RNA, 22 nt, Human
uggacaggcauguucucugagg

SEQ ID NO: 2984467 - RNA, 18 nt, Human
uggacaggcauguucucu

SEQ ID NO: 2984468 - RNA, 19 nt, Human
uggacuaacuugucuuugg

SEQ ID NO: 2984469 - RNA, 20 nt, Human
uggacuaacuugucuuugga

SEQ ID NO: 2984470 - RNA, 19 nt, Human
uggacguguuaugacucca

SEQ ID NO: 2984471 - RNA, 23 nt, Human
uggacguguuaugacuccagaau

SEQ ID NO: 2984472 - RNA, 20 nt, Human
uggauugugccuaauguguu

SEQ ID NO: 2984473 - RNA, 23 nt, Human
uggauugugccuaauguguuuga

SEQ ID NO: 2984474 - RNA, 19 nt, Human
uggauugugccuaaugugu

SEQ ID NO: 2984475 - RNA, 15 nt, Human
uggauuuaacagaaa

SEQ ID NO: 2984476 - RNA, 17 nt, Human
uggauuuaacagaaaug

SEQ ID NO: 2984477 - RNA, 21 nt, Human
uggcacuauaauguaagcucu

SEQ ID NO: 2984478 - RNA, 18 nt, Human
uggcagcucagagagggu

SEQ ID NO: 2984479 - RNA, 22 nt, Human
uggcacuggcaaacagggccuc

SEQ ID NO: 2984480 - RNA, 21 nt, Human
uggcacuggcaaacagggccu

SEQ ID NO: 2984481 - RNA, 13 nt, Human
uggcacuggcaaa

SEQ ID NO: 2984482 - RNA, 22 nt, Human
uggcacugcuuccagugaggcu

SEQ ID NO: 2984483 - RNA, 19 nt, Human
uggcacugcuuccagugag

SEQ ID NO: 2984484 - RNA, 22 nt, Human
uggcacuauaauguaagcucua

SEQ ID NO: 2984485 - RNA, 23 nt, Human
uggaggggggaggugggauccuc

SEQ ID NO: 2984486 - RNA, 13 nt, Human
uggaugcagccuc

SEQ ID NO: 2984487 - RNA, 21 nt, Human
uggaugcagccucacaguccu

SEQ ID NO: 2984488 - RNA, 22 nt, Human
uggaugcagccucacaguccuu

SEQ ID NO: 2984489 - RNA, 21 nt, Human
uggauuguccccgacccuugc

SEQ ID NO: 2984490 - RNA, 14 nt, Human
uggaaaagaauaaa

SEQ ID NO: 2984491 - RNA, 13 nt, Human
ugcuucuucagag

SEQ ID NO: 2984492 - RNA, 22 nt, Human
ugcuucuguuuuauaauuuugu

SEQ ID NO: 2984493 - RNA, 18 nt, Human
ugcuugugaaaggaaaga

SEQ ID NO: 2984494 - RNA, 15 nt, Human
uggaacacucugaga

SEQ ID NO: 2984495 - RNA, 17 nt, Human
uggaacacucugagacu

SEQ ID NO: 2984496 - RNA, 14 nt, Human
uggaacacucugag

SEQ ID NO: 2984497 - RNA, 18 nt, Human
ugcuuaacuucacauauu

SEQ ID NO: 2984498 - RNA, 17 nt, Human
ugcuuaacuucacauau

SEQ ID NO: 2984499 - RNA, 14 nt, Human
ugcuuaacuucaca

SEQ ID NO: 2984500 - RNA, 13 nt, Human
ugcuuaacuucac

SEQ ID NO: 2984501 - RNA, 19 nt, Human
ugcuuaacuucacauauug

SEQ ID NO: 2984502 - RNA, 22 nt, Human
ugcuuccagugaggcucugccc

SEQ ID NO: 2984503 - RNA, 23 nt, Human
ugcuuccagugaggcucugcccu

SEQ ID NO: 2984504 - RNA, 21 nt, Human
ugcuuccagugaggcucugcc

SEQ ID NO: 2984505 - RNA, 12 nt, Human
ugcuucucacug

SEQ ID NO: 2984506 - RNA, 17 nt, Human
ugcuucuguuuuauaau

SEQ ID NO: 2984507 - RNA, 19 nt, Human
uggggggcugaggugggag

SEQ ID NO: 2984508 - RNA, 19 nt, Human
ugggggcugggcagaggaa

SEQ ID NO: 2984509 - RNA, 16 nt, Human
ugggggccucagugcc

SEQ ID NO: 2984510 - RNA, 17 nt, Human
ugggcuugucuguagau

SEQ ID NO: 2984511 - RNA, 23 nt, Human
ugggcuuggggaccagagcugcc

SEQ ID NO: 2984512 - RNA, 21 nt, Human
ugggcuugucuguagauuuua

SEQ ID NO: 2984513 - RNA, 22 nt, Human
ugggcuuggggaccagagcugc

SEQ ID NO: 2984514 - RNA, 15 nt, Human
ugggcuucauccucc

SEQ ID NO: 2984515 - RNA, 21 nt, Human
ugggcuucaguggcagcugcu

SEQ ID NO: 2984516 - RNA, 22 nt, Human
ugggcuucaguggcagcugcuu

SEQ ID NO: 2984517 - RNA, 22 nt, Human
ugggcagcugccuccccuccuc

SEQ ID NO: 2984518 - RNA, 20 nt, Human
ugggcagcugccuccccucc

SEQ ID NO: 2984519 - RNA, 23 nt, Human
ugggcagcugccuccccuccucu

SEQ ID NO: 2984520 - RNA, 15 nt, Human
ugggcagagcagaga

SEQ ID NO: 2984521 - RNA, 17 nt, Human
ugggcagagcagagacc

SEQ ID NO: 2984522 - RNA, 14 nt, Human
ugggcagagcagag

SEQ ID NO: 2984523 - RNA, 13 nt, Human
ugggcagagcaga

SEQ ID NO: 2984524 - RNA, 18 nt, Human
ugggaugauuggaggggg

SEQ ID NO: 2984525 - RNA, 16 nt, Human
ugggaaugaaugucag

SEQ ID NO: 2984526 - RNA, 21 nt, Human
ugggaaugaaugucaguguga

SEQ ID NO: 2984527 - RNA, 13 nt, Human
ugggacacccugu

SEQ ID NO: 2984528 - RNA, 14 nt, Human
ugggacacccugug

SEQ ID NO: 2984529 - RNA, 15 nt, Human
ugggacacccuguga

SEQ ID NO: 2984530 - RNA, 16 nt, Human
ugggaggaucucuuga

SEQ ID NO: 2984531 - RNA, 14 nt, Human
ugggacagggagga

SEQ ID NO: 2984532 - RNA, 20 nt, Human
uggccuagcauacguacaca

SEQ ID NO: 2984533 - RNA, 21 nt, Human
uggccccucagggucccuggu

SEQ ID NO: 2984534 - RNA, 22 nt, Human
uggccccucagggucccuggug

SEQ ID NO: 2984535 - RNA, 13 nt, Human
uggccccucaggg

SEQ ID NO: 2984536 - RNA, 20 nt, Human
uggccccucagggucccugg

SEQ ID NO: 2984537 - RNA, 17 nt, Human
uggcagcugcgguccac

SEQ ID NO: 2984538 - RNA, 23 nt, Human
uggccuagcauacguacacauuu

SEQ ID NO: 2984539 - RNA, 23 nt, Human
uggccucaagugauucuccugcc

SEQ ID NO: 2984540 - RNA, 18 nt, Human
uggccucaagugauucuc

SEQ ID NO: 2984541 - RNA, 11 nt, Human
uggccucccaa

SEQ ID NO: 2984542 - RNA, 14 nt, Human
uggccucccaacuc

SEQ ID NO: 2984543 - RNA, 19 nt, Human
uggccucccaacucacccc

SEQ ID NO: 2984544 - RNA, 20 nt, Human
uggccucccaacucacccca

SEQ ID NO: 2984545 - RNA, 21 nt, Human
uggccucccaacucaccccag

SEQ ID NO: 2984546 - RNA, 22 nt, Human
uggccucccaacucaccccagc

SEQ ID NO: 2984547 - RNA, 23 nt, Human
uggccuucggccuccauccugag

SEQ ID NO: 2984548 - RNA, 20 nt, Human
uggccuucggccuccauccu

SEQ ID NO: 2984549 - RNA, 22 nt, Human
uggccuucggccuccauccuga

SEQ ID NO: 2984550 - RNA, 11 nt, Human
uggcugcugaa

SEQ ID NO: 2984551 - RNA, 13 nt, Human
uggcugcugaagg

SEQ ID NO: 2984552 - RNA, 14 nt, Human
uggcugcugaaggc

SEQ ID NO: 2984553 - RNA, 16 nt, Human
uggcugcugaaggcuc

SEQ ID NO: 2984554 - RNA, 21 nt, Human
uggcuugaguuuaaauuguaa

SEQ ID NO: 2984555 - RNA, 14 nt, Human
ugucuuuuaaacuc

SEQ ID NO: 2984556 - RNA, 16 nt, Human
ugucuuuucuugcaug

SEQ ID NO: 2984557 - RNA, 23 nt, Human
ugucuuuggacccugaggcccag

SEQ ID NO: 2984558 - RNA, 21 nt, Human
ugucucaaaaaaagaaaaaga

SEQ ID NO: 2984559 - RNA, 15 nt, Human
ugucuaguuguuuga

SEQ ID NO: 2984560 - RNA, 23 nt, Human
ugucuaguuguuugauucagaca

SEQ ID NO: 2984561 - RNA, 16 nt, Human
ugucuaugggacucaa

SEQ ID NO: 2984562 - RNA, 15 nt, Human
ugucuaugggacuca

SEQ ID NO: 2984563 - RNA, 14 nt, Human
ugucuaugggacuc

SEQ ID NO: 2984564 - RNA, 15 nt, Human
uguccuauuauauuc

SEQ ID NO: 2984565 - RNA, 17 nt, Human
uguccccgcacugggcu

SEQ ID NO: 2984566 - RNA, 19 nt, Human
uguccccgcacugggcuug

SEQ ID NO: 2984567 - RNA, 22 nt, Human
ugucuacacuaagagagaauga

SEQ ID NO: 2984568 - RNA, 17 nt, Human
ugucuacacuaagagag

SEQ ID NO: 2984569 - RNA, 14 nt, Human
ugucuaaugaaacc

SEQ ID NO: 2984570 - RNA, 20 nt, Human
uguccugggagugagcuggu

SEQ ID NO: 2984571 - RNA, 19 nt, Human
uguccugggagugagcugg

SEQ ID NO: 2984572 - RNA, 12 nt, Human
uguccugggagu

SEQ ID NO: 2984573 - RNA, 21 nt, Human
ugucacaggcagguccagggu

SEQ ID NO: 2984574 - RNA, 17 nt, Human
ugucacaggcaggucca

SEQ ID NO: 2984575 - RNA, 16 nt, Human
ugucacaggcaggucc

SEQ ID NO: 2984576 - RNA, 15 nt, Human
ugucacaggcagguc

SEQ ID NO: 2984577 - RNA, 13 nt, Human
ugucacaggcagg

SEQ ID NO: 2984578 - RNA, 16 nt, Human
ugucagugugacugau

SEQ ID NO: 2984579 - RNA, 19 nt, Human
ugucagugugacugaucuc

SEQ ID NO: 2984580 - RNA, 15 nt, Human
ugucagugugacuga

SEQ ID NO: 2984581 - RNA, 14 nt, Human
ugucagugugacug

SEQ ID NO: 2984582 - RNA, 12 nt, Human
ugucacuucugg

SEQ ID NO: 2984583 - RNA, 19 nt, Human
ugucaauuacaggaaguac

SEQ ID NO: 2984584 - RNA, 19 nt, Human
uguauuuuaaaagaaugau

SEQ ID NO: 2984585 - RNA, 18 nt, Human
uguauuuuaaaagaauga

SEQ ID NO: 2984586 - RNA, 14 nt, Human
ugucacaggcaggu

SEQ ID NO: 2984587 - RNA, 21 nt, Human
ugucaauuacaggaaguacug

SEQ ID NO: 2984588 - RNA, 16 nt, Human
ugucaauuaccagaaa

SEQ ID NO: 2984589 - RNA, 21 nt, Human
uguaguguuggagaagaacug

SEQ ID NO: 2984590 - RNA, 20 nt, Human
uguaguguuggagaagaacu

SEQ ID NO: 2984591 - RNA, 19 nt, Human
uguaguguuggagaagaac

SEQ ID NO: 2984592 - RNA, 14 nt, Human
uguauaaaauaauu

SEQ ID NO: 2984593 - RNA, 13 nt, Human
uguauaaaauaau

SEQ ID NO: 2984594 - RNA, 21 nt, Human
uguacagagcccacgccccca

SEQ ID NO: 2984595 - RNA, 12 nt, Human
uguacagagccc

SEQ ID NO: 2984596 - RNA, 22 nt, Human
uguacagcaaggagauuuacaa

SEQ ID NO: 2984597 - RNA, 21 nt, Human
uguacagaguggaauaagaca

SEQ ID NO: 2984598 - RNA, 23 nt, Human
uguacagcaaggagauuuacaac

SEQ ID NO: 2984599 - RNA, 13 nt, Human
uguaucugagcag

SEQ ID NO: 2984600 - RNA, 14 nt, Human
uggguagacacaca

SEQ ID NO: 2984601 - RNA, 23 nt, Human
uggguacuuguggacacagcucu

SEQ ID NO: 2984602 - RNA, 20 nt, Human
uggguacuuguggacacagc

SEQ ID NO: 2984603 - RNA, 14 nt, Human
uggugagaggcauc

SEQ ID NO: 2984604 - RNA, 18 nt, Human
ugguggcagugggagcug

SEQ ID NO: 2984605 - RNA, 13 nt, Human
ugguggcaguggg

SEQ ID NO: 2984606 - RNA, 20 nt, Human
ugguggcagugggagcugcc

SEQ ID NO: 2984607 - RNA, 14 nt, Human
uggugcaaugaccu

SEQ ID NO: 2984608 - RNA, 19 nt, Human
uggugcaaugaccuuucaa

SEQ ID NO: 2984609 - RNA, 12 nt, Human
ugguggcagugg

SEQ ID NO: 2984610 - RNA, 13 nt, Human
ugguggcuggguu

SEQ ID NO: 2984611 - RNA, 16 nt, Human
uggugggggccucggu

SEQ ID NO: 2984612 - RNA, 18 nt, Human
uggugggggccucggugu

SEQ ID NO: 2984613 - RNA, 18 nt, Human
uggugguuucagaaaugu

SEQ ID NO: 2984614 - RNA, 17 nt, Human
uggugguuucagaaaug

SEQ ID NO: 2984615 - RNA, 19 nt, Human
uggugguuuucuguucuuu

SEQ ID NO: 2984616 - RNA, 20 nt, Human
ugguucccuugaugaagaag

SEQ ID NO: 2984617 - RNA, 17 nt, Human
ugguucccuugaugaag

SEQ ID NO: 2984618 - RNA, 16 nt, Human
ugguucccuugaugaa

SEQ ID NO: 2984619 - RNA, 18 nt, Human
ugguugaugaucuuugca

SEQ ID NO: 2984620 - RNA, 18 nt, Human
uggugucgggcaugacac

SEQ ID NO: 2984621 - RNA, 15 nt, Human
uggugucgggcauga

SEQ ID NO: 2984622 - RNA, 16 nt, Human
uggugucaccugaaga

SEQ ID NO: 2984623 - RNA, 11 nt, Human
uguaaaauggu

SEQ ID NO: 2984624 - RNA, 12 nt, Human
uguaaaauggug

SEQ ID NO: 2984625 - RNA, 23 nt, Human
ugguuuuuaaaaaacugcugacu

SEQ ID NO: 2984626 - RNA, 21 nt, Human
ugguuuuuaaaaaacugcuga

SEQ ID NO: 2984627 - RNA, 19 nt, Human
ugguuuucuuguguguuua

SEQ ID NO: 2984628 - RNA, 16 nt, Human
ugguuuucuguucuuu

SEQ ID NO: 2984629 - RNA, 14 nt, Human
uguacagacaacaa

SEQ ID NO: 2984630 - RNA, 11 nt, Human
uguacagagcc

SEQ ID NO: 2984631 - RNA, 14 nt, Human
uguaacaagccacc

SEQ ID NO: 2984632 - RNA, 17 nt, Human
uguaacaagccacccca

SEQ ID NO: 2984633 - RNA, 21 nt, Human
uguaauaaauauguuucacac

SEQ ID NO: 2984634 - RNA, 22 nt, Human
uguaauaaauauguuucacaca

SEQ ID NO: 2984635 - RNA, 14 nt, Human
uguaauaaauaugu

SEQ ID NO: 2984636 - RNA, 19 nt, Human
ucuguuuuguguacuuuua

SEQ ID NO: 2984637 - RNA, 13 nt, Human
ucuguuuugugua

SEQ ID NO: 2984638 - RNA, 13 nt, Human
ucuuaaaaacaac

SEQ ID NO: 2984639 - RNA, 22 nt, Human
ucuuaaaaacaacgaaagaagg

SEQ ID NO: 2984640 - RNA, 15 nt, Human
ucugucuucacaaca

SEQ ID NO: 2984641 - RNA, 22 nt, Human
ucuuaaauauguggaguucauc

SEQ ID NO: 2984642 - RNA, 12 nt, Human
ucuuaagaagac

SEQ ID NO: 2984643 - RNA, 18 nt, Human
ucuuaagaagacugcauu

SEQ ID NO: 2984644 - RNA, 23 nt, Human
ucuucagaucucuaacuucacca

SEQ ID NO: 2984645 - RNA, 18 nt, Human
ucuucagaucucuaacuu

SEQ ID NO: 2984646 - RNA, 15 nt, Human
ucuucagaucucuaa

SEQ ID NO: 2984647 - RNA, 18 nt, Human
ucuucauggaauucacaa

SEQ ID NO: 2984648 - RNA, 22 nt, Human
ucuucauggaauucacaaagua

SEQ ID NO: 2984649 - RNA, 12 nt, Human
ucuugaacuccu

SEQ ID NO: 2984650 - RNA, 15 nt, Human
ucuucuccaggcugu

SEQ ID NO: 2984651 - RNA, 17 nt, Human
ucuggcuaugcauuuga

SEQ ID NO: 2984652 - RNA, 18 nt, Human
ucuggccuucggccucca

SEQ ID NO: 2984653 - RNA, 17 nt, Human
ucuggccuucggccucc

SEQ ID NO: 2984654 - RNA, 22 nt, Human
ucuggcuaugcauuugaaaauu

SEQ ID NO: 2984655 - RNA, 19 nt, Human
ucuggcuaugcauuugaaa

SEQ ID NO: 2984656 - RNA, 10 nt, Human
ucuggccuuc

SEQ ID NO: 2984657 - RNA, 18 nt, Human
ucuggcucuuccaggcug

SEQ ID NO: 2984658 - RNA, 23 nt, Human
ucuggcucuuccaggcugggaga

SEQ ID NO: 2984659 - RNA, 23 nt, Human
ucuggugacuuuccucuuugguc

SEQ ID NO: 2984660 - RNA, 13 nt, Human
ucugggacacagu

SEQ ID NO: 2984661 - RNA, 14 nt, Human
ucugggacacaguu

SEQ ID NO: 2984662 - RNA, 14 nt, Human
ucuguccuacucug

SEQ ID NO: 2984663 - RNA, 19 nt, Human
ucuguccuacucuguguca

SEQ ID NO: 2984664 - RNA, 15 nt, Human
ucuguccuacucugu

SEQ ID NO: 2984665 - RNA, 21 nt, Human
ucuguccugggagugagcugg

SEQ ID NO: 2984666 - RNA, 14 nt, Human
ucugucgcccaguc

SEQ ID NO: 2984667 - RNA, 13 nt, Human
ucugccugcccag

SEQ ID NO: 2984668 - RNA, 14 nt, Human
ucugccugcccagg

SEQ ID NO: 2984669 - RNA, 17 nt, Human
ucugcugacagacacag

SEQ ID NO: 2984670 - RNA, 18 nt, Human
ucugcugacagacacagg

SEQ ID NO: 2984671 - RNA, 18 nt, Human
ucugcuccucuccccagc

SEQ ID NO: 2984672 - RNA, 15 nt, Human
ucugccugcccaggc

SEQ ID NO: 2984673 - RNA, 22 nt, Human
ucugcugacagacacaggcccg

SEQ ID NO: 2984674 - RNA, 21 nt, Human
ucugcugacagacacaggccc

SEQ ID NO: 2984675 - RNA, 20 nt, Human
ucugcugacagacacaggcc

SEQ ID NO: 2984676 - RNA, 19 nt, Human
ucugcugacagacacaggc

SEQ ID NO: 2984677 - RNA, 19 nt, Human
ucuggaauaaggagaauga

SEQ ID NO: 2984678 - RNA, 15 nt, Human
ucuggaaugcagugg

SEQ ID NO: 2984679 - RNA, 14 nt, Human
ucuggacaggcaug

SEQ ID NO: 2984680 - RNA, 21 nt, Human
ucuggacaggcauguucucug

SEQ ID NO: 2984681 - RNA, 22 nt, Human
ucucuguaauaaacucauuucu

SEQ ID NO: 2984682 - RNA, 18 nt, Human
ucucuguaauaaacucau

SEQ ID NO: 2984683 - RNA, 20 nt, Human
ucucugauucccugauuuaa

SEQ ID NO: 2984684 - RNA, 23 nt, Human
ucucuggccuucggccuccaucc

SEQ ID NO: 2984685 - RNA, 15 nt, Human
ucucugauacagaaa

SEQ ID NO: 2984686 - RNA, 17 nt, Human
ucucugaggacacuaac

SEQ ID NO: 2984687 - RNA, 14 nt, Human
ucucugaggacacu

SEQ ID NO: 2984688 - RNA, 15 nt, Human
ucucuaguuugauua

SEQ ID NO: 2984689 - RNA, 21 nt, Human
ucuccuggaaauauuaagaaa

SEQ ID NO: 2984690 - RNA, 15 nt, Human
ucuccuguaccucuu

SEQ ID NO: 2984691 - RNA, 15 nt, Human
ucuccugccucagcc

SEQ ID NO: 2984692 - RNA, 17 nt, Human
ucuccugccucagccuc

SEQ ID NO: 2984693 - RNA, 17 nt, Human
ucuccuguaccucuuga

SEQ ID NO: 2984694 - RNA, 16 nt, Human
ucuccuguaccucuug

SEQ ID NO: 2984695 - RNA, 13 nt, Human
ucuccuguaccuc

SEQ ID NO: 2984696 - RNA, 14 nt, Human
ucucgugauugaua

SEQ ID NO: 2984697 - RNA, 22 nt, Human
ucucgugauugauaagaaccuu

SEQ ID NO: 2984698 - RNA, 12 nt, Human
ucucuaacuuca

SEQ ID NO: 2984699 - RNA, 19 nt, Human
ucucuaggaaauauuuauu

SEQ ID NO: 2984700 - RNA, 19 nt, Human
ucucuaacuucaccauauu

SEQ ID NO: 2984701 - RNA, 13 nt, Human
ucugacccacugc

SEQ ID NO: 2984702 - RNA, 22 nt, Human
ucugacaggcaaugcuggcugu

SEQ ID NO: 2984703 - RNA, 21 nt, Human
ucugacaggcaaugcuggcug

SEQ ID NO: 2984704 - RNA, 12 nt, Human
ucugacaggcaa

SEQ ID NO: 2984705 - RNA, 19 nt, Human
ucugacacacagcucuguc

SEQ ID NO: 2984706 - RNA, 18 nt, Human
ucugacacacagcucugu

SEQ ID NO: 2984707 - RNA, 17 nt, Human
ucugacacacagcucug

SEQ ID NO: 2984708 - RNA, 16 nt, Human
ucugacacacagcucu

SEQ ID NO: 2984709 - RNA, 20 nt, Human
ucugaaauuuccugggagcu

SEQ ID NO: 2984710 - RNA, 18 nt, Human
ucugaaauuuccugggag

SEQ ID NO: 2984711 - RNA, 17 nt, Human
ucugaaauuuccuggga

SEQ ID NO: 2984712 - RNA, 13 nt, Human
ucugaaaauguau

SEQ ID NO: 2984713 - RNA, 16 nt, Human
ucucuuaucuuacgaa

SEQ ID NO: 2984714 - RNA, 21 nt, Human
ucucuuaucuuacgaaaaaau

SEQ ID NO: 2984715 - RNA, 19 nt, Human
ucugcaucagcugcugaaa

SEQ ID NO: 2984716 - RNA, 21 nt, Human
ucugcaucagcugcugaaaca

SEQ ID NO: 2984717 - RNA, 14 nt, Human
ucugcaucagcugc

SEQ ID NO: 2984718 - RNA, 23 nt, Human
ucugaggaauccagacccggcug

SEQ ID NO: 2984719 - RNA, 15 nt, Human
ucugacccacugcuu

SEQ ID NO: 2984720 - RNA, 14 nt, Human
ucugacccacugcu

SEQ ID NO: 2984721 - RNA, 20 nt, Human
ucugcaagaauugaagcagg

SEQ ID NO: 2984722 - RNA, 21 nt, Human
ucugcaagaauugaagcagga

SEQ ID NO: 2984723 - RNA, 15 nt, Human
ucugcaacucugaag

SEQ ID NO: 2984724 - RNA, 14 nt, Human
ucugcaacucugaa

SEQ ID NO: 2984725 - RNA, 18 nt, Human
uccuaauaaaaaggugac

SEQ ID NO: 2984726 - RNA, 16 nt, Human
uccuaauaaaaaggug

SEQ ID NO: 2984727 - RNA, 17 nt, Human
uccuaauaaaaagguga

SEQ ID NO: 2984728 - RNA, 16 nt, Human
uccuaaucuucugaac

SEQ ID NO: 2984729 - RNA, 12 nt, Human
uccuaauaaaaa

SEQ ID NO: 2984730 - RNA, 13 nt, Human
uccuaauaaaaag

SEQ ID NO: 2984731 - RNA, 14 nt, Human
uccuaauaaaaagg

SEQ ID NO: 2984732 - RNA, 15 nt, Human
uccuaauaaaaaggu

SEQ ID NO: 2984733 - RNA, 21 nt, Human
uccuaaguaucaaguauagaa

SEQ ID NO: 2984734 - RNA, 13 nt, Human
uccgaccagacac

SEQ ID NO: 2984735 - RNA, 18 nt, Human
uccuacccacccuccuuu

SEQ ID NO: 2984736 - RNA, 12 nt, Human
uccuauuauauu

SEQ ID NO: 2984737 - RNA, 17 nt, Human
uccucauuagcauuuug

SEQ ID NO: 2984738 - RNA, 18 nt, Human
uccuauauuguuuucagu

SEQ ID NO: 2984739 - RNA, 22 nt, Human
uccuaguuccaccaucaagcca

SEQ ID NO: 2984740 - RNA, 12 nt, Human
uccucugcugcu

SEQ ID NO: 2984741 - RNA, 14 nt, Human
uccucugcugcugg

SEQ ID NO: 2984742 - RNA, 15 nt, Human
uccucugcugcuggc

SEQ ID NO: 2984743 - RNA, 16 nt, Human
uccucugcugcuggcu

SEQ ID NO: 2984744 - RNA, 19 nt, Human
uccucugcuugccaucccu

SEQ ID NO: 2984745 - RNA, 20 nt, Human
uccucugcuugccaucccuc

SEQ ID NO: 2984746 - RNA, 22 nt, Human
uccucugcuugccaucccuccc

SEQ ID NO: 2984747 - RNA, 21 nt, Human
uccucugcuugccaucccucc

SEQ ID NO: 2984748 - RNA, 16 nt, Human
uccucuguacagagcc

SEQ ID NO: 2984749 - RNA, 17 nt, Human
uccucuguacagagccc

SEQ ID NO: 2984750 - RNA, 18 nt, Human
uccucuguacagagccca

SEQ ID NO: 2984751 - RNA, 15 nt, Human
uccucuguacagagc

SEQ ID NO: 2984752 - RNA, 14 nt, Human
uccucuaggagguc

SEQ ID NO: 2984753 - RNA, 19 nt, Human
uccuccuuuucacaguucu

SEQ ID NO: 2984754 - RNA, 15 nt, Human
ucccuugaugaagaa

SEQ ID NO: 2984755 - RNA, 16 nt, Human
ucccuugaugaagaag

SEQ ID NO: 2984756 - RNA, 13 nt, Human
ucccuucccaccu

SEQ ID NO: 2984757 - RNA, 16 nt, Human
ucccugcaauaaaaug

SEQ ID NO: 2984758 - RNA, 13 nt, Human
ucccugcacuugc

SEQ ID NO: 2984759 - RNA, 14 nt, Human
ucccugcacuugca

SEQ ID NO: 2984760 - RNA, 18 nt, Human
ucccugcugcuccuagga

SEQ ID NO: 2984761 - RNA, 21 nt, Human
uccccuguuuguuucugaaag

SEQ ID NO: 2984762 - RNA, 18 nt, Human
uccccuguuuguuucuga

SEQ ID NO: 2984763 - RNA, 20 nt, Human
uccccuguuuguuucugaaa

SEQ ID NO: 2984764 - RNA, 17 nt, Human
uccagguuuaagcuguu

SEQ ID NO: 2984765 - RNA, 16 nt, Human
ucccuauuagagaaga

SEQ ID NO: 2984766 - RNA, 22 nt, Human
ucuaaauaucccuuggacauuu

SEQ ID NO: 2984767 - RNA, 21 nt, Human
ucuaaaucuccaaaauaaaac

SEQ ID NO: 2984768 - RNA, 13 nt, Human
ucguuaauuugua

SEQ ID NO: 2984769 - RNA, 22 nt, Human
ucgugggacagucaccucaugg

SEQ ID NO: 2984770 - RNA, 21 nt, Human
ucguggaacaguuaccucugc

SEQ ID NO: 2984771 - RNA, 17 nt, Human
ucggccuccauccugag

SEQ ID NO: 2984772 - RNA, 18 nt, Human
ucggccuccauccugagg

SEQ ID NO: 2984773 - RNA, 16 nt, Human
ucgugauugauaagaa

SEQ ID NO: 2984774 - RNA, 22 nt, Human
ucuaucaaguauuauaccuuuu

SEQ ID NO: 2984775 - RNA, 21 nt, Human
ucuaucaaguauuauaccuuu

SEQ ID NO: 2984776 - RNA, 15 nt, Human
ucuaucaaguauuau

SEQ ID NO: 2984777 - RNA, 14 nt, Human
ucuaugaaauauua

SEQ ID NO: 2984778 - RNA, 13 nt, Human
ucuaugaaauauu

SEQ ID NO: 2984779 - RNA, 17 nt, Human
ucuaugaaauauuaugu

SEQ ID NO: 2984780 - RNA, 17 nt, Human
ucucaaauaacuaaaag

SEQ ID NO: 2984781 - RNA, 15 nt, Human
ucucaacuccaaacu

SEQ ID NO: 2984782 - RNA, 19 nt, Human
ucuagugagcagucaggaa

SEQ ID NO: 2984783 - RNA, 22 nt, Human
ucuagugagcagucaggaaaga

SEQ ID NO: 2984784 - RNA, 11 nt, Human
ucuagugaaug

SEQ ID NO: 2984785 - RNA, 21 nt, Human
ucuaggaagacuuuggaaaga

SEQ ID NO: 2984786 - RNA, 23 nt, Human
ucuaggacugaauuaugaaacuu

SEQ ID NO: 2984787 - RNA, 16 nt, Human
ucuaggacugaauuau

SEQ ID NO: 2984788 - RNA, 14 nt, Human
ucuaauauguaaca

SEQ ID NO: 2984789 - RNA, 19 nt, Human
uccugucggagcccugucu

SEQ ID NO: 2984790 - RNA, 14 nt, Human
uccuuaccagcaga

SEQ ID NO: 2984791 - RNA, 20 nt, Human
uccuguaccucuugagccuu

SEQ ID NO: 2984792 - RNA, 18 nt, Human
uccuggcacugcuuccag

SEQ ID NO: 2984793 - RNA, 22 nt, Human
uccuggcacugcuuccagugag

SEQ ID NO: 2984794 - RNA, 17 nt, Human
uccuggcacugcuucca

SEQ ID NO: 2984795 - RNA, 21 nt, Human
uccuggcacccggccccugcu

SEQ ID NO: 2984796 - RNA, 20 nt, Human
uccuggcacccggccccugc

SEQ ID NO: 2984797 - RNA, 14 nt, Human
uccugagccagauu

SEQ ID NO: 2984798 - RNA, 20 nt, Human
uccugccuaagugcagcccc

SEQ ID NO: 2984799 - RNA, 14 nt, Human
uccugccucagccu

SEQ ID NO: 2984800 - RNA, 13 nt, Human
uccugagccagau

SEQ ID NO: 2984801 - RNA, 13 nt, Human
uccugagagcugc

SEQ ID NO: 2984802 - RNA, 18 nt, Human
uccugagagcugcaugug

SEQ ID NO: 2984803 - RNA, 19 nt, Human
uccugagagcugcaugugu

SEQ ID NO: 2984804 - RNA, 17 nt, Human
uccuggcaauagucaaa

SEQ ID NO: 2984805 - RNA, 14 nt, Human
uccuggcacccggc

SEQ ID NO: 2984806 - RNA, 19 nt, Human
uccuggcacccggccccug

SEQ ID NO: 2984807 - RNA, 16 nt, Human
uccuggcacccggccc

SEQ ID NO: 2984808 - RNA, 15 nt, Human
uccugccucagccuc

SEQ ID NO: 2984809 - RNA, 13 nt, Human
uccugccucagcc

SEQ ID NO: 2984810 - RNA, 16 nt, Human
uccugccucagccucc

SEQ ID NO: 2984811 - RNA, 16 nt, Human
uccuuggacucauuuu

SEQ ID NO: 2984812 - RNA, 23 nt, Human
uccuuuucacaguucucuccuuc

SEQ ID NO: 2984813 - RNA, 21 nt, Human
uccuucaccuuuguccccacc

SEQ ID NO: 2984814 - RNA, 22 nt, Human
uccuucaccuuuguccccaccg

SEQ ID NO: 2984815 - RNA, 16 nt, Human
uccuuaccagcagagc

SEQ ID NO: 2984816 - RNA, 17 nt, Human
uccuuaccagcagagca

SEQ ID NO: 2984817 - RNA, 18 nt, Human
uccuuaccagcagagcac

SEQ ID NO: 2984818 - RNA, 18 nt, Human
uccuucacagaugggugc

SEQ ID NO: 2984819 - RNA, 18 nt, Human
uccuucaccuuugucccc

SEQ ID NO: 2984820 - RNA, 20 nt, Human
uccuucaccuuuguccccac

SEQ ID NO: 2984821 - RNA, 19 nt, Human
uccuucacagaugggugcu

SEQ ID NO: 2984822 - RNA, 17 nt, Human
uauuuucuccaaauguu

SEQ ID NO: 2984823 - RNA, 22 nt, Human
uauuuucccuauuagagaagag

SEQ ID NO: 2984824 - RNA, 14 nt, Human
ucaaaaaaagaaaa

SEQ ID NO: 2984825 - RNA, 15 nt, Human
ucaaaaaaagaaaaa

SEQ ID NO: 2984826 - RNA, 14 nt, Human
uauuuuuuuacuaa

SEQ ID NO: 2984827 - RNA, 17 nt, Human
uauuuuuuucuuuucuu

SEQ ID NO: 2984828 - RNA, 17 nt, Human
uauuuuauuaugcauga

SEQ ID NO: 2984829 - RNA, 14 nt, Human
uauuuuauuaugca

SEQ ID NO: 2984830 - RNA, 14 nt, Human
ucaaauugugugaa

SEQ ID NO: 2984831 - RNA, 23 nt, Human
ucaaccccuucgcuccugugucu

SEQ ID NO: 2984832 - RNA, 14 nt, Human
ucaaauaugcaaag

SEQ ID NO: 2984833 - RNA, 20 nt, Human
ucaaaucaagaaacuuaagg

SEQ ID NO: 2984834 - RNA, 16 nt, Human
ucaaaucagguuuucu

SEQ ID NO: 2984835 - RNA, 22 nt, Human
ucaaaucagguuuucuuuuaag

SEQ ID NO: 2984836 - RNA, 21 nt, Human
ucaauuaccagaaagauaaca

SEQ ID NO: 2984837 - RNA, 17 nt, Human
ucaauuaccagaaagau

SEQ ID NO: 2984838 - RNA, 20 nt, Human
ucaauuacaggaaguacugg

SEQ ID NO: 2984839 - RNA, 13 nt, Human
ucacaagacccaa

SEQ ID NO: 2984840 - RNA, 17 nt, Human
ucacaagacccaaaagg

SEQ ID NO: 2984841 - RNA, 22 nt, Human
ucacaguccuuaccagcagagc

SEQ ID NO: 2984842 - RNA, 23 nt, Human
ucacaguccuuaccagcagagca

SEQ ID NO: 2984843 - RNA, 19 nt, Human
ucacaguccuuaccagcag

SEQ ID NO: 2984844 - RNA, 16 nt, Human
ucacagucacauucca

SEQ ID NO: 2984845 - RNA, 18 nt, Human
ucacaggcagguccaggg

SEQ ID NO: 2984846 - RNA, 17 nt, Human
ucacaggcagguccagg

SEQ ID NO: 2984847 - RNA, 16 nt, Human
ucacaggcagguccag

SEQ ID NO: 2984848 - RNA, 20 nt, Human
ucaccaaaucagcugcuacu

SEQ ID NO: 2984849 - RNA, 19 nt, Human
ucaccaaaucagcugcuac

SEQ ID NO: 2984850 - RNA, 14 nt, Human
ucaccaaggcugau

SEQ ID NO: 2984851 - RNA, 17 nt, Human
ucacauuuauucugcuc

SEQ ID NO: 2984852 - RNA, 19 nt, Human
ucacauuuauucugcucac

SEQ ID NO: 2984853 - RNA, 18 nt, Human
ucacauuuauucugcuca

SEQ ID NO: 2984854 - RNA, 13 nt, Human
ucaaugcagcccc

SEQ ID NO: 2984855 - RNA, 20 nt, Human
ucaaugccccugaauuuaaa

SEQ ID NO: 2984856 - RNA, 18 nt, Human
ucaaugccccugaauuua

SEQ ID NO: 2984857 - RNA, 17 nt, Human
ucaaugccccugaauuu

SEQ ID NO: 2984858 - RNA, 21 nt, Human
ucaauuacaggaaguacugga

SEQ ID NO: 2984859 - RNA, 23 nt, Human
ucaauuacaggaaguacuggaga

SEQ ID NO: 2984860 - RNA, 20 nt, Human
ucaagugauucuccugccuc

SEQ ID NO: 2984861 - RNA, 18 nt, Human
ucaagugauucuccugcc

SEQ ID NO: 2984862 - RNA, 21 nt, Human
ucaagugauucuccugccuca

SEQ ID NO: 2984863 - RNA, 21 nt, Human
ucaauaaaauccauacauuug

SEQ ID NO: 2984864 - RNA, 14 nt, Human
ucaauaaaauccau

SEQ ID NO: 2984865 - RNA, 15 nt, Human
uauucucagcagagu

SEQ ID NO: 2984866 - RNA, 16 nt, Human
uauuauucccauucua

SEQ ID NO: 2984867 - RNA, 21 nt, Human
uauucucagcagagugcuuua

SEQ ID NO: 2984868 - RNA, 17 nt, Human
uauucucagcagagugc

SEQ ID NO: 2984869 - RNA, 17 nt, Human
uauucucuccuguaccu

SEQ ID NO: 2984870 - RNA, 21 nt, Human
uauugauaugcuuauacacuu

SEQ ID NO: 2984871 - RNA, 13 nt, Human
uauugauguuuuc

SEQ ID NO: 2984872 - RNA, 14 nt, Human
uauugauguuuuca

SEQ ID NO: 2984873 - RNA, 23 nt, Human
uauugauucaccuccuaaaacaa

SEQ ID NO: 2984874 - RNA, 22 nt, Human
uauuggaaauuuguuauaauga

SEQ ID NO: 2984875 - RNA, 17 nt, Human
uauugcugauggugcaa

SEQ ID NO: 2984876 - RNA, 20 nt, Human
uauuguuuucaguguacaug

SEQ ID NO: 2984877 - RNA, 18 nt, Human
uauuguuuucaguguaca

SEQ ID NO: 2984878 - RNA, 22 nt, Human
uauuguuuucaguguacaugga

SEQ ID NO: 2984879 - RNA, 12 nt, Human
uauuguuuucag

SEQ ID NO: 2984880 - RNA, 13 nt, Human
uauuaacaaaaca

SEQ ID NO: 2984881 - RNA, 24 nt, Human
uauuaagaaagacuaucuaaaugu

SEQ ID NO: 2984882 - RNA, 20 nt, Human
uauuaagagguaagacuuag

SEQ ID NO: 2984883 - RNA, 12 nt, Human
uauuaaauuaug

SEQ ID NO: 2984884 - RNA, 19 nt, Human
uauguugcccaggcagguc

SEQ ID NO: 2984885 - RNA, 16 nt, Human
uauguugcccaggcag

SEQ ID NO: 2984886 - RNA, 13 nt, Human
uauguugcccagg

SEQ ID NO: 2984887 - RNA, 20 nt, Human
uauguugcccaggcaggucu

SEQ ID NO: 2984888 - RNA, 13 nt, Human
gggaguggccaca

SEQ ID NO: 2984889 - RNA, 15 nt, Human
gggaguggccacaga

SEQ ID NO: 2984890 - RNA, 20 nt, Human
uauguagauguaugcacaca

SEQ ID NO: 2984891 - RNA, 17 nt, Human
uauguacuucaugcugu

SEQ ID NO: 2984892 - RNA, 13 nt, Human
uauguacuucaug

SEQ ID NO: 2984893 - RNA, 14 nt, Human
ucauuaguuuugaa

SEQ ID NO: 2984894 - RNA, 23 nt, Human
ucauuaguuuugaagauucuaug

SEQ ID NO: 2984895 - RNA, 13 nt, Human
ucauuaucucaaa

SEQ ID NO: 2984896 - RNA, 21 nt, Human
ucaugcugccaauauccuaau

SEQ ID NO: 2984897 - RNA, 23 nt, Human
ucaugcugccaauauccuaauaa

SEQ ID NO: 2984898 - RNA, 16 nt, Human
ucauuauguuaauauu

SEQ ID NO: 2984899 - RNA, 17 nt, Human
ucauuauguuaauauuu

SEQ ID NO: 2984900 - RNA, 19 nt, Human
ucauuaucucaaaacugca

SEQ ID NO: 2984901 - RNA, 20 nt, Human
ucauuaucucaaaacugcac

SEQ ID NO: 2984902 - RNA, 21 nt, Human
ucauucaacccaccugcgucu

SEQ ID NO: 2984903 - RNA, 13 nt, Human
ucauuuccaagca

SEQ ID NO: 2984904 - RNA, 16 nt, Human
ucauuuccaagcaagu

SEQ ID NO: 2984905 - RNA, 16 nt, Human
ucauuuccugugucuu

SEQ ID NO: 2984906 - RNA, 13 nt, Human
ucauuuccugugu

SEQ ID NO: 2984907 - RNA, 13 nt, Human
ucaugcugccaau

SEQ ID NO: 2984908 - RNA, 17 nt, Human
ucaugcugccaauaucc

SEQ ID NO: 2984909 - RNA, 19 nt, Human
ucaugcugccaauauccua

SEQ ID NO: 2984910 - RNA, 20 nt, Human
ucaugcugccaauauccuaa

SEQ ID NO: 2984911 - RNA, 23 nt, Human
ucaucuuagguuggcaaaaaggc

SEQ ID NO: 2984912 - RNA, 18 nt, Human
ucauaccuaucaucuuaa

SEQ ID NO: 2984913 - RNA, 21 nt, Human
ucauacccacccccacccaag

SEQ ID NO: 2984914 - RNA, 15 nt, Human
ucaggugcugccauc

SEQ ID NO: 2984915 - RNA, 21 nt, Human
ucaggugagaagcagaggaag

SEQ ID NO: 2984916 - RNA, 23 nt, Human
ucaggugccucaagagaaggcaa

SEQ ID NO: 2984917 - RNA, 14 nt, Human
ucaggugcugccau

SEQ ID NO: 2984918 - RNA, 13 nt, Human
ucaggugcugcca

SEQ ID NO: 2984919 - RNA, 19 nt, Human
ucaucaccaacgucugugc

SEQ ID NO: 2984920 - RNA, 20 nt, Human
ucaucaccaacgucugugcc

SEQ ID NO: 2984921 - RNA, 21 nt, Human
ucaucaccaacgucugugcca

SEQ ID NO: 2984922 - RNA, 19 nt, Human
uccacagaagcuccaggua

SEQ ID NO: 2984923 - RNA, 14 nt, Human
uccaccucccugca

SEQ ID NO: 2984924 - RNA, 13 nt, Human
uccaccucccugc

SEQ ID NO: 2984925 - RNA, 12 nt, Human
uccaccucccug

SEQ ID NO: 2984926 - RNA, 12 nt, Human
uccacccugcuc

SEQ ID NO: 2984927 - RNA, 17 nt, Human
uccaccugccagggaca

SEQ ID NO: 2984928 - RNA, 15 nt, Human
uccaccugccaggga

SEQ ID NO: 2984929 - RNA, 17 nt, Human
uccaccucccugcaaua

SEQ ID NO: 2984930 - RNA, 16 nt, Human
uccaccucccugcaau

SEQ ID NO: 2984931 - RNA, 15 nt, Human
uccaccucccugcaa

SEQ ID NO: 2984932 - RNA, 18 nt, Human
uccaccugccagggacag

SEQ ID NO: 2984933 - RNA, 21 nt, Human
uccaccugccagggacagagg

SEQ ID NO: 2984934 - RNA, 18 nt, Human
uccaaaauaaaacuuuuu

SEQ ID NO: 2984935 - RNA, 20 nt, Human
uccaaaauaaaacuuuuuaa

SEQ ID NO: 2984936 - RNA, 18 nt, Human
uccaauuuacauacucug

SEQ ID NO: 2984937 - RNA, 17 nt, Human
uccaauuuacauacucu

SEQ ID NO: 2984938 - RNA, 16 nt, Human
uccacaagagcccagg

SEQ ID NO: 2984939 - RNA, 17 nt, Human
uccacaagagcccaggc

SEQ ID NO: 2984940 - RNA, 18 nt, Human
uccacaagagcccaggcc

SEQ ID NO: 2984941 - RNA, 15 nt, Human
uccacaagagcccag

SEQ ID NO: 2984942 - RNA, 18 nt, Human
uccacaaguuaaauaaau

SEQ ID NO: 2984943 - RNA, 17 nt, Human
uccacaaguuaaauaaa

SEQ ID NO: 2984944 - RNA, 16 nt, Human
uccacuuggucuguga

SEQ ID NO: 2984945 - RNA, 15 nt, Human
uccacuuggucugug

SEQ ID NO: 2984946 - RNA, 14 nt, Human
uccacuuggucugu

SEQ ID NO: 2984947 - RNA, 23 nt, Human
uccagccaaagccuccuccagcc

SEQ ID NO: 2984948 - RNA, 17 nt, Human
uccagcucaccagcccc

SEQ ID NO: 2984949 - RNA, 16 nt, Human
uccagcucaccagccc

SEQ ID NO: 2984950 - RNA, 18 nt, Human
uccagcucaccagcccca

SEQ ID NO: 2984951 - RNA, 15 nt, Human
uccagcucaccagcc

SEQ ID NO: 2984952 - RNA, 17 nt, Human
uccagcuguucagcugg

SEQ ID NO: 2984953 - RNA, 16 nt, Human
uccaggagcagccaca

SEQ ID NO: 2984954 - RNA, 18 nt, Human
uccaggugcacaagcucc

SEQ ID NO: 2984955 - RNA, 20 nt, Human
uccaggugcacaagcuccaa

SEQ ID NO: 2984956 - RNA, 21 nt, Human
uccaggugcacaagcuccaag

SEQ ID NO: 2984957 - RNA, 22 nt, Human
uccaggugcacaagcuccaagc

SEQ ID NO: 2984958 - RNA, 16 nt, Human
uccagguucagcuugu

SEQ ID NO: 2984959 - RNA, 15 nt, Human
uccagguucagcuug

SEQ ID NO: 2984960 - RNA, 23 nt, Human
uccaggggugggacacccuguga

SEQ ID NO: 2984961 - RNA, 15 nt, Human
uccaggugcacaagc

SEQ ID NO: 2984962 - RNA, 17 nt, Human
uccaggagcagccacau

SEQ ID NO: 2984963 - RNA, 18 nt, Human
uccaggagcagccacauu

SEQ ID NO: 2984964 - RNA, 22 nt, Human
uccaggagcagccacauuccug

SEQ ID NO: 2984965 - RNA, 22 nt, Human
uccaggggugggacacccugug

SEQ ID NO: 2984966 - RNA, 17 nt, Human
ucacugguacucugcca

SEQ ID NO: 2984967 - RNA, 14 nt, Human
ucacugcuuaacuu

SEQ ID NO: 2984968 - RNA, 20 nt, Human
ucacucuuauugcccacgcu

SEQ ID NO: 2984969 - RNA, 18 nt, Human
ucacugccaugccagcuu

SEQ ID NO: 2984970 - RNA, 22 nt, Human
ucacucugucgcccagucugga

SEQ ID NO: 2984971 - RNA, 17 nt, Human
ucacucuuauugcccac

SEQ ID NO: 2984972 - RNA, 22 nt, Human
ucaccccggccaccugcggugc

SEQ ID NO: 2984973 - RNA, 13 nt, Human
ucaccagccccag

SEQ ID NO: 2984974 - RNA, 21 nt, Human
ucagagcugcccucuccuggg

SEQ ID NO: 2984975 - RNA, 20 nt, Human
ucagagcugcccucuccugg

SEQ ID NO: 2984976 - RNA, 19 nt, Human
ucagagcugcccucuccug

SEQ ID NO: 2984977 - RNA, 18 nt, Human
ucagagcugcccucuccu

SEQ ID NO: 2984978 - RNA, 22 nt, Human
ucagagcugcccucuccugggc

SEQ ID NO: 2984979 - RNA, 13 nt, Human
ucagacagcugcc

SEQ ID NO: 2984980 - RNA, 16 nt, Human
ucagaauucucuaguu

SEQ ID NO: 2984981 - RNA, 13 nt, Human
ucagacacagauu

SEQ ID NO: 2984982 - RNA, 15 nt, Human
ucagaaauguguuau

SEQ ID NO: 2984983 - RNA, 23 nt, Human
ucagaauucucuaguuugauuaa

SEQ ID NO: 2984984 - RNA, 20 nt, Human
ucacuuguuuuauuuaaccu

SEQ ID NO: 2984985 - RNA, 10 nt, Human
ucagaaaugu

SEQ ID NO: 2984986 - RNA, 17 nt, Human
ucagcuccccucggaga

SEQ ID NO: 2984987 - RNA, 15 nt, Human
ucagcugaaccuggg

SEQ ID NO: 2984988 - RNA, 16 nt, Human
ucagcugaaccugggu

SEQ ID NO: 2984989 - RNA, 18 nt, Human
ucagcuccccucggagaa

SEQ ID NO: 2984990 - RNA, 22 nt, Human
ucagccucccgaguagcuggga

SEQ ID NO: 2984991 - RNA, 21 nt, Human
ucagccucccgaguagcuggg

SEQ ID NO: 2984992 - RNA, 18 nt, Human
ucagccugcuccagcugu

SEQ ID NO: 2984993 - RNA, 19 nt, Human
ucagccugcuccagcuguu

SEQ ID NO: 2984994 - RNA, 21 nt, Human
ucagccucccaaagugcuggg

SEQ ID NO: 2984995 - RNA, 19 nt, Human
ucagccucccaaagugcug

SEQ ID NO: 2984996 - RNA, 14 nt, Human
ucagccucccaaag

SEQ ID NO: 2984997 - RNA, 13 nt, Human
ucagccucccaaa

SEQ ID NO: 2984998 - RNA, 22 nt, Human
ucagccucccgaauagcuggga

SEQ ID NO: 2984999 - RNA, 21 nt, Human
ucagccucccgaauagcuggg

SEQ ID NO: 2985000 - RNA, 18 nt, Human
ucagccucccgaguagcu

SEQ ID NO: 2985001 - RNA, 20 nt, Human
ucagccucccgaguagcugg

SEQ ID NO: 2985002 - RNA, 15 nt, Human
ucagauaugauucaa

SEQ ID NO: 2985003 - RNA, 17 nt, Human
ucaggcuagauguaugu

SEQ ID NO: 2985004 - RNA, 13 nt, Human
ucaggcuagaugu

SEQ ID NO: 2985005 - RNA, 15 nt, Human
ucaggugagaagcag

SEQ ID NO: 2985006 - RNA, 16 nt, Human
ucaggugagaagcaga

SEQ ID NO: 2985007 - RNA, 14 nt, Human
ucagggccuggcuc

SEQ ID NO: 2985008 - RNA, 16 nt, Human
ucagggccuggcucag

SEQ ID NO: 2985009 - RNA, 22 nt, Human
ggcuuagacccucaugcugcca

SEQ ID NO: 2985010 - RNA, 23 nt, Human
ggcuuagacccucaugcugccaa

SEQ ID NO: 2985011 - RNA, 14 nt, Human
ggcuuagucacuga

SEQ ID NO: 2985012 - RNA, 20 nt, Human
ggcuucacggaagagccuug

SEQ ID NO: 2985013 - RNA, 15 nt, Human
ggcuuagucacugag

SEQ ID NO: 2985014 - RNA, 21 nt, Human
ggcuucacggaagagccuugc

SEQ ID NO: 2985015 - RNA, 17 nt, Human
ggcuuggggaccagagc

SEQ ID NO: 2985016 - RNA, 18 nt, Human
ggcuuggggaccagagcu

SEQ ID NO: 2985017 - RNA, 20 nt, Human
ggcuuagacccucaugcugc

SEQ ID NO: 2985018 - RNA, 18 nt, Human
ggcuuagacccucaugcu

SEQ ID NO: 2985019 - RNA, 20 nt, Human
ggcuguuggcugggggccuc

SEQ ID NO: 2985020 - RNA, 16 nt, Human
ggcuguuggcuggggg

SEQ ID NO: 2985021 - RNA, 15 nt, Human
ggcuguuggcugggg

SEQ ID NO: 2985022 - RNA, 14 nt, Human
ggcuguuggcuggg

SEQ ID NO: 2985023 - RNA, 15 nt, Human
ggcuggaguuauuga

SEQ ID NO: 2985024 - RNA, 23 nt, Human
ggcuggaguuauugaagcagagu

SEQ ID NO: 2985025 - RNA, 20 nt, Human
ggcugggcucccuucccacc

SEQ ID NO: 2985026 - RNA, 21 nt, Human
ggcugggcucccuucccaccu

SEQ ID NO: 2985027 - RNA, 18 nt, Human
ggcugggcucccuuccca

SEQ ID NO: 2985028 - RNA, 18 nt, Human
ggcugggcuucaguggca

SEQ ID NO: 2985029 - RNA, 22 nt, Human
ggcugggcuucaguggcagcug

SEQ ID NO: 2985030 - RNA, 21 nt, Human
ggcugggcuucaguggcagcu

SEQ ID NO: 2985031 - RNA, 11 nt, Human
ggcugggcuuc

SEQ ID NO: 2985032 - RNA, 14 nt, Human
ggcugggggccuca

SEQ ID NO: 2985033 - RNA, 16 nt, Human
ggcugggggaagaagc

SEQ ID NO: 2985034 - RNA, 18 nt, Human
ggcuggagcuagaauuug

SEQ ID NO: 2985035 - RNA, 20 nt, Human
ggcugcuucaaggauccuga

SEQ ID NO: 2985036 - RNA, 15 nt, Human
ggcugcuucaaggau

SEQ ID NO: 2985037 - RNA, 19 nt, Human
ggcugcuucaaggauccug

SEQ ID NO: 2985038 - RNA, 20 nt, Human
ggcugaggcaggagacuggc

SEQ ID NO: 2985039 - RNA, 21 nt, Human
gggacugaggggaggggagca

SEQ ID NO: 2985040 - RNA, 23 nt, Human
gggacucaaugcacugacauugu

SEQ ID NO: 2985041 - RNA, 19 nt, Human
gggacucaaugcacugaca

SEQ ID NO: 2985042 - RNA, 17 nt, Human
gggacucaaugcacuga

SEQ ID NO: 2985043 - RNA, 14 nt, Human
gggacacccuguga

SEQ ID NO: 2985044 - RNA, 21 nt, Human
gggaauguuugccucugccuc

SEQ ID NO: 2985045 - RNA, 19 nt, Human
gggaauguuugccucugcc

SEQ ID NO: 2985046 - RNA, 20 nt, Human
gggaggacgcucucuggccu

SEQ ID NO: 2985047 - RNA, 17 nt, Human
gggaggacgcucucugg

SEQ ID NO: 2985048 - RNA, 23 nt, Human
gggaggaucucuugagccuggga

SEQ ID NO: 2985049 - RNA, 21 nt, Human
gggaggauugcuugagcucag

SEQ ID NO: 2985050 - RNA, 22 nt, Human
gggaggauguucugggacacag

SEQ ID NO: 2985051 - RNA, 21 nt, Human
gggagugaguugauagcacag

SEQ ID NO: 2985052 - RNA, 23 nt, Human
gggaggauugcuugagcucagga

SEQ ID NO: 2985053 - RNA, 20 nt, Human
gggaggugggauccuccagg

SEQ ID NO: 2985054 - RNA, 22 nt, Human
gggagcugccuguucagcucca

SEQ ID NO: 2985055 - RNA, 21 nt, Human
gggagcugccuguucagcucc

SEQ ID NO: 2985056 - RNA, 13 nt, Human
gggagcugccugu

SEQ ID NO: 2985057 - RNA, 9 nt, Human
ggcuccaga

SEQ ID NO: 2985058 - RNA, 16 nt, Human
ggcuccacuuggucug

SEQ ID NO: 2985059 - RNA, 16 nt, Human
ggcucacccaguccug

SEQ ID NO: 2985060 - RNA, 13 nt, Human
ggcuaugcauuug

SEQ ID NO: 2985061 - RNA, 12 nt, Human
ggcuaugcauuu

SEQ ID NO: 2985062 - RNA, 13 nt, Human
ggcucacccaguc

SEQ ID NO: 2985063 - RNA, 10 nt, Human
ggcuccagac

SEQ ID NO: 2985064 - RNA, 14 nt, Human
ggcuccaggagcag

SEQ ID NO: 2985065 - RNA, 16 nt, Human
ggcuccaggagcagcc

SEQ ID NO: 2985066 - RNA, 17 nt, Human
ggcuccaggagcagcca

SEQ ID NO: 2985067 - RNA, 13 nt, Human
ggcuccaggcucc

SEQ ID NO: 2985068 - RNA, 12 nt, Human
ggcuccaggcuc

SEQ ID NO: 2985069 - RNA, 20 nt, Human
ggcuaguaucaaaagaaaga

SEQ ID NO: 2985070 - RNA, 23 nt, Human
ggcuauaggugcuacaaaaacac

SEQ ID NO: 2985071 - RNA, 20 nt, Human
ggcggguggaucacgagguc

SEQ ID NO: 2985072 - RNA, 11 nt, Human
ggcgcugcccc

SEQ ID NO: 2985073 - RNA, 17 nt, Human
ggcgcugccccuggcag

SEQ ID NO: 2985074 - RNA, 15 nt, Human
ggcgcgguggcucac

SEQ ID NO: 2985075 - RNA, 14 nt, Human
ggcucucaggccag

SEQ ID NO: 2985076 - RNA, 17 nt, Human
ggcucucaggccagcug

SEQ ID NO: 2985077 - RNA, 18 nt, Human
ggcucucaggccagcugc

SEQ ID NO: 2985078 - RNA, 19 nt, Human
ggcucucaggccagcugcu

SEQ ID NO: 2985079 - RNA, 20 nt, Human
ggcucucaggccagcugcuu

SEQ ID NO: 2985080 - RNA, 15 nt, Human
ggcucucaggccagc

SEQ ID NO: 2985081 - RNA, 16 nt, Human
ggcucucaggccagcu

SEQ ID NO: 2985082 - RNA, 14 nt, Human
ggcuccaggcuccu

SEQ ID NO: 2985083 - RNA, 16 nt, Human
ggcucugccucccauc

SEQ ID NO: 2985084 - RNA, 14 nt, Human
ggcucugcccuugg

SEQ ID NO: 2985085 - RNA, 15 nt, Human
ggcucugcccuuggu

SEQ ID NO: 2985086 - RNA, 13 nt, Human
ggcucugccuccc

SEQ ID NO: 2985087 - RNA, 15 nt, Human
ggcucugccucccau

SEQ ID NO: 2985088 - RNA, 12 nt, Human
ggcucugcccuu

SEQ ID NO: 2985089 - RNA, 14 nt, Human
ggccuccugugugu

SEQ ID NO: 2985090 - RNA, 20 nt, Human
ggccucgguguggagaagcg

SEQ ID NO: 2985091 - RNA, 16 nt, Human
ggccucugcacucccc

SEQ ID NO: 2985092 - RNA, 22 nt, Human
ggccuagcauacguacacauuu

SEQ ID NO: 2985093 - RNA, 20 nt, Human
ggccuagcauacguacacau

SEQ ID NO: 2985094 - RNA, 22 nt, Human
ggccucaagugauucuccugcc

SEQ ID NO: 2985095 - RNA, 14 nt, Human
ggccucaagugauu

SEQ ID NO: 2985096 - RNA, 14 nt, Human
ggcccagagggccu

SEQ ID NO: 2985097 - RNA, 17 nt, Human
ggcccagagggccugca

SEQ ID NO: 2985098 - RNA, 19 nt, Human
ggcccagagggccugcaag

SEQ ID NO: 2985099 - RNA, 20 nt, Human
ggcccagagggccugcaagg

SEQ ID NO: 2985100 - RNA, 14 nt, Human
ggccuggccccuca

SEQ ID NO: 2985101 - RNA, 15 nt, Human
ggccuggccccucag

SEQ ID NO: 2985102 - RNA, 17 nt, Human
ggccuggccccucaggg

SEQ ID NO: 2985103 - RNA, 18 nt, Human
ggccuggccccucagggu

SEQ ID NO: 2985104 - RNA, 23 nt, Human
ggccuggccccucagggucccug

SEQ ID NO: 2985105 - RNA, 10 nt, Human
ggccuggccu

SEQ ID NO: 2985106 - RNA, 13 nt, Human
ggccuggccugag

SEQ ID NO: 2985107 - RNA, 14 nt, Human
ggccuggccugagc

SEQ ID NO: 2985108 - RNA, 13 nt, Human
ggccuggccccuc

SEQ ID NO: 2985109 - RNA, 18 nt, Human
ggccucugcacuccccug

SEQ ID NO: 2985110 - RNA, 19 nt, Human
ggccucugcacuccccugc

SEQ ID NO: 2985111 - RNA, 22 nt, Human
ggccucugcacuccccugcugg

SEQ ID NO: 2985112 - RNA, 19 nt, Human
ggccucugcggagcacacu

SEQ ID NO: 2985113 - RNA, 23 nt, Human
ggcgcagcauauucaggaagcuc

SEQ ID NO: 2985114 - RNA, 24 nt, Human
ggcgcagcauauucaggaagcuca

SEQ ID NO: 2985115 - RNA, 15 nt, Human
ggccuggccugagcu

SEQ ID NO: 2985116 - RNA, 16 nt, Human
ggccuggccugagcug

SEQ ID NO: 2985117 - RNA, 23 nt, Human
ggccugggggcugggcagaggaa

SEQ ID NO: 2985118 - RNA, 19 nt, Human
ggauugaaggaugcugucu

SEQ ID NO: 2985119 - RNA, 17 nt, Human
ggcaagcaccuccugcc

SEQ ID NO: 2985120 - RNA, 16 nt, Human
ggauucuuccucccuc

SEQ ID NO: 2985121 - RNA, 21 nt, Human
ggauucuuccucccucccucu

SEQ ID NO: 2985122 - RNA, 17 nt, Human
ggcaccagcagccugga

SEQ ID NO: 2985123 - RNA, 19 nt, Human
ggcaagcaccuccugccuc

SEQ ID NO: 2985124 - RNA, 18 nt, Human
ggcaagcaccuccugccu

SEQ ID NO: 2985125 - RNA, 21 nt, Human
ggcagagguugcagugagccg

SEQ ID NO: 2985126 - RNA, 22 nt, Human
ggcagagcagagaccaucccug

SEQ ID NO: 2985127 - RNA, 19 nt, Human
ggcacucagaagacacuga

SEQ ID NO: 2985128 - RNA, 18 nt, Human
ggcacucagaagacacug

SEQ ID NO: 2985129 - RNA, 19 nt, Human
ggcacuauuuauuuacaaa

SEQ ID NO: 2985130 - RNA, 18 nt, Human
ggcacuauuuauuuacaa

SEQ ID NO: 2985131 - RNA, 17 nt, Human
ggcacccggccccugcu

SEQ ID NO: 2985132 - RNA, 20 nt, Human
ggcacccggccccugcuggu

SEQ ID NO: 2985133 - RNA, 19 nt, Human
ggcacccggccccugcugg

SEQ ID NO: 2985134 - RNA, 18 nt, Human
ggcacccggccccugcug

SEQ ID NO: 2985135 - RNA, 17 nt, Human
ggauuagggagagaaga

SEQ ID NO: 2985136 - RNA, 21 nt, Human
ggaugccugguggcagcugcg

SEQ ID NO: 2985137 - RNA, 20 nt, Human
ggaugccugguggcagcugc

SEQ ID NO: 2985138 - RNA, 19 nt, Human
ggaugccugguggcagcug

SEQ ID NO: 2985139 - RNA, 18 nt, Human
ggaugccugguggcagcu

SEQ ID NO: 2985140 - RNA, 23 nt, Human
ggagucccaccuuggcugcaggg

SEQ ID NO: 2985141 - RNA, 18 nt, Human
ggaugaucuaggaagacu

SEQ ID NO: 2985142 - RNA, 22 nt, Human
ggaugaucuaggaagacuuugg

SEQ ID NO: 2985143 - RNA, 16 nt, Human
ggaugaucuaggaaga

SEQ ID NO: 2985144 - RNA, 17 nt, Human
ggaugccugguggcagc

SEQ ID NO: 2985145 - RNA, 13 nt, Human
ggaugccuggugg

SEQ ID NO: 2985146 - RNA, 19 nt, Human
ggaugcccaaagaugcagc

SEQ ID NO: 2985147 - RNA, 18 nt, Human
ggaugcccaaagaugcag

SEQ ID NO: 2985148 - RNA, 15 nt, Human
ggaugccauccaagu

SEQ ID NO: 2985149 - RNA, 17 nt, Human
ggcagugcuuggcccag

SEQ ID NO: 2985150 - RNA, 18 nt, Human
ggcagugcuuggcccagg

SEQ ID NO: 2985151 - RNA, 19 nt, Human
ggcagugcuuggcccagga

SEQ ID NO: 2985152 - RNA, 20 nt, Human
ggcagugcuuggcccaggag

SEQ ID NO: 2985153 - RNA, 21 nt, Human
ggcagugcuuggcccaggagu

SEQ ID NO: 2985154 - RNA, 22 nt, Human
ggcagugcuuggcccaggaguu

SEQ ID NO: 2985155 - RNA, 23 nt, Human
ggcagugcuuggcccaggaguuu

SEQ ID NO: 2985156 - RNA, 16 nt, Human
ggcagugcuuggccca

SEQ ID NO: 2985157 - RNA, 22 nt, Human
ggcaugacacgaauauugcuga

SEQ ID NO: 2985158 - RNA, 18 nt, Human
ggcaugugaugagaggaa

SEQ ID NO: 2985159 - RNA, 23 nt, Human
ggcaugugaugagaggaaaucac

SEQ ID NO: 2985160 - RNA, 19 nt, Human
ggcagaguugaagacagag

SEQ ID NO: 2985161 - RNA, 21 nt, Human
ggcagaguugaagacagagcu

SEQ ID NO: 2985162 - RNA, 17 nt, Human
ggcagaguugaagacag

SEQ ID NO: 2985163 - RNA, 11 nt, Human
ggcagcugccu

SEQ ID NO: 2985164 - RNA, 13 nt, Human
ggcagcugccucc

SEQ ID NO: 2985165 - RNA, 12 nt, Human
ggcagcugccuc

SEQ ID NO: 2985166 - RNA, 21 nt, Human
ggcagcugcgguccacccagg

SEQ ID NO: 2985167 - RNA, 12 nt, Human
ggcaggguccua

SEQ ID NO: 2985168 - RNA, 24 nt, Human
ggcagcugcgguccacccaggagc

SEQ ID NO: 2985169 - RNA, 23 nt, Human
ggcagcugcgguccacccaggag

SEQ ID NO: 2985170 - RNA, 17 nt, Human
ggcagguuggugggggc

SEQ ID NO: 2985171 - RNA, 18 nt, Human
ggcagggucucacucugu

SEQ ID NO: 2985172 - RNA, 17 nt, Human
ggcagggucucacucug

SEQ ID NO: 2985173 - RNA, 12 nt, Human
ggcccagagagg

SEQ ID NO: 2985174 - RNA, 15 nt, Human
ggccaggcccucugc

SEQ ID NO: 2985175 - RNA, 16 nt, Human
ggccaggcccucugcc

SEQ ID NO: 2985176 - RNA, 17 nt, Human
ggccaggcccucugccc

SEQ ID NO: 2985177 - RNA, 13 nt, Human
ggccaggagccuc

SEQ ID NO: 2985178 - RNA, 14 nt, Human
ggccaggcccucug

SEQ ID NO: 2985179 - RNA, 11 nt, Human
ggccaggagcc

SEQ ID NO: 2985180 - RNA, 20 nt, Human
ggccacugugaagagaacca

SEQ ID NO: 2985181 - RNA, 21 nt, Human
ggccagaaaccuuccugcuga

SEQ ID NO: 2985182 - RNA, 22 nt, Human
ggccacagaaaauucuucucca

SEQ ID NO: 2985183 - RNA, 20 nt, Human
ggcauguucucugaggacac

SEQ ID NO: 2985184 - RNA, 20 nt, Human
ggccaccgccuugcccagcc

SEQ ID NO: 2985185 - RNA, 18 nt, Human
ggccaccgccuugcccag

SEQ ID NO: 2985186 - RNA, 15 nt, Human
ggacauuuuaugucu

SEQ ID NO: 2985187 - RNA, 19 nt, Human
ggaccagagcugccaccug

SEQ ID NO: 2985188 - RNA, 14 nt, Human
ggaccagagcugcc

SEQ ID NO: 2985189 - RNA, 20 nt, Human
ggacauuugcucauggaauu

SEQ ID NO: 2985190 - RNA, 17 nt, Human
ggacauuugcucaugga

SEQ ID NO: 2985191 - RNA, 16 nt, Human
ggacauuugcucaugg

SEQ ID NO: 2985192 - RNA, 16 nt, Human
ggacagcuccuucugu

SEQ ID NO: 2985193 - RNA, 15 nt, Human
ggacagcuccuucug

SEQ ID NO: 2985194 - RNA, 11 nt, Human
ggacagcuccu

SEQ ID NO: 2985195 - RNA, 20 nt, Human
ggacagaggggguggccucc

SEQ ID NO: 2985196 - RNA, 22 nt, Human
ggacagccacggccaggccaga

SEQ ID NO: 2985197 - RNA, 16 nt, Human
ggacagaggggguggc

SEQ ID NO: 2985198 - RNA, 22 nt, Human
ggacacucaaaagcugggcagg

SEQ ID NO: 2985199 - RNA, 19 nt, Human
ggagaagucuucuauuuau

SEQ ID NO: 2985200 - RNA, 20 nt, Human
ggagaagucuucuauuuauu

SEQ ID NO: 2985201 - RNA, 23 nt, Human
ggagaagagcuguucacagccag

SEQ ID NO: 2985202 - RNA, 14 nt, Human
ggagaagaacugaa

SEQ ID NO: 2985203 - RNA, 11 nt, Human
ggagaagaacu

SEQ ID NO: 2985204 - RNA, 15 nt, Human
ggagaagagcuguuc

SEQ ID NO: 2985205 - RNA, 20 nt, Human
ggacugagggggccuggaug

SEQ ID NO: 2985206 - RNA, 16 nt, Human
ggacgcucucuggccu

SEQ ID NO: 2985207 - RNA, 15 nt, Human
ggacgcucucuggcc

SEQ ID NO: 2985208 - RNA, 19 nt, Human
ggacgcucucuggccuucg

SEQ ID NO: 2985209 - RNA, 19 nt, Human
ggacugaauuaugaaacuu

SEQ ID NO: 2985210 - RNA, 17 nt, Human
ggacugaauuaugaaac

SEQ ID NO: 2985211 - RNA, 18 nt, Human
ggaccuugaacuggguac

SEQ ID NO: 2985212 - RNA, 18 nt, Human
ggagcccugucuccucuc

SEQ ID NO: 2985213 - RNA, 14 nt, Human
ggagccuccugccc

SEQ ID NO: 2985214 - RNA, 16 nt, Human
ggagcacacuggcuca

SEQ ID NO: 2985215 - RNA, 14 nt, Human
ggagcuagaauuug

SEQ ID NO: 2985216 - RNA, 15 nt, Human
ggagccuccugcccu

SEQ ID NO: 2985217 - RNA, 19 nt, Human
ggaggggagcaugggaagu

SEQ ID NO: 2985218 - RNA, 22 nt, Human
ggagucccaccuuggcugcagg

SEQ ID NO: 2985219 - RNA, 21 nt, Human
ggagucccaccuuggcugcag

SEQ ID NO: 2985220 - RNA, 16 nt, Human
ggaggacgcucucugg

SEQ ID NO: 2985221 - RNA, 21 nt, Human
ggaggauguucugggacacag

SEQ ID NO: 2985222 - RNA, 18 nt, Human
ggaggauguucugggaca

SEQ ID NO: 2985223 - RNA, 13 nt, Human
ggagggagggcuc

SEQ ID NO: 2985224 - RNA, 16 nt, Human
ggagggagggcuccag

SEQ ID NO: 2985225 - RNA, 17 nt, Human
ggagggagggcuccaga

SEQ ID NO: 2985226 - RNA, 23 nt, Human
gccuuguuuaaugguaguuuuac

SEQ ID NO: 2985227 - RNA, 15 nt, Human
gccuuguuuaauggu

SEQ ID NO: 2985228 - RNA, 18 nt, Human
gccuuggggcugaugcag

SEQ ID NO: 2985229 - RNA, 15 nt, Human
gccuuacacaauggu

SEQ ID NO: 2985230 - RNA, 12 nt, Human
gcgacaaugcaa

SEQ ID NO: 2985231 - RNA, 13 nt, Human
gcgacaaugcaaa

SEQ ID NO: 2985232 - RNA, 20 nt, Human
gcgacaaugcaaaccaucau

SEQ ID NO: 2985233 - RNA, 21 nt, Human
gcgacaaugcaaaccaucauu

SEQ ID NO: 2985234 - RNA, 23 nt, Human
gcgcccaguuggguggaugccug

SEQ ID NO: 2985235 - RNA, 21 nt, Human
gcgccuuaaggauguucuagc

SEQ ID NO: 2985236 - RNA, 14 nt, Human
gcggggacagcucc

SEQ ID NO: 2985237 - RNA, 19 nt, Human
gcggagacggagucccacc

SEQ ID NO: 2985238 - RNA, 16 nt, Human
gcggagaaaggaaggg

SEQ ID NO: 2985239 - RNA, 18 nt, Human
gcgcugccccuggcagcc

SEQ ID NO: 2985240 - RNA, 21 nt, Human
gcgcugccccuggcagccccu

SEQ ID NO: 2985241 - RNA, 14 nt, Human
gcgguccacccagg

SEQ ID NO: 2985242 - RNA, 13 nt, Human
gcgguccacccag

SEQ ID NO: 2985243 - RNA, 19 nt, Human
gcggugagaggggaacaga

SEQ ID NO: 2985244 - RNA, 17 nt, Human
gcggggacagcuccuuc

SEQ ID NO: 2985245 - RNA, 15 nt, Human
gcggggacagcuccu

SEQ ID NO: 2985246 - RNA, 20 nt, Human
gccugagcgacagugagacu

SEQ ID NO: 2985247 - RNA, 17 nt, Human
gccugagcgacagugag

SEQ ID NO: 2985248 - RNA, 18 nt, Human
gccugaagucacacagug

SEQ ID NO: 2985249 - RNA, 17 nt, Human
gccugaagucacacagu

SEQ ID NO: 2985250 - RNA, 16 nt, Human
gccugaagucacacag

SEQ ID NO: 2985251 - RNA, 15 nt, Human
gccugaagucacaca

SEQ ID NO: 2985252 - RNA, 21 nt, Human
gcccaguuggguggaugccug

SEQ ID NO: 2985253 - RNA, 19 nt, Human
gcccaguuggguggaugcc

SEQ ID NO: 2985254 - RNA, 12 nt, Human
gccugagcuggg

SEQ ID NO: 2985255 - RNA, 20 nt, Human
gccuggauggggcugcaccg

SEQ ID NO: 2985256 - RNA, 16 nt, Human
gccuggauggggcugc

SEQ ID NO: 2985257 - RNA, 18 nt, Human
gccuggauggggcugcac

SEQ ID NO: 2985258 - RNA, 15 nt, Human
gccuguaauccuagc

SEQ ID NO: 2985259 - RNA, 20 nt, Human
gccuguaauccuagcacuuu

SEQ ID NO: 2985260 - RNA, 21 nt, Human
gccuggccagaugcaccagcc

SEQ ID NO: 2985261 - RNA, 16 nt, Human
gccuggccagaugcac

SEQ ID NO: 2985262 - RNA, 20 nt, Human
gccuggccagaugcaccagc

SEQ ID NO: 2985263 - RNA, 13 nt, Human
gccuggccccuca

SEQ ID NO: 2985264 - RNA, 14 nt, Human
gccuggccccucag

SEQ ID NO: 2985265 - RNA, 20 nt, Human
gcuccauuuuuagugaaaua

SEQ ID NO: 2985266 - RNA, 23 nt, Human
gcuccgcuuucuacccagcgagc

SEQ ID NO: 2985267 - RNA, 22 nt, Human
gcuccgcuuucuacccagcgag

SEQ ID NO: 2985268 - RNA, 21 nt, Human
gcuccgcuuucuacccagcga

SEQ ID NO: 2985269 - RNA, 18 nt, Human
gcuccgcuuucuacccag

SEQ ID NO: 2985270 - RNA, 20 nt, Human
gcucccuucccaccucucuc

SEQ ID NO: 2985271 - RNA, 15 nt, Human
gcuccaggagcagcc

SEQ ID NO: 2985272 - RNA, 16 nt, Human
gcuccaggagcagcca

SEQ ID NO: 2985273 - RNA, 17 nt, Human
gcuccaggagcagccac

SEQ ID NO: 2985274 - RNA, 18 nt, Human
gcuccaggagcagccaca

SEQ ID NO: 2985275 - RNA, 24 nt, Human
gcuccaggcuccuuuagcgcccag

SEQ ID NO: 2985276 - RNA, 12 nt, Human
gcuccaggcucc

SEQ ID NO: 2985277 - RNA, 12 nt, Human
gcuccaggagca

SEQ ID NO: 2985278 - RNA, 14 nt, Human
gcuccaggagcagc

SEQ ID NO: 2985279 - RNA, 11 nt, Human
gcuccaggagc

SEQ ID NO: 2985280 - RNA, 21 nt, Human
gcuccagcuguucagcugguu

SEQ ID NO: 2985281 - RNA, 20 nt, Human
gcuccagcuguucagcuggu

SEQ ID NO: 2985282 - RNA, 24 nt, Human
gcuccgcuuucuacccagcgagcc

SEQ ID NO: 2985283 - RNA, 22 nt, Human
gcuccuaggacccgucuccagc

SEQ ID NO: 2985284 - RNA, 21 nt, Human
gcuccuaggacccgucuccag

SEQ ID NO: 2985285 - RNA, 19 nt, Human
gcucgagcaugccuggaug

SEQ ID NO: 2985286 - RNA, 21 nt, Human
gcucgagcaugccuggauggg

SEQ ID NO: 2985287 - RNA, 17 nt, Human
gcucgagcaugccugga

SEQ ID NO: 2985288 - RNA, 17 nt, Human
gcuccuuuagcgcccag

SEQ ID NO: 2985289 - RNA, 13 nt, Human
gcuccuucugucc

SEQ ID NO: 2985290 - RNA, 13 nt, Human
gcuccugugucuu

SEQ ID NO: 2985291 - RNA, 12 nt, Human
gcuccugugucu

SEQ ID NO: 2985292 - RNA, 21 nt, Human
gcuauaggugcuacaaaaaca

SEQ ID NO: 2985293 - RNA, 19 nt, Human
gcuauaggugcuacaaaaa

SEQ ID NO: 2985294 - RNA, 19 nt, Human
gcggugcuaucucccccag

SEQ ID NO: 2985295 - RNA, 22 nt, Human
gcggugcuaucucccccagccc

SEQ ID NO: 2985296 - RNA, 13 nt, Human
gcuagauguaugu

SEQ ID NO: 2985297 - RNA, 14 nt, Human
gcuagauguaugua

SEQ ID NO: 2985298 - RNA, 21 nt, Human
gcuaguugggcuuccucauag

SEQ ID NO: 2985299 - RNA, 22 nt, Human
gcucaaguccucuuuucugaga

SEQ ID NO: 2985300 - RNA, 19 nt, Human
gcucaaguccucuuuucug

SEQ ID NO: 2985301 - RNA, 23 nt, Human
gcucaauagauugcucaaaucag

SEQ ID NO: 2985302 - RNA, 13 nt, Human
gcuaucuccccca

SEQ ID NO: 2985303 - RNA, 18 nt, Human
gcucaaguccucuuuucu

SEQ ID NO: 2985304 - RNA, 14 nt, Human
gcuaucucccccag

SEQ ID NO: 2985305 - RNA, 15 nt, Human
gcucaccagccccag

SEQ ID NO: 2985306 - RNA, 14 nt, Human
gcucaccagcccca

SEQ ID NO: 2985307 - RNA, 13 nt, Human
gcucaccagcccc

SEQ ID NO: 2985308 - RNA, 12 nt, Human
gcucaccagccc

SEQ ID NO: 2985309 - RNA, 16 nt, Human
gcucacauaucuguca

SEQ ID NO: 2985310 - RNA, 14 nt, Human
gcucaccucucccu

SEQ ID NO: 2985311 - RNA, 16 nt, Human
gcucaccucucccuug

SEQ ID NO: 2985312 - RNA, 17 nt, Human
gcucaccucucccuugg

SEQ ID NO: 2985313 - RNA, 18 nt, Human
gcucaccucucccuugga

SEQ ID NO: 2985314 - RNA, 23 nt, Human
gcucagcggggacagcuccuucu

SEQ ID NO: 2985315 - RNA, 18 nt, Human
gcucagcggggacagcuc

SEQ ID NO: 2985316 - RNA, 17 nt, Human
gcucagcggggacagcu

SEQ ID NO: 2985317 - RNA, 16 nt, Human
gcucagcggggacagc

SEQ ID NO: 2985318 - RNA, 14 nt, Human
gcugaccuugcuga

SEQ ID NO: 2985319 - RNA, 22 nt, Human
gcugacuguuuucucuugagag

SEQ ID NO: 2985320 - RNA, 19 nt, Human
gcugacagacacaggcccg

SEQ ID NO: 2985321 - RNA, 18 nt, Human
gcugacagacacaggccc

SEQ ID NO: 2985322 - RNA, 17 nt, Human
gcugacagacacaggcc

SEQ ID NO: 2985323 - RNA, 21 nt, Human
gcucucaggccagcugcuugg

SEQ ID NO: 2985324 - RNA, 20 nt, Human
gcucucaggccagcugcuug

SEQ ID NO: 2985325 - RNA, 19 nt, Human
gcugauuuaaacacauuaa

SEQ ID NO: 2985326 - RNA, 23 nt, Human
gcugcaaaggguaucaggugcug

SEQ ID NO: 2985327 - RNA, 22 nt, Human
gcugcaaaggguaucaggugcu

SEQ ID NO: 2985328 - RNA, 21 nt, Human
gcugauuaaaccaaggcuaga

SEQ ID NO: 2985329 - RNA, 15 nt, Human
gcugaucgcuucucc

SEQ ID NO: 2985330 - RNA, 12 nt, Human
gcugcccucucc

SEQ ID NO: 2985331 - RNA, 13 nt, Human
gcugccaccugcc

SEQ ID NO: 2985332 - RNA, 12 nt, Human
gcugccaccugc

SEQ ID NO: 2985333 - RNA, 20 nt, Human
gcugccaaugggagcucaug

SEQ ID NO: 2985334 - RNA, 18 nt, Human
gcugcauuuaaaagauac

SEQ ID NO: 2985335 - RNA, 17 nt, Human
gcugcauuuaaaagaua

SEQ ID NO: 2985336 - RNA, 19 nt, Human
gcugcauuuaaaagauaca

SEQ ID NO: 2985337 - RNA, 13 nt, Human
gcugcaguugcca

SEQ ID NO: 2985338 - RNA, 14 nt, Human
gcugcaguugccag

SEQ ID NO: 2985339 - RNA, 22 nt, Human
gcugcccucuccugggcagcug

SEQ ID NO: 2985340 - RNA, 20 nt, Human
gcugcccucuccugggcagc

SEQ ID NO: 2985341 - RNA, 18 nt, Human
gcugcccucuccugggca

SEQ ID NO: 2985342 - RNA, 17 nt, Human
gcugcccucuccugggc

SEQ ID NO: 2985343 - RNA, 16 nt, Human
gcugcccucuccuggg

SEQ ID NO: 2985344 - RNA, 15 nt, Human
gcugcccucuccugg

SEQ ID NO: 2985345 - RNA, 14 nt, Human
gcugcccucuccug

SEQ ID NO: 2985346 - RNA, 13 nt, Human
gcugcccucuccu

SEQ ID NO: 2985347 - RNA, 13 nt, Human
gcugcccugccca

SEQ ID NO: 2985348 - RNA, 14 nt, Human
gcugcccugcccac

SEQ ID NO: 2985349 - RNA, 12 nt, Human
gcugcccugccc

SEQ ID NO: 2985350 - RNA, 23 nt, Human
gcugcccucuccugggcagcugc

SEQ ID NO: 2985351 - RNA, 16 nt, Human
gcugcccugcccaccu

SEQ ID NO: 2985352 - RNA, 18 nt, Human
gcugcccugcccaccugg

SEQ ID NO: 2985353 - RNA, 20 nt, Human
gcugcccugcccaccuggcc

SEQ ID NO: 2985354 - RNA, 21 nt, Human
gcugcccugcccaccuggccu

SEQ ID NO: 2985355 - RNA, 22 nt, Human
gcugcccugcccaccuggccuc

SEQ ID NO: 2985356 - RNA, 23 nt, Human
gcugcccugcccaccuggccucu

SEQ ID NO: 2985357 - RNA, 24 nt, Human
gcugcccugcccaccuggccucug

SEQ ID NO: 2985358 - RNA, 19 nt, Human
gcugccuguucagcuccag

SEQ ID NO: 2985359 - RNA, 18 nt, Human
gcugccuguucagcucca

SEQ ID NO: 2985360 - RNA, 22 nt, Human
gcugccuguucagcuccagcuc

SEQ ID NO: 2985361 - RNA, 20 nt, Human
gcugccuguucagcuccagc

SEQ ID NO: 2985362 - RNA, 15 nt, Human
gcugcgguccaccca

SEQ ID NO: 2985363 - RNA, 14 nt, Human
gcugcgguccaccc

SEQ ID NO: 2985364 - RNA, 21 nt, Human
gcugcgguccacccaggagcc

SEQ ID NO: 2985365 - RNA, 19 nt, Human
gcugcgguccacccaggag

SEQ ID NO: 2985366 - RNA, 22 nt, Human
gcugcgguccacccaggagccc

SEQ ID NO: 2985367 - RNA, 15 nt, Human
gcuggaccuugaacu

SEQ ID NO: 2985368 - RNA, 21 nt, Human
gcuggaaaaguauguuagugc

SEQ ID NO: 2985369 - RNA, 23 nt, Human
gcuggaaaaguauguuagugcaa

SEQ ID NO: 2985370 - RNA, 22 nt, Human
gcugcuuuugucuaugggacuc

SEQ ID NO: 2985371 - RNA, 22 nt, Human
gcuuacaugccuaccaauauuu

SEQ ID NO: 2985372 - RNA, 15 nt, Human
gcugugucucccuuc

SEQ ID NO: 2985373 - RNA, 15 nt, Human
gcuggugucaccuga

SEQ ID NO: 2985374 - RNA, 14 nt, Human
gcuggugucaccug

SEQ ID NO: 2985375 - RNA, 17 nt, Human
gcugucagccauuccug

SEQ ID NO: 2985376 - RNA, 23 nt, Human
gcugucccuuacgugaguccugg

SEQ ID NO: 2985377 - RNA, 22 nt, Human
gcugucccuuacgugaguccug

SEQ ID NO: 2985378 - RNA, 16 nt, Human
gcugucccuuuuccuu

SEQ ID NO: 2985379 - RNA, 23 nt, Human
gcuggucccagccagcaguucag

SEQ ID NO: 2985380 - RNA, 13 nt, Human
gcugggggccuca

SEQ ID NO: 2985381 - RNA, 18 nt, Human
gcugggggccucagugcc

SEQ ID NO: 2985382 - RNA, 15 nt, Human
gcugggggccucagu

SEQ ID NO: 2985383 - RNA, 14 nt, Human
gcugggggccucag

SEQ ID NO: 2985384 - RNA, 20 nt, Human
gcugggcuucaguggcagcu

SEQ ID NO: 2985385 - RNA, 22 nt, Human
gcugggcuucaguggcagcugc

SEQ ID NO: 2985386 - RNA, 21 nt, Human
gcugggcuucaguggcagcug

SEQ ID NO: 2985387 - RNA, 13 nt, Human
gcuggccuggccc

SEQ ID NO: 2985388 - RNA, 12 nt, Human
gcuggccuggcc

SEQ ID NO: 2985389 - RNA, 14 nt, Human
gcuggccuggcccc

SEQ ID NO: 2985390 - RNA, 15 nt, Human
gcuggccuggccccu

SEQ ID NO: 2985391 - RNA, 19 nt, Human
gcugggaugauuggagggg

SEQ ID NO: 2985392 - RNA, 21 nt, Human
gcugggcucccuucccaccuc

SEQ ID NO: 2985393 - RNA, 16 nt, Human
gcuuagacccucaugc

SEQ ID NO: 2985394 - RNA, 21 nt, Human
gcuuagacccucaugcugcca

SEQ ID NO: 2985395 - RNA, 19 nt, Human
gcuuagaaauaacagaaga

SEQ ID NO: 2985396 - RNA, 12 nt, Human
gcuuagaaauaa

SEQ ID NO: 2985397 - RNA, 20 nt, Human
gcuuauacacuuacacuuua

SEQ ID NO: 2985398 - RNA, 20 nt, Human
gcuucaguggcagcugcuuu

SEQ ID NO: 2985399 - RNA, 19 nt, Human
gcuucaguggcagcugcuu

SEQ ID NO: 2985400 - RNA, 21 nt, Human
gcuucauccuccucagaucuu

SEQ ID NO: 2985401 - RNA, 19 nt, Human
gcuucuguuuuauaauuuu

SEQ ID NO: 2985402 - RNA, 18 nt, Human
gcuucauuuccugugucu

SEQ ID NO: 2985403 - RNA, 22 nt, Human
gcuucucacugccaugccagcu

SEQ ID NO: 2985404 - RNA, 17 nt, Human
gcuucucacugccaugc

SEQ ID NO: 2985405 - RNA, 18 nt, Human
gcuugcccuguuaaaaga

SEQ ID NO: 2985406 - RNA, 22 nt, Human
gcagaguaggggucugucuuuu

SEQ ID NO: 2985407 - RNA, 23 nt, Human
gcagagguugcagugagccgaga

SEQ ID NO: 2985408 - RNA, 18 nt, Human
gcagagguugcagugagc

SEQ ID NO: 2985409 - RNA, 13 nt, Human
gcagcagacacau

SEQ ID NO: 2985410 - RNA, 17 nt, Human
gcagcagacacaugcca

SEQ ID NO: 2985411 - RNA, 18 nt, Human
gcagauggagaccccuug

SEQ ID NO: 2985412 - RNA, 22 nt, Human
gcagagaccaucccugaaggcc

SEQ ID NO: 2985413 - RNA, 20 nt, Human
gcagagaccaucccugaagg

SEQ ID NO: 2985414 - RNA, 21 nt, Human
gcagagaccaucccugaaggc

SEQ ID NO: 2985415 - RNA, 19 nt, Human
gcagagaccaucccugaag

SEQ ID NO: 2985416 - RNA, 22 nt, Human
gcagacucuacagaggccaugg

SEQ ID NO: 2985417 - RNA, 19 nt, Human
gcagacucuacagaggcca

SEQ ID NO: 2985418 - RNA, 18 nt, Human
gcagacucuacagaggcc

SEQ ID NO: 2985419 - RNA, 17 nt, Human
gcagacucuacagaggc

SEQ ID NO: 2985420 - RNA, 16 nt, Human
gcacuugcagacucua

SEQ ID NO: 2985421 - RNA, 14 nt, Human
gcacuugcagacuc

SEQ ID NO: 2985422 - RNA, 22 nt, Human
gcacuucgggaggucgaggcag

SEQ ID NO: 2985423 - RNA, 16 nt, Human
gcaggaagcugugaga

SEQ ID NO: 2985424 - RNA, 18 nt, Human
gcagcucagagagggugg

SEQ ID NO: 2985425 - RNA, 19 nt, Human
gcagcucagagaggguggg

SEQ ID NO: 2985426 - RNA, 17 nt, Human
gcagcucaccucucccu

SEQ ID NO: 2985427 - RNA, 20 nt, Human
gcagcucaccucucccuugg

SEQ ID NO: 2985428 - RNA, 21 nt, Human
gcagcucaccucucccuugga

SEQ ID NO: 2985429 - RNA, 14 nt, Human
gcagcucagagagg

SEQ ID NO: 2985430 - RNA, 16 nt, Human
gcagcucaccucuccc

SEQ ID NO: 2985431 - RNA, 18 nt, Human
gcagcagggagggcuucu

SEQ ID NO: 2985432 - RNA, 19 nt, Human
gcagcagggagggcuucug

SEQ ID NO: 2985433 - RNA, 19 nt, Human
gcagccucacaguccuuac

SEQ ID NO: 2985434 - RNA, 15 nt, Human
gcagccucacagucc

SEQ ID NO: 2985435 - RNA, 17 nt, Human
gcagccucacaguccuu

SEQ ID NO: 2985436 - RNA, 15 nt, Human
gcacgcacacugucu

SEQ ID NO: 2985437 - RNA, 16 nt, Human
gcacgcacacugucug

SEQ ID NO: 2985438 - RNA, 16 nt, Human
gcacccucaggcaggu

SEQ ID NO: 2985439 - RNA, 19 nt, Human
gcacccucaggcagguggg

SEQ ID NO: 2985440 - RNA, 14 nt, Human
gcacgugugugcac

SEQ ID NO: 2985441 - RNA, 20 nt, Human
gcacuaaggugugcucugau

SEQ ID NO: 2985442 - RNA, 19 nt, Human
gcacuaaggugugcucuga

SEQ ID NO: 2985443 - RNA, 19 nt, Human
gcacuguggguagacacac

SEQ ID NO: 2985444 - RNA, 19 nt, Human
gcacuguuuuauuuuaauu

SEQ ID NO: 2985445 - RNA, 12 nt, Human
gcacugggcuug

SEQ ID NO: 2985446 - RNA, 12 nt, Human
gcacugcuucca

SEQ ID NO: 2985447 - RNA, 13 nt, Human
gcacugcuuccag

SEQ ID NO: 2985448 - RNA, 14 nt, Human
gcacugcuuccagu

SEQ ID NO: 2985449 - RNA, 15 nt, Human
gcacugcuuccagug

SEQ ID NO: 2985450 - RNA, 15 nt, Human
gcacuauaauguaag

SEQ ID NO: 2985451 - RNA, 14 nt, Human
gcacuauaauguaa

SEQ ID NO: 2985452 - RNA, 20 nt, Human
gcacuauaauguaagcucua

SEQ ID NO: 2985453 - RNA, 22 nt, Human
gcacagcaggcugccagugccu

SEQ ID NO: 2985454 - RNA, 18 nt, Human
gcacagcaggcugccagu

SEQ ID NO: 2985455 - RNA, 23 nt, Human
gcacagcaggcugccagugccug

SEQ ID NO: 2985456 - RNA, 17 nt, Human
gcacagcaggcugccag

SEQ ID NO: 2985457 - RNA, 15 nt, Human
gcacagccucuuaga

SEQ ID NO: 2985458 - RNA, 20 nt, Human
gauugugucucuugguccug

SEQ ID NO: 2985459 - RNA, 12 nt, Human
gcacagcaggcu

SEQ ID NO: 2985460 - RNA, 21 nt, Human
gcacagcuucauuuccugugu

SEQ ID NO: 2985461 - RNA, 23 nt, Human
gcacagcuucauuuccugugucu

SEQ ID NO: 2985462 - RNA, 17 nt, Human
gcaccaucucuccuccu

SEQ ID NO: 2985463 - RNA, 14 nt, Human
gcaccaucucuccu

SEQ ID NO: 2985464 - RNA, 15 nt, Human
gcaccaucucuccuc

SEQ ID NO: 2985465 - RNA, 13 nt, Human
gcaccagcagccu

SEQ ID NO: 2985466 - RNA, 21 nt, Human
gcauacuauuaaacaugcugu

SEQ ID NO: 2985467 - RNA, 17 nt, Human
gcauacuauuaaacaug

SEQ ID NO: 2985468 - RNA, 14 nt, Human
gcauacuauuaaac

SEQ ID NO: 2985469 - RNA, 13 nt, Human
gcauacuauuaaa

SEQ ID NO: 2985470 - RNA, 18 nt, Human
gcauacguacacauuuua

SEQ ID NO: 2985471 - RNA, 19 nt, Human
gcauacguacacauuuuau

SEQ ID NO: 2985472 - RNA, 21 nt, Human
gcaguugaaaagacuccaaag

SEQ ID NO: 2985473 - RNA, 16 nt, Human
gcaguugaaaagacuc

SEQ ID NO: 2985474 - RNA, 19 nt, Human
gcaguugaaaagacuccaa

SEQ ID NO: 2985475 - RNA, 15 nt, Human
gcaguugaaaagacu

SEQ ID NO: 2985476 - RNA, 21 nt, Human
gcaguggugguuuucuguucu

SEQ ID NO: 2985477 - RNA, 20 nt, Human
gcaguggugguuuucuguuc

SEQ ID NO: 2985478 - RNA, 23 nt, Human
gcaguucagagcugcccucuccu

SEQ ID NO: 2985479 - RNA, 22 nt, Human
gcaguucagagcugcccucucc

SEQ ID NO: 2985480 - RNA, 20 nt, Human
gcaguucagagcugcccucu

SEQ ID NO: 2985481 - RNA, 19 nt, Human
gcaguucagagcugcccuc

SEQ ID NO: 2985482 - RNA, 21 nt, Human
gcaguggugcgaucuggguuc

SEQ ID NO: 2985483 - RNA, 20 nt, Human
gcaguggugcgaucuggguu

SEQ ID NO: 2985484 - RNA, 19 nt, Human
gcaguggugguuuucuguu

SEQ ID NO: 2985485 - RNA, 22 nt, Human
gcaguggugcgaucuggguuca

SEQ ID NO: 2985486 - RNA, 19 nt, Human
gcaguggugcgaucugggu

SEQ ID NO: 2985487 - RNA, 18 nt, Human
gcaguggugcgaucuggg

SEQ ID NO: 2985488 - RNA, 11 nt, Human
gcagugggagc

SEQ ID NO: 2985489 - RNA, 22 nt, Human
gcaggggaggguagagcggaga

SEQ ID NO: 2985490 - RNA, 19 nt, Human
gcaggguccuagaaauucc

SEQ ID NO: 2985491 - RNA, 16 nt, Human
gcagggucucacucug

SEQ ID NO: 2985492 - RNA, 22 nt, Human
gcagggcucagcggggacagcu

SEQ ID NO: 2985493 - RNA, 18 nt, Human
gcaggcagccaggccaca

SEQ ID NO: 2985494 - RNA, 17 nt, Human
gcaggcagccaggccac

SEQ ID NO: 2985495 - RNA, 22 nt, Human
gcauacugccuuguuuaauggu

SEQ ID NO: 2985496 - RNA, 22 nt, Human
gcaucagcugcugaaacaacaa

SEQ ID NO: 2985497 - RNA, 12 nt, Human
gcaucaggccag

SEQ ID NO: 2985498 - RNA, 23 nt, Human
gcaucagcugcugaaacaacaaa

SEQ ID NO: 2985499 - RNA, 18 nt, Human
gcaucaggccaggcccuc

SEQ ID NO: 2985500 - RNA, 23 nt, Human
gcaucaggccaggcccucugccc

SEQ ID NO: 2985501 - RNA, 20 nt, Human
gcaucuagcaugucgucaaa

SEQ ID NO: 2985502 - RNA, 20 nt, Human
gcaugacacgaauauugcug

SEQ ID NO: 2985503 - RNA, 21 nt, Human
gcaugacacgaauauugcuga

SEQ ID NO: 2985504 - RNA, 22 nt, Human
gcaugacacgaauauugcugau

SEQ ID NO: 2985505 - RNA, 22 nt, Human
gcaugaaguaauaugcacacau

SEQ ID NO: 2985506 - RNA, 21 nt, Human
gcaugaaguaauaugcacaca

SEQ ID NO: 2985507 - RNA, 20 nt, Human
gcaugaaguaauaugcacac

SEQ ID NO: 2985508 - RNA, 13 nt, Human
gcauguuacauaa

SEQ ID NO: 2985509 - RNA, 14 nt, Human
gcaugccuggaugg

SEQ ID NO: 2985510 - RNA, 24 nt, Human
gcauuaucuagauacuguaucaug

SEQ ID NO: 2985511 - RNA, 22 nt, Human
gcauuaucuagauacuguauca

SEQ ID NO: 2985512 - RNA, 19 nt, Human
gcauuaucuagauacugua

SEQ ID NO: 2985513 - RNA, 12 nt, Human
gcauuccccagg

SEQ ID NO: 2985514 - RNA, 14 nt, Human
gcauuccccaggag

SEQ ID NO: 2985515 - RNA, 15 nt, Human
gcauuccccaggagg

SEQ ID NO: 2985516 - RNA, 16 nt, Human
gcauuccccaggaggc

SEQ ID NO: 2985517 - RNA, 17 nt, Human
gcauuccccaggaggcc

SEQ ID NO: 2985518 - RNA, 18 nt, Human
gcauuccccaggaggcca

SEQ ID NO: 2985519 - RNA, 19 nt, Human
gcauuccccaggaggccag

SEQ ID NO: 2985520 - RNA, 20 nt, Human
gcauuccccaggaggccagc

SEQ ID NO: 2985521 - RNA, 21 nt, Human
gcauuccccaggaggccagcc

SEQ ID NO: 2985522 - RNA, 22 nt, Human
gcauuccccaggaggccagccu

SEQ ID NO: 2985523 - RNA, 18 nt, Human
gcauuugaggucuguucu

SEQ ID NO: 2985524 - RNA, 12 nt, Human
gccaauuugcac

SEQ ID NO: 2985525 - RNA, 16 nt, Human
gccacaagacccuugu

SEQ ID NO: 2985526 - RNA, 22 nt, Human
gccacaagacccuugugguccc

SEQ ID NO: 2985527 - RNA, 20 nt, Human
gccacagagaaaguacuucu

SEQ ID NO: 2985528 - RNA, 14 nt, Human
gccacagagaaagu

SEQ ID NO: 2985529 - RNA, 13 nt, Human
gccacagagaaag

SEQ ID NO: 2985530 - RNA, 19 nt, Human
gccacaccucuaucccggc

SEQ ID NO: 2985531 - RNA, 23 nt, Human
gccacagagaaaguacuucucca

SEQ ID NO: 2985532 - RNA, 14 nt, Human
gccaauauccuaau

SEQ ID NO: 2985533 - RNA, 15 nt, Human
gccaauauccuaaua

SEQ ID NO: 2985534 - RNA, 16 nt, Human
gccaauauccuaauaa

SEQ ID NO: 2985535 - RNA, 17 nt, Human
gccaauauccuaauaaa

SEQ ID NO: 2985536 - RNA, 13 nt, Human
gccaauauccuaa

SEQ ID NO: 2985537 - RNA, 18 nt, Human
gccaauauccuaauaaaa

SEQ ID NO: 2985538 - RNA, 19 nt, Human
gccaauauccuaauaaaaa

SEQ ID NO: 2985539 - RNA, 20 nt, Human
gccaauauccuaauaaaaag

SEQ ID NO: 2985540 - RNA, 22 nt, Human
gccaauauccuaauaaaaaggu

SEQ ID NO: 2985541 - RNA, 23 nt, Human
gccaauauccuaauaaaaaggug

SEQ ID NO: 2985542 - RNA, 21 nt, Human
gccaaugcuacaguaauaaau

SEQ ID NO: 2985543 - RNA, 23 nt, Human
gcauuuggugguuucagaaaugu

SEQ ID NO: 2985544 - RNA, 22 nt, Human
gcauuuggugguuucagaaaug

SEQ ID NO: 2985545 - RNA, 20 nt, Human
gcauuugaggucuguucuuu

SEQ ID NO: 2985546 - RNA, 19 nt, Human
gcauuugaggucuguucuu

SEQ ID NO: 2985547 - RNA, 21 nt, Human
gccaaggcugggggaagaagc

SEQ ID NO: 2985548 - RNA, 23 nt, Human
gccaaggugggaggauugcuuga

SEQ ID NO: 2985549 - RNA, 14 nt, Human
gccaaggugggagg

SEQ ID NO: 2985550 - RNA, 15 nt, Human
gccaaggugggagga

SEQ ID NO: 2985551 - RNA, 15 nt, Human
gccagacuggcacag

SEQ ID NO: 2985552 - RNA, 18 nt, Human
gccagacuggcacaguuu

SEQ ID NO: 2985553 - RNA, 23 nt, Human
gccacuacauuugcuccauccuc

SEQ ID NO: 2985554 - RNA, 17 nt, Human
gccagagacacaagccu

SEQ ID NO: 2985555 - RNA, 19 nt, Human
gccagagacacaagccuuc

SEQ ID NO: 2985556 - RNA, 16 nt, Human
gccagagacacaagcc

SEQ ID NO: 2985557 - RNA, 19 nt, Human
gccagacuggcacaguuuu

SEQ ID NO: 2985558 - RNA, 20 nt, Human
gccagagacacaagccuucg

SEQ ID NO: 2985559 - RNA, 10 nt, Human
gccagaggag

SEQ ID NO: 2985560 - RNA, 18 nt, Human
gccagaugcaccagcccu

SEQ ID NO: 2985561 - RNA, 17 nt, Human
gccagaugcaccagccc

SEQ ID NO: 2985562 - RNA, 16 nt, Human
gccagaugcaccagcc

SEQ ID NO: 2985563 - RNA, 23 nt, Human
gccagagggagugacagaggcag

SEQ ID NO: 2985564 - RNA, 12 nt, Human
gccagaggagag

SEQ ID NO: 2985565 - RNA, 13 nt, Human
gccagaggagaga

SEQ ID NO: 2985566 - RNA, 15 nt, Human
gccagaggagagagg

SEQ ID NO: 2985567 - RNA, 17 nt, Human
gccagaggagagaggac

SEQ ID NO: 2985568 - RNA, 19 nt, Human
gccagaggagagaggaccc

SEQ ID NO: 2985569 - RNA, 22 nt, Human
gccagaggagagaggacccccu

SEQ ID NO: 2985570 - RNA, 22 nt, Human
gccagagggagugacagaggca

SEQ ID NO: 2985571 - RNA, 21 nt, Human
gccagagggagugacagaggc

SEQ ID NO: 2985572 - RNA, 17 nt, Human
gccaccugccuguuggg

SEQ ID NO: 2985573 - RNA, 13 nt, Human
gccaccgccuugc

SEQ ID NO: 2985574 - RNA, 20 nt, Human
gccaccgccuugcccagccu

SEQ ID NO: 2985575 - RNA, 16 nt, Human
gccaccgccuugccca

SEQ ID NO: 2985576 - RNA, 14 nt, Human
gccaccugcggugc

SEQ ID NO: 2985577 - RNA, 20 nt, Human
gccaccugcggugcuaucuc

SEQ ID NO: 2985578 - RNA, 22 nt, Human
gccaccugcggugcuaucuccc

SEQ ID NO: 2985579 - RNA, 19 nt, Human
gccacggccaggccagagg

SEQ ID NO: 2985580 - RNA, 17 nt, Human
gccacggccaggccaga

SEQ ID NO: 2985581 - RNA, 18 nt, Human
gccacggccaggccagag

SEQ ID NO: 2985582 - RNA, 20 nt, Human
gcccagagggccugcaaggg

SEQ ID NO: 2985583 - RNA, 21 nt, Human
gcccagagggccugcaaggga

SEQ ID NO: 2985584 - RNA, 22 nt, Human
gcccagagggccugcaagggag

SEQ ID NO: 2985585 - RNA, 11 nt, Human
gcccagccccu

SEQ ID NO: 2985586 - RNA, 12 nt, Human
gcccagccccuu

SEQ ID NO: 2985587 - RNA, 9 nt, Human
gcccagccc

SEQ ID NO: 2985588 - RNA, 14 nt, Human
gcccagagggccug

SEQ ID NO: 2985589 - RNA, 15 nt, Human
gcccagagggccugc

SEQ ID NO: 2985590 - RNA, 18 nt, Human
gcccagagggccugcaag

SEQ ID NO: 2985591 - RNA, 19 nt, Human
gcccagagggccugcaagg

SEQ ID NO: 2985592 - RNA, 12 nt, Human
gcccagagggcc

SEQ ID NO: 2985593 - RNA, 21 nt, Human
gcccaaugcacuuuguucugg

SEQ ID NO: 2985594 - RNA, 18 nt, Human
gcccaggaaaggcuccag

SEQ ID NO: 2985595 - RNA, 19 nt, Human
gcccaggaaaggcuccagg

SEQ ID NO: 2985596 - RNA, 20 nt, Human
gcccaggaaaggcuccagga

SEQ ID NO: 2985597 - RNA, 21 nt, Human
gcccaggaaaggcuccaggag

SEQ ID NO: 2985598 - RNA, 20 nt, Human
gcccaggcuggcgugcagug

SEQ ID NO: 2985599 - RNA, 19 nt, Human
gcccaggcuggcgugcagu

SEQ ID NO: 2985600 - RNA, 22 nt, Human
gcccaggcuggcgugcaguggu

SEQ ID NO: 2985601 - RNA, 19 nt, Human
gcccaggcuuagucacuga

SEQ ID NO: 2985602 - RNA, 21 nt, Human
gcccaggcuuagucacugaga

SEQ ID NO: 2985603 - RNA, 23 nt, Human
gcccaggcuuagucacugagaca

SEQ ID NO: 2985604 - RNA, 19 nt, Human
gcccagucuggaaugcagu

SEQ ID NO: 2985605 - RNA, 15 nt, Human
gcccaguugggugga

SEQ ID NO: 2985606 - RNA, 13 nt, Human
gcccagccccuuc

SEQ ID NO: 2985607 - RNA, 14 nt, Human
gcccagccccuucu

SEQ ID NO: 2985608 - RNA, 16 nt, Human
gcccagccccuucuga

SEQ ID NO: 2985609 - RNA, 17 nt, Human
gcccagccccuucugac

SEQ ID NO: 2985610 - RNA, 20 nt, Human
gcccagccccuucugaccca

SEQ ID NO: 2985611 - RNA, 24 nt, Human
gcccagccccuucugacccaugcu

SEQ ID NO: 2985612 - RNA, 16 nt, Human
gcccagccuggaugcc

SEQ ID NO: 2985613 - RNA, 14 nt, Human
gcccagccuggaug

SEQ ID NO: 2985614 - RNA, 22 nt, Human
gccaugggacagggaggacgcu

SEQ ID NO: 2985615 - RNA, 23 nt, Human
gccaugggacagggaggacgcuc

SEQ ID NO: 2985616 - RNA, 16 nt, Human
gccauuuguguuuaua

SEQ ID NO: 2985617 - RNA, 18 nt, Human
gccaugagccgcccaagg

SEQ ID NO: 2985618 - RNA, 21 nt, Human
gccaugagccgcccaaggccu

SEQ ID NO: 2985619 - RNA, 19 nt, Human
gccaugagccgcccaaggc

SEQ ID NO: 2985620 - RNA, 18 nt, Human
gccaugaggaacaaggca

SEQ ID NO: 2985621 - RNA, 13 nt, Human
gccaugccagcuu

SEQ ID NO: 2985622 - RNA, 18 nt, Human
gccaugccagcuuaucuc

SEQ ID NO: 2985623 - RNA, 19 nt, Human
gccaugccagcuuaucuca

SEQ ID NO: 2985624 - RNA, 24 nt, Human
gccaugcuccuggcccacugcauc

SEQ ID NO: 2985625 - RNA, 12 nt, Human
gccagugccugg

SEQ ID NO: 2985626 - RNA, 13 nt, Human
gccagugccuggg

SEQ ID NO: 2985627 - RNA, 14 nt, Human
gccagugccugggu

SEQ ID NO: 2985628 - RNA, 23 nt, Human
gccauccuggcccagggcaucug

SEQ ID NO: 2985629 - RNA, 23 nt, Human
gccagggacagaggggguggccu

SEQ ID NO: 2985630 - RNA, 16 nt, Human
gccagggacagagggg

SEQ ID NO: 2985631 - RNA, 18 nt, Human
gccagggacagagggggu

SEQ ID NO: 2985632 - RNA, 13 nt, Human
gccagggacagag

SEQ ID NO: 2985633 - RNA, 16 nt, Human
gccagauuucacucuc

SEQ ID NO: 2985634 - RNA, 18 nt, Human
gccagauuucacucuccu

SEQ ID NO: 2985635 - RNA, 21 nt, Human
gccagauuucacucuccuugg

SEQ ID NO: 2985636 - RNA, 21 nt, Human
gccagggccaugucagacaca

SEQ ID NO: 2985637 - RNA, 17 nt, Human
gccagucaccccggcca

SEQ ID NO: 2985638 - RNA, 18 nt, Human
gccagucaccccggccac

SEQ ID NO: 2985639 - RNA, 20 nt, Human
gccagucaccccggccaccu

SEQ ID NO: 2985640 - RNA, 17 nt, Human
gccagguuuuuggucug

SEQ ID NO: 2985641 - RNA, 17 nt, Human
gaguuauugaagcagag

SEQ ID NO: 2985642 - RNA, 23 nt, Human
gaguucaucuugaauuguaagga

SEQ ID NO: 2985643 - RNA, 17 nt, Human
gagugugccugaagucc

SEQ ID NO: 2985644 - RNA, 21 nt, Human
gaguugaaaaucuuauaauuu

SEQ ID NO: 2985645 - RNA, 13 nt, Human
gaguucugguucc

SEQ ID NO: 2985646 - RNA, 19 nt, Human
gagugaacaaauuuacaga

SEQ ID NO: 2985647 - RNA, 22 nt, Human
gagugaacaaauuuacagagac

SEQ ID NO: 2985648 - RNA, 23 nt, Human
gagugggggaucacagccucuga

SEQ ID NO: 2985649 - RNA, 12 nt, Human
gagugggcccaa

SEQ ID NO: 2985650 - RNA, 19 nt, Human
gagugucuuaauuaaaaga

SEQ ID NO: 2985651 - RNA, 17 nt, Human
gauacaaaagcauguga

SEQ ID NO: 2985652 - RNA, 17 nt, Human
gauagcacagacccugc

SEQ ID NO: 2985653 - RNA, 18 nt, Human
gauagcacagacccugcc

SEQ ID NO: 2985654 - RNA, 18 nt, Human
gauacaaugcugugcccu

SEQ ID NO: 2985655 - RNA, 13 nt, Human
gauacaaugcugu

SEQ ID NO: 2985656 - RNA, 16 nt, Human
gauagcacagacccug

SEQ ID NO: 2985657 - RNA, 12 nt, Human
gauagccaaggc

SEQ ID NO: 2985658 - RNA, 19 nt, Human
gauagcacagacccugccc

SEQ ID NO: 2985659 - RNA, 13 nt, Human
gauagcagggcau

SEQ ID NO: 2985660 - RNA, 13 nt, Human
gauagccaaggcc

SEQ ID NO: 2985661 - RNA, 22 nt, Human
gaucaaccccuucgcuccugug

SEQ ID NO: 2985662 - RNA, 21 nt, Human
gaucaaccccuucgcuccugu

SEQ ID NO: 2985663 - RNA, 23 nt, Human
gauauaugcucugcauguuacau

SEQ ID NO: 2985664 - RNA, 14 nt, Human
gagguucccuuuga

SEQ ID NO: 2985665 - RNA, 19 nt, Human
gagguucaaagauauuuug

SEQ ID NO: 2985666 - RNA, 16 nt, Human
gagguuaaaaagaaaa

SEQ ID NO: 2985667 - RNA, 16 nt, Human
gaguacguugugcauu

SEQ ID NO: 2985668 - RNA, 19 nt, Human
gagguuuuaaaaaaauccc

SEQ ID NO: 2985669 - RNA, 20 nt, Human
gaguacguugugcauuuggu

SEQ ID NO: 2985670 - RNA, 15 nt, Human
gaguacuacaguccu

SEQ ID NO: 2985671 - RNA, 18 nt, Human
gaguacguugugcauuug

SEQ ID NO: 2985672 - RNA, 17 nt, Human
gaguacguugugcauuu

SEQ ID NO: 2985673 - RNA, 18 nt, Human
gaguacuacaguccuccc

SEQ ID NO: 2985674 - RNA, 19 nt, Human
gaguacuacaguccuccca

SEQ ID NO: 2985675 - RNA, 21 nt, Human
gaggugggauccuccaggugc

SEQ ID NO: 2985676 - RNA, 22 nt, Human
gaggugggauccuccaggugca

SEQ ID NO: 2985677 - RNA, 18 nt, Human
gaggugggauccuccagg

SEQ ID NO: 2985678 - RNA, 15 nt, Human
gaggggggagguggg

SEQ ID NO: 2985679 - RNA, 15 nt, Human
gaggggguggccucc

SEQ ID NO: 2985680 - RNA, 22 nt, Human
gaggggggaggugggauccucc

SEQ ID NO: 2985681 - RNA, 23 nt, Human
gagucucacuguugcccaggcug

SEQ ID NO: 2985682 - RNA, 22 nt, Human
gagucucacuguugcccaggcu

SEQ ID NO: 2985683 - RNA, 21 nt, Human
gagucugaaggcuggguucug

SEQ ID NO: 2985684 - RNA, 21 nt, Human
gagucucacuguugcccaggc

SEQ ID NO: 2985685 - RNA, 20 nt, Human
gagucucacuguugcccagg

SEQ ID NO: 2985686 - RNA, 19 nt, Human
gagucucacuguugcccag

SEQ ID NO: 2985687 - RNA, 17 nt, Human
gagucgaggacagggag

SEQ ID NO: 2985688 - RNA, 16 nt, Human
gagucgaggacaggga

SEQ ID NO: 2985689 - RNA, 12 nt, Human
gaguccccuguu

SEQ ID NO: 2985690 - RNA, 14 nt, Human
gaguccccuguuug

SEQ ID NO: 2985691 - RNA, 23 nt, Human
gaguccccuguuuguuucugaaa

SEQ ID NO: 2985692 - RNA, 14 nt, Human
gaguagcugggacu

SEQ ID NO: 2985693 - RNA, 12 nt, Human
gaguagcuggga

SEQ ID NO: 2985694 - RNA, 21 nt, Human
gagucccaccuuggcugcagg

SEQ ID NO: 2985695 - RNA, 18 nt, Human
gauugugccuaauguguu

SEQ ID NO: 2985696 - RNA, 13 nt, Human
gauugugccccug

SEQ ID NO: 2985697 - RNA, 20 nt, Human
gauuguccccgacccuugcc

SEQ ID NO: 2985698 - RNA, 15 nt, Human
gauuguccccgaccc

SEQ ID NO: 2985699 - RNA, 20 nt, Human
gauucuauguuaauauuuua

SEQ ID NO: 2985700 - RNA, 17 nt, Human
gauucuauguuaauauu

SEQ ID NO: 2985701 - RNA, 23 nt, Human
gauugacgggacuguugguauug

SEQ ID NO: 2985702 - RNA, 18 nt, Human
gauugcuugagcucagga

SEQ ID NO: 2985703 - RNA, 12 nt, Human
gauucagacagc

SEQ ID NO: 2985704 - RNA, 19 nt, Human
gauucaccuccuaaaacaa

SEQ ID NO: 2985705 - RNA, 22 nt, Human
gauucccaagcucugcuccucu

SEQ ID NO: 2985706 - RNA, 21 nt, Human
gauucccaagcucugcuccuc

SEQ ID NO: 2985707 - RNA, 15 nt, Human
gauucccugauuuaa

SEQ ID NO: 2985708 - RNA, 23 nt, Human
gauggugcaaugaccuuucaaua

SEQ ID NO: 2985709 - RNA, 20 nt, Human
gauggugcaaugaccuuuca

SEQ ID NO: 2985710 - RNA, 18 nt, Human
gaugggccaccgccuugc

SEQ ID NO: 2985711 - RNA, 16 nt, Human
gauguucugggacaca

SEQ ID NO: 2985712 - RNA, 14 nt, Human
gauguucugggaca

SEQ ID NO: 2985713 - RNA, 19 nt, Human
gauuaaauucuugcaaagu

SEQ ID NO: 2985714 - RNA, 12 nt, Human
gauuaaauucuu

SEQ ID NO: 2985715 - RNA, 15 nt, Human
gauguuuuccaugag

SEQ ID NO: 2985716 - RNA, 23 nt, Human
gauguuuuccaugaguccccugu

SEQ ID NO: 2985717 - RNA, 14 nt, Human
gauguuuuccauga

SEQ ID NO: 2985718 - RNA, 21 nt, Human
gauguuuuaaggaugcuugua

SEQ ID NO: 2985719 - RNA, 21 nt, Human
gauguucuuucacccuuuucu

SEQ ID NO: 2985720 - RNA, 19 nt, Human
gauuaaccacuucagcuga

SEQ ID NO: 2985721 - RNA, 21 nt, Human
gauuaaccacuucagcugacu

SEQ ID NO: 2985722 - RNA, 18 nt, Human
gauuaaccacuucagcug

SEQ ID NO: 2985723 - RNA, 19 nt, Human
gauucaacagguuuuccug

SEQ ID NO: 2985724 - RNA, 15 nt, Human
gaugacuguuuuuaa

SEQ ID NO: 2985725 - RNA, 22 nt, Human
gaugagaaagguugaagcacca

SEQ ID NO: 2985726 - RNA, 11 nt, Human
gaugagaaagg

SEQ ID NO: 2985727 - RNA, 18 nt, Human
gaugcaguucugaagaag

SEQ ID NO: 2985728 - RNA, 22 nt, Human
gaugcuagaacucccuuucaac

SEQ ID NO: 2985729 - RNA, 16 nt, Human
gaugggaaagcauugu

SEQ ID NO: 2985730 - RNA, 22 nt, Human
gaugggcaacccccagccugcu

SEQ ID NO: 2985731 - RNA, 13 nt, Human
gaucuuuaaaaua

SEQ ID NO: 2985732 - RNA, 14 nt, Human
gaucuuuaaaauac

SEQ ID NO: 2985733 - RNA, 16 nt, Human
gaucuuugcagacagg

SEQ ID NO: 2985734 - RNA, 15 nt, Human
gaugaaaaaauaaca

SEQ ID NO: 2985735 - RNA, 18 nt, Human
gauccucccaccucagcc

SEQ ID NO: 2985736 - RNA, 19 nt, Human
gaucgagaccauccuggcu

SEQ ID NO: 2985737 - RNA, 16 nt, Human
gaucgagaccauccug

SEQ ID NO: 2985738 - RNA, 13 nt, Human
gauccugagccag

SEQ ID NO: 2985739 - RNA, 14 nt, Human
gauccugagccaga

SEQ ID NO: 2985740 - RNA, 15 nt, Human
gauccugagccagau

SEQ ID NO: 2985741 - RNA, 19 nt, Human
gauccugagccagauuuca

SEQ ID NO: 2985742 - RNA, 20 nt, Human
gauccucccaccucagccuc

SEQ ID NO: 2985743 - RNA, 12 nt, Human
gauccuccaggu

SEQ ID NO: 2985744 - RNA, 19 nt, Human
gauccucccaccucagccu

SEQ ID NO: 2985745 - RNA, 11 nt, Human
gauccuccagg

SEQ ID NO: 2985746 - RNA, 18 nt, Human
gauccuaggcauuugcug

SEQ ID NO: 2985747 - RNA, 18 nt, Human
gauccuaguuccaccauc

SEQ ID NO: 2985748 - RNA, 15 nt, Human
gaucacgccacugca

SEQ ID NO: 2985749 - RNA, 14 nt, Human
gaucacgccacugc

SEQ ID NO: 2985750 - RNA, 13 nt, Human
gaucacgccacug

SEQ ID NO: 2985751 - RNA, 23 nt, Human
gaucaaccccuucgcuccugugu

SEQ ID NO: 2985752 - RNA, 15 nt, Human
gaucacgaggucagg

SEQ ID NO: 2985753 - RNA, 19 nt, Human
gaggcagagguugcaguga

SEQ ID NO: 2985754 - RNA, 13 nt, Human
gaggcagccccau

SEQ ID NO: 2985755 - RNA, 22 nt, Human
gaggcagccccauucugccugc

SEQ ID NO: 2985756 - RNA, 21 nt, Human
gaggcagccccauucugccug

SEQ ID NO: 2985757 - RNA, 16 nt, Human
gaggcaggagacuggc

SEQ ID NO: 2985758 - RNA, 23 nt, Human
gaggcagccccauucugccugcc

SEQ ID NO: 2985759 - RNA, 13 nt, Human
gaggccagccuug

SEQ ID NO: 2985760 - RNA, 12 nt, Human
gaggccagccuu

SEQ ID NO: 2985761 - RNA, 23 nt, Human
gaggaguuugggguaugggagag

SEQ ID NO: 2985762 - RNA, 12 nt, Human
gaggauguucug

SEQ ID NO: 2985763 - RNA, 20 nt, Human
gaggauguucugggacacag

SEQ ID NO: 2985764 - RNA, 17 nt, Human
gaggauguucugggaca

SEQ ID NO: 2985765 - RNA, 16 nt, Human
gaggauugcuugagcu

SEQ ID NO: 2985766 - RNA, 15 nt, Human
gaggaauccagaccc

SEQ ID NO: 2985767 - RNA, 22 nt, Human
gaggaaggaaacccagcucugg

SEQ ID NO: 2985768 - RNA, 14 nt, Human
gaggaauccagacc

SEQ ID NO: 2985769 - RNA, 23 nt, Human
gaggacagggaggugaccccagg

SEQ ID NO: 2985770 - RNA, 22 nt, Human
gaggacagggaggugaccccag

SEQ ID NO: 2985771 - RNA, 13 nt, Human
gaggacagggagg

SEQ ID NO: 2985772 - RNA, 14 nt, Human
gaggcccuucucuc

SEQ ID NO: 2985773 - RNA, 23 nt, Human
gaggcccuucucuccagccccug

SEQ ID NO: 2985774 - RNA, 24 nt, Human
gaggcccuucucuccagccccugg

SEQ ID NO: 2985775 - RNA, 22 nt, Human
gaggcccuucucuccagccccu

SEQ ID NO: 2985776 - RNA, 14 nt, Human
gaggccuucucuga

SEQ ID NO: 2985777 - RNA, 13 nt, Human
gaggcugggcucc

SEQ ID NO: 2985778 - RNA, 14 nt, Human
gaggcugggcuccc

SEQ ID NO: 2985779 - RNA, 15 nt, Human
gaggcugggcucccu

SEQ ID NO: 2985780 - RNA, 15 nt, Human
gagggagggagggcu

SEQ ID NO: 2985781 - RNA, 15 nt, Human
gagggagggcuccag

SEQ ID NO: 2985782 - RNA, 14 nt, Human
gagggagggagggc

SEQ ID NO: 2985783 - RNA, 14 nt, Human
gagggagugacaga

SEQ ID NO: 2985784 - RNA, 14 nt, Human
gagggagguaagga

SEQ ID NO: 2985785 - RNA, 13 nt, Human
gagggagugacag

SEQ ID NO: 2985786 - RNA, 14 nt, Human
gagggcacagaaaa

SEQ ID NO: 2985787 - RNA, 22 nt, Human
gagggcacagaaaauggaagac

SEQ ID NO: 2985788 - RNA, 23 nt, Human
gagggcacagaaaauggaagaca

SEQ ID NO: 2985789 - RNA, 22 nt, Human
gaggggccucuuaugggcuggg

SEQ ID NO: 2985790 - RNA, 12 nt, Human
gaggggccucuu

SEQ ID NO: 2985791 - RNA, 15 nt, Human
gagcugccaccugcc

SEQ ID NO: 2985792 - RNA, 16 nt, Human
gagcugccaccugccu

SEQ ID NO: 2985793 - RNA, 14 nt, Human
gagcugcccucucc

SEQ ID NO: 2985794 - RNA, 13 nt, Human
gagcugccaccug

SEQ ID NO: 2985795 - RNA, 16 nt, Human
gagcugcccucuccug

SEQ ID NO: 2985796 - RNA, 15 nt, Human
gagcugcccucuccu

SEQ ID NO: 2985797 - RNA, 14 nt, Human
gagcuacaaaugca

SEQ ID NO: 2985798 - RNA, 23 nt, Human
gagcuacacaggggaaaagagga

SEQ ID NO: 2985799 - RNA, 12 nt, Human
gagcuacaaaug

SEQ ID NO: 2985800 - RNA, 13 nt, Human
gagcuacaaaugc

SEQ ID NO: 2985801 - RNA, 13 nt, Human
gagccugggaggu

SEQ ID NO: 2985802 - RNA, 21 nt, Human
gagccugggaggucaaggcug

SEQ ID NO: 2985803 - RNA, 10 nt, Human
gagccuggca

SEQ ID NO: 2985804 - RNA, 15 nt, Human
gagccuggcaagaau

SEQ ID NO: 2985805 - RNA, 20 nt, Human
gagccuccugcccuuaccug

SEQ ID NO: 2985806 - RNA, 22 nt, Human
gagccuccugcccuuaccugcc

SEQ ID NO: 2985807 - RNA, 17 nt, Human
gagcccugguggcagug

SEQ ID NO: 2985808 - RNA, 19 nt, Human
gagccucagcauccuggca

SEQ ID NO: 2985809 - RNA, 16 nt, Human
gagcccugguggcagu

SEQ ID NO: 2985810 - RNA, 15 nt, Human
gagcccugguggcag

SEQ ID NO: 2985811 - RNA, 14 nt, Human
gagccuccugcccu

SEQ ID NO: 2985812 - RNA, 21 nt, Human
gagccucagcauccuggcacc

SEQ ID NO: 2985813 - RNA, 20 nt, Human
gagccucagcauccuggcac

SEQ ID NO: 2985814 - RNA, 15 nt, Human
gagcacacuggcuca

SEQ ID NO: 2985815 - RNA, 17 nt, Human
gagcaccuuagacaguc

SEQ ID NO: 2985816 - RNA, 21 nt, Human
gagcaagacgcugugcugccc

SEQ ID NO: 2985817 - RNA, 18 nt, Human
gagcaagacgcugugcug

SEQ ID NO: 2985818 - RNA, 22 nt, Human
gagcaagacgcugugcugcccu

SEQ ID NO: 2985819 - RNA, 23 nt, Human
gagcaagacgcugugcugcccug

SEQ ID NO: 2985820 - RNA, 19 nt, Human
gagcaaaaucgaugcagug

SEQ ID NO: 2985821 - RNA, 20 nt, Human
gagaucaaccccuucgcucc

SEQ ID NO: 2985822 - RNA, 14 nt, Human
gagaucagccuggg

SEQ ID NO: 2985823 - RNA, 16 nt, Human
gagaucagccugggca

SEQ ID NO: 2985824 - RNA, 13 nt, Human
gagaucagccugg

SEQ ID NO: 2985825 - RNA, 13 nt, Human
gagauccuggacu

SEQ ID NO: 2985826 - RNA, 14 nt, Human
gagaucgagaccau

SEQ ID NO: 2985827 - RNA, 21 nt, Human
gagcaggcuacugucagcucc

SEQ ID NO: 2985828 - RNA, 18 nt, Human
gagcagccacauuccuga

SEQ ID NO: 2985829 - RNA, 12 nt, Human
gagcccacgccc

SEQ ID NO: 2985830 - RNA, 15 nt, Human
gagcccacgccccca

SEQ ID NO: 2985831 - RNA, 16 nt, Human
gagcccacgcccccac

SEQ ID NO: 2985832 - RNA, 12 nt, Human
gagcccaggccu

SEQ ID NO: 2985833 - RNA, 13 nt, Human
gagcccaggccuc

SEQ ID NO: 2985834 - RNA, 14 nt, Human
gagcccaggccucc

SEQ ID NO: 2985835 - RNA, 11 nt, Human
gagcccacgcc

SEQ ID NO: 2985836 - RNA, 22 nt, Human
gagccauuugucccaagugcca

SEQ ID NO: 2985837 - RNA, 20 nt, Human
gagccauuugucccaagugc

SEQ ID NO: 2985838 - RNA, 19 nt, Human
gagccauuugucccaagug

SEQ ID NO: 2985839 - RNA, 18 nt, Human
gagccauuugucccaagu

SEQ ID NO: 2985840 - RNA, 23 nt, Human
gagccauuugucccaagugccaa

SEQ ID NO: 2985841 - RNA, 17 nt, Human
gagccauuugucccaag

SEQ ID NO: 2985842 - RNA, 16 nt, Human
gagccauuugucccaa

SEQ ID NO: 2985843 - RNA, 15 nt, Human
gagccauuuguccca

SEQ ID NO: 2985844 - RNA, 22 nt, Human
gagccacugcaccgggccacag

SEQ ID NO: 2985845 - RNA, 23 nt, Human
cugacgacuugagugcucaguag

SEQ ID NO: 2985846 - RNA, 18 nt, Human
cugacagacacaggcccg

SEQ ID NO: 2985847 - RNA, 17 nt, Human
cugacagacacaggccc

SEQ ID NO: 2985848 - RNA, 15 nt, Human
cugacagacacaggc

SEQ ID NO: 2985849 - RNA, 14 nt, Human
cugaauuucuuuug

SEQ ID NO: 2985850 - RNA, 16 nt, Human
cugaauuaugaaacuu

SEQ ID NO: 2985851 - RNA, 16 nt, Human
cugacagacacaggcc

SEQ ID NO: 2985852 - RNA, 12 nt, Human
cugagaaagacu

SEQ ID NO: 2985853 - RNA, 13 nt, Human
cugagaaagacua

SEQ ID NO: 2985854 - RNA, 15 nt, Human
cugagaaagacuauu

SEQ ID NO: 2985855 - RNA, 18 nt, Human
cugagaaagacuauucaa

SEQ ID NO: 2985856 - RNA, 21 nt, Human
cugagacagcccgggcucugc

SEQ ID NO: 2985857 - RNA, 22 nt, Human
cugagacagcccgggcucugcc

SEQ ID NO: 2985858 - RNA, 16 nt, Human
cugagaugugaacaca

SEQ ID NO: 2985859 - RNA, 20 nt, Human
cugagaugugaacacaucag

SEQ ID NO: 2985860 - RNA, 20 nt, Human
cugagacagcccgggcucug

SEQ ID NO: 2985861 - RNA, 19 nt, Human
cugagacagcccgggcucu

SEQ ID NO: 2985862 - RNA, 19 nt, Human
cugagaaagacuauucaaa

SEQ ID NO: 2985863 - RNA, 20 nt, Human
cugagaaagacuauucaaac

SEQ ID NO: 2985864 - RNA, 21 nt, Human
cugagaugugaacacaucagc

SEQ ID NO: 2985865 - RNA, 16 nt, Human
cugagcaggauuuuaa

SEQ ID NO: 2985866 - RNA, 13 nt, Human
cugagccagauuu

SEQ ID NO: 2985867 - RNA, 14 nt, Human
cugagccagauuuc

SEQ ID NO: 2985868 - RNA, 19 nt, Human
cugagcauaaguccucuag

SEQ ID NO: 2985869 - RNA, 17 nt, Human
cugaacaucacagcuua

SEQ ID NO: 2985870 - RNA, 19 nt, Human
cugaaaugucaguucugau

SEQ ID NO: 2985871 - RNA, 18 nt, Human
cugaaaugucaguucuga

SEQ ID NO: 2985872 - RNA, 20 nt, Human
cugaaaugucaguucugaua

SEQ ID NO: 2985873 - RNA, 13 nt, Human
cugaaaugucagu

SEQ ID NO: 2985874 - RNA, 20 nt, Human
cugaaauaaacgucuuaaau

SEQ ID NO: 2985875 - RNA, 21 nt, Human
cugaacaaacuaucagaggaa

SEQ ID NO: 2985876 - RNA, 23 nt, Human
cugaaagggacgcuacccgggaa

SEQ ID NO: 2985877 - RNA, 14 nt, Human
cucuuuucaaaaca

SEQ ID NO: 2985878 - RNA, 22 nt, Human
cucuuuggucuacacugugcug

SEQ ID NO: 2985879 - RNA, 23 nt, Human
cucuuuggucuacacugugcuga

SEQ ID NO: 2985880 - RNA, 16 nt, Human
cucuucuccaggcugu

SEQ ID NO: 2985881 - RNA, 13 nt, Human
cugaauuaugaaa

SEQ ID NO: 2985882 - RNA, 15 nt, Human
cugaauuaugaaacu

SEQ ID NO: 2985883 - RNA, 14 nt, Human
cugaauuaugaaac

SEQ ID NO: 2985884 - RNA, 12 nt, Human
cugaauuucuuu

SEQ ID NO: 2985885 - RNA, 20 nt, Human
cugaaugguuuucaaaauaa

SEQ ID NO: 2985886 - RNA, 19 nt, Human
cugaaugguuuucaaaaua

SEQ ID NO: 2985887 - RNA, 18 nt, Human
cugaauggacuuugcaca

SEQ ID NO: 2985888 - RNA, 17 nt, Human
cugaagucacacaguga

SEQ ID NO: 2985889 - RNA, 19 nt, Human
cugaagucacacagugagu

SEQ ID NO: 2985890 - RNA, 18 nt, Human
cugaagucacacagugag

SEQ ID NO: 2985891 - RNA, 21 nt, Human
cugaagucacacagugagucg

SEQ ID NO: 2985892 - RNA, 16 nt, Human
cugaagucacacagug

SEQ ID NO: 2985893 - RNA, 22 nt, Human
cugaagucccagauacuugggg

SEQ ID NO: 2985894 - RNA, 17 nt, Human
cugaagucuuuguacag

SEQ ID NO: 2985895 - RNA, 20 nt, Human
cugaagucuuuguacagaca

SEQ ID NO: 2985896 - RNA, 17 nt, Human
cugaaguucagcugcau

SEQ ID NO: 2985897 - RNA, 13 nt, Human
cucugcccacucc

SEQ ID NO: 2985898 - RNA, 15 nt, Human
cucugcccacucccu

SEQ ID NO: 2985899 - RNA, 16 nt, Human
cucugcccacucccug

SEQ ID NO: 2985900 - RNA, 17 nt, Human
cucugcccacucccugc

SEQ ID NO: 2985901 - RNA, 18 nt, Human
cucugcccacucccugca

SEQ ID NO: 2985902 - RNA, 20 nt, Human
cucugcccacucccugcaac

SEQ ID NO: 2985903 - RNA, 13 nt, Human
cucugccucccau

SEQ ID NO: 2985904 - RNA, 14 nt, Human
cucugccucccauc

SEQ ID NO: 2985905 - RNA, 16 nt, Human
cucugccucccaucac

SEQ ID NO: 2985906 - RNA, 17 nt, Human
cucugccucccaucacc

SEQ ID NO: 2985907 - RNA, 12 nt, Human
cucugcccuugg

SEQ ID NO: 2985908 - RNA, 14 nt, Human
cucugcacaagcug

SEQ ID NO: 2985909 - RNA, 15 nt, Human
cucugcacaagcugc

SEQ ID NO: 2985910 - RNA, 10 nt, Human
cucugcacaa

SEQ ID NO: 2985911 - RNA, 13 nt, Human
cucugcacaagcu

SEQ ID NO: 2985912 - RNA, 15 nt, Human
cucugauacagaaaa

SEQ ID NO: 2985913 - RNA, 14 nt, Human
cucugaggacacua

SEQ ID NO: 2985914 - RNA, 12 nt, Human
cucugaggacac

SEQ ID NO: 2985915 - RNA, 16 nt, Human
cucugaggacacuaac

SEQ ID NO: 2985916 - RNA, 20 nt, Human
cucugagacucgcgacaaug

SEQ ID NO: 2985917 - RNA, 23 nt, Human
cucugagacucgcgacaaugcaa

SEQ ID NO: 2985918 - RNA, 21 nt, Human
cucugagacucgcgacaaugc

SEQ ID NO: 2985919 - RNA, 23 nt, Human
cucugacagaagaaccccagggu

SEQ ID NO: 2985920 - RNA, 19 nt, Human
cucugacacacagcucugu

SEQ ID NO: 2985921 - RNA, 18 nt, Human
cucugacacacagcucug

SEQ ID NO: 2985922 - RNA, 17 nt, Human
cucugacacacagcucu

SEQ ID NO: 2985923 - RNA, 16 nt, Human
cucugacacacagcuc

SEQ ID NO: 2985924 - RNA, 15 nt, Human
cucugacacacagcu

SEQ ID NO: 2985925 - RNA, 14 nt, Human
cucugacacacagc

SEQ ID NO: 2985926 - RNA, 19 nt, Human
cucugaaggguaauuauau

SEQ ID NO: 2985927 - RNA, 22 nt, Human
cucugaaggacauugcggacag

SEQ ID NO: 2985928 - RNA, 13 nt, Human
cucuucuccaggc

SEQ ID NO: 2985929 - RNA, 15 nt, Human
cucuucuccaggcug

SEQ ID NO: 2985930 - RNA, 23 nt, Human
cucugugucagguggggcagcuu

SEQ ID NO: 2985931 - RNA, 22 nt, Human
cucugugucagguggggcagcu

SEQ ID NO: 2985932 - RNA, 21 nt, Human
cucugugucagguggggcagc

SEQ ID NO: 2985933 - RNA, 20 nt, Human
cucugugucagguggggcag

SEQ ID NO: 2985934 - RNA, 19 nt, Human
cucugugucagguggggca

SEQ ID NO: 2985935 - RNA, 13 nt, Human
cucuuaagaagac

SEQ ID NO: 2985936 - RNA, 19 nt, Human
cucuuaagaagacugcauu

SEQ ID NO: 2985937 - RNA, 22 nt, Human
cucuggccuucggccuccaucc

SEQ ID NO: 2985938 - RNA, 21 nt, Human
cucuggccuucggccuccauc

SEQ ID NO: 2985939 - RNA, 23 nt, Human
cucuggcagcucagagagggugg

SEQ ID NO: 2985940 - RNA, 20 nt, Human
cucuggcagcucagagaggg

SEQ ID NO: 2985941 - RNA, 20 nt, Human
cucugccucugacacacagc

SEQ ID NO: 2985942 - RNA, 19 nt, Human
cucugccucugacacacag

SEQ ID NO: 2985943 - RNA, 21 nt, Human
cucugccucccaucacccgcu

SEQ ID NO: 2985944 - RNA, 16 nt, Human
cucugccucugacaca

SEQ ID NO: 2985945 - RNA, 13 nt, Human
cucugucgcccag

SEQ ID NO: 2985946 - RNA, 17 nt, Human
cucugucgcccagucug

SEQ ID NO: 2985947 - RNA, 19 nt, Human
cucugucgcccagucugga

SEQ ID NO: 2985948 - RNA, 18 nt, Human
cucugucgcccagucugg

SEQ ID NO: 2985949 - RNA, 22 nt, Human
cucuguccugggagugagcugg

SEQ ID NO: 2985950 - RNA, 15 nt, Human
cucuguccugggagu

SEQ ID NO: 2985951 - RNA, 13 nt, Human
cucuguccuggga

SEQ ID NO: 2985952 - RNA, 14 nt, Human
cucuguccugggag

SEQ ID NO: 2985953 - RNA, 22 nt, Human
cugauuuaaacacauuaaaggu

SEQ ID NO: 2985954 - RNA, 16 nt, Human
cugauuuaauaugcaa

SEQ ID NO: 2985955 - RNA, 21 nt, Human
cugauugugucucuugguccu

SEQ ID NO: 2985956 - RNA, 17 nt, Human
cugauggugcaaugacc

SEQ ID NO: 2985957 - RNA, 19 nt, Human
cugauggugcaaugaccuu

SEQ ID NO: 2985958 - RNA, 20 nt, Human
cugauggugcaaugaccuuu

SEQ ID NO: 2985959 - RNA, 21 nt, Human
cugauggugcaaugaccuuuc

SEQ ID NO: 2985960 - RNA, 17 nt, Human
cugauugugucucuugg

SEQ ID NO: 2985961 - RNA, 16 nt, Human
cugauuuuuuuuuccu

SEQ ID NO: 2985962 - RNA, 18 nt, Human
cugauuuuuuuuuccuuc

SEQ ID NO: 2985963 - RNA, 19 nt, Human
cugauuuuuuuuuccuuca

SEQ ID NO: 2985964 - RNA, 20 nt, Human
cugauuuuuuuuuccuucag

SEQ ID NO: 2985965 - RNA, 21 nt, Human
cugauuuuuuuuuccuucagu

SEQ ID NO: 2985966 - RNA, 22 nt, Human
cugauuuuuuuuuccuucagug

SEQ ID NO: 2985967 - RNA, 23 nt, Human
cugauuuuuuuuuccuucagugc

SEQ ID NO: 2985968 - RNA, 15 nt, Human
cugcaauaaaauggg

SEQ ID NO: 2985969 - RNA, 18 nt, Human
cugcaauaaggggagagu

SEQ ID NO: 2985970 - RNA, 22 nt, Human
cugcaauaaaauggguuuuacu

SEQ ID NO: 2985971 - RNA, 22 nt, Human
cugcacaagcugcacccucagg

SEQ ID NO: 2985972 - RNA, 18 nt, Human
cugcacaagcugcacccu

SEQ ID NO: 2985973 - RNA, 18 nt, Human
cugcacagcaggcugcca

SEQ ID NO: 2985974 - RNA, 19 nt, Human
cugcacagcaggcugccag

SEQ ID NO: 2985975 - RNA, 16 nt, Human
cugcacuccccugcug

SEQ ID NO: 2985976 - RNA, 17 nt, Human
cugcacuccccugcugg

SEQ ID NO: 2985977 - RNA, 18 nt, Human
cugcacuugcagacucua

SEQ ID NO: 2985978 - RNA, 13 nt, Human
cugcacccucagg

SEQ ID NO: 2985979 - RNA, 14 nt, Human
cugcacccucaggc

SEQ ID NO: 2985980 - RNA, 20 nt, Human
cugcaccggcuggccuggcc

SEQ ID NO: 2985981 - RNA, 22 nt, Human
cugcaccggcuggccuggcccc

SEQ ID NO: 2985982 - RNA, 14 nt, Human
cugcacuccccugc

SEQ ID NO: 2985983 - RNA, 15 nt, Human
cugcacuccccugcu

SEQ ID NO: 2985984 - RNA, 23 nt, Human
cugcaccggcuggccuggccccu

SEQ ID NO: 2985985 - RNA, 12 nt, Human
cugcaccgggcc

SEQ ID NO: 2985986 - RNA, 21 nt, Human
cugaggcuccacuuggucugu

SEQ ID NO: 2985987 - RNA, 15 nt, Human
cugaggcuccacuug

SEQ ID NO: 2985988 - RNA, 24 nt, Human
cugaggcccuucucuccagccccu

SEQ ID NO: 2985989 - RNA, 15 nt, Human
cugaggcugggcucc

SEQ ID NO: 2985990 - RNA, 16 nt, Human
cugaggcugggcuccc

SEQ ID NO: 2985991 - RNA, 17 nt, Human
cugaggcugggcucccu

SEQ ID NO: 2985992 - RNA, 22 nt, Human
cugaggcugggcucccuuccca

SEQ ID NO: 2985993 - RNA, 13 nt, Human
cugaggcugggcu

SEQ ID NO: 2985994 - RNA, 17 nt, Human
cugaguguacagagugg

SEQ ID NO: 2985995 - RNA, 18 nt, Human
cugagucugaaggcuggg

SEQ ID NO: 2985996 - RNA, 19 nt, Human
cugagucugaaggcugggu

SEQ ID NO: 2985997 - RNA, 17 nt, Human
cugagucugaaggcugg

SEQ ID NO: 2985998 - RNA, 21 nt, Human
cugauaaagaugagugagcau

SEQ ID NO: 2985999 - RNA, 20 nt, Human
cugauccuaguuccaccauc

SEQ ID NO: 2986000 - RNA, 21 nt, Human
cugauccuaguuccaccauca

SEQ ID NO: 2986001 - RNA, 15 nt, Human
cugauggugcaauga

SEQ ID NO: 2986002 - RNA, 16 nt, Human
cugauggugcaaugac

SEQ ID NO: 2986003 - RNA, 14 nt, Human
cugauggugcaaug

SEQ ID NO: 2986004 - RNA, 16 nt, Human
cugauauggaagcacc

SEQ ID NO: 2986005 - RNA, 22 nt, Human
cugauacagaaaaguugaauuu

SEQ ID NO: 2986006 - RNA, 21 nt, Human
cugcaguugccagucaccccg

SEQ ID NO: 2986007 - RNA, 22 nt, Human
cugcaguugccagucaccccgg

SEQ ID NO: 2986008 - RNA, 17 nt, Human
cugcaguugccagucac

SEQ ID NO: 2986009 - RNA, 20 nt, Human
cugcaucagcugcugaaaca

SEQ ID NO: 2986010 - RNA, 19 nt, Human
cugcaguugccagucaccc

SEQ ID NO: 2986011 - RNA, 23 nt, Human
cugcacuugcagacucuacagag

SEQ ID NO: 2986012 - RNA, 16 nt, Human
cugcaucguuucaucu

SEQ ID NO: 2986013 - RNA, 22 nt, Human
cugcaucguuucaucuuccaac

SEQ ID NO: 2986014 - RNA, 18 nt, Human
cugccaaugggagcucau

SEQ ID NO: 2986015 - RNA, 19 nt, Human
cugccaaugggagcucaug

SEQ ID NO: 2986016 - RNA, 18 nt, Human
cugcaugcgggcuuccuc

SEQ ID NO: 2986017 - RNA, 22 nt, Human
cugcaugcgggcuuccuccugg

SEQ ID NO: 2986018 - RNA, 17 nt, Human
cugcccaccuggccucu

SEQ ID NO: 2986019 - RNA, 18 nt, Human
cugcccaccuggccucug

SEQ ID NO: 2986020 - RNA, 19 nt, Human
cugcccaccuggccucugc

SEQ ID NO: 2986021 - RNA, 20 nt, Human
cugcccaccuggccucugca

SEQ ID NO: 2986022 - RNA, 22 nt, Human
cugcccaccuggccucugcacu

SEQ ID NO: 2986023 - RNA, 14 nt, Human
cugcccacucccug

SEQ ID NO: 2986024 - RNA, 15 nt, Human
cugcccacucccugc

SEQ ID NO: 2986025 - RNA, 16 nt, Human
cugcccacucccugca

SEQ ID NO: 2986026 - RNA, 18 nt, Human
cugcccacucccugcaac

SEQ ID NO: 2986027 - RNA, 14 nt, Human
cugcccaccuggcc

SEQ ID NO: 2986028 - RNA, 15 nt, Human
cugcccaccuggccu

SEQ ID NO: 2986029 - RNA, 13 nt, Human
cugcccaccuggc

SEQ ID NO: 2986030 - RNA, 14 nt, Human
cugccaugccagcu

SEQ ID NO: 2986031 - RNA, 11 nt, Human
cugccaggcau

SEQ ID NO: 2986032 - RNA, 13 nt, Human
cugccaggcaugg

SEQ ID NO: 2986033 - RNA, 15 nt, Human
cugccucagccuccc

SEQ ID NO: 2986034 - RNA, 19 nt, Human
cugccucagccucccaaag

SEQ ID NO: 2986035 - RNA, 19 nt, Human
cugccgcagcccugcagag

SEQ ID NO: 2986036 - RNA, 20 nt, Human
cugccgcagcccugcagagg

SEQ ID NO: 2986037 - RNA, 21 nt, Human
cugccgcagcccugcagaggg

SEQ ID NO: 2986038 - RNA, 22 nt, Human
cugccgcagcccugcagagggc

SEQ ID NO: 2986039 - RNA, 23 nt, Human
cugccgcagcccugcagagggca

SEQ ID NO: 2986040 - RNA, 12 nt, Human
cugccgcagccc

SEQ ID NO: 2986041 - RNA, 13 nt, Human
cugccgcagcccu

SEQ ID NO: 2986042 - RNA, 19 nt, Human
cugccccugcacagcaggc

SEQ ID NO: 2986043 - RNA, 15 nt, Human
cugccccugcacagc

SEQ ID NO: 2986044 - RNA, 14 nt, Human
cugccccugcacag

SEQ ID NO: 2986045 - RNA, 21 nt, Human
cugccucugacacacagcucu

SEQ ID NO: 2986046 - RNA, 18 nt, Human
cugccucugacacacagc

SEQ ID NO: 2986047 - RNA, 15 nt, Human
cugccucugacacac

SEQ ID NO: 2986048 - RNA, 17 nt, Human
cugccucugacacacag

SEQ ID NO: 2986049 - RNA, 22 nt, Human
cugccugcccaggccccugcca

SEQ ID NO: 2986050 - RNA, 21 nt, Human
cugccugcccaggccccugcc

SEQ ID NO: 2986051 - RNA, 18 nt, Human
cugcgguccacccaggag

SEQ ID NO: 2986052 - RNA, 17 nt, Human
cugcgguccacccagga

SEQ ID NO: 2986053 - RNA, 20 nt, Human
cugcgguccacccaggagcc

SEQ ID NO: 2986054 - RNA, 19 nt, Human
cugcgguccacccaggagc

SEQ ID NO: 2986055 - RNA, 20 nt, Human
cugcggagcacacuggcuca

SEQ ID NO: 2986056 - RNA, 19 nt, Human
cugcggagcacacuggcuc

SEQ ID NO: 2986057 - RNA, 13 nt, Human
cucagcagagugc

SEQ ID NO: 2986058 - RNA, 12 nt, Human
cucagcagagug

SEQ ID NO: 2986059 - RNA, 11 nt, Human
cucagcagagu

SEQ ID NO: 2986060 - RNA, 16 nt, Human
cucagcagagugcuuu

SEQ ID NO: 2986061 - RNA, 17 nt, Human
cucagcauccuggcacc

SEQ ID NO: 2986062 - RNA, 16 nt, Human
cucagcauccuggcac

SEQ ID NO: 2986063 - RNA, 21 nt, Human
cucagcaaaagaugcuucuca

SEQ ID NO: 2986064 - RNA, 15 nt, Human
cucagaucuucugug

SEQ ID NO: 2986065 - RNA, 14 nt, Human
cucagagagggugg

SEQ ID NO: 2986066 - RNA, 22 nt, Human
cucacuguugcccaggcuggcg

SEQ ID NO: 2986067 - RNA, 21 nt, Human
cucacuguugcccaggcuggc

SEQ ID NO: 2986068 - RNA, 19 nt, Human
cucacugccaugccagcuu

SEQ ID NO: 2986069 - RNA, 22 nt, Human
cucacugccaugccagcuuauc

SEQ ID NO: 2986070 - RNA, 20 nt, Human
cucacuguugcccaggcugg

SEQ ID NO: 2986071 - RNA, 21 nt, Human
cucacucugucgcccagucug

SEQ ID NO: 2986072 - RNA, 13 nt, Human
cucacucugucgc

SEQ ID NO: 2986073 - RNA, 22 nt, Human
cucacucugucgcccagucugg

SEQ ID NO: 2986074 - RNA, 12 nt, Human
cucacugcagcc

SEQ ID NO: 2986075 - RNA, 13 nt, Human
cucacugcagccu

SEQ ID NO: 2986076 - RNA, 13 nt, Human
cucacuccuugaa

SEQ ID NO: 2986077 - RNA, 12 nt, Human
cucacucugucg

SEQ ID NO: 2986078 - RNA, 11 nt, Human
cucacucuguc

SEQ ID NO: 2986079 - RNA, 20 nt, Human
cucacuauguugcccaggca

SEQ ID NO: 2986080 - RNA, 19 nt, Human
cucacuauguugcccaggc

SEQ ID NO: 2986081 - RNA, 15 nt, Human
cucacccaguccugc

SEQ ID NO: 2986082 - RNA, 15 nt, Human
cucaccccagcccca

SEQ ID NO: 2986083 - RNA, 12 nt, Human
cucacccagucc

SEQ ID NO: 2986084 - RNA, 13 nt, Human
cucacccacacca

SEQ ID NO: 2986085 - RNA, 22 nt, Human
cucacuauguugcccaggcagg

SEQ ID NO: 2986086 - RNA, 21 nt, Human
cucacuauguugcccaggcag

SEQ ID NO: 2986087 - RNA, 23 nt, Human
cucacuauguugcccaggcaggu

SEQ ID NO: 2986088 - RNA, 15 nt, Human
cucaagucuggcaga

SEQ ID NO: 2986089 - RNA, 17 nt, Human
cucaagugauucuccug

SEQ ID NO: 2986090 - RNA, 14 nt, Human
cucaaguccucuuu

SEQ ID NO: 2986091 - RNA, 21 nt, Human
cucaaguccucuuuucugaga

SEQ ID NO: 2986092 - RNA, 22 nt, Human
cucacacaugagcaucaggcca

SEQ ID NO: 2986093 - RNA, 24 nt, Human
cucacacaugagcaucaggccagg

SEQ ID NO: 2986094 - RNA, 15 nt, Human
cucacaguccuuacc

SEQ ID NO: 2986095 - RNA, 19 nt, Human
cucacagcagugagacugg

SEQ ID NO: 2986096 - RNA, 17 nt, Human
cucacaguccuuaccag

SEQ ID NO: 2986097 - RNA, 19 nt, Human
cucacaguccuuaccagca

SEQ ID NO: 2986098 - RNA, 22 nt, Human
cucacaguccuuaccagcagag

SEQ ID NO: 2986099 - RNA, 13 nt, Human
cucacauuuauau

SEQ ID NO: 2986100 - RNA, 22 nt, Human
cucacauuuauucugcucacau

SEQ ID NO: 2986101 - RNA, 19 nt, Human
cucacauuuauucugcuca

SEQ ID NO: 2986102 - RNA, 15 nt, Human
cucacauuuauucug

SEQ ID NO: 2986103 - RNA, 18 nt, Human
cucaccagccccagugcc

SEQ ID NO: 2986104 - RNA, 17 nt, Human
cucaccagccccagugc

SEQ ID NO: 2986105 - RNA, 15 nt, Human
cucaccagccccagu

SEQ ID NO: 2986106 - RNA, 14 nt, Human
cucaccagccccag

SEQ ID NO: 2986107 - RNA, 13 nt, Human
cucaccagcccca

SEQ ID NO: 2986108 - RNA, 23 nt, Human
cucaaauacgugggcauucaaau

SEQ ID NO: 2986109 - RNA, 17 nt, Human
cucaaccuccugggcua

SEQ ID NO: 2986110 - RNA, 15 nt, Human
cucaaccuccugggc

SEQ ID NO: 2986111 - RNA, 13 nt, Human
cucaaccuccugg

SEQ ID NO: 2986112 - RNA, 21 nt, Human
cucaacaccucugcacaagcu

SEQ ID NO: 2986113 - RNA, 13 nt, Human
cuauuccugagag

SEQ ID NO: 2986114 - RNA, 17 nt, Human
cuauuccugagagcugc

SEQ ID NO: 2986115 - RNA, 22 nt, Human
cuaugcuguucacuggacacuu

SEQ ID NO: 2986116 - RNA, 22 nt, Human
cuaugggguaaaagggguaggg

SEQ ID NO: 2986117 - RNA, 23 nt, Human
cuaugggacucaaugcacugaca

SEQ ID NO: 2986118 - RNA, 22 nt, Human
cuaugggacucaaugcacugac

SEQ ID NO: 2986119 - RNA, 18 nt, Human
cuaugggacucaaugcac

SEQ ID NO: 2986120 - RNA, 15 nt, Human
cuauuagagaagaga

SEQ ID NO: 2986121 - RNA, 18 nt, Human
cuauucaaacagucucag

SEQ ID NO: 2986122 - RNA, 16 nt, Human
cuauucaaacagucuc

SEQ ID NO: 2986123 - RNA, 23 nt, Human
cuauucaaacagucucaggaaau

SEQ ID NO: 2986124 - RNA, 15 nt, Human
cuauaggugcuacaa

SEQ ID NO: 2986125 - RNA, 21 nt, Human
cuauaggugcuacaaaaacac

SEQ ID NO: 2986126 - RNA, 22 nt, Human
cuauaggugcuacaaaaacaca

SEQ ID NO: 2986127 - RNA, 20 nt, Human
cuauaggugcuacaaaaaca

SEQ ID NO: 2986128 - RNA, 17 nt, Human
cuauagccuaggugaca

SEQ ID NO: 2986129 - RNA, 17 nt, Human
cuauauuuuacauaaau

SEQ ID NO: 2986130 - RNA, 21 nt, Human
cuauaauguaagcucuacuga

SEQ ID NO: 2986131 - RNA, 13 nt, Human
cuauaauuuaaau

SEQ ID NO: 2986132 - RNA, 22 nt, Human
cuauaauuuaccugaagucuuu

SEQ ID NO: 2986133 - RNA, 19 nt, Human
cuauaauuuccauuuacuu

SEQ ID NO: 2986134 - RNA, 16 nt, Human
cuauaauguaagcucu

SEQ ID NO: 2986135 - RNA, 21 nt, Human
cuagugagcagucaggaaaga

SEQ ID NO: 2986136 - RNA, 19 nt, Human
cuagugaauguaggcuggc

SEQ ID NO: 2986137 - RNA, 21 nt, Human
cuagugaauguaggcuggcuu

SEQ ID NO: 2986138 - RNA, 18 nt, Human
cuagugaaagaggcagcu

SEQ ID NO: 2986139 - RNA, 19 nt, Human
cuagugaaagaggcagcuu

SEQ ID NO: 2986140 - RNA, 20 nt, Human
cuagugaaacucguuaauuu

SEQ ID NO: 2986141 - RNA, 16 nt, Human
cuaguaauuggaaagg

SEQ ID NO: 2986142 - RNA, 18 nt, Human
cuaggugacagagugaga

SEQ ID NO: 2986143 - RNA, 14 nt, Human
cuaggugacagagu

SEQ ID NO: 2986144 - RNA, 24 nt, Human
cuaggugacagagugagacucugu

SEQ ID NO: 2986145 - RNA, 15 nt, Human
cuaggugacauauac

SEQ ID NO: 2986146 - RNA, 16 nt, Human
cuaggugacauauaca

SEQ ID NO: 2986147 - RNA, 15 nt, Human
cgccaugcuccuggc

SEQ ID NO: 2986148 - RNA, 20 nt, Human
cgccaucccagccccaauga

SEQ ID NO: 2986149 - RNA, 17 nt, Human
cgccaucccagccccaa

SEQ ID NO: 2986150 - RNA, 22 nt, Human
cgcccaguuggguggaugccug

SEQ ID NO: 2986151 - RNA, 23 nt, Human
cgcccaguuggguggaugccugg

SEQ ID NO: 2986152 - RNA, 17 nt, Human
cuccaccuugcagcucu

SEQ ID NO: 2986153 - RNA, 15 nt, Human
cuccagccccuggau

SEQ ID NO: 2986154 - RNA, 12 nt, Human
cuccaccugcca

SEQ ID NO: 2986155 - RNA, 13 nt, Human
cuccaccugccag

SEQ ID NO: 2986156 - RNA, 14 nt, Human
cuccaccugccagg

SEQ ID NO: 2986157 - RNA, 20 nt, Human
cuccagccccuggaugcagc

SEQ ID NO: 2986158 - RNA, 16 nt, Human
cuccagccccuggaug

SEQ ID NO: 2986159 - RNA, 17 nt, Human
cuccagccccuggaugc

SEQ ID NO: 2986160 - RNA, 12 nt, Human
cuccagccuggg

SEQ ID NO: 2986161 - RNA, 11 nt, Human
cuccauccuga

SEQ ID NO: 2986162 - RNA, 12 nt, Human
cuccauccugag

SEQ ID NO: 2986163 - RNA, 18 nt, Human
cuccaggagcagccacau

SEQ ID NO: 2986164 - RNA, 23 nt, Human
cuccaggagcagccacauuccug

SEQ ID NO: 2986165 - RNA, 19 nt, Human
cuccaggcagcagacacau

SEQ ID NO: 2986166 - RNA, 14 nt, Human
cuccaggagcagcc

SEQ ID NO: 2986167 - RNA, 15 nt, Human
cuccaggagcagcca

SEQ ID NO: 2986168 - RNA, 16 nt, Human
cuccaggagcagccac

SEQ ID NO: 2986169 - RNA, 17 nt, Human
cuccaggagcagccaca

SEQ ID NO: 2986170 - RNA, 11 nt, Human
cuccaggagca

SEQ ID NO: 2986171 - RNA, 13 nt, Human
cuccaggagcagc

SEQ ID NO: 2986172 - RNA, 13 nt, Human
cuccacauuuguu

SEQ ID NO: 2986173 - RNA, 15 nt, Human
cuccacauuuguuuu

SEQ ID NO: 2986174 - RNA, 13 nt, Human
cuccacccugcuc

SEQ ID NO: 2986175 - RNA, 23 nt, Human
cuccaccucccugcaauaaaaug

SEQ ID NO: 2986176 - RNA, 15 nt, Human
cuccacccugcucuc

SEQ ID NO: 2986177 - RNA, 14 nt, Human
cucauuucuagcag

SEQ ID NO: 2986178 - RNA, 17 nt, Human
cucauuugucacacacu

SEQ ID NO: 2986179 - RNA, 21 nt, Human
cucauuuccaagcaaguauua

SEQ ID NO: 2986180 - RNA, 17 nt, Human
cucauguugaaacuuua

SEQ ID NO: 2986181 - RNA, 13 nt, Human
cuccaaagaaaug

SEQ ID NO: 2986182 - RNA, 12 nt, Human
cuccaaagaaau

SEQ ID NO: 2986183 - RNA, 21 nt, Human
cuccaaacugacucuuaagaa

SEQ ID NO: 2986184 - RNA, 16 nt, Human
cuccaaaauaaaacuu

SEQ ID NO: 2986185 - RNA, 15 nt, Human
cuccaaaauaaaacu

SEQ ID NO: 2986186 - RNA, 16 nt, Human
cucaggugagaagcag

SEQ ID NO: 2986187 - RNA, 14 nt, Human
cucaggugagaagc

SEQ ID NO: 2986188 - RNA, 19 nt, Human
cucaggugagaagcagagg

SEQ ID NO: 2986189 - RNA, 20 nt, Human
cucaggugagaagcagagga

SEQ ID NO: 2986190 - RNA, 15 nt, Human
cucagggucccuggu

SEQ ID NO: 2986191 - RNA, 16 nt, Human
cucagggucccuggug

SEQ ID NO: 2986192 - RNA, 17 nt, Human
cucagggucccuggugg

SEQ ID NO: 2986193 - RNA, 15 nt, Human
cucagggccuggucg

SEQ ID NO: 2986194 - RNA, 16 nt, Human
cucagggccuggcuca

SEQ ID NO: 2986195 - RNA, 14 nt, Human
cucagggccuggcu

SEQ ID NO: 2986196 - RNA, 15 nt, Human
cucagggccuggcuc

SEQ ID NO: 2986197 - RNA, 13 nt, Human
cucagggccuggc

SEQ ID NO: 2986198 - RNA, 18 nt, Human
cucaggaguuugagacca

SEQ ID NO: 2986199 - RNA, 23 nt, Human
cucaggaguuugagaccaaccug

SEQ ID NO: 2986200 - RNA, 18 nt, Human
cucagcauccuggcaccc

SEQ ID NO: 2986201 - RNA, 15 nt, Human
cucagcauccuggca

SEQ ID NO: 2986202 - RNA, 15 nt, Human
cucauccucauaccc

SEQ ID NO: 2986203 - RNA, 21 nt, Human
cucaucaccaacgucugugcc

SEQ ID NO: 2986204 - RNA, 23 nt, Human
cucauaguaugguggcuggguug

SEQ ID NO: 2986205 - RNA, 20 nt, Human
cucauaguaugguggcuggg

SEQ ID NO: 2986206 - RNA, 22 nt, Human
cucaucaccaacgucugugcca

SEQ ID NO: 2986207 - RNA, 16 nt, Human
cucauacccaccccca

SEQ ID NO: 2986208 - RNA, 18 nt, Human
cucauacccacccccacc

SEQ ID NO: 2986209 - RNA, 19 nt, Human
cucauacccacccccaccc

SEQ ID NO: 2986210 - RNA, 21 nt, Human
cucauacccacccccacccaa

SEQ ID NO: 2986211 - RNA, 19 nt, Human
cucaggugauccacccacc

SEQ ID NO: 2986212 - RNA, 18 nt, Human
cucaggugauccacccac

SEQ ID NO: 2986213 - RNA, 20 nt, Human
cucaggugauccacccaccu

SEQ ID NO: 2986214 - RNA, 22 nt, Human
cucauacucaccucaccccacu

SEQ ID NO: 2986215 - RNA, 14 nt, Human
cucauacucaccuc

SEQ ID NO: 2986216 - RNA, 15 nt, Human
cucauacccaccccc

SEQ ID NO: 2986217 - RNA, 21 nt, Human
cucauaguaugguggcugggu

SEQ ID NO: 2986218 - RNA, 24 nt, Human
cuccugugugugcgccuacaggag

SEQ ID NO: 2986219 - RNA, 23 nt, Human
cuccugugugugcgccuacagga

SEQ ID NO: 2986220 - RNA, 21 nt, Human
cuccugugugugcgccuacag

SEQ ID NO: 2986221 - RNA, 14 nt, Human
cuccuggaaauauu

SEQ ID NO: 2986222 - RNA, 15 nt, Human
cuccucuccccagca

SEQ ID NO: 2986223 - RNA, 13 nt, Human
cuccucuccccag

SEQ ID NO: 2986224 - RNA, 11 nt, Human
cuccugccuca

SEQ ID NO: 2986225 - RNA, 12 nt, Human
cuccugccucag

SEQ ID NO: 2986226 - RNA, 16 nt, Human
cuccugccucagccuc

SEQ ID NO: 2986227 - RNA, 17 nt, Human
cuccugccucagccucc

SEQ ID NO: 2986228 - RNA, 21 nt, Human
cuccugccucgaacuggcugc

SEQ ID NO: 2986229 - RNA, 20 nt, Human
cuccugccucgaacuggcug

SEQ ID NO: 2986230 - RNA, 18 nt, Human
cuccugccucgaacuggc

SEQ ID NO: 2986231 - RNA, 23 nt, Human
cuccuuggugucgggcaugacac

SEQ ID NO: 2986232 - RNA, 13 nt, Human
cucgagcaugccu

SEQ ID NO: 2986233 - RNA, 15 nt, Human
cucgagcaugccugg

SEQ ID NO: 2986234 - RNA, 16 nt, Human
cucgagcaugccugga

SEQ ID NO: 2986235 - RNA, 19 nt, Human
cucgagcaugccuggaugg

SEQ ID NO: 2986236 - RNA, 22 nt, Human
cucgagcaugccuggauggggc

SEQ ID NO: 2986237 - RNA, 20 nt, Human
cuccccuccucugcuugcca

SEQ ID NO: 2986238 - RNA, 13 nt, Human
cuccauccugagg

SEQ ID NO: 2986239 - RNA, 23 nt, Human
cuccccagcaagugagagcuggg

SEQ ID NO: 2986240 - RNA, 22 nt, Human
cuccccagcaagugagagcugg

SEQ ID NO: 2986241 - RNA, 11 nt, Human
cuccccuccuc

SEQ ID NO: 2986242 - RNA, 21 nt, Human
cuccccagcaagugagagcug

SEQ ID NO: 2986243 - RNA, 13 nt, Human
cuccccuccucug

SEQ ID NO: 2986244 - RNA, 20 nt, Human
cucccgaguagcugggacua

SEQ ID NO: 2986245 - RNA, 19 nt, Human
cucccgaguagcugggacu

SEQ ID NO: 2986246 - RNA, 18 nt, Human
cucccgaguagcugggac

SEQ ID NO: 2986247 - RNA, 15 nt, Human
cuccuccagccgcca

SEQ ID NO: 2986248 - RNA, 13 nt, Human
cuccuccagaguc

SEQ ID NO: 2986249 - RNA, 15 nt, Human
cuccuccagagucag

SEQ ID NO: 2986250 - RNA, 20 nt, Human
cucccuuggauuguccccga

SEQ ID NO: 2986251 - RNA, 18 nt, Human
cuccucagaucuucugug

SEQ ID NO: 2986252 - RNA, 16 nt, Human
cuuguuuaaugguagu

SEQ ID NO: 2986253 - RNA, 21 nt, Human
cuuguguguuuauugucaaag

SEQ ID NO: 2986254 - RNA, 20 nt, Human
cuuguguguuuauugucaaa

SEQ ID NO: 2986255 - RNA, 19 nt, Human
cuuuaaacuacauuagguu

SEQ ID NO: 2986256 - RNA, 18 nt, Human
cuuuaaagggauggcaag

SEQ ID NO: 2986257 - RNA, 18 nt, Human
cuuuccaaaugcccagcu

SEQ ID NO: 2986258 - RNA, 19 nt, Human
cuuuccaaaugcccagcuu

SEQ ID NO: 2986259 - RNA, 22 nt, Human
cuuuccaaaugcccagcuuaaa

SEQ ID NO: 2986260 - RNA, 13 nt, Human
cuuuccacagaag

SEQ ID NO: 2986261 - RNA, 18 nt, Human
cuuguaaaggaauuuaaa

SEQ ID NO: 2986262 - RNA, 16 nt, Human
cuuggggggcugaggu

SEQ ID NO: 2986263 - RNA, 19 nt, Human
cuuguaaaggaauuuaaaa

SEQ ID NO: 2986264 - RNA, 15 nt, Human
cuuggggggcugagg

SEQ ID NO: 2986265 - RNA, 22 nt, Human
cuuggggaccagagcugccacc

SEQ ID NO: 2986266 - RNA, 22 nt, Human
cuugggcuucauccuccucaga

SEQ ID NO: 2986267 - RNA, 20 nt, Human
cuuggggaccagagcugcca

SEQ ID NO: 2986268 - RNA, 21 nt, Human
cuuggggaccagagcugccac

SEQ ID NO: 2986269 - RNA, 14 nt, Human
cuugggccacugug

SEQ ID NO: 2986270 - RNA, 13 nt, Human
cuugggcuucauc

SEQ ID NO: 2986271 - RNA, 17 nt, Human
cuuggcugcagggaguc

SEQ ID NO: 2986272 - RNA, 14 nt, Human
cuuggcugcaggga

SEQ ID NO: 2986273 - RNA, 12 nt, Human
cuuggagggcau

SEQ ID NO: 2986274 - RNA, 23 nt, Human
cuuggagggcaugaagacagaua

SEQ ID NO: 2986275 - RNA, 22 nt, Human
cuuggaggaaggaaacccagcu

SEQ ID NO: 2986276 - RNA, 16 nt, Human
cuuggcugcagggagu

SEQ ID NO: 2986277 - RNA, 22 nt, Human
cuugccaucccucccuccaccu

SEQ ID NO: 2986278 - RNA, 16 nt, Human
cuugcccagccuggau

SEQ ID NO: 2986279 - RNA, 17 nt, Human
cuugcccagccuggaug

SEQ ID NO: 2986280 - RNA, 13 nt, Human
cuugcccagccug

SEQ ID NO: 2986281 - RNA, 15 nt, Human
cuugcccagccugga

SEQ ID NO: 2986282 - RNA, 14 nt, Human
cuugcucugcugac

SEQ ID NO: 2986283 - RNA, 13 nt, Human
cuugcucugcuga

SEQ ID NO: 2986284 - RNA, 21 nt, Human
cuugccaucccucccuccacc

SEQ ID NO: 2986285 - RNA, 19 nt, Human
cuugccaucccucccucca

SEQ ID NO: 2986286 - RNA, 21 nt, Human
cuucuccacccugcucuccga

SEQ ID NO: 2986287 - RNA, 16 nt, Human
cuucuccacccugcuc

SEQ ID NO: 2986288 - RNA, 18 nt, Human
cuucuccacccugcucuc

SEQ ID NO: 2986289 - RNA, 17 nt, Human
cuucuccacccugcucu

SEQ ID NO: 2986290 - RNA, 16 nt, Human
cuuggaaaugggagac

SEQ ID NO: 2986291 - RNA, 13 nt, Human
cuuggaggaagga

SEQ ID NO: 2986292 - RNA, 13 nt, Human
cuuggaagcuccg

SEQ ID NO: 2986293 - RNA, 17 nt, Human
cuugcucugcugacaga

SEQ ID NO: 2986294 - RNA, 16 nt, Human
cuugcucugcugacag

SEQ ID NO: 2986295 - RNA, 20 nt, Human
cuugcuucaaccccaugaga

SEQ ID NO: 2986296 - RNA, 13 nt, Human
gaaacacugguuu

SEQ ID NO: 2986297 - RNA, 20 nt, Human
gaaaaucuuauaauuuaaaa

SEQ ID NO: 2986298 - RNA, 22 nt, Human
gaaacacugguuuuaaauauuu

SEQ ID NO: 2986299 - RNA, 18 nt, Human
gaaacagcuaaugggaca

SEQ ID NO: 2986300 - RNA, 18 nt, Human
gaaacagaugaaaagccu

SEQ ID NO: 2986301 - RNA, 19 nt, Human
gaaaauaacgauaaaagac

SEQ ID NO: 2986302 - RNA, 17 nt, Human
gaaaagcugcugacagu

SEQ ID NO: 2986303 - RNA, 13 nt, Human
gaaaagcugcuga

SEQ ID NO: 2986304 - RNA, 16 nt, Human
gaaaaucagccugcuc

SEQ ID NO: 2986305 - RNA, 18 nt, Human
gaaaaucagccugcucca

SEQ ID NO: 2986306 - RNA, 19 nt, Human
gaaaaucuuauaauuuaaa

SEQ ID NO: 2986307 - RNA, 12 nt, Human
gaaaauaucacu

SEQ ID NO: 2986308 - RNA, 14 nt, Human
gaaaaucagccugc

SEQ ID NO: 2986309 - RNA, 22 nt, Human
gaaaacaauaacgauaaaagac

SEQ ID NO: 2986310 - RNA, 13 nt, Human
gaaaacacauuuu

SEQ ID NO: 2986311 - RNA, 12 nt, Human
gaaaacaaugca

SEQ ID NO: 2986312 - RNA, 14 nt, Human
gaaaacaaggauga

SEQ ID NO: 2986313 - RNA, 15 nt, Human
gaaaacaugcuacac

SEQ ID NO: 2986314 - RNA, 14 nt, Human
gaaaacaugcuaca

SEQ ID NO: 2986315 - RNA, 12 nt, Human
gaaaacaugcua

SEQ ID NO: 2986316 - RNA, 15 nt, Human
gaaaacguggcugcu

SEQ ID NO: 2986317 - RNA, 16 nt, Human
gaaaacguggcugcuu

SEQ ID NO: 2986318 - RNA, 18 nt, Human
gaaaacguggcugcuuca

SEQ ID NO: 2986319 - RNA, 14 nt, Human
gaaaacguggcugc

SEQ ID NO: 2986320 - RNA, 16 nt, Human
cuuuugagcauuuaga

SEQ ID NO: 2986321 - RNA, 21 nt, Human
cuuuugagugccuuacacaau

SEQ ID NO: 2986322 - RNA, 20 nt, Human
cuuuuuucucugauacagaa

SEQ ID NO: 2986323 - RNA, 15 nt, Human
cuuuuuucacuacau

SEQ ID NO: 2986324 - RNA, 14 nt, Human
cuuuuuuggcugcu

SEQ ID NO: 2986325 - RNA, 15 nt, Human
cuuuuuuggcugcug

SEQ ID NO: 2986326 - RNA, 22 nt, Human
cuuuuuucucugauacagaaaa

SEQ ID NO: 2986327 - RNA, 17 nt, Human
gaaaaaggaugcacaga

SEQ ID NO: 2986328 - RNA, 23 nt, Human
gaaaaaggaugcacagaguuguu

SEQ ID NO: 2986329 - RNA, 19 nt, Human
cuuuggacccugaggccca

SEQ ID NO: 2986330 - RNA, 17 nt, Human
cuuuggacccugaggcc

SEQ ID NO: 2986331 - RNA, 18 nt, Human
cuuuggacccugaggccc

SEQ ID NO: 2986332 - RNA, 15 nt, Human
cuuuggacccugagg

SEQ ID NO: 2986333 - RNA, 16 nt, Human
cuuuggacccugaggc

SEQ ID NO: 2986334 - RNA, 16 nt, Human
cuuucccaucuuccaa

SEQ ID NO: 2986335 - RNA, 18 nt, Human
cuuugugauuuuuguaau

SEQ ID NO: 2986336 - RNA, 17 nt, Human
cuuugugauuuuuguaa

SEQ ID NO: 2986337 - RNA, 19 nt, Human
cuuugugauuuuuguaauu

SEQ ID NO: 2986338 - RNA, 14 nt, Human
cuuuguucuggcuc

SEQ ID NO: 2986339 - RNA, 15 nt, Human
cuuuguucuggcucu

SEQ ID NO: 2986340 - RNA, 13 nt, Human
cuuugggaggcca

SEQ ID NO: 2986341 - RNA, 18 nt, Human
cuuuguccccaccgcaga

SEQ ID NO: 2986342 - RNA, 22 nt, Human
cuuuguccccaccgcagacagg

SEQ ID NO: 2986343 - RNA, 14 nt, Human
cuuugugauuuuug

SEQ ID NO: 2986344 - RNA, 18 nt, Human
cuuuucuguccgagcuuu

SEQ ID NO: 2986345 - RNA, 23 nt, Human
cuuuucuguccgagcuuugaaaa

SEQ ID NO: 2986346 - RNA, 18 nt, Human
cuuuucuugcaugaggcu

SEQ ID NO: 2986347 - RNA, 23 nt, Human
cuuuucuugcaugaggcuagugu

SEQ ID NO: 2986348 - RNA, 16 nt, Human
cuuuucuuucagccaa

SEQ ID NO: 2986349 - RNA, 20 nt, Human
cuuuucauaaccuagccuua

SEQ ID NO: 2986350 - RNA, 22 nt, Human
cuuuucauaaccuagccuuaga

SEQ ID NO: 2986351 - RNA, 18 nt, Human
cuuuguuuguugucagcu

SEQ ID NO: 2986352 - RNA, 20 nt, Human
cuuuguuuguugucagcuga

SEQ ID NO: 2986353 - RNA, 18 nt, Human
gaaguaaaauguggcagg

SEQ ID NO: 2986354 - RNA, 17 nt, Human
gaaguaaaauguggcag

SEQ ID NO: 2986355 - RNA, 12 nt, Human
gaaguuucugcc

SEQ ID NO: 2986356 - RNA, 20 nt, Human
gaauaauccuaaacauauga

SEQ ID NO: 2986357 - RNA, 14 nt, Human
gaauaacauguaau

SEQ ID NO: 2986358 - RNA, 14 nt, Human
gaauacuuuauaaa

SEQ ID NO: 2986359 - RNA, 16 nt, Human
gaaucucaaauaacua

SEQ ID NO: 2986360 - RNA, 14 nt, Human
gaaugaaagggccc

SEQ ID NO: 2986361 - RNA, 19 nt, Human
gaaugaaagggcccagaga

SEQ ID NO: 2986362 - RNA, 14 nt, Human
gaauagcugggacu

SEQ ID NO: 2986363 - RNA, 15 nt, Human
gaauagcugggacua

SEQ ID NO: 2986364 - RNA, 16 nt, Human
gaagguagaauguuuu

SEQ ID NO: 2986365 - RNA, 17 nt, Human
gaagguagaauguuuuc

SEQ ID NO: 2986366 - RNA, 15 nt, Human
gaagguagaauguuu

SEQ ID NO: 2986367 - RNA, 14 nt, Human
gaaggccccgccca

SEQ ID NO: 2986368 - RNA, 15 nt, Human
gaaggccccgcccag

SEQ ID NO: 2986369 - RNA, 16 nt, Human
gaaggccccgcccagg

SEQ ID NO: 2986370 - RNA, 21 nt, Human
gaaggauacaaaagcauguga

SEQ ID NO: 2986371 - RNA, 19 nt, Human
gaaggauacaaaagcaugu

SEQ ID NO: 2986372 - RNA, 12 nt, Human
gaaggauacaaa

SEQ ID NO: 2986373 - RNA, 14 nt, Human
gaaggaaacccagc

SEQ ID NO: 2986374 - RNA, 17 nt, Human
gaaggaaacccagcucu

SEQ ID NO: 2986375 - RNA, 18 nt, Human
gaaggaaacccagcucug

SEQ ID NO: 2986376 - RNA, 15 nt, Human
gaagccagcaggcuc

SEQ ID NO: 2986377 - RNA, 16 nt, Human
gaagccagcaggcucu

SEQ ID NO: 2986378 - RNA, 21 nt, Human
gaagacucauucuucuguacg

SEQ ID NO: 2986379 - RNA, 19 nt, Human
gaagacucauucuucugua

SEQ ID NO: 2986380 - RNA, 23 nt, Human
gaagccagcaggcucucaggcca

SEQ ID NO: 2986381 - RNA, 20 nt, Human
gaagcccaggaaaggcucca

SEQ ID NO: 2986382 - RNA, 21 nt, Human
gaagcccaggaaaggcuccag

SEQ ID NO: 2986383 - RNA, 22 nt, Human
gaagcccaggaaaggcuccagg

SEQ ID NO: 2986384 - RNA, 21 nt, Human
gaagccgcuggggccaguugg

SEQ ID NO: 2986385 - RNA, 21 nt, Human
gaagccuuggggcugaugcag

SEQ ID NO: 2986386 - RNA, 14 nt, Human
gaagaaaauaauua

SEQ ID NO: 2986387 - RNA, 21 nt, Human
gaagaaaauagaauugacauu

SEQ ID NO: 2986388 - RNA, 15 nt, Human
gaagaaaauagaauu

SEQ ID NO: 2986389 - RNA, 21 nt, Human
gaagaagcaccaaucaugaau

SEQ ID NO: 2986390 - RNA, 23 nt, Human
gaacuugguucccauuugcuccu

SEQ ID NO: 2986391 - RNA, 12 nt, Human
gaacuugguucc

SEQ ID NO: 2986392 - RNA, 21 nt, Human
gaacuuguaaaggaauuuaaa

SEQ ID NO: 2986393 - RNA, 15 nt, Human
gaacuuggcgcugcc

SEQ ID NO: 2986394 - RNA, 16 nt, Human
gaacuuggcgcugccc

SEQ ID NO: 2986395 - RNA, 13 nt, Human
gaacuuggcgcug

SEQ ID NO: 2986396 - RNA, 14 nt, Human
gaacucccuuucaa

SEQ ID NO: 2986397 - RNA, 22 nt, Human
gaacuggguacuuguggacaca

SEQ ID NO: 2986398 - RNA, 22 nt, Human
gaacuuccagauccuggaaauc

SEQ ID NO: 2986399 - RNA, 21 nt, Human
gaaccacaucuugcucugcug

SEQ ID NO: 2986400 - RNA, 20 nt, Human
gaaccacaucuugcucugcu

SEQ ID NO: 2986401 - RNA, 16 nt, Human
gaacagacuggaagca

SEQ ID NO: 2986402 - RNA, 15 nt, Human
gaacagacuggaagc

SEQ ID NO: 2986403 - RNA, 17 nt, Human
gaaccaccacacccagc

SEQ ID NO: 2986404 - RNA, 16 nt, Human
gaaccaccacacccag

SEQ ID NO: 2986405 - RNA, 22 nt, Human
gaacuagaguuuagcuggaaaa

SEQ ID NO: 2986406 - RNA, 21 nt, Human
gaacuagaguuuagcuggaaa

SEQ ID NO: 2986407 - RNA, 21 nt, Human
gaaauaucugaaaauguaugu

SEQ ID NO: 2986408 - RNA, 13 nt, Human
gaaauauaauuga

SEQ ID NO: 2986409 - RNA, 20 nt, Human
gaaauaucugaaaauguaug

SEQ ID NO: 2986410 - RNA, 19 nt, Human
gaaauaacagaagaaaaua

SEQ ID NO: 2986411 - RNA, 18 nt, Human
gaaauaacagaagaaaau

SEQ ID NO: 2986412 - RNA, 17 nt, Human
gaaauaacagaagaaaa

SEQ ID NO: 2986413 - RNA, 22 nt, Human
gaaauaacagaagaaaauagaa

SEQ ID NO: 2986414 - RNA, 20 nt, Human
gaaauaacagaagaaaauag

SEQ ID NO: 2986415 - RNA, 16 nt, Human
gaaauauuauguuaaa

SEQ ID NO: 2986416 - RNA, 13 nt, Human
gaaauauuauguu

SEQ ID NO: 2986417 - RNA, 20 nt, Human
gaaaugggcagagcagagac

SEQ ID NO: 2986418 - RNA, 14 nt, Human
gaaaugggcagagc

SEQ ID NO: 2986419 - RNA, 18 nt, Human
gaaauuguauuacaaauc

SEQ ID NO: 2986420 - RNA, 17 nt, Human
gaaauuuguuauaauga

SEQ ID NO: 2986421 - RNA, 23 nt, Human
cugggguggguggggcagugcuu

SEQ ID NO: 2986422 - RNA, 18 nt, Human
cugggcuugucuguagau

SEQ ID NO: 2986423 - RNA, 22 nt, Human
cugggcuuggggaccagagcug

SEQ ID NO: 2986424 - RNA, 15 nt, Human
cugggcuucaguggc

SEQ ID NO: 2986425 - RNA, 18 nt, Human
cugggggcugggcagagg

SEQ ID NO: 2986426 - RNA, 14 nt, Human
cugggggcugggca

SEQ ID NO: 2986427 - RNA, 21 nt, Human
cugggauuacaagcgugagcc

SEQ ID NO: 2986428 - RNA, 19 nt, Human
cugggcaacagagcaagac

SEQ ID NO: 2986429 - RNA, 14 nt, Human
cugggauuggcugu

SEQ ID NO: 2986430 - RNA, 18 nt, Human
cugggcaacagagcaaga

SEQ ID NO: 2986431 - RNA, 15 nt, Human
cugggcaacagagca

SEQ ID NO: 2986432 - RNA, 21 nt, Human
cugggauuggcugugaacuga

SEQ ID NO: 2986433 - RNA, 17 nt, Human
cugggauuggcugugaa

SEQ ID NO: 2986434 - RNA, 17 nt, Human
cugggccucggacccca

SEQ ID NO: 2986435 - RNA, 19 nt, Human
cugggccucggaccccacu

SEQ ID NO: 2986436 - RNA, 18 nt, Human
cugguggcagugggagcu

SEQ ID NO: 2986437 - RNA, 14 nt, Human
cugguggcaguggg

SEQ ID NO: 2986438 - RNA, 20 nt, Human
cugguggcagcucaccucuc

SEQ ID NO: 2986439 - RNA, 15 nt, Human
cugguggcagcugcg

SEQ ID NO: 2986440 - RNA, 17 nt, Human
cugguggcagcucaccu

SEQ ID NO: 2986441 - RNA, 18 nt, Human
cugguggcagcucaccuc

SEQ ID NO: 2986442 - RNA, 16 nt, Human
cugguggcagcucacc

SEQ ID NO: 2986443 - RNA, 21 nt, Human
cugguuagagguucccuuuga

SEQ ID NO: 2986444 - RNA, 22 nt, Human
cugguuagagguucccuuugac

SEQ ID NO: 2986445 - RNA, 19 nt, Human
cuguaauccuagcacuuug

SEQ ID NO: 2986446 - RNA, 14 nt, Human
cuguacagagccca

SEQ ID NO: 2986447 - RNA, 15 nt, Human
cuguacagagcccac

SEQ ID NO: 2986448 - RNA, 18 nt, Human
cuguacagagcccacgcc

SEQ ID NO: 2986449 - RNA, 22 nt, Human
cuguacagagcccacgccccca

SEQ ID NO: 2986450 - RNA, 15 nt, Human
cuguaauuugugaua

SEQ ID NO: 2986451 - RNA, 14 nt, Human
cuguaauuugugau

SEQ ID NO: 2986452 - RNA, 18 nt, Human
cuguacgucugacaggca

SEQ ID NO: 2986453 - RNA, 16 nt, Human
cuguacgucugacagg

SEQ ID NO: 2986454 - RNA, 15 nt, Human
cuguacgucugacag

SEQ ID NO: 2986455 - RNA, 14 nt, Human
cuguacgucugaca

SEQ ID NO: 2986456 - RNA, 21 nt, Human
cuguacaugaaaacacauuuu

SEQ ID NO: 2986457 - RNA, 20 nt, Human
cuguacaugaaaacacauuu

SEQ ID NO: 2986458 - RNA, 17 nt, Human
cuguacaugaaaacaca

SEQ ID NO: 2986459 - RNA, 20 nt, Human
cuguacgucugacaggcaau

SEQ ID NO: 2986460 - RNA, 19 nt, Human
cuguacgucugacaggcaa

SEQ ID NO: 2986461 - RNA, 19 nt, Human
cuguaucccaugagccuca

SEQ ID NO: 2986462 - RNA, 20 nt, Human
cuguaucccaugagccucag

SEQ ID NO: 2986463 - RNA, 22 nt, Human
cuguaucccaugagccucagca

SEQ ID NO: 2986464 - RNA, 21 nt, Human
cuguaucccaugagccucagc

SEQ ID NO: 2986465 - RNA, 15 nt, Human
cugucaauuacagga

SEQ ID NO: 2986466 - RNA, 16 nt, Human
cugucaauuacaggaa

SEQ ID NO: 2986467 - RNA, 13 nt, Human
cugucaauuacag

SEQ ID NO: 2986468 - RNA, 20 nt, Human
cuguauuuuguuuuugucuu

SEQ ID NO: 2986469 - RNA, 15 nt, Human
cugucuuuuaaacuc

SEQ ID NO: 2986470 - RNA, 14 nt, Human
cugucuuuuaaacu

SEQ ID NO: 2986471 - RNA, 15 nt, Human
cugugaaaggaaaga

SEQ ID NO: 2986472 - RNA, 18 nt, Human
cugucuucacaacagauu

SEQ ID NO: 2986473 - RNA, 18 nt, Human
cugucuucaguaagccgu

SEQ ID NO: 2986474 - RNA, 18 nt, Human
cugucaauuacaggaagu

SEQ ID NO: 2986475 - RNA, 20 nt, Human
cugucauuugagcagggcuc

SEQ ID NO: 2986476 - RNA, 22 nt, Human
cugucauuugagcagggcucag

SEQ ID NO: 2986477 - RNA, 21 nt, Human
cugucauuugagcagggcuca

SEQ ID NO: 2986478 - RNA, 22 nt, Human
cugugauuuuugguauuugaaa

SEQ ID NO: 2986479 - RNA, 23 nt, Human
cugugauggggcccugccuccuu

SEQ ID NO: 2986480 - RNA, 16 nt, Human
cugugauggggcccug

SEQ ID NO: 2986481 - RNA, 21 nt, Human
cugugauggggcccugccucc

SEQ ID NO: 2986482 - RNA, 15 nt, Human
cugugauggggcccu

SEQ ID NO: 2986483 - RNA, 19 nt, Human
cugugaugacauucccugc

SEQ ID NO: 2986484 - RNA, 16 nt, Human
cugugaaaggaaagag

SEQ ID NO: 2986485 - RNA, 22 nt, Human
cugugaaaggaaagagggaggu

SEQ ID NO: 2986486 - RNA, 14 nt, Human
cugugccaugugcc

SEQ ID NO: 2986487 - RNA, 19 nt, Human
cugugcccuaaaguguauu

SEQ ID NO: 2986488 - RNA, 22 nt, Human
cugugccauuuuguauuuuacu

SEQ ID NO: 2986489 - RNA, 15 nt, Human
cugugccaugugcca

SEQ ID NO: 2986490 - RNA, 15 nt, Human
cuguguuguacagcu

SEQ ID NO: 2986491 - RNA, 15 nt, Human
cuguuaaaagaugaa

SEQ ID NO: 2986492 - RNA, 16 nt, Human
cuguuaaaagaugaaa

SEQ ID NO: 2986493 - RNA, 19 nt, Human
cuguuaaaagaugaaaaua

SEQ ID NO: 2986494 - RNA, 20 nt, Human
cugugucuuuuuucacuaca

SEQ ID NO: 2986495 - RNA, 23 nt, Human
cugugucuugcaauggcagccuu

SEQ ID NO: 2986496 - RNA, 22 nt, Human
cuguggguuucuaaagcugcca

SEQ ID NO: 2986497 - RNA, 21 nt, Human
cuguggguuucuaaagcugcc

SEQ ID NO: 2986498 - RNA, 23 nt, Human
cuuagacccucaugcugccaaua

SEQ ID NO: 2986499 - RNA, 19 nt, Human
cuuagacccucaugcugcc

SEQ ID NO: 2986500 - RNA, 20 nt, Human
cuuagacccucaugcugcca

SEQ ID NO: 2986501 - RNA, 21 nt, Human
cuuagacccucaugcugccaa

SEQ ID NO: 2986502 - RNA, 22 nt, Human
cuuagacccucaugcugccaau

SEQ ID NO: 2986503 - RNA, 19 nt, Human
cuuagaauuaguggcacuu

SEQ ID NO: 2986504 - RNA, 18 nt, Human
cuuagacccucaugcugc

SEQ ID NO: 2986505 - RNA, 23 nt, Human
cuuagguuggcaaaaaggcagga

SEQ ID NO: 2986506 - RNA, 21 nt, Human
cuuagguuggcaaaaaggcag

SEQ ID NO: 2986507 - RNA, 20 nt, Human
cuuagaagucacacaguauu

SEQ ID NO: 2986508 - RNA, 17 nt, Human
cuuagaagucacacagu

SEQ ID NO: 2986509 - RNA, 20 nt, Human
cuuagaaaaaccaccaccau

SEQ ID NO: 2986510 - RNA, 21 nt, Human
cuuagaaauaacagaagaaaa

SEQ ID NO: 2986511 - RNA, 23 nt, Human
cuuagaaauaacagaagaaaaua

SEQ ID NO: 2986512 - RNA, 13 nt, Human
cuuaccugccagg

SEQ ID NO: 2986513 - RNA, 20 nt, Human
cuuaccugccaggaagccag

SEQ ID NO: 2986514 - RNA, 10 nt, Human
cuuaauuauu

SEQ ID NO: 2986515 - RNA, 19 nt, Human
cuuaauuaaaagaauauuu

SEQ ID NO: 2986516 - RNA, 20 nt, Human
cuuaauuaaaagaauauuuu

SEQ ID NO: 2986517 - RNA, 16 nt, Human
cuuaauuauugauguu

SEQ ID NO: 2986518 - RNA, 20 nt, Human
cuuaauucuuagcucauucu

SEQ ID NO: 2986519 - RNA, 16 nt, Human
cuuaauuaaaagaaua

SEQ ID NO: 2986520 - RNA, 17 nt, Human
cuuaauuaaaagaauau

SEQ ID NO: 2986521 - RNA, 19 nt, Human
cuuaaugagacuuuaaaag

SEQ ID NO: 2986522 - RNA, 15 nt, Human
cuuaaugaaaacaau

SEQ ID NO: 2986523 - RNA, 16 nt, Human
cuuaaucuaaauggaa

SEQ ID NO: 2986524 - RNA, 17 nt, Human
cuuaagacuuaaugaga

SEQ ID NO: 2986525 - RNA, 15 nt, Human
cuuaagacuuaauga

SEQ ID NO: 2986526 - RNA, 21 nt, Human
cuuaagaagacugcauuauau

SEQ ID NO: 2986527 - RNA, 23 nt, Human
cuuaagaagacugcauuauauuu

SEQ ID NO: 2986528 - RNA, 20 nt, Human
cuguuuuuauuauuaacaaa

SEQ ID NO: 2986529 - RNA, 12 nt, Human
cuuaaaaacaac

SEQ ID NO: 2986530 - RNA, 14 nt, Human
cuuaaaaacaacga

SEQ ID NO: 2986531 - RNA, 16 nt, Human
cuuaaaaaguggaaaa

SEQ ID NO: 2986532 - RNA, 17 nt, Human
cuuaaaaaguggaaaaa

SEQ ID NO: 2986533 - RNA, 18 nt, Human
cuguuuuuauuauuaaca

SEQ ID NO: 2986534 - RNA, 15 nt, Human
cuguuuuauaauuuu

SEQ ID NO: 2986535 - RNA, 14 nt, Human
cuguuuuauaauuu

SEQ ID NO: 2986536 - RNA, 17 nt, Human
cuguuugcuaagugagg

SEQ ID NO: 2986537 - RNA, 19 nt, Human
cuguuugcuaagugaggau

SEQ ID NO: 2986538 - RNA, 18 nt, Human
cuguuuagauaauacacc

SEQ ID NO: 2986539 - RNA, 17 nt, Human
cuguuucaaacuuuacu

SEQ ID NO: 2986540 - RNA, 15 nt, Human
cuguuucaaacuuua

SEQ ID NO: 2986541 - RNA, 17 nt, Human
cuguuuagauaauacac

SEQ ID NO: 2986542 - RNA, 14 nt, Human
cuguuuagauaaua

SEQ ID NO: 2986543 - RNA, 17 nt, Human
cuguugcccaggcuggc

SEQ ID NO: 2986544 - RNA, 23 nt, Human
cuguucuuucuggcuaugcauuu

SEQ ID NO: 2986545 - RNA, 16 nt, Human
cuguugcccaggcugg

SEQ ID NO: 2986546 - RNA, 15 nt, Human
cuguugcccaggcug

SEQ ID NO: 2986547 - RNA, 14 nt, Human
cuguugcccaggcu

SEQ ID NO: 2986548 - RNA, 13 nt, Human
cuguugcccaggc

SEQ ID NO: 2986549 - RNA, 12 nt, Human
cuguugcccagg

SEQ ID NO: 2986550 - RNA, 21 nt, Human
cuguucuuucuggcuaugcau

SEQ ID NO: 2986551 - RNA, 14 nt, Human
cuguucuuucuggc

SEQ ID NO: 2986552 - RNA, 13 nt, Human
cuguucuuucugg

SEQ ID NO: 2986553 - RNA, 21 nt, Human
cuguucuuuccaaaguacacu

SEQ ID NO: 2986554 - RNA, 19 nt, Human
cuguucuuuccaaaguaca

SEQ ID NO: 2986555 - RNA, 16 nt, Human
cuguucuuuccaaagu

SEQ ID NO: 2986556 - RNA, 15 nt, Human
cuguucuuuccaaag

SEQ ID NO: 2986557 - RNA, 16 nt, Human
cuguuaauaguucagg

SEQ ID NO: 2986558 - RNA, 14 nt, Human
cuucaagaaugcag

SEQ ID NO: 2986559 - RNA, 17 nt, Human
cuucaaggauccugagc

SEQ ID NO: 2986560 - RNA, 18 nt, Human
cuucaaggauccugagcc

SEQ ID NO: 2986561 - RNA, 19 nt, Human
cuucaaggauccugagcca

SEQ ID NO: 2986562 - RNA, 20 nt, Human
cuucaaggauccugagccag

SEQ ID NO: 2986563 - RNA, 21 nt, Human
cuuagucacugagacagcccg

SEQ ID NO: 2986564 - RNA, 20 nt, Human
cuuagucacugagacagccc

SEQ ID NO: 2986565 - RNA, 22 nt, Human
cuuagucacugagacagcccgg

SEQ ID NO: 2986566 - RNA, 15 nt, Human
cuucaaauauuuccc

SEQ ID NO: 2986567 - RNA, 17 nt, Human
cuucaaauccuugaaga

SEQ ID NO: 2986568 - RNA, 12 nt, Human
cuucacaacaga

SEQ ID NO: 2986569 - RNA, 14 nt, Human
cuucacaacagauu

SEQ ID NO: 2986570 - RNA, 21 nt, Human
cuucaaggauccugagccaga

SEQ ID NO: 2986571 - RNA, 22 nt, Human
cuucaaggauccugagccagau

SEQ ID NO: 2986572 - RNA, 23 nt, Human
cuucaaggauccugagccagauu

SEQ ID NO: 2986573 - RNA, 23 nt, Human
cuucacauauugauuuccguuaa

SEQ ID NO: 2986574 - RNA, 14 nt, Human
cuucacauauugau

SEQ ID NO: 2986575 - RNA, 24 nt, Human
cuucagagacuccugcaggcagcc

SEQ ID NO: 2986576 - RNA, 15 nt, Human
cuucagccugaaaga

SEQ ID NO: 2986577 - RNA, 20 nt, Human
cuucagccucccgaguagcu

SEQ ID NO: 2986578 - RNA, 16 nt, Human
cuucagccucccgagu

SEQ ID NO: 2986579 - RNA, 14 nt, Human
cuucagccucccga

SEQ ID NO: 2986580 - RNA, 14 nt, Human
cuucaguaagccgu

SEQ ID NO: 2986581 - RNA, 15 nt, Human
cuucagcugacuuuu

SEQ ID NO: 2986582 - RNA, 19 nt, Human
cuucagcugacuuuucugu

SEQ ID NO: 2986583 - RNA, 14 nt, Human
cuucagugccaaaa

SEQ ID NO: 2986584 - RNA, 14 nt, Human
cuuccacaagagcc

SEQ ID NO: 2986585 - RNA, 15 nt, Human
cuuccacaagagccc

SEQ ID NO: 2986586 - RNA, 13 nt, Human
cuuccacaagagc

SEQ ID NO: 2986587 - RNA, 16 nt, Human
cuuccacuugaguguc

SEQ ID NO: 2986588 - RNA, 20 nt, Human
cuuccuuggacucauuuuaa

SEQ ID NO: 2986589 - RNA, 17 nt, Human
cuucgcuccugugucuu

SEQ ID NO: 2986590 - RNA, 16 nt, Human
cuucgcuccugugucu

SEQ ID NO: 2986591 - RNA, 21 nt, Human
cuucucacugccaugccagcu

SEQ ID NO: 2986592 - RNA, 16 nt, Human
cuucucacugccaugc

SEQ ID NO: 2986593 - RNA, 19 nt, Human
cuucgggaggucgaggcag

SEQ ID NO: 2986594 - RNA, 20 nt, Human
cuucggccuccauccugagg

SEQ ID NO: 2986595 - RNA, 19 nt, Human
cuucggccuccauccugag

SEQ ID NO: 2986596 - RNA, 12 nt, Human
cccuaaucuucc

SEQ ID NO: 2986597 - RNA, 20 nt, Human
cccuacaguugaaaaacagc

SEQ ID NO: 2986598 - RNA, 15 nt, Human
cccgugggguuccuc

SEQ ID NO: 2986599 - RNA, 17 nt, Human
cccgucuccagcugcug

SEQ ID NO: 2986600 - RNA, 16 nt, Human
cccgucuccagcugcu

SEQ ID NO: 2986601 - RNA, 13 nt, Human
cccgucuccagcu

SEQ ID NO: 2986602 - RNA, 16 nt, Human
cccgggcucugccucc

SEQ ID NO: 2986603 - RNA, 21 nt, Human
cccgaguagcugggacuacag

SEQ ID NO: 2986604 - RNA, 18 nt, Human
cccgaguagcugggacua

SEQ ID NO: 2986605 - RNA, 17 nt, Human
cccgaguagcugggacu

SEQ ID NO: 2986606 - RNA, 16 nt, Human
cccgaguagcugggac

SEQ ID NO: 2986607 - RNA, 15 nt, Human
cccgaguagcuggga

SEQ ID NO: 2986608 - RNA, 14 nt, Human
cccgaguagcuggg

SEQ ID NO: 2986609 - RNA, 13 nt, Human
cccgaguagcugg

SEQ ID NO: 2986610 - RNA, 15 nt, Human
cccagagggccugca

SEQ ID NO: 2986611 - RNA, 21 nt, Human
cccgaggccuucucugaagga

SEQ ID NO: 2986612 - RNA, 14 nt, Human
cccagagggccugc

SEQ ID NO: 2986613 - RNA, 19 nt, Human
cccgcugucagccauuccu

SEQ ID NO: 2986614 - RNA, 20 nt, Human
cccgcugucagccauuccug

SEQ ID NO: 2986615 - RNA, 22 nt, Human
cccgaguagcugggacuacagg

SEQ ID NO: 2986616 - RNA, 14 nt, Human
cccgggcucugccu

SEQ ID NO: 2986617 - RNA, 15 nt, Human
cccgggcucugccuc

SEQ ID NO: 2986618 - RNA, 12 nt, Human
cccgggcucugc

SEQ ID NO: 2986619 - RNA, 13 nt, Human
cccucuccugggc

SEQ ID NO: 2986620 - RNA, 12 nt, Human
cccucuccuggg

SEQ ID NO: 2986621 - RNA, 11 nt, Human
cccucuccugg

SEQ ID NO: 2986622 - RNA, 14 nt, Human
cccucuccugggca

SEQ ID NO: 2986623 - RNA, 12 nt, Human
cccucuggggcu

SEQ ID NO: 2986624 - RNA, 17 nt, Human
cccuccaccucccugca

SEQ ID NO: 2986625 - RNA, 15 nt, Human
cccuccaccucccug

SEQ ID NO: 2986626 - RNA, 19 nt, Human
cccuccaccucccugcaau

SEQ ID NO: 2986627 - RNA, 13 nt, Human
cccuccagagccc

SEQ ID NO: 2986628 - RNA, 12 nt, Human
cccuccaccucc

SEQ ID NO: 2986629 - RNA, 14 nt, Human
cccuccaccucccu

SEQ ID NO: 2986630 - RNA, 14 nt, Human
cccugaggcccaga

SEQ ID NO: 2986631 - RNA, 15 nt, Human
cccugaggcccagag

SEQ ID NO: 2986632 - RNA, 16 nt, Human
cccugaggcccagagg

SEQ ID NO: 2986633 - RNA, 17 nt, Human
cccugaggcccagaggg

SEQ ID NO: 2986634 - RNA, 18 nt, Human
cccugaggcccagagggc

SEQ ID NO: 2986635 - RNA, 19 nt, Human
cccugaggcccagagggcc

SEQ ID NO: 2986636 - RNA, 20 nt, Human
cccugaggcccagagggccu

SEQ ID NO: 2986637 - RNA, 23 nt, Human
cccugaggcccagagggccugca

SEQ ID NO: 2986638 - RNA, 16 nt, Human
cccucuggggcuguuc

SEQ ID NO: 2986639 - RNA, 13 nt, Human
cccugaggcccag

SEQ ID NO: 2986640 - RNA, 15 nt, Human
cccugaaagcccuga

SEQ ID NO: 2986641 - RNA, 19 nt, Human
cccugcacuugcagacucu

SEQ ID NO: 2986642 - RNA, 12 nt, Human
cccugcacuugc

SEQ ID NO: 2986643 - RNA, 21 nt, Human
cccugcacagcaggcugccag

SEQ ID NO: 2986644 - RNA, 20 nt, Human
cccugcacagcaggcugcca

SEQ ID NO: 2986645 - RNA, 15 nt, Human
cccugcacagcaggc

SEQ ID NO: 2986646 - RNA, 14 nt, Human
cccugcacagcagg

SEQ ID NO: 2986647 - RNA, 22 nt, Human
cccugcacagcaggcugccagu

SEQ ID NO: 2986648 - RNA, 13 nt, Human
cccugcacagcag

SEQ ID NO: 2986649 - RNA, 18 nt, Human
cccugcccaccuggccuc

SEQ ID NO: 2986650 - RNA, 16 nt, Human
cccugcuggguguggc

SEQ ID NO: 2986651 - RNA, 21 nt, Human
cccugcuggguguggcgcagc

SEQ ID NO: 2986652 - RNA, 13 nt, Human
cccugcccaccug

SEQ ID NO: 2986653 - RNA, 14 nt, Human
cccugcccaccugg

SEQ ID NO: 2986654 - RNA, 17 nt, Human
cccugcccaccuggccu

SEQ ID NO: 2986655 - RNA, 22 nt, Human
cccugcuggguguggcgcagca

SEQ ID NO: 2986656 - RNA, 16 nt, Human
cccugguggcagcuca

SEQ ID NO: 2986657 - RNA, 17 nt, Human
cccugguggcagcucac

SEQ ID NO: 2986658 - RNA, 15 nt, Human
cccugguggcagcuc

SEQ ID NO: 2986659 - RNA, 16 nt, Human
cccaaugcacuuuguu

SEQ ID NO: 2986660 - RNA, 20 nt, Human
cccaaugcacuuuguucugg

SEQ ID NO: 2986661 - RNA, 21 nt, Human
cccacaaaggagagcuagcag

SEQ ID NO: 2986662 - RNA, 13 nt, Human
cccacaagaaaug

SEQ ID NO: 2986663 - RNA, 20 nt, Human
cccacaagaaaugaaagcag

SEQ ID NO: 2986664 - RNA, 22 nt, Human
cccaccucucucacuccuugaa

SEQ ID NO: 2986665 - RNA, 17 nt, Human
cccaccucagccucccg

SEQ ID NO: 2986666 - RNA, 16 nt, Human
cccaccagugccucuc

SEQ ID NO: 2986667 - RNA, 15 nt, Human
cccaccagugccucu

SEQ ID NO: 2986668 - RNA, 23 nt, Human
cccaccagugccucucccugcug

SEQ ID NO: 2986669 - RNA, 20 nt, Human
cccaccgcagacaggaccag

SEQ ID NO: 2986670 - RNA, 19 nt, Human
cccaccgcagacaggacca

SEQ ID NO: 2986671 - RNA, 14 nt, Human
cccaccagugccuc

SEQ ID NO: 2986672 - RNA, 13 nt, Human
cccaccagugccu

SEQ ID NO: 2986673 - RNA, 21 nt, Human
cccacgcuggagugcagugag

SEQ ID NO: 2986674 - RNA, 20 nt, Human
cccacgcuggagugcaguga

SEQ ID NO: 2986675 - RNA, 19 nt, Human
cccacgcuggagugcagug

SEQ ID NO: 2986676 - RNA, 14 nt, Human
cccacgcuggagug

SEQ ID NO: 2986677 - RNA, 23 nt, Human
cccacuugagaauuacccuuuug

SEQ ID NO: 2986678 - RNA, 12 nt, Human
cccacuucugcc

SEQ ID NO: 2986679 - RNA, 20 nt, Human
cccacgacugcccggcaggg

SEQ ID NO: 2986680 - RNA, 21 nt, Human
cccacgacugcccggcagggu

SEQ ID NO: 2986681 - RNA, 20 nt, Human
cccaccuuggcugcagggag

SEQ ID NO: 2986682 - RNA, 16 nt, Human
cccaccuggccucugc

SEQ ID NO: 2986683 - RNA, 19 nt, Human
cccaccuggccucugcacu

SEQ ID NO: 2986684 - RNA, 21 nt, Human
cccaccuggccucugcacucc

SEQ ID NO: 2986685 - RNA, 17 nt, Human
cccaccuggccucugca

SEQ ID NO: 2986686 - RNA, 15 nt, Human
ccuccacauuuguuu

SEQ ID NO: 2986687 - RNA, 13 nt, Human
ccucauccucaua

SEQ ID NO: 2986688 - RNA, 20 nt, Human
ccucauccucauacccaccc

SEQ ID NO: 2986689 - RNA, 13 nt, Human
ccucaucaccaac

SEQ ID NO: 2986690 - RNA, 14 nt, Human
ccucaucaccaacg

SEQ ID NO: 2986691 - RNA, 22 nt, Human
ccucauaguaugguggcugggu

SEQ ID NO: 2986692 - RNA, 21 nt, Human
ccucauaguaugguggcuggg

SEQ ID NO: 2986693 - RNA, 13 nt, Human
ccucauacccacc

SEQ ID NO: 2986694 - RNA, 20 nt, Human
ccucauaguaugguggcugg

SEQ ID NO: 2986695 - RNA, 20 nt, Human
ccucagucuggcccuuccuu

SEQ ID NO: 2986696 - RNA, 12 nt, Human
ccucauacccac

SEQ ID NO: 2986697 - RNA, 11 nt, Human
ccucagugcca

SEQ ID NO: 2986698 - RNA, 19 nt, Human
ccucagucuggcccuuccu

SEQ ID NO: 2986699 - RNA, 15 nt, Human
ccuccaccucccugc

SEQ ID NO: 2986700 - RNA, 14 nt, Human
ccuccaccucccug

SEQ ID NO: 2986701 - RNA, 13 nt, Human
ccuccaccucccu

SEQ ID NO: 2986702 - RNA, 22 nt, Human
ccuccaccucccugcaauaaaa

SEQ ID NO: 2986703 - RNA, 17 nt, Human
ccuccaccucccugcaa

SEQ ID NO: 2986704 - RNA, 20 nt, Human
ccuccagagccccacagccc

SEQ ID NO: 2986705 - RNA, 19 nt, Human
ccuccagagccccacagcc

SEQ ID NO: 2986706 - RNA, 18 nt, Human
ccuccagagccccacagc

SEQ ID NO: 2986707 - RNA, 15 nt, Human
ccuccagagccccac

SEQ ID NO: 2986708 - RNA, 12 nt, Human
ccuccagagccc

SEQ ID NO: 2986709 - RNA, 13 nt, Human
ccuccagagcccc

SEQ ID NO: 2986710 - RNA, 19 nt, Human
ccuccaggugcacaagcuc

SEQ ID NO: 2986711 - RNA, 21 nt, Human
ccuccaggugcacaagcucca

SEQ ID NO: 2986712 - RNA, 22 nt, Human
ccuccaggugcacaagcuccaa

SEQ ID NO: 2986713 - RNA, 14 nt, Human
ccuccauccugagg

SEQ ID NO: 2986714 - RNA, 15 nt, Human
ccucccaaagugcug

SEQ ID NO: 2986715 - RNA, 23 nt, Human
ccuccaugugggcuaguugggcu

SEQ ID NO: 2986716 - RNA, 16 nt, Human
ccucccaaagugcugg

SEQ ID NO: 2986717 - RNA, 17 nt, Human
ccucccgaauagcuggg

SEQ ID NO: 2986718 - RNA, 16 nt, Human
ccucggugccuuccuc

SEQ ID NO: 2986719 - RNA, 14 nt, Human
ccucgguguggaga

SEQ ID NO: 2986720 - RNA, 16 nt, Human
ccucuaggaggucucu

SEQ ID NO: 2986721 - RNA, 21 nt, Human
ccucuagugaauguaggcugg

SEQ ID NO: 2986722 - RNA, 18 nt, Human
ccucuaucccggcuuugg

SEQ ID NO: 2986723 - RNA, 10 nt, Human
ccucccuccc

SEQ ID NO: 2986724 - RNA, 17 nt, Human
ccucccuccaccucccu

SEQ ID NO: 2986725 - RNA, 20 nt, Human
ccucccuccaccucccugca

SEQ ID NO: 2986726 - RNA, 14 nt, Human
ccuccucagaucuu

SEQ ID NO: 2986727 - RNA, 21 nt, Human
ccucccgaguagcugggacua

SEQ ID NO: 2986728 - RNA, 20 nt, Human
ccucccgaguagcugggacu

SEQ ID NO: 2986729 - RNA, 19 nt, Human
ccucccgaguagcugggac

SEQ ID NO: 2986730 - RNA, 13 nt, Human
ccuccucugcuug

SEQ ID NO: 2986731 - RNA, 16 nt, Human
ccuccucugcuugcca

SEQ ID NO: 2986732 - RNA, 18 nt, Human
ccuccucugcuugccauc

SEQ ID NO: 2986733 - RNA, 14 nt, Human
ccuccugggcuaag

SEQ ID NO: 2986734 - RNA, 23 nt, Human
ccuccugccucgaacuggcugca

SEQ ID NO: 2986735 - RNA, 13 nt, Human
ccuccugccucga

SEQ ID NO: 2986736 - RNA, 14 nt, Human
ccuaaaguguauuu

SEQ ID NO: 2986737 - RNA, 16 nt, Human
ccuaaaauuauggaaa

SEQ ID NO: 2986738 - RNA, 13 nt, Human
ccuaguuccacca

SEQ ID NO: 2986739 - RNA, 21 nt, Human
ccuaguuccaccaucaagcca

SEQ ID NO: 2986740 - RNA, 23 nt, Human
ccuaguuccaccaucaagccacc

SEQ ID NO: 2986741 - RNA, 18 nt, Human
ccuauauuguuuucagug

SEQ ID NO: 2986742 - RNA, 22 nt, Human
ccuauauuguuuucaguguaca

SEQ ID NO: 2986743 - RNA, 20 nt, Human
ccgggcgcgguggcucacgc

SEQ ID NO: 2986744 - RNA, 16 nt, Human
ccgggcguggugguga

SEQ ID NO: 2986745 - RNA, 22 nt, Human
ccgggcucugccucccaucacc

SEQ ID NO: 2986746 - RNA, 17 nt, Human
ccggcuggccuggcccc

SEQ ID NO: 2986747 - RNA, 18 nt, Human
ccggcuggccuggccccu

SEQ ID NO: 2986748 - RNA, 15 nt, Human
ccggcuggccuggcc

SEQ ID NO: 2986749 - RNA, 19 nt, Human
ccgcuuucuacccagcgag

SEQ ID NO: 2986750 - RNA, 20 nt, Human
ccgggaagggggcugggaca

SEQ ID NO: 2986751 - RNA, 12 nt, Human
ccgcuuucuacc

SEQ ID NO: 2986752 - RNA, 14 nt, Human
ccgaggccuucucu

SEQ ID NO: 2986753 - RNA, 20 nt, Human
cccugguggcagcucaccuc

SEQ ID NO: 2986754 - RNA, 17 nt, Human
ccgaguagcugggacua

SEQ ID NO: 2986755 - RNA, 16 nt, Human
ccgaguagcugggacu

SEQ ID NO: 2986756 - RNA, 20 nt, Human
ccgaguagcugggacuacag

SEQ ID NO: 2986757 - RNA, 14 nt, Human
ccgcacugggcuug

SEQ ID NO: 2986758 - RNA, 22 nt, Human
ccgccuugcccagccuggaugc

SEQ ID NO: 2986759 - RNA, 17 nt, Human
ccgccuugcccagccug

SEQ ID NO: 2986760 - RNA, 16 nt, Human
ccgccuugcccagccu

SEQ ID NO: 2986761 - RNA, 15 nt, Human
ccgccuugcccagcc

SEQ ID NO: 2986762 - RNA, 23 nt, Human
ccgcuaagagggagggagggcuc

SEQ ID NO: 2986763 - RNA, 21 nt, Human
ccgcuaagagggagggagggc

SEQ ID NO: 2986764 - RNA, 15 nt, Human
ccuguuuuuauuauu

SEQ ID NO: 2986765 - RNA, 14 nt, Human
ccuguuuuuauuau

SEQ ID NO: 2986766 - RNA, 14 nt, Human
ccuuacacaauggu

SEQ ID NO: 2986767 - RNA, 20 nt, Human
ccuuacacaaugguuuucuu

SEQ ID NO: 2986768 - RNA, 13 nt, Human
ccuuaccagcaga

SEQ ID NO: 2986769 - RNA, 20 nt, Human
ccuuaccagcagagcaccuu

SEQ ID NO: 2986770 - RNA, 15 nt, Human
ccuuacccucauguu

SEQ ID NO: 2986771 - RNA, 19 nt, Human
ccuuaccugccaggaagcc

SEQ ID NO: 2986772 - RNA, 18 nt, Human
ccuuagaagucacacagu

SEQ ID NO: 2986773 - RNA, 17 nt, Human
ccuuagaagucacacag

SEQ ID NO: 2986774 - RNA, 21 nt, Human
ccugugugugcgccuacagga

SEQ ID NO: 2986775 - RNA, 20 nt, Human
ccugugugugcgccuacagg

SEQ ID NO: 2986776 - RNA, 22 nt, Human
ccugugucuugcaauggcagcc

SEQ ID NO: 2986777 - RNA, 21 nt, Human
ccugugucuugcaauggcagc

SEQ ID NO: 2986778 - RNA, 19 nt, Human
ccugugucuugcaauggca

SEQ ID NO: 2986779 - RNA, 17 nt, Human
ccugugucuugcaaugg

SEQ ID NO: 2986780 - RNA, 14 nt, Human
ccuguuuguuucug

SEQ ID NO: 2986781 - RNA, 18 nt, Human
ccuguuuguuucugaaag

SEQ ID NO: 2986782 - RNA, 16 nt, Human
ccuguuucugcagcca

SEQ ID NO: 2986783 - RNA, 20 nt, Human
ccuguuaaaagaugaaaaua

SEQ ID NO: 2986784 - RNA, 21 nt, Human
ccuguuaaaagaugaaaauau

SEQ ID NO: 2986785 - RNA, 23 nt, Human
ccuguugggccaggagccuccug

SEQ ID NO: 2986786 - RNA, 13 nt, Human
ccuuguuuaaugg

SEQ ID NO: 2986787 - RNA, 21 nt, Human
ccuugucggccccaccagugc

SEQ ID NO: 2986788 - RNA, 15 nt, Human
ccuugucggccccac

SEQ ID NO: 2986789 - RNA, 16 nt, Human
ccuuugacgccauccc

SEQ ID NO: 2986790 - RNA, 17 nt, Human
ccuuugacgccauccca

SEQ ID NO: 2986791 - RNA, 18 nt, Human
ccuuugacgccaucccag

SEQ ID NO: 2986792 - RNA, 19 nt, Human
ccuuggggcugaugcaguu

SEQ ID NO: 2986793 - RNA, 21 nt, Human
ccuugguuaggcauuguggga

SEQ ID NO: 2986794 - RNA, 22 nt, Human
ccuugguuaggcauugugggaa

SEQ ID NO: 2986795 - RNA, 22 nt, Human
ccuuggugucgggcaugacacg

SEQ ID NO: 2986796 - RNA, 21 nt, Human
ccuuggugucgggcaugacac

SEQ ID NO: 2986797 - RNA, 14 nt, Human
ccuugaugaagaag

SEQ ID NO: 2986798 - RNA, 23 nt, Human
ccuucuucccaauagcaaggcug

SEQ ID NO: 2986799 - RNA, 15 nt, Human
ccuucuccuucaccu

SEQ ID NO: 2986800 - RNA, 19 nt, Human
ccuucuccuucaccuuugu

SEQ ID NO: 2986801 - RNA, 15 nt, Human
ccuucggcgccuuaa

SEQ ID NO: 2986802 - RNA, 20 nt, Human
ccuugaaaacuuuaugcuaa

SEQ ID NO: 2986803 - RNA, 19 nt, Human
ccuugaacuuugaccucug

SEQ ID NO: 2986804 - RNA, 13 nt, Human
ccuugacucuuuc

SEQ ID NO: 2986805 - RNA, 22 nt, Human
ccuugaccauucuccaccugcc

SEQ ID NO: 2986806 - RNA, 23 nt, Human
ccuugaccauucuccaccugcca

SEQ ID NO: 2986807 - RNA, 20 nt, Human
ccuucggccuccauccugag

SEQ ID NO: 2986808 - RNA, 19 nt, Human
ccuucggccuccauccuga

SEQ ID NO: 2986809 - RNA, 14 nt, Human
ccuucggccuccau

SEQ ID NO: 2986810 - RNA, 22 nt, Human
ccuucauuuggcauuccccacu

SEQ ID NO: 2986811 - RNA, 19 nt, Human
ccuucauuuggcauucccc

SEQ ID NO: 2986812 - RNA, 14 nt, Human
ccuucagugccaaa

SEQ ID NO: 2986813 - RNA, 11 nt, Human
ccuucagugcc

SEQ ID NO: 2986814 - RNA, 10 nt, Human
ccuucagugc

SEQ ID NO: 2986815 - RNA, 21 nt, Human
ccuucaccuuuguccccaccg

SEQ ID NO: 2986816 - RNA, 19 nt, Human
ccuucaccuuuguccccac

SEQ ID NO: 2986817 - RNA, 20 nt, Human
ccuucaccuuuguccccacc

SEQ ID NO: 2986818 - RNA, 17 nt, Human
ccuucacagaugggugc

SEQ ID NO: 2986819 - RNA, 14 nt, Human
ccuuagacaguccc

SEQ ID NO: 2986820 - RNA, 17 nt, Human
cgccaugcuccuggccc

SEQ ID NO: 2986821 - RNA, 17 nt, Human
cgccagauucuuuccug

SEQ ID NO: 2986822 - RNA, 19 nt, Human
cgccagauucuuuccugag

SEQ ID NO: 2986823 - RNA, 20 nt, Human
cgccagauucuuuccugagg

SEQ ID NO: 2986824 - RNA, 21 nt, Human
cgccagauucuuuccugaggc

SEQ ID NO: 2986825 - RNA, 22 nt, Human
cgccaggggaaaaucagccugc

SEQ ID NO: 2986826 - RNA, 15 nt, Human
cgcagacaggaccag

SEQ ID NO: 2986827 - RNA, 16 nt, Human
cgcagacaggaccagg

SEQ ID NO: 2986828 - RNA, 14 nt, Human
cgcagcccugcaga

SEQ ID NO: 2986829 - RNA, 20 nt, Human
cgauuucuguuuagauaaua

SEQ ID NO: 2986830 - RNA, 21 nt, Human
cgagccauuugucccaagugc

SEQ ID NO: 2986831 - RNA, 20 nt, Human
cgagccauuugucccaagug

SEQ ID NO: 2986832 - RNA, 19 nt, Human
cgagccauuugucccaagu

SEQ ID NO: 2986833 - RNA, 16 nt, Human
cgagccauuuguccca

SEQ ID NO: 2986834 - RNA, 18 nt, Human
cgagcaugccuggauggg

SEQ ID NO: 2986835 - RNA, 16 nt, Human
cgagcccugguggcag

SEQ ID NO: 2986836 - RNA, 15 nt, Human
cgagcccugguggca

SEQ ID NO: 2986837 - RNA, 23 nt, Human
cgagccauuugucccaagugcca

SEQ ID NO: 2986838 - RNA, 22 nt, Human
cgagccauuugucccaagugcc

SEQ ID NO: 2986839 - RNA, 14 nt, Human
cgagcaugccugga

SEQ ID NO: 2986840 - RNA, 13 nt, Human
cgagcaugccugg

SEQ ID NO: 2986841 - RNA, 16 nt, Human
cgagcaugccuggaug

SEQ ID NO: 2986842 - RNA, 17 nt, Human
cgagcaugccuggaugg

SEQ ID NO: 2986843 - RNA, 20 nt, Human
cgagcaggcuucuucccccc

SEQ ID NO: 2986844 - RNA, 18 nt, Human
cgagcaggcuacugucag

SEQ ID NO: 2986845 - RNA, 20 nt, Human
cgagaucacgccacugcacu

SEQ ID NO: 2986846 - RNA, 18 nt, Human
cgagaucacgccacugca

SEQ ID NO: 2986847 - RNA, 20 nt, Human
cgagauugcaccacugcacu

SEQ ID NO: 2986848 - RNA, 18 nt, Human
cgagauagccaaggccaa

SEQ ID NO: 2986849 - RNA, 17 nt, Human
cgagaucacgccacugc

SEQ ID NO: 2986850 - RNA, 14 nt, Human
cgaauagcugggac

SEQ ID NO: 2986851 - RNA, 13 nt, Human
cgaauagcuggga

SEQ ID NO: 2986852 - RNA, 17 nt, Human
cgacuugcauaccugcu

SEQ ID NO: 2986853 - RNA, 14 nt, Human
cgaacuggcugcaa

SEQ ID NO: 2986854 - RNA, 12 nt, Human
cgaacuggcugc

SEQ ID NO: 2986855 - RNA, 22 nt, Human
cgaaagggacuuggaagcuccg

SEQ ID NO: 2986856 - RNA, 20 nt, Human
cgaaaggaugaaagugacca

SEQ ID NO: 2986857 - RNA, 19 nt, Human
cgaaagggacuuggaagcu

SEQ ID NO: 2986858 - RNA, 12 nt, Human
cgaaagaacagu

SEQ ID NO: 2986859 - RNA, 21 nt, Human
cgaaagaacaguccauugaaa

SEQ ID NO: 2986860 - RNA, 23 nt, Human
cgaaagaaggcauggacuucugg

SEQ ID NO: 2986861 - RNA, 19 nt, Human
cgaaagaaggcauggacuu

SEQ ID NO: 2986862 - RNA, 12 nt, Human
cgaaagaaggca

SEQ ID NO: 2986863 - RNA, 18 nt, Human
cgaaaacguggcugcuuc

SEQ ID NO: 2986864 - RNA, 19 nt, Human
cgaaaacguggcugcuuca

SEQ ID NO: 2986865 - RNA, 15 nt, Human
cgaaaacguggcugc

SEQ ID NO: 2986866 - RNA, 20 nt, Human
cgaaaacguggcugcuucaa

SEQ ID NO: 2986867 - RNA, 20 nt, Human
ccuuugacgccaucccagcc

SEQ ID NO: 2986868 - RNA, 21 nt, Human
ccuuugacgccaucccagccc

SEQ ID NO: 2986869 - RNA, 22 nt, Human
ccuuugacgccaucccagcccc

SEQ ID NO: 2986870 - RNA, 16 nt, Human
ccugcaauaaaauggg

SEQ ID NO: 2986871 - RNA, 14 nt, Human
ccugcaagaacaag

SEQ ID NO: 2986872 - RNA, 22 nt, Human
ccugcaaccugauugugucucu

SEQ ID NO: 2986873 - RNA, 21 nt, Human
ccugcaaccugauugugucuc

SEQ ID NO: 2986874 - RNA, 17 nt, Human
ccugauugugucucuug

SEQ ID NO: 2986875 - RNA, 19 nt, Human
ccugauugugucucuuggu

SEQ ID NO: 2986876 - RNA, 11 nt, Human
ccugaggcccu

SEQ ID NO: 2986877 - RNA, 12 nt, Human
ccugaggcccuu

SEQ ID NO: 2986878 - RNA, 19 nt, Human
ccugaugcuucuucagaga

SEQ ID NO: 2986879 - RNA, 20 nt, Human
ccugaugcuucuucagagac

SEQ ID NO: 2986880 - RNA, 21 nt, Human
ccugaugcuucuucagagacu

SEQ ID NO: 2986881 - RNA, 22 nt, Human
ccugaugcuucuucagagacuc

SEQ ID NO: 2986882 - RNA, 15 nt, Human
ccugauugugucucu

SEQ ID NO: 2986883 - RNA, 13 nt, Human
ccugccaggaagc

SEQ ID NO: 2986884 - RNA, 14 nt, Human
ccugccaggaagcc

SEQ ID NO: 2986885 - RNA, 15 nt, Human
ccugccaggaagcca

SEQ ID NO: 2986886 - RNA, 17 nt, Human
ccugccaggaagccagc

SEQ ID NO: 2986887 - RNA, 15 nt, Human
ccugccaggcauggu

SEQ ID NO: 2986888 - RNA, 23 nt, Human
ccugccaggaagccagcaggcuc

SEQ ID NO: 2986889 - RNA, 16 nt, Human
ccugccaggcauggug

SEQ ID NO: 2986890 - RNA, 11 nt, Human
ccugccaggga

SEQ ID NO: 2986891 - RNA, 18 nt, Human
ccugccaggaagccagca

SEQ ID NO: 2986892 - RNA, 19 nt, Human
ccugccaggaagccagcag

SEQ ID NO: 2986893 - RNA, 21 nt, Human
ccugccaggaagccagcaggc

SEQ ID NO: 2986894 - RNA, 22 nt, Human
ccugccaggaagccagcaggcu

SEQ ID NO: 2986895 - RNA, 12 nt, Human
ccugccagggac

SEQ ID NO: 2986896 - RNA, 13 nt, Human
ccugccagggaca

SEQ ID NO: 2986897 - RNA, 14 nt, Human
ccugccagggacag

SEQ ID NO: 2986898 - RNA, 15 nt, Human
ccugccagggacaga

SEQ ID NO: 2986899 - RNA, 16 nt, Human
ccugccagggacagag

SEQ ID NO: 2986900 - RNA, 14 nt, Human
ccugagcuuucugc

SEQ ID NO: 2986901 - RNA, 11 nt, Human
ccugagcccca

SEQ ID NO: 2986902 - RNA, 20 nt, Human
ccugagccagauuucacucu

SEQ ID NO: 2986903 - RNA, 21 nt, Human
ccugaggcccagagggccugc

SEQ ID NO: 2986904 - RNA, 16 nt, Human
ccugagcuuucugcua

SEQ ID NO: 2986905 - RNA, 23 nt, Human
ccugacaacacucauugaccuga

SEQ ID NO: 2986906 - RNA, 23 nt, Human
ccuggaaaucaggguuaguauug

SEQ ID NO: 2986907 - RNA, 14 nt, Human
ccugcuucaaauau

SEQ ID NO: 2986908 - RNA, 22 nt, Human
ccugcucuccgaccagacaccu

SEQ ID NO: 2986909 - RNA, 20 nt, Human
ccugcugagccucacagcag

SEQ ID NO: 2986910 - RNA, 22 nt, Human
ccugcggugcuaucucccccag

SEQ ID NO: 2986911 - RNA, 21 nt, Human
ccugcucuccgaccagacacc

SEQ ID NO: 2986912 - RNA, 23 nt, Human
ccugccuguugggccaggagccu

SEQ ID NO: 2986913 - RNA, 22 nt, Human
ccugccccucaacucuccucca

SEQ ID NO: 2986914 - RNA, 16 nt, Human
ccugcggugcuaucuc

SEQ ID NO: 2986915 - RNA, 17 nt, Human
ccugcggugcuaucucc

SEQ ID NO: 2986916 - RNA, 22 nt, Human
ccugggcagcugccuccccucc

SEQ ID NO: 2986917 - RNA, 15 nt, Human
ccuggccagaugcac

SEQ ID NO: 2986918 - RNA, 18 nt, Human
ccuggaauauauaaccag

SEQ ID NO: 2986919 - RNA, 12 nt, Human
ccuggcagcccc

SEQ ID NO: 2986920 - RNA, 13 nt, Human
ccuggcagccccu

SEQ ID NO: 2986921 - RNA, 23 nt, Human
ccuggcacccggccccugcuggu

SEQ ID NO: 2986922 - RNA, 22 nt, Human
ccuggcacccggccccugcugg

SEQ ID NO: 2986923 - RNA, 19 nt, Human
ccaguguuuuaggagcaug

SEQ ID NO: 2986924 - RNA, 22 nt, Human
ccaguguuguggauuuaacaga

SEQ ID NO: 2986925 - RNA, 11 nt, Human
ccagugccucu

SEQ ID NO: 2986926 - RNA, 14 nt, Human
ccaguuauggcuau

SEQ ID NO: 2986927 - RNA, 21 nt, Human
ccaguuauggcuauaggugcu

SEQ ID NO: 2986928 - RNA, 23 nt, Human
ccauauucuguuggccaguguga

SEQ ID NO: 2986929 - RNA, 20 nt, Human
ccagugccgagaaggaagcc

SEQ ID NO: 2986930 - RNA, 22 nt, Human
ccagugguuccuaauccucuag

SEQ ID NO: 2986931 - RNA, 14 nt, Human
ccagugaggcucug

SEQ ID NO: 2986932 - RNA, 15 nt, Human
ccagugaggcucugc

SEQ ID NO: 2986933 - RNA, 16 nt, Human
ccagugaggcucugcc

SEQ ID NO: 2986934 - RNA, 23 nt, Human
ccagugcccacaggaucagucug

SEQ ID NO: 2986935 - RNA, 17 nt, Human
ccaggcuuagucacuga

SEQ ID NO: 2986936 - RNA, 24 nt, Human
ccaggcuguaucccaugagccuca

SEQ ID NO: 2986937 - RNA, 20 nt, Human
ccaggcccucugcccacucc

SEQ ID NO: 2986938 - RNA, 21 nt, Human
ccaggcccucugcccacuccc

SEQ ID NO: 2986939 - RNA, 22 nt, Human
ccaggcccucugcccacucccu

SEQ ID NO: 2986940 - RNA, 23 nt, Human
ccaggcccucugcccacucccug

SEQ ID NO: 2986941 - RNA, 17 nt, Human
ccaggcauuccccagga

SEQ ID NO: 2986942 - RNA, 18 nt, Human
ccaggcauuccccaggag

SEQ ID NO: 2986943 - RNA, 19 nt, Human
ccaggcauuccccaggagg

SEQ ID NO: 2986944 - RNA, 21 nt, Human
ccaggcauuccccaggaggcc

SEQ ID NO: 2986945 - RNA, 19 nt, Human
ccaggagccccgaggccuu

SEQ ID NO: 2986946 - RNA, 16 nt, Human
ccaggagccccgaggc

SEQ ID NO: 2986947 - RNA, 20 nt, Human
ccaggagccccgaggccuuc

SEQ ID NO: 2986948 - RNA, 19 nt, Human
ccaggagccuccugcccuu

SEQ ID NO: 2986949 - RNA, 22 nt, Human
ccagggacagaggggguggccu

SEQ ID NO: 2986950 - RNA, 20 nt, Human
ccaggcuuagucacugagac

SEQ ID NO: 2986951 - RNA, 14 nt, Human
ccagggacagaggg

SEQ ID NO: 2986952 - RNA, 15 nt, Human
ccagggacagagggg

SEQ ID NO: 2986953 - RNA, 21 nt, Human
ccagggacagaggggguggcc

SEQ ID NO: 2986954 - RNA, 19 nt, Human
ccaggugcacaagcuccaa

SEQ ID NO: 2986955 - RNA, 20 nt, Human
ccaggugcacaagcuccaag

SEQ ID NO: 2986956 - RNA, 18 nt, Human
ccaggugcacaagcucca

SEQ ID NO: 2986957 - RNA, 16 nt, Human
ccagggccaugucaga

SEQ ID NO: 2986958 - RNA, 18 nt, Human
ccagucuggaaugcagug

SEQ ID NO: 2986959 - RNA, 13 nt, Human
ccagugaggcucu

SEQ ID NO: 2986960 - RNA, 20 nt, Human
ccagucuggaaugcaguggu

SEQ ID NO: 2986961 - RNA, 19 nt, Human
ccagucuggaaugcagugg

SEQ ID NO: 2986962 - RNA, 17 nt, Human
ccagguuuuuggucuga

SEQ ID NO: 2986963 - RNA, 24 nt, Human
ccaggugcacaagcuccaagcucc

SEQ ID NO: 2986964 - RNA, 15 nt, Human
ccagguucagcuugu

SEQ ID NO: 2986965 - RNA, 19 nt, Human
ccaugggacagggaggacg

SEQ ID NO: 2986966 - RNA, 16 nt, Human
ccaugggacagggagg

SEQ ID NO: 2986967 - RNA, 16 nt, Human
ccauguuggccaggcu

SEQ ID NO: 2986968 - RNA, 17 nt, Human
ccauguuggccaggcug

SEQ ID NO: 2986969 - RNA, 18 nt, Human
ccauucuccaccugccag

SEQ ID NO: 2986970 - RNA, 19 nt, Human
ccauauucuguuggccagu

SEQ ID NO: 2986971 - RNA, 21 nt, Human
ccaucugcgggggcagugcuc

SEQ ID NO: 2986972 - RNA, 20 nt, Human
ccaucugcgggggcagugcu

SEQ ID NO: 2986973 - RNA, 22 nt, Human
ccaucugcgggggcagugcuca

SEQ ID NO: 2986974 - RNA, 16 nt, Human
cccaaagugcugggau

SEQ ID NO: 2986975 - RNA, 18 nt, Human
cccaaauggaaaugggca

SEQ ID NO: 2986976 - RNA, 22 nt, Human
cccaaauggaaaugggcagagc

SEQ ID NO: 2986977 - RNA, 23 nt, Human
cccaaggccuuccccuggcacug

SEQ ID NO: 2986978 - RNA, 19 nt, Human
ccauucuccaccugccagg

SEQ ID NO: 2986979 - RNA, 20 nt, Human
ccauucuccaccugccaggg

SEQ ID NO: 2986980 - RNA, 14 nt, Human
ccauuuguguuuau

SEQ ID NO: 2986981 - RNA, 17 nt, Human
ccauuugucccaagugc

SEQ ID NO: 2986982 - RNA, 15 nt, Human
ccauuugucccaagu

SEQ ID NO: 2986983 - RNA, 13 nt, Human
ccauuugucccaa

SEQ ID NO: 2986984 - RNA, 16 nt, Human
cccaaaacucuccucu

SEQ ID NO: 2986985 - RNA, 18 nt, Human
cccaaaacucuccucugc

SEQ ID NO: 2986986 - RNA, 15 nt, Human
cccaaagugcuggga

SEQ ID NO: 2986987 - RNA, 13 nt, Human
cccaaagugcugg

SEQ ID NO: 2986988 - RNA, 17 nt, Human
ccaccucccacaaagga

SEQ ID NO: 2986989 - RNA, 17 nt, Human
ccaccugccuguugggc

SEQ ID NO: 2986990 - RNA, 20 nt, Human
ccaccugccuguugggccag

SEQ ID NO: 2986991 - RNA, 16 nt, Human
ccaccugccagggaca

SEQ ID NO: 2986992 - RNA, 17 nt, Human
ccaccuggccucugcac

SEQ ID NO: 2986993 - RNA, 14 nt, Human
ccaccuggccucug

SEQ ID NO: 2986994 - RNA, 22 nt, Human
ccaccugcggugcuaucucccc

SEQ ID NO: 2986995 - RNA, 15 nt, Human
ccaccuggccucugc

SEQ ID NO: 2986996 - RNA, 16 nt, Human
ccaccuggccucugca

SEQ ID NO: 2986997 - RNA, 14 nt, Human
ccacggccaggcca

SEQ ID NO: 2986998 - RNA, 13 nt, Human
ccacggccaggcc

SEQ ID NO: 2986999 - RNA, 12 nt, Human
ccacggccaggc

SEQ ID NO: 2987000 - RNA, 15 nt, Human
ccacggccaggccag

SEQ ID NO: 2987001 - RNA, 14 nt, Human
ccacccaggagccc

SEQ ID NO: 2987002 - RNA, 12 nt, Human
ccacccaggagc

SEQ ID NO: 2987003 - RNA, 15 nt, Human
ccaccucagccuccc

SEQ ID NO: 2987004 - RNA, 14 nt, Human
ccaccucagccucc

SEQ ID NO: 2987005 - RNA, 13 nt, Human
ccaccucagccuc

SEQ ID NO: 2987006 - RNA, 16 nt, Human
ccacccugaaagcccu

SEQ ID NO: 2987007 - RNA, 17 nt, Human
ccacccugaaagcccug

SEQ ID NO: 2987008 - RNA, 18 nt, Human
ccacccugaaagcccuga

SEQ ID NO: 2987009 - RNA, 12 nt, Human
ccaccucagccu

SEQ ID NO: 2987010 - RNA, 18 nt, Human
ccacuacauucuguuaau

SEQ ID NO: 2987011 - RNA, 22 nt, Human
ccacuacggaauaguuggcuag

SEQ ID NO: 2987012 - RNA, 23 nt, Human
ccacuacggaauaguuggcuagg

SEQ ID NO: 2987013 - RNA, 12 nt, Human
ccacucccugca

SEQ ID NO: 2987014 - RNA, 13 nt, Human
ccacucccugcaa

SEQ ID NO: 2987015 - RNA, 18 nt, Human
ccacucaguccauagcag

SEQ ID NO: 2987016 - RNA, 16 nt, Human
ccacugcgaccacaag

SEQ ID NO: 2987017 - RNA, 20 nt, Human
ccacugcacuccagccuggg

SEQ ID NO: 2987018 - RNA, 19 nt, Human
ccacugcacuccagccugg

SEQ ID NO: 2987019 - RNA, 15 nt, Human
ccacucccugcaacc

SEQ ID NO: 2987020 - RNA, 18 nt, Human
ccacugcacuccagccug

SEQ ID NO: 2987021 - RNA, 13 nt, Human
ccacguuucuaaa

SEQ ID NO: 2987022 - RNA, 20 nt, Human
ccacccaagggccuggccug

SEQ ID NO: 2987023 - RNA, 21 nt, Human
ccacccaagggccuggccuga

SEQ ID NO: 2987024 - RNA, 22 nt, Human
ccacccaagggccuggccugag

SEQ ID NO: 2987025 - RNA, 13 nt, Human
ccacccaccucag

SEQ ID NO: 2987026 - RNA, 15 nt, Human
ccacccaccucagcc

SEQ ID NO: 2987027 - RNA, 14 nt, Human
ccacccaccucagc

SEQ ID NO: 2987028 - RNA, 16 nt, Human
ccacccaccucagccu

SEQ ID NO: 2987029 - RNA, 17 nt, Human
ccacccaagggccuggc

SEQ ID NO: 2987030 - RNA, 19 nt, Human
ccacccaagggccuggccu

SEQ ID NO: 2987031 - RNA, 16 nt, Human
ccacccaagggccugg

SEQ ID NO: 2987032 - RNA, 20 nt, Human
ccaccaacauacucccaucu

SEQ ID NO: 2987033 - RNA, 16 nt, Human
ccaccacacccagccc

SEQ ID NO: 2987034 - RNA, 14 nt, Human
ccaccacacccagc

SEQ ID NO: 2987035 - RNA, 14 nt, Human
ccacaucuugcucu

SEQ ID NO: 2987036 - RNA, 23 nt, Human
ccacaucuugcucugcugacaga

SEQ ID NO: 2987037 - RNA, 22 nt, Human
ccacaucuugcucugcugacag

SEQ ID NO: 2987038 - RNA, 20 nt, Human
ccacaucuugcucugcugac

SEQ ID NO: 2987039 - RNA, 16 nt, Human
ccacaucuugcucugc

SEQ ID NO: 2987040 - RNA, 14 nt, Human
ccaccaacauacuc

SEQ ID NO: 2987041 - RNA, 18 nt, Human
ccaccaacauacucccau

SEQ ID NO: 2987042 - RNA, 23 nt, Human
ccacaccauaagcuacugccauc

SEQ ID NO: 2987043 - RNA, 12 nt, Human
ccacacccagcc

SEQ ID NO: 2987044 - RNA, 14 nt, Human
ccacacccagccca

SEQ ID NO: 2987045 - RNA, 13 nt, Human
ccacacccagccc

SEQ ID NO: 2987046 - RNA, 22 nt, Human
ccagcaguucagagcugcccuc

SEQ ID NO: 2987047 - RNA, 21 nt, Human
ccagcaguucagagcugcccu

SEQ ID NO: 2987048 - RNA, 20 nt, Human
ccagcaguucagagcugccc

SEQ ID NO: 2987049 - RNA, 19 nt, Human
ccagcaguucagagcugcc

SEQ ID NO: 2987050 - RNA, 18 nt, Human
ccagcaguucagagcugc

SEQ ID NO: 2987051 - RNA, 13 nt, Human
ccagcaguucaga

SEQ ID NO: 2987052 - RNA, 23 nt, Human
ccagcaguucagagcugcccucu

SEQ ID NO: 2987053 - RNA, 13 nt, Human
ccagccaggcccu

SEQ ID NO: 2987054 - RNA, 22 nt, Human
ccagccagcaguucagagcugc

SEQ ID NO: 2987055 - RNA, 18 nt, Human
ccagccaaagccuccucc

SEQ ID NO: 2987056 - RNA, 19 nt, Human
ccagccaaagccuccucca

SEQ ID NO: 2987057 - RNA, 15 nt, Human
ccagccaaagccucc

SEQ ID NO: 2987058 - RNA, 18 nt, Human
ccagccgccaugcuccug

SEQ ID NO: 2987059 - RNA, 19 nt, Human
ccagccgccaugcuccugg

SEQ ID NO: 2987060 - RNA, 14 nt, Human
ccagccgccaugcu

SEQ ID NO: 2987061 - RNA, 23 nt, Human
ccagccgagauagccaaggccaa

SEQ ID NO: 2987062 - RNA, 17 nt, Human
ccagcccuuagcaggga

SEQ ID NO: 2987063 - RNA, 16 nt, Human
ccagcccuuagcaggg

SEQ ID NO: 2987064 - RNA, 16 nt, Human
ccagccccagugccca

SEQ ID NO: 2987065 - RNA, 23 nt, Human
ccagccccaaaacucuccucugc

SEQ ID NO: 2987066 - RNA, 15 nt, Human
ccagccccagugccc

SEQ ID NO: 2987067 - RNA, 13 nt, Human
ccagccccagugc

SEQ ID NO: 2987068 - RNA, 15 nt, Human
ccagcaauuaugaaa

SEQ ID NO: 2987069 - RNA, 22 nt, Human
ccagcaagugagagcugggugu

SEQ ID NO: 2987070 - RNA, 21 nt, Human
ccagcaagugagagcugggug

SEQ ID NO: 2987071 - RNA, 20 nt, Human
ccagcaagugagagcugggu

SEQ ID NO: 2987072 - RNA, 16 nt, Human
ccagcaagugagagcu

SEQ ID NO: 2987073 - RNA, 14 nt, Human
ccagauuucacucu

SEQ ID NO: 2987074 - RNA, 15 nt, Human
ccagcaagugagagc

SEQ ID NO: 2987075 - RNA, 22 nt, Human
ccagaggagagaggacccccug

SEQ ID NO: 2987076 - RNA, 21 nt, Human
ccagaggagagaggacccccu

SEQ ID NO: 2987077 - RNA, 21 nt, Human
ccagagggagugacagaggca

SEQ ID NO: 2987078 - RNA, 20 nt, Human
ccagagggagugacagaggc

SEQ ID NO: 2987079 - RNA, 19 nt, Human
ccagagggagugacagagg

SEQ ID NO: 2987080 - RNA, 18 nt, Human
ccagagggagugacagag

SEQ ID NO: 2987081 - RNA, 17 nt, Human
ccagagggagugacaga

SEQ ID NO: 2987082 - RNA, 16 nt, Human
ccagagggagugacag

SEQ ID NO: 2987083 - RNA, 14 nt, Human
ccagagcugccacc

SEQ ID NO: 2987084 - RNA, 15 nt, Human
ccagagcugccaccu

SEQ ID NO: 2987085 - RNA, 16 nt, Human
ccagagcugccaccug

SEQ ID NO: 2987086 - RNA, 19 nt, Human
ccagagcugccaccugccu

SEQ ID NO: 2987087 - RNA, 12 nt, Human
ccagagcugcca

SEQ ID NO: 2987088 - RNA, 13 nt, Human
ccagagcugccac

SEQ ID NO: 2987089 - RNA, 11 nt, Human
ccagagcugcc

SEQ ID NO: 2987090 - RNA, 14 nt, Human
ccagagaggguggu

SEQ ID NO: 2987091 - RNA, 23 nt, Human
ccagagaggguggugaccucugc

SEQ ID NO: 2987092 - RNA, 21 nt, Human
ccagagaggguggugaccucu

SEQ ID NO: 2987093 - RNA, 19 nt, Human
ccagacaccuugacagggc

SEQ ID NO: 2987094 - RNA, 17 nt, Human
ccagacaccuugacagg

SEQ ID NO: 2987095 - RNA, 12 nt, Human
ccagauuucacu

SEQ ID NO: 2987096 - RNA, 21 nt, Human
ccagauugcaacaggcugggc

SEQ ID NO: 2987097 - RNA, 18 nt, Human
ccagauugcaacaggcug

SEQ ID NO: 2987098 - RNA, 23 nt, Human
ccagauucuuuccugaggcuggg

SEQ ID NO: 2987099 - RNA, 20 nt, Human
ccagauugcaacaggcuggg

SEQ ID NO: 2987100 - RNA, 19 nt, Human
ccagauugcaacaggcugg

SEQ ID NO: 2987101 - RNA, 15 nt, Human
ccagagggccugcaa

SEQ ID NO: 2987102 - RNA, 16 nt, Human
ccagagggccugcaag

SEQ ID NO: 2987103 - RNA, 23 nt, Human
ccagaugcaccagcccuuagcag

SEQ ID NO: 2987104 - RNA, 23 nt, Human
ccagagggagugacagaggcagc

SEQ ID NO: 2987105 - RNA, 22 nt, Human
ccagagggagugacagaggcag

SEQ ID NO: 2987106 - RNA, 13 nt, Human
ccagagggccugc

SEQ ID NO: 2987107 - RNA, 19 nt, Human
ccagauucuuuccugaggc

SEQ ID NO: 2987108 - RNA, 20 nt, Human
ccagauucuuuccugaggcu

SEQ ID NO: 2987109 - RNA, 21 nt, Human
ccagauucuuuccugaggcug

SEQ ID NO: 2987110 - RNA, 22 nt, Human
ccagauucuuuccugaggcugg

SEQ ID NO: 2987111 - RNA, 18 nt, Human
ccagauucuuuccugagg

SEQ ID NO: 2987112 - RNA, 21 nt, Human
cauauugcauacuauuaaaca

SEQ ID NO: 2987113 - RNA, 19 nt, Human
cauauugcauacuauuaaa

SEQ ID NO: 2987114 - RNA, 21 nt, Human
cauauugauuuccguuaaaau

SEQ ID NO: 2987115 - RNA, 22 nt, Human
cauauugcauacuauuaaacau

SEQ ID NO: 2987116 - RNA, 17 nt, Human
cauauugauuuccguua

SEQ ID NO: 2987117 - RNA, 22 nt, Human
cauauucuguuggccaguguga

SEQ ID NO: 2987118 - RNA, 20 nt, Human
cauaucucuuaucuuacgaa

SEQ ID NO: 2987119 - RNA, 23 nt, Human
cauaucucuuaucuuacgaaaaa

SEQ ID NO: 2987120 - RNA, 17 nt, Human
cauauuuaauuugaagg

SEQ ID NO: 2987121 - RNA, 16 nt, Human
cauagguuuaauaauu

SEQ ID NO: 2987122 - RNA, 19 nt, Human
cagugcucacccacaccau

SEQ ID NO: 2987123 - RNA, 15 nt, Human
cauaguaugguggcu

SEQ ID NO: 2987124 - RNA, 16 nt, Human
cauaguaugguggcug

SEQ ID NO: 2987125 - RNA, 23 nt, Human
cauauaagauucauauuuacuuc

SEQ ID NO: 2987126 - RNA, 13 nt, Human
cauauauaacaau

SEQ ID NO: 2987127 - RNA, 15 nt, Human
cauauauaacaaugc

SEQ ID NO: 2987128 - RNA, 23 nt, Human
cauauauauguuuuaagaggcag

SEQ ID NO: 2987129 - RNA, 14 nt, Human
caucaacaucuugg

SEQ ID NO: 2987130 - RNA, 14 nt, Human
caucccuuucccuu

SEQ ID NO: 2987131 - RNA, 17 nt, Human
caucccuuucccuuggu

SEQ ID NO: 2987132 - RNA, 18 nt, Human
caucccuuaccugggaaa

SEQ ID NO: 2987133 - RNA, 23 nt, Human
caucccucccuccaccucccugc

SEQ ID NO: 2987134 - RNA, 22 nt, Human
caucccucccuccaccucccug

SEQ ID NO: 2987135 - RNA, 15 nt, Human
caucccucuggggcu

SEQ ID NO: 2987136 - RNA, 22 nt, Human
caucccugaaggccccgcccag

SEQ ID NO: 2987137 - RNA, 20 nt, Human
caucccucccuccaccuccc

SEQ ID NO: 2987138 - RNA, 17 nt, Human
cauccagguucagcuug

SEQ ID NO: 2987139 - RNA, 23 nt, Human
cauccacugugccaugugccagg

SEQ ID NO: 2987140 - RNA, 17 nt, Human
cauccacugugccaugu

SEQ ID NO: 2987141 - RNA, 14 nt, Human
cauccacugugcca

SEQ ID NO: 2987142 - RNA, 11 nt, Human
caucaucccuu

SEQ ID NO: 2987143 - RNA, 16 nt, Human
caucauccuaagcuau

SEQ ID NO: 2987144 - RNA, 15 nt, Human
caucaugucuggcua

SEQ ID NO: 2987145 - RNA, 14 nt, Human
caucaugucuggcu

SEQ ID NO: 2987146 - RNA, 13 nt, Human
caucaugucuggc

SEQ ID NO: 2987147 - RNA, 20 nt, Human
caucaccaacgucugugcca

SEQ ID NO: 2987148 - RNA, 12 nt, Human
caucacccgcua

SEQ ID NO: 2987149 - RNA, 17 nt, Human
caucuugcucugcugac

SEQ ID NO: 2987150 - RNA, 16 nt, Human
caucuugcucugcuga

SEQ ID NO: 2987151 - RNA, 19 nt, Human
caucuugcucugcugacag

SEQ ID NO: 2987152 - RNA, 15 nt, Human
caucuugcucugcug

SEQ ID NO: 2987153 - RNA, 16 nt, Human
caucuugaauuguaag

SEQ ID NO: 2987154 - RNA, 21 nt, Human
caucuugaauuguaaggaaug

SEQ ID NO: 2987155 - RNA, 15 nt, Human
caucucuccuccuuu

SEQ ID NO: 2987156 - RNA, 16 nt, Human
caucucuacaaaaagc

SEQ ID NO: 2987157 - RNA, 21 nt, Human
caugaaaacacauuuuucuua

SEQ ID NO: 2987158 - RNA, 19 nt, Human
caugaaaacacauuuuucu

SEQ ID NO: 2987159 - RNA, 14 nt, Human
caugaaagauucaa

SEQ ID NO: 2987160 - RNA, 17 nt, Human
caugaaagacuucucua

SEQ ID NO: 2987161 - RNA, 12 nt, Human
caugaagacaga

SEQ ID NO: 2987162 - RNA, 17 nt, Human
caugaaaacacauuuuu

SEQ ID NO: 2987163 - RNA, 16 nt, Human
caugaaaacacauuuu

SEQ ID NO: 2987164 - RNA, 15 nt, Human
caugaaaacacauuu

SEQ ID NO: 2987165 - RNA, 14 nt, Human
caugaaaacacauu

SEQ ID NO: 2987166 - RNA, 13 nt, Human
caugaaaacacau

SEQ ID NO: 2987167 - RNA, 18 nt, Human
caugagggagaugccaug

SEQ ID NO: 2987168 - RNA, 16 nt, Human
caugagguacugagag

SEQ ID NO: 2987169 - RNA, 23 nt, Human
caugaggaacaaggcaaggcugu

SEQ ID NO: 2987170 - RNA, 16 nt, Human
caugaggaacaaggca

SEQ ID NO: 2987171 - RNA, 17 nt, Human
caugaggaacaaggcaa

SEQ ID NO: 2987172 - RNA, 20 nt, Human
caugaggaacaaggcaaggc

SEQ ID NO: 2987173 - RNA, 21 nt, Human
caugaggaacaaggcaaggcu

SEQ ID NO: 2987174 - RNA, 23 nt, Human
caugagccucagcauccuggcac

SEQ ID NO: 2987175 - RNA, 22 nt, Human
caugagccucagcauccuggca

SEQ ID NO: 2987176 - RNA, 13 nt, Human
caugaguccccug

SEQ ID NO: 2987177 - RNA, 19 nt, Human
caugagguacugagaguga

SEQ ID NO: 2987178 - RNA, 14 nt, Human
caugaguccccugu

SEQ ID NO: 2987179 - RNA, 15 nt, Human
caugaguccccuguu

SEQ ID NO: 2987180 - RNA, 23 nt, Human
caugaguccccuguuuguuucug

SEQ ID NO: 2987181 - RNA, 15 nt, Human
caugagcaucaggcc

SEQ ID NO: 2987182 - RNA, 16 nt, Human
caugagcaucaggcca

SEQ ID NO: 2987183 - RNA, 17 nt, Human
caugagcaucaggccag

SEQ ID NO: 2987184 - RNA, 18 nt, Human
caugagcaucaggccagg

SEQ ID NO: 2987185 - RNA, 20 nt, Human
caugagcaucaggccaggcc

SEQ ID NO: 2987186 - RNA, 21 nt, Human
caugagcaucaggccaggccc

SEQ ID NO: 2987187 - RNA, 22 nt, Human
caugagcaucaggccaggcccu

SEQ ID NO: 2987188 - RNA, 23 nt, Human
caugagcaucaggccaggcccuc

SEQ ID NO: 2987189 - RNA, 21 nt, Human
caugagccucagcauccuggc

SEQ ID NO: 2987190 - RNA, 20 nt, Human
caugagccucagcauccugg

SEQ ID NO: 2987191 - RNA, 19 nt, Human
caugagccucagcauccug

SEQ ID NO: 2987192 - RNA, 18 nt, Human
caugagccucagcauccu

SEQ ID NO: 2987193 - RNA, 17 nt, Human
caugagccucagcaucc

SEQ ID NO: 2987194 - RNA, 15 nt, Human
caugagccucagcau

SEQ ID NO: 2987195 - RNA, 12 nt, Human
caugagccucag

SEQ ID NO: 2987196 - RNA, 22 nt, Human
caugagccgcccaaggccuucc

SEQ ID NO: 2987197 - RNA, 21 nt, Human
caugagccgcccaaggccuuc

SEQ ID NO: 2987198 - RNA, 19 nt, Human
caugagccgcccaaggccu

SEQ ID NO: 2987199 - RNA, 17 nt, Human
caugagccgcccaaggc

SEQ ID NO: 2987200 - RNA, 16 nt, Human
caugagccgcccaagg

SEQ ID NO: 2987201 - RNA, 19 nt, Human
caugaagauguagaggaga

SEQ ID NO: 2987202 - RNA, 18 nt, Human
caugaagauguagaggag

SEQ ID NO: 2987203 - RNA, 13 nt, Human
caugagcaucagg

SEQ ID NO: 2987204 - RNA, 13 nt, Human
caugcuguacaua

SEQ ID NO: 2987205 - RNA, 21 nt, Human
caugcuguacauacuuuuugg

SEQ ID NO: 2987206 - RNA, 19 nt, Human
caugcuguacauacuuuuu

SEQ ID NO: 2987207 - RNA, 16 nt, Human
caugcuguacauacuu

SEQ ID NO: 2987208 - RNA, 15 nt, Human
caugcuguucaugaa

SEQ ID NO: 2987209 - RNA, 13 nt, Human
caugcugucccuu

SEQ ID NO: 2987210 - RNA, 15 nt, Human
caugcugucccuuac

SEQ ID NO: 2987211 - RNA, 15 nt, Human
cauggacuuccacug

SEQ ID NO: 2987212 - RNA, 18 nt, Human
caugcuguucaugaaaga

SEQ ID NO: 2987213 - RNA, 16 nt, Human
caugcuguucaugaaa

SEQ ID NO: 2987214 - RNA, 20 nt, Human
cauggaauuggagcucgugg

SEQ ID NO: 2987215 - RNA, 19 nt, Human
cauggaauucacaaaguaa

SEQ ID NO: 2987216 - RNA, 23 nt, Human
caugggacagggaggacgcucuc

SEQ ID NO: 2987217 - RNA, 18 nt, Human
caugggccuccugugugu

SEQ ID NO: 2987218 - RNA, 20 nt, Human
cauguuuuucuucucccuca

SEQ ID NO: 2987219 - RNA, 19 nt, Human
cauguuuuucuucucccuc

SEQ ID NO: 2987220 - RNA, 14 nt, Human
cauguuugugauug

SEQ ID NO: 2987221 - RNA, 12 nt, Human
cauguuugugau

SEQ ID NO: 2987222 - RNA, 19 nt, Human
cauggucggaaaacaugcu

SEQ ID NO: 2987223 - RNA, 17 nt, Human
cauggucggaaaacaug

SEQ ID NO: 2987224 - RNA, 23 nt, Human
cauggucggaaaacaugcuacac

SEQ ID NO: 2987225 - RNA, 16 nt, Human
caugguuuggagcuga

SEQ ID NO: 2987226 - RNA, 15 nt, Human
caugguuuggagcug

SEQ ID NO: 2987227 - RNA, 14 nt, Human
caugguuuggagcu

SEQ ID NO: 2987228 - RNA, 18 nt, Human
caugguuuggagcugauc

SEQ ID NO: 2987229 - RNA, 12 nt, Human
caugucuggcua

SEQ ID NO: 2987230 - RNA, 21 nt, Human
caugugaugagaggaaaucac

SEQ ID NO: 2987231 - RNA, 18 nt, Human
caugugaugagaggaaau

SEQ ID NO: 2987232 - RNA, 20 nt, Human
caugugaugagaggaaauca

SEQ ID NO: 2987233 - RNA, 16 nt, Human
caugugaugagaggaa

SEQ ID NO: 2987234 - RNA, 17 nt, Human
caugugaugagaggaaa

SEQ ID NO: 2987235 - RNA, 15 nt, Human
caugugaugagagga

SEQ ID NO: 2987236 - RNA, 14 nt, Human
caugugcacaugca

SEQ ID NO: 2987237 - RNA, 22 nt, Human
caugugccagguuuuuggucug

SEQ ID NO: 2987238 - RNA, 20 nt, Human
caugugcuaguaauuggaaa

SEQ ID NO: 2987239 - RNA, 14 nt, Human
cauucuuuuugaaa

SEQ ID NO: 2987240 - RNA, 16 nt, Human
cauucuuuuugaaaug

SEQ ID NO: 2987241 - RNA, 13 nt, Human
cauucuuuuugaa

SEQ ID NO: 2987242 - RNA, 15 nt, Human
cauugaccugaggcc

SEQ ID NO: 2987243 - RNA, 17 nt, Human
cauugaccugaggcccu

SEQ ID NO: 2987244 - RNA, 14 nt, Human
cauugaccugaggc

SEQ ID NO: 2987245 - RNA, 18 nt, Human
cauugaccugaggcccuu

SEQ ID NO: 2987246 - RNA, 21 nt, Human
cauuguaaaugugcuuuuaaa

SEQ ID NO: 2987247 - RNA, 15 nt, Human
cauugugggaagggg

SEQ ID NO: 2987248 - RNA, 13 nt, Human
cauugugggaagg

SEQ ID NO: 2987249 - RNA, 15 nt, Human
cauuuaaaaaaaauc

SEQ ID NO: 2987250 - RNA, 19 nt, Human
cauuugaaaauuuugaugu

SEQ ID NO: 2987251 - RNA, 17 nt, Human
cauuugaaaauuuugau

SEQ ID NO: 2987252 - RNA, 16 nt, Human
ccaaacccuucagugc

SEQ ID NO: 2987253 - RNA, 21 nt, Human
cauuuuuaagugcugcauuua

SEQ ID NO: 2987254 - RNA, 17 nt, Human
cauuuuuaguagagaca

SEQ ID NO: 2987255 - RNA, 19 nt, Human
cauuuuacacacuguacac

SEQ ID NO: 2987256 - RNA, 23 nt, Human
cauuuuauuuuauuaugcaugaa

SEQ ID NO: 2987257 - RNA, 22 nt, Human
cauuuuauuuuauuaugcauga

SEQ ID NO: 2987258 - RNA, 13 nt, Human
cauuugcugaaua

SEQ ID NO: 2987259 - RNA, 22 nt, Human
cauuugaggucuguucuuucca

SEQ ID NO: 2987260 - RNA, 13 nt, Human
cauucuuggccca

SEQ ID NO: 2987261 - RNA, 16 nt, Human
cauucuuggcccagga

SEQ ID NO: 2987262 - RNA, 23 nt, Human
cauucuucuguacgucugacagg

SEQ ID NO: 2987263 - RNA, 14 nt, Human
cauuccugaugcuu

SEQ ID NO: 2987264 - RNA, 16 nt, Human
cauuccugaugcuucu

SEQ ID NO: 2987265 - RNA, 19 nt, Human
cauuccugaugcuucuuca

SEQ ID NO: 2987266 - RNA, 22 nt, Human
cauuccugaugcuucuucagag

SEQ ID NO: 2987267 - RNA, 14 nt, Human
cauuccugaacagg

SEQ ID NO: 2987268 - RNA, 23 nt, Human
cauuccugaugcuucuucagaga

SEQ ID NO: 2987269 - RNA, 20 nt, Human
cauucugccugcccaggccc

SEQ ID NO: 2987270 - RNA, 19 nt, Human
cauucugccugcccaggcc

SEQ ID NO: 2987271 - RNA, 18 nt, Human
cauucugccugcccaggc

SEQ ID NO: 2987272 - RNA, 17 nt, Human
cauucugccugcccagg

SEQ ID NO: 2987273 - RNA, 16 nt, Human
cauucugccugcccag

SEQ ID NO: 2987274 - RNA, 15 nt, Human
cauucugccugccca

SEQ ID NO: 2987275 - RNA, 13 nt, Human
cauucugccugcc

SEQ ID NO: 2987276 - RNA, 12 nt, Human
cauucugccugc

SEQ ID NO: 2987277 - RNA, 17 nt, Human
cauucuguuaaucauua

SEQ ID NO: 2987278 - RNA, 13 nt, Human
cauucuggaauaa

SEQ ID NO: 2987279 - RNA, 20 nt, Human
cauucaaauguauuacagug

SEQ ID NO: 2987280 - RNA, 18 nt, Human
cauuccccaggaggccag

SEQ ID NO: 2987281 - RNA, 19 nt, Human
cauuccccaggaggccagc

SEQ ID NO: 2987282 - RNA, 20 nt, Human
cauuccccaggaggccagcc

SEQ ID NO: 2987283 - RNA, 15 nt, Human
cauuccccaggaggc

SEQ ID NO: 2987284 - RNA, 17 nt, Human
cauuccccaggaggcca

SEQ ID NO: 2987285 - RNA, 13 nt, Human
cauuccccaggag

SEQ ID NO: 2987286 - RNA, 21 nt, Human
cauucagauaugauucaaaug

SEQ ID NO: 2987287 - RNA, 22 nt, Human
cauuccaacuaucucauuucca

SEQ ID NO: 2987288 - RNA, 18 nt, Human
caguacuaacauuuauuu

SEQ ID NO: 2987289 - RNA, 21 nt, Human
caguaaugagcuuaagaaauu

SEQ ID NO: 2987290 - RNA, 17 nt, Human
caguaauaaaugaaugu

SEQ ID NO: 2987291 - RNA, 21 nt, Human
caguaauaaaugaaugucacu

SEQ ID NO: 2987292 - RNA, 13 nt, Human
caguaauaacucu

SEQ ID NO: 2987293 - RNA, 12 nt, Human
caguaauaacuc

SEQ ID NO: 2987294 - RNA, 13 nt, Human
caguaacauagcu

SEQ ID NO: 2987295 - RNA, 22 nt, Human
caguaaaugggggugcauuuga

SEQ ID NO: 2987296 - RNA, 21 nt, Human
caguaaaugggggugcauuug

SEQ ID NO: 2987297 - RNA, 20 nt, Human
caguaaaugggggugcauuu

SEQ ID NO: 2987298 - RNA, 12 nt, Human
cagguucagcuu

SEQ ID NO: 2987299 - RNA, 13 nt, Human
cagguucagcuug

SEQ ID NO: 2987300 - RNA, 12 nt, Human
caggugugaacc

SEQ ID NO: 2987301 - RNA, 19 nt, Human
caggugucccugcacuugc

SEQ ID NO: 2987302 - RNA, 18 nt, Human
caggugucccugcacuug

SEQ ID NO: 2987303 - RNA, 16 nt, Human
caggugucccugcacu

SEQ ID NO: 2987304 - RNA, 15 nt, Human
caggugucccugcac

SEQ ID NO: 2987305 - RNA, 16 nt, Human
caggugugagucacca

SEQ ID NO: 2987306 - RNA, 21 nt, Human
caggugugagucaccaagccc

SEQ ID NO: 2987307 - RNA, 20 nt, Human
caggugugagucaccaagcc

SEQ ID NO: 2987308 - RNA, 23 nt, Human
caggugugaaccaccacacccag

SEQ ID NO: 2987309 - RNA, 22 nt, Human
caggugugaaccaccacaccca

SEQ ID NO: 2987310 - RNA, 19 nt, Human
caggugugaaccaccacac

SEQ ID NO: 2987311 - RNA, 16 nt, Human
caggugugaaccacca

SEQ ID NO: 2987312 - RNA, 23 nt, Human
caggugugagucaccaagcccag

SEQ ID NO: 2987313 - RNA, 22 nt, Human
caggugugagucaccaagccca

SEQ ID NO: 2987314 - RNA, 18 nt, Human
cagguggggucacucugg

SEQ ID NO: 2987315 - RNA, 17 nt, Human
cagguggggcagcuuga

SEQ ID NO: 2987316 - RNA, 16 nt, Human
cagguggggcagcuug

SEQ ID NO: 2987317 - RNA, 15 nt, Human
cagguggggcagcuu

SEQ ID NO: 2987318 - RNA, 14 nt, Human
cagguggggcagcu

SEQ ID NO: 2987319 - RNA, 13 nt, Human
cagguggggcagc

SEQ ID NO: 2987320 - RNA, 19 nt, Human
cagguggggucacucuggc

SEQ ID NO: 2987321 - RNA, 20 nt, Human
cagguggggucacucuggca

SEQ ID NO: 2987322 - RNA, 21 nt, Human
cagguggggucacucuggcag

SEQ ID NO: 2987323 - RNA, 22 nt, Human
cagguggggucacucuggcagc

SEQ ID NO: 2987324 - RNA, 23 nt, Human
cagguggggucacucuggcagcu

SEQ ID NO: 2987325 - RNA, 18 nt, Human
caggugguuauggagagg

SEQ ID NO: 2987326 - RNA, 14 nt, Human
caggugucccugca

SEQ ID NO: 2987327 - RNA, 11 nt, Human
caggugucccu

SEQ ID NO: 2987328 - RNA, 20 nt, Human
caggugguuauggagagggu

SEQ ID NO: 2987329 - RNA, 23 nt, Human
cagggucccugguggcagcucac

SEQ ID NO: 2987330 - RNA, 18 nt, Human
caggguccuguagcccua

SEQ ID NO: 2987331 - RNA, 15 nt, Human
cagggucucacucug

SEQ ID NO: 2987332 - RNA, 23 nt, Human
cagggucucacuauguugcccag

SEQ ID NO: 2987333 - RNA, 22 nt, Human
cagggucucacuauguugccca

SEQ ID NO: 2987334 - RNA, 21 nt, Human
cagggucucacuauguugccc

SEQ ID NO: 2987335 - RNA, 16 nt, Human
cagggucucacucugu

SEQ ID NO: 2987336 - RNA, 16 nt, Human
caggguuuugccaugu

SEQ ID NO: 2987337 - RNA, 17 nt, Human
cagguaacaggcagaua

SEQ ID NO: 2987338 - RNA, 16 nt, Human
cagguaacaggcagau

SEQ ID NO: 2987339 - RNA, 15 nt, Human
cagguaacaggcaga

SEQ ID NO: 2987340 - RNA, 14 nt, Human
cagguaacaggcag

SEQ ID NO: 2987341 - RNA, 15 nt, Human
cagggucccuggugg

SEQ ID NO: 2987342 - RNA, 18 nt, Human
cagggucccugguggcag

SEQ ID NO: 2987343 - RNA, 19 nt, Human
cagggucccugguggcagc

SEQ ID NO: 2987344 - RNA, 22 nt, Human
cagggucccugguggcagcuca

SEQ ID NO: 2987345 - RNA, 14 nt, Human
cagggucccuggug

SEQ ID NO: 2987346 - RNA, 12 nt, Human
cagggucccugg

SEQ ID NO: 2987347 - RNA, 20 nt, Human
caggguauuccagagugggg

SEQ ID NO: 2987348 - RNA, 21 nt, Human
caggguauuccagagugggga

SEQ ID NO: 2987349 - RNA, 14 nt, Human
caggggugggacac

SEQ ID NO: 2987350 - RNA, 15 nt, Human
caggggugggacacc

SEQ ID NO: 2987351 - RNA, 20 nt, Human
caggggugggacacccugug

SEQ ID NO: 2987352 - RNA, 21 nt, Human
caggggugggacacccuguga

SEQ ID NO: 2987353 - RNA, 23 nt, Human
caggucuugaacuccuggccuca

SEQ ID NO: 2987354 - RNA, 22 nt, Human
caggucuugaacuccuggccuc

SEQ ID NO: 2987355 - RNA, 21 nt, Human
caggucuugaacuccuggccu

SEQ ID NO: 2987356 - RNA, 20 nt, Human
caggucuugaacuccuggcc

SEQ ID NO: 2987357 - RNA, 19 nt, Human
caggucuugaacuccuggc

SEQ ID NO: 2987358 - RNA, 18 nt, Human
caggucuugaacuccugg

SEQ ID NO: 2987359 - RNA, 13 nt, Human
caggugagaagca

SEQ ID NO: 2987360 - RNA, 20 nt, Human
caggugagaagcagaggaag

SEQ ID NO: 2987361 - RNA, 21 nt, Human
caggugagaagcagaggaagg

SEQ ID NO: 2987362 - RNA, 21 nt, Human
cagguaacaggcagauacagg

SEQ ID NO: 2987363 - RNA, 20 nt, Human
cagguaacaggcagauacag

SEQ ID NO: 2987364 - RNA, 23 nt, Human
cagucagggaaggugccucugga

SEQ ID NO: 2987365 - RNA, 18 nt, Human
cagucaggaaagagaacu

SEQ ID NO: 2987366 - RNA, 15 nt, Human
cagucaggaaagaga

SEQ ID NO: 2987367 - RNA, 22 nt, Human
cagucaggaaagagaacuucca

SEQ ID NO: 2987368 - RNA, 16 nt, Human
caguauuacuucugcu

SEQ ID NO: 2987369 - RNA, 18 nt, Human
caguauuacuucugcuac

SEQ ID NO: 2987370 - RNA, 19 nt, Human
cagucauuauguuaauauu

SEQ ID NO: 2987371 - RNA, 20 nt, Human
cagucauucagauaugauuc

SEQ ID NO: 2987372 - RNA, 17 nt, Human
cagucauucagauauga

SEQ ID NO: 2987373 - RNA, 14 nt, Human
caguccauugaaag

SEQ ID NO: 2987374 - RNA, 13 nt, Human
caguccaugaaga

SEQ ID NO: 2987375 - RNA, 16 nt, Human
caguccauagcagaga

SEQ ID NO: 2987376 - RNA, 15 nt, Human
caguaucucagggcc

SEQ ID NO: 2987377 - RNA, 12 nt, Human
caguaucuugaa

SEQ ID NO: 2987378 - RNA, 18 nt, Human
caguaucuugaagacuuu

SEQ ID NO: 2987379 - RNA, 12 nt, Human
caguauggcagc

SEQ ID NO: 2987380 - RNA, 21 nt, Human
caguaucuugaagacuuuucu

SEQ ID NO: 2987381 - RNA, 13 nt, Human
caguaucucaggg

SEQ ID NO: 2987382 - RNA, 18 nt, Human
caguauagaauaggcacu

SEQ ID NO: 2987383 - RNA, 12 nt, Human
caguauagaaua

SEQ ID NO: 2987384 - RNA, 22 nt, Human
caguauagaauaggcacuuuaa

SEQ ID NO: 2987385 - RNA, 12 nt, Human
caguagugauag

SEQ ID NO: 2987386 - RNA, 13 nt, Human
cagucccugccaa

SEQ ID NO: 2987387 - RNA, 14 nt, Human
cagucccugccaau

SEQ ID NO: 2987388 - RNA, 15 nt, Human
cagucccugccaaug

SEQ ID NO: 2987389 - RNA, 16 nt, Human
cagucccugccaaugg

SEQ ID NO: 2987390 - RNA, 12 nt, Human
cagucccugcca

SEQ ID NO: 2987391 - RNA, 12 nt, Human
caguccucccau

SEQ ID NO: 2987392 - RNA, 13 nt, Human
caguccucccauc

SEQ ID NO: 2987393 - RNA, 14 nt, Human
caguccucccaucu

SEQ ID NO: 2987394 - RNA, 15 nt, Human
caguccucccaucuc

SEQ ID NO: 2987395 - RNA, 17 nt, Human
cagucccugccaaugga

SEQ ID NO: 2987396 - RNA, 23 nt, Human
cagugccuuauggaacacucuga

SEQ ID NO: 2987397 - RNA, 18 nt, Human
cagugcucacccacacca

SEQ ID NO: 2987398 - RNA, 17 nt, Human
cagugcucacccacacc

SEQ ID NO: 2987399 - RNA, 12 nt, Human
cagugcucaccc

SEQ ID NO: 2987400 - RNA, 13 nt, Human
cagugcucaccca

SEQ ID NO: 2987401 - RNA, 17 nt, Human
cagugauuaccagggac

SEQ ID NO: 2987402 - RNA, 18 nt, Human
cagugauuaccagggacu

SEQ ID NO: 2987403 - RNA, 23 nt, Human
cagugagucgaggacagggaggu

SEQ ID NO: 2987404 - RNA, 22 nt, Human
cagugagucgaggacagggagg

SEQ ID NO: 2987405 - RNA, 20 nt, Human
cagugagucgaggacaggga

SEQ ID NO: 2987406 - RNA, 19 nt, Human
cagugagucgaggacaggg

SEQ ID NO: 2987407 - RNA, 15 nt, Human
cagugccuuauggaa

SEQ ID NO: 2987408 - RNA, 16 nt, Human
cagugccuuauggaac

SEQ ID NO: 2987409 - RNA, 17 nt, Human
cagugccuuauggaaca

SEQ ID NO: 2987410 - RNA, 18 nt, Human
cagugccuuauggaacac

SEQ ID NO: 2987411 - RNA, 19 nt, Human
cagugccuuauggaacacu

SEQ ID NO: 2987412 - RNA, 20 nt, Human
cagugccuuauggaacacuc

SEQ ID NO: 2987413 - RNA, 21 nt, Human
cagugccuuauggaacacucu

SEQ ID NO: 2987414 - RNA, 22 nt, Human
cagugccuuauggaacacucug

SEQ ID NO: 2987415 - RNA, 22 nt, Human
cagugccucucccugcugcucc

SEQ ID NO: 2987416 - RNA, 21 nt, Human
cagugccucucccugcugcuc

SEQ ID NO: 2987417 - RNA, 20 nt, Human
cagugccucucccugcugcu

SEQ ID NO: 2987418 - RNA, 12 nt, Human
cagugccucucc

SEQ ID NO: 2987419 - RNA, 15 nt, Human
cagugccgagaagga

SEQ ID NO: 2987420 - RNA, 18 nt, Human
cagugccgagaaggaagc

SEQ ID NO: 2987421 - RNA, 11 nt, Human
cagugccuuau

SEQ ID NO: 2987422 - RNA, 13 nt, Human
cagugccuuaugg

SEQ ID NO: 2987423 - RNA, 22 nt, Human
cagugccuggguggaugggcca

SEQ ID NO: 2987424 - RNA, 15 nt, Human
cagugagacagcucu

SEQ ID NO: 2987425 - RNA, 17 nt, Human
cagugaggcucugcccu

SEQ ID NO: 2987426 - RNA, 18 nt, Human
cagugaggcucugcccuu

SEQ ID NO: 2987427 - RNA, 19 nt, Human
cagugaggcucugcccuug

SEQ ID NO: 2987428 - RNA, 20 nt, Human
cagugaggcucugcccuugg

SEQ ID NO: 2987429 - RNA, 18 nt, Human
cagugagucgaggacagg

SEQ ID NO: 2987430 - RNA, 17 nt, Human
cagugagucgaggacag

SEQ ID NO: 2987431 - RNA, 21 nt, Human
cagugaggcucugcccuuggu

SEQ ID NO: 2987432 - RNA, 13 nt, Human
cagugaggcucug

SEQ ID NO: 2987433 - RNA, 14 nt, Human
cagugaggcucugc

SEQ ID NO: 2987434 - RNA, 15 nt, Human
cagugaggcucugcc

SEQ ID NO: 2987435 - RNA, 16 nt, Human
cagugaggcucugccc

SEQ ID NO: 2987436 - RNA, 12 nt, Human
cagugaggcucu

SEQ ID NO: 2987437 - RNA, 24 nt, Human
cagugagccgagauugcaccacug

SEQ ID NO: 2987438 - RNA, 16 nt, Human
cagugaaagaaaauaa

SEQ ID NO: 2987439 - RNA, 20 nt, Human
cagugaaagaaaauaacaau

SEQ ID NO: 2987440 - RNA, 19 nt, Human
cagucuggaaugcaguggu

SEQ ID NO: 2987441 - RNA, 15 nt, Human
caguccuuaccagca

SEQ ID NO: 2987442 - RNA, 18 nt, Human
caguccuuaccagcagag

SEQ ID NO: 2987443 - RNA, 15 nt, Human
caguccugcccgcca

SEQ ID NO: 2987444 - RNA, 19 nt, Human
caguccuuaccagcagagc

SEQ ID NO: 2987445 - RNA, 20 nt, Human
caguccuuaccagcagagca

SEQ ID NO: 2987446 - RNA, 21 nt, Human
caguccuuaccagcagagcac

SEQ ID NO: 2987447 - RNA, 18 nt, Human
cagucuggaaugcagugg

SEQ ID NO: 2987448 - RNA, 14 nt, Human
caguccugcccgcc

SEQ ID NO: 2987449 - RNA, 16 nt, Human
caguccucccaucuca

SEQ ID NO: 2987450 - RNA, 17 nt, Human
caguccucccaucucac

SEQ ID NO: 2987451 - RNA, 15 nt, Human
caggaguuuggccag

SEQ ID NO: 2987452 - RNA, 16 nt, Human
caggaguuuggccaga

SEQ ID NO: 2987453 - RNA, 17 nt, Human
caggaguuuggccagaa

SEQ ID NO: 2987454 - RNA, 13 nt, Human
caggaguuuggcc

SEQ ID NO: 2987455 - RNA, 14 nt, Human
caggaguuuggcca

SEQ ID NO: 2987456 - RNA, 22 nt, Human
caggaguuugagaccaaccugg

SEQ ID NO: 2987457 - RNA, 23 nt, Human
caggaguuugagaccaaccuggg

SEQ ID NO: 2987458 - RNA, 21 nt, Human
caggaguuugagaccaaccug

SEQ ID NO: 2987459 - RNA, 12 nt, Human
caggagugagca

SEQ ID NO: 2987460 - RNA, 14 nt, Human
caggagccuccugc

SEQ ID NO: 2987461 - RNA, 17 nt, Human
caggagccuccugcccu

SEQ ID NO: 2987462 - RNA, 20 nt, Human
caggagccuccugcccuuac

SEQ ID NO: 2987463 - RNA, 12 nt, Human
caggagcagcca

SEQ ID NO: 2987464 - RNA, 13 nt, Human
caggagcagccac

SEQ ID NO: 2987465 - RNA, 14 nt, Human
caggagcagccaca

SEQ ID NO: 2987466 - RNA, 19 nt, Human
caggagcagccacauuccu

SEQ ID NO: 2987467 - RNA, 18 nt, Human
caggagccccgaggccuu

SEQ ID NO: 2987468 - RNA, 16 nt, Human
caggagccccgaggcc

SEQ ID NO: 2987469 - RNA, 15 nt, Human
caggagccccgaggc

SEQ ID NO: 2987470 - RNA, 22 nt, Human
caggagccccgaggccuucucu

SEQ ID NO: 2987471 - RNA, 20 nt, Human
caggagccccgaggccuucu

SEQ ID NO: 2987472 - RNA, 23 nt, Human
caggagccccgaggccuucucug

SEQ ID NO: 2987473 - RNA, 22 nt, Human
caggagacuggcgugaacccag

SEQ ID NO: 2987474 - RNA, 23 nt, Human
caggagacuggcgugaacccagg

SEQ ID NO: 2987475 - RNA, 23 nt, Human
caggagaucgagaccauccuggc

SEQ ID NO: 2987476 - RNA, 14 nt, Human
caggcccccaggug

SEQ ID NO: 2987477 - RNA, 19 nt, Human
caggcccccaggugccagu

SEQ ID NO: 2987478 - RNA, 20 nt, Human
caggcccccaggugccaguu

SEQ ID NO: 2987479 - RNA, 13 nt, Human
caggccccugcca

SEQ ID NO: 2987480 - RNA, 21 nt, Human
caggccaggcccucugcccac

SEQ ID NO: 2987481 - RNA, 22 nt, Human
caggccaggcccucugcccacu

SEQ ID NO: 2987482 - RNA, 20 nt, Human
caggccacaagacccuugug

SEQ ID NO: 2987483 - RNA, 17 nt, Human
caggccacaagacccuu

SEQ ID NO: 2987484 - RNA, 18 nt, Human
caggccacaagacccuug

SEQ ID NO: 2987485 - RNA, 13 nt, Human
caggccacaagac

SEQ ID NO: 2987486 - RNA, 18 nt, Human
caggccaaacucaccugc

SEQ ID NO: 2987487 - RNA, 23 nt, Human
caggccaaacucaccugccccuc

SEQ ID NO: 2987488 - RNA, 20 nt, Human
caggccccugccacccuggg

SEQ ID NO: 2987489 - RNA, 19 nt, Human
caggccccugccacccugg

SEQ ID NO: 2987490 - RNA, 17 nt, Human
caggccccugccacccu

SEQ ID NO: 2987491 - RNA, 15 nt, Human
caggccccugccacc

SEQ ID NO: 2987492 - RNA, 15 nt, Human
caggcccggcuccag

SEQ ID NO: 2987493 - RNA, 14 nt, Human
caggcccggcucca

SEQ ID NO: 2987494 - RNA, 13 nt, Human
caggcccggcucc

SEQ ID NO: 2987495 - RNA, 16 nt, Human
caggauuuuaaucuuu

SEQ ID NO: 2987496 - RNA, 20 nt, Human
caggauucuuccucccuccc

SEQ ID NO: 2987497 - RNA, 14 nt, Human
caggcagccaggcc

SEQ ID NO: 2987498 - RNA, 15 nt, Human
caggcagccaggcca

SEQ ID NO: 2987499 - RNA, 21 nt, Human
caggcaagcaccuccugccuc

SEQ ID NO: 2987500 - RNA, 16 nt, Human
caggcaagcaccuccu

SEQ ID NO: 2987501 - RNA, 15 nt, Human
caggcaagcaccucc

SEQ ID NO: 2987502 - RNA, 14 nt, Human
caggcaagcaccuc

SEQ ID NO: 2987503 - RNA, 13 nt, Human
caggcagguccag

SEQ ID NO: 2987504 - RNA, 16 nt, Human
caggcagccaggccac

SEQ ID NO: 2987505 - RNA, 17 nt, Human
caggcagccaggccaca

SEQ ID NO: 2987506 - RNA, 13 nt, Human
caggcauucccca

SEQ ID NO: 2987507 - RNA, 15 nt, Human
caggcauuccccagg

SEQ ID NO: 2987508 - RNA, 16 nt, Human
caggcauuccccagga

SEQ ID NO: 2987509 - RNA, 17 nt, Human
caggcauuccccaggag

SEQ ID NO: 2987510 - RNA, 20 nt, Human
caggcauguucucugaggac

SEQ ID NO: 2987511 - RNA, 19 nt, Human
caggcauguucucugagga

SEQ ID NO: 2987512 - RNA, 18 nt, Human
caggcauguucucugagg

SEQ ID NO: 2987513 - RNA, 15 nt, Human
caggcauguucucug

SEQ ID NO: 2987514 - RNA, 18 nt, Human
caggcauuccccaggagg

SEQ ID NO: 2987515 - RNA, 19 nt, Human
caggcauuccccaggaggc

SEQ ID NO: 2987516 - RNA, 20 nt, Human
caggcauuccccaggaggcc

SEQ ID NO: 2987517 - RNA, 21 nt, Human
caggcauuccccaggaggcca

SEQ ID NO: 2987518 - RNA, 22 nt, Human
caggcauuccccaggaggccag

SEQ ID NO: 2987519 - RNA, 23 nt, Human
caggcauuccccaggaggccagc

SEQ ID NO: 2987520 - RNA, 24 nt, Human
caggcauuccccaggaggccagcc

SEQ ID NO: 2987521 - RNA, 12 nt, Human
caggcaggucuu

SEQ ID NO: 2987522 - RNA, 19 nt, Human
caggcagguccaggguuug

SEQ ID NO: 2987523 - RNA, 15 nt, Human
caggcagguccaggg

SEQ ID NO: 2987524 - RNA, 14 nt, Human
caggcagguccagg

SEQ ID NO: 2987525 - RNA, 22 nt, Human
caggcaggucuugaacuccugg

SEQ ID NO: 2987526 - RNA, 13 nt, Human
caggcaggucuug

SEQ ID NO: 2987527 - RNA, 15 nt, Human
caggcaggugggaug

SEQ ID NO: 2987528 - RNA, 23 nt, Human
caggcaggucuugaacuccuggc

SEQ ID NO: 2987529 - RNA, 17 nt, Human
caggcaugguggcccac

SEQ ID NO: 2987530 - RNA, 23 nt, Human
caggaugguucccuugaugaaga

SEQ ID NO: 2987531 - RNA, 21 nt, Human
caggaugguucccuugaugaa

SEQ ID NO: 2987532 - RNA, 18 nt, Human
caggauucuuccucccuc

SEQ ID NO: 2987533 - RNA, 17 nt, Human
caggauucuuccucccu

SEQ ID NO: 2987534 - RNA, 23 nt, Human
caggauggccgggcgcgguggcu

SEQ ID NO: 2987535 - RNA, 21 nt, Human
caggauauucucacagcucca

SEQ ID NO: 2987536 - RNA, 13 nt, Human
caggaucagucug

SEQ ID NO: 2987537 - RNA, 14 nt, Human
caggaucagucuga

SEQ ID NO: 2987538 - RNA, 13 nt, Human
caggcuggaguua

SEQ ID NO: 2987539 - RNA, 16 nt, Human
caggcuggaguuauug

SEQ ID NO: 2987540 - RNA, 23 nt, Human
caggcugggcuucaguggcagcu

SEQ ID NO: 2987541 - RNA, 17 nt, Human
caggcugccagugccug

SEQ ID NO: 2987542 - RNA, 16 nt, Human
caggcugccagugccu

SEQ ID NO: 2987543 - RNA, 14 nt, Human
caggcugccagugc

SEQ ID NO: 2987544 - RNA, 20 nt, Human
caggcugccagugccugggu

SEQ ID NO: 2987545 - RNA, 19 nt, Human
caggcugccagugccuggg

SEQ ID NO: 2987546 - RNA, 21 nt, Human
caggcugccagugccugggug

SEQ ID NO: 2987547 - RNA, 12 nt, Human
caggcugccagu

SEQ ID NO: 2987548 - RNA, 16 nt, Human
caggcuuagucacuga

SEQ ID NO: 2987549 - RNA, 17 nt, Human
caggcuuagucacugag

SEQ ID NO: 2987550 - RNA, 20 nt, Human
caggcuuagucacugagaca

SEQ ID NO: 2987551 - RNA, 21 nt, Human
caggcuuagucacugagacag

SEQ ID NO: 2987552 - RNA, 23 nt, Human
caggcuguaucccaugagccuca

SEQ ID NO: 2987553 - RNA, 22 nt, Human
caggcuguaucccaugagccuc

SEQ ID NO: 2987554 - RNA, 21 nt, Human
caggcuguaucccaugagccu

SEQ ID NO: 2987555 - RNA, 20 nt, Human
caggcuguaucccaugagcc

SEQ ID NO: 2987556 - RNA, 14 nt, Human
caggcuguauccca

SEQ ID NO: 2987557 - RNA, 19 nt, Human
caggcuggucucaaacucu

SEQ ID NO: 2987558 - RNA, 12 nt, Human
caggcuggucuc

SEQ ID NO: 2987559 - RNA, 22 nt, Human
caggcuuagucacugagacagc

SEQ ID NO: 2987560 - RNA, 23 nt, Human
caggcuuagucacugagacagcc

SEQ ID NO: 2987561 - RNA, 19 nt, Human
caggcuagauguauguacu

SEQ ID NO: 2987562 - RNA, 13 nt, Human
caggcuagaugua

SEQ ID NO: 2987563 - RNA, 14 nt, Human
caggcuacugucag

SEQ ID NO: 2987564 - RNA, 20 nt, Human
caggcuccuuuagcgcccag

SEQ ID NO: 2987565 - RNA, 19 nt, Human
caggcuccuuuagcgccca

SEQ ID NO: 2987566 - RNA, 14 nt, Human
caggcuccuuuagc

SEQ ID NO: 2987567 - RNA, 13 nt, Human
caggcucucaggc

SEQ ID NO: 2987568 - RNA, 14 nt, Human
caggcucucaggcc

SEQ ID NO: 2987569 - RNA, 15 nt, Human
caggcucucaggcca

SEQ ID NO: 2987570 - RNA, 16 nt, Human
caggcucucaggccag

SEQ ID NO: 2987571 - RNA, 20 nt, Human
caggcucgggcuccccagcc

SEQ ID NO: 2987572 - RNA, 12 nt, Human
caggcucucagg

SEQ ID NO: 2987573 - RNA, 21 nt, Human
caggcuccuuuagcgcccagu

SEQ ID NO: 2987574 - RNA, 17 nt, Human
caggcucucaggccagc

SEQ ID NO: 2987575 - RNA, 18 nt, Human
caggcucucaggccagcu

SEQ ID NO: 2987576 - RNA, 19 nt, Human
caggcucucaggccagcug

SEQ ID NO: 2987577 - RNA, 20 nt, Human
caggcucucaggccagcugc

SEQ ID NO: 2987578 - RNA, 21 nt, Human
caggcucucaggccagcugcu

SEQ ID NO: 2987579 - RNA, 23 nt, Human
caggcucucaggccagcugcuug

SEQ ID NO: 2987580 - RNA, 19 nt, Human
caggcccggcuccaggcuc

SEQ ID NO: 2987581 - RNA, 18 nt, Human
caggcccggcuccaggcu

SEQ ID NO: 2987582 - RNA, 16 nt, Human
caggcccggcuccagg

SEQ ID NO: 2987583 - RNA, 17 nt, Human
caggcccggcuccaggc

SEQ ID NO: 2987584 - RNA, 13 nt, Human
caggcccucugcc

SEQ ID NO: 2987585 - RNA, 14 nt, Human
caggcccucugccc

SEQ ID NO: 2987586 - RNA, 15 nt, Human
caggcccucugccca

SEQ ID NO: 2987587 - RNA, 21 nt, Human
caggcccggcuccaggcuccu

SEQ ID NO: 2987588 - RNA, 20 nt, Human
caggcccggcuccaggcucc

SEQ ID NO: 2987589 - RNA, 22 nt, Human
caggcccggcuccaggcuccuu

SEQ ID NO: 2987590 - RNA, 16 nt, Human
caggcccucugcccac

SEQ ID NO: 2987591 - RNA, 17 nt, Human
caggcccucugcccacu

SEQ ID NO: 2987592 - RNA, 19 nt, Human
caggcccucugcccacucc

SEQ ID NO: 2987593 - RNA, 20 nt, Human
caggcccucugcccacuccc

SEQ ID NO: 2987594 - RNA, 21 nt, Human
caggcccucugcccacucccu

SEQ ID NO: 2987595 - RNA, 22 nt, Human
caggcccucugcccacucccug

SEQ ID NO: 2987596 - RNA, 20 nt, Human
caggcccuugucggccccac

SEQ ID NO: 2987597 - RNA, 22 nt, Human
cagggaaacagcuaaugggaca

SEQ ID NO: 2987598 - RNA, 16 nt, Human
cagggaaacagcuaau

SEQ ID NO: 2987599 - RNA, 14 nt, Human
cagggacagagggg

SEQ ID NO: 2987600 - RNA, 20 nt, Human
cagggacagaggggguggcc

SEQ ID NO: 2987601 - RNA, 13 nt, Human
cagggacagaggg

SEQ ID NO: 2987602 - RNA, 16 nt, Human
caggggacaggauggu

SEQ ID NO: 2987603 - RNA, 11 nt, Human
caggggacagg

SEQ ID NO: 2987604 - RNA, 14 nt, Human
cagggccuggcuca

SEQ ID NO: 2987605 - RNA, 15 nt, Human
cagggccuggcucag

SEQ ID NO: 2987606 - RNA, 13 nt, Human
cagggccuggcuc

SEQ ID NO: 2987607 - RNA, 21 nt, Human
cagggccucugcggagcacac

SEQ ID NO: 2987608 - RNA, 16 nt, Human
cagggccuggcucagg

SEQ ID NO: 2987609 - RNA, 19 nt, Human
cagggccuggcucaggugg

SEQ ID NO: 2987610 - RNA, 19 nt, Human
caggggaggguagagcgga

SEQ ID NO: 2987611 - RNA, 18 nt, Human
cagggacaggauaagagg

SEQ ID NO: 2987612 - RNA, 23 nt, Human
cagggacagaggggguggccucc

SEQ ID NO: 2987613 - RNA, 14 nt, Human
cagggcacaccggg

SEQ ID NO: 2987614 - RNA, 21 nt, Human
cagggcacaccgggcacucag

SEQ ID NO: 2987615 - RNA, 19 nt, Human
cagggcacaccgggcacuc

SEQ ID NO: 2987616 - RNA, 17 nt, Human
cagggcacaccgggcac

SEQ ID NO: 2987617 - RNA, 15 nt, Human
cagggcacaccgggc

SEQ ID NO: 2987618 - RNA, 23 nt, Human
cagggcacaccgggcacucagaa

SEQ ID NO: 2987619 - RNA, 22 nt, Human
cagggcacaccgggcacucaga

SEQ ID NO: 2987620 - RNA, 17 nt, Human
cagggcauggcugggaa

SEQ ID NO: 2987621 - RNA, 14 nt, Human
cagggcaucuggga

SEQ ID NO: 2987622 - RNA, 17 nt, Human
cagggccaugucagaca

SEQ ID NO: 2987623 - RNA, 21 nt, Human
cagggccaugucagacacaga

SEQ ID NO: 2987624 - RNA, 20 nt, Human
cagggccaugucagacacag

SEQ ID NO: 2987625 - RNA, 17 nt, Human
cagggccucugcggagc

SEQ ID NO: 2987626 - RNA, 15 nt, Human
cagggccucugcgga

SEQ ID NO: 2987627 - RNA, 14 nt, Human
cagggccucugcgg

SEQ ID NO: 2987628 - RNA, 13 nt, Human
cagggccucugcg

SEQ ID NO: 2987629 - RNA, 12 nt, Human
cagggccucugc

SEQ ID NO: 2987630 - RNA, 19 nt, Human
cagcacaaggaaauaaaau

SEQ ID NO: 2987631 - RNA, 21 nt, Human
cagcaauaaagcagcguuucu

SEQ ID NO: 2987632 - RNA, 13 nt, Human
cagcaauaaagca

SEQ ID NO: 2987633 - RNA, 21 nt, Human
cagcaagugagagcugggugu

SEQ ID NO: 2987634 - RNA, 19 nt, Human
cagcaagugagagcugggu

SEQ ID NO: 2987635 - RNA, 22 nt, Human
cagcaauaaagcagcguuucua

SEQ ID NO: 2987636 - RNA, 16 nt, Human
cagcaauuaugaaaau

SEQ ID NO: 2987637 - RNA, 19 nt, Human
cagcaauuaugaaaauaau

SEQ ID NO: 2987638 - RNA, 22 nt, Human
cagcaagggugaugggaaagca

SEQ ID NO: 2987639 - RNA, 23 nt, Human
cagcaagggugaugggaaagcau

SEQ ID NO: 2987640 - RNA, 12 nt, Human
cagcaagugaga

SEQ ID NO: 2987641 - RNA, 17 nt, Human
cagcaagugagagcugg

SEQ ID NO: 2987642 - RNA, 16 nt, Human
cagcaagugagagcug

SEQ ID NO: 2987643 - RNA, 15 nt, Human
cagcaagugagagcu

SEQ ID NO: 2987644 - RNA, 14 nt, Human
cagcaagugagagc

SEQ ID NO: 2987645 - RNA, 19 nt, Human
cagcaagggugaugggaaa

SEQ ID NO: 2987646 - RNA, 18 nt, Human
cagcaaggagauuuacaa

SEQ ID NO: 2987647 - RNA, 17 nt, Human
cagcaaggagauuuaca

SEQ ID NO: 2987648 - RNA, 10 nt, Human
cagcagagug

SEQ ID NO: 2987649 - RNA, 9 nt, Human
cagcagagu

SEQ ID NO: 2987650 - RNA, 15 nt, Human
cagcagagugcuuua

SEQ ID NO: 2987651 - RNA, 11 nt, Human
cagcagagugc

SEQ ID NO: 2987652 - RNA, 11 nt, Human
cagcagagcac

SEQ ID NO: 2987653 - RNA, 13 nt, Human
cagcagagcaccu

SEQ ID NO: 2987654 - RNA, 22 nt, Human
cagcagaaaugccuuacccuca

SEQ ID NO: 2987655 - RNA, 19 nt, Human
cagcagaaaugccuuaccc

SEQ ID NO: 2987656 - RNA, 12 nt, Human
cagcagacacau

SEQ ID NO: 2987657 - RNA, 17 nt, Human
cagcagaaaugccuuac

SEQ ID NO: 2987658 - RNA, 15 nt, Human
cagcagaaaugccuu

SEQ ID NO: 2987659 - RNA, 17 nt, Human
cagcacuuugggaggcu

SEQ ID NO: 2987660 - RNA, 18 nt, Human
cagcacuuugggaggcug

SEQ ID NO: 2987661 - RNA, 20 nt, Human
cagcacuuugggaggcugag

SEQ ID NO: 2987662 - RNA, 15 nt, Human
cagcaacacaaagcu

SEQ ID NO: 2987663 - RNA, 23 nt, Human
cagcaacacaaagcuuuugcaua

SEQ ID NO: 2987664 - RNA, 18 nt, Human
cagcaaaagaugcuucuc

SEQ ID NO: 2987665 - RNA, 23 nt, Human
cagcaacgcaggcccccaggugc

SEQ ID NO: 2987666 - RNA, 15 nt, Human
cagauuuuccugaaa

SEQ ID NO: 2987667 - RNA, 14 nt, Human
cagauuuuccugaa

SEQ ID NO: 2987668 - RNA, 14 nt, Human
cagauucuuuccug

SEQ ID NO: 2987669 - RNA, 23 nt, Human
cagaugggugcuuggaggaagga

SEQ ID NO: 2987670 - RNA, 18 nt, Human
cagaugggugcuuggagg

SEQ ID NO: 2987671 - RNA, 20 nt, Human
cagccccaaaacucuccucu

SEQ ID NO: 2987672 - RNA, 21 nt, Human
cagccccaaaacucuccucug

SEQ ID NO: 2987673 - RNA, 22 nt, Human
cagccccaaaacucuccucugc

SEQ ID NO: 2987674 - RNA, 18 nt, Human
cagcccacuucugccaua

SEQ ID NO: 2987675 - RNA, 15 nt, Human
cagcccaccccucaa

SEQ ID NO: 2987676 - RNA, 15 nt, Human
cagcccacuucugcc

SEQ ID NO: 2987677 - RNA, 22 nt, Human
cagccacggccaggccagaggg

SEQ ID NO: 2987678 - RNA, 21 nt, Human
cagccacggccaggccagagg

SEQ ID NO: 2987679 - RNA, 19 nt, Human
cagccacggccaggccaga

SEQ ID NO: 2987680 - RNA, 18 nt, Human
cagccacggccaggccag

SEQ ID NO: 2987681 - RNA, 17 nt, Human
cagccacggccaggcca

SEQ ID NO: 2987682 - RNA, 16 nt, Human
cagccacggccaggcc

SEQ ID NO: 2987683 - RNA, 15 nt, Human
cagccacggccaggc

SEQ ID NO: 2987684 - RNA, 14 nt, Human
cagccacggccagg

SEQ ID NO: 2987685 - RNA, 13 nt, Human
cagccaguaaaug

SEQ ID NO: 2987686 - RNA, 22 nt, Human
cagccaguaaaugggggugcau

SEQ ID NO: 2987687 - RNA, 23 nt, Human
cagccacggccaggccagaggga

SEQ ID NO: 2987688 - RNA, 15 nt, Human
cagccacauuccuga

SEQ ID NO: 2987689 - RNA, 17 nt, Human
cagccacauuccugaug

SEQ ID NO: 2987690 - RNA, 19 nt, Human
cagccacauuccugaugcu

SEQ ID NO: 2987691 - RNA, 14 nt, Human
cagccacauuccug

SEQ ID NO: 2987692 - RNA, 12 nt, Human
cagcagccugga

SEQ ID NO: 2987693 - RNA, 14 nt, Human
cagcagccuggacc

SEQ ID NO: 2987694 - RNA, 15 nt, Human
cagcagccuggaccc

SEQ ID NO: 2987695 - RNA, 18 nt, Human
cagcagccuggacccugu

SEQ ID NO: 2987696 - RNA, 19 nt, Human
cagcagccuggacccugug

SEQ ID NO: 2987697 - RNA, 22 nt, Human
cagcagccuggacccuguggau

SEQ ID NO: 2987698 - RNA, 14 nt, Human
cagcaggcucucag

SEQ ID NO: 2987699 - RNA, 15 nt, Human
cagcaggcucucagg

SEQ ID NO: 2987700 - RNA, 12 nt, Human
cagcaggcucuc

SEQ ID NO: 2987701 - RNA, 19 nt, Human
cagcaggcugccagugccu

SEQ ID NO: 2987702 - RNA, 18 nt, Human
cagcaggcugccagugcc

SEQ ID NO: 2987703 - RNA, 15 nt, Human
cagcaggcugccagu

SEQ ID NO: 2987704 - RNA, 14 nt, Human
cagcaggcugccag

SEQ ID NO: 2987705 - RNA, 13 nt, Human
cagcaggcugcca

SEQ ID NO: 2987706 - RNA, 18 nt, Human
cagcagggagggcuucug

SEQ ID NO: 2987707 - RNA, 20 nt, Human
cagcaggcucucaggccagc

SEQ ID NO: 2987708 - RNA, 22 nt, Human
cagcaggcucucaggccagcug

SEQ ID NO: 2987709 - RNA, 16 nt, Human
cagcaggcucucaggc

SEQ ID NO: 2987710 - RNA, 17 nt, Human
cagcaggcucucaggcc

SEQ ID NO: 2987711 - RNA, 18 nt, Human
cagcaggcucucaggcca

SEQ ID NO: 2987712 - RNA, 19 nt, Human
cagcaggcucucaggccag

SEQ ID NO: 2987713 - RNA, 20 nt, Human
cagcaggcugccagugccug

SEQ ID NO: 2987714 - RNA, 20 nt, Human
cagcagggagggcuucugcc

SEQ ID NO: 2987715 - RNA, 17 nt, Human
cagcauccuggcacccg

SEQ ID NO: 2987716 - RNA, 16 nt, Human
cagcauccuggcaccc

SEQ ID NO: 2987717 - RNA, 15 nt, Human
cagcauccuggcacc

SEQ ID NO: 2987718 - RNA, 14 nt, Human
cagcauccuggcac

SEQ ID NO: 2987719 - RNA, 20 nt, Human
cagcauccuggcacccggcc

SEQ ID NO: 2987720 - RNA, 19 nt, Human
cagcauccuggcacccggc

SEQ ID NO: 2987721 - RNA, 21 nt, Human
cagcauccuggcacccggccc

SEQ ID NO: 2987722 - RNA, 15 nt, Human
cagccaaagccuccu

SEQ ID NO: 2987723 - RNA, 16 nt, Human
cagccaaagccuccuc

SEQ ID NO: 2987724 - RNA, 18 nt, Human
cagccaaagccuccucca

SEQ ID NO: 2987725 - RNA, 21 nt, Human
cagccaaagccuccuccagcc

SEQ ID NO: 2987726 - RNA, 14 nt, Human
cagcucaccagccc

SEQ ID NO: 2987727 - RNA, 13 nt, Human
cagcccucagaau

SEQ ID NO: 2987728 - RNA, 18 nt, Human
cagcccucaauugugaaa

SEQ ID NO: 2987729 - RNA, 17 nt, Human
cagcccgggcucugccu

SEQ ID NO: 2987730 - RNA, 18 nt, Human
cagcccgggcucugccuc

SEQ ID NO: 2987731 - RNA, 19 nt, Human
cagcccgggcucugccucc

SEQ ID NO: 2987732 - RNA, 20 nt, Human
cagcccgggcucugccuccc

SEQ ID NO: 2987733 - RNA, 21 nt, Human
cagcccgggcucugccuccca

SEQ ID NO: 2987734 - RNA, 22 nt, Human
cagcccgggcucugccucccau

SEQ ID NO: 2987735 - RNA, 16 nt, Human
cagccccuucugaccc

SEQ ID NO: 2987736 - RNA, 17 nt, Human
cagccccuucugaccca

SEQ ID NO: 2987737 - RNA, 19 nt, Human
cagccccuucugacccaug

SEQ ID NO: 2987738 - RNA, 21 nt, Human
cagccccuucugacccaugcu

SEQ ID NO: 2987739 - RNA, 22 nt, Human
cagccccuucugacccaugcug

SEQ ID NO: 2987740 - RNA, 23 nt, Human
cagccccuucugacccaugcugc

SEQ ID NO: 2987741 - RNA, 24 nt, Human
cagccccuucugacccaugcugcc

SEQ ID NO: 2987742 - RNA, 13 nt, Human
cagcccgggcucu

SEQ ID NO: 2987743 - RNA, 14 nt, Human
cagcccgggcucug

SEQ ID NO: 2987744 - RNA, 15 nt, Human
cagcccgggcucugc

SEQ ID NO: 2987745 - RNA, 16 nt, Human
cagcccgggcucugcc

SEQ ID NO: 2987746 - RNA, 22 nt, Human
cagccccaucccaaacccuuca

SEQ ID NO: 2987747 - RNA, 12 nt, Human
cagccccauccu

SEQ ID NO: 2987748 - RNA, 13 nt, Human
cagccccauccuc

SEQ ID NO: 2987749 - RNA, 14 nt, Human
cagccccauccucu

SEQ ID NO: 2987750 - RNA, 16 nt, Human
cagccccauccucugu

SEQ ID NO: 2987751 - RNA, 22 nt, Human
cagccccauccucuguacagag

SEQ ID NO: 2987752 - RNA, 14 nt, Human
cagccccauucugc

SEQ ID NO: 2987753 - RNA, 13 nt, Human
cagccccauucug

SEQ ID NO: 2987754 - RNA, 23 nt, Human
cagccccuggaugcagccucaca

SEQ ID NO: 2987755 - RNA, 18 nt, Human
cagccccauucugccugc

SEQ ID NO: 2987756 - RNA, 17 nt, Human
cagccccauucugccug

SEQ ID NO: 2987757 - RNA, 16 nt, Human
cagccccauucugccu

SEQ ID NO: 2987758 - RNA, 20 nt, Human
cagccccuguucuggcagag

SEQ ID NO: 2987759 - RNA, 22 nt, Human
cagccccuggaugcagccucac

SEQ ID NO: 2987760 - RNA, 21 nt, Human
cagccccuguucuggcagagu

SEQ ID NO: 2987761 - RNA, 11 nt, Human
cagccccaucc

SEQ ID NO: 2987762 - RNA, 21 nt, Human
cagccccaucccaaacccuuc

SEQ ID NO: 2987763 - RNA, 18 nt, Human
cagccccagugcccacag

SEQ ID NO: 2987764 - RNA, 17 nt, Human
cagccccagugcccaca

SEQ ID NO: 2987765 - RNA, 16 nt, Human
cagccccagugcccac

SEQ ID NO: 2987766 - RNA, 15 nt, Human
cagccccagugccca

SEQ ID NO: 2987767 - RNA, 14 nt, Human
cagccccagugccc

SEQ ID NO: 2987768 - RNA, 13 nt, Human
cagccccagugcc

SEQ ID NO: 2987769 - RNA, 16 nt, Human
cagccuaguugaucag

SEQ ID NO: 2987770 - RNA, 18 nt, Human
cagccucaaccuccuggg

SEQ ID NO: 2987771 - RNA, 17 nt, Human
cagccucaaccuccugg

SEQ ID NO: 2987772 - RNA, 21 nt, Human
cagccucaaccuccugggcua

SEQ ID NO: 2987773 - RNA, 20 nt, Human
cagccucaaccuccugggcu

SEQ ID NO: 2987774 - RNA, 19 nt, Human
cagccucaaccuccugggc

SEQ ID NO: 2987775 - RNA, 14 nt, Human
cagccucacagucc

SEQ ID NO: 2987776 - RNA, 15 nt, Human
cagccucacaguccu

SEQ ID NO: 2987777 - RNA, 20 nt, Human
cagccucacaguccuuacca

SEQ ID NO: 2987778 - RNA, 22 nt, Human
cagccucccgaauagcugggac

SEQ ID NO: 2987779 - RNA, 21 nt, Human
cagccucccgaauagcuggga

SEQ ID NO: 2987780 - RNA, 20 nt, Human
cagccucccgaauagcuggg

SEQ ID NO: 2987781 - RNA, 23 nt, Human
cagccucccaaagugcugggauu

SEQ ID NO: 2987782 - RNA, 21 nt, Human
cagccucccaaagugcuggga

SEQ ID NO: 2987783 - RNA, 20 nt, Human
cagccucccaaagugcuggg

SEQ ID NO: 2987784 - RNA, 19 nt, Human
cagccucccaaagugcugg

SEQ ID NO: 2987785 - RNA, 21 nt, Human
cagccguguaaccauggaccc

SEQ ID NO: 2987786 - RNA, 18 nt, Human
cagcccugcagagggcac

SEQ ID NO: 2987787 - RNA, 20 nt, Human
cagcccugcagagggcacag

SEQ ID NO: 2987788 - RNA, 13 nt, Human
cagcccugcagag

SEQ ID NO: 2987789 - RNA, 14 nt, Human
cagcccugcagagg

SEQ ID NO: 2987790 - RNA, 15 nt, Human
cagcccugcagaggg

SEQ ID NO: 2987791 - RNA, 16 nt, Human
cagcccugcagagggc

SEQ ID NO: 2987792 - RNA, 19 nt, Human
cagcuacuugggaggcuga

SEQ ID NO: 2987793 - RNA, 24 nt, Human
cagcuacucgggaggcugaggcag

SEQ ID NO: 2987794 - RNA, 23 nt, Human
cagcuacucgggaggcugaggca

SEQ ID NO: 2987795 - RNA, 17 nt, Human
cagcuacucgggaggcu

SEQ ID NO: 2987796 - RNA, 19 nt, Human
cagcuacucgggaggcuga

SEQ ID NO: 2987797 - RNA, 16 nt, Human
cagcuaaugggacacu

SEQ ID NO: 2987798 - RNA, 15 nt, Human
cagcuaaugggacac

SEQ ID NO: 2987799 - RNA, 20 nt, Human
cagcuaacauggaaguacua

SEQ ID NO: 2987800 - RNA, 20 nt, Human
cagcgagcccugguggcagu

SEQ ID NO: 2987801 - RNA, 19 nt, Human
cagcgagcccugguggcag

SEQ ID NO: 2987802 - RNA, 17 nt, Human
cagcgagcccugguggc

SEQ ID NO: 2987803 - RNA, 16 nt, Human
cagcgagcccuggugg

SEQ ID NO: 2987804 - RNA, 13 nt, Human
cagcgagcccugg

SEQ ID NO: 2987805 - RNA, 19 nt, Human
cagcuaacauggaaguacu

SEQ ID NO: 2987806 - RNA, 18 nt, Human
cagcuaacauggaaguac

SEQ ID NO: 2987807 - RNA, 21 nt, Human
cagcgagcccugguggcagug

SEQ ID NO: 2987808 - RNA, 19 nt, Human
cagcucaccagccccagug

SEQ ID NO: 2987809 - RNA, 17 nt, Human
cagcucaccagccccag

SEQ ID NO: 2987810 - RNA, 16 nt, Human
cagcucaccagcccca

SEQ ID NO: 2987811 - RNA, 15 nt, Human
cagcucaccagcccc

SEQ ID NO: 2987812 - RNA, 13 nt, Human
cagcucaccagcc

SEQ ID NO: 2987813 - RNA, 13 nt, Human
cagcucaccucuc

SEQ ID NO: 2987814 - RNA, 15 nt, Human
cagcucaccucuccc

SEQ ID NO: 2987815 - RNA, 16 nt, Human
cagcucaccucucccu

SEQ ID NO: 2987816 - RNA, 17 nt, Human
cagcucaccucucccuu

SEQ ID NO: 2987817 - RNA, 21 nt, Human
cagcucaccagccccagugcc

SEQ ID NO: 2987818 - RNA, 20 nt, Human
cagcucaccagccccagugc

SEQ ID NO: 2987819 - RNA, 22 nt, Human
cagcucaccagccccagugccc

SEQ ID NO: 2987820 - RNA, 19 nt, Human
cagcucaccucucccuugg

SEQ ID NO: 2987821 - RNA, 20 nt, Human
cagcucaccucucccuugga

SEQ ID NO: 2987822 - RNA, 12 nt, Human
cagcucagagag

SEQ ID NO: 2987823 - RNA, 20 nt, Human
cagccuugaccauucuccac

SEQ ID NO: 2987824 - RNA, 21 nt, Human
cagccuugaccauucuccacc

SEQ ID NO: 2987825 - RNA, 17 nt, Human
cagccuugaccauucuc

SEQ ID NO: 2987826 - RNA, 22 nt, Human
cagccuugaccauucuccaccu

SEQ ID NO: 2987827 - RNA, 23 nt, Human
cagccuugaccauucuccaccug

SEQ ID NO: 2987828 - RNA, 24 nt, Human
cagccuugaccauucuccaccugc

SEQ ID NO: 2987829 - RNA, 16 nt, Human
cagccugggcaaugug

SEQ ID NO: 2987830 - RNA, 19 nt, Human
cagccugggcaaugugaua

SEQ ID NO: 2987831 - RNA, 20 nt, Human
cagccugggcaacagagcaa

SEQ ID NO: 2987832 - RNA, 19 nt, Human
cagccugggcaacagagca

SEQ ID NO: 2987833 - RNA, 15 nt, Human
cagccuggacccugu

SEQ ID NO: 2987834 - RNA, 19 nt, Human
cagccuggacccuguggau

SEQ ID NO: 2987835 - RNA, 21 nt, Human
cagccuggaugccauccaagu

SEQ ID NO: 2987836 - RNA, 17 nt, Human
cagccuggaugccaucc

SEQ ID NO: 2987837 - RNA, 11 nt, Human
cagccuggaug

SEQ ID NO: 2987838 - RNA, 16 nt, Human
cagccuggaugccauc

SEQ ID NO: 2987839 - RNA, 15 nt, Human
cagccuggaugccau

SEQ ID NO: 2987840 - RNA, 12 nt, Human
cagccuggaugc

SEQ ID NO: 2987841 - RNA, 23 nt, Human
cagccucccgaguagcugggacu

SEQ ID NO: 2987842 - RNA, 22 nt, Human
cagccucccgaguagcugggac

SEQ ID NO: 2987843 - RNA, 21 nt, Human
cagccucccgaguagcuggga

SEQ ID NO: 2987844 - RNA, 20 nt, Human
cagccucccgaguagcuggg

SEQ ID NO: 2987845 - RNA, 19 nt, Human
cagccucccgaguagcugg

SEQ ID NO: 2987846 - RNA, 23 nt, Human
cagccucccgaauagcugggacu

SEQ ID NO: 2987847 - RNA, 20 nt, Human
cagccugcuccagcuguuca

SEQ ID NO: 2987848 - RNA, 16 nt, Human
cagcucuccccuucuc

SEQ ID NO: 2987849 - RNA, 21 nt, Human
cagcucugcaagaauugaagc

SEQ ID NO: 2987850 - RNA, 20 nt, Human
cagcucugcauacucauuag

SEQ ID NO: 2987851 - RNA, 15 nt, Human
cagcucugcaagaau

SEQ ID NO: 2987852 - RNA, 16 nt, Human
cagcucugcaagaauu

SEQ ID NO: 2987853 - RNA, 23 nt, Human
cagcuccuucuguccuacucugu

SEQ ID NO: 2987854 - RNA, 21 nt, Human
cagcuccuucuguccuacucu

SEQ ID NO: 2987855 - RNA, 17 nt, Human
cagcuccuucuguccua

SEQ ID NO: 2987856 - RNA, 16 nt, Human
cagcuccuucuguccu

SEQ ID NO: 2987857 - RNA, 13 nt, Human
cagcucagagagg

SEQ ID NO: 2987858 - RNA, 17 nt, Human
cagcucagagagggugg

SEQ ID NO: 2987859 - RNA, 19 nt, Human
cagcucagagaggguggga

SEQ ID NO: 2987860 - RNA, 20 nt, Human
cagcucagagagggugggag

SEQ ID NO: 2987861 - RNA, 23 nt, Human
cagcucuucuccaggcuguaucc

SEQ ID NO: 2987862 - RNA, 19 nt, Human
cagcucuucuccaggcugu

SEQ ID NO: 2987863 - RNA, 18 nt, Human
cagcucuucuccaggcug

SEQ ID NO: 2987864 - RNA, 17 nt, Human
cagcucuucuccaggcu

SEQ ID NO: 2987865 - RNA, 16 nt, Human
cagcucuucuccaggc

SEQ ID NO: 2987866 - RNA, 15 nt, Human
cagcucuucuccagg

SEQ ID NO: 2987867 - RNA, 14 nt, Human
cagcucuucuccag

SEQ ID NO: 2987868 - RNA, 13 nt, Human
cagcucuucucca

SEQ ID NO: 2987869 - RNA, 10 nt, Human
cagcucuuau

SEQ ID NO: 2987870 - RNA, 21 nt, Human
cagcucuuauauugccauuuc

SEQ ID NO: 2987871 - RNA, 23 nt, Human
cagcucuguccugggagugagcu

SEQ ID NO: 2987872 - RNA, 18 nt, Human
cagcucuguccugggagu

SEQ ID NO: 2987873 - RNA, 17 nt, Human
cagcucuguccugggag

SEQ ID NO: 2987874 - RNA, 16 nt, Human
cagcucuguccuggga

SEQ ID NO: 2987875 - RNA, 14 nt, Human
cagcucuguccugg

SEQ ID NO: 2987876 - RNA, 22 nt, Human
cagcucugguccauagagagca

SEQ ID NO: 2987877 - RNA, 23 nt, Human
cagcucugguccauagagagcaa

SEQ ID NO: 2987878 - RNA, 13 nt, Human
cagcucuguccug

SEQ ID NO: 2987879 - RNA, 12 nt, Human
cagcucuguccu

SEQ ID NO: 2987880 - RNA, 16 nt, Human
cagcucugguccauag

SEQ ID NO: 2987881 - RNA, 17 nt, Human
cagcucugguccauaga

SEQ ID NO: 2987882 - RNA, 18 nt, Human
cagcucugguccauagag

SEQ ID NO: 2987883 - RNA, 21 nt, Human
cagcucugguccauagagagc

SEQ ID NO: 2987884 - RNA, 10 nt, Human
cagcucuggu

SEQ ID NO: 2987885 - RNA, 13 nt, Human
cagcucuggucca

SEQ ID NO: 2987886 - RNA, 18 nt, Human
cagcugguugagguuuca

SEQ ID NO: 2987887 - RNA, 18 nt, Human
cagcuguaugauucccag

SEQ ID NO: 2987888 - RNA, 21 nt, Human
cagcugggguggggaccucag

SEQ ID NO: 2987889 - RNA, 22 nt, Human
cagcugggguggggaccucagg

SEQ ID NO: 2987890 - RNA, 23 nt, Human
cagcugggguggggaccucaggc

SEQ ID NO: 2987891 - RNA, 22 nt, Human
cagcugcuuuugucuaugggac

SEQ ID NO: 2987892 - RNA, 23 nt, Human
cagcugcuuuugucuaugggacu

SEQ ID NO: 2987893 - RNA, 13 nt, Human
cagcugcuugggc

SEQ ID NO: 2987894 - RNA, 14 nt, Human
cagcugcuugggcu

SEQ ID NO: 2987895 - RNA, 15 nt, Human
cagcugcuugggcuu

SEQ ID NO: 2987896 - RNA, 16 nt, Human
cagcugcuugggcuuc

SEQ ID NO: 2987897 - RNA, 18 nt, Human
cagcugcuugggcuucau

SEQ ID NO: 2987898 - RNA, 19 nt, Human
cagcugcuugggcuucauc

SEQ ID NO: 2987899 - RNA, 21 nt, Human
cagcugcuugggcuucauccu

SEQ ID NO: 2987900 - RNA, 22 nt, Human
cagcugcuugggcuucauccuc

SEQ ID NO: 2987901 - RNA, 20 nt, Human
cagcugcugaaacaacaaau

SEQ ID NO: 2987902 - RNA, 21 nt, Human
cagcugcugaaacaacaaaua

SEQ ID NO: 2987903 - RNA, 19 nt, Human
cagcugcugagauccugga

SEQ ID NO: 2987904 - RNA, 12 nt, Human
cagcugcugaga

SEQ ID NO: 2987905 - RNA, 21 nt, Human
cagcugcugagauccuggacu

SEQ ID NO: 2987906 - RNA, 17 nt, Human
cagcugcuacuacuccu

SEQ ID NO: 2987907 - RNA, 18 nt, Human
cagcugccugggaucccu

SEQ ID NO: 2987908 - RNA, 23 nt, Human
cagcugccugggaucccucaucc

SEQ ID NO: 2987909 - RNA, 24 nt, Human
cagcugcgguccacccaggagccc

SEQ ID NO: 2987910 - RNA, 23 nt, Human
cagcugcgguccacccaggagcc

SEQ ID NO: 2987911 - RNA, 22 nt, Human
cagcugcgguccacccaggagc

SEQ ID NO: 2987912 - RNA, 21 nt, Human
cagcugcgguccacccaggag

SEQ ID NO: 2987913 - RNA, 20 nt, Human
cagcugcgguccacccagga

SEQ ID NO: 2987914 - RNA, 19 nt, Human
cagcugcgguccacccagg

SEQ ID NO: 2987915 - RNA, 15 nt, Human
cagcugccugggauc

SEQ ID NO: 2987916 - RNA, 18 nt, Human
cagcugcgguccacccag

SEQ ID NO: 2987917 - RNA, 22 nt, Human
caggaagcugugagagcaguuu

SEQ ID NO: 2987918 - RNA, 13 nt, Human
caggaagcuguga

SEQ ID NO: 2987919 - RNA, 14 nt, Human
caggaagcugugag

SEQ ID NO: 2987920 - RNA, 20 nt, Human
caggaagcucagggccuggc

SEQ ID NO: 2987921 - RNA, 21 nt, Human
caggaagcucagggccuggcu

SEQ ID NO: 2987922 - RNA, 23 nt, Human
caggaagcucagggccuggcuca

SEQ ID NO: 2987923 - RNA, 16 nt, Human
caggaagcucagggcc

SEQ ID NO: 2987924 - RNA, 17 nt, Human
caggaagcucagggccu

SEQ ID NO: 2987925 - RNA, 18 nt, Human
caggaagcucagggccug

SEQ ID NO: 2987926 - RNA, 19 nt, Human
caggaagcucagggccugg

SEQ ID NO: 2987927 - RNA, 14 nt, Human
caggaagcucaggg

SEQ ID NO: 2987928 - RNA, 15 nt, Human
caggaagcucagggc

SEQ ID NO: 2987929 - RNA, 13 nt, Human
caggaagcucagg

SEQ ID NO: 2987930 - RNA, 14 nt, Human
caggaagccagcag

SEQ ID NO: 2987931 - RNA, 16 nt, Human
caggaagccagcaggc

SEQ ID NO: 2987932 - RNA, 17 nt, Human
caggaagccagcaggcu

SEQ ID NO: 2987933 - RNA, 18 nt, Human
caggaagccagcaggcuc

SEQ ID NO: 2987934 - RNA, 19 nt, Human
caggaagccagcaggcucu

SEQ ID NO: 2987935 - RNA, 21 nt, Human
caggaagccagcaggcucuca

SEQ ID NO: 2987936 - RNA, 22 nt, Human
caggaagccagcaggcucucag

SEQ ID NO: 2987937 - RNA, 14 nt, Human
caggacgagaugac

SEQ ID NO: 2987938 - RNA, 15 nt, Human
caggaaggcuaaagg

SEQ ID NO: 2987939 - RNA, 14 nt, Human
caggaaguacugga

SEQ ID NO: 2987940 - RNA, 16 nt, Human
caggaaguacuggaga

SEQ ID NO: 2987941 - RNA, 12 nt, Human
caggaaguacug

SEQ ID NO: 2987942 - RNA, 17 nt, Human
caggaaguacuggagaa

SEQ ID NO: 2987943 - RNA, 18 nt, Human
caggaaguacuggagaaa

SEQ ID NO: 2987944 - RNA, 20 nt, Human
caggaaguacuggagaaaau

SEQ ID NO: 2987945 - RNA, 15 nt, Human
caggaaguagaggag

SEQ ID NO: 2987946 - RNA, 16 nt, Human
caggaaguagaggagg

SEQ ID NO: 2987947 - RNA, 18 nt, Human
cagcuugaaacugagaug

SEQ ID NO: 2987948 - RNA, 21 nt, Human
cagcuucauuuccugugucuu

SEQ ID NO: 2987949 - RNA, 20 nt, Human
cagcuucauuuccugugucu

SEQ ID NO: 2987950 - RNA, 19 nt, Human
cagcuucauuuccuguguc

SEQ ID NO: 2987951 - RNA, 21 nt, Human
cagcuugaggguugggcuggu

SEQ ID NO: 2987952 - RNA, 20 nt, Human
cagcuugaggguugggcugg

SEQ ID NO: 2987953 - RNA, 19 nt, Human
cagcuugaggguugggcug

SEQ ID NO: 2987954 - RNA, 18 nt, Human
cagcuugaggguugggcu

SEQ ID NO: 2987955 - RNA, 18 nt, Human
cagcuugaccgugaggcc

SEQ ID NO: 2987956 - RNA, 19 nt, Human
cagcuugaccgugaggcca

SEQ ID NO: 2987957 - RNA, 20 nt, Human
cagcuugaccgugaggccag

SEQ ID NO: 2987958 - RNA, 21 nt, Human
cagcuugaccgugaggccaga

SEQ ID NO: 2987959 - RNA, 15 nt, Human
cagcuugaggguugg

SEQ ID NO: 2987960 - RNA, 14 nt, Human
cagcuugaggguug

SEQ ID NO: 2987961 - RNA, 23 nt, Human
cagcuuuccucaaaacuucagac

SEQ ID NO: 2987962 - RNA, 22 nt, Human
cagcuuguaaauagcucaggug

SEQ ID NO: 2987963 - RNA, 21 nt, Human
cagcuuguaaauagcucaggu

SEQ ID NO: 2987964 - RNA, 20 nt, Human
cagcuuguaaauagcucagg

SEQ ID NO: 2987965 - RNA, 19 nt, Human
cagcuuguaaauagcucag

SEQ ID NO: 2987966 - RNA, 18 nt, Human
cagcuuguaaauagcuca

SEQ ID NO: 2987967 - RNA, 18 nt, Human
caggaaccacaagacugc

SEQ ID NO: 2987968 - RNA, 12 nt, Human
cagcuuuguuug

SEQ ID NO: 2987969 - RNA, 21 nt, Human
cagcuuuguuuguugucagcu

SEQ ID NO: 2987970 - RNA, 22 nt, Human
cagcuuuguuuguugucagcug

SEQ ID NO: 2987971 - RNA, 23 nt, Human
cagcuuuguuuguugucagcuga

SEQ ID NO: 2987972 - RNA, 22 nt, Human
caggaagcucagggccuggcuc

SEQ ID NO: 2987973 - RNA, 20 nt, Human
cagagccccacccucagaug

SEQ ID NO: 2987974 - RNA, 12 nt, Human
cagagccugcag

SEQ ID NO: 2987975 - RNA, 20 nt, Human
cagaggaaagcaaaggagau

SEQ ID NO: 2987976 - RNA, 13 nt, Human
cagagccugcagu

SEQ ID NO: 2987977 - RNA, 13 nt, Human
cagaggaaggaga

SEQ ID NO: 2987978 - RNA, 13 nt, Human
cagagccccacag

SEQ ID NO: 2987979 - RNA, 22 nt, Human
cagagccccacagccccaucug

SEQ ID NO: 2987980 - RNA, 16 nt, Human
cagagccccacagccc

SEQ ID NO: 2987981 - RNA, 15 nt, Human
cagagccccacagcc

SEQ ID NO: 2987982 - RNA, 23 nt, Human
cagagcccacgcccccacuggug

SEQ ID NO: 2987983 - RNA, 17 nt, Human
cagagcccacgccccca

SEQ ID NO: 2987984 - RNA, 19 nt, Human
cagagcccacgcccccacu

SEQ ID NO: 2987985 - RNA, 20 nt, Human
cagagcccacgcccccacug

SEQ ID NO: 2987986 - RNA, 21 nt, Human
cagagcccacgcccccacugg

SEQ ID NO: 2987987 - RNA, 20 nt, Human
cagaggagagaggacccccu

SEQ ID NO: 2987988 - RNA, 11 nt, Human
cagaggcagcc

SEQ ID NO: 2987989 - RNA, 15 nt, Human
cagaggagagaggac

SEQ ID NO: 2987990 - RNA, 19 nt, Human
cagaggagagaggaccccc

SEQ ID NO: 2987991 - RNA, 13 nt, Human
cagaggagagagg

SEQ ID NO: 2987992 - RNA, 16 nt, Human
cagagcccacgccccc

SEQ ID NO: 2987993 - RNA, 20 nt, Human
cagagcccaccuuggcucaa

SEQ ID NO: 2987994 - RNA, 19 nt, Human
cagagcccaccuuggcuca

SEQ ID NO: 2987995 - RNA, 17 nt, Human
cagagcccaccuuggcu

SEQ ID NO: 2987996 - RNA, 15 nt, Human
cagagcccaccuugg

SEQ ID NO: 2987997 - RNA, 13 nt, Human
cagagcagagacc

SEQ ID NO: 2987998 - RNA, 14 nt, Human
cagagcagagacca

SEQ ID NO: 2987999 - RNA, 15 nt, Human
cagagcagagaccau

SEQ ID NO: 2988000 - RNA, 17 nt, Human
cagagcagagaccaucc

SEQ ID NO: 2988001 - RNA, 18 nt, Human
cagagcagagaccauccc

SEQ ID NO: 2988002 - RNA, 19 nt, Human
cagagcagagaccaucccu

SEQ ID NO: 2988003 - RNA, 21 nt, Human
cagagcagagaccaucccuga

SEQ ID NO: 2988004 - RNA, 18 nt, Human
cagagcaccuuagacagu

SEQ ID NO: 2988005 - RNA, 19 nt, Human
cagagcaccuuagacaguc

SEQ ID NO: 2988006 - RNA, 21 nt, Human
cagagcaccuuagacaguccc

SEQ ID NO: 2988007 - RNA, 22 nt, Human
cagagcaccuuagacagucccu

SEQ ID NO: 2988008 - RNA, 11 nt, Human
cagagcagaga

SEQ ID NO: 2988009 - RNA, 12 nt, Human
cagagcagagac

SEQ ID NO: 2988010 - RNA, 23 nt, Human
cagagcaccuuagacagucccug

SEQ ID NO: 2988011 - RNA, 21 nt, Human
cagagaagauucuuguauuua

SEQ ID NO: 2988012 - RNA, 21 nt, Human
cagagaaugaaagggcccaga

SEQ ID NO: 2988013 - RNA, 20 nt, Human
cagagaaugaaagggcccag

SEQ ID NO: 2988014 - RNA, 15 nt, Human
cagagaauucucuua

SEQ ID NO: 2988015 - RNA, 19 nt, Human
cagagaaugaaagggccca

SEQ ID NO: 2988016 - RNA, 16 nt, Human
cagagacacaagccuu

SEQ ID NO: 2988017 - RNA, 17 nt, Human
cagagacacaagccuuc

SEQ ID NO: 2988018 - RNA, 14 nt, Human
cagagacacaagcc

SEQ ID NO: 2988019 - RNA, 15 nt, Human
cagagacacaagccu

SEQ ID NO: 2988020 - RNA, 14 nt, Human
cagagaccaucccu

SEQ ID NO: 2988021 - RNA, 16 nt, Human
cagagaccaucccuga

SEQ ID NO: 2988022 - RNA, 13 nt, Human
cagagaccauccc

SEQ ID NO: 2988023 - RNA, 16 nt, Human
cagagacuccugcagg

SEQ ID NO: 2988024 - RNA, 17 nt, Human
cagagacuccugcaggc

SEQ ID NO: 2988025 - RNA, 18 nt, Human
cagagacuccugcaggca

SEQ ID NO: 2988026 - RNA, 19 nt, Human
cagagacuccugcaggcag

SEQ ID NO: 2988027 - RNA, 14 nt, Human
cagagacuccugca

SEQ ID NO: 2988028 - RNA, 15 nt, Human
cagagacuccugcag

SEQ ID NO: 2988029 - RNA, 13 nt, Human
cagagacuccugc

SEQ ID NO: 2988030 - RNA, 17 nt, Human
cagagaccaucccugaa

SEQ ID NO: 2988031 - RNA, 18 nt, Human
cagagaccaucccugaag

SEQ ID NO: 2988032 - RNA, 19 nt, Human
cagagaccaucccugaagg

SEQ ID NO: 2988033 - RNA, 20 nt, Human
cagagaccaucccugaaggc

SEQ ID NO: 2988034 - RNA, 21 nt, Human
cagagaccaucccugaaggcc

SEQ ID NO: 2988035 - RNA, 14 nt, Human
cagagcaagugaga

SEQ ID NO: 2988036 - RNA, 20 nt, Human
cagagcaagugagacccugu

SEQ ID NO: 2988037 - RNA, 16 nt, Human
cagagcaccuuagaca

SEQ ID NO: 2988038 - RNA, 21 nt, Human
cagagugcuuuaccaauugaa

SEQ ID NO: 2988039 - RNA, 20 nt, Human
cagagugagacucugucuca

SEQ ID NO: 2988040 - RNA, 19 nt, Human
cagagugagacucugucuc

SEQ ID NO: 2988041 - RNA, 12 nt, Human
cagaguggcagu

SEQ ID NO: 2988042 - RNA, 18 nt, Human
cagaguggaauaagacag

SEQ ID NO: 2988043 - RNA, 17 nt, Human
cagaguggaauaagaca

SEQ ID NO: 2988044 - RNA, 20 nt, Human
cagaguggaauaagacagag

SEQ ID NO: 2988045 - RNA, 18 nt, Human
cagagugagacucugucu

SEQ ID NO: 2988046 - RNA, 17 nt, Human
cagagugagacucuguc

SEQ ID NO: 2988047 - RNA, 16 nt, Human
cagagugagacucugu

SEQ ID NO: 2988048 - RNA, 23 nt, Human
cagagucucacuguugcccaggc

SEQ ID NO: 2988049 - RNA, 22 nt, Human
cagagucucacuguugcccagg

SEQ ID NO: 2988050 - RNA, 23 nt, Human
cagagggagugacagaggcagcc

SEQ ID NO: 2988051 - RNA, 22 nt, Human
cagagggagugacagaggcagc

SEQ ID NO: 2988052 - RNA, 21 nt, Human
cagagggagugacagaggcag

SEQ ID NO: 2988053 - RNA, 20 nt, Human
cagagggagugacagaggca

SEQ ID NO: 2988054 - RNA, 15 nt, Human
cagagggccugcaag

SEQ ID NO: 2988055 - RNA, 19 nt, Human
cagagggccugcaagggag

SEQ ID NO: 2988056 - RNA, 21 nt, Human
cagagucucacuguugcccag

SEQ ID NO: 2988057 - RNA, 20 nt, Human
cagagucucacuguugccca

SEQ ID NO: 2988058 - RNA, 19 nt, Human
cagagucucacuguugccc

SEQ ID NO: 2988059 - RNA, 17 nt, Human
cagagucucacuguugc

SEQ ID NO: 2988060 - RNA, 13 nt, Human
cagagucucacug

SEQ ID NO: 2988061 - RNA, 13 nt, Human
cagaggcugccuc

SEQ ID NO: 2988062 - RNA, 19 nt, Human
cagagggagugacagaggc

SEQ ID NO: 2988063 - RNA, 18 nt, Human
cagagggagugacagagg

SEQ ID NO: 2988064 - RNA, 16 nt, Human
cagagggagugacaga

SEQ ID NO: 2988065 - RNA, 14 nt, Human
cagagggagugaca

SEQ ID NO: 2988066 - RNA, 23 nt, Human
cagaggcugccucucccaucacu

SEQ ID NO: 2988067 - RNA, 22 nt, Human
cagaggcagccccauucugccu

SEQ ID NO: 2988068 - RNA, 20 nt, Human
cagaggcagccccauucugc

SEQ ID NO: 2988069 - RNA, 19 nt, Human
cagaggcagccccauucug

SEQ ID NO: 2988070 - RNA, 18 nt, Human
cagaggcagccccauucu

SEQ ID NO: 2988071 - RNA, 15 nt, Human
cagaggcagccccau

SEQ ID NO: 2988072 - RNA, 14 nt, Human
cagaggcagcccca

SEQ ID NO: 2988073 - RNA, 13 nt, Human
cagaggcagcccc

SEQ ID NO: 2988074 - RNA, 12 nt, Human
cagaggcagccc

SEQ ID NO: 2988075 - RNA, 16 nt, Human
cagaggccaugggccu

SEQ ID NO: 2988076 - RNA, 19 nt, Human
cagaggccaugggccuccu

SEQ ID NO: 2988077 - RNA, 23 nt, Human
cagaggcagccccauucugccug

SEQ ID NO: 2988078 - RNA, 21 nt, Human
cagaggccaugggccuccugu

SEQ ID NO: 2988079 - RNA, 20 nt, Human
cagaggccaugggccuccug

SEQ ID NO: 2988080 - RNA, 17 nt, Human
cagaugcacaugagcug

SEQ ID NO: 2988081 - RNA, 13 nt, Human
cagaugcaccagc

SEQ ID NO: 2988082 - RNA, 16 nt, Human
cagaugcaccagcccu

SEQ ID NO: 2988083 - RNA, 14 nt, Human
cagaugcaccagcc

SEQ ID NO: 2988084 - RNA, 22 nt, Human
cagaugcaccagcccuuagcag

SEQ ID NO: 2988085 - RNA, 17 nt, Human
cagaugcaccagcccuu

SEQ ID NO: 2988086 - RNA, 14 nt, Human
cagauccuggaaau

SEQ ID NO: 2988087 - RNA, 20 nt, Human
cagaucucuaacuucaccau

SEQ ID NO: 2988088 - RNA, 13 nt, Human
cagauccuggaaa

SEQ ID NO: 2988089 - RNA, 22 nt, Human
cagauacaggaaaagcugcuga

SEQ ID NO: 2988090 - RNA, 21 nt, Human
cagauacaggaaaagcugcug

SEQ ID NO: 2988091 - RNA, 20 nt, Human
cagauacaggaaaagcugcu

SEQ ID NO: 2988092 - RNA, 15 nt, Human
cagaguugaagacag

SEQ ID NO: 2988093 - RNA, 16 nt, Human
cagaguugaagacaga

SEQ ID NO: 2988094 - RNA, 14 nt, Human
cagaguugaagaca

SEQ ID NO: 2988095 - RNA, 17 nt, Human
cagaguugaagacagag

SEQ ID NO: 2988096 - RNA, 18 nt, Human
cagaguugaagacagagc

SEQ ID NO: 2988097 - RNA, 19 nt, Human
cagaguugaagacagagcu

SEQ ID NO: 2988098 - RNA, 20 nt, Human
cagaguugaagacagagcua

SEQ ID NO: 2988099 - RNA, 14 nt, Human
cagaguuguuacau

SEQ ID NO: 2988100 - RNA, 22 nt, Human
cagaguugaagacagagcuaca

SEQ ID NO: 2988101 - RNA, 14 nt, Human
cagauaaucacaau

SEQ ID NO: 2988102 - RNA, 18 nt, Human
cagaguuguuacauuuuu

SEQ ID NO: 2988103 - RNA, 15 nt, Human
cagaguuguuacauu

SEQ ID NO: 2988104 - RNA, 19 nt, Human
cagaguuguuacauuuuua

SEQ ID NO: 2988105 - RNA, 23 nt, Human
cagauaaauaguuuaugauucca

SEQ ID NO: 2988106 - RNA, 14 nt, Human
cagauaaacaguag

SEQ ID NO: 2988107 - RNA, 17 nt, Human
cagaacuauguuuuugu

SEQ ID NO: 2988108 - RNA, 20 nt, Human
cagaagcaacccaaauguuc

SEQ ID NO: 2988109 - RNA, 19 nt, Human
cagaagcaacccaaauguu

SEQ ID NO: 2988110 - RNA, 21 nt, Human
cagaagacacugaugggcaac

SEQ ID NO: 2988111 - RNA, 22 nt, Human
cagaagaaaauagaauugacau

SEQ ID NO: 2988112 - RNA, 19 nt, Human
cagaagaaaauagaauuga

SEQ ID NO: 2988113 - RNA, 13 nt, Human
cagaagaaaauag

SEQ ID NO: 2988114 - RNA, 18 nt, Human
cagaagucaaggcuuaga

SEQ ID NO: 2988115 - RNA, 16 nt, Human
cagaagucaaggcuua

SEQ ID NO: 2988116 - RNA, 17 nt, Human
cagaagucaaggcuuag

SEQ ID NO: 2988117 - RNA, 23 nt, Human
cagaaucgcuccaccuugcagcu

SEQ ID NO: 2988118 - RNA, 21 nt, Human
cagaaucgcuccaccuugcag

SEQ ID NO: 2988119 - RNA, 18 nt, Human
cagaaucucaaauaacua

SEQ ID NO: 2988120 - RNA, 17 nt, Human
cagaaucucaaauaacu

SEQ ID NO: 2988121 - RNA, 16 nt, Human
cagaaggaagacuuca

SEQ ID NO: 2988122 - RNA, 17 nt, Human
cagaaggaagacuucau

SEQ ID NO: 2988123 - RNA, 18 nt, Human
cagaaggaagacuucauc

SEQ ID NO: 2988124 - RNA, 19 nt, Human
cagaaggaagacuucaucc

SEQ ID NO: 2988125 - RNA, 22 nt, Human
cacuuucuagccagaggagaga

SEQ ID NO: 2988126 - RNA, 16 nt, Human
cacuuuggcccagggu

SEQ ID NO: 2988127 - RNA, 13 nt, Human
cacuuuggcccag

SEQ ID NO: 2988128 - RNA, 13 nt, Human
cacuuuguucugg

SEQ ID NO: 2988129 - RNA, 14 nt, Human
cacuuuguucuggc

SEQ ID NO: 2988130 - RNA, 16 nt, Human
cacuuuguucuggcuc

SEQ ID NO: 2988131 - RNA, 23 nt, Human
cacuuuguucuggcucuuccagg

SEQ ID NO: 2988132 - RNA, 12 nt, Human
cacuuugggagg

SEQ ID NO: 2988133 - RNA, 13 nt, Human
cacuuugggaggc

SEQ ID NO: 2988134 - RNA, 16 nt, Human
cacuuugggaggccaa

SEQ ID NO: 2988135 - RNA, 14 nt, Human
cacuuuuguucuug

SEQ ID NO: 2988136 - RNA, 22 nt, Human
cacuuuuguucuugguuuguaa

SEQ ID NO: 2988137 - RNA, 22 nt, Human
cagaaaaguugaauuuuacaug

SEQ ID NO: 2988138 - RNA, 20 nt, Human
cagaaaaguugaauuuuaca

SEQ ID NO: 2988139 - RNA, 17 nt, Human
cagaaaaguugaauuuu

SEQ ID NO: 2988140 - RNA, 16 nt, Human
cagaaaauggaagaca

SEQ ID NO: 2988141 - RNA, 20 nt, Human
cagaaaauggaagacagcuc

SEQ ID NO: 2988142 - RNA, 21 nt, Human
cagaaaauggaagacagcucu

SEQ ID NO: 2988143 - RNA, 22 nt, Human
cagaaaauggaagacagcucuu

SEQ ID NO: 2988144 - RNA, 23 nt, Human
cagaaaauggaagacagcucuua

SEQ ID NO: 2988145 - RNA, 23 nt, Human
cagaacagugauuaccagggacu

SEQ ID NO: 2988146 - RNA, 18 nt, Human
cagaacagugauuaccag

SEQ ID NO: 2988147 - RNA, 19 nt, Human
cagaaagcagaacagugau

SEQ ID NO: 2988148 - RNA, 18 nt, Human
cagaaagcagaacaguga

SEQ ID NO: 2988149 - RNA, 18 nt, Human
cagaaaccuuccugcuga

SEQ ID NO: 2988150 - RNA, 23 nt, Human
cagagaaaguacuucuccacccu

SEQ ID NO: 2988151 - RNA, 19 nt, Human
cagagaaaguacuucucca

SEQ ID NO: 2988152 - RNA, 14 nt, Human
cagaccacaaaacu

SEQ ID NO: 2988153 - RNA, 20 nt, Human
cagaccacaaaacuuuucua

SEQ ID NO: 2988154 - RNA, 19 nt, Human
cagaccauuggggcuccca

SEQ ID NO: 2988155 - RNA, 21 nt, Human
cagaccauuggggcucccagc

SEQ ID NO: 2988156 - RNA, 20 nt, Human
cagaccauuggggcucccag

SEQ ID NO: 2988157 - RNA, 23 nt, Human
cagaccauuggggcucccagcca

SEQ ID NO: 2988158 - RNA, 22 nt, Human
cagaccauuggggcucccagcc

SEQ ID NO: 2988159 - RNA, 22 nt, Human
cagacccugcccugugggcccc

SEQ ID NO: 2988160 - RNA, 15 nt, Human
cagacccugcccugu

SEQ ID NO: 2988161 - RNA, 16 nt, Human
cagacccugcccugug

SEQ ID NO: 2988162 - RNA, 17 nt, Human
cagacccugcccugugg

SEQ ID NO: 2988163 - RNA, 21 nt, Human
cagacccugcccugugggccc

SEQ ID NO: 2988164 - RNA, 14 nt, Human
cagacccggcugcg

SEQ ID NO: 2988165 - RNA, 12 nt, Human
cagacccggcug

SEQ ID NO: 2988166 - RNA, 13 nt, Human
cagacccugcccu

SEQ ID NO: 2988167 - RNA, 14 nt, Human
cagacccugcccug

SEQ ID NO: 2988168 - RNA, 12 nt, Human
cagacccugccc

SEQ ID NO: 2988169 - RNA, 16 nt, Human
cagacccggcugcgug

SEQ ID NO: 2988170 - RNA, 14 nt, Human
cagaauuucccaaa

SEQ ID NO: 2988171 - RNA, 18 nt, Human
cagaauucucuaguuuga

SEQ ID NO: 2988172 - RNA, 15 nt, Human
cagaauucucuaguu

SEQ ID NO: 2988173 - RNA, 11 nt, Human
cagaauucuca

SEQ ID NO: 2988174 - RNA, 17 nt, Human
cagaauuucccaaagca

SEQ ID NO: 2988175 - RNA, 18 nt, Human
cagaauuucccaaagcag

SEQ ID NO: 2988176 - RNA, 19 nt, Human
cagaauuucccaaagcagu

SEQ ID NO: 2988177 - RNA, 20 nt, Human
cagaauuucccaaagcagug

SEQ ID NO: 2988178 - RNA, 24 nt, Human
cagaauuucccaaagcagugcaug

SEQ ID NO: 2988179 - RNA, 12 nt, Human
cagacaaagcgu

SEQ ID NO: 2988180 - RNA, 20 nt, Human
cagacaacaaaccuguuucu

SEQ ID NO: 2988181 - RNA, 22 nt, Human
cagacaaagcgugguggacaug

SEQ ID NO: 2988182 - RNA, 14 nt, Human
cagacacaugucca

SEQ ID NO: 2988183 - RNA, 17 nt, Human
cagacacauguccaaga

SEQ ID NO: 2988184 - RNA, 21 nt, Human
cagacacauguccaagaagcc

SEQ ID NO: 2988185 - RNA, 22 nt, Human
cagacacauguccaagaagccc

SEQ ID NO: 2988186 - RNA, 23 nt, Human
cagacacauguccaagaagccca

SEQ ID NO: 2988187 - RNA, 23 nt, Human
cagacacaggcccggcuccaggc

SEQ ID NO: 2988188 - RNA, 22 nt, Human
cagacacaggcccggcuccagg

SEQ ID NO: 2988189 - RNA, 21 nt, Human
cagacacaggcccggcuccag

SEQ ID NO: 2988190 - RNA, 18 nt, Human
cagacacaggcccggcuc

SEQ ID NO: 2988191 - RNA, 17 nt, Human
cagacacaggcccggcu

SEQ ID NO: 2988192 - RNA, 15 nt, Human
cagacacaggcccgg

SEQ ID NO: 2988193 - RNA, 14 nt, Human
cagacacaggcccg

SEQ ID NO: 2988194 - RNA, 13 nt, Human
cagacacaggccc

SEQ ID NO: 2988195 - RNA, 19 nt, Human
cagacauagaauuaacaca

SEQ ID NO: 2988196 - RNA, 17 nt, Human
cagacauagaauuaaca

SEQ ID NO: 2988197 - RNA, 19 nt, Human
cagacauacuaaccagcag

SEQ ID NO: 2988198 - RNA, 22 nt, Human
cagacaccuugacagggcacac

SEQ ID NO: 2988199 - RNA, 20 nt, Human
cagacaccuugacagggcac

SEQ ID NO: 2988200 - RNA, 19 nt, Human
cagacaccuugacagggca

SEQ ID NO: 2988201 - RNA, 20 nt, Human
cagacaguuaagagaaauga

SEQ ID NO: 2988202 - RNA, 16 nt, Human
cagacaacaaaccugu

SEQ ID NO: 2988203 - RNA, 20 nt, Human
cacccucagaugcacaugag

SEQ ID NO: 2988204 - RNA, 21 nt, Human
cacccggccccugcugguuca

SEQ ID NO: 2988205 - RNA, 18 nt, Human
cacccggccccugcuggu

SEQ ID NO: 2988206 - RNA, 17 nt, Human
cacccggccccugcugg

SEQ ID NO: 2988207 - RNA, 16 nt, Human
cacccggccccugcug

SEQ ID NO: 2988208 - RNA, 14 nt, Human
cacccggccccugc

SEQ ID NO: 2988209 - RNA, 13 nt, Human
cacccggccccug

SEQ ID NO: 2988210 - RNA, 19 nt, Human
cacccgcuaagagggaggg

SEQ ID NO: 2988211 - RNA, 12 nt, Human
cacccggccccu

SEQ ID NO: 2988212 - RNA, 20 nt, Human
caccccucaacaccucugca

SEQ ID NO: 2988213 - RNA, 13 nt, Human
cacauauugauuu

SEQ ID NO: 2988214 - RNA, 11 nt, Human
cacccugugau

SEQ ID NO: 2988215 - RNA, 12 nt, Human
cacccugugaug

SEQ ID NO: 2988216 - RNA, 15 nt, Human
cacccugugaugggg

SEQ ID NO: 2988217 - RNA, 18 nt, Human
cacccugugauggggccc

SEQ ID NO: 2988218 - RNA, 20 nt, Human
cacccugugauggggcccug

SEQ ID NO: 2988219 - RNA, 21 nt, Human
cacccugugauggggcccugc

SEQ ID NO: 2988220 - RNA, 22 nt, Human
cacccugugauggggcccugcc

SEQ ID NO: 2988221 - RNA, 23 nt, Human
cacccugugauggggcccugccu

SEQ ID NO: 2988222 - RNA, 15 nt, Human
caccgaaaacguggc

SEQ ID NO: 2988223 - RNA, 18 nt, Human
caccgaaaacguggcugc

SEQ ID NO: 2988224 - RNA, 19 nt, Human
caccgaaaacguggcugcu

SEQ ID NO: 2988225 - RNA, 21 nt, Human
caccgaaaacguggcugcuuc

SEQ ID NO: 2988226 - RNA, 22 nt, Human
caccgaaaacguggcugcuuca

SEQ ID NO: 2988227 - RNA, 14 nt, Human
caccgcagacagga

SEQ ID NO: 2988228 - RNA, 15 nt, Human
caccgcagacaggac

SEQ ID NO: 2988229 - RNA, 17 nt, Human
caccgcagacaggacca

SEQ ID NO: 2988230 - RNA, 18 nt, Human
caccgcagacaggaccag

SEQ ID NO: 2988231 - RNA, 12 nt, Human
caccgcagacag

SEQ ID NO: 2988232 - RNA, 13 nt, Human
caccgcagacagg

SEQ ID NO: 2988233 - RNA, 13 nt, Human
caccucccugcaa

SEQ ID NO: 2988234 - RNA, 14 nt, Human
caccucccugcaau

SEQ ID NO: 2988235 - RNA, 16 nt, Human
caccuccuaaaacaac

SEQ ID NO: 2988236 - RNA, 11 nt, Human
caccuccugcc

SEQ ID NO: 2988237 - RNA, 13 nt, Human
caccuccugccuc

SEQ ID NO: 2988238 - RNA, 14 nt, Human
caccuccugccucg

SEQ ID NO: 2988239 - RNA, 13 nt, Human
caccucucccuug

SEQ ID NO: 2988240 - RNA, 14 nt, Human
caccucucccuugg

SEQ ID NO: 2988241 - RNA, 17 nt, Human
caccucucccuuggauu

SEQ ID NO: 2988242 - RNA, 22 nt, Human
caccucuaucccggcuuuggug

SEQ ID NO: 2988243 - RNA, 10 nt, Human
caccucccug

SEQ ID NO: 2988244 - RNA, 14 nt, Human
caccucauggaauu

SEQ ID NO: 2988245 - RNA, 12 nt, Human
caccucauggaa

SEQ ID NO: 2988246 - RNA, 11 nt, Human
caccucaugga

SEQ ID NO: 2988247 - RNA, 18 nt, Human
caccgggccacagagaaa

SEQ ID NO: 2988248 - RNA, 15 nt, Human
caccgggccacagag

SEQ ID NO: 2988249 - RNA, 22 nt, Human
caccgggcacucagaagacacu

SEQ ID NO: 2988250 - RNA, 15 nt, Human
caccgggcacucaga

SEQ ID NO: 2988251 - RNA, 15 nt, Human
caccggcuggccugg

SEQ ID NO: 2988252 - RNA, 16 nt, Human
caccggcuggccuggc

SEQ ID NO: 2988253 - RNA, 14 nt, Human
caccggcuggccug

SEQ ID NO: 2988254 - RNA, 17 nt, Human
caccggcuggccuggcc

SEQ ID NO: 2988255 - RNA, 18 nt, Human
caccggcuggccuggccc

SEQ ID NO: 2988256 - RNA, 20 nt, Human
caccggcuggccuggccccu

SEQ ID NO: 2988257 - RNA, 14 nt, Human
caccgggcacucag

SEQ ID NO: 2988258 - RNA, 21 nt, Human
caccgcagacaggaccaggga

SEQ ID NO: 2988259 - RNA, 17 nt, Human
caccgccuugcccagcc

SEQ ID NO: 2988260 - RNA, 15 nt, Human
caccgccuugcccag

SEQ ID NO: 2988261 - RNA, 23 nt, Human
caccgccuugcccagccuggaug

SEQ ID NO: 2988262 - RNA, 18 nt, Human
caccgccuugcccagccu

SEQ ID NO: 2988263 - RNA, 12 nt, Human
caccuggccucu

SEQ ID NO: 2988264 - RNA, 13 nt, Human
caccuggccucug

SEQ ID NO: 2988265 - RNA, 14 nt, Human
caccuggccucugc

SEQ ID NO: 2988266 - RNA, 15 nt, Human
caccuggccucugca

SEQ ID NO: 2988267 - RNA, 17 nt, Human
caccuggccucugcacu

SEQ ID NO: 2988268 - RNA, 18 nt, Human
caccuggccucugcacuc

SEQ ID NO: 2988269 - RNA, 19 nt, Human
caccuggccucugcacucc

SEQ ID NO: 2988270 - RNA, 20 nt, Human
caccuggccucugcacuccc

SEQ ID NO: 2988271 - RNA, 12 nt, Human
caccuggcucug

SEQ ID NO: 2988272 - RNA, 23 nt, Human
caccuggccucugcacuccccug

SEQ ID NO: 2988273 - RNA, 23 nt, Human
caccuggcucuguggcgagccau

SEQ ID NO: 2988274 - RNA, 15 nt, Human
caccuggcucugugg

SEQ ID NO: 2988275 - RNA, 14 nt, Human
caccuggcucugug

SEQ ID NO: 2988276 - RNA, 13 nt, Human
caccuggcucugu

SEQ ID NO: 2988277 - RNA, 15 nt, Human
caccuguagucccag

SEQ ID NO: 2988278 - RNA, 23 nt, Human
caccugaagacucauucuucugu

SEQ ID NO: 2988279 - RNA, 15 nt, Human
caccugaagacucau

SEQ ID NO: 2988280 - RNA, 14 nt, Human
caccugaagacuca

SEQ ID NO: 2988281 - RNA, 15 nt, Human
caccucucucacucc

SEQ ID NO: 2988282 - RNA, 17 nt, Human
caccucucucacuccuu

SEQ ID NO: 2988283 - RNA, 18 nt, Human
caccucucucacuccuug

SEQ ID NO: 2988284 - RNA, 19 nt, Human
caccucucucacuccuuga

SEQ ID NO: 2988285 - RNA, 18 nt, Human
caccucugcacaagcugc

SEQ ID NO: 2988286 - RNA, 19 nt, Human
caccucugcacaagcugca

SEQ ID NO: 2988287 - RNA, 20 nt, Human
caccuggaauauauaaccag

SEQ ID NO: 2988288 - RNA, 23 nt, Human
caccugcggugcuaucuccccca

SEQ ID NO: 2988289 - RNA, 20 nt, Human
caccugcggugcuaucuccc

SEQ ID NO: 2988290 - RNA, 16 nt, Human
cacgccagauucuuuc

SEQ ID NO: 2988291 - RNA, 15 nt, Human
cacgcacacugucug

SEQ ID NO: 2988292 - RNA, 17 nt, Human
cacgcacuucgggaggu

SEQ ID NO: 2988293 - RNA, 14 nt, Human
cacgauuucuguuu

SEQ ID NO: 2988294 - RNA, 12 nt, Human
cacgauuucugu

SEQ ID NO: 2988295 - RNA, 16 nt, Human
cacgauuucuguuuag

SEQ ID NO: 2988296 - RNA, 19 nt, Human
cacgagcaggcuacuguca

SEQ ID NO: 2988297 - RNA, 20 nt, Human
cacgagcaggcuacugucag

SEQ ID NO: 2988298 - RNA, 17 nt, Human
cacgagcaggcuacugu

SEQ ID NO: 2988299 - RNA, 22 nt, Human
cacgagcaggcuacugucagcu

SEQ ID NO: 2988300 - RNA, 20 nt, Human
cacgccagauucuuuccuga

SEQ ID NO: 2988301 - RNA, 22 nt, Human
cacgccagauucuuuccugagg

SEQ ID NO: 2988302 - RNA, 19 nt, Human
cacgccagauucuuuccug

SEQ ID NO: 2988303 - RNA, 15 nt, Human
cacgccacugcacua

SEQ ID NO: 2988304 - RNA, 13 nt, Human
cacgccacugcac

SEQ ID NO: 2988305 - RNA, 13 nt, Human
cacgcccccacug

SEQ ID NO: 2988306 - RNA, 15 nt, Human
cacgcccccacuggu

SEQ ID NO: 2988307 - RNA, 23 nt, Human
cacgccagauucuuuccugaggc

SEQ ID NO: 2988308 - RNA, 17 nt, Human
cacgcccccacugguga

SEQ ID NO: 2988309 - RNA, 18 nt, Human
cacgcccccacuggugac

SEQ ID NO: 2988310 - RNA, 14 nt, Human
caccuuagacaguc

SEQ ID NO: 2988311 - RNA, 16 nt, Human
caccuuagacaguccc

SEQ ID NO: 2988312 - RNA, 18 nt, Human
caccuuagacagucccug

SEQ ID NO: 2988313 - RNA, 19 nt, Human
caccuuagacagucccugc

SEQ ID NO: 2988314 - RNA, 21 nt, Human
caccuuagacagucccugcca

SEQ ID NO: 2988315 - RNA, 23 nt, Human
caccuuagacagucccugccaau

SEQ ID NO: 2988316 - RNA, 16 nt, Human
cacgaauauugcugau

SEQ ID NO: 2988317 - RNA, 19 nt, Human
cacgaauauugcugauggu

SEQ ID NO: 2988318 - RNA, 22 nt, Human
cacgaauauugcugauggugca

SEQ ID NO: 2988319 - RNA, 16 nt, Human
cacgacugcccggcag

SEQ ID NO: 2988320 - RNA, 17 nt, Human
cacgacugcccggcagg

SEQ ID NO: 2988321 - RNA, 13 nt, Human
caccuugacaggg

SEQ ID NO: 2988322 - RNA, 16 nt, Human
caccuugacagggcac

SEQ ID NO: 2988323 - RNA, 15 nt, Human
caccuugacagggca

SEQ ID NO: 2988324 - RNA, 22 nt, Human
cacguucuuacuaguuucccuu

SEQ ID NO: 2988325 - RNA, 16 nt, Human
cacgugguccuaaucu

SEQ ID NO: 2988326 - RNA, 19 nt, Human
cacgugguccuaaucuucu

SEQ ID NO: 2988327 - RNA, 13 nt, Human
cacuaaacaaaga

SEQ ID NO: 2988328 - RNA, 14 nt, Human
cacguuucuaaagg

SEQ ID NO: 2988329 - RNA, 12 nt, Human
cacguuucuaaa

SEQ ID NO: 2988330 - RNA, 23 nt, Human
cacguuucuaaaggcuaccuuug

SEQ ID NO: 2988331 - RNA, 14 nt, Human
cacguacacacaca

SEQ ID NO: 2988332 - RNA, 19 nt, Human
cacguacacacacauacac

SEQ ID NO: 2988333 - RNA, 18 nt, Human
cacguacacacacauaca

SEQ ID NO: 2988334 - RNA, 20 nt, Human
cacggcucacugcagccuca

SEQ ID NO: 2988335 - RNA, 19 nt, Human
cacggcucacugcagccuc

SEQ ID NO: 2988336 - RNA, 17 nt, Human
cacggcucacugcagcc

SEQ ID NO: 2988337 - RNA, 16 nt, Human
cacggcucacugcagc

SEQ ID NO: 2988338 - RNA, 17 nt, Human
cacgcuggaccuugaac

SEQ ID NO: 2988339 - RNA, 20 nt, Human
cacgcuggaccuugaacugg

SEQ ID NO: 2988340 - RNA, 15 nt, Human
cacggcucacugcag

SEQ ID NO: 2988341 - RNA, 23 nt, Human
cacgcgugcacacaccagagccc

SEQ ID NO: 2988342 - RNA, 21 nt, Human
cacgcgugcacacaccagagc

SEQ ID NO: 2988343 - RNA, 16 nt, Human
cacgcgugcacacacc

SEQ ID NO: 2988344 - RNA, 15 nt, Human
cacgcgugcacacac

SEQ ID NO: 2988345 - RNA, 19 nt, Human
cacgccuguaauccuagca

SEQ ID NO: 2988346 - RNA, 20 nt, Human
cacgccuguaauccuagcac

SEQ ID NO: 2988347 - RNA, 13 nt, Human
cacucuauaacaa

SEQ ID NO: 2988348 - RNA, 12 nt, Human
cacucugagacu

SEQ ID NO: 2988349 - RNA, 23 nt, Human
cacucugagacucgcgacaaugc

SEQ ID NO: 2988350 - RNA, 12 nt, Human
cacucuccuugg

SEQ ID NO: 2988351 - RNA, 12 nt, Human
cacucuggcagc

SEQ ID NO: 2988352 - RNA, 13 nt, Human
cacucuggcagcu

SEQ ID NO: 2988353 - RNA, 14 nt, Human
cacucuggcagcuc

SEQ ID NO: 2988354 - RNA, 16 nt, Human
cacucaguccauagca

SEQ ID NO: 2988355 - RNA, 15 nt, Human
cacucauugaccuga

SEQ ID NO: 2988356 - RNA, 18 nt, Human
cacucauugaccugaggc

SEQ ID NO: 2988357 - RNA, 19 nt, Human
cacucauugaccugaggcc

SEQ ID NO: 2988358 - RNA, 20 nt, Human
cacucauugaccugaggccc

SEQ ID NO: 2988359 - RNA, 22 nt, Human
cacucauugaccugaggcccuu

SEQ ID NO: 2988360 - RNA, 13 nt, Human
cacucccugcaac

SEQ ID NO: 2988361 - RNA, 16 nt, Human
cacucccugcaaccug

SEQ ID NO: 2988362 - RNA, 12 nt, Human
cacucccugcaa

SEQ ID NO: 2988363 - RNA, 15 nt, Human
cacuccccugcuggg

SEQ ID NO: 2988364 - RNA, 14 nt, Human
cacuccuucacaga

SEQ ID NO: 2988365 - RNA, 21 nt, Human
cacuccuucacagaugggugc

SEQ ID NO: 2988366 - RNA, 17 nt, Human
cacucccugcaaccuga

SEQ ID NO: 2988367 - RNA, 17 nt, Human
cacuccggcccuccaga

SEQ ID NO: 2988368 - RNA, 21 nt, Human
cacuccggcccuccagagccc

SEQ ID NO: 2988369 - RNA, 20 nt, Human
cacuccggcccuccagagcc

SEQ ID NO: 2988370 - RNA, 18 nt, Human
cacuccggcccuccagag

SEQ ID NO: 2988371 - RNA, 20 nt, Human
cacucaaaagcugggcaggu

SEQ ID NO: 2988372 - RNA, 16 nt, Human
cacucaaaucaagaaa

SEQ ID NO: 2988373 - RNA, 15 nt, Human
cacucaaaagcuggg

SEQ ID NO: 2988374 - RNA, 17 nt, Human
cacucaaaagcugggca

SEQ ID NO: 2988375 - RNA, 18 nt, Human
cacucaaaagcugggcag

SEQ ID NO: 2988376 - RNA, 19 nt, Human
cacucaaaagcugggcagg

SEQ ID NO: 2988377 - RNA, 21 nt, Human
cacuauguugcccaggcaggu

SEQ ID NO: 2988378 - RNA, 20 nt, Human
cacuauguugcccaggcagg

SEQ ID NO: 2988379 - RNA, 22 nt, Human
cacuauuuauuuacaaauguuu

SEQ ID NO: 2988380 - RNA, 18 nt, Human
cacuauuuauuuacaaau

SEQ ID NO: 2988381 - RNA, 19 nt, Human
cacucagaagacacugaug

SEQ ID NO: 2988382 - RNA, 18 nt, Human
cacucagaagacacugau

SEQ ID NO: 2988383 - RNA, 22 nt, Human
cacucagaagacacugaugggc

SEQ ID NO: 2988384 - RNA, 20 nt, Human
cacucacauuuauucugcuc

SEQ ID NO: 2988385 - RNA, 19 nt, Human
cacucacauuuauucugcu

SEQ ID NO: 2988386 - RNA, 17 nt, Human
cacucagaagacacuga

SEQ ID NO: 2988387 - RNA, 16 nt, Human
cacucagaagacacug

SEQ ID NO: 2988388 - RNA, 12 nt, Human
cacucagaagac

SEQ ID NO: 2988389 - RNA, 21 nt, Human
cacuaaauugacacuuaaaaa

SEQ ID NO: 2988390 - RNA, 16 nt, Human
cacuaaccacgcugga

SEQ ID NO: 2988391 - RNA, 15 nt, Human
cacuaaccacgcugg

SEQ ID NO: 2988392 - RNA, 14 nt, Human
cacuaaccacgcug

SEQ ID NO: 2988393 - RNA, 17 nt, Human
cacuaagagagaaugag

SEQ ID NO: 2988394 - RNA, 18 nt, Human
cacuaaccacgcuggacc

SEQ ID NO: 2988395 - RNA, 18 nt, Human
cacuaaggugugcucuga

SEQ ID NO: 2988396 - RNA, 17 nt, Human
cacuaaggugugcucug

SEQ ID NO: 2988397 - RNA, 19 nt, Human
cacuaguauuucuaugaaa

SEQ ID NO: 2988398 - RNA, 14 nt, Human
cacuaguauuucua

SEQ ID NO: 2988399 - RNA, 14 nt, Human
cacuauaauguaag

SEQ ID NO: 2988400 - RNA, 21 nt, Human
cacuauagccuaggugacaga

SEQ ID NO: 2988401 - RNA, 18 nt, Human
cacuauaauguaagcucu

SEQ ID NO: 2988402 - RNA, 14 nt, Human
cacuauagccuagg

SEQ ID NO: 2988403 - RNA, 19 nt, Human
cacuauguugcccaggcag

SEQ ID NO: 2988404 - RNA, 18 nt, Human
cacuauguugcccaggca

SEQ ID NO: 2988405 - RNA, 17 nt, Human
cacuauguugcccaggc

SEQ ID NO: 2988406 - RNA, 16 nt, Human
cacuauguugcccagg

SEQ ID NO: 2988407 - RNA, 15 nt, Human
cacuauguugcccag

SEQ ID NO: 2988408 - RNA, 19 nt, Human
cacuucacgcccuuggcca

SEQ ID NO: 2988409 - RNA, 17 nt, Human
cacuucacgcccuuggc

SEQ ID NO: 2988410 - RNA, 21 nt, Human
cacuucacgcccuuggccaug

SEQ ID NO: 2988411 - RNA, 20 nt, Human
cacuucacgcccuuggccau

SEQ ID NO: 2988412 - RNA, 12 nt, Human
cacuucagcuga

SEQ ID NO: 2988413 - RNA, 21 nt, Human
cacuucagcugacuuuucugu

SEQ ID NO: 2988414 - RNA, 23 nt, Human
cacuucuggauauagcuagguga

SEQ ID NO: 2988415 - RNA, 22 nt, Human
cacuucuggauauagcuaggug

SEQ ID NO: 2988416 - RNA, 22 nt, Human
cacuucugccauauucuguugg

SEQ ID NO: 2988417 - RNA, 21 nt, Human
cacuucgggaggucgaggcag

SEQ ID NO: 2988418 - RNA, 23 nt, Human
cacuucgggaggucgaggcagga

SEQ ID NO: 2988419 - RNA, 16 nt, Human
cacuucccuacaugga

SEQ ID NO: 2988420 - RNA, 16 nt, Human
cacuugacaucaacug

SEQ ID NO: 2988421 - RNA, 23 nt, Human
cacuugaacccgggaggcagagg

SEQ ID NO: 2988422 - RNA, 21 nt, Human
cacuugaacccgggaggcaga

SEQ ID NO: 2988423 - RNA, 20 nt, Human
cacuugaacccgggaggcag

SEQ ID NO: 2988424 - RNA, 13 nt, Human
cacuugcagacuc

SEQ ID NO: 2988425 - RNA, 13 nt, Human
cacuugaguccag

SEQ ID NO: 2988426 - RNA, 17 nt, Human
cacuugagaauuacccu

SEQ ID NO: 2988427 - RNA, 19 nt, Human
cacuugacaucaacugcau

SEQ ID NO: 2988428 - RNA, 20 nt, Human
cacuugagaauuacccuuuu

SEQ ID NO: 2988429 - RNA, 19 nt, Human
cacuuucuagccagaggag

SEQ ID NO: 2988430 - RNA, 20 nt, Human
cacuuucuagccagaggaga

SEQ ID NO: 2988431 - RNA, 18 nt, Human
cacuuucuagccagagga

SEQ ID NO: 2988432 - RNA, 15 nt, Human
cacuuggucugugag

SEQ ID NO: 2988433 - RNA, 22 nt, Human
cacuugcagacucuacagaggc

SEQ ID NO: 2988434 - RNA, 19 nt, Human
cacuugcagacucuacaga

SEQ ID NO: 2988435 - RNA, 18 nt, Human
cacuugcagacucuacag

SEQ ID NO: 2988436 - RNA, 14 nt, Human
cacuugcagacucu

SEQ ID NO: 2988437 - RNA, 24 nt, Human
cacuugcagacucuacagaggcca

SEQ ID NO: 2988438 - RNA, 18 nt, Human
cacugguuuguucccugu

SEQ ID NO: 2988439 - RNA, 16 nt, Human
cacugguuuuaaauau

SEQ ID NO: 2988440 - RNA, 15 nt, Human
cacugguuuuaaaua

SEQ ID NO: 2988441 - RNA, 13 nt, Human
cacugguuuuaaa

SEQ ID NO: 2988442 - RNA, 12 nt, Human
cacugguuuuaa

SEQ ID NO: 2988443 - RNA, 18 nt, Human
cacuggcucacccagucc

SEQ ID NO: 2988444 - RNA, 17 nt, Human
cacuggcucacccaguc

SEQ ID NO: 2988445 - RNA, 15 nt, Human
cacuggcucacccag

SEQ ID NO: 2988446 - RNA, 14 nt, Human
cacuggcucaccca

SEQ ID NO: 2988447 - RNA, 13 nt, Human
cacuggcucaccc

SEQ ID NO: 2988448 - RNA, 14 nt, Human
cacuguacacauaa

SEQ ID NO: 2988449 - RNA, 16 nt, Human
cacuguccuauuauau

SEQ ID NO: 2988450 - RNA, 14 nt, Human
cacugucaagauga

SEQ ID NO: 2988451 - RNA, 14 nt, Human
cacugugccaugug

SEQ ID NO: 2988452 - RNA, 13 nt, Human
cacugugaagaga

SEQ ID NO: 2988453 - RNA, 17 nt, Human
cacugugcugagucuga

SEQ ID NO: 2988454 - RNA, 20 nt, Human
cacugugcugagucugaagg

SEQ ID NO: 2988455 - RNA, 21 nt, Human
cacugugcugagucugaaggc

SEQ ID NO: 2988456 - RNA, 22 nt, Human
cacugugcugagucugaaggcu

SEQ ID NO: 2988457 - RNA, 19 nt, Human
cacuguggguagacacaca

SEQ ID NO: 2988458 - RNA, 16 nt, Human
cacugugccaugugcc

SEQ ID NO: 2988459 - RNA, 15 nt, Human
cacugugccaugugc

SEQ ID NO: 2988460 - RNA, 18 nt, Human
cacugugccaugugccag

SEQ ID NO: 2988461 - RNA, 13 nt, Human
cacugugcugagu

SEQ ID NO: 2988462 - RNA, 15 nt, Human
cacugugcugagucu

SEQ ID NO: 2988463 - RNA, 13 nt, Human
cacuguucucugc

SEQ ID NO: 2988464 - RNA, 14 nt, Human
cacuguucucugcc

SEQ ID NO: 2988465 - RNA, 15 nt, Human
cacuguucucugccc

SEQ ID NO: 2988466 - RNA, 16 nt, Human
cacuguucucugcccu

SEQ ID NO: 2988467 - RNA, 17 nt, Human
cacuguucucugcccuc

SEQ ID NO: 2988468 - RNA, 19 nt, Human
cacuguucucugcccucca

SEQ ID NO: 2988469 - RNA, 21 nt, Human
cacuguucucugcccuccaag

SEQ ID NO: 2988470 - RNA, 22 nt, Human
cacuguucucugcccuccaaga

SEQ ID NO: 2988471 - RNA, 24 nt, Human
cacuguggguagacacacaugaag

SEQ ID NO: 2988472 - RNA, 22 nt, Human
cacuguggguagacacacauga

SEQ ID NO: 2988473 - RNA, 14 nt, Human
cacugagacagccc

SEQ ID NO: 2988474 - RNA, 17 nt, Human
cacugagacagcccggg

SEQ ID NO: 2988475 - RNA, 19 nt, Human
cacugagacagcccgggcu

SEQ ID NO: 2988476 - RNA, 22 nt, Human
cacugagacagcccgggcucug

SEQ ID NO: 2988477 - RNA, 12 nt, Human
cacugagacagc

SEQ ID NO: 2988478 - RNA, 13 nt, Human
cacugagacagcc

SEQ ID NO: 2988479 - RNA, 21 nt, Human
cacugacuucuaaguaaaacc

SEQ ID NO: 2988480 - RNA, 14 nt, Human
cacugacuucuaag

SEQ ID NO: 2988481 - RNA, 15 nt, Human
cacugacuucuaagu

SEQ ID NO: 2988482 - RNA, 16 nt, Human
cacugacuucuaagua

SEQ ID NO: 2988483 - RNA, 20 nt, Human
cacugacuucuaaguaaaac

SEQ ID NO: 2988484 - RNA, 23 nt, Human
cacugacauuguuggccaaagcc

SEQ ID NO: 2988485 - RNA, 19 nt, Human
cacucugucgcccagucug

SEQ ID NO: 2988486 - RNA, 16 nt, Human
cacucugucgcccagu

SEQ ID NO: 2988487 - RNA, 15 nt, Human
cacucugucgcccag

SEQ ID NO: 2988488 - RNA, 15 nt, Human
cacucuggcagcuca

SEQ ID NO: 2988489 - RNA, 16 nt, Human
cacucuggcagcucag

SEQ ID NO: 2988490 - RNA, 17 nt, Human
cacucuggcagcucaga

SEQ ID NO: 2988491 - RNA, 19 nt, Human
cacucuggcagcucagaga

SEQ ID NO: 2988492 - RNA, 20 nt, Human
cacucuggcagcucagagag

SEQ ID NO: 2988493 - RNA, 21 nt, Human
cacucuggcagcucagagagg

SEQ ID NO: 2988494 - RNA, 23 nt, Human
cacucuggcagcucagagagggu

SEQ ID NO: 2988495 - RNA, 13 nt, Human
cacugcaaccucc

SEQ ID NO: 2988496 - RNA, 23 nt, Human
cacugcaaccuccgccucuuggg

SEQ ID NO: 2988497 - RNA, 16 nt, Human
cacugcaaccuccgcc

SEQ ID NO: 2988498 - RNA, 14 nt, Human
cacugcaaccuccg

SEQ ID NO: 2988499 - RNA, 24 nt, Human
cacugaugggcaacccccagccug

SEQ ID NO: 2988500 - RNA, 18 nt, Human
cacugaugggcaaccccc

SEQ ID NO: 2988501 - RNA, 14 nt, Human
cacugaugggcaac

SEQ ID NO: 2988502 - RNA, 23 nt, Human
cacugagacagcccgggcucugc

SEQ ID NO: 2988503 - RNA, 20 nt, Human
cacugccuucucaacuccaa

SEQ ID NO: 2988504 - RNA, 12 nt, Human
cacugcucuggu

SEQ ID NO: 2988505 - RNA, 18 nt, Human
cacugcacuauagccuag

SEQ ID NO: 2988506 - RNA, 19 nt, Human
cacugcaccgggccacaga

SEQ ID NO: 2988507 - RNA, 18 nt, Human
cacugcaccgggccacag

SEQ ID NO: 2988508 - RNA, 16 nt, Human
cacugcaccgggccac

SEQ ID NO: 2988509 - RNA, 15 nt, Human
cacugcaccgggcca

SEQ ID NO: 2988510 - RNA, 14 nt, Human
cacugcaccgggcc

SEQ ID NO: 2988511 - RNA, 18 nt, Human
cacugcuuccagugaggc

SEQ ID NO: 2988512 - RNA, 19 nt, Human
cacugcuuccagugaggcu

SEQ ID NO: 2988513 - RNA, 20 nt, Human
cacugcuuccagugaggcuc

SEQ ID NO: 2988514 - RNA, 21 nt, Human
cacugcuuccagugaggcucu

SEQ ID NO: 2988515 - RNA, 22 nt, Human
cacugcuuccagugaggcucug

SEQ ID NO: 2988516 - RNA, 20 nt, Human
cacugcuuuuggucugugug

SEQ ID NO: 2988517 - RNA, 13 nt, Human
cacugcuuaacuu

SEQ ID NO: 2988518 - RNA, 14 nt, Human
cacugcuuccagug

SEQ ID NO: 2988519 - RNA, 15 nt, Human
cacugcuuccaguga

SEQ ID NO: 2988520 - RNA, 16 nt, Human
cacugcuuccagugag

SEQ ID NO: 2988521 - RNA, 17 nt, Human
cacuggaacacuaauga

SEQ ID NO: 2988522 - RNA, 21 nt, Human
cacugcuuuuggucuguguga

SEQ ID NO: 2988523 - RNA, 19 nt, Human
cacuggcaaacagggccuc

SEQ ID NO: 2988524 - RNA, 18 nt, Human
cacuggcaaacagggccu

SEQ ID NO: 2988525 - RNA, 17 nt, Human
cacuggcaaacagggcc

SEQ ID NO: 2988526 - RNA, 21 nt, Human
cacuggcaaacagggccucug

SEQ ID NO: 2988527 - RNA, 20 nt, Human
cacuggcaaacagggccucu

SEQ ID NO: 2988528 - RNA, 22 nt, Human
cacuggcaaacagggccucugc

SEQ ID NO: 2988529 - RNA, 18 nt, Human
cugccaauauccuaauaa

SEQ ID NO: 2988530 - RNA, 19 nt, Human
cugccaauauccuaauaaa

SEQ ID NO: 2988531 - RNA, 20 nt, Human
cugccaauauccuaauaaaa

SEQ ID NO: 2988532 - RNA, 22 nt, Human
cugccaauauccuaauaaaaag

SEQ ID NO: 2988533 - RNA, 15 nt, Human
cugccaaugggagcu

SEQ ID NO: 2988534 - RNA, 17 nt, Human
cugccaaugggagcuca

SEQ ID NO: 2988535 - RNA, 13 nt, Human
cugccaauauccu

SEQ ID NO: 2988536 - RNA, 14 nt, Human
cugccaauauccua

SEQ ID NO: 2988537 - RNA, 16 nt, Human
cugccaauauccuaau

SEQ ID NO: 2988538 - RNA, 17 nt, Human
cugccaauauccuaaua

SEQ ID NO: 2988539 - RNA, 22 nt, Human
cugcauuuaaaagauacaguua

SEQ ID NO: 2988540 - RNA, 20 nt, Human
cugcauuuaaaagauacagu

SEQ ID NO: 2988541 - RNA, 13 nt, Human
cugcauguuacau

SEQ ID NO: 2988542 - RNA, 15 nt, Human
cugcauguuugugau

SEQ ID NO: 2988543 - RNA, 14 nt, Human
cugccccucaacuc

SEQ ID NO: 2988544 - RNA, 22 nt, Human
cugccccucaacucuccuccag

SEQ ID NO: 2988545 - RNA, 13 nt, Human
cugcccugugagu

SEQ ID NO: 2988546 - RNA, 15 nt, Human
cugcccugugggccc

SEQ ID NO: 2988547 - RNA, 16 nt, Human
cugcccugugggcccc

SEQ ID NO: 2988548 - RNA, 18 nt, Human
cugcccugugggccccca

SEQ ID NO: 2988549 - RNA, 12 nt, Human
cugcccugugag

SEQ ID NO: 2988550 - RNA, 23 nt, Human
cugccauauucuguuggccagug

SEQ ID NO: 2988551 - RNA, 22 nt, Human
cugccauauucuguuggccagu

SEQ ID NO: 2988552 - RNA, 21 nt, Human
cugccauauucuguuggccag

SEQ ID NO: 2988553 - RNA, 20 nt, Human
cugccauauucuguuggcca

SEQ ID NO: 2988554 - RNA, 12 nt, Human
cugccagggaca

SEQ ID NO: 2988555 - RNA, 15 nt, Human
cugccagggacagag

SEQ ID NO: 2988556 - RNA, 11 nt, Human
cugccagggac

SEQ ID NO: 2988557 - RNA, 17 nt, Human
cugagacucgcgacaau

SEQ ID NO: 2988558 - RNA, 19 nt, Human
cugagacucgcgacaaugc

SEQ ID NO: 2988559 - RNA, 22 nt, Human
cugccugggaucccucauccuc

SEQ ID NO: 2988560 - RNA, 18 nt, Human
cugccucgaacuggcugc

SEQ ID NO: 2988561 - RNA, 17 nt, Human
cugccucgaacuggcug

SEQ ID NO: 2988562 - RNA, 15 nt, Human
cugccucgaacuggc

SEQ ID NO: 2988563 - RNA, 15 nt, Human
cugccuguucagcuc

SEQ ID NO: 2988564 - RNA, 14 nt, Human
cugccuguucagcu

SEQ ID NO: 2988565 - RNA, 23 nt, Human
cugccugggaucccucauccuca

SEQ ID NO: 2988566 - RNA, 15 nt, Human
cugcuacagagcaga

SEQ ID NO: 2988567 - RNA, 16 nt, Human
cugccuguugggccag

SEQ ID NO: 2988568 - RNA, 14 nt, Human
cugccuguugggcc

SEQ ID NO: 2988569 - RNA, 18 nt, Human
cugccuguugggccagga

SEQ ID NO: 2988570 - RNA, 19 nt, Human
cugccuguugggccaggag

SEQ ID NO: 2988571 - RNA, 16 nt, Human
cugcuaauuccccaga

SEQ ID NO: 2988572 - RNA, 14 nt, Human
cugcccugugggcc

SEQ ID NO: 2988573 - RNA, 16 nt, Human
cuggaaauauuaagaa

SEQ ID NO: 2988574 - RNA, 21 nt, Human
cuggaaaucaggguuaguauu

SEQ ID NO: 2988575 - RNA, 17 nt, Human
cuggaacacuaaugagg

SEQ ID NO: 2988576 - RNA, 22 nt, Human
cugcuuuuuaaagaaugcucuu

SEQ ID NO: 2988577 - RNA, 16 nt, Human
cugcuucagccucccg

SEQ ID NO: 2988578 - RNA, 14 nt, Human
cugcuucagccucc

SEQ ID NO: 2988579 - RNA, 17 nt, Human
cugcuuaacuucacaua

SEQ ID NO: 2988580 - RNA, 15 nt, Human
cugcuuaacuucaca

SEQ ID NO: 2988581 - RNA, 13 nt, Human
cugcuucagccuc

SEQ ID NO: 2988582 - RNA, 13 nt, Human
cugcuuaacuuca

SEQ ID NO: 2988583 - RNA, 20 nt, Human
cugcugacagacacaggccc

SEQ ID NO: 2988584 - RNA, 19 nt, Human
cugcugacagacacaggcc

SEQ ID NO: 2988585 - RNA, 18 nt, Human
cugcugacagacacaggc

SEQ ID NO: 2988586 - RNA, 15 nt, Human
cugcugacagacaca

SEQ ID NO: 2988587 - RNA, 23 nt, Human
cugcugacagacacaggcccggc

SEQ ID NO: 2988588 - RNA, 21 nt, Human
cugcugacagacacaggcccg

SEQ ID NO: 2988589 - RNA, 22 nt, Human
cugguuuuaaauauuuugacuu

SEQ ID NO: 2988590 - RNA, 21 nt, Human
cuguaggaagguuaauguuca

SEQ ID NO: 2988591 - RNA, 18 nt, Human
cuguaggaagguuaaugu

SEQ ID NO: 2988592 - RNA, 23 nt, Human
cugucagcuccccucggagaaga

SEQ ID NO: 2988593 - RNA, 16 nt, Human
cugucauuugagcagg

SEQ ID NO: 2988594 - RNA, 18 nt, Human
cugucauuugagcagggc

SEQ ID NO: 2988595 - RNA, 17 nt, Human
cugucauuugagcaggg

SEQ ID NO: 2988596 - RNA, 22 nt, Human
cugucagcuaaagaaguuugaa

SEQ ID NO: 2988597 - RNA, 18 nt, Human
cugucagccauuccuguu

SEQ ID NO: 2988598 - RNA, 21 nt, Human
cugucagcuccccucggagaa

SEQ ID NO: 2988599 - RNA, 16 nt, Human
cugguuuguucccugu

SEQ ID NO: 2988600 - RNA, 16 nt, Human
cugugagaugcuagaa

SEQ ID NO: 2988601 - RNA, 14 nt, Human
cugugcucuggaca

SEQ ID NO: 2988602 - RNA, 15 nt, Human
cugugaagagaacca

SEQ ID NO: 2988603 - RNA, 13 nt, Human
cugucgcccaguc

SEQ ID NO: 2988604 - RNA, 16 nt, Human
cugggcagaaggaaga

SEQ ID NO: 2988605 - RNA, 18 nt, Human
cugggcagaaggaagacu

SEQ ID NO: 2988606 - RNA, 19 nt, Human
cugggcagcugccuccccu

SEQ ID NO: 2988607 - RNA, 16 nt, Human
cugggcagcugccucc

SEQ ID NO: 2988608 - RNA, 21 nt, Human
cugggcagcugccuccccucc

SEQ ID NO: 2988609 - RNA, 20 nt, Human
cugggcagcugccuccccuc

SEQ ID NO: 2988610 - RNA, 22 nt, Human
cugggcagcugccuccccuccu

SEQ ID NO: 2988611 - RNA, 16 nt, Human
cuggggccgaaagaac

SEQ ID NO: 2988612 - RNA, 17 nt, Human
cugggcagaaggaagac

SEQ ID NO: 2988613 - RNA, 20 nt, Human
cuggugacuuuccucuuugg

SEQ ID NO: 2988614 - RNA, 21 nt, Human
cuggugacuuuccucuuuggu

SEQ ID NO: 2988615 - RNA, 15 nt, Human
cuggugacuuuccuc

SEQ ID NO: 2988616 - RNA, 14 nt, Human
cuggguucacugca

SEQ ID NO: 2988617 - RNA, 23 nt, Human
cuggguggcaccagcagccugga

SEQ ID NO: 2988618 - RNA, 22 nt, Human
cuggguggcaccagcagccugg

SEQ ID NO: 2988619 - RNA, 17 nt, Human
cuggguguggcgcagca

SEQ ID NO: 2988620 - RNA, 16 nt, Human
cuggguguggcgcagc

SEQ ID NO: 2988621 - RNA, 23 nt, Human
cuggugacuuuccucuuuggucu

SEQ ID NO: 2988622 - RNA, 10 nt, Human
cugggacagg

SEQ ID NO: 2988623 - RNA, 13 nt, Human
cugggacacaguu

SEQ ID NO: 2988624 - RNA, 12 nt, Human
cugggacacagu

SEQ ID NO: 2988625 - RNA, 17 nt, Human
cuggccccucagggucc

SEQ ID NO: 2988626 - RNA, 18 nt, Human
cuggccccucaggguccc

SEQ ID NO: 2988627 - RNA, 20 nt, Human
cuggccccucagggucccug

SEQ ID NO: 2988628 - RNA, 21 nt, Human
cuggccccucagggucccugg

SEQ ID NO: 2988629 - RNA, 17 nt, Human
cuggcucacccaguccu

SEQ ID NO: 2988630 - RNA, 13 nt, Human
cuggcagcucaga

SEQ ID NO: 2988631 - RNA, 14 nt, Human
cuggcagcucagag

SEQ ID NO: 2988632 - RNA, 12 nt, Human
cuggcagcucag

SEQ ID NO: 2988633 - RNA, 15 nt, Human
cuggcagcucagaga

SEQ ID NO: 2988634 - RNA, 13 nt, Human
cuggccccucagg

SEQ ID NO: 2988635 - RNA, 15 nt, Human
cuucacgcccuuggc

SEQ ID NO: 2988636 - RNA, 17 nt, Human
cuucacgcccuuggcca

SEQ ID NO: 2988637 - RNA, 15 nt, Human
cuucacuguaaaaua

SEQ ID NO: 2988638 - RNA, 17 nt, Human
cuucagagacuccugca

SEQ ID NO: 2988639 - RNA, 16 nt, Human
cuucaguuugcagagu

SEQ ID NO: 2988640 - RNA, 17 nt, Human
cuucaguuugcagagua

SEQ ID NO: 2988641 - RNA, 18 nt, Human
cuucagagacuccugcag

SEQ ID NO: 2988642 - RNA, 19 nt, Human
cuucagagacuccugcagg

SEQ ID NO: 2988643 - RNA, 20 nt, Human
cuucagagacuccugcaggc

SEQ ID NO: 2988644 - RNA, 22 nt, Human
cuuccagugaggcucugcccuu

SEQ ID NO: 2988645 - RNA, 23 nt, Human
cuuccagugaggcucugcccuug

SEQ ID NO: 2988646 - RNA, 21 nt, Human
cuuccagugaggcucugcccu

SEQ ID NO: 2988647 - RNA, 11 nt, Human
cuucccaccuc

SEQ ID NO: 2988648 - RNA, 21 nt, Human
cuucccaccucucucacuccu

SEQ ID NO: 2988649 - RNA, 23 nt, Human
cuucccaccucucucacuccuug

SEQ ID NO: 2988650 - RNA, 14 nt, Human
cugugcugagucug

SEQ ID NO: 2988651 - RNA, 12 nt, Human
cugugcugaguc

SEQ ID NO: 2988652 - RNA, 15 nt, Human
cuucacggaagagcc

SEQ ID NO: 2988653 - RNA, 19 nt, Human
cuucacggaagagccuugc

SEQ ID NO: 2988654 - RNA, 20 nt, Human
cuuauuguagcauccuggaa

SEQ ID NO: 2988655 - RNA, 22 nt, Human
cuucaccuuuguccccaccgca

SEQ ID NO: 2988656 - RNA, 21 nt, Human
cuucaccuuuguccccaccgc

SEQ ID NO: 2988657 - RNA, 23 nt, Human
cuuauuguagcauccuggaauau

SEQ ID NO: 2988658 - RNA, 17 nt, Human
cuuauggaacacucuga

SEQ ID NO: 2988659 - RNA, 19 nt, Human
cuuauggaacacucugaga

SEQ ID NO: 2988660 - RNA, 20 nt, Human
cuuauggaacacucugagac

SEQ ID NO: 2988661 - RNA, 13 nt, Human
cuuauggaacacu

SEQ ID NO: 2988662 - RNA, 16 nt, Human
cuuauggaacacucug

SEQ ID NO: 2988663 - RNA, 13 nt, Human
cuugaugaagaag

SEQ ID NO: 2988664 - RNA, 14 nt, Human
cuuggcgcugcccc

SEQ ID NO: 2988665 - RNA, 17 nt, Human
cuuggcgcugccccugg

SEQ ID NO: 2988666 - RNA, 12 nt, Human
cuuggcgcugcc

SEQ ID NO: 2988667 - RNA, 20 nt, Human
cuuggcgcugccccuggcag

SEQ ID NO: 2988668 - RNA, 12 nt, Human
cuugaugaagaa

SEQ ID NO: 2988669 - RNA, 13 nt, Human
cuugacagggcac

SEQ ID NO: 2988670 - RNA, 15 nt, Human
cuugacagggcacac

SEQ ID NO: 2988671 - RNA, 14 nt, Human
cuugacagggcaca

SEQ ID NO: 2988672 - RNA, 19 nt, Human
cuugaauuguaaggaauga

SEQ ID NO: 2988673 - RNA, 18 nt, Human
cuugaauuguaaggaaug

SEQ ID NO: 2988674 - RNA, 16 nt, Human
cuugaagacuuuucuu

SEQ ID NO: 2988675 - RNA, 22 nt, Human
cuucuaaguaaaaccacagcag

SEQ ID NO: 2988676 - RNA, 23 nt, Human
cuucuaaguaaaaccacagcagu

SEQ ID NO: 2988677 - RNA, 17 nt, Human
cuuccugcaacaccuug

SEQ ID NO: 2988678 - RNA, 22 nt, Human
cuucuauuuauuuauuuauuca

SEQ ID NO: 2988679 - RNA, 18 nt, Human
cuuccucccucccucuuu

SEQ ID NO: 2988680 - RNA, 23 nt, Human
cuucuucagagacuccugcaggc

SEQ ID NO: 2988681 - RNA, 21 nt, Human
cuucugacccaugcugcccug

SEQ ID NO: 2988682 - RNA, 22 nt, Human
cuucugacccaugcugcccugu

SEQ ID NO: 2988683 - RNA, 20 nt, Human
cuucugacccaugcugcccu

SEQ ID NO: 2988684 - RNA, 23 nt, Human
cuucugacccaugcugcccugug

SEQ ID NO: 2988685 - RNA, 20 nt, Human
gaaaaaauuuacuuuaaacu

SEQ ID NO: 2988686 - RNA, 13 nt, Human
cuuuugugcauua

SEQ ID NO: 2988687 - RNA, 12 nt, Human
cuuuugugcauu

SEQ ID NO: 2988688 - RNA, 23 nt, Human
cuuuuuuggcugcugaaggcucg

SEQ ID NO: 2988689 - RNA, 23 nt, Human
cuuuugcccacacuugggagcaa

SEQ ID NO: 2988690 - RNA, 18 nt, Human
cuuuuggaagguauuuaa

SEQ ID NO: 2988691 - RNA, 23 nt, Human
cuuuugcauauugcauacuauua

SEQ ID NO: 2988692 - RNA, 18 nt, Human
cuuuugucuaugggacuc

SEQ ID NO: 2988693 - RNA, 15 nt, Human
gaaaauguaugugua

SEQ ID NO: 2988694 - RNA, 19 nt, Human
gaaaauggacguguuauga

SEQ ID NO: 2988695 - RNA, 23 nt, Human
gaaaauggacguguuaugacucc

SEQ ID NO: 2988696 - RNA, 14 nt, Human
gaaaaacugauuuu

SEQ ID NO: 2988697 - RNA, 21 nt, Human
gaaaauggaagacagcucuua

SEQ ID NO: 2988698 - RNA, 18 nt, Human
gaaaagaaaaaugagccu

SEQ ID NO: 2988699 - RNA, 17 nt, Human
gaaauauuuauuuuaau

SEQ ID NO: 2988700 - RNA, 22 nt, Human
gaaagggacuuggaagcuccgc

SEQ ID NO: 2988701 - RNA, 20 nt, Human
gaaagggacgcuacccggga

SEQ ID NO: 2988702 - RNA, 19 nt, Human
gaaagggacuuggaagcuc

SEQ ID NO: 2988703 - RNA, 22 nt, Human
gaaauauuuauuuuaauaaugu

SEQ ID NO: 2988704 - RNA, 18 nt, Human
gaaauauuuauuuuaaua

SEQ ID NO: 2988705 - RNA, 18 nt, Human
gaaaucaaauaugcaaag

SEQ ID NO: 2988706 - RNA, 17 nt, Human
gaaaucaaauaugcaaa

SEQ ID NO: 2988707 - RNA, 19 nt, Human
gaaaucaaauaugcaaagc

SEQ ID NO: 2988708 - RNA, 20 nt, Human
gaaaucaaauaugcaaagca

SEQ ID NO: 2988709 - RNA, 19 nt, Human
gaaaucaccgaaaacgugg

SEQ ID NO: 2988710 - RNA, 20 nt, Human
gaaaggcuccaggagcagcc

SEQ ID NO: 2988711 - RNA, 22 nt, Human
gaaaggcuccaggagcagccac

SEQ ID NO: 2988712 - RNA, 21 nt, Human
gaaaggcuccaggagcagcca

SEQ ID NO: 2988713 - RNA, 17 nt, Human
gaaagacuauucaaaca

SEQ ID NO: 2988714 - RNA, 14 nt, Human
gaaagacuauucaa

SEQ ID NO: 2988715 - RNA, 15 nt, Human
gaaagacuauucaaa

SEQ ID NO: 2988716 - RNA, 20 nt, Human
gaaagacuaucuaaauguug

SEQ ID NO: 2988717 - RNA, 21 nt, Human
gaaagaaaauaccaaggaaca

SEQ ID NO: 2988718 - RNA, 15 nt, Human
gaaacuuuuggaagg

SEQ ID NO: 2988719 - RNA, 13 nt, Human
gaaacuuuuggaa

SEQ ID NO: 2988720 - RNA, 22 nt, Human
cuuuuaugauugccuuuuuaua

SEQ ID NO: 2988721 - RNA, 13 nt, Human
cuuuuauaaacuu

SEQ ID NO: 2988722 - RNA, 16 nt, Human
cuuucuagccagagga

SEQ ID NO: 2988723 - RNA, 15 nt, Human
cuuucuagccagagg

SEQ ID NO: 2988724 - RNA, 17 nt, Human
cuuucuacccagcgagc

SEQ ID NO: 2988725 - RNA, 17 nt, Human
cuuugggccuggcuccc

SEQ ID NO: 2988726 - RNA, 23 nt, Human
cuuucaauaggaaaaacugauuu

SEQ ID NO: 2988727 - RNA, 23 nt, Human
cuuucagccaagaauucuuaaau

SEQ ID NO: 2988728 - RNA, 20 nt, Human
cuuucagccaagaauucuua

SEQ ID NO: 2988729 - RNA, 22 nt, Human
cuuuccugaggcugggcucccu

SEQ ID NO: 2988730 - RNA, 20 nt, Human
gagaagucuucuauuuauuu

SEQ ID NO: 2988731 - RNA, 21 nt, Human
gagaagucuucuauuuauuua

SEQ ID NO: 2988732 - RNA, 14 nt, Human
gagaaucacuugaa

SEQ ID NO: 2988733 - RNA, 15 nt, Human
gagaaucacuugaac

SEQ ID NO: 2988734 - RNA, 12 nt, Human
gagaaggaagcc

SEQ ID NO: 2988735 - RNA, 13 nt, Human
gagaagcggcugg

SEQ ID NO: 2988736 - RNA, 15 nt, Human
gagaagcggcuggca

SEQ ID NO: 2988737 - RNA, 23 nt, Human
gacuuuucuuucagccaagaauu

SEQ ID NO: 2988738 - RNA, 21 nt, Human
gacuuuucuuuguggcuuccu

SEQ ID NO: 2988739 - RNA, 23 nt, Human
gacuuuucuguccgagcuuugaa

SEQ ID NO: 2988740 - RNA, 22 nt, Human
gacuauuuuuguuuuuauuaaa

SEQ ID NO: 2988741 - RNA, 21 nt, Human
gacuauuuuuguuuuuauuaa

SEQ ID NO: 2988742 - RNA, 12 nt, Human
gacucugucuca

SEQ ID NO: 2988743 - RNA, 16 nt, Human
gacucuuaagaagacu

SEQ ID NO: 2988744 - RNA, 15 nt, Human
gacucuuaagaagac

SEQ ID NO: 2988745 - RNA, 17 nt, Human
gacucuuaagaagacug

SEQ ID NO: 2988746 - RNA, 18 nt, Human
gacuauuuuuguuuuuau

SEQ ID NO: 2988747 - RNA, 17 nt, Human
gacuauuuuuguuuuua

SEQ ID NO: 2988748 - RNA, 13 nt, Human
gacuauuuuuguu

SEQ ID NO: 2988749 - RNA, 22 nt, Human
gacuauucaaacagucucagga

SEQ ID NO: 2988750 - RNA, 22 nt, Human
gacuaucuaaauguugaaagau

SEQ ID NO: 2988751 - RNA, 22 nt, Human
gagcaugccuggauggggcugc

SEQ ID NO: 2988752 - RNA, 21 nt, Human
gagcaugccuggauggggcug

SEQ ID NO: 2988753 - RNA, 12 nt, Human
gagcaucaggcc

SEQ ID NO: 2988754 - RNA, 14 nt, Human
gagcagggcucagc

SEQ ID NO: 2988755 - RNA, 14 nt, Human
gagccuuccagggg

SEQ ID NO: 2988756 - RNA, 15 nt, Human
gagccuuccaggggu

SEQ ID NO: 2988757 - RNA, 16 nt, Human
gagccuuccaggggug

SEQ ID NO: 2988758 - RNA, 17 nt, Human
gagccuuccaggggugg

SEQ ID NO: 2988759 - RNA, 19 nt, Human
gagccuugaacuuugaccu

SEQ ID NO: 2988760 - RNA, 22 nt, Human
gagccuugaacuuugaccucug

SEQ ID NO: 2988761 - RNA, 22 nt, Human
gagcugccuguucagcuccagc

SEQ ID NO: 2988762 - RNA, 21 nt, Human
gagcugccuguucagcuccag

SEQ ID NO: 2988763 - RNA, 20 nt, Human
gagcugccuguucagcucca

SEQ ID NO: 2988764 - RNA, 18 nt, Human
gagcggagaaaggaaggg

SEQ ID NO: 2988765 - RNA, 21 nt, Human
gagcggagaaaggaagggcug

SEQ ID NO: 2988766 - RNA, 17 nt, Human
gagcggagaaaggaagg

SEQ ID NO: 2988767 - RNA, 18 nt, Human
gagcugggugucaagagg

SEQ ID NO: 2988768 - RNA, 15 nt, Human
gagacuccugcaggc

SEQ ID NO: 2988769 - RNA, 16 nt, Human
gagacuccugcaggca

SEQ ID NO: 2988770 - RNA, 17 nt, Human
gagacuccugcaggcag

SEQ ID NO: 2988771 - RNA, 14 nt, Human
gagaggcauccagu

SEQ ID NO: 2988772 - RNA, 22 nt, Human
gagaggcauccaguaucuugaa

SEQ ID NO: 2988773 - RNA, 21 nt, Human
gagaugaugccaugggcccuc

SEQ ID NO: 2988774 - RNA, 18 nt, Human
gagauugcaccacugcac

SEQ ID NO: 2988775 - RNA, 13 nt, Human
gagauuuacaacu

SEQ ID NO: 2988776 - RNA, 16 nt, Human
gaaggcucgagcaugc

SEQ ID NO: 2988777 - RNA, 17 nt, Human
gaaggcucgagcaugcc

SEQ ID NO: 2988778 - RNA, 19 nt, Human
gaagucuuuguacagacaa

SEQ ID NO: 2988779 - RNA, 20 nt, Human
gaagucuuuguacagacaac

SEQ ID NO: 2988780 - RNA, 18 nt, Human
gaagucuuuguacagaca

SEQ ID NO: 2988781 - RNA, 16 nt, Human
gaagcucagggccugg

SEQ ID NO: 2988782 - RNA, 17 nt, Human
gaagcucagggccuggc

SEQ ID NO: 2988783 - RNA, 18 nt, Human
gaagcucagggccuggcu

SEQ ID NO: 2988784 - RNA, 19 nt, Human
gaagcucagggccuggcuc

SEQ ID NO: 2988785 - RNA, 20 nt, Human
gaagcucagggccuggcuca

SEQ ID NO: 2988786 - RNA, 21 nt, Human
gaagcucagggccuggcucag

SEQ ID NO: 2988787 - RNA, 23 nt, Human
gaagcucagggccuggcucaggu

SEQ ID NO: 2988788 - RNA, 14 nt, Human
gaagcucagggccu

SEQ ID NO: 2988789 - RNA, 15 nt, Human
gaagcucagggccug

SEQ ID NO: 2988790 - RNA, 23 nt, Human
gaaugagagacacacugaagaag

SEQ ID NO: 2988791 - RNA, 22 nt, Human
gaaugagagacacacugaagaa

SEQ ID NO: 2988792 - RNA, 20 nt, Human
gaaugagagacacacugaag

SEQ ID NO: 2988793 - RNA, 20 nt, Human
gaaugaauggcuaagcaaaa

SEQ ID NO: 2988794 - RNA, 11 nt, Human
gaaugaauguc

SEQ ID NO: 2988795 - RNA, 14 nt, Human
gaaugaaugucagu

SEQ ID NO: 2988796 - RNA, 18 nt, Human
gaaugaaugucaguguga

SEQ ID NO: 2988797 - RNA, 22 nt, Human
gaaugaaugucagugugacuga

SEQ ID NO: 2988798 - RNA, 11 nt, Human
gaauuaguuuu

SEQ ID NO: 2988799 - RNA, 12 nt, Human
gaauuaugaaac

SEQ ID NO: 2988800 - RNA, 19 nt, Human
gaauuuuggcugugucucc

SEQ ID NO: 2988801 - RNA, 19 nt, Human
gacacacagcucuguccug

SEQ ID NO: 2988802 - RNA, 18 nt, Human
gacacacagcucuguccu

SEQ ID NO: 2988803 - RNA, 17 nt, Human
gacacacagcucugucc

SEQ ID NO: 2988804 - RNA, 15 nt, Human
gacacacagcucugu

SEQ ID NO: 2988805 - RNA, 13 nt, Human
gacacacagcucu

SEQ ID NO: 2988806 - RNA, 14 nt, Human
gacacacagcucug

SEQ ID NO: 2988807 - RNA, 15 nt, Human
gacaaaauggaauac

SEQ ID NO: 2988808 - RNA, 20 nt, Human
gaauuuugugcccccaugua

SEQ ID NO: 2988809 - RNA, 23 nt, Human
gaauuuuggcugugucucccuuc

SEQ ID NO: 2988810 - RNA, 21 nt, Human
gaauuuugugcccccauguaa

SEQ ID NO: 2988811 - RNA, 14 nt, Human
gacaaaaagcuacu

SEQ ID NO: 2988812 - RNA, 13 nt, Human
gacacacugaaga

SEQ ID NO: 2988813 - RNA, 12 nt, Human
gacacacaugaa

SEQ ID NO: 2988814 - RNA, 21 nt, Human
gacacacagcucuguccuggg

SEQ ID NO: 2988815 - RNA, 16 nt, Human
gacacuuaaaaauggu

SEQ ID NO: 2988816 - RNA, 15 nt, Human
gacacugaugggcaa

SEQ ID NO: 2988817 - RNA, 13 nt, Human
gacacugaugggc

SEQ ID NO: 2988818 - RNA, 21 nt, Human
gacagcccgggcucugccucc

SEQ ID NO: 2988819 - RNA, 22 nt, Human
gacagcccgggcucugccuccc

SEQ ID NO: 2988820 - RNA, 23 nt, Human
gacagcccgggcucugccuccca

SEQ ID NO: 2988821 - RNA, 20 nt, Human
gacaguauggcagcuuuccu

SEQ ID NO: 2988822 - RNA, 17 nt, Human
gacagucaccucaugga

SEQ ID NO: 2988823 - RNA, 11 nt, Human
gacagcuccuu

SEQ ID NO: 2988824 - RNA, 22 nt, Human
gacaggguuuugccauguuggc

SEQ ID NO: 2988825 - RNA, 20 nt, Human
gacaggguuuugccauguug

SEQ ID NO: 2988826 - RNA, 15 nt, Human
gcacaucuguuuugu

SEQ ID NO: 2988827 - RNA, 21 nt, Human
gcacaugagcuggcgggauug

SEQ ID NO: 2988828 - RNA, 13 nt, Human
gcacaugccucuc

SEQ ID NO: 2988829 - RNA, 20 nt, Human
gcacaucagcacgauuucug

SEQ ID NO: 2988830 - RNA, 19 nt, Human
gcacaucagcacgauuucu

SEQ ID NO: 2988831 - RNA, 21 nt, Human
gcacaucagcacgauuucugu

SEQ ID NO: 2988832 - RNA, 14 nt, Human
gcacaguuuucuga

SEQ ID NO: 2988833 - RNA, 17 nt, Human
gcacaguuuucugagaa

SEQ ID NO: 2988834 - RNA, 18 nt, Human
gcacaguuuucugagaaa

SEQ ID NO: 2988835 - RNA, 14 nt, Human
gcacaugccucucu

SEQ ID NO: 2988836 - RNA, 17 nt, Human
gcacaugccucucucag

SEQ ID NO: 2988837 - RNA, 18 nt, Human
gcacaugccucucucagg

SEQ ID NO: 2988838 - RNA, 19 nt, Human
gcacaugccucucucaggc

SEQ ID NO: 2988839 - RNA, 20 nt, Human
gcacaugccucucucaggcc

SEQ ID NO: 2988840 - RNA, 21 nt, Human
gcacaugccucucucaggcca

SEQ ID NO: 2988841 - RNA, 19 nt, Human
gcaccggcuggccuggccc

SEQ ID NO: 2988842 - RNA, 21 nt, Human
gcaccggcuggccuggccccu

SEQ ID NO: 2988843 - RNA, 23 nt, Human
gcaccggcuggccuggccccuca

SEQ ID NO: 2988844 - RNA, 18 nt, Human
gcaccggcuggccuggcc

SEQ ID NO: 2988845 - RNA, 13 nt, Human
gcaagugagagcu

SEQ ID NO: 2988846 - RNA, 14 nt, Human
gcacaagcugcacc

SEQ ID NO: 2988847 - RNA, 23 nt, Human
gcacaagcuccaagcucccaggc

SEQ ID NO: 2988848 - RNA, 21 nt, Human
gcacaagcuccaagcucccag

SEQ ID NO: 2988849 - RNA, 22 nt, Human
gcacaagcuccaagcucccagg

SEQ ID NO: 2988850 - RNA, 21 nt, Human
gcaauaaagcagcguuucuau

SEQ ID NO: 2988851 - RNA, 22 nt, Human
gcagagcaccuuagacaguccc

SEQ ID NO: 2988852 - RNA, 23 nt, Human
gcagagcaccuuagacagucccu

SEQ ID NO: 2988853 - RNA, 19 nt, Human
gcagagcaccuuagacagu

SEQ ID NO: 2988854 - RNA, 24 nt, Human
gcagagcaccuuagacagucccug

SEQ ID NO: 2988855 - RNA, 12 nt, Human
gcagagcagaga

SEQ ID NO: 2988856 - RNA, 14 nt, Human
gcagagcagagacc

SEQ ID NO: 2988857 - RNA, 15 nt, Human
gcagagcagagacca

SEQ ID NO: 2988858 - RNA, 19 nt, Human
gcagagcagagaccauccc

SEQ ID NO: 2988859 - RNA, 20 nt, Human
gcagagcagagaccaucccu

SEQ ID NO: 2988860 - RNA, 13 nt, Human
gcacuuuaaaaca

SEQ ID NO: 2988861 - RNA, 12 nt, Human
gcacugacauug

SEQ ID NO: 2988862 - RNA, 19 nt, Human
gcaguaaaaaaugguguuu

SEQ ID NO: 2988863 - RNA, 19 nt, Human
gcagggacuugaacccaua

SEQ ID NO: 2988864 - RNA, 22 nt, Human
gcaguaaaaaaugguguuuuau

SEQ ID NO: 2988865 - RNA, 21 nt, Human
gcaguacuaacauuuauuuga

SEQ ID NO: 2988866 - RNA, 15 nt, Human
gcaguacuaacauuu

SEQ ID NO: 2988867 - RNA, 22 nt, Human
gcagcugccuccccuccucugc

SEQ ID NO: 2988868 - RNA, 18 nt, Human
gcagcugccuccccuccu

SEQ ID NO: 2988869 - RNA, 17 nt, Human
gcagcugccuccccucc

SEQ ID NO: 2988870 - RNA, 16 nt, Human
gcagcugccuccccuc

SEQ ID NO: 2988871 - RNA, 15 nt, Human
gcagcugccuccccu

SEQ ID NO: 2988872 - RNA, 13 nt, Human
gcagcugccuccc

SEQ ID NO: 2988873 - RNA, 12 nt, Human
gcagcugccucc

SEQ ID NO: 2988874 - RNA, 11 nt, Human
gcagcugccuc

SEQ ID NO: 2988875 - RNA, 20 nt, Human
gcaggcucucaggccagcug

SEQ ID NO: 2988876 - RNA, 22 nt, Human
gcaggcucucaggccagcugcu

SEQ ID NO: 2988877 - RNA, 19 nt, Human
gcagcugcgguccacccag

SEQ ID NO: 2988878 - RNA, 17 nt, Human
gcagcugcgguccaccc

SEQ ID NO: 2988879 - RNA, 23 nt, Human
gcaggcucucaggccagcugcuu

SEQ ID NO: 2988880 - RNA, 18 nt, Human
gcaggcucucaggccagc

SEQ ID NO: 2988881 - RNA, 20 nt, Human
gcauaccacuuuuguucuug

SEQ ID NO: 2988882 - RNA, 17 nt, Human
gcauaccacuuuuguuc

SEQ ID NO: 2988883 - RNA, 22 nt, Human
gcauaaguccucuagugaaugu

SEQ ID NO: 2988884 - RNA, 15 nt, Human
gcauaaguccucuag

SEQ ID NO: 2988885 - RNA, 14 nt, Human
gcauacguacacau

SEQ ID NO: 2988886 - RNA, 16 nt, Human
gcauaccacuuuuguu

SEQ ID NO: 2988887 - RNA, 12 nt, Human
gcagccaggcca

SEQ ID NO: 2988888 - RNA, 14 nt, Human
gcagccacuauugu

SEQ ID NO: 2988889 - RNA, 16 nt, Human
gcagccacauuccuga

SEQ ID NO: 2988890 - RNA, 13 nt, Human
gcagccaggccac

SEQ ID NO: 2988891 - RNA, 14 nt, Human
gcagccaggccaca

SEQ ID NO: 2988892 - RNA, 21 nt, Human
gagugcucaguagucagacug

SEQ ID NO: 2988893 - RNA, 18 nt, Human
gagugccuuacacaaugg

SEQ ID NO: 2988894 - RNA, 20 nt, Human
gaguuguuacauuuuuaagu

SEQ ID NO: 2988895 - RNA, 16 nt, Human
gaguuguuacauuuuu

SEQ ID NO: 2988896 - RNA, 23 nt, Human
gaguugugugaauaccccaagac

SEQ ID NO: 2988897 - RNA, 18 nt, Human
gaguuuagcccugaacau

SEQ ID NO: 2988898 - RNA, 16 nt, Human
gaguuuagcuggaaaa

SEQ ID NO: 2988899 - RNA, 16 nt, Human
gaguuuaaauuguaau

SEQ ID NO: 2988900 - RNA, 12 nt, Human
gaguuuggccag

SEQ ID NO: 2988901 - RNA, 13 nt, Human
gaguuuggccaga

SEQ ID NO: 2988902 - RNA, 20 nt, Human
gaguuugggguaugggagag

SEQ ID NO: 2988903 - RNA, 14 nt, Human
gaguuuggccagaa

SEQ ID NO: 2988904 - RNA, 12 nt, Human
gagugagcuggu

SEQ ID NO: 2988905 - RNA, 13 nt, Human
gagucccaccuug

SEQ ID NO: 2988906 - RNA, 24 nt, Human
gagugagcacuaaggugugcucug

SEQ ID NO: 2988907 - RNA, 12 nt, Human
gagugcagugag

SEQ ID NO: 2988908 - RNA, 11 nt, Human
gagugcaguga

SEQ ID NO: 2988909 - RNA, 20 nt, Human
gagucccaccuuggcugcag

SEQ ID NO: 2988910 - RNA, 16 nt, Human
gagucccaccuuggcu

SEQ ID NO: 2988911 - RNA, 14 nt, Human
gagucaccaagccc

SEQ ID NO: 2988912 - RNA, 13 nt, Human
gagucaccaagcc

SEQ ID NO: 2988913 - RNA, 12 nt, Human
gaggugggaucc

SEQ ID NO: 2988914 - RNA, 11 nt, Human
gaggugggagg

SEQ ID NO: 2988915 - RNA, 14 nt, Human
gaggucuguucuuu

SEQ ID NO: 2988916 - RNA, 13 nt, Human
gaggucuguucuu

SEQ ID NO: 2988917 - RNA, 16 nt, Human
gauacuuauuuaaaua

SEQ ID NO: 2988918 - RNA, 19 nt, Human
gauacuuauuuaaauagau

SEQ ID NO: 2988919 - RNA, 13 nt, Human
gauacuuauuuaa

SEQ ID NO: 2988920 - RNA, 14 nt, Human
gauaugugaacagu

SEQ ID NO: 2988921 - RNA, 13 nt, Human
gauaugugaacag

SEQ ID NO: 2988922 - RNA, 20 nt, Human
gauauguaccuaacgaagua

SEQ ID NO: 2988923 - RNA, 18 nt, Human
gauauggguaguauuuuu

SEQ ID NO: 2988924 - RNA, 17 nt, Human
gauauggguaguauuuu

SEQ ID NO: 2988925 - RNA, 11 nt, Human
gauacuacagu

SEQ ID NO: 2988926 - RNA, 16 nt, Human
gauacuacaguuuguu

SEQ ID NO: 2988927 - RNA, 13 nt, Human
gauacccauccca

SEQ ID NO: 2988928 - RNA, 14 nt, Human
gauacccaucccau

SEQ ID NO: 2988929 - RNA, 17 nt, Human
gauuagggagagaagau

SEQ ID NO: 2988930 - RNA, 14 nt, Human
gaugugaacacauc

SEQ ID NO: 2988931 - RNA, 16 nt, Human
gaugugaacacaucag

SEQ ID NO: 2988932 - RNA, 20 nt, Human
gauuacaggugugaaccacc

SEQ ID NO: 2988933 - RNA, 14 nt, Human
gauuaccagggacu

SEQ ID NO: 2988934 - RNA, 15 nt, Human
gauauuuuuuucuuu

SEQ ID NO: 2988935 - RNA, 16 nt, Human
gauauuuugcuuugug

SEQ ID NO: 2988936 - RNA, 15 nt, Human
gauauuuugcuuugu

SEQ ID NO: 2988937 - RNA, 12 nt, Human
gaucucuugagc

SEQ ID NO: 2988938 - RNA, 16 nt, Human
gaucucuugagccugg

SEQ ID NO: 2988939 - RNA, 17 nt, Human
gaucucuugagccuggg

SEQ ID NO: 2988940 - RNA, 14 nt, Human
gaugaucuuugcag

SEQ ID NO: 2988941 - RNA, 21 nt, Human
gaugaucuuugcagacaggca

SEQ ID NO: 2988942 - RNA, 20 nt, Human
gaugaucuuugcagacaggc

SEQ ID NO: 2988943 - RNA, 16 nt, Human
gaugagaggaaaucac

SEQ ID NO: 2988944 - RNA, 12 nt, Human
gcugaacaucac

SEQ ID NO: 2988945 - RNA, 16 nt, Human
gcugaaacaacaaaua

SEQ ID NO: 2988946 - RNA, 20 nt, Human
gcucuguggcgagccauuug

SEQ ID NO: 2988947 - RNA, 23 nt, Human
gcucugguccauagagagcaaga

SEQ ID NO: 2988948 - RNA, 13 nt, Human
gcugacagacaca

SEQ ID NO: 2988949 - RNA, 17 nt, Human
gcugagccucacagcag

SEQ ID NO: 2988950 - RNA, 21 nt, Human
gcugagccucacagcagugag

SEQ ID NO: 2988951 - RNA, 19 nt, Human
gcugagccucacagcagug

SEQ ID NO: 2988952 - RNA, 22 nt, Human
gcugagccucacagcagugaga

SEQ ID NO: 2988953 - RNA, 23 nt, Human
gcugaaggcucgagcaugccugg

SEQ ID NO: 2988954 - RNA, 17 nt, Human
gcugaauacagaggcaa

SEQ ID NO: 2988955 - RNA, 21 nt, Human
gcucugcccauccugccccug

SEQ ID NO: 2988956 - RNA, 15 nt, Human
gcucugcccauccug

SEQ ID NO: 2988957 - RNA, 22 nt, Human
gcucugaucauccacugugcca

SEQ ID NO: 2988958 - RNA, 21 nt, Human
gcucugaucauccacugugcc

SEQ ID NO: 2988959 - RNA, 20 nt, Human
gcucugaucauccacugugc

SEQ ID NO: 2988960 - RNA, 15 nt, Human
gcuccucuccccagc

SEQ ID NO: 2988961 - RNA, 23 nt, Human
gcucccaggcauuccccaggagg

SEQ ID NO: 2988962 - RNA, 14 nt, Human
gcuccagcucacca

SEQ ID NO: 2988963 - RNA, 13 nt, Human
gcuccagcucacc

SEQ ID NO: 2988964 - RNA, 18 nt, Human
gcuccagacacaugucca

SEQ ID NO: 2988965 - RNA, 21 nt, Human
gcuccagacacauguccaaga

SEQ ID NO: 2988966 - RNA, 23 nt, Human
gcuccagacacauguccaagaag

SEQ ID NO: 2988967 - RNA, 9 nt, Human
gcuccagac

SEQ ID NO: 2988968 - RNA, 20 nt, Human
gcuccacuuggucugugaga

SEQ ID NO: 2988969 - RNA, 18 nt, Human
gcucucaaguuaucaggg

SEQ ID NO: 2988970 - RNA, 19 nt, Human
gcuccucuccccagcaagu

SEQ ID NO: 2988971 - RNA, 16 nt, Human
gcuccucuccccagca

SEQ ID NO: 2988972 - RNA, 19 nt, Human
gcucuacugaggugcuaug

SEQ ID NO: 2988973 - RNA, 17 nt, Human
gcucucaggccagcugc

SEQ ID NO: 2988974 - RNA, 18 nt, Human
gcucucaggccagcugcu

SEQ ID NO: 2988975 - RNA, 19 nt, Human
gcucucaggccagcugcuu

SEQ ID NO: 2988976 - RNA, 15 nt, Human
gcugaggugggagga

SEQ ID NO: 2988977 - RNA, 13 nt, Human
gcugccauccagg

SEQ ID NO: 2988978 - RNA, 12 nt, Human
gcugccauccag

SEQ ID NO: 2988979 - RNA, 14 nt, Human
gcugccagugccug

SEQ ID NO: 2988980 - RNA, 13 nt, Human
gcugccagugccu

SEQ ID NO: 2988981 - RNA, 13 nt, Human
gcugcacccucag

SEQ ID NO: 2988982 - RNA, 15 nt, Human
gcugcacccucaggc

SEQ ID NO: 2988983 - RNA, 20 nt, Human
gcugccccugcacagcaggc

SEQ ID NO: 2988984 - RNA, 15 nt, Human
gcugcucccaccugg

SEQ ID NO: 2988985 - RNA, 11 nt, Human
gcugcucccac

SEQ ID NO: 2988986 - RNA, 22 nt, Human
gcugcucccaccuggcucugug

SEQ ID NO: 2988987 - RNA, 20 nt, Human
gcugcucccaccuggcucug

SEQ ID NO: 2988988 - RNA, 24 nt, Human
gcugcucccaccuggcucuguggc

SEQ ID NO: 2988989 - RNA, 15 nt, Human
gcugccccuggcagc

SEQ ID NO: 2988990 - RNA, 16 nt, Human
gcugccccuggcagcc

SEQ ID NO: 2988991 - RNA, 13 nt, Human
gcugccccuggca

SEQ ID NO: 2988992 - RNA, 17 nt, Human
gcugccauccagguuca

SEQ ID NO: 2988993 - RNA, 18 nt, Human
gcugcugagauccuggac

SEQ ID NO: 2988994 - RNA, 20 nt, Human
gcugcugagauccuggacug

SEQ ID NO: 2988995 - RNA, 12 nt, Human
gcugcugacagu

SEQ ID NO: 2988996 - RNA, 18 nt, Human
gcugcugaaggcucgagc

SEQ ID NO: 2988997 - RNA, 17 nt, Human
gcuuauuuccucauuuu

SEQ ID NO: 2988998 - RNA, 22 nt, Human
gcuuaauuauugauguuuucau

SEQ ID NO: 2988999 - RNA, 13 nt, Human
gcuguuggcuggg

SEQ ID NO: 2989000 - RNA, 14 nt, Human
gcuucaaggauccu

SEQ ID NO: 2989001 - RNA, 14 nt, Human
gcuucaguggcagc

SEQ ID NO: 2989002 - RNA, 22 nt, Human
gcuguacauacuuuuuggguuu

SEQ ID NO: 2989003 - RNA, 13 nt, Human
gcuguauuuuaaa

SEQ ID NO: 2989004 - RNA, 12 nt, Human
gcuguauuuuaa

SEQ ID NO: 2989005 - RNA, 23 nt, Human
gcugguucaggguuggccccugc

SEQ ID NO: 2989006 - RNA, 22 nt, Human
gcuggaguuauugaagcagagu

SEQ ID NO: 2989007 - RNA, 23 nt, Human
gcuugaccgugaggccagagaca

SEQ ID NO: 2989008 - RNA, 18 nt, Human
gcuugaccuuuaagagaa

SEQ ID NO: 2989009 - RNA, 22 nt, Human
gcuugaccuuuaagagaaauga

SEQ ID NO: 2989010 - RNA, 17 nt, Human
gcuuguaaauagcucag

SEQ ID NO: 2989011 - RNA, 19 nt, Human
gcuuguaaauagcucaggu

SEQ ID NO: 2989012 - RNA, 18 nt, Human
gcuuguaaauagcucagg

SEQ ID NO: 2989013 - RNA, 23 nt, Human
gcuuucuacccagcgagcccugg

SEQ ID NO: 2989014 - RNA, 12 nt, Human
gcuucuucagag

SEQ ID NO: 2989015 - RNA, 15 nt, Human
gcuucuucagagacu

SEQ ID NO: 2989016 - RNA, 20 nt, Human
gcuugaccgugaggccagag

SEQ ID NO: 2989017 - RNA, 19 nt, Human
gcuuccuggcaauagucaa

SEQ ID NO: 2989018 - RNA, 23 nt, Human
gcuuccagugaggcucugcccuu

SEQ ID NO: 2989019 - RNA, 22 nt, Human
gcuuccagugaggcucugcccu

SEQ ID NO: 2989020 - RNA, 12 nt, Human
gcuuuugugcau

SEQ ID NO: 2989021 - RNA, 16 nt, Human
ggaaacccagcucugg

SEQ ID NO: 2989022 - RNA, 18 nt, Human
ggaaaauuuuaaaaauac

SEQ ID NO: 2989023 - RNA, 22 nt, Human
gcuuuuuucucugauacagaaa

SEQ ID NO: 2989024 - RNA, 18 nt, Human
gcuuuugucuaugggacu

SEQ ID NO: 2989025 - RNA, 15 nt, Human
gcuuuuggucugugu

SEQ ID NO: 2989026 - RNA, 14 nt, Human
gcuuugaucccuuc

SEQ ID NO: 2989027 - RNA, 17 nt, Human
gcuuugaucccuucuua

SEQ ID NO: 2989028 - RNA, 14 nt, Human
ggaagacaauguga

SEQ ID NO: 2989029 - RNA, 16 nt, Human
ggaagacaaugugaaa

SEQ ID NO: 2989030 - RNA, 15 nt, Human
ggaacacuccuucac

SEQ ID NO: 2989031 - RNA, 23 nt, Human
ggaacaaggcaaggcugucaauu

SEQ ID NO: 2989032 - RNA, 13 nt, Human
ggaacaccuccuc

SEQ ID NO: 2989033 - RNA, 17 nt, Human
ggaacaaggcaaggcug

SEQ ID NO: 2989034 - RNA, 21 nt, Human
ggaacaaggcaaggcugucaa

SEQ ID NO: 2989035 - RNA, 15 nt, Human
ggaacaaggcaaggc

SEQ ID NO: 2989036 - RNA, 20 nt, Human
ggaaauuagguugaaacaua

SEQ ID NO: 2989037 - RNA, 16 nt, Human
ggaaaugggcagagca

SEQ ID NO: 2989038 - RNA, 17 nt, Human
ggaaaugggcagagcag

SEQ ID NO: 2989039 - RNA, 18 nt, Human
ggaaaugggcagagcaga

SEQ ID NO: 2989040 - RNA, 22 nt, Human
ggaaaugggcagagcagagacc

SEQ ID NO: 2989041 - RNA, 14 nt, Human
ggaaaugggcagag

SEQ ID NO: 2989042 - RNA, 17 nt, Human
ggaagacuucaucccuc

SEQ ID NO: 2989043 - RNA, 20 nt, Human
ggaagacuucaucccucugg

SEQ ID NO: 2989044 - RNA, 15 nt, Human
gcccaggaguuuggc

SEQ ID NO: 2989045 - RNA, 16 nt, Human
gcccaggaguuuggcc

SEQ ID NO: 2989046 - RNA, 13 nt, Human
gcccaggaguuug

SEQ ID NO: 2989047 - RNA, 12 nt, Human
gcccaggcaggu

SEQ ID NO: 2989048 - RNA, 13 nt, Human
gcccaggcagguc

SEQ ID NO: 2989049 - RNA, 13 nt, Human
gcccaggccccug

SEQ ID NO: 2989050 - RNA, 15 nt, Human
gcccaggccccugcc

SEQ ID NO: 2989051 - RNA, 16 nt, Human
gcccaggcaggucuug

SEQ ID NO: 2989052 - RNA, 14 nt, Human
gcccaggcaggucu

SEQ ID NO: 2989053 - RNA, 22 nt, Human
gccaugugcuaguaauuggaaa

SEQ ID NO: 2989054 - RNA, 14 nt, Human
gccaugugccaggu

SEQ ID NO: 2989055 - RNA, 17 nt, Human
gcccaggaguuuggcca

SEQ ID NO: 2989056 - RNA, 17 nt, Human
gcccaggccccugccac

SEQ ID NO: 2989057 - RNA, 15 nt, Human
gccccacccucagau

SEQ ID NO: 2989058 - RNA, 18 nt, Human
gccccacccucagaugca

SEQ ID NO: 2989059 - RNA, 22 nt, Human
gccccugcugguucaggguugg

SEQ ID NO: 2989060 - RNA, 21 nt, Human
gccccugcugguucaggguug

SEQ ID NO: 2989061 - RNA, 15 nt, Human
gccccugcccggcug

SEQ ID NO: 2989062 - RNA, 15 nt, Human
gccccuggaugcagc

SEQ ID NO: 2989063 - RNA, 20 nt, Human
gccagcaguucagagcugcc

SEQ ID NO: 2989064 - RNA, 19 nt, Human
gccagcaguucagagcugc

SEQ ID NO: 2989065 - RNA, 14 nt, Human
gccagcaguucaga

SEQ ID NO: 2989066 - RNA, 13 nt, Human
gccagcaguucag

SEQ ID NO: 2989067 - RNA, 21 nt, Human
gccaggccacaagacccuugu

SEQ ID NO: 2989068 - RNA, 15 nt, Human
gccaggccagaggga

SEQ ID NO: 2989069 - RNA, 22 nt, Human
gccaggccagagggagugacag

SEQ ID NO: 2989070 - RNA, 13 nt, Human
gccaggccacaag

SEQ ID NO: 2989071 - RNA, 18 nt, Human
gccaggccacaagacccu

SEQ ID NO: 2989072 - RNA, 13 nt, Human
gccaggcccucug

SEQ ID NO: 2989073 - RNA, 14 nt, Human
gccaggcccucugc

SEQ ID NO: 2989074 - RNA, 16 nt, Human
gccaguuggucccccu

SEQ ID NO: 2989075 - RNA, 18 nt, Human
gccaguuggucccccuuc

SEQ ID NO: 2989076 - RNA, 20 nt, Human
gccaguuggucccccuucca

SEQ ID NO: 2989077 - RNA, 21 nt, Human
gccaguuggucccccuuccau

SEQ ID NO: 2989078 - RNA, 22 nt, Human
gccaguuggucccccuuccaug

SEQ ID NO: 2989079 - RNA, 23 nt, Human
gccaguuggucccccuuccaugg

SEQ ID NO: 2989080 - RNA, 13 nt, Human
gccaguugguccc

SEQ ID NO: 2989081 - RNA, 22 nt, Human
gccaguuauggcuauaggugcu

SEQ ID NO: 2989082 - RNA, 13 nt, Human
gccagugugacaa

SEQ ID NO: 2989083 - RNA, 14 nt, Human
gcgauucuucugcu

SEQ ID NO: 2989084 - RNA, 20 nt, Human
gcgagccauuugucccaagu

SEQ ID NO: 2989085 - RNA, 24 nt, Human
gcgagccauuugucccaagugcca

SEQ ID NO: 2989086 - RNA, 13 nt, Human
gcgauucuucugc

SEQ ID NO: 2989087 - RNA, 17 nt, Human
gcguuucuaugacacau

SEQ ID NO: 2989088 - RNA, 16 nt, Human
gcuaauuuuucauuuu

SEQ ID NO: 2989089 - RNA, 18 nt, Human
gcuacaaaaacacagcaa

SEQ ID NO: 2989090 - RNA, 19 nt, Human
gcuacaaaaacacagcaag

SEQ ID NO: 2989091 - RNA, 17 nt, Human
gcuacaaaaacacagca

SEQ ID NO: 2989092 - RNA, 20 nt, Human
gcuacugccauccuggccca

SEQ ID NO: 2989093 - RNA, 18 nt, Human
gcuacugccauccuggcc

SEQ ID NO: 2989094 - RNA, 21 nt, Human
gcuacugccauccuggcccag

SEQ ID NO: 2989095 - RNA, 17 nt, Human
gcuacugccauccuggc

SEQ ID NO: 2989096 - RNA, 15 nt, Human
gcuacugucagcucc

SEQ ID NO: 2989097 - RNA, 20 nt, Human
gcuacuguccuacccacccu

SEQ ID NO: 2989098 - RNA, 19 nt, Human
gcuacuguccuacccaccc

SEQ ID NO: 2989099 - RNA, 17 nt, Human
gcuacuugggaggcuga

SEQ ID NO: 2989100 - RNA, 20 nt, Human
gcgugguggacaugcacagc

SEQ ID NO: 2989101 - RNA, 18 nt, Human
gcgugcacacaccagagc

SEQ ID NO: 2989102 - RNA, 14 nt, Human
gcgugcacacacca

SEQ ID NO: 2989103 - RNA, 17 nt, Human
gcggagcacacuggcuc

SEQ ID NO: 2989104 - RNA, 20 nt, Human
gccuccauccugaggcucca

SEQ ID NO: 2989105 - RNA, 16 nt, Human
gccuccauccugaggc

SEQ ID NO: 2989106 - RNA, 15 nt, Human
gccuccauccugagg

SEQ ID NO: 2989107 - RNA, 20 nt, Human
gccuccuuugugaggaagcc

SEQ ID NO: 2989108 - RNA, 21 nt, Human
gccuccuuugugaggaagccg

SEQ ID NO: 2989109 - RNA, 19 nt, Human
gccuccuuugugaggaagc

SEQ ID NO: 2989110 - RNA, 23 nt, Human
gccugcuaauuccccagauugca

SEQ ID NO: 2989111 - RNA, 17 nt, Human
gccugcuaauuccccag

SEQ ID NO: 2989112 - RNA, 13 nt, Human
gccugcuccagcu

SEQ ID NO: 2989113 - RNA, 15 nt, Human
gguacacuugugaau

SEQ ID NO: 2989114 - RNA, 13 nt, Human
gguaacaggcaga

SEQ ID NO: 2989115 - RNA, 20 nt, Human
gguaacaggcagauacagga

SEQ ID NO: 2989116 - RNA, 14 nt, Human
gguaacaggcagau

SEQ ID NO: 2989117 - RNA, 17 nt, Human
ggguuucuaaagcugcc

SEQ ID NO: 2989118 - RNA, 20 nt, Human
ggguggggaccucaggccug

SEQ ID NO: 2989119 - RNA, 19 nt, Human
gggugggacacccugugau

SEQ ID NO: 2989120 - RNA, 13 nt, Human
ggguggaugccug

SEQ ID NO: 2989121 - RNA, 15 nt, Human
ggguggcaccagcag

SEQ ID NO: 2989122 - RNA, 17 nt, Human
ggguggaugccuggugg

SEQ ID NO: 2989123 - RNA, 12 nt, Human
ggguggugaccu

SEQ ID NO: 2989124 - RNA, 17 nt, Human
ggguguggcgcagcaua

SEQ ID NO: 2989125 - RNA, 16 nt, Human
gguccacccaggagcc

SEQ ID NO: 2989126 - RNA, 15 nt, Human
gguccacccaggagc

SEQ ID NO: 2989127 - RNA, 13 nt, Human
gguccacccagga

SEQ ID NO: 2989128 - RNA, 12 nt, Human
gguccacccagg

SEQ ID NO: 2989129 - RNA, 17 nt, Human
gguccacccaggagccc

SEQ ID NO: 2989130 - RNA, 14 nt, Human
gguaugcaaucaaa

SEQ ID NO: 2989131 - RNA, 22 nt, Human
gguaugaucacggcucacugca

SEQ ID NO: 2989132 - RNA, 22 nt, Human
aaacuuuaccuuuuuuauacau

SEQ ID NO: 2989133 - RNA, 17 nt, Human
aaacuuuaccuuuuuua

SEQ ID NO: 2989134 - RNA, 15 nt, Human
gguccauagagagca

SEQ ID NO: 2989135 - RNA, 12 nt, Human
aaacuuuacuau

SEQ ID NO: 2989136 - RNA, 17 nt, Human
aaagaaguuugaacauu

SEQ ID NO: 2989137 - RNA, 17 nt, Human
aaagacuaucuaaaugu

SEQ ID NO: 2989138 - RNA, 14 nt, Human
aaagacuauucaaa

SEQ ID NO: 2989139 - RNA, 21 nt, Human
ggucuguuuuguguacuuuua

SEQ ID NO: 2989140 - RNA, 19 nt, Human
ggugcaaugaccuuucaau

SEQ ID NO: 2989141 - RNA, 20 nt, Human
ggugcaaugaccuuucaaua

SEQ ID NO: 2989142 - RNA, 18 nt, Human
ggugcaaugaccuuucaa

SEQ ID NO: 2989143 - RNA, 21 nt, Human
ggugcauuugaggucuguucu

SEQ ID NO: 2989144 - RNA, 16 nt, Human
ggugcaaugaccuuuc

SEQ ID NO: 2989145 - RNA, 17 nt, Human
aaagcagggacuugaac

SEQ ID NO: 2989146 - RNA, 15 nt, Human
aaagcagcguuucua

SEQ ID NO: 2989147 - RNA, 22 nt, Human
aaagcagcguuucuaugacaca

SEQ ID NO: 2989148 - RNA, 18 nt, Human
aaagcagcguuucuauga

SEQ ID NO: 2989149 - RNA, 16 nt, Human
aaagcagcguuucuau

SEQ ID NO: 2989150 - RNA, 14 nt, Human
gguggaugccuggu

SEQ ID NO: 2989151 - RNA, 21 nt, Human
gguggaugccugguggcagcu

SEQ ID NO: 2989152 - RNA, 14 nt, Human
gguccugcugcagu

SEQ ID NO: 2989153 - RNA, 13 nt, Human
ggucggaaaacau

SEQ ID NO: 2989154 - RNA, 17 nt, Human
ggucuacacugugcuga

SEQ ID NO: 2989155 - RNA, 14 nt, Human
ggucggaaaacaug

SEQ ID NO: 2989156 - RNA, 21 nt, Human
gguccugcugcaguugccagu

SEQ ID NO: 2989157 - RNA, 23 nt, Human
gguccugcugcaguugccaguca

SEQ ID NO: 2989158 - RNA, 23 nt, Human
gguccuagaaauuccccacccug

SEQ ID NO: 2989159 - RNA, 15 nt, Human
aaagacuauucaaac

SEQ ID NO: 2989160 - RNA, 13 nt, Human
aaagcaaaggaga

SEQ ID NO: 2989161 - RNA, 11 nt, Human
gguuuauuugg

SEQ ID NO: 2989162 - RNA, 16 nt, Human
gguuuagaaagcuugc

SEQ ID NO: 2989163 - RNA, 12 nt, Human
gguuucuagcau

SEQ ID NO: 2989164 - RNA, 14 nt, Human
gguuucagaaaugu

SEQ ID NO: 2989165 - RNA, 13 nt, Human
gguuucagaaaug

SEQ ID NO: 2989166 - RNA, 12 nt, Human
gguuucagaaau

SEQ ID NO: 2989167 - RNA, 21 nt, Human
ggugugcggccuuuggcuuca

SEQ ID NO: 2989168 - RNA, 13 nt, Human
ggugugcucugau

SEQ ID NO: 2989169 - RNA, 12 nt, Human
gguguggaagag

SEQ ID NO: 2989170 - RNA, 12 nt, Human
gguucagcuugu

SEQ ID NO: 2989171 - RNA, 21 nt, Human
gguucaggguuggccccugcc

SEQ ID NO: 2989172 - RNA, 18 nt, Human
gguucaggguuggccccu

SEQ ID NO: 2989173 - RNA, 22 nt, Human
gguucaggguuggccccugccc

SEQ ID NO: 2989174 - RNA, 21 nt, Human
gguucccuuugacgccauccc

SEQ ID NO: 2989175 - RNA, 18 nt, Human
gguggggcagugcuuggc

SEQ ID NO: 2989176 - RNA, 17 nt, Human
gguggggcagcuugagg

SEQ ID NO: 2989177 - RNA, 13 nt, Human
gguggggcagcuu

SEQ ID NO: 2989178 - RNA, 19 nt, Human
ggugggauccuccaggugc

SEQ ID NO: 2989179 - RNA, 14 nt, Human
ggugggauccucca

SEQ ID NO: 2989180 - RNA, 15 nt, Human
ggugggauccuccag

SEQ ID NO: 2989181 - RNA, 20 nt, Human
ggugggaggauugcuugagc

SEQ ID NO: 2989182 - RNA, 20 nt, Human
ggugggaggaucucuugagc

SEQ ID NO: 2989183 - RNA, 16 nt, Human
ggugugaccacugcag

SEQ ID NO: 2989184 - RNA, 16 nt, Human
ggugugacugaauuuc

SEQ ID NO: 2989185 - RNA, 18 nt, Human
ggugugagucaccaagcc

SEQ ID NO: 2989186 - RNA, 13 nt, Human
ggugucgggcaug

SEQ ID NO: 2989187 - RNA, 16 nt, Human
ggugucgggcaugaca

SEQ ID NO: 2989188 - RNA, 15 nt, Human
gguggggucacucug

SEQ ID NO: 2989189 - RNA, 23 nt, Human
gguggggucacucuggcagcuca

SEQ ID NO: 2989190 - RNA, 22 nt, Human
aaauaaggaaugauauaagguu

SEQ ID NO: 2989191 - RNA, 20 nt, Human
aaauaauuuuuauauuugaa

SEQ ID NO: 2989192 - RNA, 18 nt, Human
aaauaauuuuuauauuug

SEQ ID NO: 2989193 - RNA, 13 nt, Human
aaauaaugugaaa

SEQ ID NO: 2989194 - RNA, 15 nt, Human
aaauaauuuuuauau

SEQ ID NO: 2989195 - RNA, 12 nt, Human
aaauaaugugaa

SEQ ID NO: 2989196 - RNA, 17 nt, Human
aaauaagucugauuuaa

SEQ ID NO: 2989197 - RNA, 16 nt, Human
aaauaagucugauuua

SEQ ID NO: 2989198 - RNA, 14 nt, Human
aaauaagucugauu

SEQ ID NO: 2989199 - RNA, 12 nt, Human
aaauaagucuga

SEQ ID NO: 2989200 - RNA, 15 nt, Human
aaauaaucucugauu

SEQ ID NO: 2989201 - RNA, 15 nt, Human
aaaguugcaaggcaa

SEQ ID NO: 2989202 - RNA, 21 nt, Human
aaaguugcaaggcaaauguuu

SEQ ID NO: 2989203 - RNA, 14 nt, Human
aaaguugcaaggca

SEQ ID NO: 2989204 - RNA, 16 nt, Human
aaaguugaauuuuaca

SEQ ID NO: 2989205 - RNA, 23 nt, Human
aaaguuucucuuuucaaaacauu

SEQ ID NO: 2989206 - RNA, 21 nt, Human
aaaguuucucuuuucaaaaca

SEQ ID NO: 2989207 - RNA, 18 nt, Human
aaaguuuauaaaagugaa

SEQ ID NO: 2989208 - RNA, 13 nt, Human
gguuuggagcuga

SEQ ID NO: 2989209 - RNA, 20 nt, Human
gguuuggacaaaauggaaua

SEQ ID NO: 2989210 - RNA, 12 nt, Human
aaaguggugaga

SEQ ID NO: 2989211 - RNA, 15 nt, Human
gguuuggagcugauc

SEQ ID NO: 2989212 - RNA, 16 nt, Human
aaacagucucccuucc

SEQ ID NO: 2989213 - RNA, 20 nt, Human
aaacagucucaggaaaucaa

SEQ ID NO: 2989214 - RNA, 23 nt, Human
aaacauaucucuuaucuuacgaa

SEQ ID NO: 2989215 - RNA, 20 nt, Human
aaacaagcacuaaacaaaga

SEQ ID NO: 2989216 - RNA, 16 nt, Human
aaacacauuuuucuua

SEQ ID NO: 2989217 - RNA, 12 nt, Human
aaacacauuuuu

SEQ ID NO: 2989218 - RNA, 20 nt, Human
aaacaagaccacguuucuaa

SEQ ID NO: 2989219 - RNA, 18 nt, Human
aaacaagaccacguuucu

SEQ ID NO: 2989220 - RNA, 12 nt, Human
ggggccuggaug

SEQ ID NO: 2989221 - RNA, 15 nt, Human
ggggccucagugcca

SEQ ID NO: 2989222 - RNA, 20 nt, Human
ggggacagcuccuucugucc

SEQ ID NO: 2989223 - RNA, 14 nt, Human
ggggacagcuccuu

SEQ ID NO: 2989224 - RNA, 12 nt, Human
ggggacagcucc

SEQ ID NO: 2989225 - RNA, 22 nt, Human
aaaauuuuuucucuaggaaaua

SEQ ID NO: 2989226 - RNA, 15 nt, Human
aaaaugugauaugua

SEQ ID NO: 2989227 - RNA, 22 nt, Human
gggcuggguucuacccaggugc

SEQ ID NO: 2989228 - RNA, 20 nt, Human
gggcuggguucuacccaggu

SEQ ID NO: 2989229 - RNA, 18 nt, Human
gggcucagcaaaagaugc

SEQ ID NO: 2989230 - RNA, 22 nt, Human
gggcugcaccggcuggccuggc

SEQ ID NO: 2989231 - RNA, 10 nt, Human
gggcucagca

SEQ ID NO: 2989232 - RNA, 18 nt, Human
gggcugcaugcgggcuuc

SEQ ID NO: 2989233 - RNA, 21 nt, Human
gggcugcaugcgggcuuccuc

SEQ ID NO: 2989234 - RNA, 19 nt, Human
gggcccuuuuucaauaacu

SEQ ID NO: 2989235 - RNA, 14 nt, Human
gggccaguuggucc

SEQ ID NO: 2989236 - RNA, 18 nt, Human
gggccaguuggucccccu

SEQ ID NO: 2989237 - RNA, 22 nt, Human
gggccaguuggucccccuucca

SEQ ID NO: 2989238 - RNA, 23 nt, Human
gggccaguuggucccccuuccau

SEQ ID NO: 2989239 - RNA, 18 nt, Human
gggcuaguugggcuuccu

SEQ ID NO: 2989240 - RNA, 15 nt, Human
gggcuacaaggaccc

SEQ ID NO: 2989241 - RNA, 15 nt, Human
gggcgugguggugag

SEQ ID NO: 2989242 - RNA, 15 nt, Human
gggcgggaggauguu

SEQ ID NO: 2989243 - RNA, 13 nt, Human
gggccuccugugu

SEQ ID NO: 2989244 - RNA, 15 nt, Human
gggccuccugugugu

SEQ ID NO: 2989245 - RNA, 23 nt, Human
gggccucggaccccacuccggcc

SEQ ID NO: 2989246 - RNA, 20 nt, Human
gggccucuuaugggcugggu

SEQ ID NO: 2989247 - RNA, 19 nt, Human
gggccucuuaugggcuggg

SEQ ID NO: 2989248 - RNA, 19 nt, Human
aaaaguauguuagugcaaa

SEQ ID NO: 2989249 - RNA, 16 nt, Human
aaaaucuucauggaau

SEQ ID NO: 2989250 - RNA, 15 nt, Human
aaaaucuucauggaa

SEQ ID NO: 2989251 - RNA, 23 nt, Human
aaaaucuucauggaauucacaaa

SEQ ID NO: 2989252 - RNA, 17 nt, Human
aaaaucuucauggaauu

SEQ ID NO: 2989253 - RNA, 14 nt, Human
aaaaugagccuggc

SEQ ID NO: 2989254 - RNA, 21 nt, Human
aaaaugagccuggcaagaaug

SEQ ID NO: 2989255 - RNA, 11 nt, Human
gggccaggagc

SEQ ID NO: 2989256 - RNA, 22 nt, Human
aaaagggguaggguuuaaagau

SEQ ID NO: 2989257 - RNA, 17 nt, Human
gggcagagcagagacca

SEQ ID NO: 2989258 - RNA, 22 nt, Human
gggcagagcagagaccaucccu

SEQ ID NO: 2989259 - RNA, 14 nt, Human
gggcagaggaaagc

SEQ ID NO: 2989260 - RNA, 16 nt, Human
gggcagagcagagacc

SEQ ID NO: 2989261 - RNA, 12 nt, Human
gggcagagcaga

SEQ ID NO: 2989262 - RNA, 18 nt, Human
gggcaacccccagccugc

SEQ ID NO: 2989263 - RNA, 16 nt, Human
gggcaacccccagccu

SEQ ID NO: 2989264 - RNA, 16 nt, Human
gggauuguaaaauggu

SEQ ID NO: 2989265 - RNA, 17 nt, Human
gggauuguaaaauggug

SEQ ID NO: 2989266 - RNA, 13 nt, Human
gggauuggcugug

SEQ ID NO: 2989267 - RNA, 15 nt, Human
gggauuacaggugug

SEQ ID NO: 2989268 - RNA, 19 nt, Human
gggaggccaaggugggagg

SEQ ID NO: 2989269 - RNA, 17 nt, Human
gggaggucgaggcagga

SEQ ID NO: 2989270 - RNA, 18 nt, Human
gggagggcuccagacaca

SEQ ID NO: 2989271 - RNA, 18 nt, Human
gggaggucgaggcaggag

SEQ ID NO: 2989272 - RNA, 19 nt, Human
gggaggucgaggcaggagg

SEQ ID NO: 2989273 - RNA, 14 nt, Human
gggagggcuccaga

SEQ ID NO: 2989274 - RNA, 15 nt, Human
gggagggcuccagac

SEQ ID NO: 2989275 - RNA, 17 nt, Human
gggagggcuccagacac

SEQ ID NO: 2989276 - RNA, 15 nt, Human
gggaggucgaggcag

SEQ ID NO: 2989277 - RNA, 21 nt, Human
aaaaccaauguucucucuucu

SEQ ID NO: 2989278 - RNA, 12 nt, Human
aaaaccacagca

SEQ ID NO: 2989279 - RNA, 15 nt, Human
aaaacaugcuacaca

SEQ ID NO: 2989280 - RNA, 22 nt, Human
aaaaauggaacauaaaauacaa

SEQ ID NO: 2989281 - RNA, 14 nt, Human
aaaaaucucaaauu

SEQ ID NO: 2989282 - RNA, 13 nt, Human
aaaaccacagcag

SEQ ID NO: 2989283 - RNA, 13 nt, Human
aaaagaugcuucu

SEQ ID NO: 2989284 - RNA, 17 nt, Human
aaaagaugaaaauauuu

SEQ ID NO: 2989285 - RNA, 23 nt, Human
aaaacugcugacuguuuucucuu

SEQ ID NO: 2989286 - RNA, 20 nt, Human
aaaacugcugacuguuuucu

SEQ ID NO: 2989287 - RNA, 22 nt, Human
aaaacugcugacuguuuucucu

SEQ ID NO: 2989288 - RNA, 13 nt, Human
aaaacucauuuuu

SEQ ID NO: 2989289 - RNA, 21 nt, Human
gggacauuugcucauggaauu

SEQ ID NO: 2989290 - RNA, 20 nt, Human
gggacauuugcucauggaau

SEQ ID NO: 2989291 - RNA, 19 nt, Human
gggacauuugcucauggaa

SEQ ID NO: 2989292 - RNA, 21 nt, Human
gggacagcuccuucuguccua

SEQ ID NO: 2989293 - RNA, 13 nt, Human
gggacagaggggg

SEQ ID NO: 2989294 - RNA, 22 nt, Human
gggacagaggggguggccuccc

SEQ ID NO: 2989295 - RNA, 23 nt, Human
gggacagaggggguggccuccca

SEQ ID NO: 2989296 - RNA, 16 nt, Human
gggacagcuccuucug

SEQ ID NO: 2989297 - RNA, 13 nt, Human
gggaaggauacaa

SEQ ID NO: 2989298 - RNA, 14 nt, Human
ggaguuuggccaga

SEQ ID NO: 2989299 - RNA, 15 nt, Human
ggaguuuggccagaa

SEQ ID NO: 2989300 - RNA, 13 nt, Human
ggaguuuggccag

SEQ ID NO: 2989301 - RNA, 14 nt, Human
ggaguggccacaga

SEQ ID NO: 2989302 - RNA, 15 nt, Human
ggaguucugguuccu

SEQ ID NO: 2989303 - RNA, 19 nt, Human
ggaucuguauguguucuau

SEQ ID NO: 2989304 - RNA, 18 nt, Human
ggaucuguauguguucua

SEQ ID NO: 2989305 - RNA, 15 nt, Human
ggauccuccaggugc

SEQ ID NO: 2989306 - RNA, 14 nt, Human
ggauccuccaggug

SEQ ID NO: 2989307 - RNA, 13 nt, Human
ggauccugagcca

SEQ ID NO: 2989308 - RNA, 14 nt, Human
ggauccugagccag

SEQ ID NO: 2989309 - RNA, 18 nt, Human
ggauggauuuccagccaa

SEQ ID NO: 2989310 - RNA, 12 nt, Human
ggauggcaagau

SEQ ID NO: 2989311 - RNA, 16 nt, Human
ggauggggcugcaccg

SEQ ID NO: 2989312 - RNA, 15 nt, Human
ggagugcagugagcc

SEQ ID NO: 2989313 - RNA, 13 nt, Human
ggauguucuggga

SEQ ID NO: 2989314 - RNA, 16 nt, Human
ggauguucugggacac

SEQ ID NO: 2989315 - RNA, 15 nt, Human
ggauguucugggaca

SEQ ID NO: 2989316 - RNA, 24 nt, Human
ggcacagaaaauggaagacagcuc

SEQ ID NO: 2989317 - RNA, 22 nt, Human
ggagccccgaggccuucucuga

SEQ ID NO: 2989318 - RNA, 16 nt, Human
ggagccccgaggccuu

SEQ ID NO: 2989319 - RNA, 12 nt, Human
ggagcugccugu

SEQ ID NO: 2989320 - RNA, 22 nt, Human
ggagcugaucgcuucuccccca

SEQ ID NO: 2989321 - RNA, 21 nt, Human
ggagcugccuguucagcucca

SEQ ID NO: 2989322 - RNA, 20 nt, Human
ggaggccaaggugggaggau

SEQ ID NO: 2989323 - RNA, 11 nt, Human
ggaggccagcc

SEQ ID NO: 2989324 - RNA, 20 nt, Human
ggaggaaggaaacccagcuc

SEQ ID NO: 2989325 - RNA, 23 nt, Human
ggaggaaggaaacccagcucugg

SEQ ID NO: 2989326 - RNA, 19 nt, Human
ggaggaaggaaacccagcu

SEQ ID NO: 2989327 - RNA, 16 nt, Human
ggaggggggagguggg

SEQ ID NO: 2989328 - RNA, 14 nt, Human
ggagguaaugacca

SEQ ID NO: 2989329 - RNA, 20 nt, Human
ggaggucaaggcugcaguga

SEQ ID NO: 2989330 - RNA, 14 nt, Human
ggaggugaccccag

SEQ ID NO: 2989331 - RNA, 11 nt, Human
ggcccaggagu

SEQ ID NO: 2989332 - RNA, 13 nt, Human
ggcccaggaguuu

SEQ ID NO: 2989333 - RNA, 18 nt, Human
ggcccaggaguuuggcca

SEQ ID NO: 2989334 - RNA, 19 nt, Human
ggcccaggaguuuggccag

SEQ ID NO: 2989335 - RNA, 20 nt, Human
ggcccaggaguuuggccaga

SEQ ID NO: 2989336 - RNA, 18 nt, Human
ggccccaccagugccucu

SEQ ID NO: 2989337 - RNA, 17 nt, Human
ggccccaccagugccuc

SEQ ID NO: 2989338 - RNA, 19 nt, Human
ggcccaggguggccacacc

SEQ ID NO: 2989339 - RNA, 16 nt, Human
ggcccuucucuccagc

SEQ ID NO: 2989340 - RNA, 17 nt, Human
ggcccuucucuccagcc

SEQ ID NO: 2989341 - RNA, 14 nt, Human
ggcccuuccuuuuc

SEQ ID NO: 2989342 - RNA, 18 nt, Human
ggcccuucucuccagccc

SEQ ID NO: 2989343 - RNA, 14 nt, Human
ggccaggcuggucu

SEQ ID NO: 2989344 - RNA, 12 nt, Human
ggccaggcuggu

SEQ ID NO: 2989345 - RNA, 18 nt, Human
ggccaggcuggucucaaa

SEQ ID NO: 2989346 - RNA, 16 nt, Human
ggccaggcuggucuca

SEQ ID NO: 2989347 - RNA, 17 nt, Human
ggccaaacucaccugcc

SEQ ID NO: 2989348 - RNA, 16 nt, Human
ggccagugugacaagg

SEQ ID NO: 2989349 - RNA, 15 nt, Human
ggcaccagcagccug

SEQ ID NO: 2989350 - RNA, 16 nt, Human
ggcaccagcagccugg

SEQ ID NO: 2989351 - RNA, 22 nt, Human
ggcacugcuuccagugaggcuc

SEQ ID NO: 2989352 - RNA, 24 nt, Human
ggcacugcuuccagugaggcucug

SEQ ID NO: 2989353 - RNA, 23 nt, Human
ggcacuggcaaacagggccucug

SEQ ID NO: 2989354 - RNA, 22 nt, Human
ggcacuggcaaacagggccucu

SEQ ID NO: 2989355 - RNA, 17 nt, Human
ggcagugggagcugccu

SEQ ID NO: 2989356 - RNA, 18 nt, Human
ggcauccaguaucuugaa

SEQ ID NO: 2989357 - RNA, 19 nt, Human
ggcagugggagcugccugu

SEQ ID NO: 2989358 - RNA, 18 nt, Human
ggcagugggagcugccug

SEQ ID NO: 2989359 - RNA, 22 nt, Human
ggccuucggccuccauccugag

SEQ ID NO: 2989360 - RNA, 23 nt, Human
ggccuucggccuccauccugagg

SEQ ID NO: 2989361 - RNA, 12 nt, Human
ggccuucucuga

SEQ ID NO: 2989362 - RNA, 21 nt, Human
ggccugugucuaguuguuuga

SEQ ID NO: 2989363 - RNA, 21 nt, Human
ggccuggccagaugcaccagc

SEQ ID NO: 2989364 - RNA, 13 nt, Human
ggccuuuggcuuc

SEQ ID NO: 2989365 - RNA, 16 nt, Human
ggccuucucugaagga

SEQ ID NO: 2989366 - RNA, 15 nt, Human
ggccuucucugaagg

SEQ ID NO: 2989367 - RNA, 14 nt, Human
ggccuuuggcuuca

SEQ ID NO: 2989368 - RNA, 15 nt, Human
ggccugagcugggau

SEQ ID NO: 2989369 - RNA, 12 nt, Human
ggccugagcugg

SEQ ID NO: 2989370 - RNA, 23 nt, Human
ggcucagcaaaagaugcuucuca

SEQ ID NO: 2989371 - RNA, 19 nt, Human
ggcucagcaaaagaugcuu

SEQ ID NO: 2989372 - RNA, 23 nt, Human
ggcucagcggggacagcuccuuc

SEQ ID NO: 2989373 - RNA, 22 nt, Human
ggcucagcggggacagcuccuu

SEQ ID NO: 2989374 - RNA, 21 nt, Human
ggcucagcggggacagcuccu

SEQ ID NO: 2989375 - RNA, 17 nt, Human
ggcucacugcagccuca

SEQ ID NO: 2989376 - RNA, 16 nt, Human
ggcucacugcagccuc

SEQ ID NO: 2989377 - RNA, 14 nt, Human
ggcgugcaguggug

SEQ ID NO: 2989378 - RNA, 19 nt, Human
ggcgugcaguggugcgauc

SEQ ID NO: 2989379 - RNA, 21 nt, Human
caguaaaaaaugguguuuuau

SEQ ID NO: 2989380 - RNA, 18 nt, Human
caguaaaugggggugcau

SEQ ID NO: 2989381 - RNA, 19 nt, Human
caguaaaugggggugcauu

SEQ ID NO: 2989382 - RNA, 19 nt, Human
caguauuacuucugcuaca

SEQ ID NO: 2989383 - RNA, 16 nt, Human
cagucaccccggccac

SEQ ID NO: 2989384 - RNA, 17 nt, Human
cagucaccccggccacc

SEQ ID NO: 2989385 - RNA, 14 nt, Human
cagucaccccggcc

SEQ ID NO: 2989386 - RNA, 20 nt, Human
caguaaaaaaugguguuuua

SEQ ID NO: 2989387 - RNA, 23 nt, Human
cagguuuuuggucugacccacug

SEQ ID NO: 2989388 - RNA, 21 nt, Human
caggguuggccccugcccggc

SEQ ID NO: 2989389 - RNA, 17 nt, Human
caggguuggccccugcc

SEQ ID NO: 2989390 - RNA, 14 nt, Human
caggguuggccccu

SEQ ID NO: 2989391 - RNA, 22 nt, Human
caggguggccacaccucuaucc

SEQ ID NO: 2989392 - RNA, 14 nt, Human
caggugcugccauc

SEQ ID NO: 2989393 - RNA, 13 nt, Human
caggugcugccau

SEQ ID NO: 2989394 - RNA, 23 nt, Human
cagggucucacucugucgcccag

SEQ ID NO: 2989395 - RNA, 22 nt, Human
cagggucucacucugucgccca

SEQ ID NO: 2989396 - RNA, 21 nt, Human
cagggucucuaccauccccug

SEQ ID NO: 2989397 - RNA, 16 nt, Human
caggguuggccccugc

SEQ ID NO: 2989398 - RNA, 15 nt, Human
caggguuggccccug

SEQ ID NO: 2989399 - RNA, 14 nt, Human
caggguggccacac

SEQ ID NO: 2989400 - RNA, 19 nt, Human
cagggaggacgcucucugg

SEQ ID NO: 2989401 - RNA, 22 nt, Human
cagggaggacgcucucuggccu

SEQ ID NO: 2989402 - RNA, 14 nt, Human
caggcugggcuuca

SEQ ID NO: 2989403 - RNA, 16 nt, Human
cagggagggcuucugc

SEQ ID NO: 2989404 - RNA, 20 nt, Human
cagggcucagcggggacagc

SEQ ID NO: 2989405 - RNA, 15 nt, Human
cagggcucagcgggg

SEQ ID NO: 2989406 - RNA, 12 nt, Human
cagggcucagcg

SEQ ID NO: 2989407 - RNA, 20 nt, Human
caggccugggggcugggcag

SEQ ID NO: 2989408 - RNA, 22 nt, Human
caggccugggggcugggcagag

SEQ ID NO: 2989409 - RNA, 19 nt, Human
caggcuggcgugcaguggu

SEQ ID NO: 2989410 - RNA, 18 nt, Human
caggcuggcgugcagugg

SEQ ID NO: 2989411 - RNA, 23 nt, Human
caggccugggggcugggcagagg

SEQ ID NO: 2989412 - RNA, 17 nt, Human
caggcuggcgugcagug

SEQ ID NO: 2989413 - RNA, 16 nt, Human
caggcugggagagccu

SEQ ID NO: 2989414 - RNA, 18 nt, Human
caggcugggagagccuuc

SEQ ID NO: 2989415 - RNA, 19 nt, Human
caggcugggagagccuucc

SEQ ID NO: 2989416 - RNA, 15 nt, Human
caggcuggcgugcag

SEQ ID NO: 2989417 - RNA, 24 nt, Human
caggacagcccuucuuuccacaga

SEQ ID NO: 2989418 - RNA, 23 nt, Human
caggacagcccuucuuuccacag

SEQ ID NO: 2989419 - RNA, 13 nt, Human
caggaccagggau

SEQ ID NO: 2989420 - RNA, 13 nt, Human
caggaccucaggu

SEQ ID NO: 2989421 - RNA, 13 nt, Human
caggccaggcccu

SEQ ID NO: 2989422 - RNA, 14 nt, Human
caggccaggcccuc

SEQ ID NO: 2989423 - RNA, 15 nt, Human
caggccaggcccucu

SEQ ID NO: 2989424 - RNA, 16 nt, Human
caggccaggcccucug

SEQ ID NO: 2989425 - RNA, 12 nt, Human
caggaggccagc

SEQ ID NO: 2989426 - RNA, 13 nt, Human
caggaggccagcc

SEQ ID NO: 2989427 - RNA, 20 nt, Human
caggcaaugcuggcuguugg

SEQ ID NO: 2989428 - RNA, 19 nt, Human
caggcaaugcuggcuguug

SEQ ID NO: 2989429 - RNA, 21 nt, Human
caggcaaugcuggcuguuggc

SEQ ID NO: 2989430 - RNA, 17 nt, Human
caggcaaugcuggcugu

SEQ ID NO: 2989431 - RNA, 13 nt, Human
caggccagcugcu

SEQ ID NO: 2989432 - RNA, 15 nt, Human
caggccagcugcuug

SEQ ID NO: 2989433 - RNA, 21 nt, Human
caggaaaucaaauaugcaaag

SEQ ID NO: 2989434 - RNA, 19 nt, Human
caggaaaucaaauaugcaa

SEQ ID NO: 2989435 - RNA, 16 nt, Human
cagcuguucagcuggu

SEQ ID NO: 2989436 - RNA, 15 nt, Human
cagcuguucagcugg

SEQ ID NO: 2989437 - RNA, 16 nt, Human
cagcuuauucacaaga

SEQ ID NO: 2989438 - RNA, 20 nt, Human
caggaaaagcugcugacagu

SEQ ID NO: 2989439 - RNA, 19 nt, Human
caggaaaagcugcugacag

SEQ ID NO: 2989440 - RNA, 21 nt, Human
caggaaaggcuccaggagcag

SEQ ID NO: 2989441 - RNA, 22 nt, Human
caggaaaggcuccaggagcagc

SEQ ID NO: 2989442 - RNA, 23 nt, Human
caggaaaggcuccaggagcagcc

SEQ ID NO: 2989443 - RNA, 23 nt, Human
cagccugagcgacagugagacuc

SEQ ID NO: 2989444 - RNA, 22 nt, Human
cagccugagcgacagugagacu

SEQ ID NO: 2989445 - RNA, 13 nt, Human
cagcccuuagcag

SEQ ID NO: 2989446 - RNA, 23 nt, Human
cagccgccaugcuccuggcccac

SEQ ID NO: 2989447 - RNA, 14 nt, Human
cagcguuucuauga

SEQ ID NO: 2989448 - RNA, 16 nt, Human
cagcguuucuaugaca

SEQ ID NO: 2989449 - RNA, 19 nt, Human
cagccccgugggguuccuc

SEQ ID NO: 2989450 - RNA, 22 nt, Human
cagccccauucugccugcccag

SEQ ID NO: 2989451 - RNA, 20 nt, Human
cagccccauucugccugccc

SEQ ID NO: 2989452 - RNA, 19 nt, Human
cagccccauucugccugcc

SEQ ID NO: 2989453 - RNA, 24 nt, Human
cagccccauucugccugcccaggc

SEQ ID NO: 2989454 - RNA, 23 nt, Human
cagccccauucugccugcccagg

SEQ ID NO: 2989455 - RNA, 20 nt, Human
cagcaguucagagcugcccu

SEQ ID NO: 2989456 - RNA, 19 nt, Human
cagcaguucagagcugccc

SEQ ID NO: 2989457 - RNA, 18 nt, Human
cagcaguucagagcugcc

SEQ ID NO: 2989458 - RNA, 22 nt, Human
cagcaguucagagcugcccucu

SEQ ID NO: 2989459 - RNA, 21 nt, Human
cagcaguucagagcugcccuc

SEQ ID NO: 2989460 - RNA, 17 nt, Human
cagcauagaaguaacuu

SEQ ID NO: 2989461 - RNA, 16 nt, Human
cagcauauucaggaag

SEQ ID NO: 2989462 - RNA, 17 nt, Human
cagcauauucaggaagc

SEQ ID NO: 2989463 - RNA, 18 nt, Human
cagcauauucaggaagcu

SEQ ID NO: 2989464 - RNA, 20 nt, Human
cagccagacuggcacaguuu

SEQ ID NO: 2989465 - RNA, 15 nt, Human
cagauuucacucucc

SEQ ID NO: 2989466 - RNA, 16 nt, Human
cagauuucacucuccu

SEQ ID NO: 2989467 - RNA, 19 nt, Human
cagauuugaacucuucaau

SEQ ID NO: 2989468 - RNA, 18 nt, Human
cagauuucacucuccuug

SEQ ID NO: 2989469 - RNA, 13 nt, Human
cagauuucacucu

SEQ ID NO: 2989470 - RNA, 21 nt, Human
cagauugcaacaggcugggcu

SEQ ID NO: 2989471 - RNA, 17 nt, Human
cagagcuacacagggga

SEQ ID NO: 2989472 - RNA, 22 nt, Human
cagagcuacacaggggaaaaga

SEQ ID NO: 2989473 - RNA, 23 nt, Human
cagagcugcccucuccugggcag

SEQ ID NO: 2989474 - RNA, 20 nt, Human
cagagagggugggagugggc

SEQ ID NO: 2989475 - RNA, 22 nt, Human
cagagagggugggagugggccc

SEQ ID NO: 2989476 - RNA, 14 nt, Human
cagagccugcaguu

SEQ ID NO: 2989477 - RNA, 16 nt, Human
cagagagggugggagu

SEQ ID NO: 2989478 - RNA, 13 nt, Human
cagagaggguggg

SEQ ID NO: 2989479 - RNA, 20 nt, Human
cagagacuccugcaggcagc

SEQ ID NO: 2989480 - RNA, 21 nt, Human
cagagacuccugcaggcagcc

SEQ ID NO: 2989481 - RNA, 22 nt, Human
cagagacuccugcaggcagcca

SEQ ID NO: 2989482 - RNA, 23 nt, Human
cagauacaggaaaagcugcugac

SEQ ID NO: 2989483 - RNA, 14 nt, Human
cauuucaagaaguc

SEQ ID NO: 2989484 - RNA, 16 nt, Human
cauuuauucugcucac

SEQ ID NO: 2989485 - RNA, 17 nt, Human
ccaaaaaaugcuugcuu

SEQ ID NO: 2989486 - RNA, 17 nt, Human
ccaaaacucuccucugc

SEQ ID NO: 2989487 - RNA, 23 nt, Human
cauuuuucuuagggaaggauaca

SEQ ID NO: 2989488 - RNA, 23 nt, Human
cauuuggugguuucagaaaugug

SEQ ID NO: 2989489 - RNA, 22 nt, Human
cauuuggugguuucagaaaugu

SEQ ID NO: 2989490 - RNA, 21 nt, Human
cauuuggugguuucagaaaug

SEQ ID NO: 2989491 - RNA, 21 nt, Human
cauugcggacagccacggcca

SEQ ID NO: 2989492 - RNA, 17 nt, Human
cauugcggacagccacg

SEQ ID NO: 2989493 - RNA, 15 nt, Human
cauugcggacagcca

SEQ ID NO: 2989494 - RNA, 14 nt, Human
cauugcggacagcc

SEQ ID NO: 2989495 - RNA, 18 nt, Human
cauugcugggcuugucug

SEQ ID NO: 2989496 - RNA, 17 nt, Human
cauuaucuagauacugu

SEQ ID NO: 2989497 - RNA, 16 nt, Human
cauuaucuagauacug

SEQ ID NO: 2989498 - RNA, 12 nt, Human
cauuaucuagau

SEQ ID NO: 2989499 - RNA, 15 nt, Human
cauuaggauggcuag

SEQ ID NO: 2989500 - RNA, 15 nt, Human
cauguucucugagga

SEQ ID NO: 2989501 - RNA, 17 nt, Human
cauggcugccaauggga

SEQ ID NO: 2989502 - RNA, 22 nt, Human
cauggcuggagcuagaauuuga

SEQ ID NO: 2989503 - RNA, 22 nt, Human
cauggcugccaaugggagcuca

SEQ ID NO: 2989504 - RNA, 22 nt, Human
cauggccucuucagaucucuaa

SEQ ID NO: 2989505 - RNA, 16 nt, Human
cauucuccuuguguua

SEQ ID NO: 2989506 - RNA, 18 nt, Human
cauuaucuagauacugua

SEQ ID NO: 2989507 - RNA, 18 nt, Human
ccaaauguucaucaauga

SEQ ID NO: 2989508 - RNA, 12 nt, Human
ccaaauuaagag

SEQ ID NO: 2989509 - RNA, 16 nt, Human
ccaaaucauaguggcu

SEQ ID NO: 2989510 - RNA, 16 nt, Human
ccaacgucugugccau

SEQ ID NO: 2989511 - RNA, 14 nt, Human
ccaaagugcuggga

SEQ ID NO: 2989512 - RNA, 20 nt, Human
ccaaugcacuuuguucuggc

SEQ ID NO: 2989513 - RNA, 22 nt, Human
ccaaugcacuuuguucuggcuc

SEQ ID NO: 2989514 - RNA, 23 nt, Human
ccaaugcacuuuguucuggcucu

SEQ ID NO: 2989515 - RNA, 20 nt, Human
ccaagcuggucccacucagu

SEQ ID NO: 2989516 - RNA, 20 nt, Human
ccaauguucucucuucucca

SEQ ID NO: 2989517 - RNA, 14 nt, Human
ccaccgcagacagg

SEQ ID NO: 2989518 - RNA, 17 nt, Human
ccaccgcagacaggacc

SEQ ID NO: 2989519 - RNA, 20 nt, Human
ccaccaucaagccaccaaca

SEQ ID NO: 2989520 - RNA, 13 nt, Human
ccacccugcucuc

SEQ ID NO: 2989521 - RNA, 18 nt, Human
ccaccgcagacaggacca

SEQ ID NO: 2989522 - RNA, 13 nt, Human
ccaccgcagacag

SEQ ID NO: 2989523 - RNA, 15 nt, Human
ccaccuuggcucaag

SEQ ID NO: 2989524 - RNA, 14 nt, Human
ccaccuuggcucaa

SEQ ID NO: 2989525 - RNA, 13 nt, Human
ccaccuuggcuca

SEQ ID NO: 2989526 - RNA, 16 nt, Human
ccaccaucaagccacc

SEQ ID NO: 2989527 - RNA, 17 nt, Human
ccaccaucaagccacca

SEQ ID NO: 2989528 - RNA, 14 nt, Human
caguuugcagagua

SEQ ID NO: 2989529 - RNA, 21 nt, Human
caguuugguugguaacucugu

SEQ ID NO: 2989530 - RNA, 11 nt, Human
caguuugguug

SEQ ID NO: 2989531 - RNA, 17 nt, Human
cauaaugcgugcauacc

SEQ ID NO: 2989532 - RNA, 14 nt, Human
cauaaugcgugcau

SEQ ID NO: 2989533 - RNA, 20 nt, Human
cauagcagcuuauucacaag

SEQ ID NO: 2989534 - RNA, 17 nt, Human
cauagauucccugagca

SEQ ID NO: 2989535 - RNA, 18 nt, Human
cauagauucccugagcag

SEQ ID NO: 2989536 - RNA, 15 nt, Human
cauacaauuccaaac

SEQ ID NO: 2989537 - RNA, 13 nt, Human
cauacaaggccca

SEQ ID NO: 2989538 - RNA, 21 nt, Human
cauaaugcgugcauaccacuu

SEQ ID NO: 2989539 - RNA, 16 nt, Human
cauauuaccacagaca

SEQ ID NO: 2989540 - RNA, 17 nt, Human
cauauuaccacagacau

SEQ ID NO: 2989541 - RNA, 21 nt, Human
cauauuaccacagacauacua

SEQ ID NO: 2989542 - RNA, 20 nt, Human
cauauuaccacagacauacu

SEQ ID NO: 2989543 - RNA, 18 nt, Human
cagucaccccggccaccu

SEQ ID NO: 2989544 - RNA, 15 nt, Human
caugcugccaauauc

SEQ ID NO: 2989545 - RNA, 17 nt, Human
caugcugccaauauccu

SEQ ID NO: 2989546 - RNA, 19 nt, Human
caugcugccaauauccuaa

SEQ ID NO: 2989547 - RNA, 21 nt, Human
caugcugccaauauccuaaua

SEQ ID NO: 2989548 - RNA, 16 nt, Human
caugcugcccugugag

SEQ ID NO: 2989549 - RNA, 18 nt, Human
caugcugcccugugagua

SEQ ID NO: 2989550 - RNA, 22 nt, Human
caugcugccaauauccuaauaa

SEQ ID NO: 2989551 - RNA, 19 nt, Human
cauggccuuugcuugaaag

SEQ ID NO: 2989552 - RNA, 22 nt, Human
cauggccuuugcuugaaagaaa

SEQ ID NO: 2989553 - RNA, 18 nt, Human
caugcaaggucauuuuuu

SEQ ID NO: 2989554 - RNA, 17 nt, Human
caugcaaggucauuuuu

SEQ ID NO: 2989555 - RNA, 22 nt, Human
caugcaaggucauuuuuuuuaa

SEQ ID NO: 2989556 - RNA, 16 nt, Human
caugaauuaguuuuau

SEQ ID NO: 2989557 - RNA, 14 nt, Human
caugacacgaauau

SEQ ID NO: 2989558 - RNA, 17 nt, Human
caugacacgaauauugc

SEQ ID NO: 2989559 - RNA, 18 nt, Human
caugacacgaauauugcu

SEQ ID NO: 2989560 - RNA, 17 nt, Human
caucagcugcugaaaca

SEQ ID NO: 2989561 - RNA, 18 nt, Human
caucagcugcugaaacaa

SEQ ID NO: 2989562 - RNA, 15 nt, Human
caucagcugcugaaa

SEQ ID NO: 2989563 - RNA, 13 nt, Human
caucagcugcuga

SEQ ID NO: 2989564 - RNA, 20 nt, Human
caucagcuugcccuguuaaa

SEQ ID NO: 2989565 - RNA, 13 nt, Human
caucaggccaggc

SEQ ID NO: 2989566 - RNA, 18 nt, Human
caucagcacgauuucugu

SEQ ID NO: 2989567 - RNA, 17 nt, Human
caucagcacgauuucug

SEQ ID NO: 2989568 - RNA, 20 nt, Human
caucaggccaggcccucugc

SEQ ID NO: 2989569 - RNA, 21 nt, Human
caucaggccaggcccucugcc

SEQ ID NO: 2989570 - RNA, 22 nt, Human
caucaggccaggcccucugccc

SEQ ID NO: 2989571 - RNA, 23 nt, Human
caucaggccaggcccucugccca

SEQ ID NO: 2989572 - RNA, 12 nt, Human
caucccagcccc

SEQ ID NO: 2989573 - RNA, 16 nt, Human
caucccagccccaaug

SEQ ID NO: 2989574 - RNA, 14 nt, Human
caucccagccccaa

SEQ ID NO: 2989575 - RNA, 13 nt, Human
caucccagcccca

SEQ ID NO: 2989576 - RNA, 19 nt, Human
cauccuggcccagggcauc

SEQ ID NO: 2989577 - RNA, 18 nt, Human
cauccuggcccagggcau

SEQ ID NO: 2989578 - RNA, 16 nt, Human
cauccuggcccagggc

SEQ ID NO: 2989579 - RNA, 15 nt, Human
cauccuggcccaggg

SEQ ID NO: 2989580 - RNA, 23 nt, Human
cauccuggcacccggccccugcu

SEQ ID NO: 2989581 - RNA, 18 nt, Human
caucugugaaaggaaaga

SEQ ID NO: 2989582 - RNA, 19 nt, Human
caucugugaaaggaaagag

SEQ ID NO: 2989583 - RNA, 21 nt, Human
caucuuagguuggcaaaaagg

SEQ ID NO: 2989584 - RNA, 15 nt, Human
caucuuaaaaacaac

SEQ ID NO: 2989585 - RNA, 22 nt, Human
caucuuagguuggcaaaaaggc

SEQ ID NO: 2989586 - RNA, 14 nt, Human
cacugguuugguuc

SEQ ID NO: 2989587 - RNA, 22 nt, Human
cacugguucuucuuggucucag

SEQ ID NO: 2989588 - RNA, 18 nt, Human
cacuuacacuuuaugcac

SEQ ID NO: 2989589 - RNA, 16 nt, Human
cacuuacacuuuaugc

SEQ ID NO: 2989590 - RNA, 19 nt, Human
cacuuguguuuugcaagcc

SEQ ID NO: 2989591 - RNA, 16 nt, Human
cacuugucaauaaaau

SEQ ID NO: 2989592 - RNA, 22 nt, Human
cacuuguguuuugcaagccaga

SEQ ID NO: 2989593 - RNA, 17 nt, Human
cacuuguguuuugcaag

SEQ ID NO: 2989594 - RNA, 21 nt, Human
cacugcagaagacaguauggc

SEQ ID NO: 2989595 - RNA, 12 nt, Human
cacugcagccuc

SEQ ID NO: 2989596 - RNA, 20 nt, Human
cacugcacuccagccugggu

SEQ ID NO: 2989597 - RNA, 19 nt, Human
cacugcacuccagccuggg

SEQ ID NO: 2989598 - RNA, 18 nt, Human
cacugcacuccagccugg

SEQ ID NO: 2989599 - RNA, 15 nt, Human
cacugcacuccagcc

SEQ ID NO: 2989600 - RNA, 16 nt, Human
cacugcacuccagccu

SEQ ID NO: 2989601 - RNA, 19 nt, Human
cacugcacuauagccuagg

SEQ ID NO: 2989602 - RNA, 16 nt, Human
cacugcauguuuguga

SEQ ID NO: 2989603 - RNA, 13 nt, Human
cacugcagccuca

SEQ ID NO: 2989604 - RNA, 20 nt, Human
cacuagggcagggacaggau

SEQ ID NO: 2989605 - RNA, 21 nt, Human
cacuagggcagggacaggaua

SEQ ID NO: 2989606 - RNA, 16 nt, Human
cacuccagccugggug

SEQ ID NO: 2989607 - RNA, 23 nt, Human
cacuccaauaggugcugagugua

SEQ ID NO: 2989608 - RNA, 14 nt, Human
cacuccccugcugg

SEQ ID NO: 2989609 - RNA, 12 nt, Human
cacuccccugcu

SEQ ID NO: 2989610 - RNA, 13 nt, Human
cacuccccugcug

SEQ ID NO: 2989611 - RNA, 11 nt, Human
caccccagccc

SEQ ID NO: 2989612 - RNA, 16 nt, Human
caccccagcaauuaug

SEQ ID NO: 2989613 - RNA, 14 nt, Human
cacccucaggcagg

SEQ ID NO: 2989614 - RNA, 16 nt, Human
cacccuggggagaaag

SEQ ID NO: 2989615 - RNA, 15 nt, Human
cacccuggggagaaa

SEQ ID NO: 2989616 - RNA, 17 nt, Human
cacccugaaagcccuga

SEQ ID NO: 2989617 - RNA, 15 nt, Human
caccugccccucaac

SEQ ID NO: 2989618 - RNA, 16 nt, Human
caccugccccucaacu

SEQ ID NO: 2989619 - RNA, 14 nt, Human
caccugccccucaa

SEQ ID NO: 2989620 - RNA, 13 nt, Human
caccucagccucc

SEQ ID NO: 2989621 - RNA, 12 nt, Human
caccucagccuc

SEQ ID NO: 2989622 - RNA, 14 nt, Human
caccucagccuccc

SEQ ID NO: 2989623 - RNA, 13 nt, Human
caccuuggcugca

SEQ ID NO: 2989624 - RNA, 15 nt, Human
caccuuggcucaagu

SEQ ID NO: 2989625 - RNA, 14 nt, Human
caccuuggcucaag

SEQ ID NO: 2989626 - RNA, 14 nt, Human
caccuuggcugcag

SEQ ID NO: 2989627 - RNA, 19 nt, Human
caccugccuguugggccag

SEQ ID NO: 2989628 - RNA, 24 nt, Human
caccugccuguugggccaggagcc

SEQ ID NO: 2989629 - RNA, 17 nt, Human
caccugccuguugggcc

SEQ ID NO: 2989630 - RNA, 17 nt, Human
cacagccucuuagaugc

SEQ ID NO: 2989631 - RNA, 21 nt, Human
cacagccucuuagaugcaguu

SEQ ID NO: 2989632 - RNA, 17 nt, Human
cacaggggaaaagagga

SEQ ID NO: 2989633 - RNA, 18 nt, Human
cacaggggaaaagaggag

SEQ ID NO: 2989634 - RNA, 19 nt, Human
cacaggggaaaagaggagu

SEQ ID NO: 2989635 - RNA, 21 nt, Human
cacaguauuacuucugcuaca

SEQ ID NO: 2989636 - RNA, 20 nt, Human
cacaguauuacuucugcuac

SEQ ID NO: 2989637 - RNA, 20 nt, Human
cacacaugagcaucaggcca

SEQ ID NO: 2989638 - RNA, 22 nt, Human
cacacaugaaguccaagcauuu

SEQ ID NO: 2989639 - RNA, 17 nt, Human
cacacaugaaguccaag

SEQ ID NO: 2989640 - RNA, 23 nt, Human
cacacagugagucgaggacaggg

SEQ ID NO: 2989641 - RNA, 21 nt, Human
cacacagugagucgaggacag

SEQ ID NO: 2989642 - RNA, 15 nt, Human
cacacauacacacac

SEQ ID NO: 2989643 - RNA, 16 nt, Human
cacacagcucuguccu

SEQ ID NO: 2989644 - RNA, 23 nt, Human
cacacaguauuacuucugcuaca

SEQ ID NO: 2989645 - RNA, 20 nt, Human
cacacaguauuacuucugcu

SEQ ID NO: 2989646 - RNA, 18 nt, Human
cacacagugagucgagga

SEQ ID NO: 2989647 - RNA, 18 nt, Human
cacagaaaauggaagaca

SEQ ID NO: 2989648 - RNA, 19 nt, Human
cacagaaaauggaagacag

SEQ ID NO: 2989649 - RNA, 20 nt, Human
cacagaaaauggaagacagc

SEQ ID NO: 2989650 - RNA, 22 nt, Human
cacagaaaauggaagacagcuc

SEQ ID NO: 2989651 - RNA, 21 nt, Human
cacacaugagcaucaggccag

SEQ ID NO: 2989652 - RNA, 22 nt, Human
cacacaugagcaucaggccagg

SEQ ID NO: 2989653 - RNA, 23 nt, Human
cacagaaaauggaagacagcucu

SEQ ID NO: 2989654 - RNA, 19 nt, Human
cacagaaaauucuucucca

SEQ ID NO: 2989655 - RNA, 18 nt, Human
cacagacauacuaaccag

SEQ ID NO: 2989656 - RNA, 21 nt, Human
cacagacauacuaaccagcag

SEQ ID NO: 2989657 - RNA, 19 nt, Human
cacagacauacuaaccagc

SEQ ID NO: 2989658 - RNA, 13 nt, Human
cacagacccugcc

SEQ ID NO: 2989659 - RNA, 11 nt, Human
cacagccucug

SEQ ID NO: 2989660 - RNA, 17 nt, Human
cacaagcugcacccuca

SEQ ID NO: 2989661 - RNA, 23 nt, Human
cacaagcugcacccucaggcagg

SEQ ID NO: 2989662 - RNA, 17 nt, Human
cacaagcuccaagcucc

SEQ ID NO: 2989663 - RNA, 23 nt, Human
cacaagcuccaagcucccaggca

SEQ ID NO: 2989664 - RNA, 16 nt, Human
cacaagagcccaggcc

SEQ ID NO: 2989665 - RNA, 13 nt, Human
cacaagcuccaag

SEQ ID NO: 2989666 - RNA, 14 nt, Human
cacaagcuccaagc

SEQ ID NO: 2989667 - RNA, 15 nt, Human
cacaagcuccaagcu

SEQ ID NO: 2989668 - RNA, 18 nt, Human
cacaagacugcacaucaa

SEQ ID NO: 2989669 - RNA, 14 nt, Human
cacaagagcccagg

SEQ ID NO: 2989670 - RNA, 15 nt, Human
caaugcuguauuuua

SEQ ID NO: 2989671 - RNA, 17 nt, Human
caaugcuguauuuuaaa

SEQ ID NO: 2989672 - RNA, 16 nt, Human
caaugcuguauuuuaa

SEQ ID NO: 2989673 - RNA, 15 nt, Human
caauucuugccaaau

SEQ ID NO: 2989674 - RNA, 12 nt, Human
caauggcagccu

SEQ ID NO: 2989675 - RNA, 11 nt, Human
caauggcagcc

SEQ ID NO: 2989676 - RNA, 20 nt, Human
cacacagcucuguccuggga

SEQ ID NO: 2989677 - RNA, 17 nt, Human
cacacagcucuguccug

SEQ ID NO: 2989678 - RNA, 14 nt, Human
caaguccaagcaua

SEQ ID NO: 2989679 - RNA, 13 nt, Human
caagucaagugaa

SEQ ID NO: 2989680 - RNA, 17 nt, Human
caagucaagugaaaaag

SEQ ID NO: 2989681 - RNA, 19 nt, Human
caaguauagaaaaucuuca

SEQ ID NO: 2989682 - RNA, 15 nt, Human
caaguauagaaaauc

SEQ ID NO: 2989683 - RNA, 15 nt, Human
caaggccaaaggaag

SEQ ID NO: 2989684 - RNA, 16 nt, Human
caaggccaaaggaagc

SEQ ID NO: 2989685 - RNA, 17 nt, Human
caaggccaaaggaagca

SEQ ID NO: 2989686 - RNA, 18 nt, Human
caaggccaaaggaagcac

SEQ ID NO: 2989687 - RNA, 13 nt, Human
caaguauagaaaa

SEQ ID NO: 2989688 - RNA, 14 nt, Human
caaguauagaaaau

SEQ ID NO: 2989689 - RNA, 20 nt, Human
caagcugcacccucaggcag

SEQ ID NO: 2989690 - RNA, 14 nt, Human
caagcugcacccuc

SEQ ID NO: 2989691 - RNA, 18 nt, Human
caagcugcacccucaggc

SEQ ID NO: 2989692 - RNA, 13 nt, Human
caagcugcacccu

SEQ ID NO: 2989693 - RNA, 14 nt, Human
caagcucugcuccu

SEQ ID NO: 2989694 - RNA, 12 nt, Human
caagcuccaagc

SEQ ID NO: 2989695 - RNA, 13 nt, Human
caagcucugcucc

SEQ ID NO: 2989696 - RNA, 19 nt, Human
caauaaagcagcguuucua

SEQ ID NO: 2989697 - RNA, 17 nt, Human
auugcugcuuguacacu

SEQ ID NO: 2989698 - RNA, 12 nt, Human
auugcugcuuga

SEQ ID NO: 2989699 - RNA, 23 nt, Human
auugcugauggugcaaugaccuu

SEQ ID NO: 2989700 - RNA, 14 nt, Human
auugcuugagcuca

SEQ ID NO: 2989701 - RNA, 15 nt, Human
auugcugauggugca

SEQ ID NO: 2989702 - RNA, 16 nt, Human
auugcugauggugcaa

SEQ ID NO: 2989703 - RNA, 18 nt, Human
auugcugauggugcaaug

SEQ ID NO: 2989704 - RNA, 19 nt, Human
auugcugauggugcaauga

SEQ ID NO: 2989705 - RNA, 23 nt, Human
auuguaauaggcguaacuaauuu

SEQ ID NO: 2989706 - RNA, 14 nt, Human
auuguaaaauggug

SEQ ID NO: 2989707 - RNA, 13 nt, Human
auuguaaaauggu

SEQ ID NO: 2989708 - RNA, 21 nt, Human
auugugucucuugguccugcu

SEQ ID NO: 2989709 - RNA, 23 nt, Human
auugugucucuugguccugcugc

SEQ ID NO: 2989710 - RNA, 16 nt, Human
auuguuagucucuuga

SEQ ID NO: 2989711 - RNA, 21 nt, Human
auugauaagaaccuuuugagu

SEQ ID NO: 2989712 - RNA, 22 nt, Human
auugcuacuguccuacccaccc

SEQ ID NO: 2989713 - RNA, 20 nt, Human
auugcuacuguccuacccac

SEQ ID NO: 2989714 - RNA, 17 nt, Human
auugauaugcuuauaca

SEQ ID NO: 2989715 - RNA, 15 nt, Human
auugcuacuguccua

SEQ ID NO: 2989716 - RNA, 14 nt, Human
auugcuacuguccu

SEQ ID NO: 2989717 - RNA, 11 nt, Human
auucuuuccug

SEQ ID NO: 2989718 - RNA, 12 nt, Human
auucuucugcuu

SEQ ID NO: 2989719 - RNA, 11 nt, Human
auucuucugcu

SEQ ID NO: 2989720 - RNA, 20 nt, Human
auuaaugucaguauuucaac

SEQ ID NO: 2989721 - RNA, 17 nt, Human
auuacaacucuauuuaa

SEQ ID NO: 2989722 - RNA, 19 nt, Human
auuacaguggggaaugaag

SEQ ID NO: 2989723 - RNA, 16 nt, Human
auuacaggugugaacc

SEQ ID NO: 2989724 - RNA, 17 nt, Human
auuacaggaaguacugg

SEQ ID NO: 2989725 - RNA, 13 nt, Human
auuagguugugaa

SEQ ID NO: 2989726 - RNA, 23 nt, Human
auuagguugaaacauaucucuua

SEQ ID NO: 2989727 - RNA, 19 nt, Human
auuagguugaaacauaucu

SEQ ID NO: 2989728 - RNA, 17 nt, Human
auuagguugaaacauau

SEQ ID NO: 2989729 - RNA, 16 nt, Human
auuagguugaaacaua

SEQ ID NO: 2989730 - RNA, 21 nt, Human
auuaggugugacugaauuucu

SEQ ID NO: 2989731 - RNA, 15 nt, Human
auuagguugugaaug

SEQ ID NO: 2989732 - RNA, 14 nt, Human
auuagguugugaau

SEQ ID NO: 2989733 - RNA, 13 nt, Human
auuaugaaaauaa

SEQ ID NO: 2989734 - RNA, 18 nt, Human
auuaugaaacuuuuggaa

SEQ ID NO: 2989735 - RNA, 17 nt, Human
auuaugaauuacauuug

SEQ ID NO: 2989736 - RNA, 14 nt, Human
auuaugaauuacau

SEQ ID NO: 2989737 - RNA, 18 nt, Human
auuaggugugacugaauu

SEQ ID NO: 2989738 - RNA, 16 nt, Human
auuaggugugacugaa

SEQ ID NO: 2989739 - RNA, 16 nt, Human
auuagggagagaagau

SEQ ID NO: 2989740 - RNA, 19 nt, Human
auucacaagacccaaaagg

SEQ ID NO: 2989741 - RNA, 16 nt, Human
auucaaauguauuaca

SEQ ID NO: 2989742 - RNA, 20 nt, Human
auucaaugccccugaauuua

SEQ ID NO: 2989743 - RNA, 18 nt, Human
auucaaugccccugaauu

SEQ ID NO: 2989744 - RNA, 23 nt, Human
auuaugcaugaaguaauaugcac

SEQ ID NO: 2989745 - RNA, 18 nt, Human
auuaugaauuacauuugu

SEQ ID NO: 2989746 - RNA, 14 nt, Human
auucauaaugacuu

SEQ ID NO: 2989747 - RNA, 15 nt, Human
auucauaaugacuua

SEQ ID NO: 2989748 - RNA, 19 nt, Human
auucauaaugacuuaagca

SEQ ID NO: 2989749 - RNA, 22 nt, Human
auucauagcagcuuauucacaa

SEQ ID NO: 2989750 - RNA, 19 nt, Human
auucauagcagcuuauuca

SEQ ID NO: 2989751 - RNA, 15 nt, Human
auuuggaaaggaaug

SEQ ID NO: 2989752 - RNA, 17 nt, Human
auuugcucauggaauug

SEQ ID NO: 2989753 - RNA, 14 nt, Human
auuugcucauggaa

SEQ ID NO: 2989754 - RNA, 13 nt, Human
auuugcuccuuuc

SEQ ID NO: 2989755 - RNA, 18 nt, Human
auuuggaaaggaaugcaa

SEQ ID NO: 2989756 - RNA, 17 nt, Human
auuugugauacaaugcu

SEQ ID NO: 2989757 - RNA, 15 nt, Human
auuugugauacaaug

SEQ ID NO: 2989758 - RNA, 18 nt, Human
auuuguggaaaauaacuc

SEQ ID NO: 2989759 - RNA, 20 nt, Human
auuugugauacaaugcugug

SEQ ID NO: 2989760 - RNA, 19 nt, Human
auuuuauagcuacuaauuu

SEQ ID NO: 2989761 - RNA, 20 nt, Human
auuuguuugaacugauaaag

SEQ ID NO: 2989762 - RNA, 17 nt, Human
auuuuauagcuacuaau

SEQ ID NO: 2989763 - RNA, 23 nt, Human
auuuguuugaacugauaaagaug

SEQ ID NO: 2989764 - RNA, 22 nt, Human
auuuguuugaacugauaaagau

SEQ ID NO: 2989765 - RNA, 21 nt, Human
auuugccuaauaugaugacug

SEQ ID NO: 2989766 - RNA, 13 nt, Human
caaacccaguguu

SEQ ID NO: 2989767 - RNA, 19 nt, Human
caaacagggccucugcgga

SEQ ID NO: 2989768 - RNA, 15 nt, Human
caaacagggccucug

SEQ ID NO: 2989769 - RNA, 21 nt, Human
caaaccaucauugaaaucuuu

SEQ ID NO: 2989770 - RNA, 19 nt, Human
caaaccaucauugaaaucu

SEQ ID NO: 2989771 - RNA, 15 nt, Human
caaacagaggccgcc

SEQ ID NO: 2989772 - RNA, 14 nt, Human
caaacagggccucu

SEQ ID NO: 2989773 - RNA, 12 nt, Human
caaacagggccu

SEQ ID NO: 2989774 - RNA, 20 nt, Human
caaaaaaaaaaaaaaauuag

SEQ ID NO: 2989775 - RNA, 16 nt, Human
caaaagaugcuucuca

SEQ ID NO: 2989776 - RNA, 15 nt, Human
caaaaggcagaagca

SEQ ID NO: 2989777 - RNA, 18 nt, Human
caaaagaugcuucucacu

SEQ ID NO: 2989778 - RNA, 23 nt, Human
auuuuuuuuuccuucagugccuu

SEQ ID NO: 2989779 - RNA, 20 nt, Human
caaagauauuuugcuuugug

SEQ ID NO: 2989780 - RNA, 18 nt, Human
caaagauauuuugcuuug

SEQ ID NO: 2989781 - RNA, 20 nt, Human
caaagcacugacuucuaagu

SEQ ID NO: 2989782 - RNA, 22 nt, Human
caaagcacugacuucuaaguaa

SEQ ID NO: 2989783 - RNA, 23 nt, Human
caaagauauuuugcuuugugauu

SEQ ID NO: 2989784 - RNA, 22 nt, Human
caaagauauuuugcuuugugau

SEQ ID NO: 2989785 - RNA, 22 nt, Human
caaaguacacuguuucaaacuu

SEQ ID NO: 2989786 - RNA, 15 nt, Human
caaagcagugcaugc

SEQ ID NO: 2989787 - RNA, 17 nt, Human
caaagcagugcaugcug

SEQ ID NO: 2989788 - RNA, 21 nt, Human
caaaguagaagucuuagaugu

SEQ ID NO: 2989789 - RNA, 14 nt, Human
caaaguagaagucu

SEQ ID NO: 2989790 - RNA, 15 nt, Human
caaagucuagguugg

SEQ ID NO: 2989791 - RNA, 20 nt, Human
caacaccucugcacaagcug

SEQ ID NO: 2989792 - RNA, 15 nt, Human
caacacgagcaggcu

SEQ ID NO: 2989793 - RNA, 23 nt, Human
caacacgagcaggcuacugucag

SEQ ID NO: 2989794 - RNA, 21 nt, Human
caaauggaaaugggcagagca

SEQ ID NO: 2989795 - RNA, 20 nt, Human
caaauggaaaugggcagagc

SEQ ID NO: 2989796 - RNA, 24 nt, Human
ccguagacgugcacgcacacuguc

SEQ ID NO: 2989797 - RNA, 15 nt, Human
ccgucuccagcugcu

SEQ ID NO: 2989798 - RNA, 16 nt, Human
ccguagguuauuuuca

SEQ ID NO: 2989799 - RNA, 20 nt, Human
ccuaaguaucaaguauagaa

SEQ ID NO: 2989800 - RNA, 18 nt, Human
ccuaggacccgucuccag

SEQ ID NO: 2989801 - RNA, 22 nt, Human
ccuaggacccgucuccagcugc

SEQ ID NO: 2989802 - RNA, 21 nt, Human
ccuaggacccgucuccagcug

SEQ ID NO: 2989803 - RNA, 20 nt, Human
ccuaggacccgucuccagcu

SEQ ID NO: 2989804 - RNA, 19 nt, Human
ccuaggacccgucuccagc

SEQ ID NO: 2989805 - RNA, 15 nt, Human
ccucauguccacugg

SEQ ID NO: 2989806 - RNA, 22 nt, Human
ccucagccucccgaauagcugg

SEQ ID NO: 2989807 - RNA, 23 nt, Human
ccucagccucccaaagugcuggg

SEQ ID NO: 2989808 - RNA, 13 nt, Human
ccucauguucuua

SEQ ID NO: 2989809 - RNA, 20 nt, Human
ccucauguccacugguucuu

SEQ ID NO: 2989810 - RNA, 22 nt, Human
ccucccaaggggcccaaauucu

SEQ ID NO: 2989811 - RNA, 23 nt, Human
ccucccaacucaccccagcccca

SEQ ID NO: 2989812 - RNA, 19 nt, Human
ccucauguucuuaauucuu

SEQ ID NO: 2989813 - RNA, 20 nt, Human
ccuccaagaccuucuccuuc

SEQ ID NO: 2989814 - RNA, 15 nt, Human
ccucaacucuccucc

SEQ ID NO: 2989815 - RNA, 15 nt, Human
ccucaagagaaggca

SEQ ID NO: 2989816 - RNA, 22 nt, Human
ccucagccucccaaagugcugg

SEQ ID NO: 2989817 - RNA, 11 nt, Human
ccucagccucc

SEQ ID NO: 2989818 - RNA, 16 nt, Human
ccucaaccuccugggc

SEQ ID NO: 2989819 - RNA, 13 nt, Human
cccuucucuguau

SEQ ID NO: 2989820 - RNA, 21 nt, Human
cccuucugacccaugcugccc

SEQ ID NO: 2989821 - RNA, 22 nt, Human
cccuucugacccaugcugcccu

SEQ ID NO: 2989822 - RNA, 23 nt, Human
cccuucugacccaugcugcccug

SEQ ID NO: 2989823 - RNA, 16 nt, Human
cccuucuaccuuccug

SEQ ID NO: 2989824 - RNA, 18 nt, Human
cccuucgcuccugugucu

SEQ ID NO: 2989825 - RNA, 16 nt, Human
cccuucgcuccugugu

SEQ ID NO: 2989826 - RNA, 17 nt, Human
ccgccaaggcuggggga

SEQ ID NO: 2989827 - RNA, 16 nt, Human
ccgacccuugccgucu

SEQ ID NO: 2989828 - RNA, 20 nt, Human
ccgaauagcugggacuacag

SEQ ID NO: 2989829 - RNA, 18 nt, Human
ccgaccagacaccuugac

SEQ ID NO: 2989830 - RNA, 20 nt, Human
ccgcccaggcuuagucacug

SEQ ID NO: 2989831 - RNA, 16 nt, Human
ccgccaugcuccuggc

SEQ ID NO: 2989832 - RNA, 14 nt, Human
cccuggcagccccu

SEQ ID NO: 2989833 - RNA, 16 nt, Human
cccuggcagccccugu

SEQ ID NO: 2989834 - RNA, 21 nt, Human
cccugcccugugggcccccaa

SEQ ID NO: 2989835 - RNA, 12 nt, Human
cccuggcagccc

SEQ ID NO: 2989836 - RNA, 13 nt, Human
cccuggcagcccc

SEQ ID NO: 2989837 - RNA, 16 nt, Human
cccugcccugugggcc

SEQ ID NO: 2989838 - RNA, 20 nt, Human
cccugcccugugggccccca

SEQ ID NO: 2989839 - RNA, 15 nt, Human
cccugcccugugggc

SEQ ID NO: 2989840 - RNA, 14 nt, Human
cccugcccuguggg

SEQ ID NO: 2989841 - RNA, 11 nt, Human
cccugcccugu

SEQ ID NO: 2989842 - RNA, 12 nt, Human
cccugcccugug

SEQ ID NO: 2989843 - RNA, 13 nt, Human
cccugcccugugg

SEQ ID NO: 2989844 - RNA, 13 nt, Human
ccucugcuugcca

SEQ ID NO: 2989845 - RNA, 12 nt, Human
ccucucucacuc

SEQ ID NO: 2989846 - RNA, 13 nt, Human
ccucucucacucc

SEQ ID NO: 2989847 - RNA, 14 nt, Human
ccucucucacuccu

SEQ ID NO: 2989848 - RNA, 15 nt, Human
ccucucucacuccuu

SEQ ID NO: 2989849 - RNA, 17 nt, Human
ccucucucacuccuuga

SEQ ID NO: 2989850 - RNA, 12 nt, Human
ccucucucaggc

SEQ ID NO: 2989851 - RNA, 14 nt, Human
ccucucucaggcca

SEQ ID NO: 2989852 - RNA, 15 nt, Human
ccucugcugcuggcu

SEQ ID NO: 2989853 - RNA, 16 nt, Human
ccucugcugcuggcug

SEQ ID NO: 2989854 - RNA, 17 nt, Human
ccucugcugcuggcugg

SEQ ID NO: 2989855 - RNA, 18 nt, Human
ccucugcugcuggcuggu

SEQ ID NO: 2989856 - RNA, 13 nt, Human
ccucugcugcugg

SEQ ID NO: 2989857 - RNA, 14 nt, Human
ccucugcugcuggc

SEQ ID NO: 2989858 - RNA, 22 nt, Human
ccucugccugaagucacacagu

SEQ ID NO: 2989859 - RNA, 21 nt, Human
ccucugccugaagucacacag

SEQ ID NO: 2989860 - RNA, 19 nt, Human
ccucuugagccuugaacuu

SEQ ID NO: 2989861 - RNA, 13 nt, Human
ccucuugagccuu

SEQ ID NO: 2989862 - RNA, 13 nt, Human
ccucuuggguuca

SEQ ID NO: 2989863 - RNA, 22 nt, Human
ccugcacuugcagacucuacag

SEQ ID NO: 2989864 - RNA, 19 nt, Human
ccugcacuugcagacucua

SEQ ID NO: 2989865 - RNA, 12 nt, Human
ccugagagcugc

SEQ ID NO: 2989866 - RNA, 18 nt, Human
ccugagagcugcaugugu

SEQ ID NO: 2989867 - RNA, 14 nt, Human
ccuggccucugcac

SEQ ID NO: 2989868 - RNA, 15 nt, Human
ccuggccucugcacu

SEQ ID NO: 2989869 - RNA, 13 nt, Human
ccuggccugagcu

SEQ ID NO: 2989870 - RNA, 12 nt, Human
ccuggccucugc

SEQ ID NO: 2989871 - RNA, 16 nt, Human
ccugcccaggccccug

SEQ ID NO: 2989872 - RNA, 22 nt, Human
ccugcccaggccccugccaccc

SEQ ID NO: 2989873 - RNA, 15 nt, Human
ccugcccaggccccu

SEQ ID NO: 2989874 - RNA, 14 nt, Human
ccugcccaggcccc

SEQ ID NO: 2989875 - RNA, 12 nt, Human
ccugcugggugu

SEQ ID NO: 2989876 - RNA, 14 nt, Human
ccugcugggugugg

SEQ ID NO: 2989877 - RNA, 20 nt, Human
ccugcuggguguggcgcagc

SEQ ID NO: 2989878 - RNA, 14 nt, Human
ccuggaugcagccu

SEQ ID NO: 2989879 - RNA, 17 nt, Human
ccuggaugcagccucac

SEQ ID NO: 2989880 - RNA, 19 nt, Human
ccuggaugcagccucacag

SEQ ID NO: 2989881 - RNA, 13 nt, Human
ccuggaugcagcc

SEQ ID NO: 2989882 - RNA, 16 nt, Human
ccuggaguucugguuc

SEQ ID NO: 2989883 - RNA, 17 nt, Human
ccuggaguucugguucc

SEQ ID NO: 2989884 - RNA, 15 nt, Human
ccuggaguucugguu

SEQ ID NO: 2989885 - RNA, 23 nt, Human
cccagcucugguccauagagagc

SEQ ID NO: 2989886 - RNA, 20 nt, Human
cccagccagcaguucagagc

SEQ ID NO: 2989887 - RNA, 17 nt, Human
cccagccagcaguucag

SEQ ID NO: 2989888 - RNA, 16 nt, Human
cccagccagcaguuca

SEQ ID NO: 2989889 - RNA, 22 nt, Human
cccagcuuaaaggggcuagagu

SEQ ID NO: 2989890 - RNA, 13 nt, Human
cccauccucugua

SEQ ID NO: 2989891 - RNA, 17 nt, Human
cccaggcuggcgugcag

SEQ ID NO: 2989892 - RNA, 13 nt, Human
cccaggcuggcgu

SEQ ID NO: 2989893 - RNA, 13 nt, Human
cccacugcucugg

SEQ ID NO: 2989894 - RNA, 12 nt, Human
cccacugcucug

SEQ ID NO: 2989895 - RNA, 19 nt, Human
cccacugcuuuuggucugu

SEQ ID NO: 2989896 - RNA, 20 nt, Human
cccacccaagggccuggccu

SEQ ID NO: 2989897 - RNA, 21 nt, Human
cccacccaagggccuggccug

SEQ ID NO: 2989898 - RNA, 22 nt, Human
cccacccaagggccuggccuga

SEQ ID NO: 2989899 - RNA, 18 nt, Human
cccacccugaaagcccug

SEQ ID NO: 2989900 - RNA, 18 nt, Human
cccacccaagggccuggc

SEQ ID NO: 2989901 - RNA, 12 nt, Human
cccacccccacc

SEQ ID NO: 2989902 - RNA, 15 nt, Human
cccacccccacccaa

SEQ ID NO: 2989903 - RNA, 17 nt, Human
cccacccccacccaagg

SEQ ID NO: 2989904 - RNA, 22 nt, Human
ccccaaaacucuccucugcugc

SEQ ID NO: 2989905 - RNA, 23 nt, Human
cccauuguggucacaggaaguag

SEQ ID NO: 2989906 - RNA, 22 nt, Human
cccauuguggucacaggaagua

SEQ ID NO: 2989907 - RNA, 21 nt, Human
ccccaaaacucuccucugcug

SEQ ID NO: 2989908 - RNA, 23 nt, Human
ccccaaaacucuccucugcugcu

SEQ ID NO: 2989909 - RNA, 22 nt, Human
ccccagcaagugagagcugggu

SEQ ID NO: 2989910 - RNA, 22 nt, Human
ccccagcaauuaugaaaauaau

SEQ ID NO: 2989911 - RNA, 21 nt, Human
ccccagcaagugagagcuggg

SEQ ID NO: 2989912 - RNA, 22 nt, Human
cccccaaauggaaaugggcaga

SEQ ID NO: 2989913 - RNA, 23 nt, Human
ccccgacccuugccgucuaccug

SEQ ID NO: 2989914 - RNA, 14 nt, Human
ccccaucugcgggg

SEQ ID NO: 2989915 - RNA, 23 nt, Human
cccgggaggcagagguugcagug

SEQ ID NO: 2989916 - RNA, 18 nt, Human
cccuauuagagaagagau

SEQ ID NO: 2989917 - RNA, 22 nt, Human
cccgggaagggggcugggacau

SEQ ID NO: 2989918 - RNA, 17 nt, Human
cccggccaccugcggug

SEQ ID NO: 2989919 - RNA, 16 nt, Human
cccggcuccaggcucc

SEQ ID NO: 2989920 - RNA, 15 nt, Human
cccggcuccaggcuc

SEQ ID NO: 2989921 - RNA, 14 nt, Human
cccggcuccaggcu

SEQ ID NO: 2989922 - RNA, 13 nt, Human
cccggcuccaggc

SEQ ID NO: 2989923 - RNA, 13 nt, Human
cccggccaccugc

SEQ ID NO: 2989924 - RNA, 14 nt, Human
cccggccaccugcg

SEQ ID NO: 2989925 - RNA, 12 nt, Human
cccggcuccagg

SEQ ID NO: 2989926 - RNA, 11 nt, Human
cccggcuccag

SEQ ID NO: 2989927 - RNA, 14 nt, Human
cccgaauagcuggg

SEQ ID NO: 2989928 - RNA, 15 nt, Human
ccagauccuggaaau

SEQ ID NO: 2989929 - RNA, 18 nt, Human
ccagagggccugcaaggg

SEQ ID NO: 2989930 - RNA, 19 nt, Human
ccagagggccugcaaggga

SEQ ID NO: 2989931 - RNA, 17 nt, Human
ccagagggccugcaagg

SEQ ID NO: 2989932 - RNA, 16 nt, Human
ccaccuuggcucaagu

SEQ ID NO: 2989933 - RNA, 20 nt, Human
ccagagggccugcaagggag

SEQ ID NO: 2989934 - RNA, 15 nt, Human
ccagaugcaccagcc

SEQ ID NO: 2989935 - RNA, 17 nt, Human
ccagaugcaccagcccu

SEQ ID NO: 2989936 - RNA, 18 nt, Human
ccagaugcaccagcccuu

SEQ ID NO: 2989937 - RNA, 13 nt, Human
ccagcaggcucuc

SEQ ID NO: 2989938 - RNA, 15 nt, Human
ccagcaggcucucag

SEQ ID NO: 2989939 - RNA, 11 nt, Human
ccagccccugg

SEQ ID NO: 2989940 - RNA, 12 nt, Human
ccagccccugga

SEQ ID NO: 2989941 - RNA, 16 nt, Human
ccagcucaccagcccc

SEQ ID NO: 2989942 - RNA, 15 nt, Human
ccagcucaccagccc

SEQ ID NO: 2989943 - RNA, 16 nt, Human
ccagcuguucagcugg

SEQ ID NO: 2989944 - RNA, 22 nt, Human
ccagcucaccagccccagugcc

SEQ ID NO: 2989945 - RNA, 17 nt, Human
ccagcuguucagcuggu

SEQ ID NO: 2989946 - RNA, 19 nt, Human
ccagcuuaaaggggcuaga

SEQ ID NO: 2989947 - RNA, 13 nt, Human
ccaggaagccagc

SEQ ID NO: 2989948 - RNA, 12 nt, Human
ccaggaagccag

SEQ ID NO: 2989949 - RNA, 14 nt, Human
ccaggaaaggcucc

SEQ ID NO: 2989950 - RNA, 15 nt, Human
ccaggaaaggcucca

SEQ ID NO: 2989951 - RNA, 16 nt, Human
ccaggaaaggcuccag

SEQ ID NO: 2989952 - RNA, 14 nt, Human
ccaucccagcccca

SEQ ID NO: 2989953 - RNA, 13 nt, Human
ccaucccagcccc

SEQ ID NO: 2989954 - RNA, 15 nt, Human
ccaucccagccccaa

SEQ ID NO: 2989955 - RNA, 23 nt, Human
ccaguuggucccccuuccaugga

SEQ ID NO: 2989956 - RNA, 14 nt, Human
ccaucccugaaggc

SEQ ID NO: 2989957 - RNA, 15 nt, Human
ccaucccugaaggcc

SEQ ID NO: 2989958 - RNA, 17 nt, Human
ccaucccugaaggcccc

SEQ ID NO: 2989959 - RNA, 20 nt, Human
ccaucccugaaggccccgcc

SEQ ID NO: 2989960 - RNA, 23 nt, Human
ccaugagccucagcauccuggca

SEQ ID NO: 2989961 - RNA, 21 nt, Human
ccaugagccucagcauccugg

SEQ ID NO: 2989962 - RNA, 20 nt, Human
ccauggucggaaaacaugcu

SEQ ID NO: 2989963 - RNA, 15 nt, Human
ccaugucagacacag

SEQ ID NO: 2989964 - RNA, 13 nt, Human
ccaugucagacac

SEQ ID NO: 2989965 - RNA, 21 nt, Human
ccaugucagacacagauuggc

SEQ ID NO: 2989966 - RNA, 20 nt, Human
ccaguuggguggaugccugg

SEQ ID NO: 2989967 - RNA, 19 nt, Human
ccaguuggguggaugccug

SEQ ID NO: 2989968 - RNA, 17 nt, Human
ccaguuggguggaugcc

SEQ ID NO: 2989969 - RNA, 23 nt, Human
ccaggggugggacacccugugau

SEQ ID NO: 2989970 - RNA, 14 nt, Human
ccaggggugggaca

SEQ ID NO: 2989971 - RNA, 17 nt, Human
ccaggggugggacaccc

SEQ ID NO: 2989972 - RNA, 20 nt, Human
ccaggggaaaaucagccugc

SEQ ID NO: 2989973 - RNA, 13 nt, Human
ccaggggugggac

SEQ ID NO: 2989974 - RNA, 19 nt, Human
ccaggggaaaaucagccug

SEQ ID NO: 2989975 - RNA, 21 nt, Human
ccaggcuccuuuagcgcccag

SEQ ID NO: 2989976 - RNA, 20 nt, Human
ccaggcuccuuuagcgccca

SEQ ID NO: 2989977 - RNA, 16 nt, Human
ccaggcuggcgugcag

SEQ ID NO: 2989978 - RNA, 18 nt, Human
ccaggcuggcgugcagug

SEQ ID NO: 2989979 - RNA, 17 nt, Human
ccaggcuggcgugcagu

SEQ ID NO: 2989980 - RNA, 19 nt, Human
ccaggcuggcgugcagugg

SEQ ID NO: 2989981 - RNA, 16 nt, Human
cuagcaugaagacaga

SEQ ID NO: 2989982 - RNA, 17 nt, Human
cuagcauggcugccaau

SEQ ID NO: 2989983 - RNA, 23 nt, Human
cuagcagcagggagggcuucugc

SEQ ID NO: 2989984 - RNA, 19 nt, Human
cuagaacucccuuucaaca

SEQ ID NO: 2989985 - RNA, 18 nt, Human
cuagaacucccuuucaac

SEQ ID NO: 2989986 - RNA, 17 nt, Human
cuagaacucccuuucaa

SEQ ID NO: 2989987 - RNA, 16 nt, Human
cuagaacucccuuuca

SEQ ID NO: 2989988 - RNA, 22 nt, Human
cuagcagcagggagggcuucug

SEQ ID NO: 2989989 - RNA, 12 nt, Human
cuagcagcaggg

SEQ ID NO: 2989990 - RNA, 19 nt, Human
cuagaaauuccccacccug

SEQ ID NO: 2989991 - RNA, 11 nt, Human
cuaccugaggg

SEQ ID NO: 2989992 - RNA, 14 nt, Human
cuaccugaggggcc

SEQ ID NO: 2989993 - RNA, 18 nt, Human
cuauaacaaaggauacuu

SEQ ID NO: 2989994 - RNA, 22 nt, Human
cuauaacaaaggauacuuauuu

SEQ ID NO: 2989995 - RNA, 22 nt, Human
cuaguuccaccaucaagccacc

SEQ ID NO: 2989996 - RNA, 23 nt, Human
cuaguugaucagcuuauugucua

SEQ ID NO: 2989997 - RNA, 19 nt, Human
cuagggaaaaaccagcgug

SEQ ID NO: 2989998 - RNA, 21 nt, Human
cuagggaaaaaccagcgugug

SEQ ID NO: 2989999 - RNA, 18 nt, Human
cuaguuccaccaucaagc

SEQ ID NO: 2990000 - RNA, 20 nt, Human
cuaguuccaccaucaagcca

SEQ ID NO: 2990001 - RNA, 14 nt, Human
cuaguuccaccauc

SEQ ID NO: 2990002 - RNA, 15 nt, Human
cuaacuucaccauau

SEQ ID NO: 2990003 - RNA, 14 nt, Human
cuaacuggacuggu

SEQ ID NO: 2990004 - RNA, 16 nt, Human
cuaacuuuccuucauu

SEQ ID NO: 2990005 - RNA, 16 nt, Human
cuaacuucaccauauu

SEQ ID NO: 2990006 - RNA, 23 nt, Human
cuaagugaaauaagccagacauc

SEQ ID NO: 2990007 - RNA, 20 nt, Human
cuaagugaaauaagccagac

SEQ ID NO: 2990008 - RNA, 15 nt, Human
cuacaugagguacug

SEQ ID NO: 2990009 - RNA, 18 nt, Human
cuacauacaauuccaaac

SEQ ID NO: 2990010 - RNA, 15 nt, Human
cuacaguccucccau

SEQ ID NO: 2990011 - RNA, 16 nt, Human
cuacaguccucccauc

SEQ ID NO: 2990012 - RNA, 17 nt, Human
cuacaguccucccaucu

SEQ ID NO: 2990013 - RNA, 18 nt, Human
cuacaguccucccaucuc

SEQ ID NO: 2990014 - RNA, 13 nt, Human
cuacaguugaaaa

SEQ ID NO: 2990015 - RNA, 22 nt, Human
cuaagugauccucccaccucag

SEQ ID NO: 2990016 - RNA, 20 nt, Human
cuaagugauccucccaccuc

SEQ ID NO: 2990017 - RNA, 18 nt, Human
cuaagugaggaugaaaaa

SEQ ID NO: 2990018 - RNA, 16 nt, Human
ccuuggacauuuuaug

SEQ ID NO: 2990019 - RNA, 18 nt, Human
ccuuggacauuuuauguc

SEQ ID NO: 2990020 - RNA, 21 nt, Human
ccuuggacauuuuaugucuuu

SEQ ID NO: 2990021 - RNA, 20 nt, Human
ccuuuagcgcccaguugggu

SEQ ID NO: 2990022 - RNA, 14 nt, Human
ccuuuagcgcccag

SEQ ID NO: 2990023 - RNA, 20 nt, Human
ccuuuucgcaggauucuucc

SEQ ID NO: 2990024 - RNA, 18 nt, Human
ccuuuuuuauacauaaac

SEQ ID NO: 2990025 - RNA, 17 nt, Human
ccuuuuuuauacauaaa

SEQ ID NO: 2990026 - RNA, 16 nt, Human
cgacagugagacucug

SEQ ID NO: 2990027 - RNA, 15 nt, Human
cgacagugagacucu

SEQ ID NO: 2990028 - RNA, 23 nt, Human
cgaccagacaccuugacagggca

SEQ ID NO: 2990029 - RNA, 12 nt, Human
ccuuuuuuauac

SEQ ID NO: 2990030 - RNA, 17 nt, Human
ccuugccgucuaccuga

SEQ ID NO: 2990031 - RNA, 13 nt, Human
ccuugcccagccu

SEQ ID NO: 2990032 - RNA, 16 nt, Human
ccuugcccagccugga

SEQ ID NO: 2990033 - RNA, 14 nt, Human
ccuugcccagccug

SEQ ID NO: 2990034 - RNA, 20 nt, Human
ccuugccgucuaccugaggg

SEQ ID NO: 2990035 - RNA, 17 nt, Human
ccuugcccagccuggau

SEQ ID NO: 2990036 - RNA, 21 nt, Human
ccuucugacccaugcugcccu

SEQ ID NO: 2990037 - RNA, 22 nt, Human
ccuucugacccaugcugcccug

SEQ ID NO: 2990038 - RNA, 23 nt, Human
ccuucugacccaugcugcccugu

SEQ ID NO: 2990039 - RNA, 22 nt, Human
ccuucuggaauaaggagaauga

SEQ ID NO: 2990040 - RNA, 12 nt, Human
ccuucugaccca

SEQ ID NO: 2990041 - RNA, 16 nt, Human
ccuucugacccaugcu

SEQ ID NO: 2990042 - RNA, 17 nt, Human
ccuucugacccaugcug

SEQ ID NO: 2990043 - RNA, 20 nt, Human
ccuucugacccaugcugccc

SEQ ID NO: 2990044 - RNA, 14 nt, Human
ccuggccugagcug

SEQ ID NO: 2990045 - RNA, 15 nt, Human
ccuggccugagcugg

SEQ ID NO: 2990046 - RNA, 14 nt, Human
cggagucccaccuu

SEQ ID NO: 2990047 - RNA, 15 nt, Human
cggccuuuggcuuca

SEQ ID NO: 2990048 - RNA, 18 nt, Human
cggcucacugcagccuca

SEQ ID NO: 2990049 - RNA, 19 nt, Human
cggcucacugcagccucaa

SEQ ID NO: 2990050 - RNA, 17 nt, Human
cggcucacugcagccuc

SEQ ID NO: 2990051 - RNA, 17 nt, Human
cggagcacacuggcuca

SEQ ID NO: 2990052 - RNA, 15 nt, Human
cgaguagcugggacu

SEQ ID NO: 2990053 - RNA, 14 nt, Human
cgaguagcugggac

SEQ ID NO: 2990054 - RNA, 13 nt, Human
cgaguagcuggga

SEQ ID NO: 2990055 - RNA, 17 nt, Human
cgaguuacagacaaagc

SEQ ID NO: 2990056 - RNA, 18 nt, Human
cgaguuacagacaaagcg

SEQ ID NO: 2990057 - RNA, 13 nt, Human
cgccaaggcuggg

SEQ ID NO: 2990058 - RNA, 16 nt, Human
cgccaaggcuggggga

SEQ ID NO: 2990059 - RNA, 12 nt, Human
cgccaaggcugg

SEQ ID NO: 2990060 - RNA, 13 nt, Human
cucuauuucugga

SEQ ID NO: 2990061 - RNA, 19 nt, Human
cucucagauuguaccauug

SEQ ID NO: 2990062 - RNA, 21 nt, Human
cucucacuuguuuuauuuaac

SEQ ID NO: 2990063 - RNA, 15 nt, Human
cucucacuccuugaa

SEQ ID NO: 2990064 - RNA, 12 nt, Human
cucucacuccuu

SEQ ID NO: 2990065 - RNA, 14 nt, Human
cucucacuccuuga

SEQ ID NO: 2990066 - RNA, 21 nt, Human
cucuccgaccagacaccuuga

SEQ ID NO: 2990067 - RNA, 12 nt, Human
cucucuggccuu

SEQ ID NO: 2990068 - RNA, 11 nt, Human
cucucuggccu

SEQ ID NO: 2990069 - RNA, 15 nt, Human
cucugaaggacauug

SEQ ID NO: 2990070 - RNA, 15 nt, Human
cucuuagaugcaguu

SEQ ID NO: 2990071 - RNA, 17 nt, Human
cucuguacagagcccac

SEQ ID NO: 2990072 - RNA, 21 nt, Human
cucuguacagagcccacgccc

SEQ ID NO: 2990073 - RNA, 15 nt, Human
cucugguccauagag

SEQ ID NO: 2990074 - RNA, 19 nt, Human
cucugcugacagacacagg

SEQ ID NO: 2990075 - RNA, 18 nt, Human
cucugcugacagacacag

SEQ ID NO: 2990076 - RNA, 17 nt, Human
cucugcugacagacaca

SEQ ID NO: 2990077 - RNA, 16 nt, Human
cucugguccauagaga

SEQ ID NO: 2990078 - RNA, 18 nt, Human
cucugguccauagagagc

SEQ ID NO: 2990079 - RNA, 19 nt, Human
cucugguccauagagagca

SEQ ID NO: 2990080 - RNA, 15 nt, Human
cucugguuaucuaau

SEQ ID NO: 2990081 - RNA, 19 nt, Human
cucugcagcaauaaagcag

SEQ ID NO: 2990082 - RNA, 18 nt, Human
cucugcagcaauaaagca

SEQ ID NO: 2990083 - RNA, 23 nt, Human
cucugcagcaauaaagcagcguu

SEQ ID NO: 2990084 - RNA, 13 nt, Human
cucugcagcaaua

SEQ ID NO: 2990085 - RNA, 20 nt, Human
cucuuagaugcaguucugaa

SEQ ID NO: 2990086 - RNA, 13 nt, Human
cugaaggccccgc

SEQ ID NO: 2990087 - RNA, 14 nt, Human
cugaaggccccgcc

SEQ ID NO: 2990088 - RNA, 17 nt, Human
cugaaggcuggguucug

SEQ ID NO: 2990089 - RNA, 17 nt, Human
cugaaggccccgcccag

SEQ ID NO: 2990090 - RNA, 21 nt, Human
cugaaggacauugcggacagc

SEQ ID NO: 2990091 - RNA, 20 nt, Human
cugaaggacauugcggacag

SEQ ID NO: 2990092 - RNA, 19 nt, Human
cugaaggacauugcggaca

SEQ ID NO: 2990093 - RNA, 16 nt, Human
cugaaaauguaugugu

SEQ ID NO: 2990094 - RNA, 14 nt, Human
cugaaaauguaugu

SEQ ID NO: 2990095 - RNA, 18 nt, Human
cugacccaugcugcccug

SEQ ID NO: 2990096 - RNA, 17 nt, Human
cugacccaugcugcccu

SEQ ID NO: 2990097 - RNA, 19 nt, Human
cugacccaugcugcccugu

SEQ ID NO: 2990098 - RNA, 20 nt, Human
cugacccaugcugcccugug

SEQ ID NO: 2990099 - RNA, 23 nt, Human
cugacccugcuucaaauauuucc

SEQ ID NO: 2990100 - RNA, 14 nt, Human
cugacagacacagg

SEQ ID NO: 2990101 - RNA, 12 nt, Human
cugacagacaca

SEQ ID NO: 2990102 - RNA, 14 nt, Human
cucaugcugccaau

SEQ ID NO: 2990103 - RNA, 22 nt, Human
cucaugcugccaauauccuaau

SEQ ID NO: 2990104 - RNA, 12 nt, Human
cucaugcugcca

SEQ ID NO: 2990105 - RNA, 19 nt, Human
cucauguucuuaauucuua

SEQ ID NO: 2990106 - RNA, 18 nt, Human
cucauguucuuaauucuu

SEQ ID NO: 2990107 - RNA, 14 nt, Human
cucauguucuuaau

SEQ ID NO: 2990108 - RNA, 12 nt, Human
cucauguucuua

SEQ ID NO: 2990109 - RNA, 18 nt, Human
cucagucuggcccuuccu

SEQ ID NO: 2990110 - RNA, 17 nt, Human
cucagucuggcccuucc

SEQ ID NO: 2990111 - RNA, 13 nt, Human
cucagugccacua

SEQ ID NO: 2990112 - RNA, 14 nt, Human
cucaggccagcugc

SEQ ID NO: 2990113 - RNA, 20 nt, Human
cucaggccagcugcuugggc

SEQ ID NO: 2990114 - RNA, 21 nt, Human
cucaggccagcugcuugggcu

SEQ ID NO: 2990115 - RNA, 22 nt, Human
cucaggccagcugcuugggcuu

SEQ ID NO: 2990116 - RNA, 13 nt, Human
cucaggccagcug

SEQ ID NO: 2990117 - RNA, 13 nt, Human
cucagccucccaa

SEQ ID NO: 2990118 - RNA, 16 nt, Human
cucagccucccaaagu

SEQ ID NO: 2990119 - RNA, 14 nt, Human
cucagccucccaaa

SEQ ID NO: 2990120 - RNA, 21 nt, Human
cucagccucccaaagugcugg

SEQ ID NO: 2990121 - RNA, 13 nt, Human
cucagccucccga

SEQ ID NO: 2990122 - RNA, 22 nt, Human
cucagccucccaaagugcuggg

SEQ ID NO: 2990123 - RNA, 23 nt, Human
cucagccucccgaauagcuggga

SEQ ID NO: 2990124 - RNA, 21 nt, Human
cucaggccugggggcugggca

SEQ ID NO: 2990125 - RNA, 14 nt, Human
cucaggccuggggg

SEQ ID NO: 2990126 - RNA, 20 nt, Human
cucaggccugggggcugggc

SEQ ID NO: 2990127 - RNA, 13 nt, Human
cucaggccugggg

SEQ ID NO: 2990128 - RNA, 22 nt, Human
cuccagucauuauguuaauauu

SEQ ID NO: 2990129 - RNA, 11 nt, Human
cuccaggugca

SEQ ID NO: 2990130 - RNA, 17 nt, Human
cuccagacacaugucca

SEQ ID NO: 2990131 - RNA, 19 nt, Human
cuccagacacauguccaag

SEQ ID NO: 2990132 - RNA, 15 nt, Human
cuccagaauuuccca

SEQ ID NO: 2990133 - RNA, 18 nt, Human
cuccagaauuucccaaag

SEQ ID NO: 2990134 - RNA, 17 nt, Human
cuccaagaccuucuccu

SEQ ID NO: 2990135 - RNA, 18 nt, Human
cuccaagaccuucuccuu

SEQ ID NO: 2990136 - RNA, 16 nt, Human
cuccaagaccuucucc

SEQ ID NO: 2990137 - RNA, 15 nt, Human
cuccaagaccuucuc

SEQ ID NO: 2990138 - RNA, 22 nt, Human
cuccacuuucuagccagaggag

SEQ ID NO: 2990139 - RNA, 20 nt, Human
cuccacuuucuagccagagg

SEQ ID NO: 2990140 - RNA, 16 nt, Human
cucccugcaauaaaau

SEQ ID NO: 2990141 - RNA, 14 nt, Human
cucccugcaauaaa

SEQ ID NO: 2990142 - RNA, 12 nt, Human
cucccaccucag

SEQ ID NO: 2990143 - RNA, 19 nt, Human
cuccgcuuucuacccagcg

SEQ ID NO: 2990144 - RNA, 13 nt, Human
augaaugcccagu

SEQ ID NO: 2990145 - RNA, 21 nt, Human
augaaugcccagugagacugu

SEQ ID NO: 2990146 - RNA, 20 nt, Human
augaaugucagugugacuga

SEQ ID NO: 2990147 - RNA, 17 nt, Human
augaagauacugaaaua

SEQ ID NO: 2990148 - RNA, 16 nt, Human
augaagauacugaaau

SEQ ID NO: 2990149 - RNA, 13 nt, Human
augaaugaauggc

SEQ ID NO: 2990150 - RNA, 18 nt, Human
augaagauguagaggaga

SEQ ID NO: 2990151 - RNA, 17 nt, Human
augaaauauuauguuaa

SEQ ID NO: 2990152 - RNA, 13 nt, Human
augaaauauuaug

SEQ ID NO: 2990153 - RNA, 18 nt, Human
augaaauauuauguuaaa

SEQ ID NO: 2990154 - RNA, 15 nt, Human
augaagauacugaaa

SEQ ID NO: 2990155 - RNA, 14 nt, Human
uuggggauauuuuu

SEQ ID NO: 2990156 - RNA, 15 nt, Human
uuggggcucccagcc

SEQ ID NO: 2990157 - RNA, 14 nt, Human
uuggggcucccagc

SEQ ID NO: 2990158 - RNA, 13 nt, Human
uuggggcucccag

SEQ ID NO: 2990159 - RNA, 22 nt, Human
uuggggcucccagccaggcccu

SEQ ID NO: 2990160 - RNA, 18 nt, Human
uuggggcucccagccagg

SEQ ID NO: 2990161 - RNA, 22 nt, Human
uuggggggcugaggugggagga

SEQ ID NO: 2990162 - RNA, 13 nt, Human
aucuuuuucuaac

SEQ ID NO: 2990163 - RNA, 15 nt, Human
augaaagcagggacu

SEQ ID NO: 2990164 - RNA, 12 nt, Human
augaaagauuca

SEQ ID NO: 2990165 - RNA, 18 nt, Human
aucuuugcagacaggcaa

SEQ ID NO: 2990166 - RNA, 22 nt, Human
uuggcgcugccccuggcagccc

SEQ ID NO: 2990167 - RNA, 23 nt, Human
uuggcgcugccccuggcagcccc

SEQ ID NO: 2990168 - RNA, 18 nt, Human
uuggcuagagguucaaag

SEQ ID NO: 2990169 - RNA, 21 nt, Human
uugguugguaacucuguaauu

SEQ ID NO: 2990170 - RNA, 17 nt, Human
uugguugggaugacuug

SEQ ID NO: 2990171 - RNA, 20 nt, Human
uugguucuggacuaaaacua

SEQ ID NO: 2990172 - RNA, 18 nt, Human
uugguucuggacuaaaac

SEQ ID NO: 2990173 - RNA, 15 nt, Human
uuguauaaaauaauu

SEQ ID NO: 2990174 - RNA, 16 nt, Human
uuguauaaaauaauuu

SEQ ID NO: 2990175 - RNA, 16 nt, Human
uuguaucacaaaucuu

SEQ ID NO: 2990176 - RNA, 22 nt, Human
augacacaugcaaggucauuuu

SEQ ID NO: 2990177 - RNA, 14 nt, Human
augacacaugcaag

SEQ ID NO: 2990178 - RNA, 17 nt, Human
uuguauaaaauaauuuu

SEQ ID NO: 2990179 - RNA, 23 nt, Human
augacuuggugucuaauguguag

SEQ ID NO: 2990180 - RNA, 18 nt, Human
augacuuggugucuaaug

SEQ ID NO: 2990181 - RNA, 17 nt, Human
augacuuacuguacaug

SEQ ID NO: 2990182 - RNA, 16 nt, Human
augacuuacuguacau

SEQ ID NO: 2990183 - RNA, 22 nt, Human
augagaaacuggcaaagcagaa

SEQ ID NO: 2990184 - RNA, 20 nt, Human
augagaaacuggcaaagcag

SEQ ID NO: 2990185 - RNA, 19 nt, Human
augacauugacuauuuuug

SEQ ID NO: 2990186 - RNA, 16 nt, Human
augacauugacuauuu

SEQ ID NO: 2990187 - RNA, 14 nt, Human
augacauucccugc

SEQ ID NO: 2990188 - RNA, 18 nt, Human
augacacgaauauugcug

SEQ ID NO: 2990189 - RNA, 14 nt, Human
augacuuacuguac

SEQ ID NO: 2990190 - RNA, 22 nt, Human
augacuuaagcacacuugacau

SEQ ID NO: 2990191 - RNA, 19 nt, Human
augagagacacacugaaga

SEQ ID NO: 2990192 - RNA, 17 nt, Human
augagagacacacugaa

SEQ ID NO: 2990193 - RNA, 14 nt, Human
augagagacacacu

SEQ ID NO: 2990194 - RNA, 13 nt, Human
augagagacacac

SEQ ID NO: 2990195 - RNA, 22 nt, Human
augagaaagguugaagcaccaa

SEQ ID NO: 2990196 - RNA, 21 nt, Human
augagaaagguugaagcacca

SEQ ID NO: 2990197 - RNA, 11 nt, Human
uugcacauuaa

SEQ ID NO: 2990198 - RNA, 23 nt, Human
uugcacauuaaaugacucuuccc

SEQ ID NO: 2990199 - RNA, 15 nt, Human
uugauucagacagcu

SEQ ID NO: 2990200 - RNA, 16 nt, Human
uugauucagacagcug

SEQ ID NO: 2990201 - RNA, 21 nt, Human
uugcacacuuuggcccagggu

SEQ ID NO: 2990202 - RNA, 19 nt, Human
uugauggugguauguuuuc

SEQ ID NO: 2990203 - RNA, 21 nt, Human
uugauucaccuccuaaaacaa

SEQ ID NO: 2990204 - RNA, 20 nt, Human
uugauucaccuccuaaaaca

SEQ ID NO: 2990205 - RNA, 22 nt, Human
uugauucaccuccuaaaacaac

SEQ ID NO: 2990206 - RNA, 14 nt, Human
uugauucagacagc

SEQ ID NO: 2990207 - RNA, 18 nt, Human
uugauggugguauguuuu

SEQ ID NO: 2990208 - RNA, 18 nt, Human
aucucuuaucuuacgaaa

SEQ ID NO: 2990209 - RNA, 20 nt, Human
aucucuuaucuuacgaaaaa

SEQ ID NO: 2990210 - RNA, 21 nt, Human
aucucauuuccaagcaaguau

SEQ ID NO: 2990211 - RNA, 23 nt, Human
aucucauuuccaagcaaguauua

SEQ ID NO: 2990212 - RNA, 14 nt, Human
aucucauuuccaag

SEQ ID NO: 2990213 - RNA, 12 nt, Human
aucucccccagc

SEQ ID NO: 2990214 - RNA, 13 nt, Human
aucucccccagcc

SEQ ID NO: 2990215 - RNA, 15 nt, Human
aucucacacaugagc

SEQ ID NO: 2990216 - RNA, 13 nt, Human
aucucaauauuuc

SEQ ID NO: 2990217 - RNA, 16 nt, Human
aucucacacaugagca

SEQ ID NO: 2990218 - RNA, 15 nt, Human
auccuaguuccacca

SEQ ID NO: 2990219 - RNA, 19 nt, Human
auccuaguuccaccaucaa

SEQ ID NO: 2990220 - RNA, 20 nt, Human
uugccuaauaugaugacugu

SEQ ID NO: 2990221 - RNA, 14 nt, Human
uugccguuauuaaa

SEQ ID NO: 2990222 - RNA, 19 nt, Human
uugccgucuaccugagggg

SEQ ID NO: 2990223 - RNA, 15 nt, Human
uugccgucuaccuga

SEQ ID NO: 2990224 - RNA, 18 nt, Human
uugccgucuaccugaggg

SEQ ID NO: 2990225 - RNA, 13 nt, Human
uugcccuguuaaa

SEQ ID NO: 2990226 - RNA, 13 nt, Human
uugccgucuaccu

SEQ ID NO: 2990227 - RNA, 12 nt, Human
aucuguuacaca

SEQ ID NO: 2990228 - RNA, 19 nt, Human
aucuugcucugcugacaga

SEQ ID NO: 2990229 - RNA, 17 nt, Human
aucuugcucugcugaca

SEQ ID NO: 2990230 - RNA, 18 nt, Human
aucuugaauuguaaggaa

SEQ ID NO: 2990231 - RNA, 17 nt, Human
aucuggguucacugcaa

SEQ ID NO: 2990232 - RNA, 19 nt, Human
aucuggguucacugcaacc

SEQ ID NO: 2990233 - RNA, 23 nt, Human
aucugugaaaggaaagagggagg

SEQ ID NO: 2990234 - RNA, 22 nt, Human
uuuagaugaaugucaguuguua

SEQ ID NO: 2990235 - RNA, 20 nt, Human
uuuagcuggaaaaguauguu

SEQ ID NO: 2990236 - RNA, 17 nt, Human
uuuagaugaaugucagu

SEQ ID NO: 2990237 - RNA, 18 nt, Human
uuuagaugaaugucaguu

SEQ ID NO: 2990238 - RNA, 19 nt, Human
augcccccuguggaugcug

SEQ ID NO: 2990239 - RNA, 15 nt, Human
augcccccuguggau

SEQ ID NO: 2990240 - RNA, 22 nt, Human
uuuagcuggaaaaguauguuag

SEQ ID NO: 2990241 - RNA, 15 nt, Human
uuuaguagagacagg

SEQ ID NO: 2990242 - RNA, 13 nt, Human
uuuauauaagcuu

SEQ ID NO: 2990243 - RNA, 20 nt, Human
uuuauggcuuuugugcauua

SEQ ID NO: 2990244 - RNA, 24 nt, Human
uuuauggcuuuugugcauuaucua

SEQ ID NO: 2990245 - RNA, 18 nt, Human
augcuguacauacuuuuu

SEQ ID NO: 2990246 - RNA, 16 nt, Human
augcuguacauacuuu

SEQ ID NO: 2990247 - RNA, 19 nt, Human
augcugucccuuacgugag

SEQ ID NO: 2990248 - RNA, 23 nt, Human
augcugucccuuacgugaguccu

SEQ ID NO: 2990249 - RNA, 22 nt, Human
augcugucuacacuaagagaga

SEQ ID NO: 2990250 - RNA, 16 nt, Human
auggaacacucugaga

SEQ ID NO: 2990251 - RNA, 15 nt, Human
auggaagacagcucu

SEQ ID NO: 2990252 - RNA, 14 nt, Human
auggaacacucuga

SEQ ID NO: 2990253 - RNA, 15 nt, Human
auggaacacucugag

SEQ ID NO: 2990254 - RNA, 11 nt, Human
auggaacacuc

SEQ ID NO: 2990255 - RNA, 15 nt, Human
augcuguacauacuu

SEQ ID NO: 2990256 - RNA, 12 nt, Human
augcuguacaua

SEQ ID NO: 2990257 - RNA, 22 nt, Human
augcuguaacuuucugaaauaa

SEQ ID NO: 2990258 - RNA, 16 nt, Human
augcuagaacucccuu

SEQ ID NO: 2990259 - RNA, 15 nt, Human
augcuagaacucccu

SEQ ID NO: 2990260 - RNA, 20 nt, Human
auggcuaguaucaaaagaaa

SEQ ID NO: 2990261 - RNA, 20 nt, Human
auggccuuugcuugaaagaa

SEQ ID NO: 2990262 - RNA, 21 nt, Human
auggccgggcgcgguggcuca

SEQ ID NO: 2990263 - RNA, 18 nt, Human
auggauuuccagccaaag

SEQ ID NO: 2990264 - RNA, 23 nt, Human
auggacguguuaugacuccagaa

SEQ ID NO: 2990265 - RNA, 19 nt, Human
auggacguguuaugacucc

SEQ ID NO: 2990266 - RNA, 20 nt, Human
auggacguguuaugacucca

SEQ ID NO: 2990267 - RNA, 23 nt, Human
auggcacaucagcacgauuucug

SEQ ID NO: 2990268 - RNA, 17 nt, Human
auggcacaucagcacga

SEQ ID NO: 2990269 - RNA, 13 nt, Human
uuucagaaaugug

SEQ ID NO: 2990270 - RNA, 16 nt, Human
auggaagacagcucuu

SEQ ID NO: 2990271 - RNA, 16 nt, Human
auggaauacucuuaua

SEQ ID NO: 2990272 - RNA, 17 nt, Human
auggaauacucuuauau

SEQ ID NO: 2990273 - RNA, 14 nt, Human
auggacaugaucuu

SEQ ID NO: 2990274 - RNA, 18 nt, Human
augcaguacuaacauuua

SEQ ID NO: 2990275 - RNA, 13 nt, Human
augcagguuuuau

SEQ ID NO: 2990276 - RNA, 20 nt, Human
augcaguacaggacauauau

SEQ ID NO: 2990277 - RNA, 19 nt, Human
augcaguacaggacauaua

SEQ ID NO: 2990278 - RNA, 17 nt, Human
augcaguacaggacaua

SEQ ID NO: 2990279 - RNA, 17 nt, Human
augcaguucugaagaag

SEQ ID NO: 2990280 - RNA, 15 nt, Human
augcaguucugaaga

SEQ ID NO: 2990281 - RNA, 13 nt, Human
augcagccucaca

SEQ ID NO: 2990282 - RNA, 14 nt, Human
augcagccucacag

SEQ ID NO: 2990283 - RNA, 15 nt, Human
augcagccucacagu

SEQ ID NO: 2990284 - RNA, 17 nt, Human
augcagccucacagucc

SEQ ID NO: 2990285 - RNA, 17 nt, Human
augccacuaaauugaca

SEQ ID NO: 2990286 - RNA, 15 nt, Human
augccacuaaauuga

SEQ ID NO: 2990287 - RNA, 19 nt, Human
augcaguucugaagaagau

SEQ ID NO: 2990288 - RNA, 18 nt, Human
augcaguucugaagaaga

SEQ ID NO: 2990289 - RNA, 16 nt, Human
uuguuuucaguguaca

SEQ ID NO: 2990290 - RNA, 13 nt, Human
uuguuuucagugu

SEQ ID NO: 2990291 - RNA, 15 nt, Human
augcacuuuguucug

SEQ ID NO: 2990292 - RNA, 14 nt, Human
uuguuuucauuauc

SEQ ID NO: 2990293 - RNA, 14 nt, Human
uuuaagaggcaggg

SEQ ID NO: 2990294 - RNA, 16 nt, Human
uuuaagugcugcauuu

SEQ ID NO: 2990295 - RNA, 15 nt, Human
uuuaagugcugcauu

SEQ ID NO: 2990296 - RNA, 19 nt, Human
uuuaagugcugcauuuaaa

SEQ ID NO: 2990297 - RNA, 17 nt, Human
uuuaagugcugcauuua

SEQ ID NO: 2990298 - RNA, 12 nt, Human
uuuaauucaguu

SEQ ID NO: 2990299 - RNA, 13 nt, Human
augauuucacagu

SEQ ID NO: 2990300 - RNA, 12 nt, Human
augauucccagc

SEQ ID NO: 2990301 - RNA, 21 nt, Human
augauucaaaugucuauaaac

SEQ ID NO: 2990302 - RNA, 21 nt, Human
augauucaacagguuuuccug

SEQ ID NO: 2990303 - RNA, 20 nt, Human
augauuaaccacuucagcug

SEQ ID NO: 2990304 - RNA, 21 nt, Human
augauuaaccacuucagcuga

SEQ ID NO: 2990305 - RNA, 22 nt, Human
augauuaugaauuacauuugua

SEQ ID NO: 2990306 - RNA, 19 nt, Human
augauuaaccacuucagcu

SEQ ID NO: 2990307 - RNA, 15 nt, Human
uuguugucugcaacu

SEQ ID NO: 2990308 - RNA, 15 nt, Human
augcaaagcacugac

SEQ ID NO: 2990309 - RNA, 13 nt, Human
augcaccagcccu

SEQ ID NO: 2990310 - RNA, 12 nt, Human
augcacuuuguu

SEQ ID NO: 2990311 - RNA, 14 nt, Human
augcaccagcccuu

SEQ ID NO: 2990312 - RNA, 23 nt, Human
uugugugaaagguacuucaaauc

SEQ ID NO: 2990313 - RNA, 13 nt, Human
uugugguuaaucu

SEQ ID NO: 2990314 - RNA, 17 nt, Human
uuguguguuuauuguca

SEQ ID NO: 2990315 - RNA, 19 nt, Human
uuguucuggcucuuccagg

SEQ ID NO: 2990316 - RNA, 20 nt, Human
uuguucuggcucuuccaggc

SEQ ID NO: 2990317 - RNA, 22 nt, Human
uuguucuggcucuuccaggcug

SEQ ID NO: 2990318 - RNA, 23 nt, Human
uuguucugaaaugucaguucuga

SEQ ID NO: 2990319 - RNA, 21 nt, Human
uuguucugaaaugucaguucu

SEQ ID NO: 2990320 - RNA, 18 nt, Human
uugugauacaaugcugug

SEQ ID NO: 2990321 - RNA, 21 nt, Human
uugugaggaagccgcuggggc

SEQ ID NO: 2990322 - RNA, 21 nt, Human
augagagacacacugaagaag

SEQ ID NO: 2990323 - RNA, 20 nt, Human
augagagacacacugaagaa

SEQ ID NO: 2990324 - RNA, 21 nt, Human
augagacuuuaaaagcauuuu

SEQ ID NO: 2990325 - RNA, 13 nt, Human
aucauuucaagaa

SEQ ID NO: 2990326 - RNA, 21 nt, Human
aucaggccaggcccucugccc

SEQ ID NO: 2990327 - RNA, 22 nt, Human
aucaggccaggcccucugccca

SEQ ID NO: 2990328 - RNA, 23 nt, Human
aucaggccaggcccucugcccac

SEQ ID NO: 2990329 - RNA, 20 nt, Human
aucauugaaaucuuuuugcu

SEQ ID NO: 2990330 - RNA, 20 nt, Human
aucaggccaggcccucugcc

SEQ ID NO: 2990331 - RNA, 21 nt, Human
aucauugaaaucuuuuugcuu

SEQ ID NO: 2990332 - RNA, 17 nt, Human
uucucuacucuagggaa

SEQ ID NO: 2990333 - RNA, 23 nt, Human
uucucuacccaucuuaaaaacaa

SEQ ID NO: 2990334 - RNA, 16 nt, Human
uucucuuuucaaaaca

SEQ ID NO: 2990335 - RNA, 14 nt, Human
uucugacccaugcu

SEQ ID NO: 2990336 - RNA, 13 nt, Human
uucugccgcagcc

SEQ ID NO: 2990337 - RNA, 14 nt, Human
auccauacauuugu

SEQ ID NO: 2990338 - RNA, 20 nt, Human
uucuggcuaugcauuugaaa

SEQ ID NO: 2990339 - RNA, 18 nt, Human
uucuggcuaugcauuuga

SEQ ID NO: 2990340 - RNA, 14 nt, Human
uucugccgcagccc

SEQ ID NO: 2990341 - RNA, 15 nt, Human
uucugccgcagcccu

SEQ ID NO: 2990342 - RNA, 16 nt, Human
uucuggcuaugcauuu

SEQ ID NO: 2990343 - RNA, 14 nt, Human
uugaaaugauuuca

SEQ ID NO: 2990344 - RNA, 21 nt, Human
uugaaauuuuuauuaaauuau

SEQ ID NO: 2990345 - RNA, 11 nt, Human
uugaaaucuuu

SEQ ID NO: 2990346 - RNA, 20 nt, Human
uugaaauauaggaacuuaaa

SEQ ID NO: 2990347 - RNA, 19 nt, Human
uugaaauauugacuuuuua

SEQ ID NO: 2990348 - RNA, 14 nt, Human
uucuuuuugaaaug

SEQ ID NO: 2990349 - RNA, 15 nt, Human
uucuuuuugaaaugu

SEQ ID NO: 2990350 - RNA, 17 nt, Human
uucuuuuaagaaucaau

SEQ ID NO: 2990351 - RNA, 20 nt, Human
auccuagucauucuucccua

SEQ ID NO: 2990352 - RNA, 13 nt, Human
auccuaguuccac

SEQ ID NO: 2990353 - RNA, 21 nt, Human
auccuaggcauuugcugaaua

SEQ ID NO: 2990354 - RNA, 18 nt, Human
auccuaauaaaaagguga

SEQ ID NO: 2990355 - RNA, 22 nt, Human
auccuaauaaaaaggugaccau

SEQ ID NO: 2990356 - RNA, 14 nt, Human
auccuaauaaaaag

SEQ ID NO: 2990357 - RNA, 15 nt, Human
auccuaauaaaaagg

SEQ ID NO: 2990358 - RNA, 16 nt, Human
auccuaauaaaaaggu

SEQ ID NO: 2990359 - RNA, 17 nt, Human
auccuaauaaaaaggug

SEQ ID NO: 2990360 - RNA, 12 nt, Human
auccuaauaaaa

SEQ ID NO: 2990361 - RNA, 21 nt, Human
auccuaagcuauucaguaaua

SEQ ID NO: 2990362 - RNA, 23 nt, Human
uugaacauuuggguuacuauuuc

SEQ ID NO: 2990363 - RNA, 15 nt, Human
uucuuggcccaggau

SEQ ID NO: 2990364 - RNA, 13 nt, Human
uucuugcaaagua

SEQ ID NO: 2990365 - RNA, 12 nt, Human
uucuugcaaagu

SEQ ID NO: 2990366 - RNA, 22 nt, Human
uucuuucuggcuaugcauuuga

SEQ ID NO: 2990367 - RNA, 14 nt, Human
uucuuuuaagaauc

SEQ ID NO: 2990368 - RNA, 12 nt, Human
uucuuuuaagaa

SEQ ID NO: 2990369 - RNA, 23 nt, Human
uucuuccucccucccucuuuccc

SEQ ID NO: 2990370 - RNA, 13 nt, Human
uucuuaauucuua

SEQ ID NO: 2990371 - RNA, 18 nt, Human
uucuguucuuucuggcua

SEQ ID NO: 2990372 - RNA, 11 nt, Human
uucuguucuuu

SEQ ID NO: 2990373 - RNA, 20 nt, Human
uucuguuuuucuaggccugg

SEQ ID NO: 2990374 - RNA, 13 nt, Human
uucucagcagagu

SEQ ID NO: 2990375 - RNA, 13 nt, Human
aucaggccaggcc

SEQ ID NO: 2990376 - RNA, 21 nt, Human
uucuaaguaaaaccacagcag

SEQ ID NO: 2990377 - RNA, 13 nt, Human
uucuauaauuuaa

SEQ ID NO: 2990378 - RNA, 14 nt, Human
uucuauaauuuaaa

SEQ ID NO: 2990379 - RNA, 21 nt, Human
uucucacugccaugccagcuu

SEQ ID NO: 2990380 - RNA, 22 nt, Human
uucuaaauaucccuuggacauu

SEQ ID NO: 2990381 - RNA, 19 nt, Human
uucuaaaucuccaaaauaa

SEQ ID NO: 2990382 - RNA, 13 nt, Human
uucgcuccugugu

SEQ ID NO: 2990383 - RNA, 19 nt, Human
uucuaaguaaaaccacagc

SEQ ID NO: 2990384 - RNA, 20 nt, Human
uucuaaguaaaaccacagca

SEQ ID NO: 2990385 - RNA, 17 nt, Human
uucuaaguaaaaccaca

SEQ ID NO: 2990386 - RNA, 21 nt, Human
uucgcaggauucuuccucccu

SEQ ID NO: 2990387 - RNA, 21 nt, Human
uuccuucaagaaugcaguacu

SEQ ID NO: 2990388 - RNA, 14 nt, Human
uuccuucaagaaug

SEQ ID NO: 2990389 - RNA, 20 nt, Human
aucaaauaugcaaagcacug

SEQ ID NO: 2990390 - RNA, 22 nt, Human
aucaaccccuucgcuccugugu

SEQ ID NO: 2990391 - RNA, 20 nt, Human
aucaaccccuucgcuccugu

SEQ ID NO: 2990392 - RNA, 19 nt, Human
aucaaccccuucgcuccug

SEQ ID NO: 2990393 - RNA, 14 nt, Human
aucaaguuauuuuu

SEQ ID NO: 2990394 - RNA, 20 nt, Human
auauuuuacauaaauuuagu

SEQ ID NO: 2990395 - RNA, 16 nt, Human
auauuuuacauaaauu

SEQ ID NO: 2990396 - RNA, 15 nt, Human
auauuuuacauaaau

SEQ ID NO: 2990397 - RNA, 19 nt, Human
uucccuuuuuuggcugcug

SEQ ID NO: 2990398 - RNA, 20 nt, Human
uucccuuuuuuggcugcuga

SEQ ID NO: 2990399 - RNA, 18 nt, Human
uucccuuuuuuggcugcu

SEQ ID NO: 2990400 - RNA, 16 nt, Human
auaugaugacuguuuu

SEQ ID NO: 2990401 - RNA, 13 nt, Human
auaugcacacauu

SEQ ID NO: 2990402 - RNA, 15 nt, Human
auaugcacacauuuu

SEQ ID NO: 2990403 - RNA, 14 nt, Human
auaugcacacauuu

SEQ ID NO: 2990404 - RNA, 16 nt, Human
auaugcacacauuuuu

SEQ ID NO: 2990405 - RNA, 16 nt, Human
auauguaacaagccac

SEQ ID NO: 2990406 - RNA, 17 nt, Human
auauguaacaagccacc

SEQ ID NO: 2990407 - RNA, 21 nt, Human
auaucuccgucaacucauauu

SEQ ID NO: 2990408 - RNA, 20 nt, Human
auaucuccgucaacucauau

SEQ ID NO: 2990409 - RNA, 19 nt, Human
auaucuccgucaacucaua

SEQ ID NO: 2990410 - RNA, 20 nt, Human
auaucugaaaauguaugugu

SEQ ID NO: 2990411 - RNA, 17 nt, Human
auaucugaaaauguaug

SEQ ID NO: 2990412 - RNA, 16 nt, Human
auaucugaaaauguau

SEQ ID NO: 2990413 - RNA, 13 nt, Human
uucauauuuaauu

SEQ ID NO: 2990414 - RNA, 17 nt, Human
uucaucccucuggggcu

SEQ ID NO: 2990415 - RNA, 21 nt, Human
uucaucccucuggggcuguuc

SEQ ID NO: 2990416 - RNA, 13 nt, Human
uucagaaaugugu

SEQ ID NO: 2990417 - RNA, 11 nt, Human
uucagaaaugu

SEQ ID NO: 2990418 - RNA, 16 nt, Human
uucagugccaaaaaca

SEQ ID NO: 2990419 - RNA, 12 nt, Human
uucagugccuua

SEQ ID NO: 2990420 - RNA, 13 nt, Human
uucagugccuuau

SEQ ID NO: 2990421 - RNA, 18 nt, Human
uucagugccuuauggaac

SEQ ID NO: 2990422 - RNA, 12 nt, Human
uucauacaaggc

SEQ ID NO: 2990423 - RNA, 12 nt, Human
uucccaaauuuc

SEQ ID NO: 2990424 - RNA, 18 nt, Human
uucccaacuccagaaagu

SEQ ID NO: 2990425 - RNA, 16 nt, Human
uucccaagcucugcuc

SEQ ID NO: 2990426 - RNA, 15 nt, Human
uucccaagcucugcu

SEQ ID NO: 2990427 - RNA, 14 nt, Human
uucccaagcucugc

SEQ ID NO: 2990428 - RNA, 13 nt, Human
uucccaagcucug

SEQ ID NO: 2990429 - RNA, 12 nt, Human
uucccaccucuc

SEQ ID NO: 2990430 - RNA, 22 nt, Human
uucccaccucucucacuccuug

SEQ ID NO: 2990431 - RNA, 18 nt, Human
uucccaagcucugcuccu

SEQ ID NO: 2990432 - RNA, 21 nt, Human
uuccaggggugggacacccug

SEQ ID NO: 2990433 - RNA, 17 nt, Human
uuccagugaggcucugc

SEQ ID NO: 2990434 - RNA, 19 nt, Human
uuccagugaggcucugccc

SEQ ID NO: 2990435 - RNA, 20 nt, Human
uuccagugaggcucugcccu

SEQ ID NO: 2990436 - RNA, 21 nt, Human
uuccagugaggcucugcccuu

SEQ ID NO: 2990437 - RNA, 22 nt, Human
uuccagugaggcucugcccuug

SEQ ID NO: 2990438 - RNA, 23 nt, Human
uucccaaagcagugcaugcuguc

SEQ ID NO: 2990439 - RNA, 15 nt, Human
auauguggaguucau

SEQ ID NO: 2990440 - RNA, 16 nt, Human
auauguggaguucauc

SEQ ID NO: 2990441 - RNA, 17 nt, Human
uuccaaggguacuaagg

SEQ ID NO: 2990442 - RNA, 15 nt, Human
uuccaaggguacuaa

SEQ ID NO: 2990443 - RNA, 19 nt, Human
uuccaccaucaagccacca

SEQ ID NO: 2990444 - RNA, 22 nt, Human
uuccacaagagcccaggccucc

SEQ ID NO: 2990445 - RNA, 18 nt, Human
uuccaccaucaagccacc

SEQ ID NO: 2990446 - RNA, 17 nt, Human
uuccaggggugggacac

SEQ ID NO: 2990447 - RNA, 23 nt, Human
uucaagaaguccccucuccucca

SEQ ID NO: 2990448 - RNA, 23 nt, Human
uucaagaaugcaguacuaacauu

SEQ ID NO: 2990449 - RNA, 18 nt, Human
uucaaacagucucaggaa

SEQ ID NO: 2990450 - RNA, 21 nt, Human
uucaagcgauucuucugcuuc

SEQ ID NO: 2990451 - RNA, 17 nt, Human
uuauuuuuagacagagu

SEQ ID NO: 2990452 - RNA, 18 nt, Human
uuauuuuuagacagaguc

SEQ ID NO: 2990453 - RNA, 22 nt, Human
auaggaauugacccacaagaaa

SEQ ID NO: 2990454 - RNA, 17 nt, Human
auaggcguaacuaauuu

SEQ ID NO: 2990455 - RNA, 12 nt, Human
auaggaaaaacu

SEQ ID NO: 2990456 - RNA, 14 nt, Human
auaggaaaaacuga

SEQ ID NO: 2990457 - RNA, 16 nt, Human
auaggaaaaacugauu

SEQ ID NO: 2990458 - RNA, 17 nt, Human
auaggaaaaacugauuu

SEQ ID NO: 2990459 - RNA, 15 nt, Human
auagcuuuuuucucu

SEQ ID NO: 2990460 - RNA, 23 nt, Human
uucacaagacccaaaaggcagaa

SEQ ID NO: 2990461 - RNA, 22 nt, Human
uucacaagacccaaaaggcaga

SEQ ID NO: 2990462 - RNA, 20 nt, Human
uucacagaugggugcuugga

SEQ ID NO: 2990463 - RNA, 15 nt, Human
uucacaguucucucc

SEQ ID NO: 2990464 - RNA, 20 nt, Human
uucacaguucucuccuucuu

SEQ ID NO: 2990465 - RNA, 13 nt, Human
uucacaguucucu

SEQ ID NO: 2990466 - RNA, 17 nt, Human
auaguggcuuaaaacaa

SEQ ID NO: 2990467 - RNA, 15 nt, Human
auaguggugugauuu

SEQ ID NO: 2990468 - RNA, 20 nt, Human
auaguuguaccgcaauguga

SEQ ID NO: 2990469 - RNA, 22 nt, Human
auaguuggcuaggaccccucca

SEQ ID NO: 2990470 - RNA, 22 nt, Human
auaguuaagcgugcauaaguua

SEQ ID NO: 2990471 - RNA, 19 nt, Human
auauauaacaaugcuguau

SEQ ID NO: 2990472 - RNA, 13 nt, Human
auauauaaccagu

SEQ ID NO: 2990473 - RNA, 12 nt, Human
auauauaaccag

SEQ ID NO: 2990474 - RNA, 17 nt, Human
auauaacaaugcuguau

SEQ ID NO: 2990475 - RNA, 21 nt, Human
auauauauuuuuuucugaaau

SEQ ID NO: 2990476 - RNA, 14 nt, Human
auucucagcagagu

SEQ ID NO: 2990477 - RNA, 15 nt, Human
auucucagcagagug

SEQ ID NO: 2990478 - RNA, 13 nt, Human
auucuccaccugc

SEQ ID NO: 2990479 - RNA, 20 nt, Human
auucucagaaucucaaauaa

SEQ ID NO: 2990480 - RNA, 18 nt, Human
auucucagaaucucaaau

SEQ ID NO: 2990481 - RNA, 16 nt, Human
auugacagauugaauu

SEQ ID NO: 2990482 - RNA, 16 nt, Human
auucucagcagagugc

SEQ ID NO: 2990483 - RNA, 20 nt, Human
auugacacuuaaaaaugguu

SEQ ID NO: 2990484 - RNA, 16 nt, Human
auucuccaccugccag

SEQ ID NO: 2990485 - RNA, 17 nt, Human
auucuccaccugccagg

SEQ ID NO: 2990486 - RNA, 16 nt, Human
auucuacuuugagugc

SEQ ID NO: 2990487 - RNA, 13 nt, Human
auucuacuuugag

SEQ ID NO: 2990488 - RNA, 14 nt, Human
auuccuaaaauuau

SEQ ID NO: 2990489 - RNA, 19 nt, Human
auuccuaaaauuauggaaa

SEQ ID NO: 2990490 - RNA, 14 nt, Human
auucucagaaucuc

SEQ ID NO: 2990491 - RNA, 22 nt, Human
auucucacagcuccaagaauuu

SEQ ID NO: 2990492 - RNA, 21 nt, Human
auucucacagcuccaagaauu

SEQ ID NO: 2990493 - RNA, 19 nt, Human
auucucacagcuccaagaa

SEQ ID NO: 2990494 - RNA, 18 nt, Human
auucuccaccugccaggg

SEQ ID NO: 2990495 - RNA, 18 nt, Human
auugacaggauuauugga

SEQ ID NO: 2990496 - RNA, 21 nt, Human
auugacccacaagaaaugaaa

SEQ ID NO: 2990497 - RNA, 15 nt, Human
auugcaacaggcugg

SEQ ID NO: 2990498 - RNA, 13 nt, Human
auugaccugaggc

SEQ ID NO: 2990499 - RNA, 21 nt, Human
auugcaacaggcugggcuuca

SEQ ID NO: 2990500 - RNA, 19 nt, Human
auugcggacagccacggcc

SEQ ID NO: 2990501 - RNA, 18 nt, Human
auugcggacagccacggc

SEQ ID NO: 2990502 - RNA, 16 nt, Human
auugcggacagccacg

SEQ ID NO: 2990503 - RNA, 21 nt, Human
auugcccacgcuggagugcag

SEQ ID NO: 2990504 - RNA, 17 nt, Human
auugcccacgcuggagu

SEQ ID NO: 2990505 - RNA, 23 nt, Human
auugccauuucuuccacaagagc

SEQ ID NO: 2990506 - RNA, 18 nt, Human
auuuaaacacauuaaagg

SEQ ID NO: 2990507 - RNA, 17 nt, Human
auuuaaaagagcaggcc

SEQ ID NO: 2990508 - RNA, 19 nt, Human
auuuaaagcuuauuaaaac

SEQ ID NO: 2990509 - RNA, 17 nt, Human
auuuaaacacauuaaag

SEQ ID NO: 2990510 - RNA, 14 nt, Human
auuuaaaagagcag

SEQ ID NO: 2990511 - RNA, 20 nt, Human
auuuaacagaaauguacagc

SEQ ID NO: 2990512 - RNA, 19 nt, Human
auuuaacagaaauguacag

SEQ ID NO: 2990513 - RNA, 17 nt, Human
auuuaacagaaauguac

SEQ ID NO: 2990514 - RNA, 16 nt, Human
auuuaacagaaaugua

SEQ ID NO: 2990515 - RNA, 15 nt, Human
auuuaacagaaaugu

SEQ ID NO: 2990516 - RNA, 16 nt, Human
auuuacaaaugggaaa

SEQ ID NO: 2990517 - RNA, 15 nt, Human
auuuacaaauguuuu

SEQ ID NO: 2990518 - RNA, 23 nt, Human
auuuaauuuuuuugagacagagu

SEQ ID NO: 2990519 - RNA, 19 nt, Human
auuuaauuuuuuugagaca

SEQ ID NO: 2990520 - RNA, 16 nt, Human
auuuaaccucuaaauu

SEQ ID NO: 2990521 - RNA, 18 nt, Human
auuuaaccucuaaauucu

SEQ ID NO: 2990522 - RNA, 23 nt, Human
auuggcuuuggguugcaggaccu

SEQ ID NO: 2990523 - RNA, 14 nt, Human
auuguauuacaaau

SEQ ID NO: 2990524 - RNA, 13 nt, Human
auugugccccugc

SEQ ID NO: 2990525 - RNA, 23 nt, Human
auuucuuuugccguuauuaaaaa

SEQ ID NO: 2990526 - RNA, 18 nt, Human
auuugagguuaagacaaa

SEQ ID NO: 2990527 - RNA, 22 nt, Human
auuugaggucuguucuuuccaa

SEQ ID NO: 2990528 - RNA, 17 nt, Human
auuugagcagggcucag

SEQ ID NO: 2990529 - RNA, 23 nt, Human
auuugaggucuguucuuuccaaa

SEQ ID NO: 2990530 - RNA, 16 nt, Human
auuugagcagggcuca

SEQ ID NO: 2990531 - RNA, 20 nt, Human
auuucuuuugccguuauuaa

SEQ ID NO: 2990532 - RNA, 20 nt, Human
auuuggugguuucagaaaug

SEQ ID NO: 2990533 - RNA, 18 nt, Human
auuuggugguuucagaaa

SEQ ID NO: 2990534 - RNA, 17 nt, Human
auuugguuuucacauug

SEQ ID NO: 2990535 - RNA, 15 nt, Human
auuugguuuucacau

SEQ ID NO: 2990536 - RNA, 22 nt, Human
auuugguuuucacauuggaaac

SEQ ID NO: 2990537 - RNA, 21 nt, Human
auuugguuuucacauuggaaa

SEQ ID NO: 2990538 - RNA, 18 nt, Human
auuuguaguguuggagaa

SEQ ID NO: 2990539 - RNA, 17 nt, Human
auuuggguuacuauuuc

SEQ ID NO: 2990540 - RNA, 23 nt, Human
auuugguaaggggaauugaggac

SEQ ID NO: 2990541 - RNA, 17 nt, Human
auuuggugguuucagaa

SEQ ID NO: 2990542 - RNA, 16 nt, Human
auuuauuauggcacau

SEQ ID NO: 2990543 - RNA, 22 nt, Human
auuuccugggagcuuuuguaga

SEQ ID NO: 2990544 - RNA, 23 nt, Human
auuuccugggagcuuuuguagaa

SEQ ID NO: 2990545 - RNA, 14 nt, Human
auuuccugugucuu

SEQ ID NO: 2990546 - RNA, 13 nt, Human
auuucuaaaucuc

SEQ ID NO: 2990547 - RNA, 12 nt, Human
auuucuaaaucu

SEQ ID NO: 2990548 - RNA, 21 nt, Human
auuucuaaaucuccaaaauaa

SEQ ID NO: 2990549 - RNA, 20 nt, Human
auuuauuaaaugcccagccc

SEQ ID NO: 2990550 - RNA, 22 nt, Human
auuuauuacuguaagaaaauau

SEQ ID NO: 2990551 - RNA, 13 nt, Human
auuuauuauggca

SEQ ID NO: 2990552 - RNA, 15 nt, Human
auuuuauuaugcaug

SEQ ID NO: 2990553 - RNA, 14 nt, Human
auuuuauuaugcau

SEQ ID NO: 2990554 - RNA, 17 nt, Human
auuuuauuaugcaugaa

SEQ ID NO: 2990555 - RNA, 13 nt, Human
auuuuauuaugca

SEQ ID NO: 2990556 - RNA, 21 nt, Human
auuuguauaaaauaauuuuua

SEQ ID NO: 2990557 - RNA, 15 nt, Human
auuuguaucacaaau

SEQ ID NO: 2990558 - RNA, 14 nt, Human
auuuuaauaauguu

SEQ ID NO: 2990559 - RNA, 12 nt, Human
auuuuaauaaug

SEQ ID NO: 2990560 - RNA, 15 nt, Human
auuuuaauaauguuu

SEQ ID NO: 2990561 - RNA, 11 nt, Human
auuauuaacaa

SEQ ID NO: 2990562 - RNA, 23 nt, Human
auuauuuauuaaaugcccagccc

SEQ ID NO: 2990563 - RNA, 18 nt, Human
auuaucucaaaacugcac

SEQ ID NO: 2990564 - RNA, 23 nt, Human
auuaucucaaaacugcacuguca

SEQ ID NO: 2990565 - RNA, 17 nt, Human
auuauauuuacaaaugg

SEQ ID NO: 2990566 - RNA, 15 nt, Human
auuauauuuacaaau

SEQ ID NO: 2990567 - RNA, 16 nt, Human
auuauauuuacaaaug

SEQ ID NO: 2990568 - RNA, 15 nt, Human
auuaaguaaugauaa

SEQ ID NO: 2990569 - RNA, 13 nt, Human
auuaaguaaugau

SEQ ID NO: 2990570 - RNA, 23 nt, Human
uuuuuuaaaaaagaaacauuugg

SEQ ID NO: 2990571 - RNA, 22 nt, Human
uuuuuguuccacaaguuaaaua

SEQ ID NO: 2990572 - RNA, 20 nt, Human
auuaagagagucuauuuacg

SEQ ID NO: 2990573 - RNA, 18 nt, Human
auuaagagguaagacuua

SEQ ID NO: 2990574 - RNA, 13 nt, Human
auuacauuuguau

SEQ ID NO: 2990575 - RNA, 19 nt, Human
auuaccacagacauacuaa

SEQ ID NO: 2990576 - RNA, 20 nt, Human
auuacauuuguauaaaauaa

SEQ ID NO: 2990577 - RNA, 15 nt, Human
auuacauuuguauaa

SEQ ID NO: 2990578 - RNA, 22 nt, Human
auuaccugaauuuuggcugugu

SEQ ID NO: 2990579 - RNA, 20 nt, Human
auuccacuuauaggaauuga

SEQ ID NO: 2990580 - RNA, 19 nt, Human
auuccccaggaggccagcc

SEQ ID NO: 2990581 - RNA, 16 nt, Human
auuccccaggaggcca

SEQ ID NO: 2990582 - RNA, 22 nt, Human
auuccccacccugaaagcccug

SEQ ID NO: 2990583 - RNA, 20 nt, Human
auuccccagauugcaacagg

SEQ ID NO: 2990584 - RNA, 14 nt, Human
auucagcucugcaa

SEQ ID NO: 2990585 - RNA, 18 nt, Human
auucagcucugcaagaau

SEQ ID NO: 2990586 - RNA, 21 nt, Human
auucaggaagcucagggccug

SEQ ID NO: 2990587 - RNA, 22 nt, Human
auucaggaagcucagggccugg

SEQ ID NO: 2990588 - RNA, 23 nt, Human
auucaggaagcucagggccuggc

SEQ ID NO: 2990589 - RNA, 16 nt, Human
auucaguuguuagugu

SEQ ID NO: 2990590 - RNA, 21 nt, Human
auucaguuguuagugugucuu

SEQ ID NO: 2990591 - RNA, 14 nt, Human
auucaaacagucuc

SEQ ID NO: 2990592 - RNA, 15 nt, Human
auucaaacagucuca

SEQ ID NO: 2990593 - RNA, 12 nt, Human
uuugcacauuaa

SEQ ID NO: 2990594 - RNA, 22 nt, Human
uuugccauguuggccaggcugg

SEQ ID NO: 2990595 - RNA, 16 nt, Human
uuugcacauuaaauga

SEQ ID NO: 2990596 - RNA, 13 nt, Human
uuugcacauuaaa

SEQ ID NO: 2990597 - RNA, 22 nt, Human
uuugcacacuuuggcccagggu

SEQ ID NO: 2990598 - RNA, 15 nt, Human
auggcuauaggugcu

SEQ ID NO: 2990599 - RNA, 12 nt, Human
uuugcucaugga

SEQ ID NO: 2990600 - RNA, 11 nt, Human
uuugcucaugg

SEQ ID NO: 2990601 - RNA, 19 nt, Human
uuugcuaagcauuccaacu

SEQ ID NO: 2990602 - RNA, 10 nt, Human
uuuggccaga

SEQ ID NO: 2990603 - RNA, 12 nt, Human
uuuggccagaag

SEQ ID NO: 2990604 - RNA, 14 nt, Human
uuuggccagaaguc

SEQ ID NO: 2990605 - RNA, 12 nt, Human
uuuggcccaggg

SEQ ID NO: 2990606 - RNA, 14 nt, Human
uuuggggauauuuu

SEQ ID NO: 2990607 - RNA, 22 nt, Human
uuugggaggccaaggugggagg

SEQ ID NO: 2990608 - RNA, 13 nt, Human
uuuggggaagaac

SEQ ID NO: 2990609 - RNA, 23 nt, Human
augucuagaccaggaccucccuc

SEQ ID NO: 2990610 - RNA, 22 nt, Human
augucuauaaaccgaacugaug

SEQ ID NO: 2990611 - RNA, 23 nt, Human
augucucuuuaaugucacaggca

SEQ ID NO: 2990612 - RNA, 15 nt, Human
augucaguuguuauu

SEQ ID NO: 2990613 - RNA, 21 nt, Human
augucaguucugauauggaag

SEQ ID NO: 2990614 - RNA, 16 nt, Human
augucaguucugauau

SEQ ID NO: 2990615 - RNA, 17 nt, Human
augucaguuguuauuua

SEQ ID NO: 2990616 - RNA, 23 nt, Human
auguccaagaagcccaggaaagg

SEQ ID NO: 2990617 - RNA, 19 nt, Human
auguccaagaagcccagga

SEQ ID NO: 2990618 - RNA, 18 nt, Human
auguccaagaagcccagg

SEQ ID NO: 2990619 - RNA, 15 nt, Human
augucagugugacug

SEQ ID NO: 2990620 - RNA, 16 nt, Human
augucagugugacuga

SEQ ID NO: 2990621 - RNA, 21 nt, Human
augucagugugacugaucucu

SEQ ID NO: 2990622 - RNA, 14 nt, Human
augucaguucugau

SEQ ID NO: 2990623 - RNA, 22 nt, Human
uuugggggaaaauuuagaaaua

SEQ ID NO: 2990624 - RNA, 15 nt, Human
auguaucaaugagua

SEQ ID NO: 2990625 - RNA, 15 nt, Human
auguaucugagcagg

SEQ ID NO: 2990626 - RNA, 12 nt, Human
auguauguguaa

SEQ ID NO: 2990627 - RNA, 17 nt, Human
uuuuaagacuuugguua

SEQ ID NO: 2990628 - RNA, 16 nt, Human
uuuuaagaggcagggu

SEQ ID NO: 2990629 - RNA, 15 nt, Human
uuuuaagaggcaggg

SEQ ID NO: 2990630 - RNA, 22 nt, Human
uuuuaagggcccuuuuucaaua

SEQ ID NO: 2990631 - RNA, 15 nt, Human
uuuuaagugcugcau

SEQ ID NO: 2990632 - RNA, 14 nt, Human
uuuuaaaagaauga

SEQ ID NO: 2990633 - RNA, 13 nt, Human
uuuuaaaaaagaa

SEQ ID NO: 2990634 - RNA, 18 nt, Human
uuuguuugaacugauaaa

SEQ ID NO: 2990635 - RNA, 21 nt, Human
uuuuaaaaaacugcugacugu

SEQ ID NO: 2990636 - RNA, 22 nt, Human
uuuguaacuguuuagaugaaug

SEQ ID NO: 2990637 - RNA, 23 nt, Human
uuuguaacuguuuagaugaaugu

SEQ ID NO: 2990638 - RNA, 13 nt, Human
uuuguagagccag

SEQ ID NO: 2990639 - RNA, 17 nt, Human
uuuguagaagucacauu

SEQ ID NO: 2990640 - RNA, 14 nt, Human
uuuguuugaacuga

SEQ ID NO: 2990641 - RNA, 13 nt, Human
uuuguuugaacug

SEQ ID NO: 2990642 - RNA, 12 nt, Human
uuuguuugaacu

SEQ ID NO: 2990643 - RNA, 18 nt, Human
uuugugaggaagccgcug

SEQ ID NO: 2990644 - RNA, 19 nt, Human
uuugugaggaagccgcugg

SEQ ID NO: 2990645 - RNA, 15 nt, Human
uuuuauuauuaacaa

SEQ ID NO: 2990646 - RNA, 23 nt, Human
uuuuccaguaaugagcuuaagaa

SEQ ID NO: 2990647 - RNA, 19 nt, Human
uuuuccagguuuaagcugu

SEQ ID NO: 2990648 - RNA, 16 nt, Human
uuuucuauaauuuaaa

SEQ ID NO: 2990649 - RNA, 23 nt, Human
uuuuauggaggcuuugcauagau

SEQ ID NO: 2990650 - RNA, 19 nt, Human
uuuuauggcacuaguauuu

SEQ ID NO: 2990651 - RNA, 14 nt, Human
uuuuauaauuuugu

SEQ ID NO: 2990652 - RNA, 17 nt, Human
uuuuauaaacuuuaccu

SEQ ID NO: 2990653 - RNA, 14 nt, Human
uuuuauaaacuuua

SEQ ID NO: 2990654 - RNA, 19 nt, Human
uuuuauaaacuuuaccuuu

SEQ ID NO: 2990655 - RNA, 15 nt, Human
auguugacaugggac

SEQ ID NO: 2990656 - RNA, 19 nt, Human
auguucaucaaugaaugaa

SEQ ID NO: 2990657 - RNA, 21 nt, Human
auguucaucauccuaagcuau

SEQ ID NO: 2990658 - RNA, 17 nt, Human
uuuuaagugcugcauuu

SEQ ID NO: 2990659 - RNA, 16 nt, Human
uuuuaagugcugcauu

SEQ ID NO: 2990660 - RNA, 21 nt, Human
uuuuaagugcugcauuuaaaa

SEQ ID NO: 2990661 - RNA, 14 nt, Human
auguuggccaggcu

SEQ ID NO: 2990662 - RNA, 13 nt, Human
auguuggccaggc

SEQ ID NO: 2990663 - RNA, 16 nt, Human
auguuggccaggcugg

SEQ ID NO: 2990664 - RNA, 23 nt, Human
uuuuagaguugauacuacaguuu

SEQ ID NO: 2990665 - RNA, 13 nt, Human
uuuuauaaacuuu

SEQ ID NO: 2990666 - RNA, 12 nt, Human
uuuuauaaacuu

SEQ ID NO: 2990667 - RNA, 13 nt, Human
auuaaagugccca

SEQ ID NO: 2990668 - RNA, 21 nt, Human
auuaaacuuaaucuaaaugga

SEQ ID NO: 2990669 - RNA, 19 nt, Human
auuaaacuuaaucuaaaug

SEQ ID NO: 2990670 - RNA, 16 nt, Human
auuaaacuuaaucuaa

SEQ ID NO: 2990671 - RNA, 17 nt, Human
auuaaacuuaaucuaaa

SEQ ID NO: 2990672 - RNA, 17 nt, Human
auuaaccacuucagcug

SEQ ID NO: 2990673 - RNA, 18 nt, Human
auuaaccacuucagcuga

SEQ ID NO: 2990674 - RNA, 20 nt, Human
auuaaccacuucagcugacu

SEQ ID NO: 2990675 - RNA, 20 nt, Human
auuaacuuuuauaaacuuua

SEQ ID NO: 2990676 - RNA, 19 nt, Human
auuaacuuuuauaaacuuu

SEQ ID NO: 2990677 - RNA, 17 nt, Human
auuaacuuuuauaaacu

SEQ ID NO: 2990678 - RNA, 16 nt, Human
auuaacuuuuauaaac

SEQ ID NO: 2990679 - RNA, 12 nt, Human
auuaacuuuuau

SEQ ID NO: 2990680 - RNA, 23 nt, Human
auuaacuuuuauaaacuuuaccu

SEQ ID NO: 2990681 - RNA, 14 nt, Human
auuaagaaagacua

SEQ ID NO: 2990682 - RNA, 13 nt, Human
auuaagaaagacu

SEQ ID NO: 2990683 - RNA, 19 nt, Human
uuuucucacagaagaugaa

SEQ ID NO: 2990684 - RNA, 14 nt, Human
auguuuuccaugag

SEQ ID NO: 2990685 - RNA, 18 nt, Human
auguuucaaacauauaua

SEQ ID NO: 2990686 - RNA, 20 nt, Human
auguuuauuuaaaagagcag

SEQ ID NO: 2990687 - RNA, 18 nt, Human
auguuuuucuucucccuc

SEQ ID NO: 2990688 - RNA, 17 nt, Human
auguuuuucuucucccu

SEQ ID NO: 2990689 - RNA, 15 nt, Human
auuaaaagaauauuu

SEQ ID NO: 2990690 - RNA, 16 nt, Human
auuaaaagaauauuuu

SEQ ID NO: 2990691 - RNA, 17 nt, Human
aguuuugaagauucuau

SEQ ID NO: 2990692 - RNA, 18 nt, Human
aguuuugaagauucuaug

SEQ ID NO: 2990693 - RNA, 23 nt, Human
aguuuucugagaaagacuauuca

SEQ ID NO: 2990694 - RNA, 19 nt, Human
aguuuucugagaaagacua

SEQ ID NO: 2990695 - RNA, 18 nt, Human
aguuuucugagaaagacu

SEQ ID NO: 2990696 - RNA, 23 nt, Human
aguuuuuauggcuuuugugcauu

SEQ ID NO: 2990697 - RNA, 22 nt, Human
auaaaauaauuuuuauauuuga

SEQ ID NO: 2990698 - RNA, 20 nt, Human
uuaagaaaaaggaugcacag

SEQ ID NO: 2990699 - RNA, 19 nt, Human
uuaagaaaaaggaugcaca

SEQ ID NO: 2990700 - RNA, 21 nt, Human
uuaagaaaaaggaugcacaga

SEQ ID NO: 2990701 - RNA, 12 nt, Human
auaaaauaauuu

SEQ ID NO: 2990702 - RNA, 20 nt, Human
uuaagaacuaaaauguucua

SEQ ID NO: 2990703 - RNA, 16 nt, Human
uuaagaacuaaaaugu

SEQ ID NO: 2990704 - RNA, 19 nt, Human
uuaagaacuaaaauguucu

SEQ ID NO: 2990705 - RNA, 22 nt, Human
uuaagaaagacuaucuaaaugu

SEQ ID NO: 2990706 - RNA, 13 nt, Human
uuaaggguaugau

SEQ ID NO: 2990707 - RNA, 9 nt, Human
uuaaggugg

SEQ ID NO: 2990708 - RNA, 16 nt, Human
uuaagugcugcauuua

SEQ ID NO: 2990709 - RNA, 15 nt, Human
uuaagugcugcauuu

SEQ ID NO: 2990710 - RNA, 19 nt, Human
uuaagugcugcauuuaaaa

SEQ ID NO: 2990711 - RNA, 14 nt, Human
uuaagugcugcauu

SEQ ID NO: 2990712 - RNA, 18 nt, Human
uuaaugaaagacuguaca

SEQ ID NO: 2990713 - RNA, 22 nt, Human
uuaaucugguuuauuuuuguuc

SEQ ID NO: 2990714 - RNA, 19 nt, Human
uuaaugaaagacuguacaa

SEQ ID NO: 2990715 - RNA, 13 nt, Human
uuaaucauuaggu

SEQ ID NO: 2990716 - RNA, 23 nt, Human
uuaaucauuaggugugacugaau

SEQ ID NO: 2990717 - RNA, 22 nt, Human
uuaaucauuaggugugacugaa

SEQ ID NO: 2990718 - RNA, 14 nt, Human
uuaaacacauuaaa

SEQ ID NO: 2990719 - RNA, 15 nt, Human
uuaaaaaucucaaau

SEQ ID NO: 2990720 - RNA, 14 nt, Human
uuaaaaaucucaaa

SEQ ID NO: 2990721 - RNA, 16 nt, Human
uuaaaaaucucaaauu

SEQ ID NO: 2990722 - RNA, 19 nt, Human
uuaaacaugcuguacauac

SEQ ID NO: 2990723 - RNA, 23 nt, Human
uuaaacaugcuguacauacuuuu

SEQ ID NO: 2990724 - RNA, 22 nt, Human
uuaaacaugcuguacauacuuu

SEQ ID NO: 2990725 - RNA, 21 nt, Human
uuaaacaugcuguacauacuu

SEQ ID NO: 2990726 - RNA, 22 nt, Human
uuaaacauauccaaguuugaau

SEQ ID NO: 2990727 - RNA, 15 nt, Human
uuaaauaaugugaaa

SEQ ID NO: 2990728 - RNA, 13 nt, Human
uuaaauagaugac

SEQ ID NO: 2990729 - RNA, 14 nt, Human
uuaaauagaugaca

SEQ ID NO: 2990730 - RNA, 16 nt, Human
uuaaauagaugacauu

SEQ ID NO: 2990731 - RNA, 18 nt, Human
uuaaauaaugugaaacug

SEQ ID NO: 2990732 - RNA, 16 nt, Human
uuaaauaaugugaaac

SEQ ID NO: 2990733 - RNA, 13 nt, Human
uuaaauaauguga

SEQ ID NO: 2990734 - RNA, 16 nt, Human
uuaacagaaauguaca

SEQ ID NO: 2990735 - RNA, 19 nt, Human
uuaacagaaauguacagca

SEQ ID NO: 2990736 - RNA, 20 nt, Human
uuaacagaaauguacagcaa

SEQ ID NO: 2990737 - RNA, 13 nt, Human
uguuucaaacaua

SEQ ID NO: 2990738 - RNA, 23 nt, Human
aguugccagucaccccggccacc

SEQ ID NO: 2990739 - RNA, 19 nt, Human
aguugggcuuccucauagu

SEQ ID NO: 2990740 - RNA, 13 nt, Human
aguugggcuuccu

SEQ ID NO: 2990741 - RNA, 14 nt, Human
aguuuaaauuguaa

SEQ ID NO: 2990742 - RNA, 11 nt, Human
aguuggucccc

SEQ ID NO: 2990743 - RNA, 13 nt, Human
aguuggucccccu

SEQ ID NO: 2990744 - RNA, 17 nt, Human
aguuggucccccuucca

SEQ ID NO: 2990745 - RNA, 13 nt, Human
uuaaaaaaaaucc

SEQ ID NO: 2990746 - RNA, 23 nt, Human
auaaauauugguugggaugacuu

SEQ ID NO: 2990747 - RNA, 15 nt, Human
auaaauaguuuauga

SEQ ID NO: 2990748 - RNA, 14 nt, Human
auaaauaaaaauaa

SEQ ID NO: 2990749 - RNA, 13 nt, Human
auaaauaaaaaua

SEQ ID NO: 2990750 - RNA, 18 nt, Human
uuaauugggcacuauuua

SEQ ID NO: 2990751 - RNA, 13 nt, Human
uuaauugggcacu

SEQ ID NO: 2990752 - RNA, 22 nt, Human
auaacgauaaaagacagugaaa

SEQ ID NO: 2990753 - RNA, 11 nt, Human
auaaauuauuu

SEQ ID NO: 2990754 - RNA, 20 nt, Human
auaaccaguguuguggauuu

SEQ ID NO: 2990755 - RNA, 15 nt, Human
uuacugaacaguaac

SEQ ID NO: 2990756 - RNA, 23 nt, Human
uuacugaacaguaacauagcugu

SEQ ID NO: 2990757 - RNA, 19 nt, Human
uuagaaacacaacuauauu

SEQ ID NO: 2990758 - RNA, 13 nt, Human
uuagacagucccu

SEQ ID NO: 2990759 - RNA, 20 nt, Human
uuagacagagucucacuguu

SEQ ID NO: 2990760 - RNA, 13 nt, Human
uuagacagagucu

SEQ ID NO: 2990761 - RNA, 19 nt, Human
uuacccucauguucuuaau

SEQ ID NO: 2990762 - RNA, 23 nt, Human
auaacuuaaugaaaacaaugcag

SEQ ID NO: 2990763 - RNA, 19 nt, Human
auaacuuaaugaaaacaau

SEQ ID NO: 2990764 - RNA, 18 nt, Human
auaacuuaaugaaaacaa

SEQ ID NO: 2990765 - RNA, 16 nt, Human
auaacuuaaugaaaac

SEQ ID NO: 2990766 - RNA, 15 nt, Human
auaacuuaaugaaaa

SEQ ID NO: 2990767 - RNA, 17 nt, Human
uuagguugugaaugcag

SEQ ID NO: 2990768 - RNA, 13 nt, Human
uuagguugugaau

SEQ ID NO: 2990769 - RNA, 12 nt, Human
uuagguugugaa

SEQ ID NO: 2990770 - RNA, 22 nt, Human
uuaguuugcaguuacacuaaaa

SEQ ID NO: 2990771 - RNA, 15 nt, Human
uuaguuucuccaagc

SEQ ID NO: 2990772 - RNA, 15 nt, Human
uuaggugaggaagca

SEQ ID NO: 2990773 - RNA, 20 nt, Human
uuagggaaggauacaaaagc

SEQ ID NO: 2990774 - RNA, 16 nt, Human
uuaggugugacugaau

SEQ ID NO: 2990775 - RNA, 16 nt, Human
uuaggugaggaagcaa

SEQ ID NO: 2990776 - RNA, 21 nt, Human
uuaggugugacugaauuucuu

SEQ ID NO: 2990777 - RNA, 18 nt, Human
uuagguuggcaaaaaggc

SEQ ID NO: 2990778 - RNA, 18 nt, Human
uuagcaaauucuguuuuu

SEQ ID NO: 2990779 - RNA, 14 nt, Human
uuagcggagacgga

SEQ ID NO: 2990780 - RNA, 18 nt, Human
uuagccaagugugguaga

SEQ ID NO: 2990781 - RNA, 18 nt, Human
auaauccuaaacauauga

SEQ ID NO: 2990782 - RNA, 14 nt, Human
auaaucucugauuc

SEQ ID NO: 2990783 - RNA, 23 nt, Human
auaaucucugauucccugauuua

SEQ ID NO: 2990784 - RNA, 19 nt, Human
auaaucucugauucccuga

SEQ ID NO: 2990785 - RNA, 22 nt, Human
auaauugacaggauuauuggaa

SEQ ID NO: 2990786 - RNA, 15 nt, Human
auaaugaaugaaaca

SEQ ID NO: 2990787 - RNA, 15 nt, Human
auaaugcgugcauac

SEQ ID NO: 2990788 - RNA, 20 nt, Human
auaauacaccacuacauucu

SEQ ID NO: 2990789 - RNA, 18 nt, Human
auaauacaccacuacauu

SEQ ID NO: 2990790 - RNA, 12 nt, Human
auaauacaccac

SEQ ID NO: 2990791 - RNA, 15 nt, Human
uguuuagaugaaugu

SEQ ID NO: 2990792 - RNA, 20 nt, Human
uguuuagaugaaugucaguu

SEQ ID NO: 2990793 - RNA, 20 nt, Human
uguuuagauaauacaccacu

SEQ ID NO: 2990794 - RNA, 16 nt, Human
uguugucugcaacucu

SEQ ID NO: 2990795 - RNA, 13 nt, Human
uguugucugcaac

SEQ ID NO: 2990796 - RNA, 15 nt, Human
uguuuaugagaaacu

SEQ ID NO: 2990797 - RNA, 14 nt, Human
uguuuauugucaaa

SEQ ID NO: 2990798 - RNA, 23 nt, Human
aguucuauuuauuugugagacug

SEQ ID NO: 2990799 - RNA, 13 nt, Human
aguucuaguguuu

SEQ ID NO: 2990800 - RNA, 19 nt, Human
aguucggugagcuacaaau

SEQ ID NO: 2990801 - RNA, 24 nt, Human
aguucaaucuggauucauauuuaa

SEQ ID NO: 2990802 - RNA, 16 nt, Human
aguucaauucucauuu

SEQ ID NO: 2990803 - RNA, 23 nt, Human
aguuccucauuagcauuuugcua

SEQ ID NO: 2990804 - RNA, 13 nt, Human
uguuauuuauuga

SEQ ID NO: 2990805 - RNA, 15 nt, Human
uguuauuuauugaaa

SEQ ID NO: 2990806 - RNA, 17 nt, Human
uguuauuuauugaaaug

SEQ ID NO: 2990807 - RNA, 18 nt, Human
uguuauuuauugaaauga

SEQ ID NO: 2990808 - RNA, 19 nt, Human
uguuauuuauugaaaugau

SEQ ID NO: 2990809 - RNA, 18 nt, Human
uguucuagcauggcugcc

SEQ ID NO: 2990810 - RNA, 18 nt, Human
uguucuuaguuugcaguu

SEQ ID NO: 2990811 - RNA, 15 nt, Human
aguggaguuacugaa

SEQ ID NO: 2990812 - RNA, 16 nt, Human
aguuacugaacaguaa

SEQ ID NO: 2990813 - RNA, 16 nt, Human
aguguuggagaagaac

SEQ ID NO: 2990814 - RNA, 14 nt, Human
aguguuggagaaga

SEQ ID NO: 2990815 - RNA, 18 nt, Human
aguguuggagaagaacug

SEQ ID NO: 2990816 - RNA, 17 nt, Human
aguguuggagaagaacu

SEQ ID NO: 2990817 - RNA, 22 nt, Human
uguucuugguuuguaaauuaac

SEQ ID NO: 2990818 - RNA, 20 nt, Human
uguucuugguuuguaaauua

SEQ ID NO: 2990819 - RNA, 19 nt, Human
uguucuuucacccuuuucu

SEQ ID NO: 2990820 - RNA, 13 nt, Human
uguugcccaggcu

SEQ ID NO: 2990821 - RNA, 15 nt, Human
uguugcccaggcugg

SEQ ID NO: 2990822 - RNA, 12 nt, Human
agugcuuggccc

SEQ ID NO: 2990823 - RNA, 14 nt, Human
agugcuuggcccag

SEQ ID NO: 2990824 - RNA, 15 nt, Human
agugcuuggcccagg

SEQ ID NO: 2990825 - RNA, 16 nt, Human
agugcuuggcccagga

SEQ ID NO: 2990826 - RNA, 18 nt, Human
agugcuuggcccaggagu

SEQ ID NO: 2990827 - RNA, 19 nt, Human
agugcuuggcccaggaguu

SEQ ID NO: 2990828 - RNA, 20 nt, Human
agugcuuggcccaggaguuu

SEQ ID NO: 2990829 - RNA, 16 nt, Human
uguggucccaccccac

SEQ ID NO: 2990830 - RNA, 16 nt, Human
agugcuuccaaggaug

SEQ ID NO: 2990831 - RNA, 20 nt, Human
ugugguguuuccuggcacug

SEQ ID NO: 2990832 - RNA, 19 nt, Human
ugugucagcauagaaguaa

SEQ ID NO: 2990833 - RNA, 12 nt, Human
ugugguuucauu

SEQ ID NO: 2990834 - RNA, 23 nt, Human
ugugguuauaacuuaaugaaaac

SEQ ID NO: 2990835 - RNA, 20 nt, Human
ugugguuauaacuuaaugaa

SEQ ID NO: 2990836 - RNA, 20 nt, Human
agugcugcauuuaaaagaua

SEQ ID NO: 2990837 - RNA, 17 nt, Human
agugccuuacacaaugg

SEQ ID NO: 2990838 - RNA, 15 nt, Human
agugccuuacacaau

SEQ ID NO: 2990839 - RNA, 21 nt, Human
agugccuguaaucacagcuac

SEQ ID NO: 2990840 - RNA, 20 nt, Human
agugccucucccugcugcuc

SEQ ID NO: 2990841 - RNA, 19 nt, Human
agugccucucccugcugcu

SEQ ID NO: 2990842 - RNA, 23 nt, Human
agugccucucccugcugcuccua

SEQ ID NO: 2990843 - RNA, 22 nt, Human
agugccucucccugcugcuccu

SEQ ID NO: 2990844 - RNA, 19 nt, Human
agugcugggauuacaggug

SEQ ID NO: 2990845 - RNA, 22 nt, Human
agugcugcauuuaaaagauaca

SEQ ID NO: 2990846 - RNA, 20 nt, Human
agugcugggauuacaagcgu

SEQ ID NO: 2990847 - RNA, 13 nt, Human
uguuaauauuuua

SEQ ID NO: 2990848 - RNA, 21 nt, Human
uguuaacauggacaugaucuu

SEQ ID NO: 2990849 - RNA, 22 nt, Human
agugcuuuaccaauugaaguaa

SEQ ID NO: 2990850 - RNA, 19 nt, Human
uguuaaugauagcuacugu

SEQ ID NO: 2990851 - RNA, 18 nt, Human
aguggaaaaauagccugc

SEQ ID NO: 2990852 - RNA, 19 nt, Human
aguggaaaaauagccugcc

SEQ ID NO: 2990853 - RNA, 11 nt, Human
aguggaaaaau

SEQ ID NO: 2990854 - RNA, 14 nt, Human
uguguuaugaagca

SEQ ID NO: 2990855 - RNA, 23 nt, Human
uguguuaucacccagaagaaaau

SEQ ID NO: 2990856 - RNA, 19 nt, Human
ugugucagguggggcagcu

SEQ ID NO: 2990857 - RNA, 17 nt, Human
ugugucagguggggcag

SEQ ID NO: 2990858 - RNA, 13 nt, Human
ugugucucuuggu

SEQ ID NO: 2990859 - RNA, 18 nt, Human
ugugcucuggacaggcau

SEQ ID NO: 2990860 - RNA, 16 nt, Human
ugugcucuggacaggc

SEQ ID NO: 2990861 - RNA, 19 nt, Human
ugugcucuggacaggcaug

SEQ ID NO: 2990862 - RNA, 12 nt, Human
ugugcugcccug

SEQ ID NO: 2990863 - RNA, 13 nt, Human
ugugcugcccugc

SEQ ID NO: 2990864 - RNA, 14 nt, Human
ugugcugcccugcc

SEQ ID NO: 2990865 - RNA, 15 nt, Human
ugugcugcccugccc

SEQ ID NO: 2990866 - RNA, 21 nt, Human
ugugcccuaaaguguauuuuu

SEQ ID NO: 2990867 - RNA, 20 nt, Human
ugugcccuaaaguguauuuu

SEQ ID NO: 2990868 - RNA, 19 nt, Human
agucucacuguugcccagg

SEQ ID NO: 2990869 - RNA, 18 nt, Human
agucucacuguugcccag

SEQ ID NO: 2990870 - RNA, 20 nt, Human
agucucacuguugcccaggc

SEQ ID NO: 2990871 - RNA, 15 nt, Human
ugugcucuggacagg

SEQ ID NO: 2990872 - RNA, 23 nt, Human
ugugcucugaucauccacugugc

SEQ ID NO: 2990873 - RNA, 12 nt, Human
ugugcucugauc

SEQ ID NO: 2990874 - RNA, 22 nt, Human
ugugcucugaucauccacugug

SEQ ID NO: 2990875 - RNA, 14 nt, Human
agugcaguauagaa

SEQ ID NO: 2990876 - RNA, 15 nt, Human
agugcaguauagaau

SEQ ID NO: 2990877 - RNA, 14 nt, Human
agugcccacaggau

SEQ ID NO: 2990878 - RNA, 16 nt, Human
agugccaaaaacaaca

SEQ ID NO: 2990879 - RNA, 21 nt, Human
agugccaaagaagcagaccau

SEQ ID NO: 2990880 - RNA, 14 nt, Human
agugccaaaaacaa

SEQ ID NO: 2990881 - RNA, 24 nt, Human
agugauucuccugccucagccucc

SEQ ID NO: 2990882 - RNA, 22 nt, Human
agugauucuccugccucagccu

SEQ ID NO: 2990883 - RNA, 16 nt, Human
agugagucgaggacag

SEQ ID NO: 2990884 - RNA, 21 nt, Human
agugcaaauugucacaggaca

SEQ ID NO: 2990885 - RNA, 18 nt, Human
agugcaaauugucacagg

SEQ ID NO: 2990886 - RNA, 14 nt, Human
agugcaaauuguca

SEQ ID NO: 2990887 - RNA, 17 nt, Human
agguagaauguuuucaa

SEQ ID NO: 2990888 - RNA, 23 nt, Human
agguagaaauaucugaaaaugua

SEQ ID NO: 2990889 - RNA, 21 nt, Human
agguaugcaaucaaaucugcu

SEQ ID NO: 2990890 - RNA, 19 nt, Human
agguagaaauaucugaaaa

SEQ ID NO: 2990891 - RNA, 17 nt, Human
agguagaaauaucugaa

SEQ ID NO: 2990892 - RNA, 23 nt, Human
agguacuucaaauccuugaagau

SEQ ID NO: 2990893 - RNA, 17 nt, Human
aggguuggccccugccc

SEQ ID NO: 2990894 - RNA, 23 nt, Human
aggguuggccccugcccggcugc

SEQ ID NO: 2990895 - RNA, 18 nt, Human
aggguuggccccugcccg

SEQ ID NO: 2990896 - RNA, 20 nt, Human
aggucauuuuuuuuaagaaa

SEQ ID NO: 2990897 - RNA, 17 nt, Human
aggucauuuuuuuuaag

SEQ ID NO: 2990898 - RNA, 12 nt, Human
aggucagagccu

SEQ ID NO: 2990899 - RNA, 13 nt, Human
aggguuauaauaa

SEQ ID NO: 2990900 - RNA, 22 nt, Human
aggguguccggucccuguccca

SEQ ID NO: 2990901 - RNA, 21 nt, Human
aggguggugaccucugccuga

SEQ ID NO: 2990902 - RNA, 17 nt, Human
uggucugacccacugcu

SEQ ID NO: 2990903 - RNA, 16 nt, Human
uggucugacccacugc

SEQ ID NO: 2990904 - RNA, 16 nt, Human
uggucccaccccacac

SEQ ID NO: 2990905 - RNA, 16 nt, Human
uggucucaaacucuug

SEQ ID NO: 2990906 - RNA, 13 nt, Human
uggucccacccca

SEQ ID NO: 2990907 - RNA, 23 nt, Human
uggucucaaacucuugaccucag

SEQ ID NO: 2990908 - RNA, 17 nt, Human
uggucucaaacucuuga

SEQ ID NO: 2990909 - RNA, 22 nt, Human
uggucagauuugaacucuucaa

SEQ ID NO: 2990910 - RNA, 18 nt, Human
uggucaccaaaucagcug

SEQ ID NO: 2990911 - RNA, 14 nt, Human
uggucccaccccac

SEQ ID NO: 2990912 - RNA, 15 nt, Human
uggucccaccccaca

SEQ ID NO: 2990913 - RNA, 20 nt, Human
ugguaaggggaauugaggac

SEQ ID NO: 2990914 - RNA, 16 nt, Human
ugguacuaacuuuccu

SEQ ID NO: 2990915 - RNA, 15 nt, Human
ugggugcuuggagga

SEQ ID NO: 2990916 - RNA, 19 nt, Human
ugggugcuuggaggaagga

SEQ ID NO: 2990917 - RNA, 22 nt, Human
ugggugcuuggaggaaggaaac

SEQ ID NO: 2990918 - RNA, 22 nt, Human
uggguggcaccagcagccugga

SEQ ID NO: 2990919 - RNA, 21 nt, Human
agggucucacucugucgccca

SEQ ID NO: 2990920 - RNA, 22 nt, Human
agggucucacucugucgcccag

SEQ ID NO: 2990921 - RNA, 22 nt, Human
aggguggccacaccucuauccc

SEQ ID NO: 2990922 - RNA, 23 nt, Human
aggggagcaaaaucgaugcagug

SEQ ID NO: 2990923 - RNA, 19 nt, Human
uggggucacucuggcagcu

SEQ ID NO: 2990924 - RNA, 20 nt, Human
aggggugggacacccuguga

SEQ ID NO: 2990925 - RNA, 22 nt, Human
aggggugggacacccugugaug

SEQ ID NO: 2990926 - RNA, 17 nt, Human
aggggguggccucccaa

SEQ ID NO: 2990927 - RNA, 18 nt, Human
aggggguggccucccaac

SEQ ID NO: 2990928 - RNA, 15 nt, Human
aggggguggccuccc

SEQ ID NO: 2990929 - RNA, 23 nt, Human
agggucucacuauguugcccagg

SEQ ID NO: 2990930 - RNA, 22 nt, Human
agggucucacuauguugcccag

SEQ ID NO: 2990931 - RNA, 21 nt, Human
agggucucacuauguugccca

SEQ ID NO: 2990932 - RNA, 20 nt, Human
agggucucacuauguugccc

SEQ ID NO: 2990933 - RNA, 24 nt, Human
agggguucccuuuuuuggcugcug

SEQ ID NO: 2990934 - RNA, 15 nt, Human
ugggcacaucauuuc

SEQ ID NO: 2990935 - RNA, 20 nt, Human
ugggcaacccccagccugcu

SEQ ID NO: 2990936 - RNA, 17 nt, Human
ugggcaacccccagccu

SEQ ID NO: 2990937 - RNA, 20 nt, Human
ugggcacaucauuucaagaa

SEQ ID NO: 2990938 - RNA, 23 nt, Human
ugggccaccgccuugcccagccu

SEQ ID NO: 2990939 - RNA, 17 nt, Human
ugggccaccgccuugcc

SEQ ID NO: 2990940 - RNA, 16 nt, Human
ugggccaccgccuugc

SEQ ID NO: 2990941 - RNA, 13 nt, Human
ugggccaggagcc

SEQ ID NO: 2990942 - RNA, 14 nt, Human
ugggccaggagccu

SEQ ID NO: 2990943 - RNA, 16 nt, Human
ugggccaggagccucc

SEQ ID NO: 2990944 - RNA, 20 nt, Human
ugggcccaaugcacuuuguu

SEQ ID NO: 2990945 - RNA, 16 nt, Human
ugggcaacccccagcc

SEQ ID NO: 2990946 - RNA, 15 nt, Human
ugggagguuaaaaag

SEQ ID NO: 2990947 - RNA, 18 nt, Human
ugggaggucaaggcugca

SEQ ID NO: 2990948 - RNA, 19 nt, Human
ugggaggucaaggcugcag

SEQ ID NO: 2990949 - RNA, 20 nt, Human
ugggaggucaaggcugcagu

SEQ ID NO: 2990950 - RNA, 23 nt, Human
ugggaggucaaggcugcagugag

SEQ ID NO: 2990951 - RNA, 17 nt, Human
ugggaggucaaggcugc

SEQ ID NO: 2990952 - RNA, 17 nt, Human
aggccuuccccuggcac

SEQ ID NO: 2990953 - RNA, 19 nt, Human
aggccuuccccuggcacug

SEQ ID NO: 2990954 - RNA, 17 nt, Human
agggcagggacaggaua

SEQ ID NO: 2990955 - RNA, 18 nt, Human
agggcccagagagggugg

SEQ ID NO: 2990956 - RNA, 23 nt, Human
agggcccagagaggguggugacc

SEQ ID NO: 2990957 - RNA, 15 nt, Human
agggagggcuucugc

SEQ ID NO: 2990958 - RNA, 19 nt, Human
agggagugacagaggcagc

SEQ ID NO: 2990959 - RNA, 18 nt, Human
agggagugacagaggcag

SEQ ID NO: 2990960 - RNA, 17 nt, Human
agggagugacagaggca

SEQ ID NO: 2990961 - RNA, 17 nt, Human
agggaggugaccccagg

SEQ ID NO: 2990962 - RNA, 14 nt, Human
uggggcccugccuc

SEQ ID NO: 2990963 - RNA, 12 nt, Human
uggggagaaagu

SEQ ID NO: 2990964 - RNA, 23 nt, Human
uggggaccucaggccugggggcu

SEQ ID NO: 2990965 - RNA, 18 nt, Human
uggggcggugagagggga

SEQ ID NO: 2990966 - RNA, 15 nt, Human
uggggcccugccucc

SEQ ID NO: 2990967 - RNA, 16 nt, Human
uggggcccugccuccu

SEQ ID NO: 2990968 - RNA, 20 nt, Human
ugggguacccacugcucugg

SEQ ID NO: 2990969 - RNA, 16 nt, Human
ugggguacccacugcu

SEQ ID NO: 2990970 - RNA, 15 nt, Human
ugggguacccacugc

SEQ ID NO: 2990971 - RNA, 17 nt, Human
uggggucacucuggcag

SEQ ID NO: 2990972 - RNA, 18 nt, Human
uggggucacucuggcagc

SEQ ID NO: 2990973 - RNA, 14 nt, Human
ugggguacccacug

SEQ ID NO: 2990974 - RNA, 20 nt, Human
uggggcugcaccggcuggcc

SEQ ID NO: 2990975 - RNA, 15 nt, Human
uggggaaugaagaua

SEQ ID NO: 2990976 - RNA, 14 nt, Human
uggggaaugaagau

SEQ ID NO: 2990977 - RNA, 18 nt, Human
ugggcuggguucuaccca

SEQ ID NO: 2990978 - RNA, 19 nt, Human
ugggcuggguucuacccag

SEQ ID NO: 2990979 - RNA, 17 nt, Human
uggggaccagagcugcc

SEQ ID NO: 2990980 - RNA, 18 nt, Human
uggggaccagagcugcca

SEQ ID NO: 2990981 - RNA, 13 nt, Human
uggggaccucagg

SEQ ID NO: 2990982 - RNA, 14 nt, Human
uggggaccagagcu

SEQ ID NO: 2990983 - RNA, 15 nt, Human
uggggaccagagcug

SEQ ID NO: 2990984 - RNA, 20 nt, Human
ugggcucccuucccaccucu

SEQ ID NO: 2990985 - RNA, 18 nt, Human
ugggcucccuucccaccu

SEQ ID NO: 2990986 - RNA, 19 nt, Human
ugggcucccuucccaccuc

SEQ ID NO: 2990987 - RNA, 15 nt, Human
ugggcucccuuccca

SEQ ID NO: 2990988 - RNA, 23 nt, Human
agggcuucugccauuucugagau

SEQ ID NO: 2990989 - RNA, 15 nt, Human
ugucaguauuucaac

SEQ ID NO: 2990990 - RNA, 23 nt, Human
ugucauuugcuggagcucugccc

SEQ ID NO: 2990991 - RNA, 19 nt, Human
ugucagcugaaccugggua

SEQ ID NO: 2990992 - RNA, 19 nt, Human
agucacugagacagcccgg

SEQ ID NO: 2990993 - RNA, 18 nt, Human
agucacugagacagcccg

SEQ ID NO: 2990994 - RNA, 16 nt, Human
ugucagcugaaccugg

SEQ ID NO: 2990995 - RNA, 22 nt, Human
aguauuucuaugaaauauuaug

SEQ ID NO: 2990996 - RNA, 20 nt, Human
agucacauuccugaacagga

SEQ ID NO: 2990997 - RNA, 18 nt, Human
agucacauuccugaacag

SEQ ID NO: 2990998 - RNA, 19 nt, Human
agucacauuccugaacagg

SEQ ID NO: 2990999 - RNA, 13 nt, Human
agucaccaagccc

SEQ ID NO: 2991000 - RNA, 15 nt, Human
aguauuucuaugaaa

SEQ ID NO: 2991001 - RNA, 13 nt, Human
aguauuucuauga

SEQ ID NO: 2991002 - RNA, 21 nt, Human
ugucaauaaaauccauacauu

SEQ ID NO: 2991003 - RNA, 15 nt, Human
ugucaagccauaauu

SEQ ID NO: 2991004 - RNA, 19 nt, Human
ugucaagagggucugagga

SEQ ID NO: 2991005 - RNA, 14 nt, Human
uguauuuuuuuacu

SEQ ID NO: 2991006 - RNA, 20 nt, Human
uguauuuuugucaauuacca

SEQ ID NO: 2991007 - RNA, 16 nt, Human
uguauuuuugucaauu

SEQ ID NO: 2991008 - RNA, 14 nt, Human
uguauuuuugucaa

SEQ ID NO: 2991009 - RNA, 17 nt, Human
aguaggaagacuuugga

SEQ ID NO: 2991010 - RNA, 18 nt, Human
aguaggaagacuuuggaa

SEQ ID NO: 2991011 - RNA, 19 nt, Human
aguaggaagacuuuggaaa

SEQ ID NO: 2991012 - RNA, 22 nt, Human
aguaggaagacuuuggaaagac

SEQ ID NO: 2991013 - RNA, 20 nt, Human
ugucaaucagccuaguugau

SEQ ID NO: 2991014 - RNA, 16 nt, Human
aguaggaagacuuugg

SEQ ID NO: 2991015 - RNA, 13 nt, Human
aguagucagacug

SEQ ID NO: 2991016 - RNA, 23 nt, Human
agucagacuggauaguccgucuc

SEQ ID NO: 2991017 - RNA, 15 nt, Human
agucaggaaagagaa

SEQ ID NO: 2991018 - RNA, 16 nt, Human
agucaggaaagagaac

SEQ ID NO: 2991019 - RNA, 22 nt, Human
agucagaaguuucugccgcagc

SEQ ID NO: 2991020 - RNA, 12 nt, Human
ugucgggcauga

SEQ ID NO: 2991021 - RNA, 15 nt, Human
ugucgcccagucugg

SEQ ID NO: 2991022 - RNA, 14 nt, Human
ugucgcccagucug

SEQ ID NO: 2991023 - RNA, 14 nt, Human
ugucgggcaugaca

SEQ ID NO: 2991024 - RNA, 15 nt, Human
ugucgggcaugacac

SEQ ID NO: 2991025 - RNA, 22 nt, Human
uguccuaaugcuugcugcugau

SEQ ID NO: 2991026 - RNA, 16 nt, Human
uguccuacccacccuc

SEQ ID NO: 2991027 - RNA, 17 nt, Human
ugucccuuuuccuuuuu

SEQ ID NO: 2991028 - RNA, 13 nt, Human
uguccgagcuuug

SEQ ID NO: 2991029 - RNA, 14 nt, Human
uguccgagcuuuga

SEQ ID NO: 2991030 - RNA, 12 nt, Human
agucccugccaa

SEQ ID NO: 2991031 - RNA, 23 nt, Human
aguccgaaagggacuuggaagcu

SEQ ID NO: 2991032 - RNA, 17 nt, Human
agucucacuguugccca

SEQ ID NO: 2991033 - RNA, 16 nt, Human
agucucacuguugccc

SEQ ID NO: 2991034 - RNA, 23 nt, Human
uguaauuaugguuaguagaggua

SEQ ID NO: 2991035 - RNA, 23 nt, Human
uguaauuaaguacuauguaucaa

SEQ ID NO: 2991036 - RNA, 15 nt, Human
uguaaguaaacgguc

SEQ ID NO: 2991037 - RNA, 14 nt, Human
agguuggugggggc

SEQ ID NO: 2991038 - RNA, 17 nt, Human
uguaacuuucugaaaua

SEQ ID NO: 2991039 - RNA, 17 nt, Human
aggugguuauggagagg

SEQ ID NO: 2991040 - RNA, 23 nt, Human
aggucuugaacuccuggccucaa

SEQ ID NO: 2991041 - RNA, 16 nt, Human
aggugcacaagcucca

SEQ ID NO: 2991042 - RNA, 17 nt, Human
aggugcacaagcuccaa

SEQ ID NO: 2991043 - RNA, 18 nt, Human
aggugcacaagcuccaag

SEQ ID NO: 2991044 - RNA, 20 nt, Human
aggugcacaagcuccaagcu

SEQ ID NO: 2991045 - RNA, 15 nt, Human
aggugcacaagcucc

SEQ ID NO: 2991046 - RNA, 20 nt, Human
aggugggauccuccaggugc

SEQ ID NO: 2991047 - RNA, 21 nt, Human
aggugcacaagcuccaagcuc

SEQ ID NO: 2991048 - RNA, 21 nt, Human
aguagagguacacuugugaau

SEQ ID NO: 2991049 - RNA, 20 nt, Human
aguagagguacacuugugaa

SEQ ID NO: 2991050 - RNA, 22 nt, Human
aguagagguacacuugugaaua

SEQ ID NO: 2991051 - RNA, 14 nt, Human
aguagagguacacu

SEQ ID NO: 2991052 - RNA, 12 nt, Human
aguagagacagg

SEQ ID NO: 2991053 - RNA, 19 nt, Human
aguagauaggccaugggca

SEQ ID NO: 2991054 - RNA, 15 nt, Human
aguagaucaugcaua

SEQ ID NO: 2991055 - RNA, 18 nt, Human
uguaggaagguuaauguu

SEQ ID NO: 2991056 - RNA, 18 nt, Human
aguagaucaugcauagag

SEQ ID NO: 2991057 - RNA, 20 nt, Human
uguaggaagguuaauguuca

SEQ ID NO: 2991058 - RNA, 14 nt, Human
aguacacuguuuca

SEQ ID NO: 2991059 - RNA, 20 nt, Human
aguacacuguuucaaacuuu

SEQ ID NO: 2991060 - RNA, 16 nt, Human
aguacacuguuucaaa

SEQ ID NO: 2991061 - RNA, 22 nt, Human
aguaauuuggaaauuagguuga

SEQ ID NO: 2991062 - RNA, 14 nt, Human
aguaauuuggaaau

SEQ ID NO: 2991063 - RNA, 15 nt, Human
uguacuuuuaagacu

SEQ ID NO: 2991064 - RNA, 18 nt, Human
uguacuuuuaagacuuug

SEQ ID NO: 2991065 - RNA, 13 nt, Human
uguagagugggag

SEQ ID NO: 2991066 - RNA, 14 nt, Human
uguagagugggagc

SEQ ID NO: 2991067 - RNA, 16 nt, Human
uguagaggagaaacug

SEQ ID NO: 2991068 - RNA, 18 nt, Human
uguagaggagaaacugga

SEQ ID NO: 2991069 - RNA, 17 nt, Human
uguaccacuuuugcaaa

SEQ ID NO: 2991070 - RNA, 16 nt, Human
uguaccacuuuugcaa

SEQ ID NO: 2991071 - RNA, 14 nt, Human
uguaauuugugaua

SEQ ID NO: 2991072 - RNA, 20 nt, Human
aguaagccgugauuuucauu

SEQ ID NO: 2991073 - RNA, 15 nt, Human
aguaaaaccacagca

SEQ ID NO: 2991074 - RNA, 11 nt, Human
agguuuuccug

SEQ ID NO: 2991075 - RNA, 17 nt, Human
agguuuucuuuuaagaa

SEQ ID NO: 2991076 - RNA, 19 nt, Human
aguaauaugcacacauuuu

SEQ ID NO: 2991077 - RNA, 18 nt, Human
aguaauaugcacacauuu

SEQ ID NO: 2991078 - RNA, 20 nt, Human
aguaauaugcacacauuuuu

SEQ ID NO: 2991079 - RNA, 17 nt, Human
aguaauaugcacacauu

SEQ ID NO: 2991080 - RNA, 17 nt, Human
aggaaugcaaagaugaa

SEQ ID NO: 2991081 - RNA, 15 nt, Human
aggaaugcaaagaug

SEQ ID NO: 2991082 - RNA, 13 nt, Human
ugcugcccugccc

SEQ ID NO: 2991083 - RNA, 16 nt, Human
ugcugcccugcccacc

SEQ ID NO: 2991084 - RNA, 17 nt, Human
ugcugcccugcccaccu

SEQ ID NO: 2991085 - RNA, 18 nt, Human
ugcugcccugcccaccug

SEQ ID NO: 2991086 - RNA, 11 nt, Human
ugcugcccugu

SEQ ID NO: 2991087 - RNA, 12 nt, Human
ugcugcccugcc

SEQ ID NO: 2991088 - RNA, 19 nt, Human
ugcugcccugcccaccugg

SEQ ID NO: 2991089 - RNA, 21 nt, Human
ugcugcccugcccaccuggcc

SEQ ID NO: 2991090 - RNA, 22 nt, Human
ugcuguauuuuaaaagaaugau

SEQ ID NO: 2991091 - RNA, 21 nt, Human
ugcuguauuuuaaaagaauga

SEQ ID NO: 2991092 - RNA, 13 nt, Human
ugcuguauuuuaa

SEQ ID NO: 2991093 - RNA, 17 nt, Human
ugcugggauuacaggug

SEQ ID NO: 2991094 - RNA, 21 nt, Human
ugcugggauuacaagcgugag

SEQ ID NO: 2991095 - RNA, 21 nt, Human
ugcuggcuguuggcugggggc

SEQ ID NO: 2991096 - RNA, 19 nt, Human
ugcuggcuguuggcugggg

SEQ ID NO: 2991097 - RNA, 19 nt, Human
ugcugggauuacaagcgug

SEQ ID NO: 2991098 - RNA, 18 nt, Human
ugcuggcuguuggcuggg

SEQ ID NO: 2991099 - RNA, 17 nt, Human
aggacacugauaugggu

SEQ ID NO: 2991100 - RNA, 16 nt, Human
ugcuuccagugaggcu

SEQ ID NO: 2991101 - RNA, 18 nt, Human
aggacacuaaccacgcug

SEQ ID NO: 2991102 - RNA, 20 nt, Human
ugcuucaaggauccugagcc

SEQ ID NO: 2991103 - RNA, 21 nt, Human
ugcuucaaggauccugagcca

SEQ ID NO: 2991104 - RNA, 23 nt, Human
ugcuucaaggauccugagccaga

SEQ ID NO: 2991105 - RNA, 17 nt, Human
ugcugucccuuuuccuu

SEQ ID NO: 2991106 - RNA, 19 nt, Human
ugcugucccuuacgugagu

SEQ ID NO: 2991107 - RNA, 15 nt, Human
ugcugucccuuuucc

SEQ ID NO: 2991108 - RNA, 17 nt, Human
ugcugucccuuacguga

SEQ ID NO: 2991109 - RNA, 15 nt, Human
aggaaaucaccgaaa

SEQ ID NO: 2991110 - RNA, 19 nt, Human
aggaaaucaccgaaaacgu

SEQ ID NO: 2991111 - RNA, 23 nt, Human
aggaaaucaaauaugcaaagcac

SEQ ID NO: 2991112 - RNA, 16 nt, Human
aggaagcacaugccuc

SEQ ID NO: 2991113 - RNA, 17 nt, Human
aggaagcacaugccucu

SEQ ID NO: 2991114 - RNA, 11 nt, Human
aggaagcacau

SEQ ID NO: 2991115 - RNA, 12 nt, Human
aggaaauauuua

SEQ ID NO: 2991116 - RNA, 15 nt, Human
aggaaaggcuccagg

SEQ ID NO: 2991117 - RNA, 16 nt, Human
aggaaaggcuccagga

SEQ ID NO: 2991118 - RNA, 13 nt, Human
aggaaaggcucca

SEQ ID NO: 2991119 - RNA, 14 nt, Human
aggaaaggcuccag

SEQ ID NO: 2991120 - RNA, 12 nt, Human
aggaagcucagg

SEQ ID NO: 2991121 - RNA, 20 nt, Human
aggaaggaaacccagcucug

SEQ ID NO: 2991122 - RNA, 22 nt, Human
aggaaggaaacccagcucuggu

SEQ ID NO: 2991123 - RNA, 23 nt, Human
aggaaggaaacccagcucugguc

SEQ ID NO: 2991124 - RNA, 18 nt, Human
aggaagccagcaggcucu

SEQ ID NO: 2991125 - RNA, 18 nt, Human
aggaagccgcuggggcca

SEQ ID NO: 2991126 - RNA, 19 nt, Human
aggaagccgcuggggccag

SEQ ID NO: 2991127 - RNA, 20 nt, Human
aggaagccgcuggggccagu

SEQ ID NO: 2991128 - RNA, 22 nt, Human
aggaagccagcaggcucucagg

SEQ ID NO: 2991129 - RNA, 23 nt, Human
aggaagccagcaggcucucaggc

SEQ ID NO: 2991130 - RNA, 21 nt, Human
aggaagccagcaggcucucag

SEQ ID NO: 2991131 - RNA, 14 nt, Human
ugcucauggaauug

SEQ ID NO: 2991132 - RNA, 16 nt, Human
ugcucuggacaggcau

SEQ ID NO: 2991133 - RNA, 15 nt, Human
ugcucuggacaggca

SEQ ID NO: 2991134 - RNA, 14 nt, Human
ugcucuggacaggc

SEQ ID NO: 2991135 - RNA, 22 nt, Human
ugcuccuaggacccgucuccag

SEQ ID NO: 2991136 - RNA, 11 nt, Human
ugcucauggaa

SEQ ID NO: 2991137 - RNA, 20 nt, Human
ugcuaucucccccagcccca

SEQ ID NO: 2991138 - RNA, 18 nt, Human
ugcuaucucccccagccc

SEQ ID NO: 2991139 - RNA, 19 nt, Human
ugcuaucucccccagcccc

SEQ ID NO: 2991140 - RNA, 16 nt, Human
agcuguucacagccag

SEQ ID NO: 2991141 - RNA, 19 nt, Human
agcuguucacagccagacu

SEQ ID NO: 2991142 - RNA, 20 nt, Human
ugccuguucagcuccagcuc

SEQ ID NO: 2991143 - RNA, 18 nt, Human
ugccuguucagcuccagc

SEQ ID NO: 2991144 - RNA, 13 nt, Human
agcuguucagcug

SEQ ID NO: 2991145 - RNA, 17 nt, Human
ugccuguucagcuccag

SEQ ID NO: 2991146 - RNA, 15 nt, Human
ugccuuauggaacac

SEQ ID NO: 2991147 - RNA, 16 nt, Human
ugccuuauggaacacu

SEQ ID NO: 2991148 - RNA, 20 nt, Human
ugccuguugggccaggagcc

SEQ ID NO: 2991149 - RNA, 19 nt, Human
ugccuguugggccaggagc

SEQ ID NO: 2991150 - RNA, 21 nt, Human
ugccuguucagcuccagcuca

SEQ ID NO: 2991151 - RNA, 21 nt, Human
agcugugcucuggacaggcau

SEQ ID NO: 2991152 - RNA, 20 nt, Human
agcugugcucuggacaggca

SEQ ID NO: 2991153 - RNA, 19 nt, Human
agcugugcucuggacaggc

SEQ ID NO: 2991154 - RNA, 22 nt, Human
agcugcccucuccugggcagcu

SEQ ID NO: 2991155 - RNA, 15 nt, Human
agcugccuccccucc

SEQ ID NO: 2991156 - RNA, 16 nt, Human
agcugccuccccuccu

SEQ ID NO: 2991157 - RNA, 20 nt, Human
agcugccuguucagcuccag

SEQ ID NO: 2991158 - RNA, 14 nt, Human
ugccuggauggggc

SEQ ID NO: 2991159 - RNA, 15 nt, Human
ugccuggauggggcu

SEQ ID NO: 2991160 - RNA, 21 nt, Human
agcugccuguucagcuccagc

SEQ ID NO: 2991161 - RNA, 21 nt, Human
agcugcuugggcuucauccuc

SEQ ID NO: 2991162 - RNA, 19 nt, Human
agcugccuguucagcucca

SEQ ID NO: 2991163 - RNA, 21 nt, Human
agcugcuuuugucuaugggac

SEQ ID NO: 2991164 - RNA, 15 nt, Human
ugccucugccucuga

SEQ ID NO: 2991165 - RNA, 13 nt, Human
ugccugcccaggc

SEQ ID NO: 2991166 - RNA, 14 nt, Human
ugccucugccucug

SEQ ID NO: 2991167 - RNA, 13 nt, Human
ugccucugccucu

SEQ ID NO: 2991168 - RNA, 14 nt, Human
ugcccaggcagguc

SEQ ID NO: 2991169 - RNA, 13 nt, Human
ugcccaggcaggu

SEQ ID NO: 2991170 - RNA, 12 nt, Human
ugcccaggcagg

SEQ ID NO: 2991171 - RNA, 16 nt, Human
ugccugcccaggcccc

SEQ ID NO: 2991172 - RNA, 24 nt, Human
ugccugcccaggccccugccaccc

SEQ ID NO: 2991173 - RNA, 12 nt, Human
ugccucugccuc

SEQ ID NO: 2991174 - RNA, 15 nt, Human
ugccugcccaggccc

SEQ ID NO: 2991175 - RNA, 14 nt, Human
ugccugcccaggcc

SEQ ID NO: 2991176 - RNA, 17 nt, Human
ugcggugcuaucucccc

SEQ ID NO: 2991177 - RNA, 21 nt, Human
ugcggugcuaucucccccagc

SEQ ID NO: 2991178 - RNA, 18 nt, Human
ugcgguccacccaggagc

SEQ ID NO: 2991179 - RNA, 17 nt, Human
ugcgguccacccaggag

SEQ ID NO: 2991180 - RNA, 17 nt, Human
ugcggccuuuggcuuca

SEQ ID NO: 2991181 - RNA, 19 nt, Human
ugcggccuuuggcuucacg

SEQ ID NO: 2991182 - RNA, 20 nt, Human
ugcgggcuuccuccuggugu

SEQ ID NO: 2991183 - RNA, 22 nt, Human
ugcggacagccacggccaggcc

SEQ ID NO: 2991184 - RNA, 23 nt, Human
ugcggacagccacggccaggcca

SEQ ID NO: 2991185 - RNA, 15 nt, Human
ugcggagcacacugg

SEQ ID NO: 2991186 - RNA, 13 nt, Human
ugcggagcacacu

SEQ ID NO: 2991187 - RNA, 17 nt, Human
agcuugaaacugagaug

SEQ ID NO: 2991188 - RNA, 19 nt, Human
agcuugaccgugaggccag

SEQ ID NO: 2991189 - RNA, 14 nt, Human
agcuugaggguugg

SEQ ID NO: 2991190 - RNA, 18 nt, Human
agcuugaggguugggcug

SEQ ID NO: 2991191 - RNA, 16 nt, Human
ugcuacaaaaacacag

SEQ ID NO: 2991192 - RNA, 17 nt, Human
ugcuacaaaaacacagc

SEQ ID NO: 2991193 - RNA, 18 nt, Human
ugcuacaaaaacacagca

SEQ ID NO: 2991194 - RNA, 19 nt, Human
ugcuacaaaaacacagcaa

SEQ ID NO: 2991195 - RNA, 15 nt, Human
ugcuacaaaaacaca

SEQ ID NO: 2991196 - RNA, 14 nt, Human
agcuguucagcugg

SEQ ID NO: 2991197 - RNA, 20 nt, Human
ugcuacaaaaacacagcaag

SEQ ID NO: 2991198 - RNA, 16 nt, Human
uggcaucuuacaucug

SEQ ID NO: 2991199 - RNA, 17 nt, Human
aggccccgcccaggcuu

SEQ ID NO: 2991200 - RNA, 23 nt, Human
uggccagugugacaaggauugcu

SEQ ID NO: 2991201 - RNA, 23 nt, Human
uggccaaagccaaagcuaggccu

SEQ ID NO: 2991202 - RNA, 21 nt, Human
uggccaaagccaaagcuaggc

SEQ ID NO: 2991203 - RNA, 13 nt, Human
uggccucuucaga

SEQ ID NO: 2991204 - RNA, 23 nt, Human
uggccgggcgcgguggcucacgc

SEQ ID NO: 2991205 - RNA, 13 nt, Human
uggcccacgcacu

SEQ ID NO: 2991206 - RNA, 18 nt, Human
uggccuggccccucaggg

SEQ ID NO: 2991207 - RNA, 21 nt, Human
uggccuggccccucagggucc

SEQ ID NO: 2991208 - RNA, 12 nt, Human
uggccuggcccc

SEQ ID NO: 2991209 - RNA, 12 nt, Human
aggccuggggac

SEQ ID NO: 2991210 - RNA, 18 nt, Human
aggccugggggcugggca

SEQ ID NO: 2991211 - RNA, 20 nt, Human
aggccugggggcugggcaga

SEQ ID NO: 2991212 - RNA, 18 nt, Human
uggcacaguuuucugaga

SEQ ID NO: 2991213 - RNA, 19 nt, Human
uggcacaguuuucugagaa

SEQ ID NO: 2991214 - RNA, 13 nt, Human
uggcagccuuggc

SEQ ID NO: 2991215 - RNA, 17 nt, Human
aggccacaagacccuug

SEQ ID NO: 2991216 - RNA, 18 nt, Human
aggccacaagacccuugu

SEQ ID NO: 2991217 - RNA, 19 nt, Human
aggccacaagacccuugug

SEQ ID NO: 2991218 - RNA, 14 nt, Human
aggccagagggagu

SEQ ID NO: 2991219 - RNA, 16 nt, Human
aggccacaagacccuu

SEQ ID NO: 2991220 - RNA, 19 nt, Human
uggcagcucaccucucccu

SEQ ID NO: 2991221 - RNA, 15 nt, Human
uggcagcucaccucu

SEQ ID NO: 2991222 - RNA, 17 nt, Human
uggcagccuuggcaaac

SEQ ID NO: 2991223 - RNA, 20 nt, Human
aggccagagggagugacaga

SEQ ID NO: 2991224 - RNA, 21 nt, Human
aggcccagagggccugcaagg

SEQ ID NO: 2991225 - RNA, 16 nt, Human
aggccccgcccaggcu

SEQ ID NO: 2991226 - RNA, 16 nt, Human
aggccaaaggaagcac

SEQ ID NO: 2991227 - RNA, 18 nt, Human
aggccaaaggaagcacau

SEQ ID NO: 2991228 - RNA, 19 nt, Human
aggccaaaggaagcacaug

SEQ ID NO: 2991229 - RNA, 15 nt, Human
aggccaaaggaagca

SEQ ID NO: 2991230 - RNA, 17 nt, Human
aggcagccccauucugc

SEQ ID NO: 2991231 - RNA, 16 nt, Human
aggcagccccauucug

SEQ ID NO: 2991232 - RNA, 18 nt, Human
aggcagccaggccacaag

SEQ ID NO: 2991233 - RNA, 16 nt, Human
aggccaaggugggagg

SEQ ID NO: 2991234 - RNA, 13 nt, Human
uggauuguccccg

SEQ ID NO: 2991235 - RNA, 14 nt, Human
uggaguauauguca

SEQ ID NO: 2991236 - RNA, 13 nt, Human
aggauacuuauuu

SEQ ID NO: 2991237 - RNA, 16 nt, Human
aggauacuuauuuaaa

SEQ ID NO: 2991238 - RNA, 15 nt, Human
aggauacuuauuuaa

SEQ ID NO: 2991239 - RNA, 13 nt, Human
aggauccugagcc

SEQ ID NO: 2991240 - RNA, 14 nt, Human
aggauccugagcca

SEQ ID NO: 2991241 - RNA, 17 nt, Human
uggaaaugggcagagca

SEQ ID NO: 2991242 - RNA, 18 nt, Human
uggaaaugggcagagcag

SEQ ID NO: 2991243 - RNA, 16 nt, Human
uggaagcacagcuuca

SEQ ID NO: 2991244 - RNA, 17 nt, Human
uggaagguauuuaauag

SEQ ID NO: 2991245 - RNA, 13 nt, Human
uggaagguauuua

SEQ ID NO: 2991246 - RNA, 18 nt, Human
ugcuugcugcugauuuaa

SEQ ID NO: 2991247 - RNA, 14 nt, Human
ugcuuggaggaagg

SEQ ID NO: 2991248 - RNA, 15 nt, Human
ugcuuggaggaagga

SEQ ID NO: 2991249 - RNA, 16 nt, Human
ugcuuggaggaaggaa

SEQ ID NO: 2991250 - RNA, 16 nt, Human
ugcuuguacacucauu

SEQ ID NO: 2991251 - RNA, 13 nt, Human
ugcuuguacauaa

SEQ ID NO: 2991252 - RNA, 12 nt, Human
ugcuuguacaua

SEQ ID NO: 2991253 - RNA, 21 nt, Human
ugcuugaggcaacucaucuua

SEQ ID NO: 2991254 - RNA, 22 nt, Human
ugcuuguacacucauucauuac

SEQ ID NO: 2991255 - RNA, 19 nt, Human
ugcuuguacacucauucau

SEQ ID NO: 2991256 - RNA, 22 nt, Human
ugcuuguacauaaugcgugcau

SEQ ID NO: 2991257 - RNA, 16 nt, Human
ugcuuguacauaaugc

SEQ ID NO: 2991258 - RNA, 14 nt, Human
ugcuuguacauaau

SEQ ID NO: 2991259 - RNA, 16 nt, Human
ugcuuugugauuuuug

SEQ ID NO: 2991260 - RNA, 14 nt, Human
ugcuuugugauuuu

SEQ ID NO: 2991261 - RNA, 12 nt, Human
ugcuuugugauu

SEQ ID NO: 2991262 - RNA, 13 nt, Human
uggaaaggcagcu

SEQ ID NO: 2991263 - RNA, 17 nt, Human
ugcuuuuggucugugug

SEQ ID NO: 2991264 - RNA, 14 nt, Human
ugcuuuuggucugu

SEQ ID NO: 2991265 - RNA, 20 nt, Human
uggaccuugaacuggguacu

SEQ ID NO: 2991266 - RNA, 15 nt, Human
uggacccugaggccc

SEQ ID NO: 2991267 - RNA, 23 nt, Human
uggacccuguggaugauaaaaca

SEQ ID NO: 2991268 - RNA, 21 nt, Human
uggacccugaggcccagaggg

SEQ ID NO: 2991269 - RNA, 19 nt, Human
uggacccugaggcccagag

SEQ ID NO: 2991270 - RNA, 20 nt, Human
uggacccugaggcccagagg

SEQ ID NO: 2991271 - RNA, 16 nt, Human
uggacccugaggccca

SEQ ID NO: 2991272 - RNA, 18 nt, Human
uggacccugaggcccaga

SEQ ID NO: 2991273 - RNA, 23 nt, Human
uggacacagcucuucuccaggcu

SEQ ID NO: 2991274 - RNA, 14 nt, Human
uggacacagcucuu

SEQ ID NO: 2991275 - RNA, 13 nt, Human
uggacacagcucu

SEQ ID NO: 2991276 - RNA, 22 nt, Human
uggacacagcucuucuccaggc

SEQ ID NO: 2991277 - RNA, 21 nt, Human
uggacacagcucuucuccagg

SEQ ID NO: 2991278 - RNA, 16 nt, Human
uggaauucacaaagua

SEQ ID NO: 2991279 - RNA, 17 nt, Human
aggaucucuugagccug

SEQ ID NO: 2991280 - RNA, 18 nt, Human
aggaucucuugagccugg

SEQ ID NO: 2991281 - RNA, 19 nt, Human
aggaucucuugagccuggg

SEQ ID NO: 2991282 - RNA, 12 nt, Human
aggaucucuuga

SEQ ID NO: 2991283 - RNA, 14 nt, Human
uggaauucacaaag

SEQ ID NO: 2991284 - RNA, 22 nt, Human
aggcacccaccaucaugucugg

SEQ ID NO: 2991285 - RNA, 21 nt, Human
aggcacccaccaucaugucug

SEQ ID NO: 2991286 - RNA, 20 nt, Human
aggcacccaccaucaugucu

SEQ ID NO: 2991287 - RNA, 14 nt, Human
aggcaaugcuggcu

SEQ ID NO: 2991288 - RNA, 15 nt, Human
aggcacccaccauca

SEQ ID NO: 2991289 - RNA, 13 nt, Human
uggagaagaacug

SEQ ID NO: 2991290 - RNA, 17 nt, Human
uggacuuugcacacuuu

SEQ ID NO: 2991291 - RNA, 13 nt, Human
uggagaagcggcu

SEQ ID NO: 2991292 - RNA, 22 nt, Human
uggagaagcggcuggcagccca

SEQ ID NO: 2991293 - RNA, 14 nt, Human
ugccaauauccuaa

SEQ ID NO: 2991294 - RNA, 18 nt, Human
ugccaaugggagcucaug

SEQ ID NO: 2991295 - RNA, 13 nt, Human
ugccaauuugcac

SEQ ID NO: 2991296 - RNA, 15 nt, Human
ugccaauuugcacau

SEQ ID NO: 2991297 - RNA, 21 nt, Human
ugccaauuugcacauuaaaug

SEQ ID NO: 2991298 - RNA, 17 nt, Human
ugccaauuugcacauua

SEQ ID NO: 2991299 - RNA, 22 nt, Human
ugcauuaucuagauacuguauc

SEQ ID NO: 2991300 - RNA, 21 nt, Human
ugcauuaucuagauacuguau

SEQ ID NO: 2991301 - RNA, 18 nt, Human
ugcauuaucuagauacug

SEQ ID NO: 2991302 - RNA, 11 nt, Human
agccuuccagg

SEQ ID NO: 2991303 - RNA, 14 nt, Human
agccuuccaggggu

SEQ ID NO: 2991304 - RNA, 16 nt, Human
agccuuccaggggugg

SEQ ID NO: 2991305 - RNA, 17 nt, Human
agccuuccagggguggg

SEQ ID NO: 2991306 - RNA, 20 nt, Human
agccuuggggcugaugcagu

SEQ ID NO: 2991307 - RNA, 16 nt, Human
agcggagaaaggaagg

SEQ ID NO: 2991308 - RNA, 20 nt, Human
agcggagaaaggaagggcug

SEQ ID NO: 2991309 - RNA, 18 nt, Human
agcggagacggaguccca

SEQ ID NO: 2991310 - RNA, 20 nt, Human
ugcauuaucuagauacugua

SEQ ID NO: 2991311 - RNA, 21 nt, Human
agccugugccucugggacugg

SEQ ID NO: 2991312 - RNA, 22 nt, Human
agccuuagaagucacacaguau

SEQ ID NO: 2991313 - RNA, 14 nt, Human
agccugcuccagcu

SEQ ID NO: 2991314 - RNA, 15 nt, Human
agccugcuccagcug

SEQ ID NO: 2991315 - RNA, 16 nt, Human
agccugcuccagcugu

SEQ ID NO: 2991316 - RNA, 17 nt, Human
agccugcuccagcuguu

SEQ ID NO: 2991317 - RNA, 12 nt, Human
ugcauaccacuu

SEQ ID NO: 2991318 - RNA, 19 nt, Human
agccugcuccagcuguuca

SEQ ID NO: 2991319 - RNA, 22 nt, Human
agccugcuccagcuguucagcu

SEQ ID NO: 2991320 - RNA, 22 nt, Human
agccugggugacagagcaagug

SEQ ID NO: 2991321 - RNA, 18 nt, Human
agcuacuugggaggcuga

SEQ ID NO: 2991322 - RNA, 17 nt, Human
agcuacuugggaggcug

SEQ ID NO: 2991323 - RNA, 16 nt, Human
agcuagaauuugauau

SEQ ID NO: 2991324 - RNA, 13 nt, Human
agcuagaauuuga

SEQ ID NO: 2991325 - RNA, 18 nt, Human
agcuagacgagcaggcuu

SEQ ID NO: 2991326 - RNA, 15 nt, Human
agcgugcauaaguua

SEQ ID NO: 2991327 - RNA, 22 nt, Human
agcgugagccacugcaccgggc

SEQ ID NO: 2991328 - RNA, 19 nt, Human
agcgugagccacugcaccg

SEQ ID NO: 2991329 - RNA, 21 nt, Human
agcucaggugucccugcacuu

SEQ ID NO: 2991330 - RNA, 20 nt, Human
agcucaggugucccugcacu

SEQ ID NO: 2991331 - RNA, 22 nt, Human
agcucaggugucccugcacuug

SEQ ID NO: 2991332 - RNA, 17 nt, Human
agcucaggugucccugc

SEQ ID NO: 2991333 - RNA, 18 nt, Human
agcucaggugucccugca

SEQ ID NO: 2991334 - RNA, 15 nt, Human
agcuaggccuggcca

SEQ ID NO: 2991335 - RNA, 14 nt, Human
agcuaggccuggcc

SEQ ID NO: 2991336 - RNA, 16 nt, Human
agcuaggccuggccag

SEQ ID NO: 2991337 - RNA, 12 nt, Human
agcuaggccugg

SEQ ID NO: 2991338 - RNA, 21 nt, Human
ugcccagccccuucugaccca

SEQ ID NO: 2991339 - RNA, 20 nt, Human
ugcccagccccuucugaccc

SEQ ID NO: 2991340 - RNA, 17 nt, Human
ugcccagccuggaugcc

SEQ ID NO: 2991341 - RNA, 16 nt, Human
ugcccagccuggaugc

SEQ ID NO: 2991342 - RNA, 14 nt, Human
ugcccagccuggau

SEQ ID NO: 2991343 - RNA, 20 nt, Human
ugcccagccuggaugccauc

SEQ ID NO: 2991344 - RNA, 18 nt, Human
ugcccagccuggaugcca

SEQ ID NO: 2991345 - RNA, 21 nt, Human
ugcccagccuggaugccaucc

SEQ ID NO: 2991346 - RNA, 16 nt, Human
ugcccacaggaucagu

SEQ ID NO: 2991347 - RNA, 19 nt, Human
ugcccacaggaucagucug

SEQ ID NO: 2991348 - RNA, 20 nt, Human
ugcccacaggaucagucuga

SEQ ID NO: 2991349 - RNA, 21 nt, Human
agcucauucuccuuguguuac

SEQ ID NO: 2991350 - RNA, 20 nt, Human
agcucauucuccuuguguua

SEQ ID NO: 2991351 - RNA, 14 nt, Human
ugcaguacuaacau

SEQ ID NO: 2991352 - RNA, 18 nt, Human
ugcaguacaggacauaua

SEQ ID NO: 2991353 - RNA, 16 nt, Human
ugcaguacaggacaua

SEQ ID NO: 2991354 - RNA, 17 nt, Human
ugcauaaguuaacuucc

SEQ ID NO: 2991355 - RNA, 14 nt, Human
ugcauaaguuaacu

SEQ ID NO: 2991356 - RNA, 22 nt, Human
agccugaaagaggaaugaagua

SEQ ID NO: 2991357 - RNA, 23 nt, Human
ugcagccucaaccuccugggcua

SEQ ID NO: 2991358 - RNA, 16 nt, Human
ugcagccucacagucc

SEQ ID NO: 2991359 - RNA, 13 nt, Human
ugcagccucacag

SEQ ID NO: 2991360 - RNA, 15 nt, Human
ugcagccucacaguc

SEQ ID NO: 2991361 - RNA, 15 nt, Human
agccucauguccacu

SEQ ID NO: 2991362 - RNA, 23 nt, Human
agccucagcauccuggcacccgg

SEQ ID NO: 2991363 - RNA, 22 nt, Human
agccucagcauccuggcacccg

SEQ ID NO: 2991364 - RNA, 20 nt, Human
agccucauguccacugguuc

SEQ ID NO: 2991365 - RNA, 16 nt, Human
agccucccaaagugcu

SEQ ID NO: 2991366 - RNA, 16 nt, Human
agccucagcauccugg

SEQ ID NO: 2991367 - RNA, 21 nt, Human
agccucagcauccuggcaccc

SEQ ID NO: 2991368 - RNA, 20 nt, Human
agccucagcauccuggcacc

SEQ ID NO: 2991369 - RNA, 19 nt, Human
agccucagcauccuggcac

SEQ ID NO: 2991370 - RNA, 17 nt, Human
agccucagcauccuggc

SEQ ID NO: 2991371 - RNA, 23 nt, Human
agcccuucuaccuuccugcaaca

SEQ ID NO: 2991372 - RNA, 23 nt, Human
ugcacuauagccuaggugacaga

SEQ ID NO: 2991373 - RNA, 22 nt, Human
ugcacuauagccuaggugacag

SEQ ID NO: 2991374 - RNA, 14 nt, Human
ugcacacuguccua

SEQ ID NO: 2991375 - RNA, 20 nt, Human
ugcacacauuuuuuaaaugc

SEQ ID NO: 2991376 - RNA, 10 nt, Human
ugcacacauu

SEQ ID NO: 2991377 - RNA, 15 nt, Human
ugcacgugugugcac

SEQ ID NO: 2991378 - RNA, 14 nt, Human
ugcacgugugugca

SEQ ID NO: 2991379 - RNA, 16 nt, Human
ugcacccucaggcagg

SEQ ID NO: 2991380 - RNA, 17 nt, Human
ugcacccucaggcaggu

SEQ ID NO: 2991381 - RNA, 21 nt, Human
agcccugguggcagugggagc

SEQ ID NO: 2991382 - RNA, 20 nt, Human
agccccuucugacccaugcu

SEQ ID NO: 2991383 - RNA, 24 nt, Human
agccccuucugacccaugcugccc

SEQ ID NO: 2991384 - RNA, 18 nt, Human
ugcacaagcugcacccuc

SEQ ID NO: 2991385 - RNA, 21 nt, Human
ugcacaagcugcacccucagg

SEQ ID NO: 2991386 - RNA, 22 nt, Human
ugcacacaccagagcccaccuu

SEQ ID NO: 2991387 - RNA, 14 nt, Human
ugcacaagcugcac

SEQ ID NO: 2991388 - RNA, 15 nt, Human
ugcacaagcugcacc

SEQ ID NO: 2991389 - RNA, 23 nt, Human
agcccugguggcagugggagcug

SEQ ID NO: 2991390 - RNA, 22 nt, Human
agcccugguggcagugggagcu

SEQ ID NO: 2991391 - RNA, 21 nt, Human
agccccaaaacucuccucugc

SEQ ID NO: 2991392 - RNA, 22 nt, Human
agccccaaaacucuccucugcu

SEQ ID NO: 2991393 - RNA, 20 nt, Human
agccccaaaacucuccucug

SEQ ID NO: 2991394 - RNA, 18 nt, Human
agcccauggcacucuaug

SEQ ID NO: 2991395 - RNA, 15 nt, Human
ugauucuccugccuc

SEQ ID NO: 2991396 - RNA, 19 nt, Human
ugauucuccugccucagcc

SEQ ID NO: 2991397 - RNA, 20 nt, Human
ugauucuccugccucagccu

SEQ ID NO: 2991398 - RNA, 13 nt, Human
ugauucuccugcc

SEQ ID NO: 2991399 - RNA, 19 nt, Human
agccccuggaugcagccuc

SEQ ID NO: 2991400 - RNA, 17 nt, Human
agccccuggaugcagcc

SEQ ID NO: 2991401 - RNA, 18 nt, Human
agccccuggaugcagccu

SEQ ID NO: 2991402 - RNA, 18 nt, Human
agccccgugggguuccuc

SEQ ID NO: 2991403 - RNA, 24 nt, Human
agccccaaaacucuccucugcugc

SEQ ID NO: 2991404 - RNA, 23 nt, Human
agccccauucugccugcccaggc

SEQ ID NO: 2991405 - RNA, 16 nt, Human
agccccgaggccuucu

SEQ ID NO: 2991406 - RNA, 22 nt, Human
agccccgaggccuucucugaag

SEQ ID NO: 2991407 - RNA, 17 nt, Human
agccccgaggccuucuc

SEQ ID NO: 2991408 - RNA, 23 nt, Human
agcauguccuaaugcuugcugcu

SEQ ID NO: 2991409 - RNA, 20 nt, Human
agcauguauuuuugucaauu

SEQ ID NO: 2991410 - RNA, 12 nt, Human
agcauggcugcc

SEQ ID NO: 2991411 - RNA, 17 nt, Human
agcaugucgucaaagcu

SEQ ID NO: 2991412 - RNA, 20 nt, Human
agcaugucgucaaagcugaa

SEQ ID NO: 2991413 - RNA, 14 nt, Human
agcaucaggccagg

SEQ ID NO: 2991414 - RNA, 16 nt, Human
agcaucaggccaggcc

SEQ ID NO: 2991415 - RNA, 17 nt, Human
agcaucaggccaggccc

SEQ ID NO: 2991416 - RNA, 18 nt, Human
agcaucaggccaggcccu

SEQ ID NO: 2991417 - RNA, 19 nt, Human
agcaucaggccaggcccuc

SEQ ID NO: 2991418 - RNA, 20 nt, Human
agcaucaggccaggcccucu

SEQ ID NO: 2991419 - RNA, 17 nt, Human
agcauuguaaaugugcu

SEQ ID NO: 2991420 - RNA, 18 nt, Human
agcauuguaaaugugcuu

SEQ ID NO: 2991421 - RNA, 12 nt, Human
ugauaugggucu

SEQ ID NO: 2991422 - RNA, 16 nt, Human
ugauaugugaacaguu

SEQ ID NO: 2991423 - RNA, 15 nt, Human
ugauaugugaacagu

SEQ ID NO: 2991424 - RNA, 18 nt, Human
ugauauggguaguauuuu

SEQ ID NO: 2991425 - RNA, 19 nt, Human
ugaucacggcucacugcag

SEQ ID NO: 2991426 - RNA, 18 nt, Human
ugaucacggcucacugca

SEQ ID NO: 2991427 - RNA, 13 nt, Human
agcaucaggccag

SEQ ID NO: 2991428 - RNA, 12 nt, Human
agcaucaggcca

SEQ ID NO: 2991429 - RNA, 21 nt, Human
ugaucacggcucacugcagcc

SEQ ID NO: 2991430 - RNA, 20 nt, Human
ugaucacggcucacugcagc

SEQ ID NO: 2991431 - RNA, 22 nt, Human
agcauauucaggaagcucaggg

SEQ ID NO: 2991432 - RNA, 22 nt, Human
ugaguaacugauuuguaacaag

SEQ ID NO: 2991433 - RNA, 15 nt, Human
ugaguacuacagucc

SEQ ID NO: 2991434 - RNA, 14 nt, Human
agcauauucaggaa

SEQ ID NO: 2991435 - RNA, 17 nt, Human
ugaguacuacaguccuc

SEQ ID NO: 2991436 - RNA, 21 nt, Human
ugaguacuacaguccucccau

SEQ ID NO: 2991437 - RNA, 22 nt, Human
ugaguacuacaguccucccauc

SEQ ID NO: 2991438 - RNA, 23 nt, Human
ugaguacuacaguccucccaucu

SEQ ID NO: 2991439 - RNA, 14 nt, Human
ugaguacuacaguc

SEQ ID NO: 2991440 - RNA, 15 nt, Human
agcauacguacacau

SEQ ID NO: 2991441 - RNA, 23 nt, Human
agcauaaauguugacaugggaca

SEQ ID NO: 2991442 - RNA, 12 nt, Human
ugagaauuaccc

SEQ ID NO: 2991443 - RNA, 19 nt, Human
agcauacguacacauuuua

SEQ ID NO: 2991444 - RNA, 18 nt, Human
agcauacguacacauuuu

SEQ ID NO: 2991445 - RNA, 17 nt, Human
agcauacguacacauuu

SEQ ID NO: 2991446 - RNA, 16 nt, Human
agcauacguacacauu

SEQ ID NO: 2991447 - RNA, 21 nt, Human
agcauacguacacauuuuauu

SEQ ID NO: 2991448 - RNA, 20 nt, Human
agcauacguacacauuuuau

SEQ ID NO: 2991449 - RNA, 20 nt, Human
ugauaagaaccuuuugagug

SEQ ID NO: 2991450 - RNA, 17 nt, Human
ugaguucauacccuguu

SEQ ID NO: 2991451 - RNA, 21 nt, Human
ugauacaaugcugugcccuaa

SEQ ID NO: 2991452 - RNA, 12 nt, Human
ugauacagaaaa

SEQ ID NO: 2991453 - RNA, 20 nt, Human
ugauacaaugcugugcccua

SEQ ID NO: 2991454 - RNA, 18 nt, Human
ugauacaaugcugugccc

SEQ ID NO: 2991455 - RNA, 17 nt, Human
ugauacuacaguuuguu

SEQ ID NO: 2991456 - RNA, 14 nt, Human
ugauacuacaguuu

SEQ ID NO: 2991457 - RNA, 17 nt, Human
ugagugccuuacacaau

SEQ ID NO: 2991458 - RNA, 20 nt, Human
ugagugccuuacacaauggu

SEQ ID NO: 2991459 - RNA, 17 nt, Human
ugagucaccaagcccag

SEQ ID NO: 2991460 - RNA, 16 nt, Human
ugagucaccaagccca

SEQ ID NO: 2991461 - RNA, 14 nt, Human
ugagucaccaagcc

SEQ ID NO: 2991462 - RNA, 23 nt, Human
ugagugggggaucacagccucug

SEQ ID NO: 2991463 - RNA, 21 nt, Human
ugagugggugaauaauacagu

SEQ ID NO: 2991464 - RNA, 16 nt, Human
ugagugccuuacacaa

SEQ ID NO: 2991465 - RNA, 14 nt, Human
agccagacuggcac

SEQ ID NO: 2991466 - RNA, 12 nt, Human
agccaggccaca

SEQ ID NO: 2991467 - RNA, 14 nt, Human
agccaggccacaag

SEQ ID NO: 2991468 - RNA, 21 nt, Human
agccaggccacaagacccuug

SEQ ID NO: 2991469 - RNA, 22 nt, Human
agccaggccacaagacccuugu

SEQ ID NO: 2991470 - RNA, 22 nt, Human
agccaggcccuugucggcccca

SEQ ID NO: 2991471 - RNA, 12 nt, Human
agccagggucuc

SEQ ID NO: 2991472 - RNA, 22 nt, Human
agccaguaaaugggggugcauu

SEQ ID NO: 2991473 - RNA, 23 nt, Human
agccaguaaaugggggugcauuu

SEQ ID NO: 2991474 - RNA, 22 nt, Human
agcccacuucugccauauucug

SEQ ID NO: 2991475 - RNA, 19 nt, Human
agcccaggaaaggcuccag

SEQ ID NO: 2991476 - RNA, 20 nt, Human
agcccaggaaaggcuccagg

SEQ ID NO: 2991477 - RNA, 21 nt, Human
agcccaggaaaggcuccagga

SEQ ID NO: 2991478 - RNA, 21 nt, Human
ugauucccaagcucugcuccu

SEQ ID NO: 2991479 - RNA, 19 nt, Human
ugauucccaagcucugcuc

SEQ ID NO: 2991480 - RNA, 18 nt, Human
ugauucccaagcucugcu

SEQ ID NO: 2991481 - RNA, 16 nt, Human
ugauucccaagcucug

SEQ ID NO: 2991482 - RNA, 15 nt, Human
ugauucccaagcucu

SEQ ID NO: 2991483 - RNA, 22 nt, Human
agcccaggaaaggcuccaggag

SEQ ID NO: 2991484 - RNA, 23 nt, Human
agcccaggaaaggcuccaggagc

SEQ ID NO: 2991485 - RNA, 24 nt, Human
agcccaggaaaggcuccaggagca

SEQ ID NO: 2991486 - RNA, 18 nt, Human
agcccaggaaaggcucca

SEQ ID NO: 2991487 - RNA, 13 nt, Human
ugauucagcucug

SEQ ID NO: 2991488 - RNA, 14 nt, Human
ugauucagcucugc

SEQ ID NO: 2991489 - RNA, 14 nt, Human
ugauuaccagggac

SEQ ID NO: 2991490 - RNA, 15 nt, Human
ugauuaauuaaaaca

SEQ ID NO: 2991491 - RNA, 12 nt, Human
ugauuaaaccaa

SEQ ID NO: 2991492 - RNA, 22 nt, Human
agccacugcaccgggccacaga

SEQ ID NO: 2991493 - RNA, 21 nt, Human
agccacugcaccgggccacag

SEQ ID NO: 2991494 - RNA, 13 nt, Human
agccacugcaccg

SEQ ID NO: 2991495 - RNA, 20 nt, Human
agccacugcaccgggccaca

SEQ ID NO: 2991496 - RNA, 14 nt, Human
ugaugauccuaggc

SEQ ID NO: 2991497 - RNA, 20 nt, Human
ugaugauccuaggcauuugc

SEQ ID NO: 2991498 - RNA, 14 nt, Human
ugaugaucuuuaaa

SEQ ID NO: 2991499 - RNA, 17 nt, Human
ugauggugcaaugaccu

SEQ ID NO: 2991500 - RNA, 23 nt, Human
ugauggugcaaugaccuuucaau

SEQ ID NO: 2991501 - RNA, 16 nt, Human
ugauggugcaaugacc

SEQ ID NO: 2991502 - RNA, 17 nt, Human
ugaugaucuuuaaaaua

SEQ ID NO: 2991503 - RNA, 18 nt, Human
ugauguuuuaaggaugcu

SEQ ID NO: 2991504 - RNA, 17 nt, Human
ugauguuuuaaggaugc

SEQ ID NO: 2991505 - RNA, 23 nt, Human
ugauguuuuccaugaguccccug

SEQ ID NO: 2991506 - RNA, 22 nt, Human
ugauguuuagaaacacaacuau

SEQ ID NO: 2991507 - RNA, 14 nt, Human
agccacauuccuga

SEQ ID NO: 2991508 - RNA, 18 nt, Human
agccacauuccugaugcu

SEQ ID NO: 2991509 - RNA, 20 nt, Human
agccaccaacauacucccau

SEQ ID NO: 2991510 - RNA, 23 nt, Human
agccaccaacauacucccaucug

SEQ ID NO: 2991511 - RNA, 19 nt, Human
agccaccaacauacuccca

SEQ ID NO: 2991512 - RNA, 14 nt, Human
agccacggccaggc

SEQ ID NO: 2991513 - RNA, 15 nt, Human
agccacggccaggcc

SEQ ID NO: 2991514 - RNA, 17 nt, Human
ugaugaagaaguugaua

SEQ ID NO: 2991515 - RNA, 21 nt, Human
ugaaaaaauuuacuuuaaacu

SEQ ID NO: 2991516 - RNA, 16 nt, Human
ugaaaaaggaggaaga

SEQ ID NO: 2991517 - RNA, 12 nt, Human
ucuuuuaaacuc

SEQ ID NO: 2991518 - RNA, 11 nt, Human
ucuuuuaaacu

SEQ ID NO: 2991519 - RNA, 14 nt, Human
ucuuuuaagaauca

SEQ ID NO: 2991520 - RNA, 12 nt, Human
ucuuuuaagaau

SEQ ID NO: 2991521 - RNA, 21 nt, Human
ucuuucuggcuaugcauuuga

SEQ ID NO: 2991522 - RNA, 19 nt, Human
ucuuucuggcuaugcauuu

SEQ ID NO: 2991523 - RNA, 20 nt, Human
ucuuucuggcuaugcauuug

SEQ ID NO: 2991524 - RNA, 22 nt, Human
ucuuuggucuacacugugcuga

SEQ ID NO: 2991525 - RNA, 20 nt, Human
ugaaaagcuccauuuuuagu

SEQ ID NO: 2991526 - RNA, 20 nt, Human
ugaaaaaggaggaagagaaa

SEQ ID NO: 2991527 - RNA, 22 nt, Human
ugaaaaaggaggaagagaaaaa

SEQ ID NO: 2991528 - RNA, 22 nt, Human
ugaaaaaguucugcagauaaac

SEQ ID NO: 2991529 - RNA, 16 nt, Human
ugaaaaucgugacaac

SEQ ID NO: 2991530 - RNA, 19 nt, Human
ugaaacucguuaauuugua

SEQ ID NO: 2991531 - RNA, 16 nt, Human
ugaaacgcaaccacca

SEQ ID NO: 2991532 - RNA, 19 nt, Human
ugaaaaucgugacaacacu

SEQ ID NO: 2991533 - RNA, 17 nt, Human
ugaaaauguauguguaa

SEQ ID NO: 2991534 - RNA, 21 nt, Human
agagcaguuugguuucuagca

SEQ ID NO: 2991535 - RNA, 23 nt, Human
agagcaguuugguuucuagcaug

SEQ ID NO: 2991536 - RNA, 22 nt, Human
agagcaccuuagacagucccug

SEQ ID NO: 2991537 - RNA, 21 nt, Human
agagcaccuuagacagucccu

SEQ ID NO: 2991538 - RNA, 23 nt, Human
agagcaccuuagacagucccugc

SEQ ID NO: 2991539 - RNA, 14 nt, Human
agagcugccaccug

SEQ ID NO: 2991540 - RNA, 13 nt, Human
agagccuuccagg

SEQ ID NO: 2991541 - RNA, 15 nt, Human
agagccuuccagggg

SEQ ID NO: 2991542 - RNA, 17 nt, Human
agagccuuccaggggug

SEQ ID NO: 2991543 - RNA, 22 nt, Human
agagccuuccaggggugggaca

SEQ ID NO: 2991544 - RNA, 20 nt, Human
agagcuagcagcagggaggg

SEQ ID NO: 2991545 - RNA, 19 nt, Human
agagacuccugcaggcagc

SEQ ID NO: 2991546 - RNA, 20 nt, Human
agagacuccugcaggcagcc

SEQ ID NO: 2991547 - RNA, 21 nt, Human
agagacuccugcaggcagcca

SEQ ID NO: 2991548 - RNA, 22 nt, Human
agagacuccugcaggcagccag

SEQ ID NO: 2991549 - RNA, 17 nt, Human
agagacuccugcaggca

SEQ ID NO: 2991550 - RNA, 18 nt, Human
agagacuccugcaggcag

SEQ ID NO: 2991551 - RNA, 15 nt, Human
agagacuccugcagg

SEQ ID NO: 2991552 - RNA, 15 nt, Human
ugaaagacuguacaa

SEQ ID NO: 2991553 - RNA, 13 nt, Human
ugaaagacuguac

SEQ ID NO: 2991554 - RNA, 23 nt, Human
agagacuccugcaggcagccagg

SEQ ID NO: 2991555 - RNA, 22 nt, Human
agagaucaaccccuucgcuccu

SEQ ID NO: 2991556 - RNA, 19 nt, Human
agagcaagacgcugugcug

SEQ ID NO: 2991557 - RNA, 23 nt, Human
agagcaagacgcugugcugcccu

SEQ ID NO: 2991558 - RNA, 18 nt, Human
agacaucaacagauaaau

SEQ ID NO: 2991559 - RNA, 17 nt, Human
agacaucaacagauaaa

SEQ ID NO: 2991560 - RNA, 21 nt, Human
agacauagaauuaacacauga

SEQ ID NO: 2991561 - RNA, 14 nt, Human
agacauagaauuaa

SEQ ID NO: 2991562 - RNA, 19 nt, Human
agacauacuaaccagcaga

SEQ ID NO: 2991563 - RNA, 21 nt, Human
ucuucugaacuuggcgcugcc

SEQ ID NO: 2991564 - RNA, 12 nt, Human
ucuucugcuuca

SEQ ID NO: 2991565 - RNA, 23 nt, Human
ucuucuguacgucugacaggcaa

SEQ ID NO: 2991566 - RNA, 15 nt, Human
ucuucuguacgucug

SEQ ID NO: 2991567 - RNA, 20 nt, Human
ucuucuguggguuucuaaag

SEQ ID NO: 2991568 - RNA, 17 nt, Human
ucuucagagacuccugc

SEQ ID NO: 2991569 - RNA, 18 nt, Human
ucuucagagacuccugca

SEQ ID NO: 2991570 - RNA, 12 nt, Human
ucuucagagacu

SEQ ID NO: 2991571 - RNA, 15 nt, Human
ucuucacaacagauu

SEQ ID NO: 2991572 - RNA, 14 nt, Human
agaaucacuugaac

SEQ ID NO: 2991573 - RNA, 20 nt, Human
ucuucagagacuccugcagg

SEQ ID NO: 2991574 - RNA, 15 nt, Human
ucuuccaggcuggga

SEQ ID NO: 2991575 - RNA, 17 nt, Human
ucuuccaggcugggaga

SEQ ID NO: 2991576 - RNA, 20 nt, Human
ucuuccaggcugggagagcc

SEQ ID NO: 2991577 - RNA, 21 nt, Human
ucuuccaggcugggagagccu

SEQ ID NO: 2991578 - RNA, 19 nt, Human
ucuucccuacaguugaaaa

SEQ ID NO: 2991579 - RNA, 22 nt, Human
ucuucccuacaguugaaaaaca

SEQ ID NO: 2991580 - RNA, 14 nt, Human
ucuuccucccuccc

SEQ ID NO: 2991581 - RNA, 15 nt, Human
ucuuccucccucccu

SEQ ID NO: 2991582 - RNA, 12 nt, Human
agacuauucaaa

SEQ ID NO: 2991583 - RNA, 14 nt, Human
agacuauucaaaca

SEQ ID NO: 2991584 - RNA, 15 nt, Human
agacuauucaaacag

SEQ ID NO: 2991585 - RNA, 21 nt, Human
agaccuucuccuucaccuuug

SEQ ID NO: 2991586 - RNA, 23 nt, Human
agaccuucuccuucaccuuuguc

SEQ ID NO: 2991587 - RNA, 15 nt, Human
agaccuucuccuuca

SEQ ID NO: 2991588 - RNA, 18 nt, Human
agaccuucuccuucaccu

SEQ ID NO: 2991589 - RNA, 11 nt, Human
agaccuucucc

SEQ ID NO: 2991590 - RNA, 13 nt, Human
ucuugagccuggg

SEQ ID NO: 2991591 - RNA, 16 nt, Human
ucuugagccugggagg

SEQ ID NO: 2991592 - RNA, 20 nt, Human
ucuugagccuugaacuuuga

SEQ ID NO: 2991593 - RNA, 16 nt, Human
ucuugagccuugaacu

SEQ ID NO: 2991594 - RNA, 13 nt, Human
ucuugauucauaa

SEQ ID NO: 2991595 - RNA, 17 nt, Human
ucuuggucagauuugaa

SEQ ID NO: 2991596 - RNA, 14 nt, Human
ucuugguccugcug

SEQ ID NO: 2991597 - RNA, 22 nt, Human
ucuugcaauggcagccuuggca

SEQ ID NO: 2991598 - RNA, 18 nt, Human
ucuugcaauggcagccuu

SEQ ID NO: 2991599 - RNA, 19 nt, Human
ucuugcaauggcagccuug

SEQ ID NO: 2991600 - RNA, 17 nt, Human
ucuuuccugaggcuggg

SEQ ID NO: 2991601 - RNA, 16 nt, Human
ucuuuccugaggcugg

SEQ ID NO: 2991602 - RNA, 15 nt, Human
ucuugguccugcugc

SEQ ID NO: 2991603 - RNA, 17 nt, Human
ucuugguccugcugcag

SEQ ID NO: 2991604 - RNA, 19 nt, Human
ucuugguccugcugcaguu

SEQ ID NO: 2991605 - RNA, 23 nt, Human
ugacuauuuuuguuuuuauuaaa

SEQ ID NO: 2991606 - RNA, 13 nt, Human
ugacuuacuguac

SEQ ID NO: 2991607 - RNA, 16 nt, Human
ugacuuacuguacaug

SEQ ID NO: 2991608 - RNA, 15 nt, Human
ugacuuacuguacau

SEQ ID NO: 2991609 - RNA, 18 nt, Human
ugaccugaggcccuucuc

SEQ ID NO: 2991610 - RNA, 19 nt, Human
ugaccugaggcccuucucu

SEQ ID NO: 2991611 - RNA, 17 nt, Human
ugaccugaggcccuucu

SEQ ID NO: 2991612 - RNA, 12 nt, Human
agauguugcuaa

SEQ ID NO: 2991613 - RNA, 14 nt, Human
ugacccaugcugcc

SEQ ID NO: 2991614 - RNA, 15 nt, Human
ugacccaugcugccc

SEQ ID NO: 2991615 - RNA, 12 nt, Human
ugacccaugcug

SEQ ID NO: 2991616 - RNA, 16 nt, Human
ugacccaugcugcccu

SEQ ID NO: 2991617 - RNA, 21 nt, Human
ugacccaugcugcccugugag

SEQ ID NO: 2991618 - RNA, 16 nt, Human
ugacacuuaaaaaugg

SEQ ID NO: 2991619 - RNA, 17 nt, Human
ugacacuuaaaaauggu

SEQ ID NO: 2991620 - RNA, 16 nt, Human
agaugcaguucugaag

SEQ ID NO: 2991621 - RNA, 16 nt, Human
agaugccgcauuugga

SEQ ID NO: 2991622 - RNA, 14 nt, Human
agcaagacauuaua

SEQ ID NO: 2991623 - RNA, 13 nt, Human
agcaagacgcugu

SEQ ID NO: 2991624 - RNA, 16 nt, Human
agcaagacgcugugcu

SEQ ID NO: 2991625 - RNA, 23 nt, Human
agcaacgcaggcccccaggugcc

SEQ ID NO: 2991626 - RNA, 17 nt, Human
agcaagacgcugugcug

SEQ ID NO: 2991627 - RNA, 20 nt, Human
agcaagacgcugugcugccc

SEQ ID NO: 2991628 - RNA, 21 nt, Human
agcaagacgcugugcugcccu

SEQ ID NO: 2991629 - RNA, 22 nt, Human
agcaagacgcugugcugcccug

SEQ ID NO: 2991630 - RNA, 23 nt, Human
agcaagacgcugugcugcccugc

SEQ ID NO: 2991631 - RNA, 15 nt, Human
agauucccugagcag

SEQ ID NO: 2991632 - RNA, 13 nt, Human
agauuggaaggaa

SEQ ID NO: 2991633 - RNA, 22 nt, Human
ugacuucuaaguaaaaccacag

SEQ ID NO: 2991634 - RNA, 23 nt, Human
ugacuucuaaguaaaaccacagc

SEQ ID NO: 2991635 - RNA, 19 nt, Human
ugacuuacuguacaugaaa

SEQ ID NO: 2991636 - RNA, 15 nt, Human
ugacuucuaaguaaa

SEQ ID NO: 2991637 - RNA, 22 nt, Human
agauucauauuuacuucuuaua

SEQ ID NO: 2991638 - RNA, 19 nt, Human
agauucauauuuacuucuu

SEQ ID NO: 2991639 - RNA, 21 nt, Human
agauuuugaaauuuuuauuaa

SEQ ID NO: 2991640 - RNA, 17 nt, Human
agauuugaacucuucaa

SEQ ID NO: 2991641 - RNA, 14 nt, Human
ugaauuugccuaau

SEQ ID NO: 2991642 - RNA, 23 nt, Human
ugaauuucuuuugccguuauuaa

SEQ ID NO: 2991643 - RNA, 20 nt, Human
ugacacaugcaaggucauuu

SEQ ID NO: 2991644 - RNA, 12 nt, Human
ugacacaugcaa

SEQ ID NO: 2991645 - RNA, 18 nt, Human
ugacacacagcucugucc

SEQ ID NO: 2991646 - RNA, 16 nt, Human
ugacacacagcucugu

SEQ ID NO: 2991647 - RNA, 19 nt, Human
ugacaaagacugaguacgu

SEQ ID NO: 2991648 - RNA, 19 nt, Human
ugacacacagcucuguccu

SEQ ID NO: 2991649 - RNA, 17 nt, Human
agaguuguuacauuuuu

SEQ ID NO: 2991650 - RNA, 16 nt, Human
agaguuguuacauuuu

SEQ ID NO: 2991651 - RNA, 15 nt, Human
agagucacuggaaca

SEQ ID NO: 2991652 - RNA, 20 nt, Human
agaguuguuacauuuuuaag

SEQ ID NO: 2991653 - RNA, 19 nt, Human
agaguuguuacauuuuuaa

SEQ ID NO: 2991654 - RNA, 18 nt, Human
agauaauacaccacuaca

SEQ ID NO: 2991655 - RNA, 16 nt, Human
agauacuguaucauga

SEQ ID NO: 2991656 - RNA, 15 nt, Human
agauacuguaucaug

SEQ ID NO: 2991657 - RNA, 21 nt, Human
agauauuuugcuuugugauuu

SEQ ID NO: 2991658 - RNA, 20 nt, Human
agauauuuugcuuugugauu

SEQ ID NO: 2991659 - RNA, 18 nt, Human
agaucaaaagguuaauaa

SEQ ID NO: 2991660 - RNA, 18 nt, Human
agauaauauuaaggaaga

SEQ ID NO: 2991661 - RNA, 22 nt, Human
agauaauauuaaggaagacaau

SEQ ID NO: 2991662 - RNA, 13 nt, Human
agauacaguuacu

SEQ ID NO: 2991663 - RNA, 20 nt, Human
agauacaggaaaagcugcug

SEQ ID NO: 2991664 - RNA, 11 nt, Human
agauacuguau

SEQ ID NO: 2991665 - RNA, 22 nt, Human
agauacaguuacucagaauucu

SEQ ID NO: 2991666 - RNA, 18 nt, Human
ugaagguagaauguuuuc

SEQ ID NO: 2991667 - RNA, 19 nt, Human
ugaagguagaauguuuuca

SEQ ID NO: 2991668 - RNA, 22 nt, Human
ugaaggguaauuauauaguuac

SEQ ID NO: 2991669 - RNA, 14 nt, Human
ugaagucacacagu

SEQ ID NO: 2991670 - RNA, 15 nt, Human
ugaauacuuuauaaa

SEQ ID NO: 2991671 - RNA, 22 nt, Human
ugaauaccccaagacucccaug

SEQ ID NO: 2991672 - RNA, 14 nt, Human
ugaauaccccaaga

SEQ ID NO: 2991673 - RNA, 23 nt, Human
ugaauguaggcuggcuuucagag

SEQ ID NO: 2991674 - RNA, 21 nt, Human
agaguaggcuauuccugagag

SEQ ID NO: 2991675 - RNA, 16 nt, Human
agagguggggagcaga

SEQ ID NO: 2991676 - RNA, 15 nt, Human
agagguuaagguggg

SEQ ID NO: 2991677 - RNA, 16 nt, Human
agagggagggagggcu

SEQ ID NO: 2991678 - RNA, 19 nt, Human
ucuggauucauauuuaauu

SEQ ID NO: 2991679 - RNA, 16 nt, Human
ucuggauucauauuua

SEQ ID NO: 2991680 - RNA, 22 nt, Human
ucugcuuugggguuuaucagaa

SEQ ID NO: 2991681 - RNA, 14 nt, Human
agaagcuccaggua

SEQ ID NO: 2991682 - RNA, 16 nt, Human
ucuggcagcucagaga

SEQ ID NO: 2991683 - RNA, 17 nt, Human
ucuggcagcucagagag

SEQ ID NO: 2991684 - RNA, 20 nt, Human
ucuggcagaguugaagacag

SEQ ID NO: 2991685 - RNA, 23 nt, Human
ucuggcagaguugaagacagagc

SEQ ID NO: 2991686 - RNA, 18 nt, Human
ucuggcagcucagagagg

SEQ ID NO: 2991687 - RNA, 21 nt, Human
ucuggcagcucagagagggug

SEQ ID NO: 2991688 - RNA, 16 nt, Human
agaauaaaccaagaau

SEQ ID NO: 2991689 - RNA, 18 nt, Human
agaauaggcacuuuaaaa

SEQ ID NO: 2991690 - RNA, 17 nt, Human
agaauaggcacuuuaaa

SEQ ID NO: 2991691 - RNA, 22 nt, Human
agaauaggcacuuuaaaacacu

SEQ ID NO: 2991692 - RNA, 20 nt, Human
agaauaggcacuuuaaaaca

SEQ ID NO: 2991693 - RNA, 17 nt, Human
agaaguucuaguguuuu

SEQ ID NO: 2991694 - RNA, 16 nt, Human
agaaguucuaguguuu

SEQ ID NO: 2991695 - RNA, 15 nt, Human
agaaguucuaguguu

SEQ ID NO: 2991696 - RNA, 13 nt, Human
agaaguugauaug

SEQ ID NO: 2991697 - RNA, 15 nt, Human
agaaguuugaacauu

SEQ ID NO: 2991698 - RNA, 22 nt, Human
agaaguuugagaucagccuggg

SEQ ID NO: 2991699 - RNA, 17 nt, Human
agaacuauguuuuuguu

SEQ ID NO: 2991700 - RNA, 19 nt, Human
agaaccuuuugagugccuu

SEQ ID NO: 2991701 - RNA, 23 nt, Human
agaaccuuuugagugccuuacac

SEQ ID NO: 2991702 - RNA, 16 nt, Human
agaacucccuuucaac

SEQ ID NO: 2991703 - RNA, 15 nt, Human
agaacucccuuucaa

SEQ ID NO: 2991704 - RNA, 17 nt, Human
agaacucccuuucaaca

SEQ ID NO: 2991705 - RNA, 12 nt, Human
ucugcccuuggu

SEQ ID NO: 2991706 - RNA, 23 nt, Human
ucugcccuugguuaggcauugug

SEQ ID NO: 2991707 - RNA, 23 nt, Human
ucugcccacucccugcaaccuga

SEQ ID NO: 2991708 - RNA, 20 nt, Human
ucugcccauccugccccuga

SEQ ID NO: 2991709 - RNA, 23 nt, Human
agaagcccaggaaaggcuccagg

SEQ ID NO: 2991710 - RNA, 16 nt, Human
agaagcagaggaagga

SEQ ID NO: 2991711 - RNA, 19 nt, Human
agaagcaccaaucaugaau

SEQ ID NO: 2991712 - RNA, 19 nt, Human
agaagcaacccaaauguuc

SEQ ID NO: 2991713 - RNA, 16 nt, Human
acuuuguguucaccuu

SEQ ID NO: 2991714 - RNA, 21 nt, Human
ucuccuuggugucgggcauga

SEQ ID NO: 2991715 - RNA, 23 nt, Human
ucuccuuggugucgggcaugaca

SEQ ID NO: 2991716 - RNA, 19 nt, Human
ucuccuguaccucuugagc

SEQ ID NO: 2991717 - RNA, 12 nt, Human
ucucucaggcca

SEQ ID NO: 2991718 - RNA, 22 nt, Human
ucucucacuuguuuuauuuaac

SEQ ID NO: 2991719 - RNA, 21 nt, Human
ucucucacuuguuuuauuuaa

SEQ ID NO: 2991720 - RNA, 23 nt, Human
acuuuaccuuuuuuauacauaaa

SEQ ID NO: 2991721 - RNA, 12 nt, Human
acuuuaaaagca

SEQ ID NO: 2991722 - RNA, 12 nt, Human
acuuuaaaacac

SEQ ID NO: 2991723 - RNA, 14 nt, Human
acuuuaaaagcauu

SEQ ID NO: 2991724 - RNA, 22 nt, Human
acuuguuuuauuuaaccucuaa

SEQ ID NO: 2991725 - RNA, 16 nt, Human
acuuuaaaaggagcca

SEQ ID NO: 2991726 - RNA, 14 nt, Human
acuuguggacacag

SEQ ID NO: 2991727 - RNA, 13 nt, Human
acuuuggaaagag

SEQ ID NO: 2991728 - RNA, 14 nt, Human
acuuuggaaagagu

SEQ ID NO: 2991729 - RNA, 23 nt, Human
acuuuggaaagacuuuuccaacc

SEQ ID NO: 2991730 - RNA, 23 nt, Human
acuuuggaaagaguaggaagacu

SEQ ID NO: 2991731 - RNA, 21 nt, Human
acuuugcacacuuuggcccag

SEQ ID NO: 2991732 - RNA, 22 nt, Human
acuuugcacacuuuggcccagg

SEQ ID NO: 2991733 - RNA, 20 nt, Human
agaaagcagaacagugauua

SEQ ID NO: 2991734 - RNA, 18 nt, Human
agaaagcagaacagugau

SEQ ID NO: 2991735 - RNA, 17 nt, Human
agaaagcagaacaguga

SEQ ID NO: 2991736 - RNA, 22 nt, Human
agaaagacuaucuaaauguuga

SEQ ID NO: 2991737 - RNA, 20 nt, Human
agaaagacuaucuaaauguu

SEQ ID NO: 2991738 - RNA, 16 nt, Human
agaaagacuauucaaa

SEQ ID NO: 2991739 - RNA, 15 nt, Human
agaaaugccuuaccc

SEQ ID NO: 2991740 - RNA, 20 nt, Human
ucugaaggguaauuauauag

SEQ ID NO: 2991741 - RNA, 18 nt, Human
ucugaaggcuggguucug

SEQ ID NO: 2991742 - RNA, 22 nt, Human
ucugaaggacauugcggacagc

SEQ ID NO: 2991743 - RNA, 16 nt, Human
ucucuugguccugcug

SEQ ID NO: 2991744 - RNA, 17 nt, Human
ucucuugguccugcugc

SEQ ID NO: 2991745 - RNA, 18 nt, Human
ucucuugguccugcugca

SEQ ID NO: 2991746 - RNA, 18 nt, Human
agaaaaaugagccuggca

SEQ ID NO: 2991747 - RNA, 17 nt, Human
agaaaaaauauuuuccu

SEQ ID NO: 2991748 - RNA, 23 nt, Human
agaaaaaauauuuuccugccagg

SEQ ID NO: 2991749 - RNA, 19 nt, Human
agaaaaaauauuuucccua

SEQ ID NO: 2991750 - RNA, 16 nt, Human
agaaacacaacuauau

SEQ ID NO: 2991751 - RNA, 22 nt, Human
agaaacuggcaaagcagaaugu

SEQ ID NO: 2991752 - RNA, 17 nt, Human
agaaacuggcaaagcag

SEQ ID NO: 2991753 - RNA, 16 nt, Human
agaaacuggcaaagca

SEQ ID NO: 2991754 - RNA, 15 nt, Human
agaaacuggcaaagc

SEQ ID NO: 2991755 - RNA, 15 nt, Human
agaaacuggaacucu

SEQ ID NO: 2991756 - RNA, 12 nt, Human
ucuagcaugaag

SEQ ID NO: 2991757 - RNA, 24 nt, Human
ucuagauacuguaucaugacaaag

SEQ ID NO: 2991758 - RNA, 13 nt, Human
ucuauaauuuaaa

SEQ ID NO: 2991759 - RNA, 22 nt, Human
ucuauaauuuccauuuacuuaa

SEQ ID NO: 2991760 - RNA, 19 nt, Human
ucuauaauuuccauuuacu

SEQ ID NO: 2991761 - RNA, 13 nt, Human
ucuauaauuucca

SEQ ID NO: 2991762 - RNA, 18 nt, Human
ucuaguguuuucaauuuu

SEQ ID NO: 2991763 - RNA, 23 nt, Human
ucuaguuugauuaaauucuugca

SEQ ID NO: 2991764 - RNA, 22 nt, Human
ucuaguuugauuaaauucuugc

SEQ ID NO: 2991765 - RNA, 14 nt, Human
ucuaggaaaauuau

SEQ ID NO: 2991766 - RNA, 14 nt, Human
ucuaguguuuucaa

SEQ ID NO: 2991767 - RNA, 20 nt, Human
acuuccagauccuggaaauc

SEQ ID NO: 2991768 - RNA, 17 nt, Human
acuuccacugccauccu

SEQ ID NO: 2991769 - RNA, 18 nt, Human
acuuccaauuuacauacu

SEQ ID NO: 2991770 - RNA, 20 nt, Human
acuuagagguggggagcaga

SEQ ID NO: 2991771 - RNA, 15 nt, Human
acuuacuguacauga

SEQ ID NO: 2991772 - RNA, 14 nt, Human
acuuacuguacaug

SEQ ID NO: 2991773 - RNA, 13 nt, Human
acuuacuguacau

SEQ ID NO: 2991774 - RNA, 12 nt, Human
ucuaccugaggg

SEQ ID NO: 2991775 - RNA, 19 nt, Human
ucuaccugaggggccucuu

SEQ ID NO: 2991776 - RNA, 23 nt, Human
acuugaacccgggaggcagaggu

SEQ ID NO: 2991777 - RNA, 21 nt, Human
acuugaacccgggaggcagag

SEQ ID NO: 2991778 - RNA, 19 nt, Human
acuugagaauuacccuuuu

SEQ ID NO: 2991779 - RNA, 14 nt, Human
acuugucuuuggac

SEQ ID NO: 2991780 - RNA, 14 nt, Human
acuuggaagcuccg

SEQ ID NO: 2991781 - RNA, 17 nt, Human
ucucaaaacugcacugu

SEQ ID NO: 2991782 - RNA, 21 nt, Human
ucucacagcuccaagaauuuc

SEQ ID NO: 2991783 - RNA, 16 nt, Human
ucucaaaaaaagaaaa

SEQ ID NO: 2991784 - RNA, 16 nt, Human
ucuauuguuucuuuca

SEQ ID NO: 2991785 - RNA, 18 nt, Human
acuucuaaguaaaaccac

SEQ ID NO: 2991786 - RNA, 19 nt, Human
acuucuaaguaaaaccaca

SEQ ID NO: 2991787 - RNA, 13 nt, Human
acuucuaaguaaa

SEQ ID NO: 2991788 - RNA, 18 nt, Human
acuucuccacccugcucu

SEQ ID NO: 2991789 - RNA, 21 nt, Human
acuucucuacccaucuuaaaa

SEQ ID NO: 2991790 - RNA, 17 nt, Human
acuucgggaggucgagg

SEQ ID NO: 2991791 - RNA, 20 nt, Human
acuucgggaggucgaggcag

SEQ ID NO: 2991792 - RNA, 15 nt, Human
acuguccuauuauau

SEQ ID NO: 2991793 - RNA, 16 nt, Human
acuguccuauuauauu

SEQ ID NO: 2991794 - RNA, 23 nt, Human
acuguccuacccacccuccuuuc

SEQ ID NO: 2991795 - RNA, 18 nt, Human
acuguccuauuauauuca

SEQ ID NO: 2991796 - RNA, 22 nt, Human
acugucagcuccccucggagaa

SEQ ID NO: 2991797 - RNA, 23 nt, Human
acugucagcuccccucggagaag

SEQ ID NO: 2991798 - RNA, 20 nt, Human
acuguaucaugacaaagacu

SEQ ID NO: 2991799 - RNA, 16 nt, Human
acuguaucaugacaaa

SEQ ID NO: 2991800 - RNA, 21 nt, Human
acuguacaugaaaacacauuu

SEQ ID NO: 2991801 - RNA, 20 nt, Human
acuguacaugaaaacacauu

SEQ ID NO: 2991802 - RNA, 14 nt, Human
acuguaucaugaca

SEQ ID NO: 2991803 - RNA, 22 nt, Human
acuguacaaaguagaagucuua

SEQ ID NO: 2991804 - RNA, 16 nt, Human
acuguacaaaguagaa

SEQ ID NO: 2991805 - RNA, 17 nt, Human
acuggguacuuguggac

SEQ ID NO: 2991806 - RNA, 16 nt, Human
acuguacaugaaaaca

SEQ ID NO: 2991807 - RNA, 19 nt, Human
acuguacaugaaaacacau

SEQ ID NO: 2991808 - RNA, 15 nt, Human
acuguacacauaagc

SEQ ID NO: 2991809 - RNA, 22 nt, Human
acugaagaagcaccaaucauga

SEQ ID NO: 2991810 - RNA, 12 nt, Human
acugaagaagca

SEQ ID NO: 2991811 - RNA, 22 nt, Human
acugaacaaacuaucagaggaa

SEQ ID NO: 2991812 - RNA, 14 nt, Human
ucgcuccugugucu

SEQ ID NO: 2991813 - RNA, 15 nt, Human
acuggguacuugugg

SEQ ID NO: 2991814 - RNA, 21 nt, Human
acugggcuuggggaccagagc

SEQ ID NO: 2991815 - RNA, 23 nt, Human
ucgcugugucagcauagaaguaa

SEQ ID NO: 2991816 - RNA, 17 nt, Human
ucuaccaaaaaucucaa

SEQ ID NO: 2991817 - RNA, 19 nt, Human
ucuacccaucuuaaaaaca

SEQ ID NO: 2991818 - RNA, 21 nt, Human
ucuacccaucuuaaaaacaac

SEQ ID NO: 2991819 - RNA, 21 nt, Human
ucuacccucuuagaaaaacca

SEQ ID NO: 2991820 - RNA, 16 nt, Human
ucuaaaggcuaccuuu

SEQ ID NO: 2991821 - RNA, 13 nt, Human
ucuaaaggcuacc

SEQ ID NO: 2991822 - RNA, 17 nt, Human
ucuaaagcugccagccg

SEQ ID NO: 2991823 - RNA, 17 nt, Human
acuguuaauaguucagg

SEQ ID NO: 2991824 - RNA, 21 nt, Human
acuguuaauaguucagguaac

SEQ ID NO: 2991825 - RNA, 23 nt, Human
ucgggaggcugaggcaggagacu

SEQ ID NO: 2991826 - RNA, 13 nt, Human
ucaguagucagac

SEQ ID NO: 2991827 - RNA, 19 nt, Human
ucagugccuuauggaacac

SEQ ID NO: 2991828 - RNA, 20 nt, Human
ucagugccuuauggaacacu

SEQ ID NO: 2991829 - RNA, 22 nt, Human
ucagugccuuauggaacacucu

SEQ ID NO: 2991830 - RNA, 23 nt, Human
ucagugccuuauggaacacucug

SEQ ID NO: 2991831 - RNA, 13 nt, Human
ucaguggcagcug

SEQ ID NO: 2991832 - RNA, 18 nt, Human
ucagugccuuauggaaca

SEQ ID NO: 2991833 - RNA, 16 nt, Human
ucaguggcagcugcuu

SEQ ID NO: 2991834 - RNA, 17 nt, Human
ucaguuguuaguguguc

SEQ ID NO: 2991835 - RNA, 15 nt, Human
ucaguggcagcugcu

SEQ ID NO: 2991836 - RNA, 14 nt, Human
ucaguggcagcugc

SEQ ID NO: 2991837 - RNA, 15 nt, Human
ucaguuguuauuuau

SEQ ID NO: 2991838 - RNA, 20 nt, Human
ucaguuguuauuuauugaaa

SEQ ID NO: 2991839 - RNA, 19 nt, Human
ucaguuguuagugugucuu

SEQ ID NO: 2991840 - RNA, 14 nt, Human
ucaguuuaucuguu

SEQ ID NO: 2991841 - RNA, 16 nt, Human
ucaguuuaucuguuca

SEQ ID NO: 2991842 - RNA, 12 nt, Human
ucaguuugguug

SEQ ID NO: 2991843 - RNA, 16 nt, Human
ucaguuugcagaguag

SEQ ID NO: 2991844 - RNA, 15 nt, Human
ucaguuugcagagua

SEQ ID NO: 2991845 - RNA, 22 nt, Human
ucagguggggucacucuggcag

SEQ ID NO: 2991846 - RNA, 21 nt, Human
accgaaaacguggcugcuuca

SEQ ID NO: 2991847 - RNA, 22 nt, Human
accgaaaacguggcugcuucaa

SEQ ID NO: 2991848 - RNA, 18 nt, Human
ucaggugucccugcacuu

SEQ ID NO: 2991849 - RNA, 17 nt, Human
ucaggugucccugcacu

SEQ ID NO: 2991850 - RNA, 23 nt, Human
ucagguggggucacucuggcagc

SEQ ID NO: 2991851 - RNA, 15 nt, Human
ucaggugucccugca

SEQ ID NO: 2991852 - RNA, 20 nt, Human
accgaaaacguggcugcuuc

SEQ ID NO: 2991853 - RNA, 20 nt, Human
acccuugccgucuaccugag

SEQ ID NO: 2991854 - RNA, 13 nt, Human
ucaguaauaacuc

SEQ ID NO: 2991855 - RNA, 13 nt, Human
ucaguaagccgug

SEQ ID NO: 2991856 - RNA, 22 nt, Human
ucaggugucccugcacuugcag

SEQ ID NO: 2991857 - RNA, 23 nt, Human
ucagguuuucuuuuaagaaucaa

SEQ ID NO: 2991858 - RNA, 20 nt, Human
ucagguuuucuuuuaagaau

SEQ ID NO: 2991859 - RNA, 19 nt, Human
ucagguuuucuuuuaagaa

SEQ ID NO: 2991860 - RNA, 23 nt, Human
acccugaggcccagagggccugc

SEQ ID NO: 2991861 - RNA, 11 nt, Human
acccugaggcc

SEQ ID NO: 2991862 - RNA, 17 nt, Human
acccugaggcccagagg

SEQ ID NO: 2991863 - RNA, 19 nt, Human
acccugaggcccagagggc

SEQ ID NO: 2991864 - RNA, 21 nt, Human
acccugaggcccagagggccu

SEQ ID NO: 2991865 - RNA, 19 nt, Human
acccgggaagggggcuggg

SEQ ID NO: 2991866 - RNA, 20 nt, Human
acccgggaagggggcuggga

SEQ ID NO: 2991867 - RNA, 17 nt, Human
acccucauguucuuaau

SEQ ID NO: 2991868 - RNA, 15 nt, Human
acccucauguucuua

SEQ ID NO: 2991869 - RNA, 14 nt, Human
acccucauguucuu

SEQ ID NO: 2991870 - RNA, 22 nt, Human
acccgggaagggggcugggaca

SEQ ID NO: 2991871 - RNA, 21 nt, Human
acccuccuuucaccacaugug

SEQ ID NO: 2991872 - RNA, 13 nt, Human
ucaggccaggccc

SEQ ID NO: 2991873 - RNA, 14 nt, Human
ucaggccaggcccu

SEQ ID NO: 2991874 - RNA, 15 nt, Human
ucaggccaggcccuc

SEQ ID NO: 2991875 - RNA, 16 nt, Human
ucaggccaggcccucu

SEQ ID NO: 2991876 - RNA, 13 nt, Human
ucaggccagcugc

SEQ ID NO: 2991877 - RNA, 12 nt, Human
ucaggccaggcc

SEQ ID NO: 2991878 - RNA, 12 nt, Human
acccccagccug

SEQ ID NO: 2991879 - RNA, 13 nt, Human
acccccagccugc

SEQ ID NO: 2991880 - RNA, 18 nt, Human
ucaggcaggugggaugga

SEQ ID NO: 2991881 - RNA, 17 nt, Human
ucaggcaggugggaugg

SEQ ID NO: 2991882 - RNA, 17 nt, Human
ucaggccaggcccucug

SEQ ID NO: 2991883 - RNA, 18 nt, Human
ucaggccaggcccucugc

SEQ ID NO: 2991884 - RNA, 19 nt, Human
ucaggccaggcccucugcc

SEQ ID NO: 2991885 - RNA, 12 nt, Human
ucaggggugugc

SEQ ID NO: 2991886 - RNA, 19 nt, Human
ucaggggugugcggccuuu

SEQ ID NO: 2991887 - RNA, 23 nt, Human
ucaggggugugcggccuuuggcu

SEQ ID NO: 2991888 - RNA, 17 nt, Human
ucaggguuggccccugc

SEQ ID NO: 2991889 - RNA, 19 nt, Human
ucaggguuggccccugccc

SEQ ID NO: 2991890 - RNA, 18 nt, Human
ucaggguuggccccugcc

SEQ ID NO: 2991891 - RNA, 19 nt, Human
acccgcuaagagggaggga

SEQ ID NO: 2991892 - RNA, 12 nt, Human
ucagcccucaga

SEQ ID NO: 2991893 - RNA, 13 nt, Human
ucagcccucagaa

SEQ ID NO: 2991894 - RNA, 13 nt, Human
acccagcgagccc

SEQ ID NO: 2991895 - RNA, 17 nt, Human
acccagcgagcccuggu

SEQ ID NO: 2991896 - RNA, 16 nt, Human
acccagcgagcccugg

SEQ ID NO: 2991897 - RNA, 15 nt, Human
acccaggagccccga

SEQ ID NO: 2991898 - RNA, 13 nt, Human
acccaggagcccc

SEQ ID NO: 2991899 - RNA, 13 nt, Human
accccagguuucu

SEQ ID NO: 2991900 - RNA, 11 nt, Human
acccaggugcu

SEQ ID NO: 2991901 - RNA, 23 nt, Human
acccaggugcuaggaacacuccu

SEQ ID NO: 2991902 - RNA, 16 nt, Human
ucagaucucuaacuuc

SEQ ID NO: 2991903 - RNA, 15 nt, Human
ucagaucucuaacuu

SEQ ID NO: 2991904 - RNA, 16 nt, Human
ucagagcugcccucuc

SEQ ID NO: 2991905 - RNA, 15 nt, Human
ucagagcugcccucu

SEQ ID NO: 2991906 - RNA, 17 nt, Human
ucagagcugcccucucc

SEQ ID NO: 2991907 - RNA, 14 nt, Human
ucagagcugcccuc

SEQ ID NO: 2991908 - RNA, 13 nt, Human
ucagagcugcccu

SEQ ID NO: 2991909 - RNA, 23 nt, Human
ucagagacuccugcaggcagcca

SEQ ID NO: 2991910 - RNA, 23 nt, Human
ucagaaguuucugccgcagcccu

SEQ ID NO: 2991911 - RNA, 15 nt, Human
acccagcccacuucu

SEQ ID NO: 2991912 - RNA, 12 nt, Human
ucagaauucuca

SEQ ID NO: 2991913 - RNA, 10 nt, Human
ucagaauucu

SEQ ID NO: 2991914 - RNA, 20 nt, Human
ucagaauucucagaaucuca

SEQ ID NO: 2991915 - RNA, 22 nt, Human
ucagagacuccugcaggcagcc

SEQ ID NO: 2991916 - RNA, 20 nt, Human
acccaaauguucaucaauga

SEQ ID NO: 2991917 - RNA, 16 nt, Human
acccaaauguucauca

SEQ ID NO: 2991918 - RNA, 20 nt, Human
acccacugcuuuuggucugu

SEQ ID NO: 2991919 - RNA, 20 nt, Human
accauucuccaccugccagg

SEQ ID NO: 2991920 - RNA, 21 nt, Human
accauucuccaccugccaggg

SEQ ID NO: 2991921 - RNA, 19 nt, Human
accauucuccaccugccag

SEQ ID NO: 2991922 - RNA, 22 nt, Human
accauuuugcugucccuuuucc

SEQ ID NO: 2991923 - RNA, 23 nt, Human
accauuuugcugucccuuuuccu

SEQ ID NO: 2991924 - RNA, 21 nt, Human
accauuuugggguacccacug

SEQ ID NO: 2991925 - RNA, 23 nt, Human
ucacugagacagcccgggcucug

SEQ ID NO: 2991926 - RNA, 21 nt, Human
ucacuauguugcccaggcagg

SEQ ID NO: 2991927 - RNA, 20 nt, Human
ucacuauguugcccaggcag

SEQ ID NO: 2991928 - RNA, 19 nt, Human
ucacauuccugaacaggau

SEQ ID NO: 2991929 - RNA, 22 nt, Human
ucaccagccccagugcccacag

SEQ ID NO: 2991930 - RNA, 14 nt, Human
ucacuguugcccag

SEQ ID NO: 2991931 - RNA, 18 nt, Human
ucacugcaaccuccgccu

SEQ ID NO: 2991932 - RNA, 15 nt, Human
ucacuguugcccagg

SEQ ID NO: 2991933 - RNA, 13 nt, Human
acauuuuaugucu

SEQ ID NO: 2991934 - RNA, 15 nt, Human
acauuuuaugucuuu

SEQ ID NO: 2991935 - RNA, 16 nt, Human
acauuuuacacacugu

SEQ ID NO: 2991936 - RNA, 18 nt, Human
acauuuuuaagugcugca

SEQ ID NO: 2991937 - RNA, 15 nt, Human
acauuuuuaagugcu

SEQ ID NO: 2991938 - RNA, 23 nt, Human
acauuuuucuuagggaaggauac

SEQ ID NO: 2991939 - RNA, 13 nt, Human
acauuuuucuuag

SEQ ID NO: 2991940 - RNA, 21 nt, Human
acauuuuuuaaaugcaccugg

SEQ ID NO: 2991941 - RNA, 16 nt, Human
acauuggaaacaaguc

SEQ ID NO: 2991942 - RNA, 22 nt, Human
acauugcggacagccacggcca

SEQ ID NO: 2991943 - RNA, 21 nt, Human
acauugcggacagccacggcc

SEQ ID NO: 2991944 - RNA, 22 nt, Human
ucaauaggaaaaacugauuuuu

SEQ ID NO: 2991945 - RNA, 23 nt, Human
ucaauauuucagauaaucacaau

SEQ ID NO: 2991946 - RNA, 14 nt, Human
ucaaucaugucagu

SEQ ID NO: 2991947 - RNA, 18 nt, Human
ucaauaggaaaaacugau

SEQ ID NO: 2991948 - RNA, 19 nt, Human
ucaauaggaaaaacugauu

SEQ ID NO: 2991949 - RNA, 17 nt, Human
ucaauaggaaaaacuga

SEQ ID NO: 2991950 - RNA, 17 nt, Human
ucaagugauucuccugc

SEQ ID NO: 2991951 - RNA, 16 nt, Human
ucaagugauucuccug

SEQ ID NO: 2991952 - RNA, 17 nt, Human
ucaagagggucugagga

SEQ ID NO: 2991953 - RNA, 23 nt, Human
ucaaggauccugagccagauuuc

SEQ ID NO: 2991954 - RNA, 14 nt, Human
ucacagaagaugaa

SEQ ID NO: 2991955 - RNA, 16 nt, Human
ucacagaccuuugaac

SEQ ID NO: 2991956 - RNA, 20 nt, Human
ucaauugugaaaaaauuuac

SEQ ID NO: 2991957 - RNA, 16 nt, Human
ucaauugugaaaaaau

SEQ ID NO: 2991958 - RNA, 12 nt, Human
ucaauuuaaaaa

SEQ ID NO: 2991959 - RNA, 13 nt, Human
ucaauuuaaaaaa

SEQ ID NO: 2991960 - RNA, 23 nt, Human
ucacagcagugagacuggggcca

SEQ ID NO: 2991961 - RNA, 19 nt, Human
ucacagcuccaagaauuuc

SEQ ID NO: 2991962 - RNA, 17 nt, Human
ucacagccagacuggca

SEQ ID NO: 2991963 - RNA, 23 nt, Human
ucacagccagacuggcacaguuu

SEQ ID NO: 2991964 - RNA, 14 nt, Human
ucacagaugggugc

SEQ ID NO: 2991965 - RNA, 15 nt, Human
ucacagaugggugcu

SEQ ID NO: 2991966 - RNA, 18 nt, Human
ucacagcagugagacugg

SEQ ID NO: 2991967 - RNA, 22 nt, Human
ucacagcuuauuuccucauuuu

SEQ ID NO: 2991968 - RNA, 16 nt, Human
ucacauauugauuucc

SEQ ID NO: 2991969 - RNA, 20 nt, Human
ucacauauugauuuccguua

SEQ ID NO: 2991970 - RNA, 18 nt, Human
ucacauauugauuuccgu

SEQ ID NO: 2991971 - RNA, 16 nt, Human
ucaccagccccagugc

SEQ ID NO: 2991972 - RNA, 17 nt, Human
ucaccagccccagugcc

SEQ ID NO: 2991973 - RNA, 17 nt, Human
ucacauuccugaacagg

SEQ ID NO: 2991974 - RNA, 13 nt, Human
ucacauuccugaa

SEQ ID NO: 2991975 - RNA, 16 nt, Human
accacaagacugcaca

SEQ ID NO: 2991976 - RNA, 23 nt, Human
accacacccagcccacuucugcc

SEQ ID NO: 2991977 - RNA, 21 nt, Human
accacacccagcccacuucug

SEQ ID NO: 2991978 - RNA, 20 nt, Human
accacacccagcccacuucu

SEQ ID NO: 2991979 - RNA, 16 nt, Human
accacacccagcccac

SEQ ID NO: 2991980 - RNA, 15 nt, Human
accacacccagccca

SEQ ID NO: 2991981 - RNA, 17 nt, Human
accacacagaggcugcc

SEQ ID NO: 2991982 - RNA, 14 nt, Human
accaacacgagcag

SEQ ID NO: 2991983 - RNA, 19 nt, Human
accaacacgagcaggcuac

SEQ ID NO: 2991984 - RNA, 20 nt, Human
accaaccacugcgaccacaa

SEQ ID NO: 2991985 - RNA, 16 nt, Human
accaacauacucccau

SEQ ID NO: 2991986 - RNA, 19 nt, Human
accaaaucagcugcuacua

SEQ ID NO: 2991987 - RNA, 16 nt, Human
accaaaucagcugcua

SEQ ID NO: 2991988 - RNA, 20 nt, Human
uauuuugacuuguugagggu

SEQ ID NO: 2991989 - RNA, 14 nt, Human
uauuuugacuuguu

SEQ ID NO: 2991990 - RNA, 15 nt, Human
uauuuugcuuuguga

SEQ ID NO: 2991991 - RNA, 13 nt, Human
uauuuugcuuugu

SEQ ID NO: 2991992 - RNA, 20 nt, Human
uauuuugcuuugugauuuuu

SEQ ID NO: 2991993 - RNA, 19 nt, Human
uauuuuaauaauguuucaa

SEQ ID NO: 2991994 - RNA, 22 nt, Human
uauuuuaauaauguuucaaaca

SEQ ID NO: 2991995 - RNA, 13 nt, Human
uauuuuacauaaa

SEQ ID NO: 2991996 - RNA, 17 nt, Human
uauuuuuguagagccag

SEQ ID NO: 2991997 - RNA, 18 nt, Human
uauuuuaaaagaaugauu

SEQ ID NO: 2991998 - RNA, 14 nt, Human
uauuuuaaaagaau

SEQ ID NO: 2991999 - RNA, 15 nt, Human
acaugaaaacacauu

SEQ ID NO: 2992000 - RNA, 16 nt, Human
acaucuugcucugcug

SEQ ID NO: 2992001 - RNA, 15 nt, Human
acaucuugcucugcu

SEQ ID NO: 2992002 - RNA, 17 nt, Human
acaucuugcucugcuga

SEQ ID NO: 2992003 - RNA, 22 nt, Human
acaucuugcucugcugacagac

SEQ ID NO: 2992004 - RNA, 19 nt, Human
acaucuuggucagauuuga

SEQ ID NO: 2992005 - RNA, 14 nt, Human
acaucuugcucugc

SEQ ID NO: 2992006 - RNA, 21 nt, Human
acaugucuuuucuugcaugag

SEQ ID NO: 2992007 - RNA, 18 nt, Human
acauggaauaacauguaa

SEQ ID NO: 2992008 - RNA, 14 nt, Human
acauggaaguacua

SEQ ID NO: 2992009 - RNA, 20 nt, Human
acauggaauaacauguaauu

SEQ ID NO: 2992010 - RNA, 23 nt, Human
acaugagcaucaggccaggcccu

SEQ ID NO: 2992011 - RNA, 19 nt, Human
acauggaguauaugucaag

SEQ ID NO: 2992012 - RNA, 15 nt, Human
acauggaguauaugu

SEQ ID NO: 2992013 - RNA, 14 nt, Human
acauggccuuugcu

SEQ ID NO: 2992014 - RNA, 20 nt, Human
ucaaacagucucaggaaauc

SEQ ID NO: 2992015 - RNA, 21 nt, Human
ucaaacagucucaggaaauca

SEQ ID NO: 2992016 - RNA, 13 nt, Human
ucaaacagucuca

SEQ ID NO: 2992017 - RNA, 16 nt, Human
ucaaaagcugggcagg

SEQ ID NO: 2992018 - RNA, 20 nt, Human
ucaaagauauuuugcuuugu

SEQ ID NO: 2992019 - RNA, 13 nt, Human
ucaaagauauuuu

SEQ ID NO: 2992020 - RNA, 22 nt, Human
ucaaagauauuuugcuuuguga

SEQ ID NO: 2992021 - RNA, 22 nt, Human
acaugaaaacacauuuuucuua

SEQ ID NO: 2992022 - RNA, 23 nt, Human
acaugaaaacacauuuuucuuag

SEQ ID NO: 2992023 - RNA, 13 nt, Human
acaugagcaucag

SEQ ID NO: 2992024 - RNA, 23 nt, Human
ucaaauacgugggcauucaaaug

SEQ ID NO: 2992025 - RNA, 22 nt, Human
ucaaauacgugggcauucaaau

SEQ ID NO: 2992026 - RNA, 21 nt, Human
ucaaauacgugggcauucaaa

SEQ ID NO: 2992027 - RNA, 20 nt, Human
ucaaauacgugggcauucaa

SEQ ID NO: 2992028 - RNA, 17 nt, Human
acgcccuuggccauggg

SEQ ID NO: 2992029 - RNA, 23 nt, Human
acgcgugcacacaccagagccca

SEQ ID NO: 2992030 - RNA, 20 nt, Human
acgcgugcacacaccagagc

SEQ ID NO: 2992031 - RNA, 14 nt, Human
acgcccccacuggu

SEQ ID NO: 2992032 - RNA, 13 nt, Human
acgcuacccggga

SEQ ID NO: 2992033 - RNA, 17 nt, Human
acgcuacccgggaaggg

SEQ ID NO: 2992034 - RNA, 18 nt, Human
acgcuacccgggaagggg

SEQ ID NO: 2992035 - RNA, 14 nt, Human
acgcucucuggccu

SEQ ID NO: 2992036 - RNA, 16 nt, Human
acgcucucuggccuuc

SEQ ID NO: 2992037 - RNA, 15 nt, Human
acgcucucuggccuu

SEQ ID NO: 2992038 - RNA, 16 nt, Human
acggccaggccagagg

SEQ ID NO: 2992039 - RNA, 13 nt, Human
acggccaggccag

SEQ ID NO: 2992040 - RNA, 19 nt, Human
acggagucccaccuuggcu

SEQ ID NO: 2992041 - RNA, 17 nt, Human
acgcucucuggccuucg

SEQ ID NO: 2992042 - RNA, 20 nt, Human
acgaggucaggagaucgaga

SEQ ID NO: 2992043 - RNA, 18 nt, Human
acgccaggggaaaaucag

SEQ ID NO: 2992044 - RNA, 15 nt, Human
acgacugcccggcag

SEQ ID NO: 2992045 - RNA, 23 nt, Human
acgccaggggaaaaucagccugc

SEQ ID NO: 2992046 - RNA, 11 nt, Human
acgccauccca

SEQ ID NO: 2992047 - RNA, 14 nt, Human
acgccaucccagcc

SEQ ID NO: 2992048 - RNA, 15 nt, Human
acgccaucccagccc

SEQ ID NO: 2992049 - RNA, 16 nt, Human
acgccaucccagcccc

SEQ ID NO: 2992050 - RNA, 17 nt, Human
acgccaucccagcccca

SEQ ID NO: 2992051 - RNA, 18 nt, Human
acgccaucccagccccaa

SEQ ID NO: 2992052 - RNA, 14 nt, Human
uccaggcugggaga

SEQ ID NO: 2992053 - RNA, 17 nt, Human
uccaggcugggagagcc

SEQ ID NO: 2992054 - RNA, 18 nt, Human
uccaggcugggagagccu

SEQ ID NO: 2992055 - RNA, 22 nt, Human
uccaggcuccuuuagcgcccag

SEQ ID NO: 2992056 - RNA, 16 nt, Human
ucccaaagugcuggga

SEQ ID NO: 2992057 - RNA, 15 nt, Human
ucccaaagugcuggg

SEQ ID NO: 2992058 - RNA, 14 nt, Human
ucccacaaaggaga

SEQ ID NO: 2992059 - RNA, 11 nt, Human
ucccaccccac

SEQ ID NO: 2992060 - RNA, 14 nt, Human
ucccaccccacaca

SEQ ID NO: 2992061 - RNA, 18 nt, Human
uccagugaggcucugccc

SEQ ID NO: 2992062 - RNA, 19 nt, Human
uccagugaggcucugcccu

SEQ ID NO: 2992063 - RNA, 17 nt, Human
uccagugaggcucugcc

SEQ ID NO: 2992064 - RNA, 14 nt, Human
uccagugagacagc

SEQ ID NO: 2992065 - RNA, 20 nt, Human
uccagugaggcucugcccuu

SEQ ID NO: 2992066 - RNA, 14 nt, Human
acggcucacugcag

SEQ ID NO: 2992067 - RNA, 22 nt, Human
uccaugaagauguagaggagaa

SEQ ID NO: 2992068 - RNA, 15 nt, Human
uccaugaguccccug

SEQ ID NO: 2992069 - RNA, 16 nt, Human
uccaugaguccccugu

SEQ ID NO: 2992070 - RNA, 17 nt, Human
uccaugaguccccuguu

SEQ ID NO: 2992071 - RNA, 20 nt, Human
accugcacacuguccuauua

SEQ ID NO: 2992072 - RNA, 16 nt, Human
accugccaggaagcca

SEQ ID NO: 2992073 - RNA, 17 nt, Human
accugccaggaagccag

SEQ ID NO: 2992074 - RNA, 18 nt, Human
accugccaggaagccagc

SEQ ID NO: 2992075 - RNA, 14 nt, Human
accugaggggccuc

SEQ ID NO: 2992076 - RNA, 16 nt, Human
ucauaauaaguugcau

SEQ ID NO: 2992077 - RNA, 12 nt, Human
ucauaaugacuu

SEQ ID NO: 2992078 - RNA, 19 nt, Human
accugaauuuuggcugugu

SEQ ID NO: 2992079 - RNA, 18 nt, Human
accugaagacucauucuu

SEQ ID NO: 2992080 - RNA, 23 nt, Human
accugaagaguggucagaacaga

SEQ ID NO: 2992081 - RNA, 17 nt, Human
accugagccccaaaagg

SEQ ID NO: 2992082 - RNA, 12 nt, Human
accugagcccca

SEQ ID NO: 2992083 - RNA, 23 nt, Human
accugaggcccuucucuccagcc

SEQ ID NO: 2992084 - RNA, 17 nt, Human
ucauuuuuuuuaagaaa

SEQ ID NO: 2992085 - RNA, 18 nt, Human
ucauuuuuuuuaagaaaa

SEQ ID NO: 2992086 - RNA, 19 nt, Human
ucauuuuuaguagagacag

SEQ ID NO: 2992087 - RNA, 14 nt, Human
ucauuugucacaca

SEQ ID NO: 2992088 - RNA, 16 nt, Human
ucauuugucacacacu

SEQ ID NO: 2992089 - RNA, 23 nt, Human
accugccuguugggccaggagcc

SEQ ID NO: 2992090 - RNA, 21 nt, Human
accugcgucucauacucaccu

SEQ ID NO: 2992091 - RNA, 16 nt, Human
accugcggugcuaucu

SEQ ID NO: 2992092 - RNA, 20 nt, Human
accuggaauauauaaccagu

SEQ ID NO: 2992093 - RNA, 18 nt, Human
accuuuuuuauacauaaa

SEQ ID NO: 2992094 - RNA, 17 nt, Human
accuuuuuuauacauaa

SEQ ID NO: 2992095 - RNA, 16 nt, Human
accuuuuuuauacaua

SEQ ID NO: 2992096 - RNA, 14 nt, Human
accuuuguccccac

SEQ ID NO: 2992097 - RNA, 15 nt, Human
accuuuguccccacc

SEQ ID NO: 2992098 - RNA, 16 nt, Human
accuuuguccccaccg

SEQ ID NO: 2992099 - RNA, 14 nt, Human
accuuuuuuauaca

SEQ ID NO: 2992100 - RNA, 13 nt, Human
accuuugucccca

SEQ ID NO: 2992101 - RNA, 16 nt, Human
accuugacagggcaca

SEQ ID NO: 2992102 - RNA, 22 nt, Human
accuucuccuucaccuuugucc

SEQ ID NO: 2992103 - RNA, 14 nt, Human
accuucuccuucac

SEQ ID NO: 2992104 - RNA, 21 nt, Human
accuggguaacuagggaagau

SEQ ID NO: 2992105 - RNA, 12 nt, Human
accuuccugcug

SEQ ID NO: 2992106 - RNA, 12 nt, Human
accuggccucug

SEQ ID NO: 2992107 - RNA, 13 nt, Human
accuggccucugc

SEQ ID NO: 2992108 - RNA, 17 nt, Human
uccacccaggagccccg

SEQ ID NO: 2992109 - RNA, 13 nt, Human
uccacccaccuca

SEQ ID NO: 2992110 - RNA, 18 nt, Human
uccaccaucaagccacca

SEQ ID NO: 2992111 - RNA, 12 nt, Human
uccacccaccuc

SEQ ID NO: 2992112 - RNA, 20 nt, Human
uccacccaggagccccgagg

SEQ ID NO: 2992113 - RNA, 15 nt, Human
acucuucccucaaau

SEQ ID NO: 2992114 - RNA, 19 nt, Human
acucuggcagcucagagag

SEQ ID NO: 2992115 - RNA, 20 nt, Human
acucuggcagcucagagagg

SEQ ID NO: 2992116 - RNA, 21 nt, Human
acucuuauugcccacgcugga

SEQ ID NO: 2992117 - RNA, 16 nt, Human
acucuggcagcucaga

SEQ ID NO: 2992118 - RNA, 17 nt, Human
acucuggcagcucagag

SEQ ID NO: 2992119 - RNA, 15 nt, Human
acucgcgacaaugca

SEQ ID NO: 2992120 - RNA, 16 nt, Human
acucgcgacaaugcaa

SEQ ID NO: 2992121 - RNA, 14 nt, Human
acuccagaaaguga

SEQ ID NO: 2992122 - RNA, 14 nt, Human
uccggcccuccaga

SEQ ID NO: 2992123 - RNA, 18 nt, Human
uccggcccuccagagccc

SEQ ID NO: 2992124 - RNA, 13 nt, Human
uccguuaaaauac

SEQ ID NO: 2992125 - RNA, 15 nt, Human
uccguuaaaauacca

SEQ ID NO: 2992126 - RNA, 21 nt, Human
uccuagccugugccucuggga

SEQ ID NO: 2992127 - RNA, 20 nt, Human
uccuagcacuuugggaggcc

SEQ ID NO: 2992128 - RNA, 16 nt, Human
acucgaguuacagaca

SEQ ID NO: 2992129 - RNA, 21 nt, Human
uccugaaaacccuugccaugu

SEQ ID NO: 2992130 - RNA, 23 nt, Human
uccucuuuggucuacacugugcu

SEQ ID NO: 2992131 - RNA, 19 nt, Human
acucuuucuauuguuucuu

SEQ ID NO: 2992132 - RNA, 15 nt, Human
uccugaagaauugaa

SEQ ID NO: 2992133 - RNA, 20 nt, Human
uccucccaccucagccuccc

SEQ ID NO: 2992134 - RNA, 18 nt, Human
uccucccaccucagccuc

SEQ ID NO: 2992135 - RNA, 16 nt, Human
uccucccaccucagcc

SEQ ID NO: 2992136 - RNA, 15 nt, Human
uccucccaccucagc

SEQ ID NO: 2992137 - RNA, 14 nt, Human
uccucccaccucag

SEQ ID NO: 2992138 - RNA, 13 nt, Human
uccucccaccuca

SEQ ID NO: 2992139 - RNA, 21 nt, Human
uccucccaccucagccucccg

SEQ ID NO: 2992140 - RNA, 17 nt, Human
uccucuccccaugaugu

SEQ ID NO: 2992141 - RNA, 13 nt, Human
acuauucaaacag

SEQ ID NO: 2992142 - RNA, 14 nt, Human
acuauucaaacagu

SEQ ID NO: 2992143 - RNA, 16 nt, Human
acuauucaaacagucu

SEQ ID NO: 2992144 - RNA, 12 nt, Human
acuauguaucaa

SEQ ID NO: 2992145 - RNA, 14 nt, Human
acuauaauguaagc

SEQ ID NO: 2992146 - RNA, 13 nt, Human
acuauaauguaag

SEQ ID NO: 2992147 - RNA, 12 nt, Human
acuauaauguaa

SEQ ID NO: 2992148 - RNA, 18 nt, Human
uccccuccucugcuugcc

SEQ ID NO: 2992149 - RNA, 15 nt, Human
uccccuccucugcuu

SEQ ID NO: 2992150 - RNA, 14 nt, Human
uccccuccucugcu

SEQ ID NO: 2992151 - RNA, 24 nt, Human
uccccuccucugcuugccaucccu

SEQ ID NO: 2992152 - RNA, 14 nt, Human
acucaaugcacuga

SEQ ID NO: 2992153 - RNA, 20 nt, Human
acucacauuuauucugcuca

SEQ ID NO: 2992154 - RNA, 19 nt, Human
acucacauuuauucugcuc

SEQ ID NO: 2992155 - RNA, 20 nt, Human
acuagaguuuagcuggaaaa

SEQ ID NO: 2992156 - RNA, 18 nt, Human
acuacggaauaguuggcu

SEQ ID NO: 2992157 - RNA, 14 nt, Human
acguacacauuuua

SEQ ID NO: 2992158 - RNA, 13 nt, Human
acguacacauuuu

SEQ ID NO: 2992159 - RNA, 12 nt, Human
acguacacauuu

SEQ ID NO: 2992160 - RNA, 13 nt, Human
acguacacacaca

SEQ ID NO: 2992161 - RNA, 19 nt, Human
ucccuccaccucccugcaa

SEQ ID NO: 2992162 - RNA, 13 nt, Human
ucccucuuucccu

SEQ ID NO: 2992163 - RNA, 11 nt, Human
ucccucuuucc

SEQ ID NO: 2992164 - RNA, 17 nt, Human
ucccuccaccucccugc

SEQ ID NO: 2992165 - RNA, 15 nt, Human
ucccuccaccucccu

SEQ ID NO: 2992166 - RNA, 14 nt, Human
ucccuccaccuccc

SEQ ID NO: 2992167 - RNA, 20 nt, Human
ucccucagucuggcccuucc

SEQ ID NO: 2992168 - RNA, 18 nt, Human
ucccucagucuggcccuu

SEQ ID NO: 2992169 - RNA, 21 nt, Human
ucccugaaggccccgcccagg

SEQ ID NO: 2992170 - RNA, 22 nt, Human
ucccugaaggccccgcccaggc

SEQ ID NO: 2992171 - RNA, 18 nt, Human
ucccugaaggccccgccc

SEQ ID NO: 2992172 - RNA, 17 nt, Human
ucccugaaggccccgcc

SEQ ID NO: 2992173 - RNA, 17 nt, Human
acucaccccagccccaa

SEQ ID NO: 2992174 - RNA, 23 nt, Human
ucccugaaggccccgcccaggcu

SEQ ID NO: 2992175 - RNA, 21 nt, Human
acuccaaacugacucuuaaga

SEQ ID NO: 2992176 - RNA, 18 nt, Human
acucauugaccugaggcc

SEQ ID NO: 2992177 - RNA, 22 nt, Human
acucauugaccugaggcccuuc

SEQ ID NO: 2992178 - RNA, 20 nt, Human
acucauuuuaaaaaauggaa

SEQ ID NO: 2992179 - RNA, 12 nt, Human
acucaucuuagg

SEQ ID NO: 2992180 - RNA, 16 nt, Human
acucauugaccugagg

SEQ ID NO: 2992181 - RNA, 17 nt, Human
acucauugaccugaggc

SEQ ID NO: 2992182 - RNA, 18 nt, Human
acucagaagacacugaug

SEQ ID NO: 2992183 - RNA, 22 nt, Human
acucagaauucucuaguuugau

SEQ ID NO: 2992184 - RNA, 21 nt, Human
acucagaauucucuaguuuga

SEQ ID NO: 2992185 - RNA, 14 nt, Human
acucagaauucucu

SEQ ID NO: 2992186 - RNA, 17 nt, Human
acucagaagacacugau

SEQ ID NO: 2992187 - RNA, 16 nt, Human
acucagaagacacuga

SEQ ID NO: 2992188 - RNA, 15 nt, Human
acucagaagacacug

SEQ ID NO: 2992189 - RNA, 14 nt, Human
acucagaagacacu

SEQ ID NO: 2992190 - RNA, 14 nt, Human
acucaccugccccu

SEQ ID NO: 2992191 - RNA, 19 nt, Human
acucaccugccccucaacu

SEQ ID NO: 2992192 - RNA, 21 nt, Human
acucaccugccccucaacucu

SEQ ID NO: 2992193 - RNA, 19 nt, Human
acacaaagcuuuugcauau

SEQ ID NO: 2992194 - RNA, 18 nt, Human
acacaaagcuuuugcaua

SEQ ID NO: 2992195 - RNA, 20 nt, Human
acacaaagcuuuugcauauu

SEQ ID NO: 2992196 - RNA, 13 nt, Human
acacaacuauauu

SEQ ID NO: 2992197 - RNA, 19 nt, Human
acaaugcaaaccaucauug

SEQ ID NO: 2992198 - RNA, 21 nt, Human
acaaugcaaaccaucauugaa

SEQ ID NO: 2992199 - RNA, 23 nt, Human
acaaugcaaaccaucauugaaau

SEQ ID NO: 2992200 - RNA, 15 nt, Human
uaggguuauaauaau

SEQ ID NO: 2992201 - RNA, 17 nt, Human
uaggguuauaauaaugu

SEQ ID NO: 2992202 - RNA, 19 nt, Human
uaggguaagugagagaggg

SEQ ID NO: 2992203 - RNA, 11 nt, Human
acaaugcaaac

SEQ ID NO: 2992204 - RNA, 16 nt, Human
acaaugcaaaccauca

SEQ ID NO: 2992205 - RNA, 17 nt, Human
acaaugcaaaccaucau

SEQ ID NO: 2992206 - RNA, 18 nt, Human
acaaugcaaaccaucauu

SEQ ID NO: 2992207 - RNA, 22 nt, Human
acaaugacuuacuguacaugaa

SEQ ID NO: 2992208 - RNA, 20 nt, Human
acaaugacuuacuguacaug

SEQ ID NO: 2992209 - RNA, 19 nt, Human
acaaugacuuacuguacau

SEQ ID NO: 2992210 - RNA, 14 nt, Human
uagucacugagaca

SEQ ID NO: 2992211 - RNA, 22 nt, Human
uaguagagacaggguuuugcca

SEQ ID NO: 2992212 - RNA, 15 nt, Human
uaguagagacagggu

SEQ ID NO: 2992213 - RNA, 14 nt, Human
uaguagagacaggg

SEQ ID NO: 2992214 - RNA, 22 nt, Human
uagguuuggacaaaauggaaua

SEQ ID NO: 2992215 - RNA, 16 nt, Human
acacaggcccggcucc

SEQ ID NO: 2992216 - RNA, 18 nt, Human
acacaggcccggcuccag

SEQ ID NO: 2992217 - RNA, 17 nt, Human
acacaggcccggcucca

SEQ ID NO: 2992218 - RNA, 22 nt, Human
acacaggcccggcuccaggcuc

SEQ ID NO: 2992219 - RNA, 21 nt, Human
acacaggcccggcuccaggcu

SEQ ID NO: 2992220 - RNA, 20 nt, Human
acacaggcccggcuccaggc

SEQ ID NO: 2992221 - RNA, 19 nt, Human
acacaggcccggcuccagg

SEQ ID NO: 2992222 - RNA, 24 nt, Human
acacaggcccggcuccaggcuccu

SEQ ID NO: 2992223 - RNA, 23 nt, Human
acacaggcccggcuccaggcucc

SEQ ID NO: 2992224 - RNA, 22 nt, Human
uaggggucugucuuuuaaacuc

SEQ ID NO: 2992225 - RNA, 13 nt, Human
uagggaagauaau

SEQ ID NO: 2992226 - RNA, 13 nt, Human
uaggauguugaaa

SEQ ID NO: 2992227 - RNA, 16 nt, Human
uaggaaaaacugauuu

SEQ ID NO: 2992228 - RNA, 17 nt, Human
uaggaaaaacugauuuu

SEQ ID NO: 2992229 - RNA, 12 nt, Human
uaggaaaauuau

SEQ ID NO: 2992230 - RNA, 13 nt, Human
uaggaaaaacuga

SEQ ID NO: 2992231 - RNA, 14 nt, Human
uaggaaaaacugau

SEQ ID NO: 2992232 - RNA, 23 nt, Human
uagcuuuuuucucugauacagaa

SEQ ID NO: 2992233 - RNA, 13 nt, Human
uagcuuuuuucuc

SEQ ID NO: 2992234 - RNA, 21 nt, Human
uagccuuagaagucacacagu

SEQ ID NO: 2992235 - RNA, 20 nt, Human
uagccugugccucugggacu

SEQ ID NO: 2992236 - RNA, 14 nt, Human
uagcgcccaguugg

SEQ ID NO: 2992237 - RNA, 17 nt, Human
uagcgcccaguugggug

SEQ ID NO: 2992238 - RNA, 20 nt, Human
uagccuuagaagucacacag

SEQ ID NO: 2992239 - RNA, 13 nt, Human
uagagguacacuu

SEQ ID NO: 2992240 - RNA, 18 nt, Human
uagagguacacuugugaa

SEQ ID NO: 2992241 - RNA, 14 nt, Human
uagaggguguguaa

SEQ ID NO: 2992242 - RNA, 15 nt, Human
uagcacagacccugc

SEQ ID NO: 2992243 - RNA, 20 nt, Human
uagcacagacccugcccugu

SEQ ID NO: 2992244 - RNA, 21 nt, Human
uagcacagacccugcccugug

SEQ ID NO: 2992245 - RNA, 14 nt, Human
uagcacagacccug

SEQ ID NO: 2992246 - RNA, 13 nt, Human
uagccaaggccaa

SEQ ID NO: 2992247 - RNA, 22 nt, Human
uagcacagacccugcccugugg

SEQ ID NO: 2992248 - RNA, 12 nt, Human
uagccaaggcca

SEQ ID NO: 2992249 - RNA, 13 nt, Human
acaaaaacacagc

SEQ ID NO: 2992250 - RNA, 20 nt, Human
aauuuuacauggcuggagcu

SEQ ID NO: 2992251 - RNA, 14 nt, Human
acaaaaacacagca

SEQ ID NO: 2992252 - RNA, 15 nt, Human
acaaaaacacagcaa

SEQ ID NO: 2992253 - RNA, 16 nt, Human
acaaaaagcauaaaaa

SEQ ID NO: 2992254 - RNA, 16 nt, Human
acaaaaagcuacuuau

SEQ ID NO: 2992255 - RNA, 18 nt, Human
acaaaaggauaaugaaua

SEQ ID NO: 2992256 - RNA, 22 nt, Human
uagagcggagaaaggaagggcu

SEQ ID NO: 2992257 - RNA, 14 nt, Human
uagagccagggucu

SEQ ID NO: 2992258 - RNA, 14 nt, Human
acaaaauagaaagu

SEQ ID NO: 2992259 - RNA, 16 nt, Human
acaaaguaauuuggaa

SEQ ID NO: 2992260 - RNA, 17 nt, Human
uagacagucccugccaa

SEQ ID NO: 2992261 - RNA, 21 nt, Human
uagacagucccugccaaugga

SEQ ID NO: 2992262 - RNA, 18 nt, Human
aauuugggggaaaauuua

SEQ ID NO: 2992263 - RNA, 14 nt, Human
aauuugugauacaa

SEQ ID NO: 2992264 - RNA, 18 nt, Human
aauuugugauacaaugcu

SEQ ID NO: 2992265 - RNA, 17 nt, Human
aauuugugauacaaugc

SEQ ID NO: 2992266 - RNA, 18 nt, Human
uagacaauuuauuauggc

SEQ ID NO: 2992267 - RNA, 13 nt, Human
uagacacacauga

SEQ ID NO: 2992268 - RNA, 16 nt, Human
uagacagucccugcca

SEQ ID NO: 2992269 - RNA, 10 nt, Human
uagacagagu

SEQ ID NO: 2992270 - RNA, 22 nt, Human
uagaauuugauaugugaacagu

SEQ ID NO: 2992271 - RNA, 19 nt, Human
uagaauuugauaugugaac

SEQ ID NO: 2992272 - RNA, 20 nt, Human
uagaauuugauaugugaaca

SEQ ID NO: 2992273 - RNA, 17 nt, Human
uagaacucccuuucaac

SEQ ID NO: 2992274 - RNA, 16 nt, Human
uagaacucccuuucaa

SEQ ID NO: 2992275 - RNA, 15 nt, Human
uagaacucccuuuca

SEQ ID NO: 2992276 - RNA, 15 nt, Human
uagaaacacaacuau

SEQ ID NO: 2992277 - RNA, 14 nt, Human
uagaaaaucuucau

SEQ ID NO: 2992278 - RNA, 20 nt, Human
uaugugcacaucuguuuugu

SEQ ID NO: 2992279 - RNA, 22 nt, Human
acaggcccggcuccaggcuccu

SEQ ID NO: 2992280 - RNA, 21 nt, Human
acaggcccggcuccaggcucc

SEQ ID NO: 2992281 - RNA, 20 nt, Human
acaggcccggcuccaggcuc

SEQ ID NO: 2992282 - RNA, 18 nt, Human
acaggcccggcuccaggc

SEQ ID NO: 2992283 - RNA, 17 nt, Human
acaggcccggcuccagg

SEQ ID NO: 2992284 - RNA, 16 nt, Human
acaggcccggcuccag

SEQ ID NO: 2992285 - RNA, 15 nt, Human
acaggcagauacagg

SEQ ID NO: 2992286 - RNA, 20 nt, Human
acaggaaaauuuuaaaaaua

SEQ ID NO: 2992287 - RNA, 23 nt, Human
acagcuguaugauucccagccag

SEQ ID NO: 2992288 - RNA, 20 nt, Human
acagcuguaugauucccagc

SEQ ID NO: 2992289 - RNA, 19 nt, Human
acagcuguaugauucccag

SEQ ID NO: 2992290 - RNA, 14 nt, Human
acagcuguaugauu

SEQ ID NO: 2992291 - RNA, 19 nt, Human
acagcuaaugggacacuaa

SEQ ID NO: 2992292 - RNA, 17 nt, Human
acagcuaaugggacacu

SEQ ID NO: 2992293 - RNA, 16 nt, Human
acagcuaaugggacac

SEQ ID NO: 2992294 - RNA, 15 nt, Human
acagcuaaugggaca

SEQ ID NO: 2992295 - RNA, 21 nt, Human
acagcuucauuuccugugucu

SEQ ID NO: 2992296 - RNA, 19 nt, Human
acagcuucauuuccugugu

SEQ ID NO: 2992297 - RNA, 17 nt, Human
acagcuucauuuccugu

SEQ ID NO: 2992298 - RNA, 20 nt, Human
acagcuugaccgugaggcca

SEQ ID NO: 2992299 - RNA, 21 nt, Human
acagcuugaccgugaggccag

SEQ ID NO: 2992300 - RNA, 17 nt, Human
acagcuugaccgugagg

SEQ ID NO: 2992301 - RNA, 21 nt, Human
acaggaaaagcugcugacagu

SEQ ID NO: 2992302 - RNA, 20 nt, Human
acaggaaaagcugcugacag

SEQ ID NO: 2992303 - RNA, 19 nt, Human
acaggaaaagcugcugaca

SEQ ID NO: 2992304 - RNA, 18 nt, Human
acaggaaaagcugcugac

SEQ ID NO: 2992305 - RNA, 22 nt, Human
acagcuugaccgugaggccaga

SEQ ID NO: 2992306 - RNA, 23 nt, Human
acagcuugaccgugaggccagag

SEQ ID NO: 2992307 - RNA, 22 nt, Human
uaugcaugaaguaauaugcaca

SEQ ID NO: 2992308 - RNA, 21 nt, Human
uauggcccuggccuagcauac

SEQ ID NO: 2992309 - RNA, 23 nt, Human
uauggcuuuugugcauuaucuag

SEQ ID NO: 2992310 - RNA, 20 nt, Human
uauggcccuggccuagcaua

SEQ ID NO: 2992311 - RNA, 23 nt, Human
uaugggacucaaugcacugacau

SEQ ID NO: 2992312 - RNA, 16 nt, Human
uaugggacucaaugca

SEQ ID NO: 2992313 - RNA, 15 nt, Human
uaugaggcauuuguu

SEQ ID NO: 2992314 - RNA, 14 nt, Human
uaugaggcauuugu

SEQ ID NO: 2992315 - RNA, 21 nt, Human
uaugaggcauuuguuugaacu

SEQ ID NO: 2992316 - RNA, 16 nt, Human
acagcccgggcucugc

SEQ ID NO: 2992317 - RNA, 15 nt, Human
acagcccgggcucug

SEQ ID NO: 2992318 - RNA, 18 nt, Human
acagcaagggugauggga

SEQ ID NO: 2992319 - RNA, 16 nt, Human
acacucauucauuacu

SEQ ID NO: 2992320 - RNA, 20 nt, Human
acacuguuucaaacuuuacu

SEQ ID NO: 2992321 - RNA, 16 nt, Human
acacuuacacuuuaug

SEQ ID NO: 2992322 - RNA, 18 nt, Human
acacuguuucaaacuuua

SEQ ID NO: 2992323 - RNA, 17 nt, Human
acacuguuucaaacuuu

SEQ ID NO: 2992324 - RNA, 16 nt, Human
acacuguuucaaacuu

SEQ ID NO: 2992325 - RNA, 17 nt, Human
acacucauugaccugag

SEQ ID NO: 2992326 - RNA, 21 nt, Human
acacuuacacuuuaugcacaa

SEQ ID NO: 2992327 - RNA, 18 nt, Human
acacuuacacuuuaugca

SEQ ID NO: 2992328 - RNA, 19 nt, Human
acagaaagcagaacaguga

SEQ ID NO: 2992329 - RNA, 19 nt, Human
acagacauacuaaccagca

SEQ ID NO: 2992330 - RNA, 18 nt, Human
acagacauacuaaccagc

SEQ ID NO: 2992331 - RNA, 14 nt, Human
uauccaaucuguga

SEQ ID NO: 2992332 - RNA, 19 nt, Human
uauccaacaucaacaucuu

SEQ ID NO: 2992333 - RNA, 23 nt, Human
uauccaauugcugcuuguacacu

SEQ ID NO: 2992334 - RNA, 15 nt, Human
uauccaauugcugcu

SEQ ID NO: 2992335 - RNA, 17 nt, Human
uaucagaauucucagaa

SEQ ID NO: 2992336 - RNA, 10 nt, Human
uaucagaauu

SEQ ID NO: 2992337 - RNA, 14 nt, Human
acagaccuuugaac

SEQ ID NO: 2992338 - RNA, 14 nt, Human
uaucacaaaucuua

SEQ ID NO: 2992339 - RNA, 16 nt, Human
uaucacaaaucuuaac

SEQ ID NO: 2992340 - RNA, 20 nt, Human
uaucacaaaucuuaacuuga

SEQ ID NO: 2992341 - RNA, 22 nt, Human
uaucacccagaagaaaauagug

SEQ ID NO: 2992342 - RNA, 19 nt, Human
uaucacccagaagaaaaua

SEQ ID NO: 2992343 - RNA, 18 nt, Human
uauauagcaagacauuau

SEQ ID NO: 2992344 - RNA, 16 nt, Human
uauauagcaguaaaaa

SEQ ID NO: 2992345 - RNA, 20 nt, Human
uauauagcaagacauuauau

SEQ ID NO: 2992346 - RNA, 15 nt, Human
uauauagcaguaaaa

SEQ ID NO: 2992347 - RNA, 16 nt, Human
uauaggugcuacaaaa

SEQ ID NO: 2992348 - RNA, 23 nt, Human
uauaggaacuuaaauaaugugaa

SEQ ID NO: 2992349 - RNA, 19 nt, Human
uauaggaauugacccacaa

SEQ ID NO: 2992350 - RNA, 18 nt, Human
uauagcaguaaaaaaugg

SEQ ID NO: 2992351 - RNA, 20 nt, Human
uauagauguugcuaacagca

SEQ ID NO: 2992352 - RNA, 15 nt, Human
uauagauguugcuaa

SEQ ID NO: 2992353 - RNA, 21 nt, Human
uauagauguugcuaacagcaa

SEQ ID NO: 2992354 - RNA, 10 nt, Human
uauagauguu

SEQ ID NO: 2992355 - RNA, 18 nt, Human
uauagccuaggugacaga

SEQ ID NO: 2992356 - RNA, 23 nt, Human
uauauagcaguaaaaaauggugu

SEQ ID NO: 2992357 - RNA, 19 nt, Human
uauauauuuuuuucugaaa

SEQ ID NO: 2992358 - RNA, 16 nt, Human
acacucauugaccuga

SEQ ID NO: 2992359 - RNA, 17 nt, Human
acacucaaaucaagaaa

SEQ ID NO: 2992360 - RNA, 15 nt, Human
acacuaaugaggaaa

SEQ ID NO: 2992361 - RNA, 22 nt, Human
acacuaaugaggaaacugcacu

SEQ ID NO: 2992362 - RNA, 21 nt, Human
acacucaaaagcugggcaggu

SEQ ID NO: 2992363 - RNA, 13 nt, Human
acacucaaaucaa

SEQ ID NO: 2992364 - RNA, 17 nt, Human
uagucacugagacagcc

SEQ ID NO: 2992365 - RNA, 20 nt, Human
uagucacugagacagcccgg

SEQ ID NO: 2992366 - RNA, 19 nt, Human
acacuaagagagaaugaga

SEQ ID NO: 2992367 - RNA, 22 nt, Human
uauacacuuacacuuuaugcac

SEQ ID NO: 2992368 - RNA, 21 nt, Human
uauacacuuacacuuuaugca

SEQ ID NO: 2992369 - RNA, 18 nt, Human
uauaauuuaccugaaguc

SEQ ID NO: 2992370 - RNA, 19 nt, Human
uauacauacuuacaugugu

SEQ ID NO: 2992371 - RNA, 17 nt, Human
uacauuagguugugaau

SEQ ID NO: 2992372 - RNA, 16 nt, Human
uacauuagguugugaa

SEQ ID NO: 2992373 - RNA, 12 nt, Human
uacauucuguua

SEQ ID NO: 2992374 - RNA, 18 nt, Human
uaccagccaguaaauggg

SEQ ID NO: 2992375 - RNA, 22 nt, Human
uaccagcagagcaccuuagaca

SEQ ID NO: 2992376 - RNA, 13 nt, Human
uaccagcagagca

SEQ ID NO: 2992377 - RNA, 14 nt, Human
uaccagcagagcac

SEQ ID NO: 2992378 - RNA, 12 nt, Human
uaccagcagagc

SEQ ID NO: 2992379 - RNA, 19 nt, Human
uaccagggacugaggggag

SEQ ID NO: 2992380 - RNA, 16 nt, Human
uaccaugccauuuaaa

SEQ ID NO: 2992381 - RNA, 22 nt, Human
aauguucacugguacucugcca

SEQ ID NO: 2992382 - RNA, 13 nt, Human
aauguucaucaau

SEQ ID NO: 2992383 - RNA, 21 nt, Human
aaugugcugaaugguuuucaa

SEQ ID NO: 2992384 - RNA, 20 nt, Human
aauguucaucaaugaaugaa

SEQ ID NO: 2992385 - RNA, 16 nt, Human
aauguucaucaaugaa

SEQ ID NO: 2992386 - RNA, 17 nt, Human
aauuaaguacuauguau

SEQ ID NO: 2992387 - RNA, 16 nt, Human
aauuaaguacuaugua

SEQ ID NO: 2992388 - RNA, 16 nt, Human
aauuaacuuuuauaaa

SEQ ID NO: 2992389 - RNA, 15 nt, Human
aauuaacuuuuauaa

SEQ ID NO: 2992390 - RNA, 13 nt, Human
aauuaacuuuuau

SEQ ID NO: 2992391 - RNA, 12 nt, Human
aauuaacuuuua

SEQ ID NO: 2992392 - RNA, 16 nt, Human
aauuaccagaaagaua

SEQ ID NO: 2992393 - RNA, 21 nt, Human
aauuauuuauuaaaugcccag

SEQ ID NO: 2992394 - RNA, 22 nt, Human
aauuauuuauuaaaugcccagc

SEQ ID NO: 2992395 - RNA, 11 nt, Human
aauucaguugu

SEQ ID NO: 2992396 - RNA, 17 nt, Human
aauucaguuguuagugu

SEQ ID NO: 2992397 - RNA, 22 nt, Human
aauucaguuguuagugugucuu

SEQ ID NO: 2992398 - RNA, 13 nt, Human
uaccugaagucuu

SEQ ID NO: 2992399 - RNA, 14 nt, Human
uaccugaagucuuu

SEQ ID NO: 2992400 - RNA, 13 nt, Human
uaccugaggggcc

SEQ ID NO: 2992401 - RNA, 15 nt, Human
uaccugaggggccuc

SEQ ID NO: 2992402 - RNA, 16 nt, Human
uaccugaagucuuugu

SEQ ID NO: 2992403 - RNA, 23 nt, Human
uaccucuugagccuugaacuuug

SEQ ID NO: 2992404 - RNA, 22 nt, Human
uaccucuugagccuugaacuuu

SEQ ID NO: 2992405 - RNA, 21 nt, Human
uaccucuugagccuugaacuu

SEQ ID NO: 2992406 - RNA, 23 nt, Human
uacccgggaagggggcugggaca

SEQ ID NO: 2992407 - RNA, 17 nt, Human
aauuacaggaaguacug

SEQ ID NO: 2992408 - RNA, 19 nt, Human
aauuacaggaaguacugga

SEQ ID NO: 2992409 - RNA, 20 nt, Human
aauuacaggaaguacuggag

SEQ ID NO: 2992410 - RNA, 14 nt, Human
aauuacauuuguau

SEQ ID NO: 2992411 - RNA, 13 nt, Human
aauuacauuugua

SEQ ID NO: 2992412 - RNA, 16 nt, Human
uaccugaggggccucu

SEQ ID NO: 2992413 - RNA, 16 nt, Human
uaccugccaggaagcc

SEQ ID NO: 2992414 - RNA, 16 nt, Human
uaauuauugauguuuu

SEQ ID NO: 2992415 - RNA, 22 nt, Human
uaauuccguagguuauuuucag

SEQ ID NO: 2992416 - RNA, 21 nt, Human
uaauuuuuauauuugaaauau

SEQ ID NO: 2992417 - RNA, 19 nt, Human
uaauuuuuauauuugaaau

SEQ ID NO: 2992418 - RNA, 18 nt, Human
uaauuuuuauauuugaaa

SEQ ID NO: 2992419 - RNA, 17 nt, Human
aaugcaaaaaaaauuag

SEQ ID NO: 2992420 - RNA, 16 nt, Human
aaugcaaaaaaaauua

SEQ ID NO: 2992421 - RNA, 12 nt, Human
aaugcaaaaaaa

SEQ ID NO: 2992422 - RNA, 11 nt, Human
aaugcaaacca

SEQ ID NO: 2992423 - RNA, 16 nt, Human
aaugauuucauucaau

SEQ ID NO: 2992424 - RNA, 12 nt, Human
aaugcaaaccau

SEQ ID NO: 2992425 - RNA, 13 nt, Human
aaugcaccuggaa

SEQ ID NO: 2992426 - RNA, 23 nt, Human
aaugauuaugaauuacauuugua

SEQ ID NO: 2992427 - RNA, 18 nt, Human
aaugaggucagagccugc

SEQ ID NO: 2992428 - RNA, 16 nt, Human
aaugaggucagagccu

SEQ ID NO: 2992429 - RNA, 12 nt, Human
aaugagccuggc

SEQ ID NO: 2992430 - RNA, 13 nt, Human
aaugagccuggca

SEQ ID NO: 2992431 - RNA, 22 nt, Human
aaugagagacacacugaagaag

SEQ ID NO: 2992432 - RNA, 11 nt, Human
aaugagccugg

SEQ ID NO: 2992433 - RNA, 21 nt, Human
aaugaccuuucaauaggaaaa

SEQ ID NO: 2992434 - RNA, 20 nt, Human
aaugaccuuucaauaggaaa

SEQ ID NO: 2992435 - RNA, 20 nt, Human
aaugcuugcugcugauuuaa

SEQ ID NO: 2992436 - RNA, 18 nt, Human
aaugcuugcugcugauuu

SEQ ID NO: 2992437 - RNA, 22 nt, Human
aaugcuguauuuuaaaagaaug

SEQ ID NO: 2992438 - RNA, 23 nt, Human
aaugcuugcugcugauuuaaaca

SEQ ID NO: 2992439 - RNA, 22 nt, Human
aaugcuugcugcugauuuaaac

SEQ ID NO: 2992440 - RNA, 13 nt, Human
aauggaagacagc

SEQ ID NO: 2992441 - RNA, 21 nt, Human
aaugcuguauuuuaaaagaau

SEQ ID NO: 2992442 - RNA, 20 nt, Human
aaugcuguauuuuaaaagaa

SEQ ID NO: 2992443 - RNA, 22 nt, Human
aaugcuggcuguuggcuggggg

SEQ ID NO: 2992444 - RNA, 21 nt, Human
aaugcuggcuguuggcugggg

SEQ ID NO: 2992445 - RNA, 21 nt, Human
uacaaaaaaaaaaaaaaauua

SEQ ID NO: 2992446 - RNA, 18 nt, Human
uaauuuuuuugagacaga

SEQ ID NO: 2992447 - RNA, 17 nt, Human
uaauuuuuauauuugaa

SEQ ID NO: 2992448 - RNA, 16 nt, Human
uacaaugcugugcccu

SEQ ID NO: 2992449 - RNA, 14 nt, Human
uacaaugcugugcc

SEQ ID NO: 2992450 - RNA, 13 nt, Human
uacaaugcugugc

SEQ ID NO: 2992451 - RNA, 20 nt, Human
aauguaagggaaacugccag

SEQ ID NO: 2992452 - RNA, 16 nt, Human
aaugguuuucaaaaua

SEQ ID NO: 2992453 - RNA, 16 nt, Human
aaugguuuucuugugu

SEQ ID NO: 2992454 - RNA, 16 nt, Human
aauggaagacagcucu

SEQ ID NO: 2992455 - RNA, 14 nt, Human
aaugguuuucaaaa

SEQ ID NO: 2992456 - RNA, 23 nt, Human
uacagagcagacaguuaagagaa

SEQ ID NO: 2992457 - RNA, 19 nt, Human
uacagagcccacgccccca

SEQ ID NO: 2992458 - RNA, 22 nt, Human
uacagagcccacgcccccacug

SEQ ID NO: 2992459 - RNA, 17 nt, Human
uacagagacagaaagca

SEQ ID NO: 2992460 - RNA, 13 nt, Human
uacagaauuuuau

SEQ ID NO: 2992461 - RNA, 14 nt, Human
uacagacaaagcgu

SEQ ID NO: 2992462 - RNA, 15 nt, Human
uacagacaaagcgug

SEQ ID NO: 2992463 - RNA, 13 nt, Human
uacagacaaagcg

SEQ ID NO: 2992464 - RNA, 23 nt, Human
aauauuuugacuuguugagggua

SEQ ID NO: 2992465 - RNA, 15 nt, Human
uaagacuuaaugaga

SEQ ID NO: 2992466 - RNA, 16 nt, Human
uaagacuuaaugagac

SEQ ID NO: 2992467 - RNA, 16 nt, Human
aaucagccuaguugau

SEQ ID NO: 2992468 - RNA, 11 nt, Human
aaucagccugc

SEQ ID NO: 2992469 - RNA, 13 nt, Human
aaucagccugcuc

SEQ ID NO: 2992470 - RNA, 18 nt, Human
aaucagccugcuccagcu

SEQ ID NO: 2992471 - RNA, 19 nt, Human
aaucagccugcuccagcug

SEQ ID NO: 2992472 - RNA, 21 nt, Human
aaucagguuuucuuuuaagaa

SEQ ID NO: 2992473 - RNA, 18 nt, Human
aaucagguuuucuuuuaa

SEQ ID NO: 2992474 - RNA, 14 nt, Human
uaagauucauauuu

SEQ ID NO: 2992475 - RNA, 14 nt, Human
uaagcaaaauguga

SEQ ID NO: 2992476 - RNA, 15 nt, Human
uaagcaaaaugugau

SEQ ID NO: 2992477 - RNA, 21 nt, Human
uaagcuauucaguaauaacuc

SEQ ID NO: 2992478 - RNA, 14 nt, Human
uaagcuauucagua

SEQ ID NO: 2992479 - RNA, 13 nt, Human
uaaggaagacaau

SEQ ID NO: 2992480 - RNA, 9 nt, Human
uaaggaaua

SEQ ID NO: 2992481 - RNA, 17 nt, Human
uaaggaauaccuguccc

SEQ ID NO: 2992482 - RNA, 18 nt, Human
uaaggaauaccugucccc

SEQ ID NO: 2992483 - RNA, 14 nt, Human
uaauaaaaagguga

SEQ ID NO: 2992484 - RNA, 15 nt, Human
uaauaaaaaggugac

SEQ ID NO: 2992485 - RNA, 12 nt, Human
uaauaaaaaggu

SEQ ID NO: 2992486 - RNA, 18 nt, Human
uaaguuuuuuuuuaaaaa

SEQ ID NO: 2992487 - RNA, 21 nt, Human
uaaguauucuuauuuaaugaa

SEQ ID NO: 2992488 - RNA, 16 nt, Human
uaaguaaaaccacagc

SEQ ID NO: 2992489 - RNA, 17 nt, Human
uaaguaaaaccacagca

SEQ ID NO: 2992490 - RNA, 18 nt, Human
uaaguaaaaccacagcag

SEQ ID NO: 2992491 - RNA, 20 nt, Human
uaaguaaugauaacuggaaa

SEQ ID NO: 2992492 - RNA, 13 nt, Human
uaaguaaaaccac

SEQ ID NO: 2992493 - RNA, 15 nt, Human
uaaguaaaaccacag

SEQ ID NO: 2992494 - RNA, 18 nt, Human
uaagguuaccuuuguucc

SEQ ID NO: 2992495 - RNA, 20 nt, Human
aauccucaguuuuugugaaa

SEQ ID NO: 2992496 - RNA, 17 nt, Human
aaucccauuuaaaaaaa

SEQ ID NO: 2992497 - RNA, 16 nt, Human
uaacuaucacugguuu

SEQ ID NO: 2992498 - RNA, 21 nt, Human
uaacuaucacugguuugguuc

SEQ ID NO: 2992499 - RNA, 15 nt, Human
uaacuuaaugaaaac

SEQ ID NO: 2992500 - RNA, 18 nt, Human
uaacuuaaugaaaacaau

SEQ ID NO: 2992501 - RNA, 16 nt, Human
uaacuuaaugaaaaca

SEQ ID NO: 2992502 - RNA, 21 nt, Human
uaacuuccuuggacucauuuu

SEQ ID NO: 2992503 - RNA, 16 nt, Human
uaacuugucuuuggac

SEQ ID NO: 2992504 - RNA, 20 nt, Human
uaacuugucuuuggacccug

SEQ ID NO: 2992505 - RNA, 13 nt, Human
uaagaagugaaaa

SEQ ID NO: 2992506 - RNA, 23 nt, Human
uaagacaaaaagcuacuuauugu

SEQ ID NO: 2992507 - RNA, 17 nt, Human
uaacauguaauuaagua

SEQ ID NO: 2992508 - RNA, 19 nt, Human
uaacauguaauuaaguacu

SEQ ID NO: 2992509 - RNA, 19 nt, Human
aauagucaaauugugugaa

SEQ ID NO: 2992510 - RNA, 18 nt, Human
uaacaaaggauacuuauu

SEQ ID NO: 2992511 - RNA, 17 nt, Human
uaacaaaggauacuuau

SEQ ID NO: 2992512 - RNA, 16 nt, Human
uaacaaaggauacuua

SEQ ID NO: 2992513 - RNA, 15 nt, Human
uaacaaaggauacuu

SEQ ID NO: 2992514 - RNA, 21 nt, Human
uaaauuaacuuuuauaaacuu

SEQ ID NO: 2992515 - RNA, 20 nt, Human
uaacaaaggauacuuauuua

SEQ ID NO: 2992516 - RNA, 19 nt, Human
uaacaaaggauacuuauuu

SEQ ID NO: 2992517 - RNA, 21 nt, Human
uaacaaaggauacuuauuuaa

SEQ ID NO: 2992518 - RNA, 13 nt, Human
aauacagaggcaa

SEQ ID NO: 2992519 - RNA, 21 nt, Human
aauacaccacuacauucuguu

SEQ ID NO: 2992520 - RNA, 16 nt, Human
uaaaugugcuuuuaaa

SEQ ID NO: 2992521 - RNA, 20 nt, Human
uaaauuaacuuuuauaaacu

SEQ ID NO: 2992522 - RNA, 19 nt, Human
uaaauuaacuuuuauaaac

SEQ ID NO: 2992523 - RNA, 18 nt, Human
uaaauuaacuuuuauaaa

SEQ ID NO: 2992524 - RNA, 21 nt, Human
aaguguauuuugaaauuguuu

SEQ ID NO: 2992525 - RNA, 17 nt, Human
aaguguauuuugaaauu

SEQ ID NO: 2992526 - RNA, 21 nt, Human
aaguguauuuuuuuacuaaua

SEQ ID NO: 2992527 - RNA, 18 nt, Human
aaguguauuuuuuuacua

SEQ ID NO: 2992528 - RNA, 18 nt, Human
uaaaugaaaaucgugaca

SEQ ID NO: 2992529 - RNA, 21 nt, Human
aauagcaaggcugugcaucua

SEQ ID NO: 2992530 - RNA, 22 nt, Human
aauagcagcccucaauugugaa

SEQ ID NO: 2992531 - RNA, 23 nt, Human
aauagcagcccucaauugugaaa

SEQ ID NO: 2992532 - RNA, 20 nt, Human
aauagccugccucuucucua

SEQ ID NO: 2992533 - RNA, 15 nt, Human
aauaccugucccccu

SEQ ID NO: 2992534 - RNA, 18 nt, Human
aauaccugucccccugac

SEQ ID NO: 2992535 - RNA, 19 nt, Human
aauaccugucccccugaca

SEQ ID NO: 2992536 - RNA, 20 nt, Human
aauaccccaagacucccaug

SEQ ID NO: 2992537 - RNA, 12 nt, Human
aauaccaaggaa

SEQ ID NO: 2992538 - RNA, 23 nt, Human
aauaccacaggaaccacaagacu

SEQ ID NO: 2992539 - RNA, 19 nt, Human
aauaccagccaguaaaugg

SEQ ID NO: 2992540 - RNA, 18 nt, Human
aauaccaugccauuuaaa

SEQ ID NO: 2992541 - RNA, 17 nt, Human
aauaccagccaguaaau

SEQ ID NO: 2992542 - RNA, 23 nt, Human
aauacaucccuuaccugggaaag

SEQ ID NO: 2992543 - RNA, 13 nt, Human
gugucauuucaaa

SEQ ID NO: 2992544 - RNA, 20 nt, Human
gugucagguggggcagcuug

SEQ ID NO: 2992545 - RNA, 22 nt, Human
gugugacaaggauugcuacugu

SEQ ID NO: 2992546 - RNA, 16 nt, Human
gugugguagagugugc

SEQ ID NO: 2992547 - RNA, 13 nt, Human
aagauguagagga

SEQ ID NO: 2992548 - RNA, 23 nt, Human
guguauuuuuuuacuaauagaca

SEQ ID NO: 2992549 - RNA, 17 nt, Human
guguauuuuuuuacuaa

SEQ ID NO: 2992550 - RNA, 20 nt, Human
gugucaagagggucugagga

SEQ ID NO: 2992551 - RNA, 16 nt, Human
gugucagcauagaagu

SEQ ID NO: 2992552 - RNA, 18 nt, Human
aagaugaaggucuguuuu

SEQ ID NO: 2992553 - RNA, 17 nt, Human
aagaugcuucucacugc

SEQ ID NO: 2992554 - RNA, 16 nt, Human
aagaugcuucucacug

SEQ ID NO: 2992555 - RNA, 19 nt, Human
aagaugcuucucacugcca

SEQ ID NO: 2992556 - RNA, 13 nt, Human
aagaugaaaauau

SEQ ID NO: 2992557 - RNA, 14 nt, Human
aagaugaaaauauu

SEQ ID NO: 2992558 - RNA, 13 nt, Human
aagaguaggaaga

SEQ ID NO: 2992559 - RNA, 23 nt, Human
aagagggagggagggcuccagac

SEQ ID NO: 2992560 - RNA, 12 nt, Human
aagaguaggaag

SEQ ID NO: 2992561 - RNA, 17 nt, Human
guggggucacucuggca

SEQ ID NO: 2992562 - RNA, 20 nt, Human
guggggucacucuggcagcu

SEQ ID NO: 2992563 - RNA, 21 nt, Human
guggggucacucuggcagcuc

SEQ ID NO: 2992564 - RNA, 22 nt, Human
guggggucacucuggcagcuca

SEQ ID NO: 2992565 - RNA, 22 nt, Human
aagacugaguacguugugcauu

SEQ ID NO: 2992566 - RNA, 23 nt, Human
aagacugaguacguugugcauuu

SEQ ID NO: 2992567 - RNA, 16 nt, Human
aagacugcacaucaaa

SEQ ID NO: 2992568 - RNA, 16 nt, Human
aagacuuuggaaagac

SEQ ID NO: 2992569 - RNA, 13 nt, Human
aagagcaggccag

SEQ ID NO: 2992570 - RNA, 15 nt, Human
aagaccuucuccuuc

SEQ ID NO: 2992571 - RNA, 18 nt, Human
aagaccuucuccuucacc

SEQ ID NO: 2992572 - RNA, 19 nt, Human
aagaccuucuccuucaccu

SEQ ID NO: 2992573 - RNA, 15 nt, Human
aagacgcugugcugc

SEQ ID NO: 2992574 - RNA, 17 nt, Human
aagacgcugugcugccc

SEQ ID NO: 2992575 - RNA, 18 nt, Human
aagacgcugugcugcccu

SEQ ID NO: 2992576 - RNA, 19 nt, Human
aagacgcugugcugcccug

SEQ ID NO: 2992577 - RNA, 13 nt, Human
aagacgcugugcu

SEQ ID NO: 2992578 - RNA, 23 nt, Human
aagaggaaugaaguacucauaca

SEQ ID NO: 2992579 - RNA, 21 nt, Human
guggccucccaacucacccca

SEQ ID NO: 2992580 - RNA, 22 nt, Human
guggccucccaacucaccccag

SEQ ID NO: 2992581 - RNA, 13 nt, Human
gugggacacccug

SEQ ID NO: 2992582 - RNA, 15 nt, Human
gugggacacccugug

SEQ ID NO: 2992583 - RNA, 14 nt, Human
gugggagcugccug

SEQ ID NO: 2992584 - RNA, 23 nt, Human
guggcgagccauuugucccaagu

SEQ ID NO: 2992585 - RNA, 20 nt, Human
guggcgagccauuuguccca

SEQ ID NO: 2992586 - RNA, 15 nt, Human
guggggucacucugg

SEQ ID NO: 2992587 - RNA, 18 nt, Human
gugggagcugccuguuca

SEQ ID NO: 2992588 - RNA, 15 nt, Human
gugggagcugccugu

SEQ ID NO: 2992589 - RNA, 18 nt, Human
guuauugaagcagagugg

SEQ ID NO: 2992590 - RNA, 17 nt, Human
guuauugaagcagagug

SEQ ID NO: 2992591 - RNA, 16 nt, Human
guuauugaagcagagu

SEQ ID NO: 2992592 - RNA, 20 nt, Human
guuauuauauuuacaaaugg

SEQ ID NO: 2992593 - RNA, 23 nt, Human
guuauuuuuauuuauuuaaauuu

SEQ ID NO: 2992594 - RNA, 22 nt, Human
guucaaagauauuuugcuuugu

SEQ ID NO: 2992595 - RNA, 21 nt, Human
guucaaagauauuuugcuuug

SEQ ID NO: 2992596 - RNA, 20 nt, Human
guucaaagauauuuugcuuu

SEQ ID NO: 2992597 - RNA, 18 nt, Human
guucaagcgauucuucug

SEQ ID NO: 2992598 - RNA, 19 nt, Human
guuaggcauugugggaagg

SEQ ID NO: 2992599 - RNA, 20 nt, Human
guuaggcauugugggaaggg

SEQ ID NO: 2992600 - RNA, 11 nt, Human
guuaagagaaa

SEQ ID NO: 2992601 - RNA, 12 nt, Human
guuaagagaaau

SEQ ID NO: 2992602 - RNA, 18 nt, Human
guuaagagaaaugagcuu

SEQ ID NO: 2992603 - RNA, 17 nt, Human
aagcuccaagcucccag

SEQ ID NO: 2992604 - RNA, 18 nt, Human
aagcuccaagcucccagg

SEQ ID NO: 2992605 - RNA, 14 nt, Human
aagcuccagguaga

SEQ ID NO: 2992606 - RNA, 13 nt, Human
aagcuccagguag

SEQ ID NO: 2992607 - RNA, 18 nt, Human
aagcucagggccuggcuc

SEQ ID NO: 2992608 - RNA, 19 nt, Human
aagcucagggccuggcuca

SEQ ID NO: 2992609 - RNA, 20 nt, Human
aagcucagggccuggcucag

SEQ ID NO: 2992610 - RNA, 12 nt, Human
aagcucagggcc

SEQ ID NO: 2992611 - RNA, 13 nt, Human
aagcucagggccu

SEQ ID NO: 2992612 - RNA, 16 nt, Human
aagcucagggccuggc

SEQ ID NO: 2992613 - RNA, 17 nt, Human
aagcucagggccuggcu

SEQ ID NO: 2992614 - RNA, 20 nt, Human
aagcucacagaccuuugaac

SEQ ID NO: 2992615 - RNA, 12 nt, Human
aagcuaggccug

SEQ ID NO: 2992616 - RNA, 22 nt, Human
aagcuagacgagcaggcuucuu

SEQ ID NO: 2992617 - RNA, 20 nt, Human
aagccugaguuugcuuucaa

SEQ ID NO: 2992618 - RNA, 13 nt, Human
guucagcuccagc

SEQ ID NO: 2992619 - RNA, 20 nt, Human
aagccgcuggggccaguugg

SEQ ID NO: 2992620 - RNA, 18 nt, Human
guuaagacaaacugcaua

SEQ ID NO: 2992621 - RNA, 19 nt, Human
aagcccugagcuuucugcu

SEQ ID NO: 2992622 - RNA, 19 nt, Human
aagcccaggaaaggcucca

SEQ ID NO: 2992623 - RNA, 22 nt, Human
aagcccaggaaaggcuccagga

SEQ ID NO: 2992624 - RNA, 14 nt, Human
aagcccaggaaagg

SEQ ID NO: 2992625 - RNA, 17 nt, Human
aagcccaggaaaggcuc

SEQ ID NO: 2992626 - RNA, 22 nt, Human
aagccaaagcuaggccuggcca

SEQ ID NO: 2992627 - RNA, 20 nt, Human
aagccaaagcuaggccuggc

SEQ ID NO: 2992628 - RNA, 20 nt, Human
aagcagugcaugcugucccu

SEQ ID NO: 2992629 - RNA, 14 nt, Human
aagcagugcaugcu

SEQ ID NO: 2992630 - RNA, 15 nt, Human
aagcagugcaugcug

SEQ ID NO: 2992631 - RNA, 21 nt, Human
gugugugcgccuacaggagug

SEQ ID NO: 2992632 - RNA, 12 nt, Human
aagcagugcaug

SEQ ID NO: 2992633 - RNA, 16 nt, Human
aagcauuuagauguau

SEQ ID NO: 2992634 - RNA, 16 nt, Human
aagcauuuacuuugug

SEQ ID NO: 2992635 - RNA, 13 nt, Human
aagcauuguaaau

SEQ ID NO: 2992636 - RNA, 16 nt, Human
aagccaaaacugagca

SEQ ID NO: 2992637 - RNA, 19 nt, Human
aagccaaaacugagcauaa

SEQ ID NO: 2992638 - RNA, 13 nt, Human
aagucuucuauuu

SEQ ID NO: 2992639 - RNA, 17 nt, Human
aagucuucuauuuauuu

SEQ ID NO: 2992640 - RNA, 16 nt, Human
aagucuuucacauuua

SEQ ID NO: 2992641 - RNA, 22 nt, Human
aagucuuauauauuguagauaa

SEQ ID NO: 2992642 - RNA, 19 nt, Human
aagugaagacaaugacuua

SEQ ID NO: 2992643 - RNA, 17 nt, Human
aagugaagacaaugacu

SEQ ID NO: 2992644 - RNA, 21 nt, Human
aagugaaaaaggaggaagaga

SEQ ID NO: 2992645 - RNA, 12 nt, Human
aagugagagagg

SEQ ID NO: 2992646 - RNA, 14 nt, Human
aagugagagcuggg

SEQ ID NO: 2992647 - RNA, 13 nt, Human
aaguauuagaaua

SEQ ID NO: 2992648 - RNA, 20 nt, Human
aaguacacuguuucaaacuu

SEQ ID NO: 2992649 - RNA, 19 nt, Human
aaguacacuguuucaaacu

SEQ ID NO: 2992650 - RNA, 23 nt, Human
aaguacacuguuucaaacuuuac

SEQ ID NO: 2992651 - RNA, 18 nt, Human
aaguacacuguuucaaac

SEQ ID NO: 2992652 - RNA, 13 nt, Human
aaguacacuguuu

SEQ ID NO: 2992653 - RNA, 14 nt, Human
aaguaaugauaacu

SEQ ID NO: 2992654 - RNA, 22 nt, Human
guuuugccauguuggccaggcu

SEQ ID NO: 2992655 - RNA, 21 nt, Human
guuuugccauguuggccaggc

SEQ ID NO: 2992656 - RNA, 20 nt, Human
guuuugccauguuggccagg

SEQ ID NO: 2992657 - RNA, 16 nt, Human
guuuugccauguuggc

SEQ ID NO: 2992658 - RNA, 15 nt, Human
guuucugccgcagcc

SEQ ID NO: 2992659 - RNA, 14 nt, Human
guuucugccgcagc

SEQ ID NO: 2992660 - RNA, 23 nt, Human
uaaaagaauauuuuaacuuccuu

SEQ ID NO: 2992661 - RNA, 12 nt, Human
uaaaagaaugau

SEQ ID NO: 2992662 - RNA, 22 nt, Human
uaaaacuugauguguuaucucu

SEQ ID NO: 2992663 - RNA, 20 nt, Human
uaaaacuugauguguuaucu

SEQ ID NO: 2992664 - RNA, 16 nt, Human
uaaaagaauauuuuaa

SEQ ID NO: 2992665 - RNA, 21 nt, Human
uaaaaaucucaaauuucuaaa

SEQ ID NO: 2992666 - RNA, 20 nt, Human
uaaaaaucucaaauuucuaa

SEQ ID NO: 2992667 - RNA, 19 nt, Human
uaaaaaucucaaauuucua

SEQ ID NO: 2992668 - RNA, 15 nt, Human
uaaaaaguggaaaaa

SEQ ID NO: 2992669 - RNA, 15 nt, Human
guuuuucuucucccu

SEQ ID NO: 2992670 - RNA, 15 nt, Human
guuuuucuugcaugg

SEQ ID NO: 2992671 - RNA, 17 nt, Human
uaaaaaucucaaauuuc

SEQ ID NO: 2992672 - RNA, 16 nt, Human
uaaaaaucucaaauuu

SEQ ID NO: 2992673 - RNA, 15 nt, Human
uaaaaaucucaaauu

SEQ ID NO: 2992674 - RNA, 20 nt, Human
uaaaagacagugaaagaaaa

SEQ ID NO: 2992675 - RNA, 22 nt, Human
uaaaauaccagccaguaaaugg

SEQ ID NO: 2992676 - RNA, 21 nt, Human
uaaaauaccagccaguaaaug

SEQ ID NO: 2992677 - RNA, 18 nt, Human
aagugauucuccugccuc

SEQ ID NO: 2992678 - RNA, 17 nt, Human
aagugauucuccugccu

SEQ ID NO: 2992679 - RNA, 16 nt, Human
aagugauucuccugcc

SEQ ID NO: 2992680 - RNA, 15 nt, Human
aagugauucuccugc

SEQ ID NO: 2992681 - RNA, 19 nt, Human
aagugauucuccugccuca

SEQ ID NO: 2992682 - RNA, 16 nt, Human
aagugaggaugaaaaa

SEQ ID NO: 2992683 - RNA, 15 nt, Human
aagugagagcugggu

SEQ ID NO: 2992684 - RNA, 14 nt, Human
guugcuaacagcaa

SEQ ID NO: 2992685 - RNA, 13 nt, Human
guugcccaggcug

SEQ ID NO: 2992686 - RNA, 12 nt, Human
guugcccaggcu

SEQ ID NO: 2992687 - RNA, 23 nt, Human
guugcccaggcaggucuugaacu

SEQ ID NO: 2992688 - RNA, 13 nt, Human
aaggauacuuauu

SEQ ID NO: 2992689 - RNA, 16 nt, Human
aaggauacuuauuuaa

SEQ ID NO: 2992690 - RNA, 17 nt, Human
aaggcauggacuucugg

SEQ ID NO: 2992691 - RNA, 21 nt, Human
aaggauacaaaagcaugugag

SEQ ID NO: 2992692 - RNA, 13 nt, Human
aaggauacaaaag

SEQ ID NO: 2992693 - RNA, 13 nt, Human
aaggauaaugaau

SEQ ID NO: 2992694 - RNA, 16 nt, Human
aaggccaaaggaagca

SEQ ID NO: 2992695 - RNA, 15 nt, Human
aaggaagacuucauc

SEQ ID NO: 2992696 - RNA, 13 nt, Human
aaggaagcacaug

SEQ ID NO: 2992697 - RNA, 14 nt, Human
aaggaagacuucau

SEQ ID NO: 2992698 - RNA, 17 nt, Human
aaggaauaccugucccc

SEQ ID NO: 2992699 - RNA, 16 nt, Human
aaggaagcacaugccu

SEQ ID NO: 2992700 - RNA, 15 nt, Human
aaggaaagagggagg

SEQ ID NO: 2992701 - RNA, 14 nt, Human
aaggagauuuacaa

SEQ ID NO: 2992702 - RNA, 11 nt, Human
aaggagagcua

SEQ ID NO: 2992703 - RNA, 18 nt, Human
aaggaauaccuguccccc

SEQ ID NO: 2992704 - RNA, 18 nt, Human
aaggaggaagagaaaaaa

SEQ ID NO: 2992705 - RNA, 20 nt, Human
aaggaggggauagagagaga

SEQ ID NO: 2992706 - RNA, 12 nt, Human
guuuaaugguag

SEQ ID NO: 2992707 - RNA, 17 nt, Human
guuuaaugguaguuuua

SEQ ID NO: 2992708 - RNA, 13 nt, Human
guuuauugucaaa

SEQ ID NO: 2992709 - RNA, 15 nt, Human
guugggccaggagcc

SEQ ID NO: 2992710 - RNA, 17 nt, Human
guugggccaggagccuc

SEQ ID NO: 2992711 - RNA, 13 nt, Human
guugggcuggugu

SEQ ID NO: 2992712 - RNA, 22 nt, Human
guuuauuuggaaaggaaugcaa

SEQ ID NO: 2992713 - RNA, 13 nt, Human
guuucaaacuuua

SEQ ID NO: 2992714 - RNA, 16 nt, Human
guuucaaacuuuacua

SEQ ID NO: 2992715 - RNA, 14 nt, Human
guuucaaacuuuac

SEQ ID NO: 2992716 - RNA, 16 nt, Human
aaggcuccaggagcag

SEQ ID NO: 2992717 - RNA, 18 nt, Human
aaggcuccaggagcagcc

SEQ ID NO: 2992718 - RNA, 15 nt, Human
aaggcuccaggagca

SEQ ID NO: 2992719 - RNA, 19 nt, Human
aaggcuccaggagcagcca

SEQ ID NO: 2992720 - RNA, 22 nt, Human
aaggcuccaggagcagccacau

SEQ ID NO: 2992721 - RNA, 16 nt, Human
aaggcucgagcaugcc

SEQ ID NO: 2992722 - RNA, 18 nt, Human
aaggcucgagcaugccug

SEQ ID NO: 2992723 - RNA, 19 nt, Human
aaggcucgagcaugccugg

SEQ ID NO: 2992724 - RNA, 20 nt, Human
aaggcucgagcaugccugga

SEQ ID NO: 2992725 - RNA, 22 nt, Human
aaggcucgagcaugccuggaug

SEQ ID NO: 2992726 - RNA, 19 nt, Human
aagggugaugggaaagcau

SEQ ID NO: 2992727 - RNA, 13 nt, Human
aagguacuucaaa

SEQ ID NO: 2992728 - RNA, 14 nt, Human
aagguacuucaaau

SEQ ID NO: 2992729 - RNA, 20 nt, Human
aagguagaaauaucugaaaa

SEQ ID NO: 2992730 - RNA, 17 nt, Human
aaggggcaguggugguu

SEQ ID NO: 2992731 - RNA, 22 nt, Human
aaggggcccaaauucuuucagu

SEQ ID NO: 2992732 - RNA, 22 nt, Human
guuucuaugacacaugcaaggu

SEQ ID NO: 2992733 - RNA, 18 nt, Human
aagguauuuaauagguuu

SEQ ID NO: 2992734 - RNA, 12 nt, Human
aaggucauuuuu

SEQ ID NO: 2992735 - RNA, 18 nt, Human
guuucugaaagggacgcu

SEQ ID NO: 2992736 - RNA, 19 nt, Human
guuucuauguguagggcgg

SEQ ID NO: 2992737 - RNA, 18 nt, Human
aaaugguguuuuaucuuc

SEQ ID NO: 2992738 - RNA, 17 nt, Human
aaaugguguuuuaucuu

SEQ ID NO: 2992739 - RNA, 14 nt, Human
aaauggguuuuacu

SEQ ID NO: 2992740 - RNA, 15 nt, Human
aaauggguuuuacug

SEQ ID NO: 2992741 - RNA, 16 nt, Human
aaaugguagcauuuua

SEQ ID NO: 2992742 - RNA, 20 nt, Human
aaaugguagcauuuuaaaca

SEQ ID NO: 2992743 - RNA, 18 nt, Human
aaaugguagcauuuuaaa

SEQ ID NO: 2992744 - RNA, 22 nt, Human
aaaugguagcauuuuaaacaaa

SEQ ID NO: 2992745 - RNA, 22 nt, Human
guaacaggaaaauuuuaaaaau

SEQ ID NO: 2992746 - RNA, 12 nt, Human
guaacaggcaga

SEQ ID NO: 2992747 - RNA, 19 nt, Human
aaaugggggugcauuugag

SEQ ID NO: 2992748 - RNA, 20 nt, Human
guaacaggaaaauuuuaaaa

SEQ ID NO: 2992749 - RNA, 20 nt, Human
guaguguuggagaagaacug

SEQ ID NO: 2992750 - RNA, 16 nt, Human
aaauguaagggaaacu

SEQ ID NO: 2992751 - RNA, 17 nt, Human
guaguguuggagaagaa

SEQ ID NO: 2992752 - RNA, 16 nt, Human
guauauuuuauaucaa

SEQ ID NO: 2992753 - RNA, 18 nt, Human
guaucaggugcugccauc

SEQ ID NO: 2992754 - RNA, 16 nt, Human
guaucaggugcugcca

SEQ ID NO: 2992755 - RNA, 21 nt, Human
guauaaaauaauuuuuauauu

SEQ ID NO: 2992756 - RNA, 15 nt, Human
guauaaaauaauuuu

SEQ ID NO: 2992757 - RNA, 13 nt, Human
guaugguggcugg

SEQ ID NO: 2992758 - RNA, 14 nt, Human
guaugguggcuggg

SEQ ID NO: 2992759 - RNA, 16 nt, Human
guaugguggcuggguu

SEQ ID NO: 2992760 - RNA, 15 nt, Human
guaugguggcugggu

SEQ ID NO: 2992761 - RNA, 22 nt, Human
guaucaggugcugccauccagg

SEQ ID NO: 2992762 - RNA, 19 nt, Human
guaucccaugagccucagc

SEQ ID NO: 2992763 - RNA, 16 nt, Human
gucaaauugugugaaa

SEQ ID NO: 2992764 - RNA, 22 nt, Human
guauuuuguuuuugucuuaaaa

SEQ ID NO: 2992765 - RNA, 14 nt, Human
aaauuagguugaaa

SEQ ID NO: 2992766 - RNA, 18 nt, Human
aaauuagguugaaacaua

SEQ ID NO: 2992767 - RNA, 17 nt, Human
aaauuagguugaaacau

SEQ ID NO: 2992768 - RNA, 16 nt, Human
aaauuagguugaaaca

SEQ ID NO: 2992769 - RNA, 19 nt, Human
aaauuagguugaaacauau

SEQ ID NO: 2992770 - RNA, 20 nt, Human
aaauuauucuauaauuucca

SEQ ID NO: 2992771 - RNA, 18 nt, Human
guauguacuucaugcugu

SEQ ID NO: 2992772 - RNA, 15 nt, Human
aaauguauuacagug

SEQ ID NO: 2992773 - RNA, 19 nt, Human
aaaugucuaguuguaacac

SEQ ID NO: 2992774 - RNA, 15 nt, Human
aaaugucaguucuga

SEQ ID NO: 2992775 - RNA, 16 nt, Human
aaaugucaguucugau

SEQ ID NO: 2992776 - RNA, 12 nt, Human
aaauuuguggaa

SEQ ID NO: 2992777 - RNA, 18 nt, Human
aaauuuguuauaaugaau

SEQ ID NO: 2992778 - RNA, 16 nt, Human
gucaguuguuauuuau

SEQ ID NO: 2992779 - RNA, 15 nt, Human
gucagugugacugau

SEQ ID NO: 2992780 - RNA, 17 nt, Human
gucaguuguuauuuauu

SEQ ID NO: 2992781 - RNA, 18 nt, Human
gucaguuguuauuuauug

SEQ ID NO: 2992782 - RNA, 21 nt, Human
gucaguuguuauuuauugaaa

SEQ ID NO: 2992783 - RNA, 23 nt, Human
gucagaaguuucugccgcagccc

SEQ ID NO: 2992784 - RNA, 13 nt, Human
gucagacacagau

SEQ ID NO: 2992785 - RNA, 18 nt, Human
gucagacacagauuggcc

SEQ ID NO: 2992786 - RNA, 21 nt, Human
gucacacaguauuacuucugc

SEQ ID NO: 2992787 - RNA, 22 nt, Human
gucacacaguauuacuucugcu

SEQ ID NO: 2992788 - RNA, 21 nt, Human
aacacaaagcuuuugcauauu

SEQ ID NO: 2992789 - RNA, 16 nt, Human
aacacaacuauauugu

SEQ ID NO: 2992790 - RNA, 15 nt, Human
aacacaacuauauug

SEQ ID NO: 2992791 - RNA, 22 nt, Human
aacaaugcuguauuuuaaaaga

SEQ ID NO: 2992792 - RNA, 17 nt, Human
aacaaugcuguauuuua

SEQ ID NO: 2992793 - RNA, 15 nt, Human
aacaaugcuguauuu

SEQ ID NO: 2992794 - RNA, 14 nt, Human
aacaaugcuguauu

SEQ ID NO: 2992795 - RNA, 12 nt, Human
aacaauaaaaga

SEQ ID NO: 2992796 - RNA, 18 nt, Human
aacaaggcaaggcuguca

SEQ ID NO: 2992797 - RNA, 21 nt, Human
aacaaggcaaggcugucaauu

SEQ ID NO: 2992798 - RNA, 15 nt, Human
aacaaggcaaggcug

SEQ ID NO: 2992799 - RNA, 16 nt, Human
aacaaggcaaggcugu

SEQ ID NO: 2992800 - RNA, 20 nt, Human
aacaagaccacguuucuaaa

SEQ ID NO: 2992801 - RNA, 23 nt, Human
aaauuuugauguuuuaaggaugc

SEQ ID NO: 2992802 - RNA, 18 nt, Human
aaauuuugauguuuuaag

SEQ ID NO: 2992803 - RNA, 20 nt, Human
aaauuuuuucucuaggaaau

SEQ ID NO: 2992804 - RNA, 15 nt, Human
aacacagcaagggug

SEQ ID NO: 2992805 - RNA, 21 nt, Human
gucauuuuuuuuaagaaaaag

SEQ ID NO: 2992806 - RNA, 19 nt, Human
gucauuuuuuuuaagaaaa

SEQ ID NO: 2992807 - RNA, 17 nt, Human
guccaagaagcccagga

SEQ ID NO: 2992808 - RNA, 18 nt, Human
guccaagaagcccaggaa

SEQ ID NO: 2992809 - RNA, 20 nt, Human
guccaagaagcccaggaaag

SEQ ID NO: 2992810 - RNA, 15 nt, Human
guccaagaagcccag

SEQ ID NO: 2992811 - RNA, 16 nt, Human
guccaagaagcccagg

SEQ ID NO: 2992812 - RNA, 13 nt, Human
guccaagaagccc

SEQ ID NO: 2992813 - RNA, 16 nt, Human
gucccaccuuggcugc

SEQ ID NO: 2992814 - RNA, 15 nt, Human
gucccaccuuggcug

SEQ ID NO: 2992815 - RNA, 14 nt, Human
gucccaccuuggcu

SEQ ID NO: 2992816 - RNA, 20 nt, Human
gucccaccccacacacgcca

SEQ ID NO: 2992817 - RNA, 21 nt, Human
gucccaccccacacacgccag

SEQ ID NO: 2992818 - RNA, 13 nt, Human
guccauagagagc

SEQ ID NO: 2992819 - RNA, 14 nt, Human
guccauagagagca

SEQ ID NO: 2992820 - RNA, 22 nt, Human
aacagugauuaccagggacuga

SEQ ID NO: 2992821 - RNA, 15 nt, Human
aacagugauuaccag

SEQ ID NO: 2992822 - RNA, 14 nt, Human
aacagggccucugc

SEQ ID NO: 2992823 - RNA, 20 nt, Human
aacagaugaaaagccucugu

SEQ ID NO: 2992824 - RNA, 16 nt, Human
aacagauaaauaguuu

SEQ ID NO: 2992825 - RNA, 14 nt, Human
aacagaugaaaagc

SEQ ID NO: 2992826 - RNA, 13 nt, Human
aacagaugaaaag

SEQ ID NO: 2992827 - RNA, 11 nt, Human
aacagaaaugu

SEQ ID NO: 2992828 - RNA, 13 nt, Human
aacagaagaaaau

SEQ ID NO: 2992829 - RNA, 20 nt, Human
aacagaagaaaauagaauug

SEQ ID NO: 2992830 - RNA, 13 nt, Human
aacagaaauguac

SEQ ID NO: 2992831 - RNA, 12 nt, Human
aacagaaaugua

SEQ ID NO: 2992832 - RNA, 14 nt, Human
aacagaaauguaca

SEQ ID NO: 2992833 - RNA, 12 nt, Human
guccuacucugu

SEQ ID NO: 2992834 - RNA, 15 nt, Human
guccuacccacccuc

SEQ ID NO: 2992835 - RNA, 16 nt, Human
guccuacccacccucc

SEQ ID NO: 2992836 - RNA, 16 nt, Human
gucccccuuccaugga

SEQ ID NO: 2992837 - RNA, 18 nt, Human
gucccccuuccauggacu

SEQ ID NO: 2992838 - RNA, 14 nt, Human
gucccccuuccaug

SEQ ID NO: 2992839 - RNA, 18 nt, Human
gucccccugacaacacuc

SEQ ID NO: 2992840 - RNA, 22 nt, Human
aacucugagugcaaacuucaga

SEQ ID NO: 2992841 - RNA, 20 nt, Human
aacucugagugcaaacuuca

SEQ ID NO: 2992842 - RNA, 21 nt, Human
aacucuucaaucucuugcacu

SEQ ID NO: 2992843 - RNA, 12 nt, Human
aacugaaaucau

SEQ ID NO: 2992844 - RNA, 18 nt, Human
aacucugagugcaaacuu

SEQ ID NO: 2992845 - RNA, 19 nt, Human
aacucugagugcaaacuuc

SEQ ID NO: 2992846 - RNA, 22 nt, Human
gugagucgaggacagggaggug

SEQ ID NO: 2992847 - RNA, 15 nt, Human
gugagucgaggacag

SEQ ID NO: 2992848 - RNA, 17 nt, Human
gugaggccagagacaca

SEQ ID NO: 2992849 - RNA, 22 nt, Human
gugaggccagagacacaagccu

SEQ ID NO: 2992850 - RNA, 17 nt, Human
gugaacuugggccacug

SEQ ID NO: 2992851 - RNA, 19 nt, Human
gugaacuugggccacugug

SEQ ID NO: 2992852 - RNA, 21 nt, Human
gugagaugcuagaacucccuu

SEQ ID NO: 2992853 - RNA, 17 nt, Human
gugaacugaucauguuu

SEQ ID NO: 2992854 - RNA, 20 nt, Human
aacugggaugaggugacuau

SEQ ID NO: 2992855 - RNA, 17 nt, Human
aacugggacaggggaga

SEQ ID NO: 2992856 - RNA, 22 nt, Human
aacugggggagggugaagugaa

SEQ ID NO: 2992857 - RNA, 21 nt, Human
aacugggggagggugaaguga

SEQ ID NO: 2992858 - RNA, 21 nt, Human
aacuggguacuuguggacaca

SEQ ID NO: 2992859 - RNA, 16 nt, Human
aacuggguacuugugg

SEQ ID NO: 2992860 - RNA, 15 nt, Human
aacuggauuaaacuu

SEQ ID NO: 2992861 - RNA, 19 nt, Human
aacuggacugguucaaaug

SEQ ID NO: 2992862 - RNA, 11 nt, Human
aacuggcugca

SEQ ID NO: 2992863 - RNA, 16 nt, Human
aacuggauuaaacuua

SEQ ID NO: 2992864 - RNA, 22 nt, Human
aacuggcaaagcagaaugugau

SEQ ID NO: 2992865 - RNA, 13 nt, Human
aacuggcaaagca

SEQ ID NO: 2992866 - RNA, 19 nt, Human
aacugcacugucaagauga

SEQ ID NO: 2992867 - RNA, 15 nt, Human
aacugcugacuguuu

SEQ ID NO: 2992868 - RNA, 20 nt, Human
aacugcugacuguuuucucu

SEQ ID NO: 2992869 - RNA, 21 nt, Human
aacugcugacuguuuucucuu

SEQ ID NO: 2992870 - RNA, 23 nt, Human
aacugcugacuguuuucucuuga

SEQ ID NO: 2992871 - RNA, 22 nt, Human
gugcaugcugucccuuacguga

SEQ ID NO: 2992872 - RNA, 21 nt, Human
gugcacacaccagagcccacc

SEQ ID NO: 2992873 - RNA, 22 nt, Human
gugcaaugaccuuucaauagga

SEQ ID NO: 2992874 - RNA, 19 nt, Human
gugauggggcccugccucc

SEQ ID NO: 2992875 - RNA, 22 nt, Human
gugccucucccugcugcuccua

SEQ ID NO: 2992876 - RNA, 16 nt, Human
gugccucucccugcug

SEQ ID NO: 2992877 - RNA, 14 nt, Human
gugccucucccugc

SEQ ID NO: 2992878 - RNA, 12 nt, Human
gugccucucccu

SEQ ID NO: 2992879 - RNA, 23 nt, Human
gugccucucccugcugcuccuag

SEQ ID NO: 2992880 - RNA, 19 nt, Human
gugcauuaucuagauacug

SEQ ID NO: 2992881 - RNA, 15 nt, Human
gugcauuaucuagau

SEQ ID NO: 2992882 - RNA, 19 nt, Human
gugcauguguguucaugca

SEQ ID NO: 2992883 - RNA, 23 nt, Human
gugcauuaucuagauacuguauc

SEQ ID NO: 2992884 - RNA, 21 nt, Human
aacuucagcgguuuauauaag

SEQ ID NO: 2992885 - RNA, 18 nt, Human
aacuuccagauccuggaa

SEQ ID NO: 2992886 - RNA, 13 nt, Human
aacuuccaauuua

SEQ ID NO: 2992887 - RNA, 14 nt, Human
gugauggggcccug

SEQ ID NO: 2992888 - RNA, 16 nt, Human
gugauggggcccugcc

SEQ ID NO: 2992889 - RNA, 17 nt, Human
gugauggggcccugccu

SEQ ID NO: 2992890 - RNA, 18 nt, Human
gugauggggcccugccuc

SEQ ID NO: 2992891 - RNA, 17 nt, Human
gugaugggaaagcauug

SEQ ID NO: 2992892 - RNA, 22 nt, Human
gugaugcgcaugucacggaggg

SEQ ID NO: 2992893 - RNA, 14 nt, Human
gugaugagaggaaa

SEQ ID NO: 2992894 - RNA, 16 nt, Human
gugaugagaggaaauc

SEQ ID NO: 2992895 - RNA, 17 nt, Human
gucuucuauuuauuuau

SEQ ID NO: 2992896 - RNA, 12 nt, Human
gucuucuauuua

SEQ ID NO: 2992897 - RNA, 14 nt, Human
gucuucuauuuauu

SEQ ID NO: 2992898 - RNA, 16 nt, Human
gucuuucacauuuaaa

SEQ ID NO: 2992899 - RNA, 18 nt, Human
gucuuuggacccugaggc

SEQ ID NO: 2992900 - RNA, 17 nt, Human
aaccugaggauucuauu

SEQ ID NO: 2992901 - RNA, 20 nt, Human
aaccugagccccaaaaggua

SEQ ID NO: 2992902 - RNA, 14 nt, Human
gucuggcccuuccu

SEQ ID NO: 2992903 - RNA, 12 nt, Human
aacucauuucua

SEQ ID NO: 2992904 - RNA, 12 nt, Human
aacuccuggccu

SEQ ID NO: 2992905 - RNA, 15 nt, Human
aacucuccuccagag

SEQ ID NO: 2992906 - RNA, 18 nt, Human
aacucuccuccagaguca

SEQ ID NO: 2992907 - RNA, 16 nt, Human
aacucuccucugcugc

SEQ ID NO: 2992908 - RNA, 23 nt, Human
gugaaccaccacacccagcccac

SEQ ID NO: 2992909 - RNA, 22 nt, Human
gugaaccaccacacccagccca

SEQ ID NO: 2992910 - RNA, 20 nt, Human
aacuacauuagguugugaau

SEQ ID NO: 2992911 - RNA, 12 nt, Human
aaccugugucuc

SEQ ID NO: 2992912 - RNA, 18 nt, Human
aaccuugaaaacuuuaug

SEQ ID NO: 2992913 - RNA, 21 nt, Human
aacuagaguuuagcuggaaaa

SEQ ID NO: 2992914 - RNA, 23 nt, Human
aacuaucucauuuccaagcaagu

SEQ ID NO: 2992915 - RNA, 18 nt, Human
aaccugagccccaaaagg

SEQ ID NO: 2992916 - RNA, 12 nt, Human
aaccucuaaauu

SEQ ID NO: 2992917 - RNA, 10 nt, Human
aacccagcuc

SEQ ID NO: 2992918 - RNA, 23 nt, Human
aacccaaauguucaucaaugaau

SEQ ID NO: 2992919 - RNA, 18 nt, Human
aacccaaguccaagcaua

SEQ ID NO: 2992920 - RNA, 17 nt, Human
aaccaucauugaaaucu

SEQ ID NO: 2992921 - RNA, 18 nt, Human
aaccaucauugaaaucuu

SEQ ID NO: 2992922 - RNA, 21 nt, Human
aaccaccacacccagcccacu

SEQ ID NO: 2992923 - RNA, 12 nt, Human
aaccaucauuga

SEQ ID NO: 2992924 - RNA, 19 nt, Human
aaccaccacacccagccca

SEQ ID NO: 2992925 - RNA, 15 nt, Human
aaccaagucaaguga

SEQ ID NO: 2992926 - RNA, 17 nt, Human
accaagaauugauuggg

SEQ ID NO: 2992927 - RNA, 19 nt, Human
accaaggcugauuaaacca

SEQ ID NO: 2992928 - RNA, 17 nt, Human
acauuucucauguugaa

SEQ ID NO: 2992929 - RNA, 20 nt, Human
accaaggcugauuaaaccaa

SEQ ID NO: 2992930 - RNA, 12 nt, Human
accagcagagca

SEQ ID NO: 2992931 - RNA, 13 nt, Human
accagcagagcac

SEQ ID NO: 2992932 - RNA, 14 nt, Human
accagcagaaaugc

SEQ ID NO: 2992933 - RNA, 17 nt, Human
accagccccagugccca

SEQ ID NO: 2992934 - RNA, 16 nt, Human
accagccccagugccc

SEQ ID NO: 2992935 - RNA, 19 nt, Human
accagccccagugcccaca

SEQ ID NO: 2992936 - RNA, 18 nt, Human
accagccccagugcccac

SEQ ID NO: 2992937 - RNA, 20 nt, Human
accagccccagugcccacag

SEQ ID NO: 2992938 - RNA, 19 nt, Human
acaugccuaccaauauuua

SEQ ID NO: 2992939 - RNA, 18 nt, Human
acaugccuaccaauauuu

SEQ ID NO: 2992940 - RNA, 19 nt, Human
acaugccucucucaggcca

SEQ ID NO: 2992941 - RNA, 23 nt, Human
acaugucuuuucuugcaugaggc

SEQ ID NO: 2992942 - RNA, 15 nt, Human
acccacccccaccca

SEQ ID NO: 2992943 - RNA, 17 nt, Human
acccacccccacccaag

SEQ ID NO: 2992944 - RNA, 14 nt, Human
accaugaaagacuu

SEQ ID NO: 2992945 - RNA, 12 nt, Human
accaugaaagac

SEQ ID NO: 2992946 - RNA, 19 nt, Human
accaugaaagacuucucua

SEQ ID NO: 2992947 - RNA, 15 nt, Human
acccacccuccuuuc

SEQ ID NO: 2992948 - RNA, 13 nt, Human
acccaugcugccc

SEQ ID NO: 2992949 - RNA, 14 nt, Human
accaucaagccacc

SEQ ID NO: 2992950 - RNA, 23 nt, Human
accaucauugaaaucuuuuugcu

SEQ ID NO: 2992951 - RNA, 15 nt, Human
accaucauugaaauc

SEQ ID NO: 2992952 - RNA, 12 nt, Human
accaucauugaa

SEQ ID NO: 2992953 - RNA, 15 nt, Human
accaucaagccacca

SEQ ID NO: 2992954 - RNA, 14 nt, Human
acaugccuaccaau

SEQ ID NO: 2992955 - RNA, 17 nt, Human
acaugcaaggucauuuu

SEQ ID NO: 2992956 - RNA, 15 nt, Human
acaugccucucucag

SEQ ID NO: 2992957 - RNA, 16 nt, Human
acaugccucucucagg

SEQ ID NO: 2992958 - RNA, 17 nt, Human
acaugccucucucaggc

SEQ ID NO: 2992959 - RNA, 18 nt, Human
acaugccucucucaggcc

SEQ ID NO: 2992960 - RNA, 16 nt, Human
acaugcaaggucauuu

SEQ ID NO: 2992961 - RNA, 20 nt, Human
acaucccuuaccugggaaag

SEQ ID NO: 2992962 - RNA, 16 nt, Human
acauaagauaaaugug

SEQ ID NO: 2992963 - RNA, 15 nt, Human
acauaagauaaaugu

SEQ ID NO: 2992964 - RNA, 14 nt, Human
acagcucuguccug

SEQ ID NO: 2992965 - RNA, 23 nt, Human
acagcuccuucuguccuacucug

SEQ ID NO: 2992966 - RNA, 18 nt, Human
acagcuccuucuguccua

SEQ ID NO: 2992967 - RNA, 16 nt, Human
acagcuccuucugucc

SEQ ID NO: 2992968 - RNA, 17 nt, Human
acagaggggguggccuc

SEQ ID NO: 2992969 - RNA, 18 nt, Human
acagaggggguggccucc

SEQ ID NO: 2992970 - RNA, 19 nt, Human
acagaggggguggccuccc

SEQ ID NO: 2992971 - RNA, 15 nt, Human
acagcuccuucuguc

SEQ ID NO: 2992972 - RNA, 17 nt, Human
acagcucuguccuggga

SEQ ID NO: 2992973 - RNA, 16 nt, Human
acagcucuguccuggg

SEQ ID NO: 2992974 - RNA, 13 nt, Human
acagcucuguccu

SEQ ID NO: 2992975 - RNA, 23 nt, Human
acaggcaagcaccuccugccucg

SEQ ID NO: 2992976 - RNA, 20 nt, Human
acaggcaagcaccuccugcc

SEQ ID NO: 2992977 - RNA, 12 nt, Human
acagggccucug

SEQ ID NO: 2992978 - RNA, 17 nt, Human
acagggccucugcggag

SEQ ID NO: 2992979 - RNA, 13 nt, Human
acagggccucugc

SEQ ID NO: 2992980 - RNA, 19 nt, Human
acaggcaagcaccuccugc

SEQ ID NO: 2992981 - RNA, 14 nt, Human
acaggcaaugcugg

SEQ ID NO: 2992982 - RNA, 23 nt, Human
acaggugugagucaccaagccca

SEQ ID NO: 2992983 - RNA, 22 nt, Human
acaggugugagucaccaagccc

SEQ ID NO: 2992984 - RNA, 19 nt, Human
acaggugugaaccaccaca

SEQ ID NO: 2992985 - RNA, 22 nt, Human
acagugagucgaggacagggag

SEQ ID NO: 2992986 - RNA, 21 nt, Human
acagugauuaccagggacuga

SEQ ID NO: 2992987 - RNA, 20 nt, Human
acagugauuaccagggacug

SEQ ID NO: 2992988 - RNA, 23 nt, Human
acagugagucgaggacagggagg

SEQ ID NO: 2992989 - RNA, 15 nt, Human
acaguggggaaugaa

SEQ ID NO: 2992990 - RNA, 19 nt, Human
acaguggggaaugaagaua

SEQ ID NO: 2992991 - RNA, 21 nt, Human
aauuuccugggagcuuuugua

SEQ ID NO: 2992992 - RNA, 18 nt, Human
aauuuccugggagcuuuu

SEQ ID NO: 2992993 - RNA, 17 nt, Human
aauuuccugggagcuuu

SEQ ID NO: 2992994 - RNA, 19 nt, Human
aaugucacaggcaggucca

SEQ ID NO: 2992995 - RNA, 16 nt, Human
aaugucacaggcaggu

SEQ ID NO: 2992996 - RNA, 12 nt, Human
aauuguaaggaa

SEQ ID NO: 2992997 - RNA, 16 nt, Human
aauuguaaggaaugau

SEQ ID NO: 2992998 - RNA, 17 nt, Human
aauuuauuauggcacau

SEQ ID NO: 2992999 - RNA, 20 nt, Human
aauuuauuuaugggauccug

SEQ ID NO: 2993000 - RNA, 16 nt, Human
aauuuugugcccccau

SEQ ID NO: 2993001 - RNA, 18 nt, Human
aauuuugugaagcaaaau

SEQ ID NO: 2993002 - RNA, 17 nt, Human
aauuuugugaagcaaaa

SEQ ID NO: 2993003 - RNA, 13 nt, Human
aauuuugugaagc

SEQ ID NO: 2993004 - RNA, 14 nt, Human
aauuuugauguuuu

SEQ ID NO: 2993005 - RNA, 13 nt, Human
acaaaaugaaacg

SEQ ID NO: 2993006 - RNA, 22 nt, Human
acaaaaugaaacgcaaccacca

SEQ ID NO: 2993007 - RNA, 14 nt, Human
acaaaauggaauac

SEQ ID NO: 2993008 - RNA, 13 nt, Human
acaaaauggaaua

SEQ ID NO: 2993009 - RNA, 13 nt, Human
acaagaaaugaaa

SEQ ID NO: 2993010 - RNA, 16 nt, Human
acaagaaaugaaagca

SEQ ID NO: 2993011 - RNA, 15 nt, Human
acaagaaaugaaagc

SEQ ID NO: 2993012 - RNA, 21 nt, Human
acaaggaugaauuaaguuuuu

SEQ ID NO: 2993013 - RNA, 16 nt, Human
acagaagcuccaggua

SEQ ID NO: 2993014 - RNA, 18 nt, Human
acagaagaaaauagaauu

SEQ ID NO: 2993015 - RNA, 14 nt, Human
acagacaaagcgug

SEQ ID NO: 2993016 - RNA, 13 nt, Human
acagacaaagcgu

SEQ ID NO: 2993017 - RNA, 21 nt, Human
acagaggccaugggccuccug

SEQ ID NO: 2993018 - RNA, 14 nt, Human
acagaggggguggc

SEQ ID NO: 2993019 - RNA, 17 nt, Human
acagaggccaugggccu

SEQ ID NO: 2993020 - RNA, 23 nt, Human
acagaggcagccccauucugccu

SEQ ID NO: 2993021 - RNA, 13 nt, Human
acagaggcagccc

SEQ ID NO: 2993022 - RNA, 17 nt, Human
acacugugcugagucug

SEQ ID NO: 2993023 - RNA, 22 nt, Human
acacugugcugagucugaaggc

SEQ ID NO: 2993024 - RNA, 15 nt, Human
acacgaauauugcug

SEQ ID NO: 2993025 - RNA, 21 nt, Human
acacgaauauugcugauggug

SEQ ID NO: 2993026 - RNA, 20 nt, Human
acaccacuacauucuguuaa

SEQ ID NO: 2993027 - RNA, 17 nt, Human
acaccacuacauucugu

SEQ ID NO: 2993028 - RNA, 12 nt, Human
acacgaauauug

SEQ ID NO: 2993029 - RNA, 14 nt, Human
acacgaauauugcu

SEQ ID NO: 2993030 - RNA, 15 nt, Human
acaccacuacauucu

SEQ ID NO: 2993031 - RNA, 14 nt, Human
acaccacuacauuc

SEQ ID NO: 2993032 - RNA, 18 nt, Human
acacauuuuuuaaaugca

SEQ ID NO: 2993033 - RNA, 16 nt, Human
acacauuuuuuaaaug

SEQ ID NO: 2993034 - RNA, 14 nt, Human
acacauuuuuuaaa

SEQ ID NO: 2993035 - RNA, 21 nt, Human
acacagcucuucuccaggcug

SEQ ID NO: 2993036 - RNA, 20 nt, Human
acacagcucuucuccaggcu

SEQ ID NO: 2993037 - RNA, 19 nt, Human
acacaaaaguuucucuuuu

SEQ ID NO: 2993038 - RNA, 19 nt, Human
acacagcucuucuccaggc

SEQ ID NO: 2993039 - RNA, 20 nt, Human
acaaggaugaucuaggaaga

SEQ ID NO: 2993040 - RNA, 16 nt, Human
acaaggauugcuacug

SEQ ID NO: 2993041 - RNA, 14 nt, Human
acaauuuauuaugg

SEQ ID NO: 2993042 - RNA, 13 nt, Human
acaauuuauuaug

SEQ ID NO: 2993043 - RNA, 19 nt, Human
acggacacucaaaagcugg

SEQ ID NO: 2993044 - RNA, 19 nt, Human
acggacgaaccuugaaaac

SEQ ID NO: 2993045 - RNA, 15 nt, Human
acggaauaguuggcu

SEQ ID NO: 2993046 - RNA, 15 nt, Human
acggaagagccuugc

SEQ ID NO: 2993047 - RNA, 16 nt, Human
acggaagagccuugcg

SEQ ID NO: 2993048 - RNA, 18 nt, Human
acgcuggagugcagugag

SEQ ID NO: 2993049 - RNA, 19 nt, Human
acgcuggagugcagugagc

SEQ ID NO: 2993050 - RNA, 23 nt, Human
acgucugacaggcaaugcuggcu

SEQ ID NO: 2993051 - RNA, 15 nt, Human
acgucugacaggcaa

SEQ ID NO: 2993052 - RNA, 15 nt, Human
acuaauagacaauuu

SEQ ID NO: 2993053 - RNA, 11 nt, Human
accugugucuc

SEQ ID NO: 2993054 - RNA, 18 nt, Human
acuaguauuucuaugaaa

SEQ ID NO: 2993055 - RNA, 19 nt, Human
acuaguauuucuaugaaau

SEQ ID NO: 2993056 - RNA, 16 nt, Human
acuauuguuagucucu

SEQ ID NO: 2993057 - RNA, 17 nt, Human
acuagggaagauaauau

SEQ ID NO: 2993058 - RNA, 21 nt, Human
accucuugagccuugaacuuu

SEQ ID NO: 2993059 - RNA, 20 nt, Human
accucuugagccuugaacuu

SEQ ID NO: 2993060 - RNA, 19 nt, Human
accucuugagccuugaacu

SEQ ID NO: 2993061 - RNA, 17 nt, Human
accucuugagccuugaa

SEQ ID NO: 2993062 - RNA, 18 nt, Human
accucugccucagaaaac

SEQ ID NO: 2993063 - RNA, 17 nt, Human
accucugccucagaaaa

SEQ ID NO: 2993064 - RNA, 11 nt, Human
accugccaggg

SEQ ID NO: 2993065 - RNA, 12 nt, Human
accugccaggga

SEQ ID NO: 2993066 - RNA, 13 nt, Human
accugccagggac

SEQ ID NO: 2993067 - RNA, 15 nt, Human
accugccagggacag

SEQ ID NO: 2993068 - RNA, 16 nt, Human
accugccagggacaga

SEQ ID NO: 2993069 - RNA, 18 nt, Human
accugccagggacagagg

SEQ ID NO: 2993070 - RNA, 16 nt, Human
accgugaggccagaga

SEQ ID NO: 2993071 - RNA, 17 nt, Human
accgugaggccagagac

SEQ ID NO: 2993072 - RNA, 12 nt, Human
accucaggccug

SEQ ID NO: 2993073 - RNA, 13 nt, Human
accucaggccugg

SEQ ID NO: 2993074 - RNA, 14 nt, Human
accucaggccuggg

SEQ ID NO: 2993075 - RNA, 22 nt, Human
accucaggccugggggcugggc

SEQ ID NO: 2993076 - RNA, 18 nt, Human
accucaggugagaagcag

SEQ ID NO: 2993077 - RNA, 22 nt, Human
acccugugauggggcccugccu

SEQ ID NO: 2993078 - RNA, 16 nt, Human
accccacacacgccag

SEQ ID NO: 2993079 - RNA, 14 nt, Human
acccaugcugcccu

SEQ ID NO: 2993080 - RNA, 15 nt, Human
acccaugcugcccug

SEQ ID NO: 2993081 - RNA, 18 nt, Human
accccaagacucccauga

SEQ ID NO: 2993082 - RNA, 17 nt, Human
accccaagacucccaug

SEQ ID NO: 2993083 - RNA, 16 nt, Human
accccaagacucccau

SEQ ID NO: 2993084 - RNA, 15 nt, Human
accccaagacuccca

SEQ ID NO: 2993085 - RNA, 17 nt, Human
acccuguuaccauuuug

SEQ ID NO: 2993086 - RNA, 17 nt, Human
accggcuggccuggccc

SEQ ID NO: 2993087 - RNA, 18 nt, Human
accggcuggccuggcccc

SEQ ID NO: 2993088 - RNA, 19 nt, Human
accggcuggccuggccccu

SEQ ID NO: 2993089 - RNA, 20 nt, Human
accgggcacucagaagacac

SEQ ID NO: 2993090 - RNA, 14 nt, Human
accggcuggccugg

SEQ ID NO: 2993091 - RNA, 15 nt, Human
accggcuggccuggc

SEQ ID NO: 2993092 - RNA, 14 nt, Human
accgugaggccaga

SEQ ID NO: 2993093 - RNA, 19 nt, Human
accgggccacagagaaagu

SEQ ID NO: 2993094 - RNA, 15 nt, Human
accgggccacagaga

SEQ ID NO: 2993095 - RNA, 15 nt, Human
acucuuaagaagacu

SEQ ID NO: 2993096 - RNA, 14 nt, Human
acucuuaagaagac

SEQ ID NO: 2993097 - RNA, 20 nt, Human
acucuuaagaagacugcauu

SEQ ID NO: 2993098 - RNA, 17 nt, Human
acucugucucaguccau

SEQ ID NO: 2993099 - RNA, 15 nt, Human
acucugucucagucc

SEQ ID NO: 2993100 - RNA, 19 nt, Human
acucugugucagguggggc

SEQ ID NO: 2993101 - RNA, 21 nt, Human
acucugugucagguggggcag

SEQ ID NO: 2993102 - RNA, 19 nt, Human
acucugucucaaaaaaaca

SEQ ID NO: 2993103 - RNA, 19 nt, Human
acuauuuauuuacaaaugu

SEQ ID NO: 2993104 - RNA, 23 nt, Human
acugauuuuuuuuuccuucagug

SEQ ID NO: 2993105 - RNA, 21 nt, Human
acugauuuuuuuuuccuucag

SEQ ID NO: 2993106 - RNA, 22 nt, Human
acugauuuuuuuuuccuucagu

SEQ ID NO: 2993107 - RNA, 23 nt, Human
acugacauuguuggccaaagcca

SEQ ID NO: 2993108 - RNA, 22 nt, Human
acugacauuguuggccaaagcc

SEQ ID NO: 2993109 - RNA, 13 nt, Human
acugaucucucgu

SEQ ID NO: 2993110 - RNA, 22 nt, Human
acugauggcuaauguacugcau

SEQ ID NO: 2993111 - RNA, 22 nt, Human
acugaugggcaacccccagccu

SEQ ID NO: 2993112 - RNA, 12 nt, Human
acugaugggcaa

SEQ ID NO: 2993113 - RNA, 15 nt, Human
acugcccggcagggu

SEQ ID NO: 2993114 - RNA, 14 nt, Human
acugccauccuggc

SEQ ID NO: 2993115 - RNA, 20 nt, Human
acugcuuuuggucuguguga

SEQ ID NO: 2993116 - RNA, 16 nt, Human
acugcuuuuggucugu

SEQ ID NO: 2993117 - RNA, 15 nt, Human
acugcuuuuggucug

SEQ ID NO: 2993118 - RNA, 14 nt, Human
acugcuuuuggucu

SEQ ID NO: 2993119 - RNA, 22 nt, Human
acugcccggcaggguccuagaa

SEQ ID NO: 2993120 - RNA, 19 nt, Human
acugccauccuggcccagg

SEQ ID NO: 2993121 - RNA, 22 nt, Human
acuugggaggcugagaugggag

SEQ ID NO: 2993122 - RNA, 17 nt, Human
acuuuaugcuaagugaa

SEQ ID NO: 2993123 - RNA, 12 nt, Human
acuuuaugcuaa

SEQ ID NO: 2993124 - RNA, 14 nt, Human
acuuaaaaaugguu

SEQ ID NO: 2993125 - RNA, 13 nt, Human
acuuaaaaauggu

SEQ ID NO: 2993126 - RNA, 14 nt, Human
acuuaaauaaugug

SEQ ID NO: 2993127 - RNA, 19 nt, Human
acuucaaauccuugaagau

SEQ ID NO: 2993128 - RNA, 18 nt, Human
acuucagcgguuuauaua

SEQ ID NO: 2993129 - RNA, 17 nt, Human
acuucagcgguuuauau

SEQ ID NO: 2993130 - RNA, 20 nt, Human
acuucaaauccuugaagauu

SEQ ID NO: 2993131 - RNA, 19 nt, Human
acuucagcgguuuauauaa

SEQ ID NO: 2993132 - RNA, 20 nt, Human
acuucugccauauucuguug

SEQ ID NO: 2993133 - RNA, 19 nt, Human
acuucugccauauucuguu

SEQ ID NO: 2993134 - RNA, 18 nt, Human
acuucuuauacauuugau

SEQ ID NO: 2993135 - RNA, 17 nt, Human
acuucuuauacauuuga

SEQ ID NO: 2993136 - RNA, 12 nt, Human
aaagugcccagc

SEQ ID NO: 2993137 - RNA, 16 nt, Human
aaauaaacgucuuaaa

SEQ ID NO: 2993138 - RNA, 15 nt, Human
aaauaaacgucuuaa

SEQ ID NO: 2993139 - RNA, 11 nt, Human
aaauaaauuau

SEQ ID NO: 2993140 - RNA, 19 nt, Human
aaagcauuguaaaugugcu

SEQ ID NO: 2993141 - RNA, 20 nt, Human
aaagcauuguaaaugugcuu

SEQ ID NO: 2993142 - RNA, 15 nt, Human
aaagccaaagcuagg

SEQ ID NO: 2993143 - RNA, 19 nt, Human
aaaggcagaagcaacccaa

SEQ ID NO: 2993144 - RNA, 22 nt, Human
aaaggcuccaggagcagccaca

SEQ ID NO: 2993145 - RNA, 21 nt, Human
aaaggcuccaggagcagccac

SEQ ID NO: 2993146 - RNA, 14 nt, Human
aaaggcuaccuuug

SEQ ID NO: 2993147 - RNA, 17 nt, Human
aaaggcuaccuuuguau

SEQ ID NO: 2993148 - RNA, 14 nt, Human
aaaggcuccaggag

SEQ ID NO: 2993149 - RNA, 15 nt, Human
aaagauacaguuacu

SEQ ID NO: 2993150 - RNA, 21 nt, Human
aaacccugucucuacuaaaaa

SEQ ID NO: 2993151 - RNA, 17 nt, Human
aaaccccaucucuacaa

SEQ ID NO: 2993152 - RNA, 18 nt, Human
aaacccagcucuggucca

SEQ ID NO: 2993153 - RNA, 17 nt, Human
aaacucuugaccucagg

SEQ ID NO: 2993154 - RNA, 14 nt, Human
aaacccuucagugc

SEQ ID NO: 2993155 - RNA, 20 nt, Human
aaacugauuuuuuuuuccuu

SEQ ID NO: 2993156 - RNA, 13 nt, Human
aaacugauuuuuu

SEQ ID NO: 2993157 - RNA, 19 nt, Human
aaacugauuuuuuuuuccu

SEQ ID NO: 2993158 - RNA, 13 nt, Human
aaagaaacauuug

SEQ ID NO: 2993159 - RNA, 11 nt, Human
aaacagggccu

SEQ ID NO: 2993160 - RNA, 17 nt, Human
aaacagcuaaugggaca

SEQ ID NO: 2993161 - RNA, 15 nt, Human
aaaauuagccaagug

SEQ ID NO: 2993162 - RNA, 18 nt, Human
aaaauuauggaaacagau

SEQ ID NO: 2993163 - RNA, 14 nt, Human
aaaauuauggaaac

SEQ ID NO: 2993164 - RNA, 17 nt, Human
aaaauuauggaaacaga

SEQ ID NO: 2993165 - RNA, 15 nt, Human
aaaauuauggaaaca

SEQ ID NO: 2993166 - RNA, 19 nt, Human
aaaauccauacauuugugu

SEQ ID NO: 2993167 - RNA, 18 nt, Human
aacagcaacacaaagcuu

SEQ ID NO: 2993168 - RNA, 17 nt, Human
aacagcaacacaaagcu

SEQ ID NO: 2993169 - RNA, 16 nt, Human
aacagcuaaugggaca

SEQ ID NO: 2993170 - RNA, 20 nt, Human
aacaugcuguacauacuuuu

SEQ ID NO: 2993171 - RNA, 19 nt, Human
aacaugcuguacauacuuu

SEQ ID NO: 2993172 - RNA, 18 nt, Human
aacaugcuguacauacuu

SEQ ID NO: 2993173 - RNA, 21 nt, Human
aacaugcuguacauacuuuuu

SEQ ID NO: 2993174 - RNA, 22 nt, Human
aacaugcuacacacugcauguu

SEQ ID NO: 2993175 - RNA, 15 nt, Human
aacauggaaguacua

SEQ ID NO: 2993176 - RNA, 17 nt, Human
aaccaguguuguggauu

SEQ ID NO: 2993177 - RNA, 19 nt, Human
aaccaguguuguggauuua

SEQ ID NO: 2993178 - RNA, 13 nt, Human
aacccuucagugc

SEQ ID NO: 2993179 - RNA, 21 nt, Human
aaccgagggggcugcucccac

SEQ ID NO: 2993180 - RNA, 20 nt, Human
aaccgagggggcugcuccca

SEQ ID NO: 2993181 - RNA, 19 nt, Human
aaccgagggggcugcuccc

SEQ ID NO: 2993182 - RNA, 18 nt, Human
aacugaaguucuauuuau

SEQ ID NO: 2993183 - RNA, 16 nt, Human
aacucauauuuucaug

SEQ ID NO: 2993184 - RNA, 15 nt, Human
aacucauauuuucau

SEQ ID NO: 2993185 - RNA, 18 nt, Human
aacucauauuuucaugcu

SEQ ID NO: 2993186 - RNA, 23 nt, Human
aacugagaugugaacacaucagc

SEQ ID NO: 2993187 - RNA, 15 nt, Human
aacucaccccagccc

SEQ ID NO: 2993188 - RNA, 18 nt, Human
aacucaccccagccccaa

SEQ ID NO: 2993189 - RNA, 16 nt, Human
aacucaccccagcccc

SEQ ID NO: 2993190 - RNA, 17 nt, Human
aacucaccccagcccca

SEQ ID NO: 2993191 - RNA, 17 nt, Human
aacucaaacucuuaaaa

SEQ ID NO: 2993192 - RNA, 14 nt, Human
aacgaaagaaggca

SEQ ID NO: 2993193 - RNA, 14 nt, Human
aaaucuuaacuuga

SEQ ID NO: 2993194 - RNA, 19 nt, Human
aaaucuccaaaauaaaacu

SEQ ID NO: 2993195 - RNA, 22 nt, Human
aaaucuccaaaauaaaacuuuu

SEQ ID NO: 2993196 - RNA, 15 nt, Human
aaauggacguguuau

SEQ ID NO: 2993197 - RNA, 17 nt, Human
aaauggacguguuauga

SEQ ID NO: 2993198 - RNA, 14 nt, Human
aaauggacguguua

SEQ ID NO: 2993199 - RNA, 17 nt, Human
aaauggaauacucuuau

SEQ ID NO: 2993200 - RNA, 20 nt, Human
aaauguucaucaaugaauga

SEQ ID NO: 2993201 - RNA, 17 nt, Human
aaauguucaucaaugaa

SEQ ID NO: 2993202 - RNA, 12 nt, Human
aacacaucagcu

SEQ ID NO: 2993203 - RNA, 21 nt, Human
aacacauacaggaagguagaa

SEQ ID NO: 2993204 - RNA, 22 nt, Human
aacaaaccuguuucugcagcca

SEQ ID NO: 2993205 - RNA, 14 nt, Human
aaauuaacuuuuau

SEQ ID NO: 2993206 - RNA, 13 nt, Human
aaauuaacuuuua

SEQ ID NO: 2993207 - RNA, 22 nt, Human
aaauugacacuuaaaaaugguu

SEQ ID NO: 2993208 - RNA, 12 nt, Human
aaauuaacuuuu

SEQ ID NO: 2993209 - RNA, 13 nt, Human
aauauaaaaauaa

SEQ ID NO: 2993210 - RNA, 19 nt, Human
aauagaaaguugcaaggca

SEQ ID NO: 2993211 - RNA, 20 nt, Human
aauacgugggcauucaaaug

SEQ ID NO: 2993212 - RNA, 19 nt, Human
aauacgugggcauucaaau

SEQ ID NO: 2993213 - RNA, 21 nt, Human
aauaccugucccccugacaac

SEQ ID NO: 2993214 - RNA, 16 nt, Human
aauauaggaacuuaaa

SEQ ID NO: 2993215 - RNA, 17 nt, Human
aauaaaauuuuaguuga

SEQ ID NO: 2993216 - RNA, 10 nt, Human
aauaaaccau

SEQ ID NO: 2993217 - RNA, 15 nt, Human
aauaaacgucuuaaa

SEQ ID NO: 2993218 - RNA, 17 nt, Human
aaguucugcagauaaac

SEQ ID NO: 2993219 - RNA, 22 nt, Human
aaguugauaugccuuuucccaa

SEQ ID NO: 2993220 - RNA, 13 nt, Human
aagugcugcauuu

SEQ ID NO: 2993221 - RNA, 19 nt, Human
aaguauagaaaaucuucau

SEQ ID NO: 2993222 - RNA, 18 nt, Human
aaguauagaaaaucuuca

SEQ ID NO: 2993223 - RNA, 16 nt, Human
aaguauagaaaaucuu

SEQ ID NO: 2993224 - RNA, 12 nt, Human
aaguauagaaaa

SEQ ID NO: 2993225 - RNA, 14 nt, Human
aauaauguuucaaa

SEQ ID NO: 2993226 - RNA, 12 nt, Human
aauaauguuuca

SEQ ID NO: 2993227 - RNA, 15 nt, Human
aaucaaauaugcaaa

SEQ ID NO: 2993228 - RNA, 16 nt, Human
aaucaaauaugcaaag

SEQ ID NO: 2993229 - RNA, 22 nt, Human
aaucaaauaugcaaagcacuga

SEQ ID NO: 2993230 - RNA, 22 nt, Human
aaucauuucugcaucagcugcu

SEQ ID NO: 2993231 - RNA, 14 nt, Human
aaugauaacuggaa

SEQ ID NO: 2993232 - RNA, 16 nt, Human
aaugauaacuggaaac

SEQ ID NO: 2993233 - RNA, 15 nt, Human
aaugauaacuggaaa

SEQ ID NO: 2993234 - RNA, 12 nt, Human
aaugauuaauua

SEQ ID NO: 2993235 - RNA, 13 nt, Human
aaugauuaauuaa

SEQ ID NO: 2993236 - RNA, 15 nt, Human
aaugauagcuacugu

SEQ ID NO: 2993237 - RNA, 17 nt, Human
aauccauacauuugugu

SEQ ID NO: 2993238 - RNA, 14 nt, Human
aauccauacauuug

SEQ ID NO: 2993239 - RNA, 16 nt, Human
aauccauacauuugug

SEQ ID NO: 2993240 - RNA, 15 nt, Human
aauccaaugaaauga

SEQ ID NO: 2993241 - RNA, 18 nt, Human
aaucuccaaaauaaaacu

SEQ ID NO: 2993242 - RNA, 17 nt, Human
aaugggggugcauuuga

SEQ ID NO: 2993243 - RNA, 15 nt, Human
aaugggggugcauuu

SEQ ID NO: 2993244 - RNA, 15 nt, Human
aaugucacaggcagg

SEQ ID NO: 2993245 - RNA, 23 nt, Human
aaugcucuuuacuucauggacuu

SEQ ID NO: 2993246 - RNA, 14 nt, Human
aaugggagcucaug

SEQ ID NO: 2993247 - RNA, 13 nt, Human
aaugggacacuaa

SEQ ID NO: 2993248 - RNA, 23 nt, Human
aaugcgugcauaccacuuuuguu

SEQ ID NO: 2993249 - RNA, 21 nt, Human
aaugcgugcauaccacuuuug

SEQ ID NO: 2993250 - RNA, 10 nt, Human
aagcagagug

SEQ ID NO: 2993251 - RNA, 14 nt, Human
aagcagaaugugau

SEQ ID NO: 2993252 - RNA, 21 nt, Human
aagcagaggaaggagaggaga

SEQ ID NO: 2993253 - RNA, 14 nt, Human
aagcagaguggcag

SEQ ID NO: 2993254 - RNA, 11 nt, Human
aagcagagugg

SEQ ID NO: 2993255 - RNA, 15 nt, Human
aagcagggacuugaa

SEQ ID NO: 2993256 - RNA, 20 nt, Human
aagcagaguggcagucuuca

SEQ ID NO: 2993257 - RNA, 19 nt, Human
aagccaccaacauacuccc

SEQ ID NO: 2993258 - RNA, 19 nt, Human
aagauuuugaaauuuuuau

SEQ ID NO: 2993259 - RNA, 19 nt, Human
aagauucuauguuaauauu

SEQ ID NO: 2993260 - RNA, 21 nt, Human
aagauucuauguuaauauuuu

SEQ ID NO: 2993261 - RNA, 22 nt, Human
aagauucuauguuaauauuuua

SEQ ID NO: 2993262 - RNA, 21 nt, Human
aagauucaaugccccugaauu

SEQ ID NO: 2993263 - RNA, 20 nt, Human
aagauucaaugccccugaau

SEQ ID NO: 2993264 - RNA, 20 nt, Human
aagauucauauuuacuucuu

SEQ ID NO: 2993265 - RNA, 20 nt, Human
aagauacugaaauaaacguc

SEQ ID NO: 2993266 - RNA, 16 nt, Human
aagauacugaaauaaa

SEQ ID NO: 2993267 - RNA, 14 nt, Human
aagauacugaaaua

SEQ ID NO: 2993268 - RNA, 15 nt, Human
aagacuuugguuauu

SEQ ID NO: 2993269 - RNA, 13 nt, Human
aagacuuugguua

SEQ ID NO: 2993270 - RNA, 23 nt, Human
aagacuuugguuauuuuacuuuu

SEQ ID NO: 2993271 - RNA, 17 nt, Human
aagacuuugguuauuuu

SEQ ID NO: 2993272 - RNA, 15 nt, Human
aagagaacuuccaga

SEQ ID NO: 2993273 - RNA, 13 nt, Human
aacuguuuagaug

SEQ ID NO: 2993274 - RNA, 23 nt, Human
aagacagugaaagaaaauaacaa

SEQ ID NO: 2993275 - RNA, 16 nt, Human
aagacuuuggaaagag

SEQ ID NO: 2993276 - RNA, 16 nt, Human
aaggaaugcaaagaug

SEQ ID NO: 2993277 - RNA, 15 nt, Human
aaggaaugcaaagau

SEQ ID NO: 2993278 - RNA, 23 nt, Human
aaggaaugauuaauuaaaacaca

SEQ ID NO: 2993279 - RNA, 16 nt, Human
aagcugcugacagugu

SEQ ID NO: 2993280 - RNA, 11 nt, Human
aagcugccagc

SEQ ID NO: 2993281 - RNA, 12 nt, Human
aagcugccagcc

SEQ ID NO: 2993282 - RNA, 22 nt, Human
aagcugccagccgagauagcca

SEQ ID NO: 2993283 - RNA, 14 nt, Human
aagcugcugacagu

SEQ ID NO: 2993284 - RNA, 20 nt, Human
aagcgugagccacugcaccg

SEQ ID NO: 2993285 - RNA, 17 nt, Human
aagcgugagccacugca

SEQ ID NO: 2993286 - RNA, 21 nt, Human
aagcgugagccacugcaccgg

SEQ ID NO: 2993287 - RNA, 19 nt, Human
aagccagauuuuccugaaa

SEQ ID NO: 2993288 - RNA, 21 nt, Human
aagccaccaacauacucccau

SEQ ID NO: 2993289 - RNA, 18 nt, Human
aagccagcaggcucucag

SEQ ID NO: 2993290 - RNA, 15 nt, Human
aagccagcaggcucu

SEQ ID NO: 2993291 - RNA, 16 nt, Human
aagcgauucuucugcu

SEQ ID NO: 2993292 - RNA, 16 nt, Human
aagcgugagccacugc

SEQ ID NO: 2993293 - RNA, 14 nt, Human
aagcgauucuucug

SEQ ID NO: 2993294 - RNA, 15 nt, Human
aagcgauucuucugc

SEQ ID NO: 2993295 - RNA, 23 nt, Human
aaggucuguuuuguguacuuuua

SEQ ID NO: 2993296 - RNA, 20 nt, Human
aaggucuguuuuguguacuu

SEQ ID NO: 2993297 - RNA, 19 nt, Human
aaggucuguuuuguguacu

SEQ ID NO: 2993298 - RNA, 12 nt, Human
aaguagaggagg

SEQ ID NO: 2993299 - RNA, 21 nt, Human
aagggauuuucagcccucaga

SEQ ID NO: 2993300 - RNA, 23 nt, Human
aagggauuuucagcccucagaau

SEQ ID NO: 2993301 - RNA, 15 nt, Human
aagggauuuucagcc

SEQ ID NO: 2993302 - RNA, 14 nt, Human
aagggauggcaaga

SEQ ID NO: 2993303 - RNA, 17 nt, Human
aagggauggcaagaugu

SEQ ID NO: 2993304 - RNA, 18 nt, Human
aagggacgcuacccggga

SEQ ID NO: 2993305 - RNA, 20 nt, Human
aagggacuuggaagcuccgc

SEQ ID NO: 2993306 - RNA, 17 nt, Human
agaugaaggucuguuuu

SEQ ID NO: 2993307 - RNA, 14 nt, Human
agaugaaggucugu

SEQ ID NO: 2993308 - RNA, 16 nt, Human
agaguggaauaagaca

SEQ ID NO: 2993309 - RNA, 22 nt, Human
agauucuuguauuuauuacaac

SEQ ID NO: 2993310 - RNA, 21 nt, Human
agauucuauguuaauauuuua

SEQ ID NO: 2993311 - RNA, 16 nt, Human
agauguagaggagaaa

SEQ ID NO: 2993312 - RNA, 19 nt, Human
agauguagaggagaaacug

SEQ ID NO: 2993313 - RNA, 14 nt, Human
agaugagugagcau

SEQ ID NO: 2993314 - RNA, 20 nt, Human
agcaaaggagauuggaagga

SEQ ID NO: 2993315 - RNA, 21 nt, Human
agauugcaacaggcugggcuu

SEQ ID NO: 2993316 - RNA, 20 nt, Human
agauugcaacaggcugggcu

SEQ ID NO: 2993317 - RNA, 23 nt, Human
agauugcaacaggcugggcuuca

SEQ ID NO: 2993318 - RNA, 19 nt, Human
agauugcaacaggcugggc

SEQ ID NO: 2993319 - RNA, 19 nt, Human
agauucuuuccugaggcug

SEQ ID NO: 2993320 - RNA, 21 nt, Human
agauucuuuccugaggcuggg

SEQ ID NO: 2993321 - RNA, 18 nt, Human
agauucuuuccugaggcu

SEQ ID NO: 2993322 - RNA, 24 nt, Human
agcaaaauuuuuucucuaggaaau

SEQ ID NO: 2993323 - RNA, 18 nt, Human
agcaaaagaugcuucuca

SEQ ID NO: 2993324 - RNA, 23 nt, Human
agcaaaauuuuuucucuaggaaa

SEQ ID NO: 2993325 - RNA, 21 nt, Human
agcacgauuucuguuuagaua

SEQ ID NO: 2993326 - RNA, 19 nt, Human
agcacgauuucuguuuaga

SEQ ID NO: 2993327 - RNA, 17 nt, Human
agcacgauuucuguuua

SEQ ID NO: 2993328 - RNA, 16 nt, Human
agcacagacccugccc

SEQ ID NO: 2993329 - RNA, 14 nt, Human
agcacagacccugc

SEQ ID NO: 2993330 - RNA, 15 nt, Human
agcacagacccugcc

SEQ ID NO: 2993331 - RNA, 12 nt, Human
agcacagacccu

SEQ ID NO: 2993332 - RNA, 15 nt, Human
agcaauuaugaaaau

SEQ ID NO: 2993333 - RNA, 17 nt, Human
agcaauuaugaaaauaa

SEQ ID NO: 2993334 - RNA, 19 nt, Human
agccccauucugccugccc

SEQ ID NO: 2993335 - RNA, 18 nt, Human
agccccauucugccugcc

SEQ ID NO: 2993336 - RNA, 17 nt, Human
agccccauucugccugc

SEQ ID NO: 2993337 - RNA, 17 nt, Human
agccccauccucuguac

SEQ ID NO: 2993338 - RNA, 23 nt, Human
agccccauccucuguacagagcc

SEQ ID NO: 2993339 - RNA, 15 nt, Human
agccccauccucugu

SEQ ID NO: 2993340 - RNA, 17 nt, Human
agcccgggcucugccuc

SEQ ID NO: 2993341 - RNA, 18 nt, Human
agcccgggcucugccucc

SEQ ID NO: 2993342 - RNA, 20 nt, Human
agcccgggcucugccuccca

SEQ ID NO: 2993343 - RNA, 21 nt, Human
agcccgggcucugccucccau

SEQ ID NO: 2993344 - RNA, 13 nt, Human
agccccacagccc

SEQ ID NO: 2993345 - RNA, 13 nt, Human
agcauccuggcac

SEQ ID NO: 2993346 - RNA, 16 nt, Human
agccagcaggcucuca

SEQ ID NO: 2993347 - RNA, 15 nt, Human
agcccaccccucaac

SEQ ID NO: 2993348 - RNA, 14 nt, Human
agcccaccuuggcu

SEQ ID NO: 2993349 - RNA, 16 nt, Human
agcccaccuuggcuca

SEQ ID NO: 2993350 - RNA, 14 nt, Human
agcccacgccccca

SEQ ID NO: 2993351 - RNA, 20 nt, Human
agcccacgcccccacuggug

SEQ ID NO: 2993352 - RNA, 23 nt, Human
agcccacgcccccacuggugaca

SEQ ID NO: 2993353 - RNA, 17 nt, Human
agccagaggagagagga

SEQ ID NO: 2993354 - RNA, 18 nt, Human
agccagaggagagaggac

SEQ ID NO: 2993355 - RNA, 14 nt, Human
agccagcaggcucu

SEQ ID NO: 2993356 - RNA, 13 nt, Human
agccagaggagag

SEQ ID NO: 2993357 - RNA, 15 nt, Human
agccagaggagagag

SEQ ID NO: 2993358 - RNA, 17 nt, Human
agcauccuggcacccgg

SEQ ID NO: 2993359 - RNA, 14 nt, Human
agcauccuggcacc

SEQ ID NO: 2993360 - RNA, 16 nt, Human
agccaaagcuaggccu

SEQ ID NO: 2993361 - RNA, 16 nt, Human
agacuggauaguccgu

SEQ ID NO: 2993362 - RNA, 16 nt, Human
agagagaccacuuuuc

SEQ ID NO: 2993363 - RNA, 13 nt, Human
agagccagggucu

SEQ ID NO: 2993364 - RNA, 13 nt, Human
agagcccaccuug

SEQ ID NO: 2993365 - RNA, 16 nt, Human
agacgcugugcugccc

SEQ ID NO: 2993366 - RNA, 20 nt, Human
agacugaguacguugugcau

SEQ ID NO: 2993367 - RNA, 18 nt, Human
agacucugucucagucca

SEQ ID NO: 2993368 - RNA, 22 nt, Human
agacugaguacguugugcauuu

SEQ ID NO: 2993369 - RNA, 13 nt, Human
agacucugucuca

SEQ ID NO: 2993370 - RNA, 18 nt, Human
agacucugucucaaaaaa

SEQ ID NO: 2993371 - RNA, 13 nt, Human
agaggaaugaagu

SEQ ID NO: 2993372 - RNA, 13 nt, Human
agagggccugcaa

SEQ ID NO: 2993373 - RNA, 16 nt, Human
agagggccugcaaggg

SEQ ID NO: 2993374 - RNA, 17 nt, Human
agaggggguggccuccc

SEQ ID NO: 2993375 - RNA, 19 nt, Human
agaggggguggccucccaa

SEQ ID NO: 2993376 - RNA, 22 nt, Human
agaggacuuuucuuuguggcuu

SEQ ID NO: 2993377 - RNA, 21 nt, Human
agaggacuuuucuuuguggcu

SEQ ID NO: 2993378 - RNA, 14 nt, Human
agaggacuuuucuu

SEQ ID NO: 2993379 - RNA, 21 nt, Human
agaagucuucuauuuauuuau

SEQ ID NO: 2993380 - RNA, 21 nt, Human
agaagugaaaaucuacacucc

SEQ ID NO: 2993381 - RNA, 22 nt, Human
agaagucacauuccugaacagg

SEQ ID NO: 2993382 - RNA, 18 nt, Human
agaaugaaagggcccaga

SEQ ID NO: 2993383 - RNA, 16 nt, Human
agaaugaaagggccca

SEQ ID NO: 2993384 - RNA, 19 nt, Human
agaaugcacaaacagaggc

SEQ ID NO: 2993385 - RNA, 22 nt, Human
agaaugcacaaacagaggccgc

SEQ ID NO: 2993386 - RNA, 17 nt, Human
agaaugauuaugaauua

SEQ ID NO: 2993387 - RNA, 22 nt, Human
agaaugagagacacacugaaga

SEQ ID NO: 2993388 - RNA, 17 nt, Human
agaaugagagacacacu

SEQ ID NO: 2993389 - RNA, 14 nt, Human
agaaguaacuuacu

SEQ ID NO: 2993390 - RNA, 18 nt, Human
agaagucacauuccugaa

SEQ ID NO: 2993391 - RNA, 21 nt, Human
agaagucacauuccugaacag

SEQ ID NO: 2993392 - RNA, 20 nt, Human
agaagucacauuccugaaca

SEQ ID NO: 2993393 - RNA, 21 nt, Human
agaagacacugaugggcaacc

SEQ ID NO: 2993394 - RNA, 13 nt, Human
agaagacacugau

SEQ ID NO: 2993395 - RNA, 21 nt, Human
acuuuccucuuuggucuacac

SEQ ID NO: 2993396 - RNA, 22 nt, Human
agaagagcuguucacagccaga

SEQ ID NO: 2993397 - RNA, 21 nt, Human
agaagagcuguucacagccag

SEQ ID NO: 2993398 - RNA, 21 nt, Human
agaagagauugugguuucauu

SEQ ID NO: 2993399 - RNA, 19 nt, Human
agacccaaaaggcagaagc

SEQ ID NO: 2993400 - RNA, 17 nt, Human
agacccaaaaggcagaa

SEQ ID NO: 2993401 - RNA, 15 nt, Human
agaccacguuucuaa

SEQ ID NO: 2993402 - RNA, 22 nt, Human
agacagauacuccuccaagguu

SEQ ID NO: 2993403 - RNA, 21 nt, Human
agacagagucucacuguugcc

SEQ ID NO: 2993404 - RNA, 22 nt, Human
agacaaugacuuacuguacaug

SEQ ID NO: 2993405 - RNA, 21 nt, Human
agacaaugacuuacuguacau

SEQ ID NO: 2993406 - RNA, 15 nt, Human
agacagagcuacaca

SEQ ID NO: 2993407 - RNA, 20 nt, Human
agacagagucucacuguugc

SEQ ID NO: 2993408 - RNA, 19 nt, Human
agacagagucucacuguug

SEQ ID NO: 2993409 - RNA, 13 nt, Human
agacagagcuaca

SEQ ID NO: 2993410 - RNA, 11 nt, Human
agacagagucu

SEQ ID NO: 2993411 - RNA, 20 nt, Human
agacaaugacuuacuguaca

SEQ ID NO: 2993412 - RNA, 24 nt, Human
aggcuuagacccucaugcugccaa

SEQ ID NO: 2993413 - RNA, 17 nt, Human
aggcuuagucacugaga

SEQ ID NO: 2993414 - RNA, 23 nt, Human
aggcuuagacccucaugcugcca

SEQ ID NO: 2993415 - RNA, 22 nt, Human
aggcuguaucccaugagccuca

SEQ ID NO: 2993416 - RNA, 21 nt, Human
aggcuguaucccaugagccuc

SEQ ID NO: 2993417 - RNA, 20 nt, Human
aggcuguaucccaugagccu

SEQ ID NO: 2993418 - RNA, 15 nt, Human
agggacccuccacca

SEQ ID NO: 2993419 - RNA, 15 nt, Human
agggacugaggggag

SEQ ID NO: 2993420 - RNA, 18 nt, Human
aggcuuagucacugagac

SEQ ID NO: 2993421 - RNA, 15 nt, Human
aggcuaccuuuguau

SEQ ID NO: 2993422 - RNA, 14 nt, Human
aggcuaccuuugua

SEQ ID NO: 2993423 - RNA, 13 nt, Human
aggcuaccuuugu

SEQ ID NO: 2993424 - RNA, 18 nt, Human
aggcuggguucugauccu

SEQ ID NO: 2993425 - RNA, 16 nt, Human
aggcugaggcgggugg

SEQ ID NO: 2993426 - RNA, 18 nt, Human
aggcugaggcaggagacu

SEQ ID NO: 2993427 - RNA, 16 nt, Human
aggcugaggcaggaga

SEQ ID NO: 2993428 - RNA, 22 nt, Human
aggcccucugcccacucccugc

SEQ ID NO: 2993429 - RNA, 23 nt, Human
aggcccucugcccacucccugca

SEQ ID NO: 2993430 - RNA, 21 nt, Human
aggcccucugcccacucccug

SEQ ID NO: 2993431 - RNA, 21 nt, Human
aggccaugggcacugugggua

SEQ ID NO: 2993432 - RNA, 15 nt, Human
aggcccuucucucca

SEQ ID NO: 2993433 - RNA, 19 nt, Human
aggcccuucucuccagccc

SEQ ID NO: 2993434 - RNA, 12 nt, Human
aggcccuucucu

SEQ ID NO: 2993435 - RNA, 19 nt, Human
aggcauuccccaggaggcc

SEQ ID NO: 2993436 - RNA, 20 nt, Human
aggcauuccccaggaggcca

SEQ ID NO: 2993437 - RNA, 23 nt, Human
aggccagcugcuugggcuucauc

SEQ ID NO: 2993438 - RNA, 13 nt, Human
aggccaggcccuc

SEQ ID NO: 2993439 - RNA, 14 nt, Human
aggccaggcccucu

SEQ ID NO: 2993440 - RNA, 15 nt, Human
aggccaggcccucug

SEQ ID NO: 2993441 - RNA, 18 nt, Human
aggcauuccccaggaggc

SEQ ID NO: 2993442 - RNA, 17 nt, Human
aggcauuccccaggagg

SEQ ID NO: 2993443 - RNA, 12 nt, Human
aggcauguucuc

SEQ ID NO: 2993444 - RNA, 19 nt, Human
aggcauguucucugaggac

SEQ ID NO: 2993445 - RNA, 18 nt, Human
aggcauguucucugagga

SEQ ID NO: 2993446 - RNA, 19 nt, Human
aggcaugugaugagaggaa

SEQ ID NO: 2993447 - RNA, 20 nt, Human
aggcaugugaugagaggaaa

SEQ ID NO: 2993448 - RNA, 21 nt, Human
aggcaugugaugagaggaaau

SEQ ID NO: 2993449 - RNA, 17 nt, Human
aggcauguucucugagg

SEQ ID NO: 2993450 - RNA, 17 nt, Human
aggcaugugaugagagg

SEQ ID NO: 2993451 - RNA, 15 nt, Human
aggcaugguggccca

SEQ ID NO: 2993452 - RNA, 15 nt, Human
aggcagcagacacau

SEQ ID NO: 2993453 - RNA, 18 nt, Human
aggcauggacuucuggau

SEQ ID NO: 2993454 - RNA, 17 nt, Human
agggauuuucagcccuc

SEQ ID NO: 2993455 - RNA, 22 nt, Human
agggauuuucagcccucagaau

SEQ ID NO: 2993456 - RNA, 15 nt, Human
agggauuagggagag

SEQ ID NO: 2993457 - RNA, 12 nt, Human
agggccuggccu

SEQ ID NO: 2993458 - RNA, 13 nt, Human
agggccuggccug

SEQ ID NO: 2993459 - RNA, 15 nt, Human
agggccugcaaggga

SEQ ID NO: 2993460 - RNA, 14 nt, Human
agggccugcaaggg

SEQ ID NO: 2993461 - RNA, 16 nt, Human
agggauacccauccca

SEQ ID NO: 2993462 - RNA, 16 nt, Human
agggucccugguggca

SEQ ID NO: 2993463 - RNA, 17 nt, Human
agggucccugguggcag

SEQ ID NO: 2993464 - RNA, 20 nt, Human
agggucccugguggcagcuc

SEQ ID NO: 2993465 - RNA, 22 nt, Human
agggucccugguggcagcucac

SEQ ID NO: 2993466 - RNA, 12 nt, Human
agggucccuggu

SEQ ID NO: 2993467 - RNA, 14 nt, Human
agggucccuggugg

SEQ ID NO: 2993468 - RNA, 13 nt, Human
aggguauuccaga

SEQ ID NO: 2993469 - RNA, 21 nt, Human
aggguaucuggugacuuuccu

SEQ ID NO: 2993470 - RNA, 14 nt, Human
agggccuggccuga

SEQ ID NO: 2993471 - RNA, 22 nt, Human
aggggcccaaauucuuucagug

SEQ ID NO: 2993472 - RNA, 14 nt, Human
agguaacaggcaga

SEQ ID NO: 2993473 - RNA, 13 nt, Human
agguaacaggcag

SEQ ID NO: 2993474 - RNA, 16 nt, Human
agguaacaggcagaua

SEQ ID NO: 2993475 - RNA, 22 nt, Human
agguacgaaaagaggggaagag

SEQ ID NO: 2993476 - RNA, 14 nt, Human
agguacucuccugg

SEQ ID NO: 2993477 - RNA, 13 nt, Human
agguacucuccug

SEQ ID NO: 2993478 - RNA, 23 nt, Human
aggguuuugccauguuggccagg

SEQ ID NO: 2993479 - RNA, 22 nt, Human
aggguuuugccauguuggccag

SEQ ID NO: 2993480 - RNA, 20 nt, Human
agcuuauuuccucauuuuua

SEQ ID NO: 2993481 - RNA, 18 nt, Human
agcuucauuuccuguguc

SEQ ID NO: 2993482 - RNA, 19 nt, Human
agcuucauuuccugugucu

SEQ ID NO: 2993483 - RNA, 22 nt, Human
agcuuuguuuguugucagcuga

SEQ ID NO: 2993484 - RNA, 23 nt, Human
agcuuuguuuguugucagcugaa

SEQ ID NO: 2993485 - RNA, 13 nt, Human
aggaaguagagga

SEQ ID NO: 2993486 - RNA, 15 nt, Human
aggaauaccuguccc

SEQ ID NO: 2993487 - RNA, 18 nt, Human
aggaauaccugucccccu

SEQ ID NO: 2993488 - RNA, 22 nt, Human
aggaauaccugucccccugaca

SEQ ID NO: 2993489 - RNA, 13 nt, Human
aggaacaaggcaa

SEQ ID NO: 2993490 - RNA, 16 nt, Human
aggaacaaggcaaggc

SEQ ID NO: 2993491 - RNA, 17 nt, Human
aggaacaaggcaaggcu

SEQ ID NO: 2993492 - RNA, 19 nt, Human
aggaacaaggcaaggcugu

SEQ ID NO: 2993493 - RNA, 12 nt, Human
aggaacaaggca

SEQ ID NO: 2993494 - RNA, 23 nt, Human
aggaaccgagggggcugcuccca

SEQ ID NO: 2993495 - RNA, 21 nt, Human
aggaacuuaaauaaugugaaa

SEQ ID NO: 2993496 - RNA, 20 nt, Human
aggaacaaggcaaggcuguc

SEQ ID NO: 2993497 - RNA, 15 nt, Human
aggagaggagagggg

SEQ ID NO: 2993498 - RNA, 16 nt, Human
aggacccgucuccagc

SEQ ID NO: 2993499 - RNA, 17 nt, Human
agcgacagugagacucu

SEQ ID NO: 2993500 - RNA, 13 nt, Human
agcgagcccuggu

SEQ ID NO: 2993501 - RNA, 19 nt, Human
agcgagcccugguggcagu

SEQ ID NO: 2993502 - RNA, 12 nt, Human
agccugggaggu

SEQ ID NO: 2993503 - RNA, 16 nt, Human
agcucaccagccccag

SEQ ID NO: 2993504 - RNA, 15 nt, Human
agcucaccucucccu

SEQ ID NO: 2993505 - RNA, 18 nt, Human
agcucaccucucccuugg

SEQ ID NO: 2993506 - RNA, 19 nt, Human
agcucaccucucccuugga

SEQ ID NO: 2993507 - RNA, 12 nt, Human
agcucaccucuc

SEQ ID NO: 2993508 - RNA, 15 nt, Human
agcucaccagcccca

SEQ ID NO: 2993509 - RNA, 20 nt, Human
agcucaccagccccagugcc

SEQ ID NO: 2993510 - RNA, 19 nt, Human
agcucaccagccccagugc

SEQ ID NO: 2993511 - RNA, 18 nt, Human
agcucagagaggguggga

SEQ ID NO: 2993512 - RNA, 14 nt, Human
agcucagagagggu

SEQ ID NO: 2993513 - RNA, 12 nt, Human
agcucagagagg

SEQ ID NO: 2993514 - RNA, 18 nt, Human
agcugcgguccacccagg

SEQ ID NO: 2993515 - RNA, 17 nt, Human
agcugcgguccacccag

SEQ ID NO: 2993516 - RNA, 16 nt, Human
agcugcgguccaccca

SEQ ID NO: 2993517 - RNA, 13 nt, Human
agcugcgguccac

SEQ ID NO: 2993518 - RNA, 20 nt, Human
agcugcgguccacccaggag

SEQ ID NO: 2993519 - RNA, 19 nt, Human
agcugcgguccacccagga

SEQ ID NO: 2993520 - RNA, 12 nt, Human
agcugcugacag

SEQ ID NO: 2993521 - RNA, 17 nt, Human
agcuggucccacucagu

SEQ ID NO: 2993522 - RNA, 16 nt, Human
agcuggucccacucag

SEQ ID NO: 2993523 - RNA, 14 nt, Human
agcugcugacagug

SEQ ID NO: 2993524 - RNA, 13 nt, Human
agcugcugacagu

SEQ ID NO: 2993525 - RNA, 18 nt, Human
agcuggucccacucaguc

SEQ ID NO: 2993526 - RNA, 19 nt, Human
agcugcugagauccuggac

SEQ ID NO: 2993527 - RNA, 16 nt, Human
agcugguugagguuuc

SEQ ID NO: 2993528 - RNA, 22 nt, Human
agcugguuuuuagcggagacgg

SEQ ID NO: 2993529 - RNA, 17 nt, Human
agcuccccucggagaag

SEQ ID NO: 2993530 - RNA, 19 nt, Human
agcuccccucggagaagag

SEQ ID NO: 2993531 - RNA, 20 nt, Human
agcuccccucggagaagagc

SEQ ID NO: 2993532 - RNA, 15 nt, Human
agcugaaccugggua

SEQ ID NO: 2993533 - RNA, 14 nt, Human
augacuguuuuuaa

SEQ ID NO: 2993534 - RNA, 22 nt, Human
augaggcauuuguuugaacuga

SEQ ID NO: 2993535 - RNA, 21 nt, Human
augaggcauuuguuugaacug

SEQ ID NO: 2993536 - RNA, 14 nt, Human
augaggcauuuguu

SEQ ID NO: 2993537 - RNA, 13 nt, Human
augaggcauuugu

SEQ ID NO: 2993538 - RNA, 16 nt, Human
augagggagaugccau

SEQ ID NO: 2993539 - RNA, 17 nt, Human
augagggagaugccaug

SEQ ID NO: 2993540 - RNA, 21 nt, Human
augaaguacucauacauguua

SEQ ID NO: 2993541 - RNA, 13 nt, Human
augaaguacucau

SEQ ID NO: 2993542 - RNA, 23 nt, Human
augaaguccaagcauuuagaugu

SEQ ID NO: 2993543 - RNA, 20 nt, Human
augaaguccaagcauuuaga

SEQ ID NO: 2993544 - RNA, 16 nt, Human
augaaaacacauuuuu

SEQ ID NO: 2993545 - RNA, 15 nt, Human
augaaaacacauuuu

SEQ ID NO: 2993546 - RNA, 14 nt, Human
augaaaacacauuu

SEQ ID NO: 2993547 - RNA, 21 nt, Human
aucuaguaguuguucugaaau

SEQ ID NO: 2993548 - RNA, 15 nt, Human
aucuaguaguuguuc

SEQ ID NO: 2993549 - RNA, 12 nt, Human
aucuaguaguug

SEQ ID NO: 2993550 - RNA, 20 nt, Human
aucuccgucaacucauauuu

SEQ ID NO: 2993551 - RNA, 23 nt, Human
aucucugauucccugauuuaaua

SEQ ID NO: 2993552 - RNA, 17 nt, Human
aucgcuccaccuugcag

SEQ ID NO: 2993553 - RNA, 21 nt, Human
aucgcuccaccuugcagcucu

SEQ ID NO: 2993554 - RNA, 17 nt, Human
auccucauacccacccc

SEQ ID NO: 2993555 - RNA, 19 nt, Human
auccucaguuuuugugaaa

SEQ ID NO: 2993556 - RNA, 19 nt, Human
aucccaugagccucagcau

SEQ ID NO: 2993557 - RNA, 19 nt, Human
auccagacccggcugcgug

SEQ ID NO: 2993558 - RNA, 14 nt, Human
aucaaauaugcaaa

SEQ ID NO: 2993559 - RNA, 13 nt, Human
aucacagccucug

SEQ ID NO: 2993560 - RNA, 13 nt, Human
aucaccagacagg

SEQ ID NO: 2993561 - RNA, 20 nt, Human
aucaccaacgucugugccau

SEQ ID NO: 2993562 - RNA, 20 nt, Human
aucaaagagguuuuaaaaaa

SEQ ID NO: 2993563 - RNA, 23 nt, Human
aucaaagagguuuuaaaaaaauc

SEQ ID NO: 2993564 - RNA, 24 nt, Human
aucaaaagguuaauaaaguaauua

SEQ ID NO: 2993565 - RNA, 17 nt, Human
aucaugaauuaguuuua

SEQ ID NO: 2993566 - RNA, 14 nt, Human
aucaugucuggcua

SEQ ID NO: 2993567 - RNA, 16 nt, Human
aucaugucagucugcu

SEQ ID NO: 2993568 - RNA, 22 nt, Human
aucagcuugcccuguuaaaaga

SEQ ID NO: 2993569 - RNA, 13 nt, Human
aucagcuuauugu

SEQ ID NO: 2993570 - RNA, 18 nt, Human
auggauaaauauugguug

SEQ ID NO: 2993571 - RNA, 18 nt, Human
auggcuggagcuagaauu

SEQ ID NO: 2993572 - RNA, 15 nt, Human
augcuuguacauaau

SEQ ID NO: 2993573 - RNA, 16 nt, Human
augcuuguacauaaug

SEQ ID NO: 2993574 - RNA, 17 nt, Human
auggcuuuugugcauua

SEQ ID NO: 2993575 - RNA, 16 nt, Human
auggcuuuugugcauu

SEQ ID NO: 2993576 - RNA, 18 nt, Human
auggcuuuugugcauuau

SEQ ID NO: 2993577 - RNA, 13 nt, Human
augcugcccugug

SEQ ID NO: 2993578 - RNA, 12 nt, Human
augcugcccugu

SEQ ID NO: 2993579 - RNA, 14 nt, Human
augcugcccuguga

SEQ ID NO: 2993580 - RNA, 15 nt, Human
augcugcccugugag

SEQ ID NO: 2993581 - RNA, 16 nt, Human
augcugcccugugagu

SEQ ID NO: 2993582 - RNA, 16 nt, Human
augaucuuuaaaauac

SEQ ID NO: 2993583 - RNA, 17 nt, Human
augaucuuugcagacag

SEQ ID NO: 2993584 - RNA, 21 nt, Human
augaucuuugcagacaggcaa

SEQ ID NO: 2993585 - RNA, 19 nt, Human
augaucuuugcagacaggc

SEQ ID NO: 2993586 - RNA, 18 nt, Human
augaucuuugcagacagg

SEQ ID NO: 2993587 - RNA, 15 nt, Human
augaugauccuaggc

SEQ ID NO: 2993588 - RNA, 18 nt, Human
augaugaucuuuaaaaua

SEQ ID NO: 2993589 - RNA, 21 nt, Human
augaugaucuuuaaaauacac

SEQ ID NO: 2993590 - RNA, 23 nt, Human
augaugaaaugaggucagagccu

SEQ ID NO: 2993591 - RNA, 18 nt, Human
augaugaaaugaggucag

SEQ ID NO: 2993592 - RNA, 18 nt, Human
augcacaaacagaggccg

SEQ ID NO: 2993593 - RNA, 19 nt, Human
augccuggauggggcugca

SEQ ID NO: 2993594 - RNA, 20 nt, Human
augccuggauggggcugcac

SEQ ID NO: 2993595 - RNA, 22 nt, Human
augcacagaguuguuacauuuu

SEQ ID NO: 2993596 - RNA, 21 nt, Human
augcacagaguuguuacauuu

SEQ ID NO: 2993597 - RNA, 19 nt, Human
augcacagaguuguuacau

SEQ ID NO: 2993598 - RNA, 14 nt, Human
augcacacauuuuu

SEQ ID NO: 2993599 - RNA, 13 nt, Human
augcacacauuuu

SEQ ID NO: 2993600 - RNA, 15 nt, Human
augcacacauuuuuu

SEQ ID NO: 2993601 - RNA, 15 nt, Human
augcacacacauaua

SEQ ID NO: 2993602 - RNA, 16 nt, Human
augcacacacauauau

SEQ ID NO: 2993603 - RNA, 21 nt, Human
augguaguuuuacaguguuuc

SEQ ID NO: 2993604 - RNA, 22 nt, Human
augguaguuuuacaguguuucu

SEQ ID NO: 2993605 - RNA, 15 nt, Human
augguaguuuuacag

SEQ ID NO: 2993606 - RNA, 16 nt, Human
auggucccaucugcag

SEQ ID NO: 2993607 - RNA, 23 nt, Human
augguagcauuuuaaacaaaaua

SEQ ID NO: 2993608 - RNA, 18 nt, Human
augguagcauuuuaaaca

SEQ ID NO: 2993609 - RNA, 13 nt, Human
augguagcauuuu

SEQ ID NO: 2993610 - RNA, 20 nt, Human
augggugcuuggaggaagga

SEQ ID NO: 2993611 - RNA, 21 nt, Human
augggugcuuggaggaaggaa

SEQ ID NO: 2993612 - RNA, 23 nt, Human
augggugcuuggaggaaggaaac

SEQ ID NO: 2993613 - RNA, 16 nt, Human
augucaaucagccuag

SEQ ID NO: 2993614 - RNA, 21 nt, Human
augucaaucagccuaguugau

SEQ ID NO: 2993615 - RNA, 13 nt, Human
augucacaggcag

SEQ ID NO: 2993616 - RNA, 23 nt, Human
auguaauuaaguacuauguauca

SEQ ID NO: 2993617 - RNA, 15 nt, Human
augugaacacaucag

SEQ ID NO: 2993618 - RNA, 19 nt, Human
augucacaggcagguccag

SEQ ID NO: 2993619 - RNA, 17 nt, Human
augucacaggcaggucc

SEQ ID NO: 2993620 - RNA, 19 nt, Human
auguguaagacaaaaagcu

SEQ ID NO: 2993621 - RNA, 17 nt, Human
auguguaagacaaaaag

SEQ ID NO: 2993622 - RNA, 13 nt, Human
auguguaaguauu

SEQ ID NO: 2993623 - RNA, 15 nt, Human
auguuccuagugaaa

SEQ ID NO: 2993624 - RNA, 16 nt, Human
auguuccuagugaaag

SEQ ID NO: 2993625 - RNA, 16 nt, Human
auguucucucuucucc

SEQ ID NO: 2993626 - RNA, 17 nt, Human
auguuccuagugaaaga

SEQ ID NO: 2993627 - RNA, 17 nt, Human
auguucucucuucucca

SEQ ID NO: 2993628 - RNA, 13 nt, Human
auguucucugagg

SEQ ID NO: 2993629 - RNA, 14 nt, Human
auguucugggacac

SEQ ID NO: 2993630 - RNA, 17 nt, Human
auguucucugaggacac

SEQ ID NO: 2993631 - RNA, 15 nt, Human
auguucugggacaca

SEQ ID NO: 2993632 - RNA, 17 nt, Human
auguuugccucugccuc

SEQ ID NO: 2993633 - RNA, 15 nt, Human
auguuugccucugcc

SEQ ID NO: 2993634 - RNA, 14 nt, Human
auguuugccucugc

SEQ ID NO: 2993635 - RNA, 16 nt, Human
aguacuaacauuuauu

SEQ ID NO: 2993636 - RNA, 18 nt, Human
aguacguugugcauuugg

SEQ ID NO: 2993637 - RNA, 17 nt, Human
aguacguugugcauuug

SEQ ID NO: 2993638 - RNA, 16 nt, Human
aguacguugugcauuu

SEQ ID NO: 2993639 - RNA, 19 nt, Human
aguacuacaguccucccau

SEQ ID NO: 2993640 - RNA, 22 nt, Human
aguacuacaguccucccaucuc

SEQ ID NO: 2993641 - RNA, 14 nt, Human
aguacuauaauuua

SEQ ID NO: 2993642 - RNA, 14 nt, Human
aguacuauguauca

SEQ ID NO: 2993643 - RNA, 12 nt, Human
aguacuauguau

SEQ ID NO: 2993644 - RNA, 22 nt, Human
aguacuucuccacccugcucuc

SEQ ID NO: 2993645 - RNA, 12 nt, Human
aguacuucuuuu

SEQ ID NO: 2993646 - RNA, 17 nt, Human
aguacuucuccacccug

SEQ ID NO: 2993647 - RNA, 15 nt, Human
aggucuguucuuucc

SEQ ID NO: 2993648 - RNA, 13 nt, Human
aggucuguucuuu

SEQ ID NO: 2993649 - RNA, 16 nt, Human
aggucuguucuuucca

SEQ ID NO: 2993650 - RNA, 14 nt, Human
aguacguugugcau

SEQ ID NO: 2993651 - RNA, 15 nt, Human
aguacguugugcauu

SEQ ID NO: 2993652 - RNA, 19 nt, Human
aguauuuuuuacauuuuac

SEQ ID NO: 2993653 - RNA, 18 nt, Human
aguauuuuuuacauuuua

SEQ ID NO: 2993654 - RNA, 15 nt, Human
aguauuuuuuacauu

SEQ ID NO: 2993655 - RNA, 22 nt, Human
aguauuuuuuacauuuuacaca

SEQ ID NO: 2993656 - RNA, 20 nt, Human
aguauuuuuuacauuuuaca

SEQ ID NO: 2993657 - RNA, 24 nt, Human
aguauuuuuuacauuuuacacacu

SEQ ID NO: 2993658 - RNA, 17 nt, Human
aguaugaggcauuuguu

SEQ ID NO: 2993659 - RNA, 14 nt, Human
aguauuuuguuuca

SEQ ID NO: 2993660 - RNA, 23 nt, Human
aguaugaggcauuuguuugaacu

SEQ ID NO: 2993661 - RNA, 17 nt, Human
aguauuuuguuucagug

SEQ ID NO: 2993662 - RNA, 21 nt, Human
aguaugaggcauuuguuugaa

SEQ ID NO: 2993663 - RNA, 20 nt, Human
aguaugaggcauuuguuuga

SEQ ID NO: 2993664 - RNA, 22 nt, Human
agucacacaguauuacuucugc

SEQ ID NO: 2993665 - RNA, 19 nt, Human
aguccucuuuucugagagg

SEQ ID NO: 2993666 - RNA, 20 nt, Human
aguccuuaccagcagagcac

SEQ ID NO: 2993667 - RNA, 22 nt, Human
aguccucuuuucugagaggacu

SEQ ID NO: 2993668 - RNA, 19 nt, Human
aguccuuaccagcagagca

SEQ ID NO: 2993669 - RNA, 17 nt, Human
agucugaaggcuggguu

SEQ ID NO: 2993670 - RNA, 16 nt, Human
agugaauguaggcugg

SEQ ID NO: 2993671 - RNA, 17 nt, Human
agugaauguaggcuggc

SEQ ID NO: 2993672 - RNA, 19 nt, Human
agugucaaugcagccccca

SEQ ID NO: 2993673 - RNA, 16 nt, Human
agugggagcugccugu

SEQ ID NO: 2993674 - RNA, 16 nt, Human
agugccuuauggaaca

SEQ ID NO: 2993675 - RNA, 10 nt, Human
agugccuuau

SEQ ID NO: 2993676 - RNA, 13 nt, Human
agugccuuaugga

SEQ ID NO: 2993677 - RNA, 14 nt, Human
agugccuuauggaa

SEQ ID NO: 2993678 - RNA, 15 nt, Human
agugccuuauggaac

SEQ ID NO: 2993679 - RNA, 24 nt, Human
agugauccucccaccucagccucc

SEQ ID NO: 2993680 - RNA, 23 nt, Human
agugauccucccaccucagccuc

SEQ ID NO: 2993681 - RNA, 18 nt, Human
agugauccucccaccuca

SEQ ID NO: 2993682 - RNA, 15 nt, Human
agugauccucccacc

SEQ ID NO: 2993683 - RNA, 14 nt, Human
agugauccucccac

SEQ ID NO: 2993684 - RNA, 17 nt, Human
agugauucuccugccuc

SEQ ID NO: 2993685 - RNA, 15 nt, Human
agugauucuccugcc

SEQ ID NO: 2993686 - RNA, 18 nt, Human
agugccuuacacaauggu

SEQ ID NO: 2993687 - RNA, 14 nt, Human
agugauucuccugc

SEQ ID NO: 2993688 - RNA, 19 nt, Human
aguucagagcugcccucuc

SEQ ID NO: 2993689 - RNA, 20 nt, Human
aguucagagcugcccucucc

SEQ ID NO: 2993690 - RNA, 22 nt, Human
aguucagagcugcccucuccug

SEQ ID NO: 2993691 - RNA, 21 nt, Human
aguucagagcugcccucuccu

SEQ ID NO: 2993692 - RNA, 23 nt, Human
aguucagagcugcccucuccugg

SEQ ID NO: 2993693 - RNA, 15 nt, Human
aguucaucuugaauu

SEQ ID NO: 2993694 - RNA, 19 nt, Human
aguucaucuugaauuguaa

SEQ ID NO: 2993695 - RNA, 13 nt, Human
aguucaucuugaa

SEQ ID NO: 2993696 - RNA, 19 nt, Human
aguugaaaagacuccaaag

SEQ ID NO: 2993697 - RNA, 20 nt, Human
aguugaaaagacuccaaaga

SEQ ID NO: 2993698 - RNA, 14 nt, Human
aguugaaaagacuc

SEQ ID NO: 2993699 - RNA, 18 nt, Human
aguugaaaagacuccaaa

SEQ ID NO: 2993700 - RNA, 16 nt, Human
aguugauacuacaguu

SEQ ID NO: 2993701 - RNA, 17 nt, Human
auauucauucuuuuuga

SEQ ID NO: 2993702 - RNA, 23 nt, Human
auauuucagauaaucacaauaca

SEQ ID NO: 2993703 - RNA, 14 nt, Human
auauuauguuaaaa

SEQ ID NO: 2993704 - RNA, 19 nt, Human
auauucaggaagcucaggg

SEQ ID NO: 2993705 - RNA, 17 nt, Human
auauucaggaagcucag

SEQ ID NO: 2993706 - RNA, 13 nt, Human
auauuauguuaaa

SEQ ID NO: 2993707 - RNA, 20 nt, Human
auaugcucugcauguuacau

SEQ ID NO: 2993708 - RNA, 17 nt, Human
auaugcucugcauguua

SEQ ID NO: 2993709 - RNA, 16 nt, Human
auaugcucugcauguu

SEQ ID NO: 2993710 - RNA, 22 nt, Human
auaugcacacauuuuuuaaaug

SEQ ID NO: 2993711 - RNA, 18 nt, Human
auauauuuuuuucugaaa

SEQ ID NO: 2993712 - RNA, 22 nt, Human
auauauuuuuuaaaauaagucu

SEQ ID NO: 2993713 - RNA, 18 nt, Human
auauauuuuuuaaaauaa

SEQ ID NO: 2993714 - RNA, 21 nt, Human
auagcagcccucaauugugaa

SEQ ID NO: 2993715 - RNA, 22 nt, Human
auagcagcccucaauugugaaa

SEQ ID NO: 2993716 - RNA, 15 nt, Human
auagcagcuuauuca

SEQ ID NO: 2993717 - RNA, 16 nt, Human
auagcauguccuaaug

SEQ ID NO: 2993718 - RNA, 19 nt, Human
auagcauguccuaaugcuu

SEQ ID NO: 2993719 - RNA, 17 nt, Human
auagcacagacccugcc

SEQ ID NO: 2993720 - RNA, 18 nt, Human
auagcacagacccugccc

SEQ ID NO: 2993721 - RNA, 15 nt, Human
auagcacagacccug

SEQ ID NO: 2993722 - RNA, 23 nt, Human
auagaaaguugcaaggcaaaugu

SEQ ID NO: 2993723 - RNA, 18 nt, Human
auagaaaguugcaaggca

SEQ ID NO: 2993724 - RNA, 17 nt, Human
auagaaaguugcaaggc

SEQ ID NO: 2993725 - RNA, 17 nt, Human
auagccuaggugacaga

SEQ ID NO: 2993726 - RNA, 15 nt, Human
auagccuaggugaca

SEQ ID NO: 2993727 - RNA, 18 nt, Human
auagguuuggacaaaaug

SEQ ID NO: 2993728 - RNA, 24 nt, Human
auagguuuggacaaaauggaauac

SEQ ID NO: 2993729 - RNA, 11 nt, Human
aguuuggccag

SEQ ID NO: 2993730 - RNA, 23 nt, Human
aguuugauuaaauucuugcaaag

SEQ ID NO: 2993731 - RNA, 20 nt, Human
aguuugagaucagccugggc

SEQ ID NO: 2993732 - RNA, 21 nt, Human
aguuugaauuccuaaaauuau

SEQ ID NO: 2993733 - RNA, 16 nt, Human
aguuugauuaaauucu

SEQ ID NO: 2993734 - RNA, 18 nt, Human
aguuugagaucagccugg

SEQ ID NO: 2993735 - RNA, 19 nt, Human
aguuugagaucagccuggg

SEQ ID NO: 2993736 - RNA, 22 nt, Human
aguuugauuaaauucuugcaaa

SEQ ID NO: 2993737 - RNA, 20 nt, Human
aguuugauuaaauucuugca

SEQ ID NO: 2993738 - RNA, 18 nt, Human
aguuugauuaaauucuug

SEQ ID NO: 2993739 - RNA, 17 nt, Human
aguuugauuaaauucuu

SEQ ID NO: 2993740 - RNA, 20 nt, Human
aguuguuacauuuuuaagug

SEQ ID NO: 2993741 - RNA, 19 nt, Human
aguuguuacauuuuuaagu

SEQ ID NO: 2993742 - RNA, 22 nt, Human
aguuguuacauuuuuaagugcu

SEQ ID NO: 2993743 - RNA, 20 nt, Human
auaacauguaauuaaguacu

SEQ ID NO: 2993744 - RNA, 18 nt, Human
auaacauguaauuaagua

SEQ ID NO: 2993745 - RNA, 13 nt, Human
auaacauguaauu

SEQ ID NO: 2993746 - RNA, 12 nt, Human
auaacauguaau

SEQ ID NO: 2993747 - RNA, 17 nt, Human
auaacaaugcuguauuu

SEQ ID NO: 2993748 - RNA, 15 nt, Human
auaacaaugcuguau

SEQ ID NO: 2993749 - RNA, 14 nt, Human
auaacaaugaaagu

SEQ ID NO: 2993750 - RNA, 20 nt, Human
auaacaaugcuguauuuuaa

SEQ ID NO: 2993751 - RNA, 19 nt, Human
auaacaaugcuguauuuua

SEQ ID NO: 2993752 - RNA, 21 nt, Human
auaacaaugcuguauuuuaaa

SEQ ID NO: 2993753 - RNA, 22 nt, Human
auacacuuacacuuuaugcaca

SEQ ID NO: 2993754 - RNA, 13 nt, Human
auacacuuacacu

SEQ ID NO: 2993755 - RNA, 17 nt, Human
auacaaugcugugcccu

SEQ ID NO: 2993756 - RNA, 14 nt, Human
auacaaugcugugc

SEQ ID NO: 2993757 - RNA, 18 nt, Human
auaauguuucaaacauau

SEQ ID NO: 2993758 - RNA, 17 nt, Human
auacccacccccaccca

SEQ ID NO: 2993759 - RNA, 13 nt, Human
auacagaaaaguu

SEQ ID NO: 2993760 - RNA, 17 nt, Human
auaccccaagacuccca

SEQ ID NO: 2993761 - RNA, 19 nt, Human
auaccccaagacucccaug

SEQ ID NO: 2993762 - RNA, 14 nt, Human
auacccacccccac

SEQ ID NO: 2993763 - RNA, 16 nt, Human
auacccacccccaccc

SEQ ID NO: 2993764 - RNA, 13 nt, Human
auacccaccccca

SEQ ID NO: 2993765 - RNA, 13 nt, Human
auaccuguccccc

SEQ ID NO: 2993766 - RNA, 14 nt, Human
auaccugucccccu

SEQ ID NO: 2993767 - RNA, 15 nt, Human
auaccugucccccug

SEQ ID NO: 2993768 - RNA, 16 nt, Human
auaccugucccccuga

SEQ ID NO: 2993769 - RNA, 14 nt, Human
auaagccagacauc

SEQ ID NO: 2993770 - RNA, 22 nt, Human
auaagccagacaucaacagaua

SEQ ID NO: 2993771 - RNA, 21 nt, Human
auaagccagacaucaacagau

SEQ ID NO: 2993772 - RNA, 18 nt, Human
auaaggguaucuggugac

SEQ ID NO: 2993773 - RNA, 13 nt, Human
auaauguuucaaa

SEQ ID NO: 2993774 - RNA, 23 nt, Human
cacaguguguggucaacauuucu

SEQ ID NO: 2993775 - RNA, 17 nt, Human
cacaguucaauucucau

SEQ ID NO: 2993776 - RNA, 19 nt, Human
caaggcuuagacccucaug

SEQ ID NO: 2993777 - RNA, 22 nt, Human
caaggcuuagacccucaugcug

SEQ ID NO: 2993778 - RNA, 21 nt, Human
caagggugaugggaaagcauu

SEQ ID NO: 2993779 - RNA, 23 nt, Human
caagggugaugggaaagcauugu

SEQ ID NO: 2993780 - RNA, 21 nt, Human
caauauccuaauaaaaaggug

SEQ ID NO: 2993781 - RNA, 19 nt, Human
caauagucaaauuguguga

SEQ ID NO: 2993782 - RNA, 17 nt, Human
caauagucaaauugugu

SEQ ID NO: 2993783 - RNA, 16 nt, Human
caauaggaaaaacuga

SEQ ID NO: 2993784 - RNA, 17 nt, Human
caauaggaaaaacugau

SEQ ID NO: 2993785 - RNA, 15 nt, Human
caauaggaaaaacug

SEQ ID NO: 2993786 - RNA, 19 nt, Human
caauagauugcucaaauca

SEQ ID NO: 2993787 - RNA, 18 nt, Human
caauaacuggaacacucu

SEQ ID NO: 2993788 - RNA, 18 nt, Human
caaggaaaaaauaacaau

SEQ ID NO: 2993789 - RNA, 23 nt, Human
caagcuggucccacucaguccau

SEQ ID NO: 2993790 - RNA, 22 nt, Human
caagcuggucccacucagucca

SEQ ID NO: 2993791 - RNA, 20 nt, Human
caaggaaaaaauaacaauga

SEQ ID NO: 2993792 - RNA, 17 nt, Human
caaggcugcagugagcc

SEQ ID NO: 2993793 - RNA, 22 nt, Human
caaggcugcagugagccgagau

SEQ ID NO: 2993794 - RNA, 20 nt, Human
caaggauccugagccagauu

SEQ ID NO: 2993795 - RNA, 18 nt, Human
caaggauccugagccaga

SEQ ID NO: 2993796 - RNA, 19 nt, Human
caaggauccugagccagau

SEQ ID NO: 2993797 - RNA, 16 nt, Human
caaggagauuuacaac

SEQ ID NO: 2993798 - RNA, 22 nt, Human
caagcugcacccucaggcaggu

SEQ ID NO: 2993799 - RNA, 21 nt, Human
caagcuggucccacucagucc

SEQ ID NO: 2993800 - RNA, 17 nt, Human
caagcgauucuucugcu

SEQ ID NO: 2993801 - RNA, 15 nt, Human
caagcgauucuucug

SEQ ID NO: 2993802 - RNA, 21 nt, Human
caagcugcacccucaggcagg

SEQ ID NO: 2993803 - RNA, 18 nt, Human
caagcgauucuucugcuu

SEQ ID NO: 2993804 - RNA, 13 nt, Human
cacaaagcuuuug

SEQ ID NO: 2993805 - RNA, 16 nt, Human
cacaaagcuuuugcau

SEQ ID NO: 2993806 - RNA, 13 nt, Human
cacaaaggagagc

SEQ ID NO: 2993807 - RNA, 18 nt, Human
cacaagaaaugaaagcag

SEQ ID NO: 2993808 - RNA, 21 nt, Human
cacaagaaaugaaagcaggga

SEQ ID NO: 2993809 - RNA, 20 nt, Human
cacaagaaaugaaagcaggg

SEQ ID NO: 2993810 - RNA, 15 nt, Human
cacacaaacaaggcc

SEQ ID NO: 2993811 - RNA, 17 nt, Human
cacacacgcgugcacac

SEQ ID NO: 2993812 - RNA, 22 nt, Human
caauauccuaauaaaaagguga

SEQ ID NO: 2993813 - RNA, 19 nt, Human
caaugugaaaagaaaaaug

SEQ ID NO: 2993814 - RNA, 22 nt, Human
caaugugaaaagaaaaaugagc

SEQ ID NO: 2993815 - RNA, 14 nt, Human
caauguucucucuu

SEQ ID NO: 2993816 - RNA, 17 nt, Human
caauuacaggaaguacu

SEQ ID NO: 2993817 - RNA, 18 nt, Human
caauuacaggaaguacug

SEQ ID NO: 2993818 - RNA, 17 nt, Human
caauuaccagaaagaua

SEQ ID NO: 2993819 - RNA, 22 nt, Human
caauuuuucuuauuucauuucu

SEQ ID NO: 2993820 - RNA, 14 nt, Human
cacaaacagaggcc

SEQ ID NO: 2993821 - RNA, 13 nt, Human
cacaaacagaggc

SEQ ID NO: 2993822 - RNA, 17 nt, Human
cacagccagacuggcac

SEQ ID NO: 2993823 - RNA, 18 nt, Human
cacagccagacuggcaca

SEQ ID NO: 2993824 - RNA, 14 nt, Human
cacagccccaucug

SEQ ID NO: 2993825 - RNA, 21 nt, Human
cacagcucuucuccaggcugu

SEQ ID NO: 2993826 - RNA, 19 nt, Human
cacagcaguugaaaagacu

SEQ ID NO: 2993827 - RNA, 13 nt, Human
cacagcaggcugc

SEQ ID NO: 2993828 - RNA, 17 nt, Human
cacagcaggcugccagu

SEQ ID NO: 2993829 - RNA, 16 nt, Human
cacagcaggcugccag

SEQ ID NO: 2993830 - RNA, 15 nt, Human
cacagcaggcugcca

SEQ ID NO: 2993831 - RNA, 21 nt, Human
cacagcaguugaaaagacucc

SEQ ID NO: 2993832 - RNA, 22 nt, Human
cacagcaggcugccagugccug

SEQ ID NO: 2993833 - RNA, 21 nt, Human
cacagcaggcugccagugccu

SEQ ID NO: 2993834 - RNA, 20 nt, Human
cacagcaggcugccagugcc

SEQ ID NO: 2993835 - RNA, 19 nt, Human
cacagcaggcugccagugc

SEQ ID NO: 2993836 - RNA, 17 nt, Human
cacagcagugagacugg

SEQ ID NO: 2993837 - RNA, 16 nt, Human
cacagcagugagacug

SEQ ID NO: 2993838 - RNA, 13 nt, Human
cacacugaagaag

SEQ ID NO: 2993839 - RNA, 12 nt, Human
cacagagaaagu

SEQ ID NO: 2993840 - RNA, 20 nt, Human
cacagagaaaguacuucucc

SEQ ID NO: 2993841 - RNA, 19 nt, Human
cacagagaaaguacuucuc

SEQ ID NO: 2993842 - RNA, 13 nt, Human
cacagaggcugcc

SEQ ID NO: 2993843 - RNA, 22 nt, Human
cacagaguuguuacauuuuuaa

SEQ ID NO: 2993844 - RNA, 21 nt, Human
cacagaguuguuacauuuuua

SEQ ID NO: 2993845 - RNA, 23 nt, Human
cacagaugggugcuuggaggaag

SEQ ID NO: 2993846 - RNA, 13 nt, Human
cacagauuggcca

SEQ ID NO: 2993847 - RNA, 21 nt, Human
caaacugacucuuaagaagac

SEQ ID NO: 2993848 - RNA, 17 nt, Human
caaacugacucuuaaga

SEQ ID NO: 2993849 - RNA, 16 nt, Human
caaacugacucuuaag

SEQ ID NO: 2993850 - RNA, 21 nt, Human
caaacucuugaccucagguga

SEQ ID NO: 2993851 - RNA, 20 nt, Human
caaacucuugaccucaggug

SEQ ID NO: 2993852 - RNA, 19 nt, Human
caaacucuugaccucaggu

SEQ ID NO: 2993853 - RNA, 17 nt, Human
caaacucuugaccucag

SEQ ID NO: 2993854 - RNA, 13 nt, Human
caaacagaggccg

SEQ ID NO: 2993855 - RNA, 21 nt, Human
caaacaaggccugucagcuaa

SEQ ID NO: 2993856 - RNA, 11 nt, Human
caaaaugaaac

SEQ ID NO: 2993857 - RNA, 22 nt, Human
caaaaugaaacgcaaccaccac

SEQ ID NO: 2993858 - RNA, 20 nt, Human
caaaauaaaacuuuuuaaaa

SEQ ID NO: 2993859 - RNA, 16 nt, Human
caaaauaaaacuuuuu

SEQ ID NO: 2993860 - RNA, 14 nt, Human
caaaauaaaacuuu

SEQ ID NO: 2993861 - RNA, 13 nt, Human
caaaauagaaagu

SEQ ID NO: 2993862 - RNA, 12 nt, Human
caaaauagaaag

SEQ ID NO: 2993863 - RNA, 22 nt, Human
caaaauagaaaguugcaaggca

SEQ ID NO: 2993864 - RNA, 21 nt, Human
caaaauagaaaguugcaaggc

SEQ ID NO: 2993865 - RNA, 21 nt, Human
caaaaucgaugcagugcuucc

SEQ ID NO: 2993866 - RNA, 19 nt, Human
caaaacucuccucugcugc

SEQ ID NO: 2993867 - RNA, 14 nt, Human
caaaacugcacugu

SEQ ID NO: 2993868 - RNA, 17 nt, Human
caaaacugcacugucaa

SEQ ID NO: 2993869 - RNA, 18 nt, Human
caaaacugcacugucaag

SEQ ID NO: 2993870 - RNA, 23 nt, Human
caaaacucuccucugcugcuggc

SEQ ID NO: 2993871 - RNA, 14 nt, Human
caaaaguuucucuu

SEQ ID NO: 2993872 - RNA, 15 nt, Human
caaaacgguuuuacu

SEQ ID NO: 2993873 - RNA, 21 nt, Human
caaaacgguuuuacugcagcu

SEQ ID NO: 2993874 - RNA, 18 nt, Human
auuuuauuuuauuaugca

SEQ ID NO: 2993875 - RNA, 15 nt, Human
caaaacucuccucug

SEQ ID NO: 2993876 - RNA, 16 nt, Human
caaaacucuccucugc

SEQ ID NO: 2993877 - RNA, 19 nt, Human
caagaaaugaaagcaggga

SEQ ID NO: 2993878 - RNA, 17 nt, Human
caagaaaugaaagcagg

SEQ ID NO: 2993879 - RNA, 15 nt, Human
caagaaaugaaagca

SEQ ID NO: 2993880 - RNA, 13 nt, Human
caagaagcccagg

SEQ ID NO: 2993881 - RNA, 14 nt, Human
caagaagcccagga

SEQ ID NO: 2993882 - RNA, 21 nt, Human
caagaccuucuccuucaccuu

SEQ ID NO: 2993883 - RNA, 23 nt, Human
caagaccuucuccuucaccuuug

SEQ ID NO: 2993884 - RNA, 13 nt, Human
caagacgcugugc

SEQ ID NO: 2993885 - RNA, 15 nt, Human
caagacgcugugcug

SEQ ID NO: 2993886 - RNA, 14 nt, Human
caagagcaaaguag

SEQ ID NO: 2993887 - RNA, 17 nt, Human
caacauacucccaucug

SEQ ID NO: 2993888 - RNA, 19 nt, Human
caacauacucccaucugug

SEQ ID NO: 2993889 - RNA, 12 nt, Human
caacaggcuggg

SEQ ID NO: 2993890 - RNA, 20 nt, Human
caacauacucccaucuguga

SEQ ID NO: 2993891 - RNA, 22 nt, Human
caaauuucuaaaucuccaaaau

SEQ ID NO: 2993892 - RNA, 15 nt, Human
caaauuucuaaaucu

SEQ ID NO: 2993893 - RNA, 23 nt, Human
caaagugcugggauuacaagcgu

SEQ ID NO: 2993894 - RNA, 19 nt, Human
caaaguggugagaggcauc

SEQ ID NO: 2993895 - RNA, 19 nt, Human
caaagugcugggauuacaa

SEQ ID NO: 2993896 - RNA, 13 nt, Human
caaagugcuggga

SEQ ID NO: 2993897 - RNA, 13 nt, Human
caaauaugcaaag

SEQ ID NO: 2993898 - RNA, 12 nt, Human
caaauaugcaaa

SEQ ID NO: 2993899 - RNA, 23 nt, Human
caaauggaaaugggcagagcaga

SEQ ID NO: 2993900 - RNA, 22 nt, Human
caaauggaaaugggcagagcag

SEQ ID NO: 2993901 - RNA, 18 nt, Human
caaauguucaucaaugaa

SEQ ID NO: 2993902 - RNA, 14 nt, Human
caaauguucaucaa

SEQ ID NO: 2993903 - RNA, 18 nt, Human
uguucacuggacacuuca

SEQ ID NO: 2993904 - RNA, 17 nt, Human
uguuaguaugaggcauu

SEQ ID NO: 2993905 - RNA, 20 nt, Human
uguuaguaugaggcauuugu

SEQ ID NO: 2993906 - RNA, 19 nt, Human
uguuaguaugaggcauuug

SEQ ID NO: 2993907 - RNA, 22 nt, Human
uguucagcuccagcucaccagc

SEQ ID NO: 2993908 - RNA, 21 nt, Human
uguucagcuccagcucaccag

SEQ ID NO: 2993909 - RNA, 20 nt, Human
uguucagcuccagcucacca

SEQ ID NO: 2993910 - RNA, 18 nt, Human
uguucagcuccagcucac

SEQ ID NO: 2993911 - RNA, 21 nt, Human
uguuaaaagaugaaaauauuu

SEQ ID NO: 2993912 - RNA, 14 nt, Human
uguuacuaaguuuu

SEQ ID NO: 2993913 - RNA, 14 nt, Human
uguguggucaacau

SEQ ID NO: 2993914 - RNA, 23 nt, Human
uguguggucaacauuucucaugu

SEQ ID NO: 2993915 - RNA, 16 nt, Human
uguguuuauugucaaa

SEQ ID NO: 2993916 - RNA, 13 nt, Human
uguguuuauuguc

SEQ ID NO: 2993917 - RNA, 19 nt, Human
uguguuuugcaagccagau

SEQ ID NO: 2993918 - RNA, 13 nt, Human
uguguuuugcaag

SEQ ID NO: 2993919 - RNA, 13 nt, Human
uguguuugaagca

SEQ ID NO: 2993920 - RNA, 19 nt, Human
ugugugcacguacacacac

SEQ ID NO: 2993921 - RNA, 22 nt, Human
ugugugaaagguacuucaaauc

SEQ ID NO: 2993922 - RNA, 21 nt, Human
ugugugaaagguacuucaaau

SEQ ID NO: 2993923 - RNA, 20 nt, Human
ugugugaaagguacuucaaa

SEQ ID NO: 2993924 - RNA, 20 nt, Human
uguugacaugggacauuugc

SEQ ID NO: 2993925 - RNA, 17 nt, Human
uguucuggcucuuccag

SEQ ID NO: 2993926 - RNA, 20 nt, Human
uguucuggcucuuccaggcu

SEQ ID NO: 2993927 - RNA, 21 nt, Human
uguucuggcucuuccaggcug

SEQ ID NO: 2993928 - RNA, 23 nt, Human
uguucuuucuggcuaugcauuug

SEQ ID NO: 2993929 - RNA, 13 nt, Human
uguucucugcccu

SEQ ID NO: 2993930 - RNA, 14 nt, Human
uguucucugcccuc

SEQ ID NO: 2993931 - RNA, 15 nt, Human
uguucucugcccucc

SEQ ID NO: 2993932 - RNA, 16 nt, Human
uguucucugcccucca

SEQ ID NO: 2993933 - RNA, 13 nt, Human
uguucuggcucuu

SEQ ID NO: 2993934 - RNA, 16 nt, Human
uguucuggcucuucca

SEQ ID NO: 2993935 - RNA, 12 nt, Human
uguucuggcucu

SEQ ID NO: 2993936 - RNA, 22 nt, Human
uguucaucaacagugagagacu

SEQ ID NO: 2993937 - RNA, 14 nt, Human
uguucaugaaagau

SEQ ID NO: 2993938 - RNA, 13 nt, Human
uguucaugaaaga

SEQ ID NO: 2993939 - RNA, 19 nt, Human
uguucaucauccuaagcua

SEQ ID NO: 2993940 - RNA, 15 nt, Human
uguucucucuucucc

SEQ ID NO: 2993941 - RNA, 16 nt, Human
uguucucucuucucca

SEQ ID NO: 2993942 - RNA, 14 nt, Human
uguuuaaaaucauu

SEQ ID NO: 2993943 - RNA, 17 nt, Human
uguuuaaaaucauuucu

SEQ ID NO: 2993944 - RNA, 18 nt, Human
uguuuaaaaucauuucug

SEQ ID NO: 2993945 - RNA, 19 nt, Human
uguuggcugggggccucag

SEQ ID NO: 2993946 - RNA, 17 nt, Human
uguuggcugggggccuc

SEQ ID NO: 2993947 - RNA, 16 nt, Human
uguuggccaggcuggu

SEQ ID NO: 2993948 - RNA, 15 nt, Human
uguuggccaggcugg

SEQ ID NO: 2993949 - RNA, 20 nt, Human
uguuggagaagaacugaaau

SEQ ID NO: 2993950 - RNA, 19 nt, Human
uguuggagaagaacugaaa

SEQ ID NO: 2993951 - RNA, 17 nt, Human
uguuggagaagaacuga

SEQ ID NO: 2993952 - RNA, 16 nt, Human
uguuggagaagaacug

SEQ ID NO: 2993953 - RNA, 14 nt, Human
uguuggagaagaac

SEQ ID NO: 2993954 - RNA, 22 nt, Human
uuaaacuacauuagguugugaa

SEQ ID NO: 2993955 - RNA, 23 nt, Human
uuaaacuacauuagguugugaau

SEQ ID NO: 2993956 - RNA, 18 nt, Human
uuaaaauacacacucaaa

SEQ ID NO: 2993957 - RNA, 22 nt, Human
uuaaacuuaaucuaaauggaac

SEQ ID NO: 2993958 - RNA, 14 nt, Human
uuaaaacccaagug

SEQ ID NO: 2993959 - RNA, 17 nt, Human
uuaaaauaagucugauu

SEQ ID NO: 2993960 - RNA, 15 nt, Human
uuaaaauaagucuga

SEQ ID NO: 2993961 - RNA, 20 nt, Human
uuaaauauuuugacuuguug

SEQ ID NO: 2993962 - RNA, 11 nt, Human
uuaaaugacuc

SEQ ID NO: 2993963 - RNA, 18 nt, Human
uuaaaugacucuucccuc

SEQ ID NO: 2993964 - RNA, 15 nt, Human
uuaaaugcccagccc

SEQ ID NO: 2993965 - RNA, 16 nt, Human
uuaaaugcccagcccc

SEQ ID NO: 2993966 - RNA, 14 nt, Human
uuaaaugcccagcc

SEQ ID NO: 2993967 - RNA, 18 nt, Human
uguuucuggcuuagaaca

SEQ ID NO: 2993968 - RNA, 16 nt, Human
uguuuuaagaggcagg

SEQ ID NO: 2993969 - RNA, 22 nt, Human
uuaaaaaaaaaccugagcccca

SEQ ID NO: 2993970 - RNA, 23 nt, Human
uguuuuaaggaugcuuguacaua

SEQ ID NO: 2993971 - RNA, 22 nt, Human
uguuuuaaggaugcuuguacau

SEQ ID NO: 2993972 - RNA, 19 nt, Human
uguuuuaaggaugcuugua

SEQ ID NO: 2993973 - RNA, 17 nt, Human
uguuuuaagaggcaggg

SEQ ID NO: 2993974 - RNA, 14 nt, Human
uuaacuuuuauaaa

SEQ ID NO: 2993975 - RNA, 13 nt, Human
uuaaaugcccagc

SEQ ID NO: 2993976 - RNA, 13 nt, Human
uuaacuuuuauaa

SEQ ID NO: 2993977 - RNA, 12 nt, Human
uuaacuuuuaua

SEQ ID NO: 2993978 - RNA, 17 nt, Human
uuacauuuuuaagugcu

SEQ ID NO: 2993979 - RNA, 12 nt, Human
uuacauuuuuaa

SEQ ID NO: 2993980 - RNA, 20 nt, Human
uuacauuuguauaaaauaau

SEQ ID NO: 2993981 - RNA, 20 nt, Human
uuacacuuuaugcacaaaau

SEQ ID NO: 2993982 - RNA, 13 nt, Human
uuacacuuuaugc

SEQ ID NO: 2993983 - RNA, 22 nt, Human
uuaauuaaaacacaacaucuuu

SEQ ID NO: 2993984 - RNA, 21 nt, Human
uuaaugagacuuuaaaagcau

SEQ ID NO: 2993985 - RNA, 18 nt, Human
uuaaugagacuuuaaaag

SEQ ID NO: 2993986 - RNA, 16 nt, Human
uuaaugagacuuuaaa

SEQ ID NO: 2993987 - RNA, 23 nt, Human
uuaaugagacuuuaaaagcauuu

SEQ ID NO: 2993988 - RNA, 18 nt, Human
uuacacacuguacacaua

SEQ ID NO: 2993989 - RNA, 20 nt, Human
uguaauaaacucauuucuag

SEQ ID NO: 2993990 - RNA, 18 nt, Human
uguacagagcccacgccc

SEQ ID NO: 2993991 - RNA, 16 nt, Human
uguaccgcaaugugac

SEQ ID NO: 2993992 - RNA, 15 nt, Human
uguaccgcaauguga

SEQ ID NO: 2993993 - RNA, 16 nt, Human
uguacagagcccacgc

SEQ ID NO: 2993994 - RNA, 17 nt, Human
uguacagagcccacgcc

SEQ ID NO: 2993995 - RNA, 13 nt, Human
uguacagagccca

SEQ ID NO: 2993996 - RNA, 22 nt, Human
uguaguguuggagaagaacuga

SEQ ID NO: 2993997 - RNA, 19 nt, Human
uguacugcauaugaaagga

SEQ ID NO: 2993998 - RNA, 15 nt, Human
uguacgucugacagg

SEQ ID NO: 2993999 - RNA, 16 nt, Human
uguagcauccuggaau

SEQ ID NO: 2994000 - RNA, 14 nt, Human
uguagcauccugga

SEQ ID NO: 2994001 - RNA, 18 nt, Human
uguagcauccuggaauau

SEQ ID NO: 2994002 - RNA, 17 nt, Human
uguagcauccuggaaua

SEQ ID NO: 2994003 - RNA, 18 nt, Human
uguagauguaugcacaca

SEQ ID NO: 2994004 - RNA, 14 nt, Human
uguagauguaugca

SEQ ID NO: 2994005 - RNA, 23 nt, Human
ugucccaaaaagaaaggagggga

SEQ ID NO: 2994006 - RNA, 19 nt, Human
ugucauuugagcagggcuc

SEQ ID NO: 2994007 - RNA, 16 nt, Human
ugucauuugagcaggg

SEQ ID NO: 2994008 - RNA, 13 nt, Human
ugucaccugaaga

SEQ ID NO: 2994009 - RNA, 16 nt, Human
uguccccgacccuugc

SEQ ID NO: 2994010 - RNA, 17 nt, Human
uguccccgacccuugcc

SEQ ID NO: 2994011 - RNA, 20 nt, Human
uguccuacccacccuccuuu

SEQ ID NO: 2994012 - RNA, 17 nt, Human
uguccuacucuguguca

SEQ ID NO: 2994013 - RNA, 12 nt, Human
uguccuacucug

SEQ ID NO: 2994014 - RNA, 18 nt, Human
uguccccaccgcagacag

SEQ ID NO: 2994015 - RNA, 13 nt, Human
ugucccaagugcc

SEQ ID NO: 2994016 - RNA, 12 nt, Human
ugucccaagugc

SEQ ID NO: 2994017 - RNA, 15 nt, Human
ugucccaagugccaa

SEQ ID NO: 2994018 - RNA, 14 nt, Human
ugucccaagugcca

SEQ ID NO: 2994019 - RNA, 19 nt, Human
uguccccaccgcagacagg

SEQ ID NO: 2994020 - RNA, 22 nt, Human
uguccccaccgcagacaggacc

SEQ ID NO: 2994021 - RNA, 13 nt, Human
uguccccaccgca

SEQ ID NO: 2994022 - RNA, 19 nt, Human
uguauuuuacuaauaaaau

SEQ ID NO: 2994023 - RNA, 12 nt, Human
ugucacaggcag

SEQ ID NO: 2994024 - RNA, 17 nt, Human
ugucacacacuuuggcu

SEQ ID NO: 2994025 - RNA, 13 nt, Human
uguauuuugaaau

SEQ ID NO: 2994026 - RNA, 13 nt, Human
ugucacacacuuu

SEQ ID NO: 2994027 - RNA, 22 nt, Human
uguauucucuccuguaccucuu

SEQ ID NO: 2994028 - RNA, 15 nt, Human
uguaugauucccagc

SEQ ID NO: 2994029 - RNA, 23 nt, Human
ugugaaggcaggggaauguaugu

SEQ ID NO: 2994030 - RNA, 15 nt, Human
ugugacauguuuuau

SEQ ID NO: 2994031 - RNA, 13 nt, Human
ugugaggaagccg

SEQ ID NO: 2994032 - RNA, 18 nt, Human
ugugaggaagccgcuggg

SEQ ID NO: 2994033 - RNA, 20 nt, Human
ugugaggaagccgcuggggc

SEQ ID NO: 2994034 - RNA, 12 nt, Human
ugugaggaagcc

SEQ ID NO: 2994035 - RNA, 17 nt, Human
ugugagucaccaagccc

SEQ ID NO: 2994036 - RNA, 15 nt, Human
ugugagucaccaagc

SEQ ID NO: 2994037 - RNA, 21 nt, Human
ugugagucaccaagcccaguu

SEQ ID NO: 2994038 - RNA, 19 nt, Human
ugugagucaccaagcccag

SEQ ID NO: 2994039 - RNA, 23 nt, Human
ugucuuuucuugcaugaggcuag

SEQ ID NO: 2994040 - RNA, 23 nt, Human
ugugaaaagaaaaaugagccugg

SEQ ID NO: 2994041 - RNA, 21 nt, Human
ugugaaaagaaaaaugagccu

SEQ ID NO: 2994042 - RNA, 16 nt, Human
ugucuuuggacccuga

SEQ ID NO: 2994043 - RNA, 21 nt, Human
ugucuuuucuugcaugaggcu

SEQ ID NO: 2994044 - RNA, 14 nt, Human
ugucuuuggacccu

SEQ ID NO: 2994045 - RNA, 17 nt, Human
ugugcacaucuguuuug

SEQ ID NO: 2994046 - RNA, 15 nt, Human
ugugcacaucuguuu

SEQ ID NO: 2994047 - RNA, 14 nt, Human
ugugcacguacaca

SEQ ID NO: 2994048 - RNA, 14 nt, Human
ugugcauuaucuag

SEQ ID NO: 2994049 - RNA, 19 nt, Human
ugugcauuaucuagauacu

SEQ ID NO: 2994050 - RNA, 16 nt, Human
ugugcauuaucuagau

SEQ ID NO: 2994051 - RNA, 21 nt, Human
ugugcauuaucuagauacugu

SEQ ID NO: 2994052 - RNA, 20 nt, Human
ugugcauuaucuagauacug

SEQ ID NO: 2994053 - RNA, 23 nt, Human
ugugcauuaucuagauacuguau

SEQ ID NO: 2994054 - RNA, 19 nt, Human
ugugcuaguaauuggaaag

SEQ ID NO: 2994055 - RNA, 19 nt, Human
ugugcgccuacaggaguga

SEQ ID NO: 2994056 - RNA, 14 nt, Human
ugugcgccuacagg

SEQ ID NO: 2994057 - RNA, 23 nt, Human
uguggcgcagcauauucaggaag

SEQ ID NO: 2994058 - RNA, 22 nt, Human
uguggcgagccauuugucccaa

SEQ ID NO: 2994059 - RNA, 12 nt, Human
uguggcgagcca

SEQ ID NO: 2994060 - RNA, 19 nt, Human
uguggacacagcucuucuc

SEQ ID NO: 2994061 - RNA, 16 nt, Human
uguggacacagcucuu

SEQ ID NO: 2994062 - RNA, 18 nt, Human
uguggacacagcucuucu

SEQ ID NO: 2994063 - RNA, 22 nt, Human
ugugggcuaguugggcuuccuc

SEQ ID NO: 2994064 - RNA, 12 nt, Human
uguguagggcgg

SEQ ID NO: 2994065 - RNA, 21 nt, Human
ugcuuuaccaauugaaguaaa

SEQ ID NO: 2994066 - RNA, 17 nt, Human
uggaaaaauagccugcc

SEQ ID NO: 2994067 - RNA, 20 nt, Human
uggaaaaauagccugccucu

SEQ ID NO: 2994068 - RNA, 20 nt, Human
uggaacauaaaauacaaugu

SEQ ID NO: 2994069 - RNA, 21 nt, Human
uggaacauaaaauacaauguu

SEQ ID NO: 2994070 - RNA, 20 nt, Human
uggaaagaguaggaagacuu

SEQ ID NO: 2994071 - RNA, 23 nt, Human
uggaaacuucagcgguuuauaua

SEQ ID NO: 2994072 - RNA, 21 nt, Human
uggaaagacuuuuccaacccu

SEQ ID NO: 2994073 - RNA, 17 nt, Human
uggaaacaagucaguca

SEQ ID NO: 2994074 - RNA, 18 nt, Human
uggaauaagacagagacc

SEQ ID NO: 2994075 - RNA, 14 nt, Human
uggaauaagacaga

SEQ ID NO: 2994076 - RNA, 17 nt, Human
uggaauaaggagaauga

SEQ ID NO: 2994077 - RNA, 22 nt, Human
uggaauaauccuaaacauauga

SEQ ID NO: 2994078 - RNA, 16 nt, Human
uggaauauauaaccag

SEQ ID NO: 2994079 - RNA, 15 nt, Human
uggaauauauaacca

SEQ ID NO: 2994080 - RNA, 19 nt, Human
uggaauaacauguaauuaa

SEQ ID NO: 2994081 - RNA, 15 nt, Human
uggaauaacauguaa

SEQ ID NO: 2994082 - RNA, 14 nt, Human
uggaauaacaugua

SEQ ID NO: 2994083 - RNA, 13 nt, Human
uggacaugcacag

SEQ ID NO: 2994084 - RNA, 19 nt, Human
uggacaugcacagcuaaca

SEQ ID NO: 2994085 - RNA, 12 nt, Human
uggcccaggagu

SEQ ID NO: 2994086 - RNA, 14 nt, Human
uggcccagggcauc

SEQ ID NO: 2994087 - RNA, 13 nt, Human
uggcccagggcau

SEQ ID NO: 2994088 - RNA, 22 nt, Human
uggcccaggaguuuggccagaa

SEQ ID NO: 2994089 - RNA, 20 nt, Human
uggcccaggaguuuggccag

SEQ ID NO: 2994090 - RNA, 21 nt, Human
uggcccaggaguuuggccaga

SEQ ID NO: 2994091 - RNA, 14 nt, Human
uggcccaggaguuu

SEQ ID NO: 2994092 - RNA, 19 nt, Human
uggcccaggaguuuggcca

SEQ ID NO: 2994093 - RNA, 13 nt, Human
uggcccaggaguu

SEQ ID NO: 2994094 - RNA, 21 nt, Human
uggccagaugcaccagcccuu

SEQ ID NO: 2994095 - RNA, 20 nt, Human
uggccagaugcaccagcccu

SEQ ID NO: 2994096 - RNA, 13 nt, Human
uggcagcugcuuu

SEQ ID NO: 2994097 - RNA, 21 nt, Human
uggcacccggccccugcuggu

SEQ ID NO: 2994098 - RNA, 11 nt, Human
uggagggaagc

SEQ ID NO: 2994099 - RNA, 12 nt, Human
uggaggaaggaa

SEQ ID NO: 2994100 - RNA, 18 nt, Human
uggaggaaggaaacccag

SEQ ID NO: 2994101 - RNA, 20 nt, Human
uggaggaaggaaacccagcu

SEQ ID NO: 2994102 - RNA, 24 nt, Human
uggauuuaacagaaauguacagca

SEQ ID NO: 2994103 - RNA, 20 nt, Human
uggauuuaacagaaauguac

SEQ ID NO: 2994104 - RNA, 15 nt, Human
ugguaguuuuacagu

SEQ ID NO: 2994105 - RNA, 21 nt, Human
uggguuucuaaagcugccagc

SEQ ID NO: 2994106 - RNA, 17 nt, Human
uggguuucuaaagcugc

SEQ ID NO: 2994107 - RNA, 18 nt, Human
uggguuucuaaagcugcc

SEQ ID NO: 2994108 - RNA, 23 nt, Human
ugguauuggcuagagguucaaag

SEQ ID NO: 2994109 - RNA, 21 nt, Human
ugguauguuuucaggcuagau

SEQ ID NO: 2994110 - RNA, 15 nt, Human
uggguucuacccagg

SEQ ID NO: 2994111 - RNA, 16 nt, Human
uggguucuacccaggu

SEQ ID NO: 2994112 - RNA, 22 nt, Human
uggguucuacccaggugcuagg

SEQ ID NO: 2994113 - RNA, 15 nt, Human
uggguguaaacacau

SEQ ID NO: 2994114 - RNA, 14 nt, Human
uggguguggcgcag

SEQ ID NO: 2994115 - RNA, 19 nt, Human
ugggguuuaucagaauucu

SEQ ID NO: 2994116 - RNA, 16 nt, Human
uggguaacuagggaag

SEQ ID NO: 2994117 - RNA, 21 nt, Human
ugggggaucacagccucugaa

SEQ ID NO: 2994118 - RNA, 20 nt, Human
ugggggaucacagccucuga

SEQ ID NO: 2994119 - RNA, 17 nt, Human
ugggggcugggcagagg

SEQ ID NO: 2994120 - RNA, 18 nt, Human
ugggggcugggcagagga

SEQ ID NO: 2994121 - RNA, 15 nt, Human
ugggggugcauuuga

SEQ ID NO: 2994122 - RNA, 12 nt, Human
ugggggugcauu

SEQ ID NO: 2994123 - RNA, 15 nt, Human
ugggcuucaguggca

SEQ ID NO: 2994124 - RNA, 17 nt, Human
ugggcuucaguggcagc

SEQ ID NO: 2994125 - RNA, 16 nt, Human
ugggcagaggaaagca

SEQ ID NO: 2994126 - RNA, 22 nt, Human
ugggcuaagugauccucccacc

SEQ ID NO: 2994127 - RNA, 23 nt, Human
ugggcuggguucuacccaggugc

SEQ ID NO: 2994128 - RNA, 17 nt, Human
ugggcuggugucaccug

SEQ ID NO: 2994129 - RNA, 16 nt, Human
ugggcuaguugggcuu

SEQ ID NO: 2994130 - RNA, 13 nt, Human
ugggcuacaagga

SEQ ID NO: 2994131 - RNA, 14 nt, Human
ugggaguacaaaag

SEQ ID NO: 2994132 - RNA, 22 nt, Human
ugggagcugccuguucagcucc

SEQ ID NO: 2994133 - RNA, 21 nt, Human
ugggagcugccuguucagcuc

SEQ ID NO: 2994134 - RNA, 17 nt, Human
ugggagcugccuguuca

SEQ ID NO: 2994135 - RNA, 15 nt, Human
ugggauccuccaggu

SEQ ID NO: 2994136 - RNA, 14 nt, Human
ugggauccuccagg

SEQ ID NO: 2994137 - RNA, 15 nt, Human
ugggagugagcuggu

SEQ ID NO: 2994138 - RNA, 18 nt, Human
ugggauccuccaggugca

SEQ ID NO: 2994139 - RNA, 13 nt, Human
ugggauccuggag

SEQ ID NO: 2994140 - RNA, 16 nt, Human
ugggauuacaggugug

SEQ ID NO: 2994141 - RNA, 15 nt, Human
ugggcagaggaaagc

SEQ ID NO: 2994142 - RNA, 13 nt, Human
ugggagcaaaaga

SEQ ID NO: 2994143 - RNA, 14 nt, Human
ugggagcugccugu

SEQ ID NO: 2994144 - RNA, 13 nt, Human
ugggagcugccug

SEQ ID NO: 2994145 - RNA, 12 nt, Human
ugggagcugccu

SEQ ID NO: 2994146 - RNA, 12 nt, Human
ugggacacccug

SEQ ID NO: 2994147 - RNA, 14 nt, Human
uggcuuuugugcau

SEQ ID NO: 2994148 - RNA, 16 nt, Human
uggcuuccuggcaaua

SEQ ID NO: 2994149 - RNA, 22 nt, Human
uggcuuccuaaaauucagugga

SEQ ID NO: 2994150 - RNA, 21 nt, Human
uggcugggggccucagugcca

SEQ ID NO: 2994151 - RNA, 16 nt, Human
uggcugcuucaaggau

SEQ ID NO: 2994152 - RNA, 21 nt, Human
uggcugcuucaaggauccuga

SEQ ID NO: 2994153 - RNA, 19 nt, Human
uggcccagggcaucuggga

SEQ ID NO: 2994154 - RNA, 19 nt, Human
ugcacgcacacugucugcc

SEQ ID NO: 2994155 - RNA, 17 nt, Human
ugcacgcacacugucug

SEQ ID NO: 2994156 - RNA, 19 nt, Human
ugaguccccuguuuguuuc

SEQ ID NO: 2994157 - RNA, 23 nt, Human
ugcaccggcuggccuggccccuc

SEQ ID NO: 2994158 - RNA, 15 nt, Human
ugcaccgggccacag

SEQ ID NO: 2994159 - RNA, 14 nt, Human
ugcaccgggccaca

SEQ ID NO: 2994160 - RNA, 22 nt, Human
ugcaccgggccacagagaaagu

SEQ ID NO: 2994161 - RNA, 17 nt, Human
ugcaccgggccacagag

SEQ ID NO: 2994162 - RNA, 23 nt, Human
ugcagcaauaaagcagcguuucu

SEQ ID NO: 2994163 - RNA, 20 nt, Human
ugcagcaauaaagcagcguu

SEQ ID NO: 2994164 - RNA, 12 nt, Human
ugcacuuuguuc

SEQ ID NO: 2994165 - RNA, 14 nt, Human
ugcacuuuguucug

SEQ ID NO: 2994166 - RNA, 19 nt, Human
ugcagugagccgagauugu

SEQ ID NO: 2994167 - RNA, 16 nt, Human
ugcagugcuuccaagg

SEQ ID NO: 2994168 - RNA, 17 nt, Human
ugcagugcaguauagaa

SEQ ID NO: 2994169 - RNA, 16 nt, Human
ugcagugcaguauaga

SEQ ID NO: 2994170 - RNA, 10 nt, Human
ugcagugcag

SEQ ID NO: 2994171 - RNA, 13 nt, Human
ugcaggcagccag

SEQ ID NO: 2994172 - RNA, 14 nt, Human
ugcaggcagccagg

SEQ ID NO: 2994173 - RNA, 15 nt, Human
ugcaggcagccaggc

SEQ ID NO: 2994174 - RNA, 18 nt, Human
ugcaguucugaagaagau

SEQ ID NO: 2994175 - RNA, 17 nt, Human
ugcaguucugaagaaga

SEQ ID NO: 2994176 - RNA, 16 nt, Human
ugcaguucugaagaag

SEQ ID NO: 2994177 - RNA, 15 nt, Human
ugcaguucugaagaa

SEQ ID NO: 2994178 - RNA, 14 nt, Human
ugcaguucugaaga

SEQ ID NO: 2994179 - RNA, 22 nt, Human
ugcagugguaugaucacggcuc

SEQ ID NO: 2994180 - RNA, 13 nt, Human
ugcaguugccagu

SEQ ID NO: 2994181 - RNA, 14 nt, Human
ugcaguugccaguc

SEQ ID NO: 2994182 - RNA, 22 nt, Human
ugcaguucugaagaagauggua

SEQ ID NO: 2994183 - RNA, 19 nt, Human
ugcaguucugaagaagaug

SEQ ID NO: 2994184 - RNA, 15 nt, Human
ugcaguugccaguca

SEQ ID NO: 2994185 - RNA, 12 nt, Human
ugccaucccucc

SEQ ID NO: 2994186 - RNA, 11 nt, Human
ugccaucccuc

SEQ ID NO: 2994187 - RNA, 20 nt, Human
ugccauccagguucagcuug

SEQ ID NO: 2994188 - RNA, 21 nt, Human
ugccauccagguucagcuugu

SEQ ID NO: 2994189 - RNA, 13 nt, Human
ugcccacucccug

SEQ ID NO: 2994190 - RNA, 13 nt, Human
ugcccaccuggcc

SEQ ID NO: 2994191 - RNA, 14 nt, Human
ugcccacucccugc

SEQ ID NO: 2994192 - RNA, 15 nt, Human
ugcccacucccugca

SEQ ID NO: 2994193 - RNA, 16 nt, Human
ugcccacucccugcaa

SEQ ID NO: 2994194 - RNA, 11 nt, Human
ugcccaggcug

SEQ ID NO: 2994195 - RNA, 23 nt, Human
ugccccucaacucuccuccagag

SEQ ID NO: 2994196 - RNA, 17 nt, Human
ugccccuggcagccccu

SEQ ID NO: 2994197 - RNA, 19 nt, Human
ugccccucaacucuccucc

SEQ ID NO: 2994198 - RNA, 20 nt, Human
ugccacuaaauugacacuua

SEQ ID NO: 2994199 - RNA, 19 nt, Human
ugccacccuggggagaaag

SEQ ID NO: 2994200 - RNA, 22 nt, Human
ugccacuacggaauaguuggcu

SEQ ID NO: 2994201 - RNA, 22 nt, Human
ugccagguuuuuggucugaccc

SEQ ID NO: 2994202 - RNA, 19 nt, Human
ugccagguuuuuggucuga

SEQ ID NO: 2994203 - RNA, 18 nt, Human
ugccagguuuuuggucug

SEQ ID NO: 2994204 - RNA, 17 nt, Human
ugccaaauauaaauaaa

SEQ ID NO: 2994205 - RNA, 18 nt, Human
ugccaaauauaaauaaaa

SEQ ID NO: 2994206 - RNA, 19 nt, Human
ugccaaauauaaauaaaaa

SEQ ID NO: 2994207 - RNA, 22 nt, Human
ugccaaauauaaauaaaaauaa

SEQ ID NO: 2994208 - RNA, 14 nt, Human
ugcaucaagaugug

SEQ ID NO: 2994209 - RNA, 19 nt, Human
ugcaucaagaugugacaug

SEQ ID NO: 2994210 - RNA, 16 nt, Human
ugcucaguagucagac

SEQ ID NO: 2994211 - RNA, 14 nt, Human
ugcuccucucccca

SEQ ID NO: 2994212 - RNA, 19 nt, Human
ugcuaagcauuccaacuau

SEQ ID NO: 2994213 - RNA, 15 nt, Human
ugcuaagcauuccaa

SEQ ID NO: 2994214 - RNA, 16 nt, Human
ugcucacauaucuguc

SEQ ID NO: 2994215 - RNA, 15 nt, Human
ugcucacauaucugu

SEQ ID NO: 2994216 - RNA, 17 nt, Human
ugcugaaacaacaaaua

SEQ ID NO: 2994217 - RNA, 17 nt, Human
ugcuccucuccccagca

SEQ ID NO: 2994218 - RNA, 18 nt, Human
ugcuccuuucuuguuuua

SEQ ID NO: 2994219 - RNA, 14 nt, Human
ugcugauuuaaaca

SEQ ID NO: 2994220 - RNA, 18 nt, Human
ugcugauggugcaaugac

SEQ ID NO: 2994221 - RNA, 17 nt, Human
ugcugauuuaaacacau

SEQ ID NO: 2994222 - RNA, 15 nt, Human
ugcugauuuaaacac

SEQ ID NO: 2994223 - RNA, 15 nt, Human
ugcugauggugcaau

SEQ ID NO: 2994224 - RNA, 17 nt, Human
ugcugauggugcaauga

SEQ ID NO: 2994225 - RNA, 13 nt, Human
ugcugauggugca

SEQ ID NO: 2994226 - RNA, 12 nt, Human
ugcugaaggcuc

SEQ ID NO: 2994227 - RNA, 13 nt, Human
ugcugaaggcucg

SEQ ID NO: 2994228 - RNA, 19 nt, Human
ugcugacagacacaggccc

SEQ ID NO: 2994229 - RNA, 23 nt, Human
ugcugacagacacaggcccggcu

SEQ ID NO: 2994230 - RNA, 22 nt, Human
ugcugacagacacaggcccggc

SEQ ID NO: 2994231 - RNA, 18 nt, Human
ugcugcaguugccaguca

SEQ ID NO: 2994232 - RNA, 23 nt, Human
ugcugcaguugccagucaccccg

SEQ ID NO: 2994233 - RNA, 13 nt, Human
ugcugcuggcugg

SEQ ID NO: 2994234 - RNA, 23 nt, Human
ugcuaacagcaacacaaagcuuu

SEQ ID NO: 2994235 - RNA, 22 nt, Human
ugcuaacagcaacacaaagcuu

SEQ ID NO: 2994236 - RNA, 21 nt, Human
ugcuaacagcaacacaaagcu

SEQ ID NO: 2994237 - RNA, 15 nt, Human
ugcuaaaugugaaug

SEQ ID NO: 2994238 - RNA, 16 nt, Human
ugcgccuacaggagug

SEQ ID NO: 2994239 - RNA, 14 nt, Human
ugcgccuacaggag

SEQ ID NO: 2994240 - RNA, 22 nt, Human
ugcgccuacaggagugagcacu

SEQ ID NO: 2994241 - RNA, 13 nt, Human
ugcgccuacagga

SEQ ID NO: 2994242 - RNA, 15 nt, Human
ugccuucucaacucc

SEQ ID NO: 2994243 - RNA, 21 nt, Human
ugcgaucuggguucacugcaa

SEQ ID NO: 2994244 - RNA, 20 nt, Human
ugcgaucuggguucacugca

SEQ ID NO: 2994245 - RNA, 19 nt, Human
ugcgaucuggguucacugc

SEQ ID NO: 2994246 - RNA, 15 nt, Human
ugcgaucuggguuca

SEQ ID NO: 2994247 - RNA, 14 nt, Human
ugcgaucuggguuc

SEQ ID NO: 2994248 - RNA, 18 nt, Human
ugccuguaaucacagcua

SEQ ID NO: 2994249 - RNA, 16 nt, Human
ugccugguggcagcug

SEQ ID NO: 2994250 - RNA, 15 nt, Human
ugccugguggcagcu

SEQ ID NO: 2994251 - RNA, 14 nt, Human
ugccugguggcagc

SEQ ID NO: 2994252 - RNA, 21 nt, Human
ugccugggaucccucauccuc

SEQ ID NO: 2994253 - RNA, 18 nt, Human
ugccugggcagaaggaag

SEQ ID NO: 2994254 - RNA, 19 nt, Human
ugccucgaacuggcugcaa

SEQ ID NO: 2994255 - RNA, 18 nt, Human
ugccucgaacuggcugca

SEQ ID NO: 2994256 - RNA, 20 nt, Human
ugccucgaacuggcugcaaa

SEQ ID NO: 2994257 - RNA, 18 nt, Human
ugccccuggcagccccug

SEQ ID NO: 2994258 - RNA, 17 nt, Human
ugccucucccugcugcu

SEQ ID NO: 2994259 - RNA, 20 nt, Human
ugccucucccugcugcuccu

SEQ ID NO: 2994260 - RNA, 14 nt, Human
ucggagcccugucu

SEQ ID NO: 2994261 - RNA, 15 nt, Human
ucggagcccugucuc

SEQ ID NO: 2994262 - RNA, 16 nt, Human
ucggccuccauccuga

SEQ ID NO: 2994263 - RNA, 15 nt, Human
ucggccuccauccug

SEQ ID NO: 2994264 - RNA, 19 nt, Human
ucggccccaccagugccuc

SEQ ID NO: 2994265 - RNA, 18 nt, Human
ucggccccaccagugccu

SEQ ID NO: 2994266 - RNA, 23 nt, Human
ucgucacugcuuaacuucacaua

SEQ ID NO: 2994267 - RNA, 18 nt, Human
ucggaaaacaugcuacac

SEQ ID NO: 2994268 - RNA, 15 nt, Human
ucggaaaacaugcua

SEQ ID NO: 2994269 - RNA, 23 nt, Human
ucgcccagucuggaaugcagugg

SEQ ID NO: 2994270 - RNA, 19 nt, Human
ucgcccagucuggaaugca

SEQ ID NO: 2994271 - RNA, 14 nt, Human
ucgcccagucugga

SEQ ID NO: 2994272 - RNA, 18 nt, Human
uccuuuucgcaggauucu

SEQ ID NO: 2994273 - RNA, 22 nt, Human
uccuuuucgcaggauucuuccu

SEQ ID NO: 2994274 - RNA, 23 nt, Human
ucgcaggauucuuccucccuccc

SEQ ID NO: 2994275 - RNA, 21 nt, Human
ucgcaggauucuuccucccuc

SEQ ID NO: 2994276 - RNA, 17 nt, Human
ucgcaggauucuuccuc

SEQ ID NO: 2994277 - RNA, 20 nt, Human
uccuuaccagcagagcaccu

SEQ ID NO: 2994278 - RNA, 21 nt, Human
uccuuaccagcagagcaccuu

SEQ ID NO: 2994279 - RNA, 22 nt, Human
uccuugaaaacacuguucucug

SEQ ID NO: 2994280 - RNA, 23 nt, Human
uccuugaaaacacuguucucugc

SEQ ID NO: 2994281 - RNA, 17 nt, Human
uccuugcaucaauuuuu

SEQ ID NO: 2994282 - RNA, 18 nt, Human
uccuuggugucgggcaug

SEQ ID NO: 2994283 - RNA, 21 nt, Human
uccuuggugucgggcaugaca

SEQ ID NO: 2994284 - RNA, 18 nt, Human
uccuuugugaggaagccg

SEQ ID NO: 2994285 - RNA, 22 nt, Human
uccuuugugaggaagccgcugg

SEQ ID NO: 2994286 - RNA, 17 nt, Human
uccuuugugaggaagcc

SEQ ID NO: 2994287 - RNA, 22 nt, Human
uccuuggugucgggcaugacac

SEQ ID NO: 2994288 - RNA, 16 nt, Human
ucucaaauuucuaaau

SEQ ID NO: 2994289 - RNA, 14 nt, Human
ucucaaauuucuaa

SEQ ID NO: 2994290 - RNA, 13 nt, Human
ucucaaauuucua

SEQ ID NO: 2994291 - RNA, 18 nt, Human
ucucaaauuucuaaaucu

SEQ ID NO: 2994292 - RNA, 16 nt, Human
ucucacacaugagcau

SEQ ID NO: 2994293 - RNA, 20 nt, Human
ucucacugccaugccagcuu

SEQ ID NO: 2994294 - RNA, 21 nt, Human
ucucacacaugagcaucaggc

SEQ ID NO: 2994295 - RNA, 23 nt, Human
ucucacucugucgcccagucugg

SEQ ID NO: 2994296 - RNA, 15 nt, Human
ucucacuguugccca

SEQ ID NO: 2994297 - RNA, 14 nt, Human
ucucacuguugccc

SEQ ID NO: 2994298 - RNA, 12 nt, Human
ucuacuaaaaau

SEQ ID NO: 2994299 - RNA, 15 nt, Human
ucuacuaaaaauaca

SEQ ID NO: 2994300 - RNA, 19 nt, Human
ucuacuaaaaauacaaaaa

SEQ ID NO: 2994301 - RNA, 16 nt, Human
ucuacuaaaaaugcaa

SEQ ID NO: 2994302 - RNA, 13 nt, Human
ucuauauuuuaca

SEQ ID NO: 2994303 - RNA, 12 nt, Human
ucuagggaaaaa

SEQ ID NO: 2994304 - RNA, 20 nt, Human
ucuacucgaguuacagacaa

SEQ ID NO: 2994305 - RNA, 21 nt, Human
ucuacucgaguuacagacaaa

SEQ ID NO: 2994306 - RNA, 18 nt, Human
ucuacucuagggaaaaac

SEQ ID NO: 2994307 - RNA, 18 nt, Human
ucuaggaggucucuaaga

SEQ ID NO: 2994308 - RNA, 15 nt, Human
uccugaggcugggcu

SEQ ID NO: 2994309 - RNA, 16 nt, Human
uccugaggcugggcuc

SEQ ID NO: 2994310 - RNA, 17 nt, Human
uccugaggcugggcucc

SEQ ID NO: 2994311 - RNA, 19 nt, Human
uccugaggcugggcucccu

SEQ ID NO: 2994312 - RNA, 12 nt, Human
uccugaggcugg

SEQ ID NO: 2994313 - RNA, 21 nt, Human
uccugaggcuccacuuggucu

SEQ ID NO: 2994314 - RNA, 16 nt, Human
uccugaggcuccacuu

SEQ ID NO: 2994315 - RNA, 18 nt, Human
uccugagccagauuucac

SEQ ID NO: 2994316 - RNA, 19 nt, Human
uccugagccagauuucacu

SEQ ID NO: 2994317 - RNA, 15 nt, Human
uccugaggcuccacu

SEQ ID NO: 2994318 - RNA, 17 nt, Human
uccugagccagauuuca

SEQ ID NO: 2994319 - RNA, 23 nt, Human
uccucuguacagagcccacgccc

SEQ ID NO: 2994320 - RNA, 19 nt, Human
uccucuguacagagcccac

SEQ ID NO: 2994321 - RNA, 17 nt, Human
uccucugcuugccaucc

SEQ ID NO: 2994322 - RNA, 16 nt, Human
uccucugcuugccauc

SEQ ID NO: 2994323 - RNA, 15 nt, Human
uccucugcuugccau

SEQ ID NO: 2994324 - RNA, 14 nt, Human
uccucugcuugcca

SEQ ID NO: 2994325 - RNA, 17 nt, Human
uccucugcugcuggcug

SEQ ID NO: 2994326 - RNA, 13 nt, Human
uccucuguacaga

SEQ ID NO: 2994327 - RNA, 15 nt, Human
uccucuggccugugu

SEQ ID NO: 2994328 - RNA, 21 nt, Human
uccucuaggaggucucuaaga

SEQ ID NO: 2994329 - RNA, 17 nt, Human
uccucuaggaggucucu

SEQ ID NO: 2994330 - RNA, 22 nt, Human
uccucuagugaauguaggcugg

SEQ ID NO: 2994331 - RNA, 21 nt, Human
uccuccuuuucacaguucucu

SEQ ID NO: 2994332 - RNA, 14 nt, Human
uccuaguuccacca

SEQ ID NO: 2994333 - RNA, 17 nt, Human
uccuaguuccaccauca

SEQ ID NO: 2994334 - RNA, 18 nt, Human
uccuaagcuauucaguaa

SEQ ID NO: 2994335 - RNA, 12 nt, Human
uccuaguuccac

SEQ ID NO: 2994336 - RNA, 16 nt, Human
uccuaagcuauucagu

SEQ ID NO: 2994337 - RNA, 21 nt, Human
uccuaguuccaccaucaagcc

SEQ ID NO: 2994338 - RNA, 14 nt, Human
uccuccaggugcac

SEQ ID NO: 2994339 - RNA, 18 nt, Human
uccuccaggugcacaagc

SEQ ID NO: 2994340 - RNA, 20 nt, Human
uccuccaggugcacaagcuc

SEQ ID NO: 2994341 - RNA, 22 nt, Human
uccuccaggugcacaagcucca

SEQ ID NO: 2994342 - RNA, 12 nt, Human
uccuccaggugc

SEQ ID NO: 2994343 - RNA, 13 nt, Human
uccuccaggugca

SEQ ID NO: 2994344 - RNA, 12 nt, Human
uccuccucagau

SEQ ID NO: 2994345 - RNA, 21 nt, Human
uccgcuuucuacccagcgagc

SEQ ID NO: 2994346 - RNA, 22 nt, Human
uccgaaagggacuuggaagcuc

SEQ ID NO: 2994347 - RNA, 17 nt, Human
uccgaccagacaccuug

SEQ ID NO: 2994348 - RNA, 21 nt, Human
uccgaaagggacuuggaagcu

SEQ ID NO: 2994349 - RNA, 17 nt, Human
ucccuucccaccucucu

SEQ ID NO: 2994350 - RNA, 21 nt, Human
ucccuucccacuggaggcaug

SEQ ID NO: 2994351 - RNA, 14 nt, Human
ucccuucccaccuc

SEQ ID NO: 2994352 - RNA, 16 nt, Human
ucccuucccaccucuc

SEQ ID NO: 2994353 - RNA, 13 nt, Human
ucccucuggggcu

SEQ ID NO: 2994354 - RNA, 17 nt, Human
ucccucuggggcuguuc

SEQ ID NO: 2994355 - RNA, 20 nt, Human
ucccugcacuugcagacucu

SEQ ID NO: 2994356 - RNA, 14 nt, Human
ucccugccaaugga

SEQ ID NO: 2994357 - RNA, 16 nt, Human
ucccugccaauggacu

SEQ ID NO: 2994358 - RNA, 18 nt, Human
ucccucccuuccucuuuc

SEQ ID NO: 2994359 - RNA, 22 nt, Human
ucccaugagccucagcauccug

SEQ ID NO: 2994360 - RNA, 23 nt, Human
ucccaugagggagaugccaugag

SEQ ID NO: 2994361 - RNA, 19 nt, Human
ucccaugagggagaugcca

SEQ ID NO: 2994362 - RNA, 17 nt, Human
uccauagagagcaagac

SEQ ID NO: 2994363 - RNA, 20 nt, Human
uccauagagagcaagacgcu

SEQ ID NO: 2994364 - RNA, 19 nt, Human
ucccaacucaccccagccc

SEQ ID NO: 2994365 - RNA, 21 nt, Human
ucccaacucaccccagcccca

SEQ ID NO: 2994366 - RNA, 17 nt, Human
ucccaacucaccccagc

SEQ ID NO: 2994367 - RNA, 18 nt, Human
ucccaacucaccccagcc

SEQ ID NO: 2994368 - RNA, 16 nt, Human
ucccaugagccucagc

SEQ ID NO: 2994369 - RNA, 15 nt, Human
ucccaugagccucag

SEQ ID NO: 2994370 - RNA, 17 nt, Human
ucccaggcauuccccag

SEQ ID NO: 2994371 - RNA, 18 nt, Human
ucccaggcauuccccagg

SEQ ID NO: 2994372 - RNA, 14 nt, Human
ucccacucagucca

SEQ ID NO: 2994373 - RNA, 20 nt, Human
ucccaccucucucacuccuu

SEQ ID NO: 2994374 - RNA, 18 nt, Human
ucccaccuuggcugcagg

SEQ ID NO: 2994375 - RNA, 21 nt, Human
ucccaccuuggcugcagggag

SEQ ID NO: 2994376 - RNA, 19 nt, Human
ucccaccuuggcugcaggg

SEQ ID NO: 2994377 - RNA, 17 nt, Human
ucccaccucucucacuc

SEQ ID NO: 2994378 - RNA, 18 nt, Human
ucccaccucucucacucc

SEQ ID NO: 2994379 - RNA, 14 nt, Human
ucccaccucucuca

SEQ ID NO: 2994380 - RNA, 16 nt, Human
ucccaccucagccucc

SEQ ID NO: 2994381 - RNA, 18 nt, Human
ucccaccucagccucccg

SEQ ID NO: 2994382 - RNA, 22 nt, Human
uccagcugcugagauccuggac

SEQ ID NO: 2994383 - RNA, 21 nt, Human
uccagcugcugagauccugga

SEQ ID NO: 2994384 - RNA, 18 nt, Human
uccagcugcugagauccu

SEQ ID NO: 2994385 - RNA, 14 nt, Human
uccacuuucuagcc

SEQ ID NO: 2994386 - RNA, 17 nt, Human
uccagagccccacagcc

SEQ ID NO: 2994387 - RNA, 22 nt, Human
uccacugugccaugugccaggu

SEQ ID NO: 2994388 - RNA, 14 nt, Human
uccacccugcucuc

SEQ ID NO: 2994389 - RNA, 13 nt, Human
uccacccugcucu

SEQ ID NO: 2994390 - RNA, 21 nt, Human
uccacccugcucuccgaccag

SEQ ID NO: 2994391 - RNA, 20 nt, Human
uccaagcauuuagauguaua

SEQ ID NO: 2994392 - RNA, 14 nt, Human
uccaagcaggacau

SEQ ID NO: 2994393 - RNA, 19 nt, Human
uccaagaccuucuccuuca

SEQ ID NO: 2994394 - RNA, 20 nt, Human
uccaagaccuucuccuucac

SEQ ID NO: 2994395 - RNA, 15 nt, Human
uccaagaagcccagg

SEQ ID NO: 2994396 - RNA, 16 nt, Human
uccaagaagcccagga

SEQ ID NO: 2994397 - RNA, 14 nt, Human
uccaagaagcccag

SEQ ID NO: 2994398 - RNA, 20 nt, Human
uccacaagagcccaggccuc

SEQ ID NO: 2994399 - RNA, 19 nt, Human
uccacaagagcccaggccu

SEQ ID NO: 2994400 - RNA, 21 nt, Human
uccacaagagcccaggccucc

SEQ ID NO: 2994401 - RNA, 18 nt, Human
ucaguccaugaagaugua

SEQ ID NO: 2994402 - RNA, 15 nt, Human
ucaguccauagcaga

SEQ ID NO: 2994403 - RNA, 17 nt, Human
ucagguggggucacucu

SEQ ID NO: 2994404 - RNA, 20 nt, Human
ucagguggggucacucuggc

SEQ ID NO: 2994405 - RNA, 21 nt, Human
ucagguggggucacucuggca

SEQ ID NO: 2994406 - RNA, 17 nt, Human
ucagguggggcagcuug

SEQ ID NO: 2994407 - RNA, 21 nt, Human
ucagguggggcagcuugaggg

SEQ ID NO: 2994408 - RNA, 16 nt, Human
ucagguggggcagcuu

SEQ ID NO: 2994409 - RNA, 15 nt, Human
ucagguggggcagcu

SEQ ID NO: 2994410 - RNA, 20 nt, Human
ucaggugcugccauccaggu

SEQ ID NO: 2994411 - RNA, 18 nt, Human
ucaggugcugccauccag

SEQ ID NO: 2994412 - RNA, 14 nt, Human
ucagguggggcagc

SEQ ID NO: 2994413 - RNA, 17 nt, Human
ucagucugauucccaag

SEQ ID NO: 2994414 - RNA, 18 nt, Human
ucagugugacugaucucu

SEQ ID NO: 2994415 - RNA, 13 nt, Human
ucaugaaagauuc

SEQ ID NO: 2994416 - RNA, 19 nt, Human
ucauggaauuggagcucgu

SEQ ID NO: 2994417 - RNA, 21 nt, Human
ucauggaauuggagcucgugg

SEQ ID NO: 2994418 - RNA, 15 nt, Human
ucauacucaccucac

SEQ ID NO: 2994419 - RNA, 17 nt, Human
ucagcacgauuucuguu

SEQ ID NO: 2994420 - RNA, 16 nt, Human
ucagcacgauuucugu

SEQ ID NO: 2994421 - RNA, 15 nt, Human
ucagcacgauuucug

SEQ ID NO: 2994422 - RNA, 12 nt, Human
ucagccucccaa

SEQ ID NO: 2994423 - RNA, 18 nt, Human
ucagcauccuggcacccg

SEQ ID NO: 2994424 - RNA, 17 nt, Human
ucagcauccuggcaccc

SEQ ID NO: 2994425 - RNA, 16 nt, Human
ucagcauccuggcacc

SEQ ID NO: 2994426 - RNA, 15 nt, Human
ucagcauccuggcac

SEQ ID NO: 2994427 - RNA, 18 nt, Human
ucagauaugauucaaaug

SEQ ID NO: 2994428 - RNA, 16 nt, Human
ucagauaugauucaaa

SEQ ID NO: 2994429 - RNA, 17 nt, Human
ucagauaugauucaaau

SEQ ID NO: 2994430 - RNA, 22 nt, Human
ucagcuccccucggagaagagc

SEQ ID NO: 2994431 - RNA, 21 nt, Human
ucagcuccccucggagaagag

SEQ ID NO: 2994432 - RNA, 22 nt, Human
ucagcuccagcucaccagcccc

SEQ ID NO: 2994433 - RNA, 21 nt, Human
ucagcuccagcucaccagccc

SEQ ID NO: 2994434 - RNA, 18 nt, Human
ucagcuccagcucaccag

SEQ ID NO: 2994435 - RNA, 15 nt, Human
ucagcuccagcucac

SEQ ID NO: 2994436 - RNA, 20 nt, Human
ucagccucccgaauagcugg

SEQ ID NO: 2994437 - RNA, 12 nt, Human
ucagccucccga

SEQ ID NO: 2994438 - RNA, 22 nt, Human
ucagccucccaaagugcuggga

SEQ ID NO: 2994439 - RNA, 16 nt, Human
ucagccugcuccagcu

SEQ ID NO: 2994440 - RNA, 16 nt, Human
ucagcugcugaaacaa

SEQ ID NO: 2994441 - RNA, 15 nt, Human
ucagcugcuacuacu

SEQ ID NO: 2994442 - RNA, 14 nt, Human
ucuggacuaaaacu

SEQ ID NO: 2994443 - RNA, 14 nt, Human
ucugcugcuggcug

SEQ ID NO: 2994444 - RNA, 15 nt, Human
ucugcugcuggcugg

SEQ ID NO: 2994445 - RNA, 17 nt, Human
ucugcugcuggcugguu

SEQ ID NO: 2994446 - RNA, 16 nt, Human
ucuggaaugcaguggu

SEQ ID NO: 2994447 - RNA, 20 nt, Human
ucugccugcccaggccccug

SEQ ID NO: 2994448 - RNA, 18 nt, Human
ucugccugcccaggcccc

SEQ ID NO: 2994449 - RNA, 17 nt, Human
ucugccugcccaggccc

SEQ ID NO: 2994450 - RNA, 16 nt, Human
ucugccugcccaggcc

SEQ ID NO: 2994451 - RNA, 21 nt, Human
ucugcuccucuccccagcaag

SEQ ID NO: 2994452 - RNA, 11 nt, Human
ucugcugcugg

SEQ ID NO: 2994453 - RNA, 13 nt, Human
ucugcugcuggcu

SEQ ID NO: 2994454 - RNA, 14 nt, Human
ucugucucagucca

SEQ ID NO: 2994455 - RNA, 13 nt, Human
ucugucuaggaau

SEQ ID NO: 2994456 - RNA, 16 nt, Human
ucugucgcccagucug

SEQ ID NO: 2994457 - RNA, 17 nt, Human
ucugucgcccagucugg

SEQ ID NO: 2994458 - RNA, 12 nt, Human
ucuguccuggga

SEQ ID NO: 2994459 - RNA, 14 nt, Human
ucuguacagagccc

SEQ ID NO: 2994460 - RNA, 15 nt, Human
ucuguacagagccca

SEQ ID NO: 2994461 - RNA, 20 nt, Human
ucuguccuacucugugucag

SEQ ID NO: 2994462 - RNA, 16 nt, Human
ucuggugacuuuccuc

SEQ ID NO: 2994463 - RNA, 13 nt, Human
ucugccucccauc

SEQ ID NO: 2994464 - RNA, 15 nt, Human
ucugccucccaucac

SEQ ID NO: 2994465 - RNA, 12 nt, Human
ucugccucccau

SEQ ID NO: 2994466 - RNA, 13 nt, Human
ucugcccacuccc

SEQ ID NO: 2994467 - RNA, 14 nt, Human
ucugcccacucccu

SEQ ID NO: 2994468 - RNA, 23 nt, Human
ucugccauauucuguuggccagu

SEQ ID NO: 2994469 - RNA, 22 nt, Human
ucugccauauucuguuggccag

SEQ ID NO: 2994470 - RNA, 12 nt, Human
ucugcccacucc

SEQ ID NO: 2994471 - RNA, 18 nt, Human
ucugccauauucuguugg

SEQ ID NO: 2994472 - RNA, 20 nt, Human
ucugccugaagucacacagu

SEQ ID NO: 2994473 - RNA, 19 nt, Human
ucugccugaagucacacag

SEQ ID NO: 2994474 - RNA, 22 nt, Human
ucugccucugacacacagcucu

SEQ ID NO: 2994475 - RNA, 21 nt, Human
ucugccucugacacacagcuc

SEQ ID NO: 2994476 - RNA, 23 nt, Human
ucugccucugacacacagcucug

SEQ ID NO: 2994477 - RNA, 16 nt, Human
ucugccucccaucacc

SEQ ID NO: 2994478 - RNA, 17 nt, Human
ucugccucccaucaccc

SEQ ID NO: 2994479 - RNA, 20 nt, Human
ucugccucccaucacccgcu

SEQ ID NO: 2994480 - RNA, 21 nt, Human
ucugccucccaucacccgcua

SEQ ID NO: 2994481 - RNA, 18 nt, Human
ucugccucugacacacag

SEQ ID NO: 2994482 - RNA, 15 nt, Human
ucugccucugacaca

SEQ ID NO: 2994483 - RNA, 13 nt, Human
ucugcacuccccu

SEQ ID NO: 2994484 - RNA, 21 nt, Human
ucugaggaauccagacccggc

SEQ ID NO: 2994485 - RNA, 18 nt, Human
ucugaggaauccagaccc

SEQ ID NO: 2994486 - RNA, 13 nt, Human
ucugauuuaauug

SEQ ID NO: 2994487 - RNA, 22 nt, Human
ucugaggaauccagacccggcu

SEQ ID NO: 2994488 - RNA, 19 nt, Human
ucugacccaugcugcccug

SEQ ID NO: 2994489 - RNA, 20 nt, Human
ucugacccaugcugcccugu

SEQ ID NO: 2994490 - RNA, 22 nt, Human
ucugacccaugcugcccuguga

SEQ ID NO: 2994491 - RNA, 23 nt, Human
ucugacccaugcugcccugugag

SEQ ID NO: 2994492 - RNA, 18 nt, Human
ucugagaggacuuuucuu

SEQ ID NO: 2994493 - RNA, 20 nt, Human
ugaaacacugguuuuaaaua

SEQ ID NO: 2994494 - RNA, 15 nt, Human
ugaaacacugguuuu

SEQ ID NO: 2994495 - RNA, 12 nt, Human
ugaaaauuuuga

SEQ ID NO: 2994496 - RNA, 14 nt, Human
ugaaaauucagugg

SEQ ID NO: 2994497 - RNA, 20 nt, Human
ugaaaagaaaaaugagccug

SEQ ID NO: 2994498 - RNA, 22 nt, Human
ugaaaagaaaaaugagccuggc

SEQ ID NO: 2994499 - RNA, 19 nt, Human
ugaaaagaaaaaugagccu

SEQ ID NO: 2994500 - RNA, 15 nt, Human
ugaaaagaaaaauga

SEQ ID NO: 2994501 - RNA, 21 nt, Human
ugaaaacacauuuuucuuagg

SEQ ID NO: 2994502 - RNA, 20 nt, Human
ugaaaacacauuuuucuuag

SEQ ID NO: 2994503 - RNA, 17 nt, Human
ugaaaacacuguucucu

SEQ ID NO: 2994504 - RNA, 20 nt, Human
ugaaaacacuguucucugcc

SEQ ID NO: 2994505 - RNA, 21 nt, Human
ugaaaacacuguucucugccc

SEQ ID NO: 2994506 - RNA, 22 nt, Human
ugaaaacacuguucucugcccu

SEQ ID NO: 2994507 - RNA, 23 nt, Human
ugaaaacacuguucucugcccuc

SEQ ID NO: 2994508 - RNA, 12 nt, Human
ucuuucccuccc

SEQ ID NO: 2994509 - RNA, 17 nt, Human
ucuuuccaaaguacacu

SEQ ID NO: 2994510 - RNA, 17 nt, Human
ucuuuccacagaagcuc

SEQ ID NO: 2994511 - RNA, 23 nt, Human
ucuuucccucccuuccucuuucc

SEQ ID NO: 2994512 - RNA, 13 nt, Human
ucuuucccucccu

SEQ ID NO: 2994513 - RNA, 23 nt, Human
ucuuuccaaaguacacuguuuca

SEQ ID NO: 2994514 - RNA, 13 nt, Human
ucuuguguguuua

SEQ ID NO: 2994515 - RNA, 19 nt, Human
ucuugugguuauaacuuaa

SEQ ID NO: 2994516 - RNA, 23 nt, Human
ucuugugguuauaacuuaaugaa

SEQ ID NO: 2994517 - RNA, 16 nt, Human
ucuuuggacccugagg

SEQ ID NO: 2994518 - RNA, 14 nt, Human
ucuuuggacccuga

SEQ ID NO: 2994519 - RNA, 15 nt, Human
ucuuuggacccugag

SEQ ID NO: 2994520 - RNA, 13 nt, Human
ucuuuggacccug

SEQ ID NO: 2994521 - RNA, 17 nt, Human
ucuuugcagacaggcaa

SEQ ID NO: 2994522 - RNA, 14 nt, Human
ucuuugcagacagg

SEQ ID NO: 2994523 - RNA, 23 nt, Human
ucuuugagugaagcugggagaac

SEQ ID NO: 2994524 - RNA, 13 nt, Human
ucuuugcagacag

SEQ ID NO: 2994525 - RNA, 18 nt, Human
ucuucaguuugcagagua

SEQ ID NO: 2994526 - RNA, 17 nt, Human
ucuucaguuugcagagu

SEQ ID NO: 2994527 - RNA, 22 nt, Human
ucuuauccaacaucaacaucuu

SEQ ID NO: 2994528 - RNA, 21 nt, Human
ucuucagagacuccugcaggc

SEQ ID NO: 2994529 - RNA, 14 nt, Human
ucuuaucuuacgaa

SEQ ID NO: 2994530 - RNA, 14 nt, Human
ucuucagaucucua

SEQ ID NO: 2994531 - RNA, 13 nt, Human
ucuuauaauuuaa

SEQ ID NO: 2994532 - RNA, 14 nt, Human
ucuuauaauuuaaa

SEQ ID NO: 2994533 - RNA, 20 nt, Human
ucuuagguuggcaaaaaggc

SEQ ID NO: 2994534 - RNA, 23 nt, Human
ucuuagguuggcaaaaaggcagg

SEQ ID NO: 2994535 - RNA, 22 nt, Human
ucuuaggguuaugauuaaguaa

SEQ ID NO: 2994536 - RNA, 20 nt, Human
ucugugucagguggggcagc

SEQ ID NO: 2994537 - RNA, 17 nt, Human
ucugugucagguggggc

SEQ ID NO: 2994538 - RNA, 14 nt, Human
ucuuagauguauau

SEQ ID NO: 2994539 - RNA, 15 nt, Human
ucuuagauguauaua

SEQ ID NO: 2994540 - RNA, 19 nt, Human
ucuugccaaauauaaauaa

SEQ ID NO: 2994541 - RNA, 19 nt, Human
ucuugcaugguuuggagcu

SEQ ID NO: 2994542 - RNA, 15 nt, Human
ucuugcaugguuugg

SEQ ID NO: 2994543 - RNA, 20 nt, Human
ucuugcaugguuuggagcug

SEQ ID NO: 2994544 - RNA, 14 nt, Human
ucuugcucugcuga

SEQ ID NO: 2994545 - RNA, 23 nt, Human
ucuugcucugcugacagacacag

SEQ ID NO: 2994546 - RNA, 15 nt, Human
ucuugcucugcugac

SEQ ID NO: 2994547 - RNA, 13 nt, Human
ucuugaagacuuu

SEQ ID NO: 2994548 - RNA, 22 nt, Human
ucuugaagacuuuucuuucagc

SEQ ID NO: 2994549 - RNA, 15 nt, Human
ucuugcaugaggcua

SEQ ID NO: 2994550 - RNA, 21 nt, Human
ucuugaaauauaggaacuuaa

SEQ ID NO: 2994551 - RNA, 20 nt, Human
ucuugaaauauaggaacuua

SEQ ID NO: 2994552 - RNA, 16 nt, Human
ucuucuuggucucagu

SEQ ID NO: 2994553 - RNA, 15 nt, Human
ugacucuucccucaa

SEQ ID NO: 2994554 - RNA, 16 nt, Human
ugacucuuaagaagac

SEQ ID NO: 2994555 - RNA, 15 nt, Human
ugacucuuaagaaga

SEQ ID NO: 2994556 - RNA, 14 nt, Human
ugacucuuaagaag

SEQ ID NO: 2994557 - RNA, 13 nt, Human
ugacucuuaagaa

SEQ ID NO: 2994558 - RNA, 16 nt, Human
ugaccaugaaagacuu

SEQ ID NO: 2994559 - RNA, 13 nt, Human
ugaccauucucca

SEQ ID NO: 2994560 - RNA, 14 nt, Human
ugaccauucuccac

SEQ ID NO: 2994561 - RNA, 16 nt, Human
ugacuuuccucuuugg

SEQ ID NO: 2994562 - RNA, 21 nt, Human
ugacucuuucuauuguuucuu

SEQ ID NO: 2994563 - RNA, 21 nt, Human
ugagaaacuggcaaagcagaa

SEQ ID NO: 2994564 - RNA, 20 nt, Human
ugagaaagacuauucaaaca

SEQ ID NO: 2994565 - RNA, 15 nt, Human
ugagaaagacuauuc

SEQ ID NO: 2994566 - RNA, 15 nt, Human
ugagaaauaaaguuu

SEQ ID NO: 2994567 - RNA, 22 nt, Human
ugacuuuucuguccgagcuuug

SEQ ID NO: 2994568 - RNA, 20 nt, Human
ugagcaggauuuuaaucuuu

SEQ ID NO: 2994569 - RNA, 15 nt, Human
ugagcaggauuuuaa

SEQ ID NO: 2994570 - RNA, 14 nt, Human
ugagaggggaacag

SEQ ID NO: 2994571 - RNA, 18 nt, Human
ugagaggggaacagacug

SEQ ID NO: 2994572 - RNA, 14 nt, Human
ugagaccaaccugg

SEQ ID NO: 2994573 - RNA, 15 nt, Human
ugaggcugggcuccc

SEQ ID NO: 2994574 - RNA, 16 nt, Human
ugaggcugggcucccu

SEQ ID NO: 2994575 - RNA, 18 nt, Human
ugaggcucugcccuuggu

SEQ ID NO: 2994576 - RNA, 16 nt, Human
ugaggcucugcccuug

SEQ ID NO: 2994577 - RNA, 15 nt, Human
ugaggcucugcccuu

SEQ ID NO: 2994578 - RNA, 20 nt, Human
ugaggcggguggaucacgag

SEQ ID NO: 2994579 - RNA, 19 nt, Human
ugaggucagagccugcagu

SEQ ID NO: 2994580 - RNA, 18 nt, Human
ugaggucagagccugcag

SEQ ID NO: 2994581 - RNA, 21 nt, Human
ugaggcugggcucccuuccca

SEQ ID NO: 2994582 - RNA, 21 nt, Human
ugaggugggaggaucucuuga

SEQ ID NO: 2994583 - RNA, 22 nt, Human
ugaggaugaaaaaauaacacug

SEQ ID NO: 2994584 - RNA, 22 nt, Human
ugagccgagaucacgccacugc

SEQ ID NO: 2994585 - RNA, 23 nt, Human
ugagcagggcucagcggggacag

SEQ ID NO: 2994586 - RNA, 22 nt, Human
ugagcagggcucagcggggaca

SEQ ID NO: 2994587 - RNA, 20 nt, Human
ugagcagggcucagcgggga

SEQ ID NO: 2994588 - RNA, 14 nt, Human
ugagccgcccaagg

SEQ ID NO: 2994589 - RNA, 23 nt, Human
ugagccgagaucacgccacugca

SEQ ID NO: 2994590 - RNA, 19 nt, Human
ugagccgcccaaggccuuc

SEQ ID NO: 2994591 - RNA, 18 nt, Human
ugagccgcccaaggccuu

SEQ ID NO: 2994592 - RNA, 17 nt, Human
ugagccgcccaaggccu

SEQ ID NO: 2994593 - RNA, 15 nt, Human
ugagccgcccaaggc

SEQ ID NO: 2994594 - RNA, 11 nt, Human
ugagcucagga

SEQ ID NO: 2994595 - RNA, 19 nt, Human
ugagcucaggaguuugaga

SEQ ID NO: 2994596 - RNA, 20 nt, Human
ugaaugcagguuuuaucaga

SEQ ID NO: 2994597 - RNA, 18 nt, Human
ugaaugcagguuuuauca

SEQ ID NO: 2994598 - RNA, 15 nt, Human
ugaaugaauggcuaa

SEQ ID NO: 2994599 - RNA, 23 nt, Human
ugaaugaugauccuaggcauuug

SEQ ID NO: 2994600 - RNA, 20 nt, Human
ugaaggcuggguucugaucc

SEQ ID NO: 2994601 - RNA, 21 nt, Human
ugaaggcuggguucugauccu

SEQ ID NO: 2994602 - RNA, 21 nt, Human
ugaaacacugguuuuaaauau

SEQ ID NO: 2994603 - RNA, 22 nt, Human
ugaaacauaucucuuaucuuac

SEQ ID NO: 2994604 - RNA, 23 nt, Human
ugaacuggguacuuguggacaca

SEQ ID NO: 2994605 - RNA, 20 nt, Human
ugaagacucauucuucugua

SEQ ID NO: 2994606 - RNA, 19 nt, Human
ugaagacucauucuucugu

SEQ ID NO: 2994607 - RNA, 19 nt, Human
ugaaggccccgcccaggcu

SEQ ID NO: 2994608 - RNA, 20 nt, Human
ugaaggccccgcccaggcuu

SEQ ID NO: 2994609 - RNA, 16 nt, Human
ugaaggcuggguucug

SEQ ID NO: 2994610 - RNA, 18 nt, Human
ugaaggccccgcccaggc

SEQ ID NO: 2994611 - RNA, 21 nt, Human
ugaagagguuuuaaagcuucc

SEQ ID NO: 2994612 - RNA, 20 nt, Human
ugaagagguuuuaaagcuuc

SEQ ID NO: 2994613 - RNA, 19 nt, Human
ugaagagguuuuaaagcuu

SEQ ID NO: 2994614 - RNA, 20 nt, Human
ugaccagcaccaucucuccu

SEQ ID NO: 2994615 - RNA, 17 nt, Human
ugaccacugcagaagac

SEQ ID NO: 2994616 - RNA, 16 nt, Human
ugaccacugcagaaga

SEQ ID NO: 2994617 - RNA, 15 nt, Human
ugaccaugaaagacu

SEQ ID NO: 2994618 - RNA, 18 nt, Human
ugacagacacaggcccgg

SEQ ID NO: 2994619 - RNA, 17 nt, Human
ugacagacacaggcccg

SEQ ID NO: 2994620 - RNA, 22 nt, Human
ugacagagcaagugagacccug

SEQ ID NO: 2994621 - RNA, 23 nt, Human
ugacaucaacugcaucaagaugu

SEQ ID NO: 2994622 - RNA, 23 nt, Human
ugacaaggauugcuacuguccua

SEQ ID NO: 2994623 - RNA, 13 nt, Human
ugacagacacagg

SEQ ID NO: 2994624 - RNA, 16 nt, Human
ugacagacacaggccc

SEQ ID NO: 2994625 - RNA, 14 nt, Human
ugacagacacaggc

SEQ ID NO: 2994626 - RNA, 14 nt, Human
ugacacacagcucu

SEQ ID NO: 2994627 - RNA, 15 nt, Human
ugacacacagcucug

SEQ ID NO: 2994628 - RNA, 13 nt, Human
ugaauuacauuug

SEQ ID NO: 2994629 - RNA, 14 nt, Human
ugaauuaaguuuuu

SEQ ID NO: 2994630 - RNA, 13 nt, Human
ugaauuguaagga

SEQ ID NO: 2994631 - RNA, 21 nt, Human
ugaauuguaaggaaugauuaa

SEQ ID NO: 2994632 - RNA, 23 nt, Human
ugacaacacucauugaccugagg

SEQ ID NO: 2994633 - RNA, 16 nt, Human
ugaauuuaaauagcuu

SEQ ID NO: 2994634 - RNA, 13 nt, Human
ugacaacacucau

SEQ ID NO: 2994635 - RNA, 18 nt, Human
uacuaacauuuauuugag

SEQ ID NO: 2994636 - RNA, 13 nt, Human
uacuaacuuuccu

SEQ ID NO: 2994637 - RNA, 17 nt, Human
uacuaacauuuauuuga

SEQ ID NO: 2994638 - RNA, 21 nt, Human
uacuaauagacaauuuauuau

SEQ ID NO: 2994639 - RNA, 20 nt, Human
uacuaauagacaauuuauua

SEQ ID NO: 2994640 - RNA, 14 nt, Human
uacuaaggaaucuu

SEQ ID NO: 2994641 - RNA, 18 nt, Human
uacgaaaagaggggaaga

SEQ ID NO: 2994642 - RNA, 21 nt, Human
uacgaaaagaggggaagagac

SEQ ID NO: 2994643 - RNA, 23 nt, Human
uacgaaaaaaugguagcauuuua

SEQ ID NO: 2994644 - RNA, 16 nt, Human
uaccuuuuuuauacau

SEQ ID NO: 2994645 - RNA, 13 nt, Human
uaccuuuuuuaua

SEQ ID NO: 2994646 - RNA, 17 nt, Human
uaccuuuuuuauacaua

SEQ ID NO: 2994647 - RNA, 22 nt, Human
uaccuuuuuuauacauaaacaa

SEQ ID NO: 2994648 - RNA, 23 nt, Human
uaccuuuguucccaaauuucaua

SEQ ID NO: 2994649 - RNA, 22 nt, Human
uaccuuuuuuagaguugauacu

SEQ ID NO: 2994650 - RNA, 19 nt, Human
uaccuuuuuuagaguugau

SEQ ID NO: 2994651 - RNA, 13 nt, Human
uaccuuuuuuaga

SEQ ID NO: 2994652 - RNA, 18 nt, Human
uaccucggugccuuccuc

SEQ ID NO: 2994653 - RNA, 22 nt, Human
uaccuaacgaaguauccuucag

SEQ ID NO: 2994654 - RNA, 22 nt, Human
uaccaaaaaucucaauauuuca

SEQ ID NO: 2994655 - RNA, 15 nt, Human
uacccacugcucugg

SEQ ID NO: 2994656 - RNA, 23 nt, Human
uacauuuuuaagugcugcauuua

SEQ ID NO: 2994657 - RNA, 16 nt, Human
uaccuaucaucuuaag

SEQ ID NO: 2994658 - RNA, 15 nt, Human
uaccuacauacaauu

SEQ ID NO: 2994659 - RNA, 23 nt, Human
uacugucagcuccccucggagaa

SEQ ID NO: 2994660 - RNA, 16 nt, Human
uacuguccuacccacc

SEQ ID NO: 2994661 - RNA, 21 nt, Human
uacugucuucaguaagccgug

SEQ ID NO: 2994662 - RNA, 13 nt, Human
uacuuguggacac

SEQ ID NO: 2994663 - RNA, 14 nt, Human
uacuuaagacuuaa

SEQ ID NO: 2994664 - RNA, 12 nt, Human
uacuuaagacuu

SEQ ID NO: 2994665 - RNA, 15 nt, Human
uacugccauccuggc

SEQ ID NO: 2994666 - RNA, 19 nt, Human
uacugccauccuggcccag

SEQ ID NO: 2994667 - RNA, 18 nt, Human
uacugccauccuggccca

SEQ ID NO: 2994668 - RNA, 22 nt, Human
uacugccauccuggcccagggc

SEQ ID NO: 2994669 - RNA, 15 nt, Human
uacucgggaggcuga

SEQ ID NO: 2994670 - RNA, 22 nt, Human
uacucgggaggcugaggcagga

SEQ ID NO: 2994671 - RNA, 22 nt, Human
uacucgaguuacagacaaagcg

SEQ ID NO: 2994672 - RNA, 18 nt, Human
uacucgaguuacagacaa

SEQ ID NO: 2994673 - RNA, 22 nt, Human
uacuacaguccucccaucucac

SEQ ID NO: 2994674 - RNA, 14 nt, Human
uacuacaguuuguu

SEQ ID NO: 2994675 - RNA, 13 nt, Human
uacuacaguuugu

SEQ ID NO: 2994676 - RNA, 19 nt, Human
uacaugccuaccaauauuu

SEQ ID NO: 2994677 - RNA, 16 nt, Human
uacaugccuaccaaua

SEQ ID NO: 2994678 - RNA, 22 nt, Human
uacauggaauaacauguaauua

SEQ ID NO: 2994679 - RNA, 19 nt, Human
uacauggaauaacauguaa

SEQ ID NO: 2994680 - RNA, 18 nt, Human
uacauggaauaacaugua

SEQ ID NO: 2994681 - RNA, 14 nt, Human
uacauggaauaaca

SEQ ID NO: 2994682 - RNA, 22 nt, Human
uacauuuuuaagugcugcauuu

SEQ ID NO: 2994683 - RNA, 19 nt, Human
uacauuuuuaagugcugca

SEQ ID NO: 2994684 - RNA, 14 nt, Human
uacauuuuuaagug

SEQ ID NO: 2994685 - RNA, 21 nt, Human
uacauggcuggagcuagaauu

SEQ ID NO: 2994686 - RNA, 21 nt, Human
uacaguuuguuaguaugaggc

SEQ ID NO: 2994687 - RNA, 19 nt, Human
uacaguuuguuaguaugag

SEQ ID NO: 2994688 - RNA, 16 nt, Human
uacauaaacaaguccu

SEQ ID NO: 2994689 - RNA, 23 nt, Human
uacaugaaaacacauuuuucuua

SEQ ID NO: 2994690 - RNA, 19 nt, Human
uacaugaaaacacauuuuu

SEQ ID NO: 2994691 - RNA, 18 nt, Human
uacaugaaaacacauuuu

SEQ ID NO: 2994692 - RNA, 17 nt, Human
uacaugaaaacacauuu

SEQ ID NO: 2994693 - RNA, 17 nt, Human
uacauaagauaaaugug

SEQ ID NO: 2994694 - RNA, 16 nt, Human
uacauaagauaaaugu

SEQ ID NO: 2994695 - RNA, 16 nt, Human
uacaugaaaacacauu

SEQ ID NO: 2994696 - RNA, 23 nt, Human
uacaguucggugagcuacaaaug

SEQ ID NO: 2994697 - RNA, 14 nt, Human
uacaggaaguacug

SEQ ID NO: 2994698 - RNA, 15 nt, Human
uacaggaaguacugg

SEQ ID NO: 2994699 - RNA, 22 nt, Human
uacaggaaguacuggagaaaau

SEQ ID NO: 2994700 - RNA, 15 nt, Human
uacaggagugagcac

SEQ ID NO: 2994701 - RNA, 17 nt, Human
uacaguugaaaaacagc

SEQ ID NO: 2994702 - RNA, 19 nt, Human
uacaguugaaaaacagcug

SEQ ID NO: 2994703 - RNA, 14 nt, Human
uacaggacauauau

SEQ ID NO: 2994704 - RNA, 20 nt, Human
uacaguugaaaaacagcuga

SEQ ID NO: 2994705 - RNA, 18 nt, Human
uacaguuuguuaguauga

SEQ ID NO: 2994706 - RNA, 18 nt, Human
uacaggaagguagaaaua

SEQ ID NO: 2994707 - RNA, 13 nt, Human
uacaggaaguacu

SEQ ID NO: 2994708 - RNA, 20 nt, Human
uacagcuugaccgugaggcc

SEQ ID NO: 2994709 - RNA, 16 nt, Human
uacacuuacacuuuau

SEQ ID NO: 2994710 - RNA, 22 nt, Human
uacacuguuucaaacuuuacua

SEQ ID NO: 2994711 - RNA, 22 nt, Human
uacacugugcugagucugaagg

SEQ ID NO: 2994712 - RNA, 23 nt, Human
uacacugugcugagucugaaggc

SEQ ID NO: 2994713 - RNA, 20 nt, Human
uacacuguuucaaacuuuac

SEQ ID NO: 2994714 - RNA, 18 nt, Human
uaauuccuguuuuuauua

SEQ ID NO: 2994715 - RNA, 13 nt, Human
uaauuuugugaag

SEQ ID NO: 2994716 - RNA, 16 nt, Human
uaauuuuuauauuuga

SEQ ID NO: 2994717 - RNA, 12 nt, Human
uaauuuuuauau

SEQ ID NO: 2994718 - RNA, 18 nt, Human
uaauuuugugaagcaaaa

SEQ ID NO: 2994719 - RNA, 18 nt, Human
uacaaaguagaagucuua

SEQ ID NO: 2994720 - RNA, 14 nt, Human
uacaaaguagaagu

SEQ ID NO: 2994721 - RNA, 16 nt, Human
uacacacucaaaucaa

SEQ ID NO: 2994722 - RNA, 15 nt, Human
uacacacugcauguu

SEQ ID NO: 2994723 - RNA, 17 nt, Human
uacacacucaaaucaag

SEQ ID NO: 2994724 - RNA, 14 nt, Human
uacacuccagugag

SEQ ID NO: 2994725 - RNA, 21 nt, Human
uacacugugcugagucugaag

SEQ ID NO: 2994726 - RNA, 12 nt, Human
uacaaauguuuu

SEQ ID NO: 2994727 - RNA, 11 nt, Human
uacacacacac

SEQ ID NO: 2994728 - RNA, 19 nt, Human
uagaauguuuucaaauguu

SEQ ID NO: 2994729 - RNA, 23 nt, Human
uagaauuaguggcacuugcuuuu

SEQ ID NO: 2994730 - RNA, 18 nt, Human
uagaauuaacacaugauc

SEQ ID NO: 2994731 - RNA, 16 nt, Human
uagaauuaacacauga

SEQ ID NO: 2994732 - RNA, 15 nt, Human
uagaauuaacacaug

SEQ ID NO: 2994733 - RNA, 18 nt, Human
uagaauguuuucaaaugu

SEQ ID NO: 2994734 - RNA, 12 nt, Human
uacuuuaaacua

SEQ ID NO: 2994735 - RNA, 20 nt, Human
uagaagucuuagauguauau

SEQ ID NO: 2994736 - RNA, 23 nt, Human
uagaauaccacaggaaccacaag

SEQ ID NO: 2994737 - RNA, 20 nt, Human
uagaaguucuaguguuuuca

SEQ ID NO: 2994738 - RNA, 22 nt, Human
uagaaguucuaguguuuucaau

SEQ ID NO: 2994739 - RNA, 22 nt, Human
uagaauaggcacuuuaaaacac

SEQ ID NO: 2994740 - RNA, 16 nt, Human
uagaauaggcacuuua

SEQ ID NO: 2994741 - RNA, 19 nt, Human
uagacccucaugcugccaa

SEQ ID NO: 2994742 - RNA, 17 nt, Human
uagacccucaugcugcc

SEQ ID NO: 2994743 - RNA, 18 nt, Human
uagacccucaugcugcca

SEQ ID NO: 2994744 - RNA, 15 nt, Human
uagagguucaaagau

SEQ ID NO: 2994745 - RNA, 14 nt, Human
uagagguucaaaga

SEQ ID NO: 2994746 - RNA, 19 nt, Human
uagagguacacuugugaau

SEQ ID NO: 2994747 - RNA, 17 nt, Human
uagaguugauacuacag

SEQ ID NO: 2994748 - RNA, 14 nt, Human
uagaguugauacua

SEQ ID NO: 2994749 - RNA, 12 nt, Human
uagagugggagc

SEQ ID NO: 2994750 - RNA, 18 nt, Human
uagagugugauguaugug

SEQ ID NO: 2994751 - RNA, 16 nt, Human
uagcaugaagacagag

SEQ ID NO: 2994752 - RNA, 22 nt, Human
uagccgggcgugguggcaggca

SEQ ID NO: 2994753 - RNA, 12 nt, Human
uagcucauucuc

SEQ ID NO: 2994754 - RNA, 21 nt, Human
uagcucaggugucccugcacu

SEQ ID NO: 2994755 - RNA, 20 nt, Human
uagcucaggugucccugcac

SEQ ID NO: 2994756 - RNA, 18 nt, Human
uagccugugccucuggga

SEQ ID NO: 2994757 - RNA, 19 nt, Human
uagcugggacuacaggcac

SEQ ID NO: 2994758 - RNA, 17 nt, Human
uagcugggacuacaggc

SEQ ID NO: 2994759 - RNA, 15 nt, Human
uagcugggacuacag

SEQ ID NO: 2994760 - RNA, 12 nt, Human
uagcugggacua

SEQ ID NO: 2994761 - RNA, 21 nt, Human
uagcagcccucaauugugaaa

SEQ ID NO: 2994762 - RNA, 11 nt, Human
uagcagggaaa

SEQ ID NO: 2994763 - RNA, 19 nt, Human
uagcauacguacacauuuu

SEQ ID NO: 2994764 - RNA, 18 nt, Human
uagcauacguacacauuu

SEQ ID NO: 2994765 - RNA, 17 nt, Human
uagcauacguacacauu

SEQ ID NO: 2994766 - RNA, 16 nt, Human
uagcauacguacacau

SEQ ID NO: 2994767 - RNA, 16 nt, Human
uagcauccuggaauau

SEQ ID NO: 2994768 - RNA, 15 nt, Human
uagcauccuggaaua

SEQ ID NO: 2994769 - RNA, 13 nt, Human
uagcauccuggaa

SEQ ID NO: 2994770 - RNA, 18 nt, Human
uagcauccuggaauaucu

SEQ ID NO: 2994771 - RNA, 14 nt, Human
uagauaggccaugg

SEQ ID NO: 2994772 - RNA, 16 nt, Human
uagauacuguaucaug

SEQ ID NO: 2994773 - RNA, 17 nt, Human
uaguagagguacacuug

SEQ ID NO: 2994774 - RNA, 21 nt, Human
uaguagagguacacuugugaa

SEQ ID NO: 2994775 - RNA, 20 nt, Human
uaguagagguacacuuguga

SEQ ID NO: 2994776 - RNA, 22 nt, Human
uaguagagguacacuugugaau

SEQ ID NO: 2994777 - RNA, 18 nt, Human
uaguaugaggcauuuguu

SEQ ID NO: 2994778 - RNA, 17 nt, Human
uaguaugaggcauuugu

SEQ ID NO: 2994779 - RNA, 23 nt, Human
uaggugugacugaauuucuuuug

SEQ ID NO: 2994780 - RNA, 21 nt, Human
uaggugugacugaauuucuuu

SEQ ID NO: 2994781 - RNA, 19 nt, Human
uaggugugacugaauuucu

SEQ ID NO: 2994782 - RNA, 13 nt, Human
uagguguggggga

SEQ ID NO: 2994783 - RNA, 17 nt, Human
uaggugugggggaagca

SEQ ID NO: 2994784 - RNA, 20 nt, Human
uaggugcuacaaaaacacag

SEQ ID NO: 2994785 - RNA, 22 nt, Human
uaggugcuacaaaaacacagca

SEQ ID NO: 2994786 - RNA, 23 nt, Human
uaggugcuacaaaaacacagcaa

SEQ ID NO: 2994787 - RNA, 18 nt, Human
uaggugcuacaaaaacac

SEQ ID NO: 2994788 - RNA, 16 nt, Human
uaggugacagagugag

SEQ ID NO: 2994789 - RNA, 11 nt, Human
uaggugacaga

SEQ ID NO: 2994790 - RNA, 22 nt, Human
uagcuggucuuauuuguaaagc

SEQ ID NO: 2994791 - RNA, 14 nt, Human
uauaaacuuuaccu

SEQ ID NO: 2994792 - RNA, 13 nt, Human
uauaaacuuuacc

SEQ ID NO: 2994793 - RNA, 11 nt, Human
uauaaacuuua

SEQ ID NO: 2994794 - RNA, 18 nt, Human
uauaaaccgaacugaugu

SEQ ID NO: 2994795 - RNA, 16 nt, Human
uauaaacuuuaccuuu

SEQ ID NO: 2994796 - RNA, 15 nt, Human
uauaaacuuuaccuu

SEQ ID NO: 2994797 - RNA, 17 nt, Human
uauaaacuuuaccuuuu

SEQ ID NO: 2994798 - RNA, 16 nt, Human
uaguuugauuaaauuc

SEQ ID NO: 2994799 - RNA, 15 nt, Human
uaguuugauuaaauu

SEQ ID NO: 2994800 - RNA, 17 nt, Human
uaguauuguccaggucu

SEQ ID NO: 2994801 - RNA, 15 nt, Human
uaguaugaggcauuu

SEQ ID NO: 2994802 - RNA, 16 nt, Human
uaguaugguggcuggg

SEQ ID NO: 2994803 - RNA, 20 nt, Human
uaguggcuuaaaacaacacu

SEQ ID NO: 2994804 - RNA, 20 nt, Human
uaguuguuugauucagacag

SEQ ID NO: 2994805 - RNA, 21 nt, Human
uaguuguuugauucagacagc

SEQ ID NO: 2994806 - RNA, 22 nt, Human
uaguuguuugauucagacagcu

SEQ ID NO: 2994807 - RNA, 19 nt, Human
uauauaacaaugcuguauu

SEQ ID NO: 2994808 - RNA, 17 nt, Human
uauauaacaaugcugua

SEQ ID NO: 2994809 - RNA, 13 nt, Human
uauauaacaaugc

SEQ ID NO: 2994810 - RNA, 23 nt, Human
uauagaauaggcacuuuaaaaca

SEQ ID NO: 2994811 - RNA, 20 nt, Human
uauagaauaggcacuuuaaa

SEQ ID NO: 2994812 - RNA, 15 nt, Human
uauagaaaaucuuca

SEQ ID NO: 2994813 - RNA, 12 nt, Human
uauagaaaaucu

SEQ ID NO: 2994814 - RNA, 16 nt, Human
uauaugcuucuguuuu

SEQ ID NO: 2994815 - RNA, 14 nt, Human
uauaugcuucuguu

SEQ ID NO: 2994816 - RNA, 20 nt, Human
uauauuugaaauauugacuu

SEQ ID NO: 2994817 - RNA, 20 nt, Human
uauauuuuuuucugaaauuu

SEQ ID NO: 2994818 - RNA, 19 nt, Human
uauauuuuuuucugaaauu

SEQ ID NO: 2994819 - RNA, 16 nt, Human
uauauuuuuuucugaa

SEQ ID NO: 2994820 - RNA, 21 nt, Human
uauauuuuuuguuaaaugauu

SEQ ID NO: 2994821 - RNA, 14 nt, Human
uaucaaaagaaaga

SEQ ID NO: 2994822 - RNA, 19 nt, Human
uaucaggugcugccaucca

SEQ ID NO: 2994823 - RNA, 20 nt, Human
uaucaggugcugccauccag

SEQ ID NO: 2994824 - RNA, 17 nt, Human
uaucaugacaaagacug

SEQ ID NO: 2994825 - RNA, 10 nt, Human
uaacuggaac

SEQ ID NO: 2994826 - RNA, 15 nt, Human
uaacuggaaacuuca

SEQ ID NO: 2994827 - RNA, 14 nt, Human
uaacuuuuuauauu

SEQ ID NO: 2994828 - RNA, 13 nt, Human
uaacuuuuuauau

SEQ ID NO: 2994829 - RNA, 16 nt, Human
uaacuuuuuauauucu

SEQ ID NO: 2994830 - RNA, 15 nt, Human
uaacuuuuuauauuc

SEQ ID NO: 2994831 - RNA, 18 nt, Human
uaagaaaaaggaugcaca

SEQ ID NO: 2994832 - RNA, 16 nt, Human
uaagaaaaaggaugca

SEQ ID NO: 2994833 - RNA, 23 nt, Human
uaagaaaaaggaugcacagaguu

SEQ ID NO: 2994834 - RNA, 19 nt, Human
uaagaaaaaggaugcacag

SEQ ID NO: 2994835 - RNA, 13 nt, Human
uaagagagaauga

SEQ ID NO: 2994836 - RNA, 19 nt, Human
uaagaaccuuuugagugcc

SEQ ID NO: 2994837 - RNA, 14 nt, Human
uaagagagaaugag

SEQ ID NO: 2994838 - RNA, 21 nt, Human
uaagaaaauaucacuugucaa

SEQ ID NO: 2994839 - RNA, 18 nt, Human
uaacucaccuggcaucuu

SEQ ID NO: 2994840 - RNA, 16 nt, Human
uaaccacuucagcuga

SEQ ID NO: 2994841 - RNA, 23 nt, Human
uaaccaguguuguggauuuaaca

SEQ ID NO: 2994842 - RNA, 17 nt, Human
uaaccaggggccaugaa

SEQ ID NO: 2994843 - RNA, 11 nt, Human
uaacagaaaug

SEQ ID NO: 2994844 - RNA, 13 nt, Human
uaaaugcccagcc

SEQ ID NO: 2994845 - RNA, 14 nt, Human
uaaaugcccagccc

SEQ ID NO: 2994846 - RNA, 15 nt, Human
uaaaugcccagcccc

SEQ ID NO: 2994847 - RNA, 16 nt, Human
uaaaugcccagccccu

SEQ ID NO: 2994848 - RNA, 17 nt, Human
uaaaugcccagccccuu

SEQ ID NO: 2994849 - RNA, 16 nt, Human
uaaauggaaccacucu

SEQ ID NO: 2994850 - RNA, 17 nt, Human
uaaaugggggugcauuu

SEQ ID NO: 2994851 - RNA, 14 nt, Human
uaaaugggggugca

SEQ ID NO: 2994852 - RNA, 20 nt, Human
uaaauggcuuccuggcaaua

SEQ ID NO: 2994853 - RNA, 19 nt, Human
uaaaugggggugcauuuga

SEQ ID NO: 2994854 - RNA, 18 nt, Human
uaaaugggggugcauuug

SEQ ID NO: 2994855 - RNA, 20 nt, Human
uaaaugucuaguuguaacac

SEQ ID NO: 2994856 - RNA, 22 nt, Human
uaaaugucucuuuaaugucaca

SEQ ID NO: 2994857 - RNA, 18 nt, Human
uaacaccaugauuaacca

SEQ ID NO: 2994858 - RNA, 20 nt, Human
uaaauugacacuuaaaaaug

SEQ ID NO: 2994859 - RNA, 13 nt, Human
uaaauucuuucau

SEQ ID NO: 2994860 - RNA, 22 nt, Human
uaaauuuaguauuuuguuucag

SEQ ID NO: 2994861 - RNA, 16 nt, Human
uaaauucuugcaaagu

SEQ ID NO: 2994862 - RNA, 18 nt, Human
uaaauucuugcaaaguau

SEQ ID NO: 2994863 - RNA, 17 nt, Human
uaaauucuugcaaagua

SEQ ID NO: 2994864 - RNA, 22 nt, Human
uaaauucuugcaaaguaucccu

SEQ ID NO: 2994865 - RNA, 11 nt, Human
uaaauuauuuu

SEQ ID NO: 2994866 - RNA, 16 nt, Human
uaaaugugccuucauu

SEQ ID NO: 2994867 - RNA, 15 nt, Human
uaauauggaucugua

SEQ ID NO: 2994868 - RNA, 19 nt, Human
uaauaugcacacauuuuuu

SEQ ID NO: 2994869 - RNA, 18 nt, Human
uaauaugcacacauuuuu

SEQ ID NO: 2994870 - RNA, 17 nt, Human
uaauaugcacacauuuu

SEQ ID NO: 2994871 - RNA, 16 nt, Human
uaauaugcacacauuu

SEQ ID NO: 2994872 - RNA, 15 nt, Human
uaauaugcacacauu

SEQ ID NO: 2994873 - RNA, 15 nt, Human
uaauaugaugacugu

SEQ ID NO: 2994874 - RNA, 16 nt, Human
uaauaugcaaagucua

SEQ ID NO: 2994875 - RNA, 15 nt, Human
uaauaugcaaagucu

SEQ ID NO: 2994876 - RNA, 13 nt, Human
uaaucuaaaugga

SEQ ID NO: 2994877 - RNA, 12 nt, Human
uaaucuaaaugg

SEQ ID NO: 2994878 - RNA, 20 nt, Human
uaauccucuaggaggucucu

SEQ ID NO: 2994879 - RNA, 20 nt, Human
uaauauuaaggaagacaaug

SEQ ID NO: 2994880 - RNA, 19 nt, Human
uaaugcuugcugcugauuu

SEQ ID NO: 2994881 - RNA, 15 nt, Human
uaauggggcggugag

SEQ ID NO: 2994882 - RNA, 22 nt, Human
uaaugauaacuggaaacuucag

SEQ ID NO: 2994883 - RNA, 17 nt, Human
uaaugauaacuggaaac

SEQ ID NO: 2994884 - RNA, 15 nt, Human
uaaugcgugcauacc

SEQ ID NO: 2994885 - RNA, 22 nt, Human
uaaugcgugcauaccacuuuug

SEQ ID NO: 2994886 - RNA, 19 nt, Human
uaaugcgugcauaccacuu

SEQ ID NO: 2994887 - RNA, 23 nt, Human
uaaugcgugcauaccacuuuugu

SEQ ID NO: 2994888 - RNA, 22 nt, Human
uaauguuucaaacauauauaac

SEQ ID NO: 2994889 - RNA, 17 nt, Human
uaauuaaguacuaugua

SEQ ID NO: 2994890 - RNA, 14 nt, Human
uaauuaaguacuau

SEQ ID NO: 2994891 - RNA, 20 nt, Human
uaauuaaguacuauguauca

SEQ ID NO: 2994892 - RNA, 13 nt, Human
uaagugaaauaag

SEQ ID NO: 2994893 - RNA, 14 nt, Human
uaagucugauuuaa

SEQ ID NO: 2994894 - RNA, 14 nt, Human
uaagugcugcauuu

SEQ ID NO: 2994895 - RNA, 12 nt, Human
uaagugagagag

SEQ ID NO: 2994896 - RNA, 23 nt, Human
uaagugaggaugaaaaaauaaca

SEQ ID NO: 2994897 - RNA, 20 nt, Human
uaauaaauauguuucacaca

SEQ ID NO: 2994898 - RNA, 13 nt, Human
uaauaaauauguu

SEQ ID NO: 2994899 - RNA, 22 nt, Human
uaagugcugcauuuaaaagaua

SEQ ID NO: 2994900 - RNA, 18 nt, Human
uaagugcugcauuuaaaa

SEQ ID NO: 2994901 - RNA, 16 nt, Human
uaagugcugcauuuaa

SEQ ID NO: 2994902 - RNA, 15 nt, Human
uaagugcugcauuua

SEQ ID NO: 2994903 - RNA, 14 nt, Human
uaaguguauuuuga

SEQ ID NO: 2994904 - RNA, 17 nt, Human
uaaggguaucuggugac

SEQ ID NO: 2994905 - RNA, 15 nt, Human
uaaggugugcucuga

SEQ ID NO: 2994906 - RNA, 20 nt, Human
uaagguggguacgggagggu

SEQ ID NO: 2994907 - RNA, 15 nt, Human
uaagaggcagggucu

SEQ ID NO: 2994908 - RNA, 12 nt, Human
uaagaggcaggg

SEQ ID NO: 2994909 - RNA, 14 nt, Human
uaagcuacugccau

SEQ ID NO: 2994910 - RNA, 16 nt, Human
uaagcuacugccaucc

SEQ ID NO: 2994911 - RNA, 15 nt, Human
uaagcuacugccauc

SEQ ID NO: 2994912 - RNA, 18 nt, Human
uaagcuacugccauccug

SEQ ID NO: 2994913 - RNA, 16 nt, Human
uaaggauguucuagca

SEQ ID NO: 2994914 - RNA, 22 nt, Human
uaaacaugcuguacauacuuuu

SEQ ID NO: 2994915 - RNA, 21 nt, Human
uaaacaugcuguacauacuuu

SEQ ID NO: 2994916 - RNA, 23 nt, Human
uaaacaugcuguacauacuuuuu

SEQ ID NO: 2994917 - RNA, 22 nt, Human
uaaacuugguuuuuaaaaaacu

SEQ ID NO: 2994918 - RNA, 22 nt, Human
uaaacacauuaaagguacuuug

SEQ ID NO: 2994919 - RNA, 19 nt, Human
uaaacaugcuguacauacu

SEQ ID NO: 2994920 - RNA, 20 nt, Human
uaaacaugcuguacauacuu

SEQ ID NO: 2994921 - RNA, 19 nt, Human
uaaacaagaccacguuucu

SEQ ID NO: 2994922 - RNA, 20 nt, Human
uaaacaagaccacguuucua

SEQ ID NO: 2994923 - RNA, 22 nt, Human
uaaacaagaccacguuucuaaa

SEQ ID NO: 2994924 - RNA, 21 nt, Human
uaaacaagaccacguuucuaa

SEQ ID NO: 2994925 - RNA, 19 nt, Human
uaaagcagcguuucuauga

SEQ ID NO: 2994926 - RNA, 17 nt, Human
uaaagcagcguuucuau

SEQ ID NO: 2994927 - RNA, 16 nt, Human
uaaagcagcguuucua

SEQ ID NO: 2994928 - RNA, 12 nt, Human
uaaagaaaacug

SEQ ID NO: 2994929 - RNA, 15 nt, Human
uaaaggcuaccuuug

SEQ ID NO: 2994930 - RNA, 20 nt, Human
uaaagccugaguuugcuuuc

SEQ ID NO: 2994931 - RNA, 14 nt, Human
uaaaguguuugaaa

SEQ ID NO: 2994932 - RNA, 17 nt, Human
uaaaggcuaccuuugua

SEQ ID NO: 2994933 - RNA, 18 nt, Human
uaaaaggaagcuuacaug

SEQ ID NO: 2994934 - RNA, 21 nt, Human
uaaaaggaagcuuacaugccu

SEQ ID NO: 2994935 - RNA, 12 nt, Human
uaaaaggagcca

SEQ ID NO: 2994936 - RNA, 21 nt, Human
uaaaagguaugcaaucaaauc

SEQ ID NO: 2994937 - RNA, 18 nt, Human
uaaaaucauuucugcauc

SEQ ID NO: 2994938 - RNA, 22 nt, Human
uaaaaucauuucugcaucagcu

SEQ ID NO: 2994939 - RNA, 17 nt, Human
uaaaauccauacauuug

SEQ ID NO: 2994940 - RNA, 15 nt, Human
uaaaauccauacauu

SEQ ID NO: 2994941 - RNA, 10 nt, Human
uaaaaucauu

SEQ ID NO: 2994942 - RNA, 13 nt, Human
uaaaaucauuucu

SEQ ID NO: 2994943 - RNA, 12 nt, Human
uaaaaggugacc

SEQ ID NO: 2994944 - RNA, 20 nt, Human
uaaaagauacaguuacucag

SEQ ID NO: 2994945 - RNA, 17 nt, Human
uaaaagauacaguuacu

SEQ ID NO: 2994946 - RNA, 14 nt, Human
uaaaagauacaguu

SEQ ID NO: 2994947 - RNA, 21 nt, Human
uaaaagauacaguuacucaga

SEQ ID NO: 2994948 - RNA, 18 nt, Human
uaaaaaugguuuaaaugg

SEQ ID NO: 2994949 - RNA, 15 nt, Human
uaaaaaugguuuaaa

SEQ ID NO: 2994950 - RNA, 19 nt, Human
uaaaaaugguuuaaauggu

SEQ ID NO: 2994951 - RNA, 18 nt, Human
uaaaaacaacgaaagaag

SEQ ID NO: 2994952 - RNA, 22 nt, Human
uaaaacaagcacuaaacaaaga

SEQ ID NO: 2994953 - RNA, 15 nt, Human
uaaaacaacacucac

SEQ ID NO: 2994954 - RNA, 19 nt, Human
uaaaacaacagauguacga

SEQ ID NO: 2994955 - RNA, 16 nt, Human
uaaaacaacagaugua

SEQ ID NO: 2994956 - RNA, 22 nt, Human
uaaaacacaacaucuuuuucua

SEQ ID NO: 2994957 - RNA, 23 nt, Human
uaaaacacaacaucuuuuucuac

SEQ ID NO: 2994958 - RNA, 17 nt, Human
uaaaacacaacaucuuu

SEQ ID NO: 2994959 - RNA, 20 nt, Human
guuuuccagguuuaagcugu

SEQ ID NO: 2994960 - RNA, 19 nt, Human
guuuuccaugaguccccug

SEQ ID NO: 2994961 - RNA, 20 nt, Human
guuuuccaugaguccccugu

SEQ ID NO: 2994962 - RNA, 13 nt, Human
guuuuccugaaga

SEQ ID NO: 2994963 - RNA, 20 nt, Human
guuuguuucugaaagggacg

SEQ ID NO: 2994964 - RNA, 17 nt, Human
guuuucaaaauaaaaau

SEQ ID NO: 2994965 - RNA, 12 nt, Human
guuuucacucuu

SEQ ID NO: 2994966 - RNA, 11 nt, Human
guuuucacucu

SEQ ID NO: 2994967 - RNA, 18 nt, Human
guuuucaauuuuaaacau

SEQ ID NO: 2994968 - RNA, 20 nt, Human
guuuucaauuuuaaacauau

SEQ ID NO: 2994969 - RNA, 18 nt, Human
guuuguuucugaaaggga

SEQ ID NO: 2994970 - RNA, 16 nt, Human
guuugauucagacagc

SEQ ID NO: 2994971 - RNA, 20 nt, Human
guuugauucagacagcugcc

SEQ ID NO: 2994972 - RNA, 21 nt, Human
guuugauucagacagcugccu

SEQ ID NO: 2994973 - RNA, 18 nt, Human
guuuggggaugagaaagg

SEQ ID NO: 2994974 - RNA, 20 nt, Human
guuuguaaauuaacuuuuau

SEQ ID NO: 2994975 - RNA, 23 nt, Human
guuugauuaaauucuugcaaagu

SEQ ID NO: 2994976 - RNA, 17 nt, Human
guuugagaucagccugg

SEQ ID NO: 2994977 - RNA, 16 nt, Human
guuugacggcaagguu

SEQ ID NO: 2994978 - RNA, 12 nt, Human
guuggcuggggg

SEQ ID NO: 2994979 - RNA, 14 nt, Human
guuggccccugccc

SEQ ID NO: 2994980 - RNA, 13 nt, Human
guuggccccugcc

SEQ ID NO: 2994981 - RNA, 20 nt, Human
guuggccccugcccggcugc

SEQ ID NO: 2994982 - RNA, 19 nt, Human
guuggcugggggccucagu

SEQ ID NO: 2994983 - RNA, 12 nt, Human
guugucagcuga

SEQ ID NO: 2994984 - RNA, 22 nt, Human
guuguggauuuaacagaaaugu

SEQ ID NO: 2994985 - RNA, 14 nt, Human
guugugguuaaucu

SEQ ID NO: 2994986 - RNA, 19 nt, Human
guugucugcaacucugaag

SEQ ID NO: 2994987 - RNA, 21 nt, Human
guuuagcuggaaaaguauguu

SEQ ID NO: 2994988 - RNA, 20 nt, Human
guuuagcuggaaaaguaugu

SEQ ID NO: 2994989 - RNA, 20 nt, Human
guuuauauaagcuuguauuc

SEQ ID NO: 2994990 - RNA, 15 nt, Human
guuguuacauuuuua

SEQ ID NO: 2994991 - RNA, 14 nt, Human
guuguuacauuuuu

SEQ ID NO: 2994992 - RNA, 19 nt, Human
guuguucugaaaugucagu

SEQ ID NO: 2994993 - RNA, 15 nt, Human
guuuagauaauacac

SEQ ID NO: 2994994 - RNA, 14 nt, Human
guuuagauaauaca

SEQ ID NO: 2994995 - RNA, 17 nt, Human
guuuagaaagcuugccc

SEQ ID NO: 2994996 - RNA, 15 nt, Human
guggguggggcagug

SEQ ID NO: 2994997 - RNA, 23 nt, Human
guggguuucuaaagcugccagcc

SEQ ID NO: 2994998 - RNA, 14 nt, Human
guggggcagugcuu

SEQ ID NO: 2994999 - RNA, 23 nt, Human
guggggcagugcuuggcccagga

SEQ ID NO: 2995000 - RNA, 17 nt, Human
guggggcagcuugaggg

SEQ ID NO: 2995001 - RNA, 13 nt, Human
guggggcagcuug

SEQ ID NO: 2995002 - RNA, 15 nt, Human
guggggaccucaggc

SEQ ID NO: 2995003 - RNA, 18 nt, Human
guggggaccucaggccug

SEQ ID NO: 2995004 - RNA, 15 nt, Human
gugggcauucaaaug

SEQ ID NO: 2995005 - RNA, 17 nt, Human
gugggcccaaugcacuu

SEQ ID NO: 2995006 - RNA, 15 nt, Human
gugggcuaguugggc

SEQ ID NO: 2995007 - RNA, 14 nt, Human
guggcucacgccug

SEQ ID NO: 2995008 - RNA, 17 nt, Human
guggcuaacuuggguua

SEQ ID NO: 2995009 - RNA, 15 nt, Human
gugcuacaaaaacac

SEQ ID NO: 2995010 - RNA, 20 nt, Human
gugcuacaaaaacacagcaa

SEQ ID NO: 2995011 - RNA, 12 nt, Human
guggcugcuuca

SEQ ID NO: 2995012 - RNA, 14 nt, Human
guggcugcuucaag

SEQ ID NO: 2995013 - RNA, 22 nt, Human
guggcuuaaaacaacacucaca

SEQ ID NO: 2995014 - RNA, 15 nt, Human
guggcugcuucaagg

SEQ ID NO: 2995015 - RNA, 16 nt, Human
guggcugcuucaagga

SEQ ID NO: 2995016 - RNA, 19 nt, Human
guggcugcuucaaggaucc

SEQ ID NO: 2995017 - RNA, 22 nt, Human
guggcugcuucaaggauccuga

SEQ ID NO: 2995018 - RNA, 23 nt, Human
guggcugcuucaaggauccugag

SEQ ID NO: 2995019 - RNA, 19 nt, Human
guggcuggguuggagggug

SEQ ID NO: 2995020 - RNA, 17 nt, Human
guguacauggaauaaca

SEQ ID NO: 2995021 - RNA, 22 nt, Human
guguacauggaauaacauguaa

SEQ ID NO: 2995022 - RNA, 18 nt, Human
gugucccugcacuugcag

SEQ ID NO: 2995023 - RNA, 16 nt, Human
gugucccugcacuugc

SEQ ID NO: 2995024 - RNA, 13 nt, Human
gugucccugcacu

SEQ ID NO: 2995025 - RNA, 19 nt, Human
gugguaugaucacggcuca

SEQ ID NO: 2995026 - RNA, 17 nt, Human
gugguagagugugccug

SEQ ID NO: 2995027 - RNA, 14 nt, Human
guggucccacccca

SEQ ID NO: 2995028 - RNA, 15 nt, Human
guggucccaccccac

SEQ ID NO: 2995029 - RNA, 16 nt, Human
guggucccaccccaca

SEQ ID NO: 2995030 - RNA, 17 nt, Human
guggucccaccccacac

SEQ ID NO: 2995031 - RNA, 18 nt, Human
gugguccuaaucuucuga

SEQ ID NO: 2995032 - RNA, 21 nt, Human
guggugagaggcauccaguau

SEQ ID NO: 2995033 - RNA, 17 nt, Human
guggugaccucugccug

SEQ ID NO: 2995034 - RNA, 14 nt, Human
guggugaccucugc

SEQ ID NO: 2995035 - RNA, 19 nt, Human
guggugcgaucuggguuca

SEQ ID NO: 2995036 - RNA, 17 nt, Human
guguaagacaaaaagcu

SEQ ID NO: 2995037 - RNA, 21 nt, Human
guguaaguauucuuauuuaau

SEQ ID NO: 2995038 - RNA, 21 nt, Human
guguaaguagauaggccaugg

SEQ ID NO: 2995039 - RNA, 14 nt, Human
gugugcguccuguc

SEQ ID NO: 2995040 - RNA, 16 nt, Human
gugugcguccugucgg

SEQ ID NO: 2995041 - RNA, 22 nt, Human
gugugcucugaucauccacugu

SEQ ID NO: 2995042 - RNA, 15 nt, Human
gugugcucugaucau

SEQ ID NO: 2995043 - RNA, 12 nt, Human
gugugcucugau

SEQ ID NO: 2995044 - RNA, 13 nt, Human
guguggagaagcg

SEQ ID NO: 2995045 - RNA, 21 nt, Human
guguggagaagcggcuggcag

SEQ ID NO: 2995046 - RNA, 15 nt, Human
gugucgggcaugaca

SEQ ID NO: 2995047 - RNA, 14 nt, Human
guguccggucccug

SEQ ID NO: 2995048 - RNA, 23 nt, Human
gugucccugcacuugcagacucu

SEQ ID NO: 2995049 - RNA, 14 nt, Human
gugucucuuggucc

SEQ ID NO: 2995050 - RNA, 17 nt, Human
gugucucccuucauccu

SEQ ID NO: 2995051 - RNA, 18 nt, Human
gugucucuugguccugcu

SEQ ID NO: 2995052 - RNA, 19 nt, Human
gugucucuugguccugcug

SEQ ID NO: 2995053 - RNA, 20 nt, Human
gugucucuugguccugcugc

SEQ ID NO: 2995054 - RNA, 21 nt, Human
gugucucuugguccugcugca

SEQ ID NO: 2995055 - RNA, 22 nt, Human
gugucucuugguccugcugcag

SEQ ID NO: 2995056 - RNA, 20 nt, Human
gugugagucaccaagcccag

SEQ ID NO: 2995057 - RNA, 14 nt, Human
guuaaaagaugaaa

SEQ ID NO: 2995058 - RNA, 16 nt, Human
guuaaaagaugaaaau

SEQ ID NO: 2995059 - RNA, 22 nt, Human
guuaaaaagaaaaguuuauaaa

SEQ ID NO: 2995060 - RNA, 14 nt, Human
guuaaaaagaaaag

SEQ ID NO: 2995061 - RNA, 22 nt, Human
guuaaaauaccagccaguaaau

SEQ ID NO: 2995062 - RNA, 20 nt, Human
guuaaaagaugaaaauauuu

SEQ ID NO: 2995063 - RNA, 13 nt, Human
guuacagacaaag

SEQ ID NO: 2995064 - RNA, 16 nt, Human
guuacacuaaaaggug

SEQ ID NO: 2995065 - RNA, 15 nt, Human
guuacacuaaaaggu

SEQ ID NO: 2995066 - RNA, 12 nt, Human
guguuacuaagu

SEQ ID NO: 2995067 - RNA, 14 nt, Human
guguuacuaaguuu

SEQ ID NO: 2995068 - RNA, 18 nt, Human
guguuaugacuccagaau

SEQ ID NO: 2995069 - RNA, 24 nt, Human
guucacuggacacuucacgcccuu

SEQ ID NO: 2995070 - RNA, 14 nt, Human
guucagagcugccc

SEQ ID NO: 2995071 - RNA, 13 nt, Human
guucagagcugcc

SEQ ID NO: 2995072 - RNA, 19 nt, Human
guucagagcugcccucucc

SEQ ID NO: 2995073 - RNA, 17 nt, Human
guucagagcugcccucu

SEQ ID NO: 2995074 - RNA, 16 nt, Human
guucagagcugcccuc

SEQ ID NO: 2995075 - RNA, 15 nt, Human
guucagagcugcccu

SEQ ID NO: 2995076 - RNA, 22 nt, Human
guucagagcugcccucuccugg

SEQ ID NO: 2995077 - RNA, 20 nt, Human
guucagagcugcccucuccu

SEQ ID NO: 2995078 - RNA, 23 nt, Human
guucagagcugcccucuccuggg

SEQ ID NO: 2995079 - RNA, 19 nt, Human
guucacugcaaccuccgcc

SEQ ID NO: 2995080 - RNA, 17 nt, Human
guucaucauccuaagcu

SEQ ID NO: 2995081 - RNA, 16 nt, Human
guucaucaaugaauga

SEQ ID NO: 2995082 - RNA, 12 nt, Human
guucaucuugaa

SEQ ID NO: 2995083 - RNA, 13 nt, Human
guucaucuugaau

SEQ ID NO: 2995084 - RNA, 18 nt, Human
guucaucuugaauuguaa

SEQ ID NO: 2995085 - RNA, 12 nt, Human
guucaugaaaga

SEQ ID NO: 2995086 - RNA, 22 nt, Human
guuccucauuagcauuuugcua

SEQ ID NO: 2995087 - RNA, 14 nt, Human
guuccuaauccucu

SEQ ID NO: 2995088 - RNA, 17 nt, Human
guuccaccaucaagcca

SEQ ID NO: 2995089 - RNA, 20 nt, Human
guuccaccaucaagccacca

SEQ ID NO: 2995090 - RNA, 23 nt, Human
guucaaucuggauucauauuuaa

SEQ ID NO: 2995091 - RNA, 16 nt, Human
guucaauucucauuug

SEQ ID NO: 2995092 - RNA, 23 nt, Human
guucaauucucauuugucacaca

SEQ ID NO: 2995093 - RNA, 20 nt, Human
guucaagcgauucuucugcu

SEQ ID NO: 2995094 - RNA, 19 nt, Human
guuauuaaaaaucucaaau

SEQ ID NO: 2995095 - RNA, 19 nt, Human
guucaagcgauucuucugc

SEQ ID NO: 2995096 - RNA, 21 nt, Human
guuaugacuccagaauuuccc

SEQ ID NO: 2995097 - RNA, 24 nt, Human
guuaguucaaucuggauucauauu

SEQ ID NO: 2995098 - RNA, 22 nt, Human
guuaguuucuccaagcaggaca

SEQ ID NO: 2995099 - RNA, 16 nt, Human
guuaguuucuccaagc

SEQ ID NO: 2995100 - RNA, 19 nt, Human
guuaguuucuccaagcagg

SEQ ID NO: 2995101 - RNA, 21 nt, Human
guuauaacuuaaugaaaacaa

SEQ ID NO: 2995102 - RNA, 17 nt, Human
guuauaacuuaaugaaa

SEQ ID NO: 2995103 - RNA, 14 nt, Human
guuauaacuuaaug

SEQ ID NO: 2995104 - RNA, 22 nt, Human
guuacuaaguuuuuauggcuuu

SEQ ID NO: 2995105 - RNA, 15 nt, Human
guuacucagaauucu

SEQ ID NO: 2995106 - RNA, 23 nt, Human
guuaccucugccucagaaaacaa

SEQ ID NO: 2995107 - RNA, 16 nt, Human
guuacccaaauuaaga

SEQ ID NO: 2995108 - RNA, 23 nt, Human
guuaccauuuugggguacccacu

SEQ ID NO: 2995109 - RNA, 21 nt, Human
guuacauuuuuaagugcugca

SEQ ID NO: 2995110 - RNA, 19 nt, Human
guuacauaagauaaaugug

SEQ ID NO: 2995111 - RNA, 18 nt, Human
guuacauaagauaaaugu

SEQ ID NO: 2995112 - RNA, 15 nt, Human
guuacagacaaagcg

SEQ ID NO: 2995113 - RNA, 17 nt, Human
guuacagacaaagcgug

SEQ ID NO: 2995114 - RNA, 15 nt, Human
guucugaagaagaug

SEQ ID NO: 2995115 - RNA, 14 nt, Human
guucugaagaagau

SEQ ID NO: 2995116 - RNA, 20 nt, Human
guucugaaaugucaguucug

SEQ ID NO: 2995117 - RNA, 13 nt, Human
guucugaagaaga

SEQ ID NO: 2995118 - RNA, 12 nt, Human
guucugaagaag

SEQ ID NO: 2995119 - RNA, 19 nt, Human
guucugauccuaguuccac

SEQ ID NO: 2995120 - RNA, 17 nt, Human
guugaaaagacuccaaa

SEQ ID NO: 2995121 - RNA, 22 nt, Human
guugaaaagacuccaaagaaau

SEQ ID NO: 2995122 - RNA, 23 nt, Human
guugaaaagacuccaaagaaaug

SEQ ID NO: 2995123 - RNA, 17 nt, Human
guugaaaaacagcugag

SEQ ID NO: 2995124 - RNA, 20 nt, Human
guucuuuccaaaguacacug

SEQ ID NO: 2995125 - RNA, 18 nt, Human
guucuuuccaaaguacac

SEQ ID NO: 2995126 - RNA, 14 nt, Human
guucuuuccaaagu

SEQ ID NO: 2995127 - RNA, 13 nt, Human
guucuuuccaaag

SEQ ID NO: 2995128 - RNA, 18 nt, Human
guucuuucacccuuuucu

SEQ ID NO: 2995129 - RNA, 16 nt, Human
guucugggacacaguu

SEQ ID NO: 2995130 - RNA, 15 nt, Human
guucugggacacagu

SEQ ID NO: 2995131 - RNA, 14 nt, Human
guucugggacacag

SEQ ID NO: 2995132 - RNA, 12 nt, Human
guucugggacac

SEQ ID NO: 2995133 - RNA, 11 nt, Human
guucugggaca

SEQ ID NO: 2995134 - RNA, 23 nt, Human
guucuggcagaguugaagacaga

SEQ ID NO: 2995135 - RNA, 16 nt, Human
guucuggcucuuccag

SEQ ID NO: 2995136 - RNA, 20 nt, Human
guucuggcucuuccaggcug

SEQ ID NO: 2995137 - RNA, 12 nt, Human
guucuggcucuu

SEQ ID NO: 2995138 - RNA, 23 nt, Human
guuggccaaagccaaagcuaggc

SEQ ID NO: 2995139 - RNA, 14 nt, Human
guuggcaaaaaggc

SEQ ID NO: 2995140 - RNA, 18 nt, Human
guuggcaaaaaggcagga

SEQ ID NO: 2995141 - RNA, 13 nt, Human
guuggccaggcug

SEQ ID NO: 2995142 - RNA, 14 nt, Human
guuggccaggcugg

SEQ ID NO: 2995143 - RNA, 15 nt, Human
guuggccaggcuggu

SEQ ID NO: 2995144 - RNA, 14 nt, Human
guuggccaguguga

SEQ ID NO: 2995145 - RNA, 19 nt, Human
guuggccaggcuggucuca

SEQ ID NO: 2995146 - RNA, 17 nt, Human
guuggccaggcuggucu

SEQ ID NO: 2995147 - RNA, 14 nt, Human
guugcccaggcagg

SEQ ID NO: 2995148 - RNA, 12 nt, Human
guugcccaggca

SEQ ID NO: 2995149 - RNA, 16 nt, Human
guugccagucaccccg

SEQ ID NO: 2995150 - RNA, 17 nt, Human
guugccagucaccccgg

SEQ ID NO: 2995151 - RNA, 18 nt, Human
guugccagucaccccggc

SEQ ID NO: 2995152 - RNA, 23 nt, Human
guugccagucaccccggccaccu

SEQ ID NO: 2995153 - RNA, 13 nt, Human
guugccagucacc

SEQ ID NO: 2995154 - RNA, 14 nt, Human
guugccagucaccc

SEQ ID NO: 2995155 - RNA, 15 nt, Human
guugcaggaccucag

SEQ ID NO: 2995156 - RNA, 20 nt, Human
guugauggugguauguuuuc

SEQ ID NO: 2995157 - RNA, 21 nt, Human
guugauggugguauguuuuca

SEQ ID NO: 2995158 - RNA, 12 nt, Human
guugaaacauau

SEQ ID NO: 2995159 - RNA, 16 nt, Human
guugaagacagagcua

SEQ ID NO: 2995160 - RNA, 18 nt, Human
guugaagagguuuuaaag

SEQ ID NO: 2995161 - RNA, 17 nt, Human
gucugucuuuuaaacuc

SEQ ID NO: 2995162 - RNA, 21 nt, Human
gucugugagaugcuagaacuc

SEQ ID NO: 2995163 - RNA, 17 nt, Human
gucugugagaugcuaga

SEQ ID NO: 2995164 - RNA, 16 nt, Human
gucugugagaugcuag

SEQ ID NO: 2995165 - RNA, 15 nt, Human
gucugugagaugcua

SEQ ID NO: 2995166 - RNA, 23 nt, Human
gucugugagaugcuagaacuccc

SEQ ID NO: 2995167 - RNA, 22 nt, Human
gucugugagaugcuagaacucc

SEQ ID NO: 2995168 - RNA, 18 nt, Human
gucugugccauuuuguau

SEQ ID NO: 2995169 - RNA, 14 nt, Human
gucuguuuugugua

SEQ ID NO: 2995170 - RNA, 17 nt, Human
gucuguucuuuccaaag

SEQ ID NO: 2995171 - RNA, 14 nt, Human
gucuguucuuucca

SEQ ID NO: 2995172 - RNA, 15 nt, Human
gucuguuuuguguac

SEQ ID NO: 2995173 - RNA, 20 nt, Human
gucuguuuuguguacuuuua

SEQ ID NO: 2995174 - RNA, 21 nt, Human
gucuuaaaaaguggaaaaaua

SEQ ID NO: 2995175 - RNA, 17 nt, Human
gucuugaacuccuggcc

SEQ ID NO: 2995176 - RNA, 16 nt, Human
gucuugaacuccuggc

SEQ ID NO: 2995177 - RNA, 19 nt, Human
gucuugcaauggcagccuu

SEQ ID NO: 2995178 - RNA, 18 nt, Human
gucuugcaauggcagccu

SEQ ID NO: 2995179 - RNA, 17 nt, Human
gucuugcaauggcagcc

SEQ ID NO: 2995180 - RNA, 16 nt, Human
gucuugcaauggcagc

SEQ ID NO: 2995181 - RNA, 20 nt, Human
gucuugaacuccuggccuca

SEQ ID NO: 2995182 - RNA, 18 nt, Human
gucuugaacuccuggccu

SEQ ID NO: 2995183 - RNA, 21 nt, Human
gucuugaacuccuggccucaa

SEQ ID NO: 2995184 - RNA, 21 nt, Human
gucuugcaauggcagccuugg

SEQ ID NO: 2995185 - RNA, 20 nt, Human
gucuugcaauggcagccuug

SEQ ID NO: 2995186 - RNA, 23 nt, Human
gucuugcaauggcagccuuggca

SEQ ID NO: 2995187 - RNA, 16 nt, Human
gucuuuuuucacuaca

SEQ ID NO: 2995188 - RNA, 12 nt, Human
gucggagcccug

SEQ ID NO: 2995189 - RNA, 21 nt, Human
gucggaaaacaugcuacacac

SEQ ID NO: 2995190 - RNA, 16 nt, Human
gucggagcccugucuc

SEQ ID NO: 2995191 - RNA, 15 nt, Human
gucggccccaccagu

SEQ ID NO: 2995192 - RNA, 22 nt, Human
gucggccccaccagugccucuc

SEQ ID NO: 2995193 - RNA, 19 nt, Human
gucggccccaccagugccu

SEQ ID NO: 2995194 - RNA, 17 nt, Human
gucggccccaccagugc

SEQ ID NO: 2995195 - RNA, 16 nt, Human
gucgggcaugacacga

SEQ ID NO: 2995196 - RNA, 23 nt, Human
gucggguuuuauuguuuaaaauc

SEQ ID NO: 2995197 - RNA, 21 nt, Human
guccuuaccagcagagcaccu

SEQ ID NO: 2995198 - RNA, 18 nt, Human
guccuuaccagcagagca

SEQ ID NO: 2995199 - RNA, 19 nt, Human
guccuuaccagcagagcac

SEQ ID NO: 2995200 - RNA, 11 nt, Human
gucccugccaa

SEQ ID NO: 2995201 - RNA, 14 nt, Human
gucccugccaaugg

SEQ ID NO: 2995202 - RNA, 15 nt, Human
gucccugccaaugga

SEQ ID NO: 2995203 - RNA, 18 nt, Human
gucgucaaagcugaaaug

SEQ ID NO: 2995204 - RNA, 19 nt, Human
gucucacuauguugcccag

SEQ ID NO: 2995205 - RNA, 11 nt, Human
gucucacucug

SEQ ID NO: 2995206 - RNA, 18 nt, Human
gucucacuauguugccca

SEQ ID NO: 2995207 - RNA, 13 nt, Human
gucugacuguuuc

SEQ ID NO: 2995208 - RNA, 22 nt, Human
gucucacucugucgcccagucu

SEQ ID NO: 2995209 - RNA, 19 nt, Human
gucucacucugucgcccag

SEQ ID NO: 2995210 - RNA, 18 nt, Human
gucucacucugucgccca

SEQ ID NO: 2995211 - RNA, 16 nt, Human
gucucacucugucgcc

SEQ ID NO: 2995212 - RNA, 15 nt, Human
gucucacucugucgc

SEQ ID NO: 2995213 - RNA, 13 nt, Human
gugcguccugucg

SEQ ID NO: 2995214 - RNA, 13 nt, Human
gugcgggguacac

SEQ ID NO: 2995215 - RNA, 14 nt, Human
gugcggccuuuggc

SEQ ID NO: 2995216 - RNA, 14 nt, Human
gugcgccuacagga

SEQ ID NO: 2995217 - RNA, 16 nt, Human
gugccaugugccaggu

SEQ ID NO: 2995218 - RNA, 14 nt, Human
gugccaugugccag

SEQ ID NO: 2995219 - RNA, 21 nt, Human
gugcgaucuggguucacugca

SEQ ID NO: 2995220 - RNA, 23 nt, Human
gugcaguggugcgaucuggguuc

SEQ ID NO: 2995221 - RNA, 20 nt, Human
gugcaguggugcgaucuggg

SEQ ID NO: 2995222 - RNA, 22 nt, Human
gugcauaccacuuuuguucuug

SEQ ID NO: 2995223 - RNA, 18 nt, Human
gugauuuuuguaauuuuu

SEQ ID NO: 2995224 - RNA, 13 nt, Human
gugauuuuuguaa

SEQ ID NO: 2995225 - RNA, 24 nt, Human
gugauccacccaccucagccuccc

SEQ ID NO: 2995226 - RNA, 23 nt, Human
gugauccacccaccucagccucc

SEQ ID NO: 2995227 - RNA, 22 nt, Human
gugcacuaauguguaagacaaa

SEQ ID NO: 2995228 - RNA, 22 nt, Human
gugauccacccaccucagccuc

SEQ ID NO: 2995229 - RNA, 17 nt, Human
gugaguugauagcacag

SEQ ID NO: 2995230 - RNA, 15 nt, Human
gugauacaaugcugu

SEQ ID NO: 2995231 - RNA, 17 nt, Human
gugauacaaugcugugc

SEQ ID NO: 2995232 - RNA, 19 nt, Human
gugagccgagaucacgcca

SEQ ID NO: 2995233 - RNA, 17 nt, Human
gugaggaugaaaaaaua

SEQ ID NO: 2995234 - RNA, 20 nt, Human
gugagccacugcaccgggcc

SEQ ID NO: 2995235 - RNA, 15 nt, Human
gugagccacugcacc

SEQ ID NO: 2995236 - RNA, 14 nt, Human
gugagccacugcac

SEQ ID NO: 2995237 - RNA, 14 nt, Human
gugacagaggcagc

SEQ ID NO: 2995238 - RNA, 13 nt, Human
gugacagaggcag

SEQ ID NO: 2995239 - RNA, 12 nt, Human
gugacagaggca

SEQ ID NO: 2995240 - RNA, 14 nt, Human
gugaccucugccug

SEQ ID NO: 2995241 - RNA, 13 nt, Human
gugaccucugccu

SEQ ID NO: 2995242 - RNA, 15 nt, Human
gugacagaggcagcc

SEQ ID NO: 2995243 - RNA, 12 nt, Human
gugaccucugcc

SEQ ID NO: 2995244 - RNA, 16 nt, Human
gugacaagcucacaga

SEQ ID NO: 2995245 - RNA, 20 nt, Human
gugacaaggauugcuacugu

SEQ ID NO: 2995246 - RNA, 21 nt, Human
gugaaugaugauccuaggcau

SEQ ID NO: 2995247 - RNA, 21 nt, Human
gugaacaaauuuacagagaca

SEQ ID NO: 2995248 - RNA, 13 nt, Human
gugaacacaucag

SEQ ID NO: 2995249 - RNA, 15 nt, Human
guauagauguugcua

SEQ ID NO: 2995250 - RNA, 16 nt, Human
guauagauguugcuaa

SEQ ID NO: 2995251 - RNA, 21 nt, Human
guauagaauaggcacuuuaaa

SEQ ID NO: 2995252 - RNA, 15 nt, Human
guauagaauaggcac

SEQ ID NO: 2995253 - RNA, 14 nt, Human
guauagaaaaucuu

SEQ ID NO: 2995254 - RNA, 22 nt, Human
guauaugucaagccauaauugu

SEQ ID NO: 2995255 - RNA, 23 nt, Human
guauauguagauguaugcacaca

SEQ ID NO: 2995256 - RNA, 20 nt, Human
guauguuuuauauagcaaga

SEQ ID NO: 2995257 - RNA, 17 nt, Human
guauguuagugcaaauu

SEQ ID NO: 2995258 - RNA, 21 nt, Human
guaugaucacggcucacugca

SEQ ID NO: 2995259 - RNA, 20 nt, Human
guaugaggcauuuguuugaa

SEQ ID NO: 2995260 - RNA, 17 nt, Human
guaugaggcauuuguuu

SEQ ID NO: 2995261 - RNA, 20 nt, Human
guaugaucacggcucacugc

SEQ ID NO: 2995262 - RNA, 15 nt, Human
guaugaggcauuugu

SEQ ID NO: 2995263 - RNA, 13 nt, Human
guaugaggcauuu

SEQ ID NO: 2995264 - RNA, 12 nt, Human
guaucugagcag

SEQ ID NO: 2995265 - RNA, 12 nt, Human
guaucuggugac

SEQ ID NO: 2995266 - RNA, 19 nt, Human
guaucuggugacuuuccuc

SEQ ID NO: 2995267 - RNA, 15 nt, Human
guaguguuggagaag

SEQ ID NO: 2995268 - RNA, 14 nt, Human
guaguguuggagaa

SEQ ID NO: 2995269 - RNA, 13 nt, Human
guagugagccgag

SEQ ID NO: 2995270 - RNA, 14 nt, Human
guagucaggugccu

SEQ ID NO: 2995271 - RNA, 16 nt, Human
guaggguuauaauaau

SEQ ID NO: 2995272 - RNA, 15 nt, Human
guagagugugccuga

SEQ ID NO: 2995273 - RNA, 18 nt, Human
gcuauaggugcuacaaaa

SEQ ID NO: 2995274 - RNA, 17 nt, Human
guagauguaugcacaca

SEQ ID NO: 2995275 - RNA, 20 nt, Human
guagauguaugcacacacau

SEQ ID NO: 2995276 - RNA, 16 nt, Human
guagcauccuggaaua

SEQ ID NO: 2995277 - RNA, 21 nt, Human
guagcauuuguguugaagagg

SEQ ID NO: 2995278 - RNA, 15 nt, Human
guagcauuuuaaaca

SEQ ID NO: 2995279 - RNA, 13 nt, Human
guagcauuuuaaa

SEQ ID NO: 2995280 - RNA, 22 nt, Human
guagggcgggaggauguucugg

SEQ ID NO: 2995281 - RNA, 21 nt, Human
guagggcgggaggauguucug

SEQ ID NO: 2995282 - RNA, 23 nt, Human
guagggcgggaggauguucuggg

SEQ ID NO: 2995283 - RNA, 16 nt, Human
guagggcgggaggaug

SEQ ID NO: 2995284 - RNA, 21 nt, Human
guaggcuauuccugagagcug

SEQ ID NO: 2995285 - RNA, 16 nt, Human
gucaaggcuuagaccc

SEQ ID NO: 2995286 - RNA, 18 nt, Human
gucaaggcuuagacccuc

SEQ ID NO: 2995287 - RNA, 19 nt, Human
guauuuuguuuuugucuua

SEQ ID NO: 2995288 - RNA, 20 nt, Human
gucaaggcuuagacccucau

SEQ ID NO: 2995289 - RNA, 14 nt, Human
gucaaggcuuagac

SEQ ID NO: 2995290 - RNA, 15 nt, Human
gucaagugaaaaagg

SEQ ID NO: 2995291 - RNA, 22 nt, Human
gucaauaaaauccauacauuug

SEQ ID NO: 2995292 - RNA, 23 nt, Human
gucaauaaaauccauacauuugu

SEQ ID NO: 2995293 - RNA, 15 nt, Human
gucaaugcagccccc

SEQ ID NO: 2995294 - RNA, 15 nt, Human
gucaccccggccacc

SEQ ID NO: 2995295 - RNA, 22 nt, Human
guauuuucuccaaauguucacu

SEQ ID NO: 2995296 - RNA, 13 nt, Human
guauuuugaaauu

SEQ ID NO: 2995297 - RNA, 14 nt, Human
guauuuuacuaaua

SEQ ID NO: 2995298 - RNA, 20 nt, Human
guauuuuaaaagaaugauua

SEQ ID NO: 2995299 - RNA, 13 nt, Human
guauuuuaaucac

SEQ ID NO: 2995300 - RNA, 18 nt, Human
guauuuuaaaagaaugau

SEQ ID NO: 2995301 - RNA, 19 nt, Human
gucagcuccccucggagaa

SEQ ID NO: 2995302 - RNA, 16 nt, Human
gucagagccugcaguu

SEQ ID NO: 2995303 - RNA, 15 nt, Human
gucagagccugcagu

SEQ ID NO: 2995304 - RNA, 14 nt, Human
gucagagccugcag

SEQ ID NO: 2995305 - RNA, 12 nt, Human
gucacucuggca

SEQ ID NO: 2995306 - RNA, 13 nt, Human
gucacucuggcag

SEQ ID NO: 2995307 - RNA, 14 nt, Human
gucacucuggcagc

SEQ ID NO: 2995308 - RNA, 16 nt, Human
gucacucuggcagcuc

SEQ ID NO: 2995309 - RNA, 17 nt, Human
gucacucuggcagcuca

SEQ ID NO: 2995310 - RNA, 19 nt, Human
gucacucuggcagcucaga

SEQ ID NO: 2995311 - RNA, 17 nt, Human
gucaccccggccaccug

SEQ ID NO: 2995312 - RNA, 18 nt, Human
gucaccccggccaccugc

SEQ ID NO: 2995313 - RNA, 22 nt, Human
gucaccccggccaccugcggug

SEQ ID NO: 2995314 - RNA, 14 nt, Human
gucauucuucccua

SEQ ID NO: 2995315 - RNA, 21 nt, Human
gucauucagauaugauucaaa

SEQ ID NO: 2995316 - RNA, 17 nt, Human
gucauuauguuaauauu

SEQ ID NO: 2995317 - RNA, 19 nt, Human
gucauuauguuaauauuuc

SEQ ID NO: 2995318 - RNA, 21 nt, Human
gucagcuccccucggagaaga

SEQ ID NO: 2995319 - RNA, 22 nt, Human
gucagcuccccucggagaagag

SEQ ID NO: 2995320 - RNA, 23 nt, Human
gucagcuccccucggagaagagc

SEQ ID NO: 2995321 - RNA, 21 nt, Human
gucccaccuuggcugcaggga

SEQ ID NO: 2995322 - RNA, 12 nt, Human
guccacccagga

SEQ ID NO: 2995323 - RNA, 23 nt, Human
guccacccaggagccccgaggcc

SEQ ID NO: 2995324 - RNA, 21 nt, Human
gucccugcacuugcagacucu

SEQ ID NO: 2995325 - RNA, 19 nt, Human
gucccugcacuugcagacu

SEQ ID NO: 2995326 - RNA, 16 nt, Human
gucccugcacuugcag

SEQ ID NO: 2995327 - RNA, 23 nt, Human
gucccaccuuggcugcagggagu

SEQ ID NO: 2995328 - RNA, 20 nt, Human
gucccaccuuggcugcaggg

SEQ ID NO: 2995329 - RNA, 17 nt, Human
guccccaccgcagacag

SEQ ID NO: 2995330 - RNA, 13 nt, Human
uuuuccuucaaga

SEQ ID NO: 2995331 - RNA, 14 nt, Human
uuuuccugaaaacc

SEQ ID NO: 2995332 - RNA, 13 nt, Human
uuuuccugaaaac

SEQ ID NO: 2995333 - RNA, 21 nt, Human
uuuuccuucaagaaugcagua

SEQ ID NO: 2995334 - RNA, 14 nt, Human
uuuuccuucaagaa

SEQ ID NO: 2995335 - RNA, 15 nt, Human
uuuucuuuuaagaau

SEQ ID NO: 2995336 - RNA, 13 nt, Human
uuuucuuuuaaga

SEQ ID NO: 2995337 - RNA, 16 nt, Human
uuuugguauuugaaac

SEQ ID NO: 2995338 - RNA, 14 nt, Human
uuuugguauuugaa

SEQ ID NO: 2995339 - RNA, 18 nt, Human
uuuuggucuggagggaag

SEQ ID NO: 2995340 - RNA, 15 nt, Human
uuuuggucuguguga

SEQ ID NO: 2995341 - RNA, 18 nt, Human
uuuuggguuuauuuggaa

SEQ ID NO: 2995342 - RNA, 17 nt, Human
uuuuggguuuauuugga

SEQ ID NO: 2995343 - RNA, 14 nt, Human
uuuuggcugcugaa

SEQ ID NO: 2995344 - RNA, 20 nt, Human
uuuugacaaggggcaguggu

SEQ ID NO: 2995345 - RNA, 22 nt, Human
uuuucuuuugcuuuauggguuu

SEQ ID NO: 2995346 - RNA, 18 nt, Human
uuuuuaaaaaagaaacau

SEQ ID NO: 2995347 - RNA, 16 nt, Human
uuuugucauauaagau

SEQ ID NO: 2995348 - RNA, 19 nt, Human
uuuuguagagccagggucu

SEQ ID NO: 2995349 - RNA, 20 nt, Human
uuuuuaagggcccuuuuuca

SEQ ID NO: 2995350 - RNA, 23 nt, Human
uuuuuaagaaaaaggaugcacag

SEQ ID NO: 2995351 - RNA, 11 nt, Human
uuuuuccuuca

SEQ ID NO: 2995352 - RNA, 21 nt, Human
uuuuuccuucaagaaugcagu

SEQ ID NO: 2995353 - RNA, 19 nt, Human
uuuuuccuucagugccuua

SEQ ID NO: 2995354 - RNA, 19 nt, Human
uuuuucucuaggaaauauu

SEQ ID NO: 2995355 - RNA, 23 nt, Human
uuuuucucugauacagaaaaguu

SEQ ID NO: 2995356 - RNA, 23 nt, Human
uuaccaauugaaguaaaaugugg

SEQ ID NO: 2995357 - RNA, 22 nt, Human
uuuccucaaaacuucagacaua

SEQ ID NO: 2995358 - RNA, 18 nt, Human
uuuccucauuuuuauaau

SEQ ID NO: 2995359 - RNA, 16 nt, Human
uuuccugaggcugggc

SEQ ID NO: 2995360 - RNA, 22 nt, Human
uuaccaauugaaguaaaaugug

SEQ ID NO: 2995361 - RNA, 17 nt, Human
uuaccacagacauacua

SEQ ID NO: 2995362 - RNA, 14 nt, Human
uuaccacagacaua

SEQ ID NO: 2995363 - RNA, 14 nt, Human
uuacauuuuacaca

SEQ ID NO: 2995364 - RNA, 15 nt, Human
uuacauuuuacacac

SEQ ID NO: 2995365 - RNA, 23 nt, Human
uuacauuuuuaagugcugcauuu

SEQ ID NO: 2995366 - RNA, 13 nt, Human
uuucugagaaaga

SEQ ID NO: 2995367 - RNA, 20 nt, Human
uuucuguucuuucuggcuau

SEQ ID NO: 2995368 - RNA, 18 nt, Human
uuucucugauacagaaaa

SEQ ID NO: 2995369 - RNA, 17 nt, Human
uuucucugauacagaaa

SEQ ID NO: 2995370 - RNA, 16 nt, Human
uuucucugauacagaa

SEQ ID NO: 2995371 - RNA, 15 nt, Human
uuucucugauacaga

SEQ ID NO: 2995372 - RNA, 21 nt, Human
uuucugaaauuuccugggagc

SEQ ID NO: 2995373 - RNA, 19 nt, Human
uuucugaaauuuccuggga

SEQ ID NO: 2995374 - RNA, 18 nt, Human
uuucuaaaggcuaccuuu

SEQ ID NO: 2995375 - RNA, 21 nt, Human
uuucuaaaggcuaccuuugua

SEQ ID NO: 2995376 - RNA, 20 nt, Human
uuucuaaaggcuaccuuugu

SEQ ID NO: 2995377 - RNA, 23 nt, Human
uuucuacucgaguuacagacaaa

SEQ ID NO: 2995378 - RNA, 16 nt, Human
uuugaagauucuaugu

SEQ ID NO: 2995379 - RNA, 22 nt, Human
uuugaagaugccgcauuuggau

SEQ ID NO: 2995380 - RNA, 18 nt, Human
uuugaaucaucaagucuu

SEQ ID NO: 2995381 - RNA, 14 nt, Human
uuugaacucuucaa

SEQ ID NO: 2995382 - RNA, 15 nt, Human
uuugaacugauaaag

SEQ ID NO: 2995383 - RNA, 19 nt, Human
uuugaacugauaaagauga

SEQ ID NO: 2995384 - RNA, 17 nt, Human
uuugaacugauaaagau

SEQ ID NO: 2995385 - RNA, 12 nt, Human
uuucuucucccu

SEQ ID NO: 2995386 - RNA, 13 nt, Human
uuucuucucccuc

SEQ ID NO: 2995387 - RNA, 23 nt, Human
uuucuuagggaaggauacaaaag

SEQ ID NO: 2995388 - RNA, 18 nt, Human
uuucuuagggaaggauac

SEQ ID NO: 2995389 - RNA, 17 nt, Human
uuucuuauuucauuucu

SEQ ID NO: 2995390 - RNA, 14 nt, Human
uuuggaaaagaaua

SEQ ID NO: 2995391 - RNA, 14 nt, Human
uuuggaauuuugug

SEQ ID NO: 2995392 - RNA, 16 nt, Human
uuugcuuugugauuuu

SEQ ID NO: 2995393 - RNA, 15 nt, Human
uuugcuuugugauuu

SEQ ID NO: 2995394 - RNA, 20 nt, Human
uuugcauauugcauacuauu

SEQ ID NO: 2995395 - RNA, 15 nt, Human
uuugcauauugcaua

SEQ ID NO: 2995396 - RNA, 13 nt, Human
uuugguuucuagc

SEQ ID NO: 2995397 - RNA, 19 nt, Human
uuugguuuucacauuggaa

SEQ ID NO: 2995398 - RNA, 14 nt, Human
uuuguauaaaauaa

SEQ ID NO: 2995399 - RNA, 13 nt, Human
uuuguauaaaaua

SEQ ID NO: 2995400 - RNA, 21 nt, Human
uuuggaauuuugugcccccau

SEQ ID NO: 2995401 - RNA, 12 nt, Human
uuuguucccugu

SEQ ID NO: 2995402 - RNA, 21 nt, Human
uuuguucuggcucuuccaggc

SEQ ID NO: 2995403 - RNA, 21 nt, Human
uuuuaaaagaaugauuaugaa

SEQ ID NO: 2995404 - RNA, 15 nt, Human
uuuuaaaagaaugau

SEQ ID NO: 2995405 - RNA, 17 nt, Human
uuuuaaagaaugcucuu

SEQ ID NO: 2995406 - RNA, 19 nt, Human
uuuuaauauggaucuguau

SEQ ID NO: 2995407 - RNA, 20 nt, Human
uuuuaauaauguuucaaaca

SEQ ID NO: 2995408 - RNA, 21 nt, Human
uuuuaaaugcaccuggaauau

SEQ ID NO: 2995409 - RNA, 12 nt, Human
uuuuaaaugcac

SEQ ID NO: 2995410 - RNA, 11 nt, Human
uuuuaaaugca

SEQ ID NO: 2995411 - RNA, 22 nt, Human
gccgugugugugcguccugucg

SEQ ID NO: 2995412 - RNA, 13 nt, Human
gccucacaguccu

SEQ ID NO: 2995413 - RNA, 17 nt, Human
gccucacaguccuuacc

SEQ ID NO: 2995414 - RNA, 17 nt, Human
gccucaaccuccugggc

SEQ ID NO: 2995415 - RNA, 15 nt, Human
gccucacagcaguga

SEQ ID NO: 2995416 - RNA, 19 nt, Human
gccucacagcagugagacu

SEQ ID NO: 2995417 - RNA, 19 nt, Human
gccucaaccuccugggcua

SEQ ID NO: 2995418 - RNA, 18 nt, Human
gccucaaccuccugggcu

SEQ ID NO: 2995419 - RNA, 23 nt, Human
gccguggugauuuagcaggaagc

SEQ ID NO: 2995420 - RNA, 20 nt, Human
gccguguaaccauggaccca

SEQ ID NO: 2995421 - RNA, 15 nt, Human
gccgucuaccugagg

SEQ ID NO: 2995422 - RNA, 16 nt, Human
gccgucuaccugaggg

SEQ ID NO: 2995423 - RNA, 17 nt, Human
gccgucuaccugagggg

SEQ ID NO: 2995424 - RNA, 18 nt, Human
gcccuuuuucaauaacug

SEQ ID NO: 2995425 - RNA, 16 nt, Human
gcccuuggccaugggu

SEQ ID NO: 2995426 - RNA, 21 nt, Human
gcccuugucggccccaccagu

SEQ ID NO: 2995427 - RNA, 16 nt, Human
gcccuugucggcccca

SEQ ID NO: 2995428 - RNA, 14 nt, Human
gcccuucucuccag

SEQ ID NO: 2995429 - RNA, 16 nt, Human
gcccuucucuccagcc

SEQ ID NO: 2995430 - RNA, 17 nt, Human
gcccuucucuccagccc

SEQ ID NO: 2995431 - RNA, 18 nt, Human
gcccuucucuccagcccc

SEQ ID NO: 2995432 - RNA, 20 nt, Human
gccgggcgugguggugagug

SEQ ID NO: 2995433 - RNA, 21 nt, Human
gccgggcgcgguggcucacgc

SEQ ID NO: 2995434 - RNA, 21 nt, Human
gccgggcgugguggcaggcac

SEQ ID NO: 2995435 - RNA, 11 nt, Human
gccgcagcccu

SEQ ID NO: 2995436 - RNA, 12 nt, Human
gccgcagcccug

SEQ ID NO: 2995437 - RNA, 22 nt, Human
gccgagaucacgccacugcacu

SEQ ID NO: 2995438 - RNA, 21 nt, Human
gccgagaucacgccacugcac

SEQ ID NO: 2995439 - RNA, 20 nt, Human
gccgagaucacgccacugca

SEQ ID NO: 2995440 - RNA, 16 nt, Human
gccuccccuccucugc

SEQ ID NO: 2995441 - RNA, 19 nt, Human
gccuccccuccucugcuug

SEQ ID NO: 2995442 - RNA, 17 nt, Human
gccuccccuccucugcu

SEQ ID NO: 2995443 - RNA, 22 nt, Human
gccuccccuccucugcuugcca

SEQ ID NO: 2995444 - RNA, 20 nt, Human
gccuccccuccucugcuugc

SEQ ID NO: 2995445 - RNA, 17 nt, Human
gccucccgaguagcugg

SEQ ID NO: 2995446 - RNA, 19 nt, Human
gccucccgaguagcuggga

SEQ ID NO: 2995447 - RNA, 18 nt, Human
gccucccgaguagcuggg

SEQ ID NO: 2995448 - RNA, 20 nt, Human
gccucccgaguagcugggac

SEQ ID NO: 2995449 - RNA, 16 nt, Human
gccucccaacucaccc

SEQ ID NO: 2995450 - RNA, 17 nt, Human
gccucccaacucacccc

SEQ ID NO: 2995451 - RNA, 18 nt, Human
gccucccaacucacccca

SEQ ID NO: 2995452 - RNA, 19 nt, Human
gccucccaacucaccccag

SEQ ID NO: 2995453 - RNA, 14 nt, Human
gccucccaucaccc

SEQ ID NO: 2995454 - RNA, 16 nt, Human
gccucccaucacccgc

SEQ ID NO: 2995455 - RNA, 13 nt, Human
gccucccaacuca

SEQ ID NO: 2995456 - RNA, 19 nt, Human
gccucccaaagugcuggga

SEQ ID NO: 2995457 - RNA, 18 nt, Human
gccucccaaagugcuggg

SEQ ID NO: 2995458 - RNA, 16 nt, Human
gccucagcauccuggc

SEQ ID NO: 2995459 - RNA, 15 nt, Human
gccucagcauccugg

SEQ ID NO: 2995460 - RNA, 18 nt, Human
gccucacaguccuuacca

SEQ ID NO: 2995461 - RNA, 14 nt, Human
gccucugcacuccc

SEQ ID NO: 2995462 - RNA, 21 nt, Human
gccucugacacacagcucugu

SEQ ID NO: 2995463 - RNA, 20 nt, Human
gccucugacacacagcucug

SEQ ID NO: 2995464 - RNA, 19 nt, Human
gccucugacacacagcucu

SEQ ID NO: 2995465 - RNA, 16 nt, Human
gccucucucaggccaa

SEQ ID NO: 2995466 - RNA, 16 nt, Human
gccucugacacacagc

SEQ ID NO: 2995467 - RNA, 18 nt, Human
gccucugacacacagcuc

SEQ ID NO: 2995468 - RNA, 17 nt, Human
gccucugacacacagcu

SEQ ID NO: 2995469 - RNA, 13 nt, Human
gccucucucaggc

SEQ ID NO: 2995470 - RNA, 14 nt, Human
gccucucucaggcc

SEQ ID NO: 2995471 - RNA, 13 nt, Human
gccugcaagggag

SEQ ID NO: 2995472 - RNA, 15 nt, Human
gccugcaagggagug

SEQ ID NO: 2995473 - RNA, 13 nt, Human
gccucugccucug

SEQ ID NO: 2995474 - RNA, 12 nt, Human
gccucugccucu

SEQ ID NO: 2995475 - RNA, 13 nt, Human
gcuacacaccuaa

SEQ ID NO: 2995476 - RNA, 20 nt, Human
gcuaagagggagggagggcu

SEQ ID NO: 2995477 - RNA, 20 nt, Human
gcuacacacugcauguuugu

SEQ ID NO: 2995478 - RNA, 13 nt, Human
gcuacacacugca

SEQ ID NO: 2995479 - RNA, 14 nt, Human
gcuacacaggggaa

SEQ ID NO: 2995480 - RNA, 13 nt, Human
gcuaagagggagg

SEQ ID NO: 2995481 - RNA, 19 nt, Human
gcuaaagaaguuugaacau

SEQ ID NO: 2995482 - RNA, 18 nt, Human
gcuaaagaaguuugaaca

SEQ ID NO: 2995483 - RNA, 15 nt, Human
gcuaaagaaguuuga

SEQ ID NO: 2995484 - RNA, 20 nt, Human
gcuaaagaaguuugaacauu

SEQ ID NO: 2995485 - RNA, 13 nt, Human
gcuauaggugcua

SEQ ID NO: 2995486 - RNA, 15 nt, Human
gcuaggaacacuccu

SEQ ID NO: 2995487 - RNA, 18 nt, Human
gcuagaacucccuuucaa

SEQ ID NO: 2995488 - RNA, 16 nt, Human
gcuaccuuuguauucu

SEQ ID NO: 2995489 - RNA, 19 nt, Human
gcuagaacucccuuucaac

SEQ ID NO: 2995490 - RNA, 15 nt, Human
gcuacaguaauaaau

SEQ ID NO: 2995491 - RNA, 14 nt, Human
gcuacaguaauaaa

SEQ ID NO: 2995492 - RNA, 13 nt, Human
gcuacaguaauaa

SEQ ID NO: 2995493 - RNA, 12 nt, Human
gcgacagugaga

SEQ ID NO: 2995494 - RNA, 15 nt, Human
gcgccuacaggagug

SEQ ID NO: 2995495 - RNA, 13 nt, Human
gcggacagccacg

SEQ ID NO: 2995496 - RNA, 11 nt, Human
gcggacagcca

SEQ ID NO: 2995497 - RNA, 19 nt, Human
gcgucucauacucaccuca

SEQ ID NO: 2995498 - RNA, 15 nt, Human
gcggacagccacggc

SEQ ID NO: 2995499 - RNA, 13 nt, Human
gccuuuggcuuca

SEQ ID NO: 2995500 - RNA, 23 nt, Human
gcgacaaugcaaaccaucauuga

SEQ ID NO: 2995501 - RNA, 16 nt, Human
gccuuauggaacacuc

SEQ ID NO: 2995502 - RNA, 18 nt, Human
gccuuauggaacacucug

SEQ ID NO: 2995503 - RNA, 19 nt, Human
gccuuauggaacacucuga

SEQ ID NO: 2995504 - RNA, 20 nt, Human
gccuuauggaacacucugag

SEQ ID NO: 2995505 - RNA, 12 nt, Human
gccuuccagggg

SEQ ID NO: 2995506 - RNA, 15 nt, Human
gccuuccaggggugg

SEQ ID NO: 2995507 - RNA, 16 nt, Human
gccuuccagggguggg

SEQ ID NO: 2995508 - RNA, 20 nt, Human
gccuuacacaaugguuuucu

SEQ ID NO: 2995509 - RNA, 16 nt, Human
gccuuacacaaugguu

SEQ ID NO: 2995510 - RNA, 18 nt, Human
gccuuacccucauguucu

SEQ ID NO: 2995511 - RNA, 21 nt, Human
gccuuacacaaugguuuucuu

SEQ ID NO: 2995512 - RNA, 21 nt, Human
gccuguugggccaggagccuc

SEQ ID NO: 2995513 - RNA, 18 nt, Human
gccuuagaagucacacag

SEQ ID NO: 2995514 - RNA, 17 nt, Human
gccuuagaagucacaca

SEQ ID NO: 2995515 - RNA, 19 nt, Human
gccuuagaagucacacagu

SEQ ID NO: 2995516 - RNA, 10 nt, Human
gccuuaugga

SEQ ID NO: 2995517 - RNA, 14 nt, Human
gccuuauggaacac

SEQ ID NO: 2995518 - RNA, 21 nt, Human
gccugggggcugggcagagga

SEQ ID NO: 2995519 - RNA, 22 nt, Human
gccugggggcugggcagaggaa

SEQ ID NO: 2995520 - RNA, 13 nt, Human
gccugguggcagc

SEQ ID NO: 2995521 - RNA, 21 nt, Human
gccugguggcagcugcggucc

SEQ ID NO: 2995522 - RNA, 19 nt, Human
gccugguggcagcugcggu

SEQ ID NO: 2995523 - RNA, 18 nt, Human
gccugguggcagcugcgg

SEQ ID NO: 2995524 - RNA, 15 nt, Human
gcccugcagagggca

SEQ ID NO: 2995525 - RNA, 14 nt, Human
gcccugcagagggc

SEQ ID NO: 2995526 - RNA, 13 nt, Human
gcccugcagaggg

SEQ ID NO: 2995527 - RNA, 13 nt, Human
gcccucugcccac

SEQ ID NO: 2995528 - RNA, 16 nt, Human
gcccucugcccacucc

SEQ ID NO: 2995529 - RNA, 18 nt, Human
gcccucugcccacucccu

SEQ ID NO: 2995530 - RNA, 19 nt, Human
gcccucugcccacucccug

SEQ ID NO: 2995531 - RNA, 22 nt, Human
gcccuccaagaccuucuccuuc

SEQ ID NO: 2995532 - RNA, 23 nt, Human
gcccuccaagaccuucuccuuca

SEQ ID NO: 2995533 - RNA, 12 nt, Human
gcccuccagagc

SEQ ID NO: 2995534 - RNA, 18 nt, Human
gcccuccagagccccaca

SEQ ID NO: 2995535 - RNA, 16 nt, Human
gcccuccagagcccca

SEQ ID NO: 2995536 - RNA, 14 nt, Human
gcccuccagagccc

SEQ ID NO: 2995537 - RNA, 22 nt, Human
gcccuccagagccccacagccc

SEQ ID NO: 2995538 - RNA, 20 nt, Human
gcccuccagagccccacagc

SEQ ID NO: 2995539 - RNA, 19 nt, Human
gcccuccaagaccuucucc

SEQ ID NO: 2995540 - RNA, 21 nt, Human
gcccuccaagaccuucuccuu

SEQ ID NO: 2995541 - RNA, 16 nt, Human
gccccucagggucccu

SEQ ID NO: 2995542 - RNA, 18 nt, Human
gccccucagggucccugg

SEQ ID NO: 2995543 - RNA, 14 nt, Human
gccccucagggucc

SEQ ID NO: 2995544 - RNA, 18 nt, Human
gccccgaggccuucucug

SEQ ID NO: 2995545 - RNA, 23 nt, Human
gccccucaacucuccuccagagu

SEQ ID NO: 2995546 - RNA, 13 nt, Human
gcccccuguggau

SEQ ID NO: 2995547 - RNA, 17 nt, Human
gcccccuguggaugcug

SEQ ID NO: 2995548 - RNA, 15 nt, Human
gccccgaggccuucu

SEQ ID NO: 2995549 - RNA, 20 nt, Human
gccccuucugacccaugcug

SEQ ID NO: 2995550 - RNA, 12 nt, Human
gccccagugccc

SEQ ID NO: 2995551 - RNA, 18 nt, Human
gccccaucccaaacccuu

SEQ ID NO: 2995552 - RNA, 14 nt, Human
gccccagugcccac

SEQ ID NO: 2995553 - RNA, 13 nt, Human
gccccagugccca

SEQ ID NO: 2995554 - RNA, 21 nt, Human
gccccagugcccacaggauca

SEQ ID NO: 2995555 - RNA, 13 nt, Human
gccccauccucug

SEQ ID NO: 2995556 - RNA, 14 nt, Human
gccccauccucugu

SEQ ID NO: 2995557 - RNA, 22 nt, Human
gccccauccucuguacagagcc

SEQ ID NO: 2995558 - RNA, 14 nt, Human
gccccauucugccu

SEQ ID NO: 2995559 - RNA, 18 nt, Human
gcccagggcaucugggag

SEQ ID NO: 2995560 - RNA, 15 nt, Human
gcccagggcaucugg

SEQ ID NO: 2995561 - RNA, 14 nt, Human
gcccagggcaucug

SEQ ID NO: 2995562 - RNA, 12 nt, Human
gcccaggcuggc

SEQ ID NO: 2995563 - RNA, 13 nt, Human
gcccaggccuccu

SEQ ID NO: 2995564 - RNA, 23 nt, Human
gcccaggccccugccacccuggg

SEQ ID NO: 2995565 - RNA, 21 nt, Human
gcccagagaggguggugaccu

SEQ ID NO: 2995566 - RNA, 15 nt, Human
gcccagagagggugg

SEQ ID NO: 2995567 - RNA, 22 nt, Human
gcccaguuggguggaugccugg

SEQ ID NO: 2995568 - RNA, 15 nt, Human
gcccaggguggccac

SEQ ID NO: 2995569 - RNA, 20 nt, Human
gcccaggguggccacaccuc

SEQ ID NO: 2995570 - RNA, 24 nt, Human
gccaaggccaaaggaagcacaugc

SEQ ID NO: 2995571 - RNA, 19 nt, Human
gccaaggccaaaggaagca

SEQ ID NO: 2995572 - RNA, 20 nt, Human
gccaaggccaaaggaagcac

SEQ ID NO: 2995573 - RNA, 21 nt, Human
gccagagacacaagccuucgg

SEQ ID NO: 2995574 - RNA, 22 nt, Human
gccagagacacaagccuucggc

SEQ ID NO: 2995575 - RNA, 19 nt, Human
gccacugcaccgggccaca

SEQ ID NO: 2995576 - RNA, 21 nt, Human
gccacugcaccgggccacaga

SEQ ID NO: 2995577 - RNA, 20 nt, Human
gccacugcaccgggccacag

SEQ ID NO: 2995578 - RNA, 14 nt, Human
gccagaugcaccag

SEQ ID NO: 2995579 - RNA, 24 nt, Human
gccagauucuuuccugaggcuggg

SEQ ID NO: 2995580 - RNA, 13 nt, Human
gccagauuucacu

SEQ ID NO: 2995581 - RNA, 20 nt, Human
gccagauucuuuccugaggc

SEQ ID NO: 2995582 - RNA, 15 nt, Human
gccagaugcaccagc

SEQ ID NO: 2995583 - RNA, 22 nt, Human
gccagccgagauagccaaggcc

SEQ ID NO: 2995584 - RNA, 19 nt, Human
gccagauucuuuccugagg

SEQ ID NO: 2995585 - RNA, 20 nt, Human
gccagcugcuugggcuucau

SEQ ID NO: 2995586 - RNA, 12 nt, Human
gccaggaagcca

SEQ ID NO: 2995587 - RNA, 13 nt, Human
gccaggaagccag

SEQ ID NO: 2995588 - RNA, 14 nt, Human
gccaggaagccagc

SEQ ID NO: 2995589 - RNA, 17 nt, Human
gccagcugcuugggcuu

SEQ ID NO: 2995590 - RNA, 18 nt, Human
gccagcugcuugggcuuc

SEQ ID NO: 2995591 - RNA, 16 nt, Human
gccagcugcuugggcu

SEQ ID NO: 2995592 - RNA, 19 nt, Human
gccaggagccuccugcccu

SEQ ID NO: 2995593 - RNA, 20 nt, Human
gccaggagccuccugcccuu

SEQ ID NO: 2995594 - RNA, 14 nt, Human
gccaggagccuccu

SEQ ID NO: 2995595 - RNA, 16 nt, Human
gccaggagccuccugc

SEQ ID NO: 2995596 - RNA, 15 nt, Human
gccaggaagccagca

SEQ ID NO: 2995597 - RNA, 20 nt, Human
gccaggaagccagcaggcuc

SEQ ID NO: 2995598 - RNA, 19 nt, Human
gccaugggcacugugggua

SEQ ID NO: 2995599 - RNA, 16 nt, Human
gccaugggccuccugu

SEQ ID NO: 2995600 - RNA, 15 nt, Human
gccaugggccuccug

SEQ ID NO: 2995601 - RNA, 13 nt, Human
gcccaaggccuuc

SEQ ID NO: 2995602 - RNA, 16 nt, Human
gcccaaggccuucccc

SEQ ID NO: 2995603 - RNA, 17 nt, Human
gcccaccuggccucugc

SEQ ID NO: 2995604 - RNA, 20 nt, Human
gcccaccuggccucugcacu

SEQ ID NO: 2995605 - RNA, 21 nt, Human
gcccaccuggccucugcacuc

SEQ ID NO: 2995606 - RNA, 24 nt, Human
gcccaccuggccucugcacucccc

SEQ ID NO: 2995607 - RNA, 15 nt, Human
gcccaccuggccucu

SEQ ID NO: 2995608 - RNA, 16 nt, Human
gcccaccuggccucug

SEQ ID NO: 2995609 - RNA, 16 nt, Human
gcccaccuuggcucaa

SEQ ID NO: 2995610 - RNA, 15 nt, Human
gcccaccuuggcuca

SEQ ID NO: 2995611 - RNA, 13 nt, Human
gcccaccuuggcu

SEQ ID NO: 2995612 - RNA, 14 nt, Human
gcccacuucugcca

SEQ ID NO: 2995613 - RNA, 21 nt, Human
gccagucaccccggccaccug

SEQ ID NO: 2995614 - RNA, 12 nt, Human
gccaguaaaugg

SEQ ID NO: 2995615 - RNA, 23 nt, Human
gccaguaaaugggggugcauuug

SEQ ID NO: 2995616 - RNA, 15 nt, Human
gccaggcuggucuca

SEQ ID NO: 2995617 - RNA, 13 nt, Human
gccaggcuggucu

SEQ ID NO: 2995618 - RNA, 14 nt, Human
gccaugcuccuggc

SEQ ID NO: 2995619 - RNA, 20 nt, Human
gccaugaggaacaaggcaag

SEQ ID NO: 2995620 - RNA, 16 nt, Human
gccaucccucccucca

SEQ ID NO: 2995621 - RNA, 18 nt, Human
gccaucccucccuccacc

SEQ ID NO: 2995622 - RNA, 23 nt, Human
gccaucccucccuccaccucccu

SEQ ID NO: 2995623 - RNA, 19 nt, Human
gccauccuggcccagggca

SEQ ID NO: 2995624 - RNA, 18 nt, Human
gccauccuggcccagggc

SEQ ID NO: 2995625 - RNA, 20 nt, Human
gccauccuggcccagggcau

SEQ ID NO: 2995626 - RNA, 14 nt, Human
gccauccuggccca

SEQ ID NO: 2995627 - RNA, 19 nt, Human
gcagcccucaauugugaaa

SEQ ID NO: 2995628 - RNA, 13 nt, Human
gcagcccugcaga

SEQ ID NO: 2995629 - RNA, 20 nt, Human
gcagccccuguucuggcaga

SEQ ID NO: 2995630 - RNA, 21 nt, Human
gcagccccuguucuggcagag

SEQ ID NO: 2995631 - RNA, 20 nt, Human
gcagccccgugggguuccuc

SEQ ID NO: 2995632 - RNA, 24 nt, Human
gcagccccauucugccugcccagg

SEQ ID NO: 2995633 - RNA, 21 nt, Human
gcagccccauucugccugccc

SEQ ID NO: 2995634 - RNA, 19 nt, Human
gcagccccauucugccugc

SEQ ID NO: 2995635 - RNA, 18 nt, Human
gcagccccauucugccug

SEQ ID NO: 2995636 - RNA, 23 nt, Human
gcagcaauaaagcagcguuucua

SEQ ID NO: 2995637 - RNA, 16 nt, Human
gcagcaauaaagcagc

SEQ ID NO: 2995638 - RNA, 17 nt, Human
gcagccccauucugccu

SEQ ID NO: 2995639 - RNA, 20 nt, Human
gcagaguugaagacagagcu

SEQ ID NO: 2995640 - RNA, 18 nt, Human
gcagauaaacaguaguga

SEQ ID NO: 2995641 - RNA, 21 nt, Human
gcagaguugaagacagagcua

SEQ ID NO: 2995642 - RNA, 17 nt, Human
gcagacaguuaagagaa

SEQ ID NO: 2995643 - RNA, 23 nt, Human
gcagaccauuggggcucccagcc

SEQ ID NO: 2995644 - RNA, 22 nt, Human
gcagaccauuggggcucccagc

SEQ ID NO: 2995645 - RNA, 21 nt, Human
gcagaccauuggggcucccag

SEQ ID NO: 2995646 - RNA, 20 nt, Human
gcagaccauuggggcuccca

SEQ ID NO: 2995647 - RNA, 22 nt, Human
gcagauacaggaaaagcugcug

SEQ ID NO: 2995648 - RNA, 14 nt, Human
gcagcccugcagag

SEQ ID NO: 2995649 - RNA, 15 nt, Human
gcagcccugcagagg

SEQ ID NO: 2995650 - RNA, 16 nt, Human
gcagcccugcagaggg

SEQ ID NO: 2995651 - RNA, 17 nt, Human
gcagcccugcagagggc

SEQ ID NO: 2995652 - RNA, 15 nt, Human
gcagcucaccucucc

SEQ ID NO: 2995653 - RNA, 15 nt, Human
gcagccuuggcaaac

SEQ ID NO: 2995654 - RNA, 14 nt, Human
gcagcucaccucuc

SEQ ID NO: 2995655 - RNA, 23 nt, Human
gcaggaggaucacuugaguccag

SEQ ID NO: 2995656 - RNA, 20 nt, Human
gcaggaggaucacuugaguc

SEQ ID NO: 2995657 - RNA, 13 nt, Human
gcaggcagccagg

SEQ ID NO: 2995658 - RNA, 14 nt, Human
gcaggcagccaggc

SEQ ID NO: 2995659 - RNA, 12 nt, Human
gcaggcagccag

SEQ ID NO: 2995660 - RNA, 12 nt, Human
gcaggcaccugu

SEQ ID NO: 2995661 - RNA, 17 nt, Human
gcacugguuuguucccu

SEQ ID NO: 2995662 - RNA, 20 nt, Human
gcacugcuuccagugaggcu

SEQ ID NO: 2995663 - RNA, 16 nt, Human
gcacugcuuccaguga

SEQ ID NO: 2995664 - RNA, 18 nt, Human
gcacugcuuccagugagg

SEQ ID NO: 2995665 - RNA, 19 nt, Human
gcacugguuuguucccugu

SEQ ID NO: 2995666 - RNA, 12 nt, Human
gcagacaggacc

SEQ ID NO: 2995667 - RNA, 13 nt, Human
gcagacaggacca

SEQ ID NO: 2995668 - RNA, 15 nt, Human
gcagacaggaccagg

SEQ ID NO: 2995669 - RNA, 19 nt, Human
gcagacaggcaagcaccuc

SEQ ID NO: 2995670 - RNA, 23 nt, Human
gcagacaggcaagcaccuccugc

SEQ ID NO: 2995671 - RNA, 12 nt, Human
gcacgauuucug

SEQ ID NO: 2995672 - RNA, 18 nt, Human
gcaccuuagacagucccu

SEQ ID NO: 2995673 - RNA, 21 nt, Human
gcaccuggaauauauaaccag

SEQ ID NO: 2995674 - RNA, 18 nt, Human
gcaccuggaauauauaac

SEQ ID NO: 2995675 - RNA, 15 nt, Human
gcacccucaggcagg

SEQ ID NO: 2995676 - RNA, 14 nt, Human
gcaccuuagacagu

SEQ ID NO: 2995677 - RNA, 17 nt, Human
gcaccuuagacaguccc

SEQ ID NO: 2995678 - RNA, 22 nt, Human
gcaccuggaauauauaaccagu

SEQ ID NO: 2995679 - RNA, 19 nt, Human
gcacccggccccugcuggu

SEQ ID NO: 2995680 - RNA, 18 nt, Human
gcacccggccccugcugg

SEQ ID NO: 2995681 - RNA, 22 nt, Human
gcacccaccaucaugucuggcu

SEQ ID NO: 2995682 - RNA, 16 nt, Human
gcaccagcagccugga

SEQ ID NO: 2995683 - RNA, 21 nt, Human
gcaccacugcacuccagccug

SEQ ID NO: 2995684 - RNA, 22 nt, Human
gcaccacugcacuccagccugg

SEQ ID NO: 2995685 - RNA, 15 nt, Human
gcaccagcagccugg

SEQ ID NO: 2995686 - RNA, 14 nt, Human
gcaccagcagccug

SEQ ID NO: 2995687 - RNA, 13 nt, Human
gcaauggcagccu

SEQ ID NO: 2995688 - RNA, 12 nt, Human
gcaauggcagcc

SEQ ID NO: 2995689 - RNA, 20 nt, Human
gcaccacugcacuccagccu

SEQ ID NO: 2995690 - RNA, 14 nt, Human
gcaauggcagccuu

SEQ ID NO: 2995691 - RNA, 18 nt, Human
gcagugcuuggcccagga

SEQ ID NO: 2995692 - RNA, 19 nt, Human
gcagugcuuggcccaggag

SEQ ID NO: 2995693 - RNA, 20 nt, Human
gcagugcuuggcccaggagu

SEQ ID NO: 2995694 - RNA, 15 nt, Human
gcagugcaugcuguc

SEQ ID NO: 2995695 - RNA, 16 nt, Human
gcagugcaugcugucc

SEQ ID NO: 2995696 - RNA, 22 nt, Human
gcagguccaggguuugaguuca

SEQ ID NO: 2995697 - RNA, 20 nt, Human
gcaggucuugaacuccuggc

SEQ ID NO: 2995698 - RNA, 19 nt, Human
gcaggucuugaacuccugg

SEQ ID NO: 2995699 - RNA, 18 nt, Human
gcagggucucacucuguc

SEQ ID NO: 2995700 - RNA, 17 nt, Human
gcagggucucacucugu

SEQ ID NO: 2995701 - RNA, 14 nt, Human
gcagggcucagcgg

SEQ ID NO: 2995702 - RNA, 15 nt, Human
gcaggcagccaggcc

SEQ ID NO: 2995703 - RNA, 16 nt, Human
gcaggcagccaggcca

SEQ ID NO: 2995704 - RNA, 21 nt, Human
gcagggcucagcggggacagc

SEQ ID NO: 2995705 - RNA, 19 nt, Human
gcagggcucagcggggaca

SEQ ID NO: 2995706 - RNA, 18 nt, Human
gcaguucagagcugcccu

SEQ ID NO: 2995707 - RNA, 17 nt, Human
gcaguucagagcugccc

SEQ ID NO: 2995708 - RNA, 15 nt, Human
gcaguucugaagaag

SEQ ID NO: 2995709 - RNA, 16 nt, Human
gcaguucagagcugcc

SEQ ID NO: 2995710 - RNA, 17 nt, Human
gcaguuauuaacacuaa

SEQ ID NO: 2995711 - RNA, 13 nt, Human
gcauagaaguaaa

SEQ ID NO: 2995712 - RNA, 17 nt, Human
gcaguucugaagaagau

SEQ ID NO: 2995713 - RNA, 14 nt, Human
gcaguucugaagaa

SEQ ID NO: 2995714 - RNA, 15 nt, Human
gcagugggagcugcc

SEQ ID NO: 2995715 - RNA, 14 nt, Human
gcagugggagcugc

SEQ ID NO: 2995716 - RNA, 12 nt, Human
gcagugggagcu

SEQ ID NO: 2995717 - RNA, 13 nt, Human
gcagugggagcug

SEQ ID NO: 2995718 - RNA, 23 nt, Human
gcaguggugguuuucuguucuuu

SEQ ID NO: 2995719 - RNA, 22 nt, Human
gcaguggugguuuucuguucuu

SEQ ID NO: 2995720 - RNA, 17 nt, Human
gcauagguuuaauaauu

SEQ ID NO: 2995721 - RNA, 14 nt, Human
gccaaacucaccug

SEQ ID NO: 2995722 - RNA, 16 nt, Human
gccaaacucaccugcc

SEQ ID NO: 2995723 - RNA, 19 nt, Human
gcauuuuuuaaccuccuaa

SEQ ID NO: 2995724 - RNA, 18 nt, Human
gcauuuguuugaacugau

SEQ ID NO: 2995725 - RNA, 22 nt, Human
gccaaagcuaggccuggccaga

SEQ ID NO: 2995726 - RNA, 16 nt, Human
gccaaagcuaggccug

SEQ ID NO: 2995727 - RNA, 16 nt, Human
gccaaagccuccucca

SEQ ID NO: 2995728 - RNA, 19 nt, Human
gccaaagccuccuccagcc

SEQ ID NO: 2995729 - RNA, 20 nt, Human
gccaaagccaaagcuaggcc

SEQ ID NO: 2995730 - RNA, 13 nt, Human
gccaaagccaaag

SEQ ID NO: 2995731 - RNA, 16 nt, Human
gcauuuguuugaacug

SEQ ID NO: 2995732 - RNA, 16 nt, Human
gcauuuguguugaaga

SEQ ID NO: 2995733 - RNA, 14 nt, Human
gcauuugcugaaua

SEQ ID NO: 2995734 - RNA, 13 nt, Human
gcauuugcugaau

SEQ ID NO: 2995735 - RNA, 21 nt, Human
gcauuugaggucuguucuuuc

SEQ ID NO: 2995736 - RNA, 17 nt, Human
gcauuaucuagauacug

SEQ ID NO: 2995737 - RNA, 19 nt, Human
gcauucaaauguauuacag

SEQ ID NO: 2995738 - RNA, 13 nt, Human
gcauuauauuuau

SEQ ID NO: 2995739 - RNA, 22 nt, Human
gcauguucucugaggacacuaa

SEQ ID NO: 2995740 - RNA, 21 nt, Human
gcauguucucugaggacacua

SEQ ID NO: 2995741 - RNA, 15 nt, Human
gcauguucucugagg

SEQ ID NO: 2995742 - RNA, 14 nt, Human
gcauguucucugag

SEQ ID NO: 2995743 - RNA, 18 nt, Human
gcaugcgggcuuccuccu

SEQ ID NO: 2995744 - RNA, 18 nt, Human
gcaugaaguaauaugcac

SEQ ID NO: 2995745 - RNA, 12 nt, Human
gcaucagcugcu

SEQ ID NO: 2995746 - RNA, 12 nt, Human
gauucauauuua

SEQ ID NO: 2995747 - RNA, 17 nt, Human
gauucauauuuacuucu

SEQ ID NO: 2995748 - RNA, 19 nt, Human
gauucauauuuacuucuua

SEQ ID NO: 2995749 - RNA, 18 nt, Human
gauucauauuuacuucuu

SEQ ID NO: 2995750 - RNA, 18 nt, Human
gauucccaagcucugcuc

SEQ ID NO: 2995751 - RNA, 23 nt, Human
gauggggcugcaccggcuggccu

SEQ ID NO: 2995752 - RNA, 19 nt, Human
gauggggcugcaccggcug

SEQ ID NO: 2995753 - RNA, 13 nt, Human
gauucagcucugc

SEQ ID NO: 2995754 - RNA, 15 nt, Human
gauucagcucugcaa

SEQ ID NO: 2995755 - RNA, 19 nt, Human
gauucagacagcugccugg

SEQ ID NO: 2995756 - RNA, 20 nt, Human
gauucccaagcucugcuccu

SEQ ID NO: 2995757 - RNA, 19 nt, Human
gauucccaagcucugcucc

SEQ ID NO: 2995758 - RNA, 12 nt, Human
gauucuuuccug

SEQ ID NO: 2995759 - RNA, 16 nt, Human
gauucuuuccugaggc

SEQ ID NO: 2995760 - RNA, 17 nt, Human
gauucuuuccugaggcu

SEQ ID NO: 2995761 - RNA, 18 nt, Human
gauucuuuccugaggcug

SEQ ID NO: 2995762 - RNA, 20 nt, Human
gauugcaacaggcugggcuu

SEQ ID NO: 2995763 - RNA, 16 nt, Human
gauugcaccacugcac

SEQ ID NO: 2995764 - RNA, 23 nt, Human
gauugcaccacugcacuccagcc

SEQ ID NO: 2995765 - RNA, 21 nt, Human
gauugcaacaggcugggcuuc

SEQ ID NO: 2995766 - RNA, 11 nt, Human
gauuuucagcc

SEQ ID NO: 2995767 - RNA, 15 nt, Human
gauuuucagcccuca

SEQ ID NO: 2995768 - RNA, 19 nt, Human
gauuuucagcccucagaau

SEQ ID NO: 2995769 - RNA, 15 nt, Human
gauuuuccugaaaac

SEQ ID NO: 2995770 - RNA, 18 nt, Human
gauuuccguuaaaauacc

SEQ ID NO: 2995771 - RNA, 15 nt, Human
gauuuccguuaaaau

SEQ ID NO: 2995772 - RNA, 19 nt, Human
gauuucuguuuagauaaua

SEQ ID NO: 2995773 - RNA, 11 nt, Human
gauuucuguuu

SEQ ID NO: 2995774 - RNA, 14 nt, Human
gcaagggugauggg

SEQ ID NO: 2995775 - RNA, 11 nt, Human
gcaaggcuguc

SEQ ID NO: 2995776 - RNA, 10 nt, Human
gcaagccaga

SEQ ID NO: 2995777 - RNA, 22 nt, Human
gcaaggcaaauguuuauuuaaa

SEQ ID NO: 2995778 - RNA, 18 nt, Human
gcaaggagauuuacaacu

SEQ ID NO: 2995779 - RNA, 15 nt, Human
gcaaugaccuuucaa

SEQ ID NO: 2995780 - RNA, 17 nt, Human
gcaaugaccuuucaaua

SEQ ID NO: 2995781 - RNA, 20 nt, Human
gcaaugaccuuucaauagga

SEQ ID NO: 2995782 - RNA, 22 nt, Human
gcaaugaccuuucaauaggaaa

SEQ ID NO: 2995783 - RNA, 15 nt, Human
gcaaucaaaucugcu

SEQ ID NO: 2995784 - RNA, 17 nt, Human
gcaaucaaaucugcuuu

SEQ ID NO: 2995785 - RNA, 23 nt, Human
gcaaugcuggcuguuggcugggg

SEQ ID NO: 2995786 - RNA, 22 nt, Human
gcaaugcuggcuguuggcuggg

SEQ ID NO: 2995787 - RNA, 14 nt, Human
gcaaugcuggcugu

SEQ ID NO: 2995788 - RNA, 13 nt, Human
gcaaugcuggcug

SEQ ID NO: 2995789 - RNA, 23 nt, Human
gcaaugaccuuucaauaggaaaa

SEQ ID NO: 2995790 - RNA, 23 nt, Human
gcaaagcacugacuucuaaguaa

SEQ ID NO: 2995791 - RNA, 18 nt, Human
gcaaacagggccucugcg

SEQ ID NO: 2995792 - RNA, 17 nt, Human
gcaaacagggccucugc

SEQ ID NO: 2995793 - RNA, 16 nt, Human
gcaaacagggccucug

SEQ ID NO: 2995794 - RNA, 13 nt, Human
gcaaacagggccu

SEQ ID NO: 2995795 - RNA, 16 nt, Human
gcaaaguaucccuacu

SEQ ID NO: 2995796 - RNA, 17 nt, Human
gcaagaauugaagcagg

SEQ ID NO: 2995797 - RNA, 14 nt, Human
gcaagacgcugugc

SEQ ID NO: 2995798 - RNA, 20 nt, Human
gcaagacgcugugcugcccu

SEQ ID NO: 2995799 - RNA, 21 nt, Human
gcaagacgcugugcugcccug

SEQ ID NO: 2995800 - RNA, 22 nt, Human
gcaagacgcugugcugcccugc

SEQ ID NO: 2995801 - RNA, 23 nt, Human
gcaagacgcugugcugcccugcc

SEQ ID NO: 2995802 - RNA, 15 nt, Human
gaugacauucccugc

SEQ ID NO: 2995803 - RNA, 23 nt, Human
gaugacauugacuauuuuuguuu

SEQ ID NO: 2995804 - RNA, 21 nt, Human
gaugacauugacuauuuuugu

SEQ ID NO: 2995805 - RNA, 17 nt, Human
gaugacauugacuauuu

SEQ ID NO: 2995806 - RNA, 17 nt, Human
gaugacauucccugcua

SEQ ID NO: 2995807 - RNA, 22 nt, Human
gaugcacagaguuguuacauuu

SEQ ID NO: 2995808 - RNA, 21 nt, Human
gaugcacagaguuguuacauu

SEQ ID NO: 2995809 - RNA, 13 nt, Human
gaugcaccagccc

SEQ ID NO: 2995810 - RNA, 14 nt, Human
gaugcagccucaca

SEQ ID NO: 2995811 - RNA, 12 nt, Human
gaugcagccuca

SEQ ID NO: 2995812 - RNA, 17 nt, Human
gaugccugguggcagcu

SEQ ID NO: 2995813 - RNA, 21 nt, Human
gauggcuaguaucaaaagaaa

SEQ ID NO: 2995814 - RNA, 14 nt, Human
gauggggcccugcc

SEQ ID NO: 2995815 - RNA, 22 nt, Human
gauggggcccugccuccuuugu

SEQ ID NO: 2995816 - RNA, 13 nt, Human
gauggggcccugc

SEQ ID NO: 2995817 - RNA, 22 nt, Human
gauggauuuccagccaaagccu

SEQ ID NO: 2995818 - RNA, 19 nt, Human
gaugccugguggcagcugc

SEQ ID NO: 2995819 - RNA, 18 nt, Human
gaugccugguggcagcug

SEQ ID NO: 2995820 - RNA, 20 nt, Human
gaugccugguggcagcugcg

SEQ ID NO: 2995821 - RNA, 15 nt, Human
gaugaaggucuguuu

SEQ ID NO: 2995822 - RNA, 18 nt, Human
gaugaaggucuguuuugu

SEQ ID NO: 2995823 - RNA, 14 nt, Human
gaugaaaauauuug

SEQ ID NO: 2995824 - RNA, 17 nt, Human
gaucuuugcagacaggc

SEQ ID NO: 2995825 - RNA, 18 nt, Human
gaucuuugcagacaggca

SEQ ID NO: 2995826 - RNA, 21 nt, Human
gauccugagccagauuucacu

SEQ ID NO: 2995827 - RNA, 22 nt, Human
gauccugagccagauuucacuc

SEQ ID NO: 2995828 - RNA, 15 nt, Human
gaucccucauccuca

SEQ ID NO: 2995829 - RNA, 16 nt, Human
gaucccucauccucau

SEQ ID NO: 2995830 - RNA, 18 nt, Human
gaucacgccacugcacua

SEQ ID NO: 2995831 - RNA, 16 nt, Human
gaucacgccacugcac

SEQ ID NO: 2995832 - RNA, 21 nt, Human
gaucaaguuauuuuuaauuug

SEQ ID NO: 2995833 - RNA, 12 nt, Human
gaucacggcuca

SEQ ID NO: 2995834 - RNA, 12 nt, Human
gaucagccuggg

SEQ ID NO: 2995835 - RNA, 15 nt, Human
gaucagccugggcaa

SEQ ID NO: 2995836 - RNA, 22 nt, Human
gaucagucugauucccaagcuc

SEQ ID NO: 2995837 - RNA, 21 nt, Human
gaucauccacugugccaugug

SEQ ID NO: 2995838 - RNA, 16 nt, Human
gaucauccacugugcc

SEQ ID NO: 2995839 - RNA, 17 nt, Human
gaucaugcauagagugu

SEQ ID NO: 2995840 - RNA, 14 nt, Human
gaucaugcauagag

SEQ ID NO: 2995841 - RNA, 19 nt, Human
gaucauccacugugccaug

SEQ ID NO: 2995842 - RNA, 17 nt, Human
gaucauccacugugcca

SEQ ID NO: 2995843 - RNA, 22 nt, Human
gauaaauaguuuaugauuccac

SEQ ID NO: 2995844 - RNA, 13 nt, Human
gaggaaggaaacc

SEQ ID NO: 2995845 - RNA, 19 nt, Human
gaggaaggaaacccagcuc

SEQ ID NO: 2995846 - RNA, 20 nt, Human
gaggaaggaaacccagcucu

SEQ ID NO: 2995847 - RNA, 21 nt, Human
gaggaaggaaacccagcucug

SEQ ID NO: 2995848 - RNA, 21 nt, Human
gauagcacagacccugcccug

SEQ ID NO: 2995849 - RNA, 22 nt, Human
gauagcacagacccugcccugu

SEQ ID NO: 2995850 - RNA, 20 nt, Human
gauagcacagacccugcccu

SEQ ID NO: 2995851 - RNA, 17 nt, Human
gauaggucagugcaaau

SEQ ID NO: 2995852 - RNA, 18 nt, Human
gauacaggaaaagcugcu

SEQ ID NO: 2995853 - RNA, 22 nt, Human
gauaauacaccacuacauucug

SEQ ID NO: 2995854 - RNA, 21 nt, Human
gauaauacaccacuacauucu

SEQ ID NO: 2995855 - RNA, 18 nt, Human
gauaauacaccacuacau

SEQ ID NO: 2995856 - RNA, 14 nt, Human
gauaauacaccacu

SEQ ID NO: 2995857 - RNA, 23 nt, Human
gauagauaggucagugcaaauac

SEQ ID NO: 2995858 - RNA, 11 nt, Human
gauacagaaaa

SEQ ID NO: 2995859 - RNA, 13 nt, Human
gaagucuucuauu

SEQ ID NO: 2995860 - RNA, 17 nt, Human
gaagucuucuauuuauu

SEQ ID NO: 2995861 - RNA, 14 nt, Human
gaagucuuuguaca

SEQ ID NO: 2995862 - RNA, 16 nt, Human
gaagucuuuguacaga

SEQ ID NO: 2995863 - RNA, 22 nt, Human
gacaaggauugcuacuguccua

SEQ ID NO: 2995864 - RNA, 21 nt, Human
gacaaggauugcuacuguccu

SEQ ID NO: 2995865 - RNA, 16 nt, Human
gacaaugacccagugg

SEQ ID NO: 2995866 - RNA, 21 nt, Human
gacaaugacuuacuguacaug

SEQ ID NO: 2995867 - RNA, 12 nt, Human
gacaaugcaaac

SEQ ID NO: 2995868 - RNA, 20 nt, Human
gacaaugacuuacuguacau

SEQ ID NO: 2995869 - RNA, 17 nt, Human
gacaaugacuuacugua

SEQ ID NO: 2995870 - RNA, 16 nt, Human
gacaaugcaaaccauc

SEQ ID NO: 2995871 - RNA, 18 nt, Human
gacaaugcaaaccaucau

SEQ ID NO: 2995872 - RNA, 12 nt, Human
gacaauuuauua

SEQ ID NO: 2995873 - RNA, 19 nt, Human
gacaauuuauuauggcaca

SEQ ID NO: 2995874 - RNA, 13 nt, Human
gacaauuuauuau

SEQ ID NO: 2995875 - RNA, 22 nt, Human
gacacaagccuucggcgccuua

SEQ ID NO: 2995876 - RNA, 17 nt, Human
gacacaggcccggcucc

SEQ ID NO: 2995877 - RNA, 15 nt, Human
gacacaggcccggcu

SEQ ID NO: 2995878 - RNA, 12 nt, Human
gacacaggcccg

SEQ ID NO: 2995879 - RNA, 18 nt, Human
gacacaggcccggcucca

SEQ ID NO: 2995880 - RNA, 12 nt, Human
gacacccuguga

SEQ ID NO: 2995881 - RNA, 13 nt, Human
gacacccugugau

SEQ ID NO: 2995882 - RNA, 22 nt, Human
gacacccugugauggggcccug

SEQ ID NO: 2995883 - RNA, 23 nt, Human
gacacccugugauggggcccugc

SEQ ID NO: 2995884 - RNA, 18 nt, Human
gacacuaaccacgcugga

SEQ ID NO: 2995885 - RNA, 17 nt, Human
gacacuaaccacgcugg

SEQ ID NO: 2995886 - RNA, 16 nt, Human
gacacuaaccacgcug

SEQ ID NO: 2995887 - RNA, 15 nt, Human
gacacuaaccacgcu

SEQ ID NO: 2995888 - RNA, 17 nt, Human
gacacgaauauugcuga

SEQ ID NO: 2995889 - RNA, 18 nt, Human
gacacgaauauugcugau

SEQ ID NO: 2995890 - RNA, 19 nt, Human
gacacgaauauugcugaug

SEQ ID NO: 2995891 - RNA, 17 nt, Human
gacaccuugacagggca

SEQ ID NO: 2995892 - RNA, 15 nt, Human
gacaccuugacaggg

SEQ ID NO: 2995893 - RNA, 20 nt, Human
gacaccuugacagggcacac

SEQ ID NO: 2995894 - RNA, 18 nt, Human
gacaccuugacagggcac

SEQ ID NO: 2995895 - RNA, 15 nt, Human
gacacgaauauugcu

SEQ ID NO: 2995896 - RNA, 22 nt, Human
gacaugggacauuugcucaugg

SEQ ID NO: 2995897 - RNA, 17 nt, Human
gacaugggacauuugcu

SEQ ID NO: 2995898 - RNA, 17 nt, Human
gacaugucuuuucuugc

SEQ ID NO: 2995899 - RNA, 21 nt, Human
gacaugucuuuucuugcauga

SEQ ID NO: 2995900 - RNA, 21 nt, Human
gacauauauuuuuuaaaauaa

SEQ ID NO: 2995901 - RNA, 20 nt, Human
gacauauauuuuuuaaaaua

SEQ ID NO: 2995902 - RNA, 17 nt, Human
gacauauauuuuuuaaa

SEQ ID NO: 2995903 - RNA, 23 nt, Human
gacauacuaaccagcagaaaugc

SEQ ID NO: 2995904 - RNA, 16 nt, Human
gacauacuaaccagca

SEQ ID NO: 2995905 - RNA, 15 nt, Human
gacauacuaaccagc

SEQ ID NO: 2995906 - RNA, 14 nt, Human
gacagcugccuggg

SEQ ID NO: 2995907 - RNA, 15 nt, Human
gacagcugccuggga

SEQ ID NO: 2995908 - RNA, 19 nt, Human
gacaggcauguucucugag

SEQ ID NO: 2995909 - RNA, 18 nt, Human
gacaggcauguucucuga

SEQ ID NO: 2995910 - RNA, 17 nt, Human
gacaggcaaugcuggcu

SEQ ID NO: 2995911 - RNA, 24 nt, Human
gacaggcaaugcuggcuguuggcu

SEQ ID NO: 2995912 - RNA, 16 nt, Human
gacaggcaaugcuggc

SEQ ID NO: 2995913 - RNA, 14 nt, Human
gacaggcaaugcug

SEQ ID NO: 2995914 - RNA, 16 nt, Human
gacagacacaggcccg

SEQ ID NO: 2995915 - RNA, 15 nt, Human
gacagacacaggccc

SEQ ID NO: 2995916 - RNA, 21 nt, Human
gacacuaaccacgcuggaccu

SEQ ID NO: 2995917 - RNA, 20 nt, Human
gacacuaaccacgcuggacc

SEQ ID NO: 2995918 - RNA, 14 nt, Human
gacagacacaggcc

SEQ ID NO: 2995919 - RNA, 12 nt, Human
gacagacacagg

SEQ ID NO: 2995920 - RNA, 12 nt, Human
gacagcugccug

SEQ ID NO: 2995921 - RNA, 13 nt, Human
gacagcugccugg

SEQ ID NO: 2995922 - RNA, 23 nt, Human
gaccugauuucugagcauuuaau

SEQ ID NO: 2995923 - RNA, 11 nt, Human
gaccucaggcc

SEQ ID NO: 2995924 - RNA, 12 nt, Human
gaccucaggccu

SEQ ID NO: 2995925 - RNA, 13 nt, Human
gaccucaggccug

SEQ ID NO: 2995926 - RNA, 15 nt, Human
gaccugaggcccuuc

SEQ ID NO: 2995927 - RNA, 18 nt, Human
gaccugaggcccuucucu

SEQ ID NO: 2995928 - RNA, 21 nt, Human
gaccugaggcccuucucucca

SEQ ID NO: 2995929 - RNA, 14 nt, Human
gaccgugaggccag

SEQ ID NO: 2995930 - RNA, 15 nt, Human
gaccgugaggccaga

SEQ ID NO: 2995931 - RNA, 19 nt, Human
gaccgugaggccagagaca

SEQ ID NO: 2995932 - RNA, 22 nt, Human
gacccacaagaaaugaaagcag

SEQ ID NO: 2995933 - RNA, 11 nt, Human
gacccacugcu

SEQ ID NO: 2995934 - RNA, 16 nt, Human
gacccaugcugcccug

SEQ ID NO: 2995935 - RNA, 14 nt, Human
gacccaugcugccc

SEQ ID NO: 2995936 - RNA, 15 nt, Human
gacccaugcugcccu

SEQ ID NO: 2995937 - RNA, 13 nt, Human
gacccaugcugcc

SEQ ID NO: 2995938 - RNA, 23 nt, Human
gacccugucucaaaaaaagaaaa

SEQ ID NO: 2995939 - RNA, 16 nt, Human
gacccugcccuguggg

SEQ ID NO: 2995940 - RNA, 13 nt, Human
gacccugcccugu

SEQ ID NO: 2995941 - RNA, 15 nt, Human
gacccugcccugugg

SEQ ID NO: 2995942 - RNA, 19 nt, Human
gacccugaggcccagaggg

SEQ ID NO: 2995943 - RNA, 20 nt, Human
gacccugaggcccagagggc

SEQ ID NO: 2995944 - RNA, 12 nt, Human
gacccugcccug

SEQ ID NO: 2995945 - RNA, 21 nt, Human
gacccugaggcccagagggcc

SEQ ID NO: 2995946 - RNA, 18 nt, Human
gacccugaggcccagagg

SEQ ID NO: 2995947 - RNA, 13 nt, Human
gaccccuccaugu

SEQ ID NO: 2995948 - RNA, 23 nt, Human
gaccuugaacuggguacuugugg

SEQ ID NO: 2995949 - RNA, 21 nt, Human
gaccuuucaauaggaaaaacu

SEQ ID NO: 2995950 - RNA, 18 nt, Human
gaccuuguagugagccga

SEQ ID NO: 2995951 - RNA, 21 nt, Human
gacggagucccaccuuggcug

SEQ ID NO: 2995952 - RNA, 18 nt, Human
gacggagucccaccuugg

SEQ ID NO: 2995953 - RNA, 14 nt, Human
gacggagucccacc

SEQ ID NO: 2995954 - RNA, 17 nt, Human
gacguguuaugacucca

SEQ ID NO: 2995955 - RNA, 20 nt, Human
gacguguuaugacuccagaa

SEQ ID NO: 2995956 - RNA, 21 nt, Human
gacuccaggcagcagacacau

SEQ ID NO: 2995957 - RNA, 20 nt, Human
gacuccaggcagcagacaca

SEQ ID NO: 2995958 - RNA, 17 nt, Human
gacuccaggcagcagac

SEQ ID NO: 2995959 - RNA, 16 nt, Human
gacuccaggcagcaga

SEQ ID NO: 2995960 - RNA, 15 nt, Human
gacuccaggcagcag

SEQ ID NO: 2995961 - RNA, 18 nt, Human
gacuccaaagaaauguaa

SEQ ID NO: 2995962 - RNA, 15 nt, Human
gacuccugcaggcag

SEQ ID NO: 2995963 - RNA, 16 nt, Human
gacuccugcaggcagc

SEQ ID NO: 2995964 - RNA, 14 nt, Human
gacuccugcaggca

SEQ ID NO: 2995965 - RNA, 18 nt, Human
gacucccaugagggagau

SEQ ID NO: 2995966 - RNA, 17 nt, Human
gacuacucccccaggug

SEQ ID NO: 2995967 - RNA, 12 nt, Human
gacuacaggcac

SEQ ID NO: 2995968 - RNA, 22 nt, Human
gacguguuaugacuccagaauu

SEQ ID NO: 2995969 - RNA, 13 nt, Human
gagaaagacuauu

SEQ ID NO: 2995970 - RNA, 15 nt, Human
gagaaagacuauuca

SEQ ID NO: 2995971 - RNA, 17 nt, Human
gagaaagacuauucaaa

SEQ ID NO: 2995972 - RNA, 18 nt, Human
gagaaagacuauucaaac

SEQ ID NO: 2995973 - RNA, 18 nt, Human
gagaaacuggcaaagcag

SEQ ID NO: 2995974 - RNA, 19 nt, Human
gagaaacuggcaaagcaga

SEQ ID NO: 2995975 - RNA, 22 nt, Human
gagaaaguacuucuccacccug

SEQ ID NO: 2995976 - RNA, 23 nt, Human
gagaaaguacuucuccacccugc

SEQ ID NO: 2995977 - RNA, 13 nt, Human
gacuuggaagcuc

SEQ ID NO: 2995978 - RNA, 21 nt, Human
gagaaaauggacguguuauga

SEQ ID NO: 2995979 - RNA, 17 nt, Human
gacuccugcaggcagcc

SEQ ID NO: 2995980 - RNA, 18 nt, Human
gacucgcgacaaugcaaa

SEQ ID NO: 2995981 - RNA, 19 nt, Human
gacucgcgacaaugcaaac

SEQ ID NO: 2995982 - RNA, 16 nt, Human
gacuuggaagcuccgc

SEQ ID NO: 2995983 - RNA, 15 nt, Human
gacuuggaagcuccg

SEQ ID NO: 2995984 - RNA, 14 nt, Human
gacuuggaagcucc

SEQ ID NO: 2995985 - RNA, 15 nt, Human
gagaagagcuguuca

SEQ ID NO: 2995986 - RNA, 22 nt, Human
gagaagagcuguucacagccag

SEQ ID NO: 2995987 - RNA, 13 nt, Human
gagaagagcuguu

SEQ ID NO: 2995988 - RNA, 14 nt, Human
gagaagaacugaaa

SEQ ID NO: 2995989 - RNA, 13 nt, Human
gagaagaacugaa

SEQ ID NO: 2995990 - RNA, 16 nt, Human
gagaagaacugaaauc

SEQ ID NO: 2995991 - RNA, 20 nt, Human
gagaaugcacaaacagaggc

SEQ ID NO: 2995992 - RNA, 21 nt, Human
gagaaugcacaaacagaggcc

SEQ ID NO: 2995993 - RNA, 22 nt, Human
gagaaugcacaaacagaggccg

SEQ ID NO: 2995994 - RNA, 21 nt, Human
gagaaugagagacacacugaa

SEQ ID NO: 2995995 - RNA, 12 nt, Human
gagacagcccgg

SEQ ID NO: 2995996 - RNA, 19 nt, Human
gagacagaguuuucacucu

SEQ ID NO: 2995997 - RNA, 15 nt, Human
gagacacaagccuuc

SEQ ID NO: 2995998 - RNA, 17 nt, Human
gagacacaagccuucgg

SEQ ID NO: 2995999 - RNA, 18 nt, Human
gagacacacugaagaagc

SEQ ID NO: 2996000 - RNA, 14 nt, Human
gagacagcccgggc

SEQ ID NO: 2996001 - RNA, 17 nt, Human
gagacagcccgggcucu

SEQ ID NO: 2996002 - RNA, 18 nt, Human
gagacagcccgggcucug

SEQ ID NO: 2996003 - RNA, 19 nt, Human
gagacagcccgggcucugc

SEQ ID NO: 2996004 - RNA, 20 nt, Human
gagacagcccgggcucugcc

SEQ ID NO: 2996005 - RNA, 21 nt, Human
gagacagcccgggcucugccu

SEQ ID NO: 2996006 - RNA, 22 nt, Human
gagacagcccgggcucugccuc

SEQ ID NO: 2996007 - RNA, 23 nt, Human
gagacagcccgggcucugccucc

SEQ ID NO: 2996008 - RNA, 24 nt, Human
gagacagcccgggcucugccuccc

SEQ ID NO: 2996009 - RNA, 13 nt, Human
gagacagcucugc

SEQ ID NO: 2996010 - RNA, 18 nt, Human
gagacagcucugcauacu

SEQ ID NO: 2996011 - RNA, 15 nt, Human
gagacagcucugcau

SEQ ID NO: 2996012 - RNA, 22 nt, Human
gagacuccugcaggcagccagg

SEQ ID NO: 2996013 - RNA, 16 nt, Human
gagacucgcgacaaug

SEQ ID NO: 2996014 - RNA, 18 nt, Human
gagacucgcgacaaugca

SEQ ID NO: 2996015 - RNA, 14 nt, Human
gagacucugucuca

SEQ ID NO: 2996016 - RNA, 17 nt, Human
gagauacagaauuuuau

SEQ ID NO: 2996017 - RNA, 19 nt, Human
gagagugaacaaauuuaca

SEQ ID NO: 2996018 - RNA, 15 nt, Human
gagagugaacaaauu

SEQ ID NO: 2996019 - RNA, 20 nt, Human
gagagggugggagugggccc

SEQ ID NO: 2996020 - RNA, 21 nt, Human
gagagggugggagugggccca

SEQ ID NO: 2996021 - RNA, 18 nt, Human
gagaggggaacagacugg

SEQ ID NO: 2996022 - RNA, 13 nt, Human
gagaggggaacag

SEQ ID NO: 2996023 - RNA, 13 nt, Human
gagagccuuccag

SEQ ID NO: 2996024 - RNA, 14 nt, Human
gagagccuuccagg

SEQ ID NO: 2996025 - RNA, 17 nt, Human
gagagaagagaaugcac

SEQ ID NO: 2996026 - RNA, 17 nt, Human
gagacuuuaaaagcauu

SEQ ID NO: 2996027 - RNA, 16 nt, Human
gagacuuuaaaagcau

SEQ ID NO: 2996028 - RNA, 14 nt, Human
gagacuuuaaaagc

SEQ ID NO: 2996029 - RNA, 20 nt, Human
gagcuuugaaaauucagugg

SEQ ID NO: 2996030 - RNA, 22 nt, Human
gagcuuucugcuaucaaagagg

SEQ ID NO: 2996031 - RNA, 23 nt, Human
gagcugcccucuccugggcagcu

SEQ ID NO: 2996032 - RNA, 21 nt, Human
gagcugcccucuccugggcag

SEQ ID NO: 2996033 - RNA, 19 nt, Human
gagcugcccucuccugggc

SEQ ID NO: 2996034 - RNA, 18 nt, Human
gagcugcccucuccuggg

SEQ ID NO: 2996035 - RNA, 14 nt, Human
gagcuuuuguagaa

SEQ ID NO: 2996036 - RNA, 16 nt, Human
gaggaaagcaaaggag

SEQ ID NO: 2996037 - RNA, 17 nt, Human
gaggaaagcaaaggaga

SEQ ID NO: 2996038 - RNA, 14 nt, Human
gaggaagccgcugg

SEQ ID NO: 2996039 - RNA, 17 nt, Human
gaggaagccgcuggggc

SEQ ID NO: 2996040 - RNA, 18 nt, Human
gaggaagccgcuggggcc

SEQ ID NO: 2996041 - RNA, 13 nt, Human
gaggaagccgcug

SEQ ID NO: 2996042 - RNA, 17 nt, Human
gaggaagagaaaaaaua

SEQ ID NO: 2996043 - RNA, 16 nt, Human
gaggaacaaggcaagg

SEQ ID NO: 2996044 - RNA, 14 nt, Human
gaggaacaaggcaa

SEQ ID NO: 2996045 - RNA, 16 nt, Human
gagcucgugggacagu

SEQ ID NO: 2996046 - RNA, 17 nt, Human
gagcugcccucuccugg

SEQ ID NO: 2996047 - RNA, 16 nt, Human
gagcugaucgcuucuc

SEQ ID NO: 2996048 - RNA, 21 nt, Human
gagcugaucgcuucuccccca

SEQ ID NO: 2996049 - RNA, 15 nt, Human
gagcugaguggggga

SEQ ID NO: 2996050 - RNA, 15 nt, Human
gagcuagcagcaggg

SEQ ID NO: 2996051 - RNA, 17 nt, Human
gagcuagcagcagggag

SEQ ID NO: 2996052 - RNA, 15 nt, Human
gagccugcaguuauu

SEQ ID NO: 2996053 - RNA, 13 nt, Human
gagccuccugccc

SEQ ID NO: 2996054 - RNA, 12 nt, Human
gagccugcaguu

SEQ ID NO: 2996055 - RNA, 15 nt, Human
gagccucagcauccu

SEQ ID NO: 2996056 - RNA, 14 nt, Human
gagccucagcaucc

SEQ ID NO: 2996057 - RNA, 17 nt, Human
gagccucagcauccugg

SEQ ID NO: 2996058 - RNA, 18 nt, Human
gagccucacagcagugag

SEQ ID NO: 2996059 - RNA, 15 nt, Human
gagccucacagcagu

SEQ ID NO: 2996060 - RNA, 13 nt, Human
gagccucagcauc

SEQ ID NO: 2996061 - RNA, 14 nt, Human
gagccucacagcag

SEQ ID NO: 2996062 - RNA, 13 nt, Human
gagccucacagca

SEQ ID NO: 2996063 - RNA, 18 nt, Human
gagcccacgcccccacug

SEQ ID NO: 2996064 - RNA, 20 nt, Human
gagccgagaucacgccacug

SEQ ID NO: 2996065 - RNA, 19 nt, Human
gagccgagaucacgccacu

SEQ ID NO: 2996066 - RNA, 22 nt, Human
gagccgagaucacgccacugca

SEQ ID NO: 2996067 - RNA, 21 nt, Human
gagccgagaucacgccacugc

SEQ ID NO: 2996068 - RNA, 13 nt, Human
gagccgcccaagg

SEQ ID NO: 2996069 - RNA, 20 nt, Human
gagccgagaucgcgccacug

SEQ ID NO: 2996070 - RNA, 16 nt, Human
gagccgcccaaggccu

SEQ ID NO: 2996071 - RNA, 18 nt, Human
gagccagauuucacucuc

SEQ ID NO: 2996072 - RNA, 19 nt, Human
gagccagauuucacucucc

SEQ ID NO: 2996073 - RNA, 15 nt, Human
gagccagauuucacu

SEQ ID NO: 2996074 - RNA, 20 nt, Human
gagccacugcaccgggccac

SEQ ID NO: 2996075 - RNA, 13 nt, Human
gagccacugcacc

SEQ ID NO: 2996076 - RNA, 19 nt, Human
gagccacugcaccgggcca

SEQ ID NO: 2996077 - RNA, 18 nt, Human
gagccacugcaccgggcc

SEQ ID NO: 2996078 - RNA, 17 nt, Human
gagcccaccuuggcuca

SEQ ID NO: 2996079 - RNA, 15 nt, Human
gagcccaccuuggcu

SEQ ID NO: 2996080 - RNA, 13 nt, Human
gagcccaccuugg

SEQ ID NO: 2996081 - RNA, 13 nt, Human
gagccagauuuca

SEQ ID NO: 2996082 - RNA, 22 nt, Human
gagcagccacauuccugaugcu

SEQ ID NO: 2996083 - RNA, 21 nt, Human
gagcagccacauuccugaugc

SEQ ID NO: 2996084 - RNA, 19 nt, Human
gagcagagaccaucccuga

SEQ ID NO: 2996085 - RNA, 21 nt, Human
gagcagagaccaucccugaag

SEQ ID NO: 2996086 - RNA, 23 nt, Human
gagcagagaccaucccugaaggc

SEQ ID NO: 2996087 - RNA, 17 nt, Human
gagcagagaccaucccu

SEQ ID NO: 2996088 - RNA, 18 nt, Human
gagcagagaccaucccug

SEQ ID NO: 2996089 - RNA, 16 nt, Human
gagcagagaccauccc

SEQ ID NO: 2996090 - RNA, 19 nt, Human
gagauagccaaggccaaag

SEQ ID NO: 2996091 - RNA, 20 nt, Human
gagauagccaaggccaaagg

SEQ ID NO: 2996092 - RNA, 21 nt, Human
gagauagccaaggccaaagga

SEQ ID NO: 2996093 - RNA, 17 nt, Human
cuugcugcugauuuaaa

SEQ ID NO: 2996094 - RNA, 19 nt, Human
cuugcugcugauuuaaaca

SEQ ID NO: 2996095 - RNA, 17 nt, Human
cuugccaaauauaaaua

SEQ ID NO: 2996096 - RNA, 22 nt, Human
cuugcaugguuuggagcugauc

SEQ ID NO: 2996097 - RNA, 20 nt, Human
cuugcaugguuuggagcuga

SEQ ID NO: 2996098 - RNA, 17 nt, Human
cuuggacauuuuauguc

SEQ ID NO: 2996099 - RNA, 18 nt, Human
cuuggacauuuuaugucu

SEQ ID NO: 2996100 - RNA, 16 nt, Human
cuuggacauuuuaugu

SEQ ID NO: 2996101 - RNA, 13 nt, Human
cuugcuugcuuuu

SEQ ID NO: 2996102 - RNA, 19 nt, Human
cuuggacauuuuaugucuu

SEQ ID NO: 2996103 - RNA, 13 nt, Human
cuuggauuguccc

SEQ ID NO: 2996104 - RNA, 14 nt, Human
cuuggauugucccc

SEQ ID NO: 2996105 - RNA, 23 nt, Human
cuuggcucaaguccucuuuucug

SEQ ID NO: 2996106 - RNA, 13 nt, Human
cuuggcugcaggg

SEQ ID NO: 2996107 - RNA, 12 nt, Human
cuuggcugcagg

SEQ ID NO: 2996108 - RNA, 21 nt, Human
cuuguaaauagcucagguguc

SEQ ID NO: 2996109 - RNA, 20 nt, Human
cuugguuuguaaauuaacuu

SEQ ID NO: 2996110 - RNA, 18 nt, Human
cuuggggaccagagcugc

SEQ ID NO: 2996111 - RNA, 19 nt, Human
cuuggggaccagagcugcc

SEQ ID NO: 2996112 - RNA, 17 nt, Human
cuuggggaccagagcug

SEQ ID NO: 2996113 - RNA, 16 nt, Human
cuuggggaccagagcu

SEQ ID NO: 2996114 - RNA, 18 nt, Human
cuuguggacacagcucuu

SEQ ID NO: 2996115 - RNA, 17 nt, Human
cuuguggacacagcucu

SEQ ID NO: 2996116 - RNA, 16 nt, Human
cuuguggacacagcuc

SEQ ID NO: 2996117 - RNA, 16 nt, Human
cuugagugcucaguag

SEQ ID NO: 2996118 - RNA, 22 nt, Human
cuugagugucaagcugaccuug

SEQ ID NO: 2996119 - RNA, 22 nt, Human
cuugcaaaguaucccuacugua

SEQ ID NO: 2996120 - RNA, 14 nt, Human
cuugcaauggcagc

SEQ ID NO: 2996121 - RNA, 21 nt, Human
cuugcaugaggcuaguguggu

SEQ ID NO: 2996122 - RNA, 17 nt, Human
cuugcaugaggcuagug

SEQ ID NO: 2996123 - RNA, 21 nt, Human
cuugcaugguuuagaaagcuu

SEQ ID NO: 2996124 - RNA, 19 nt, Human
cuugcaugguuuggagcug

SEQ ID NO: 2996125 - RNA, 18 nt, Human
cuugcaugguuuggagcu

SEQ ID NO: 2996126 - RNA, 18 nt, Human
cuugcagacucuacagag

SEQ ID NO: 2996127 - RNA, 22 nt, Human
cuugagccuugaacuuugaccu

SEQ ID NO: 2996128 - RNA, 20 nt, Human
cuugagccuugaacuuugac

SEQ ID NO: 2996129 - RNA, 14 nt, Human
cuugagagggugga

SEQ ID NO: 2996130 - RNA, 21 nt, Human
cuugaccauucuccaccugcc

SEQ ID NO: 2996131 - RNA, 17 nt, Human
cuugaccauucuccacc

SEQ ID NO: 2996132 - RNA, 20 nt, Human
cuugaccauucuccaccugc

SEQ ID NO: 2996133 - RNA, 19 nt, Human
cuugagccuugaacuuuga

SEQ ID NO: 2996134 - RNA, 14 nt, Human
cuugaacccgggag

SEQ ID NO: 2996135 - RNA, 19 nt, Human
cuugaacccgggaggcaga

SEQ ID NO: 2996136 - RNA, 20 nt, Human
cuugaacccgggaggcagag

SEQ ID NO: 2996137 - RNA, 18 nt, Human
cuugaacuccuggccuca

SEQ ID NO: 2996138 - RNA, 17 nt, Human
cuugaacuccuggccuc

SEQ ID NO: 2996139 - RNA, 15 nt, Human
cuugaacuccuggcc

SEQ ID NO: 2996140 - RNA, 14 nt, Human
cuugaacuccuggc

SEQ ID NO: 2996141 - RNA, 16 nt, Human
cuugaacuggguacuu

SEQ ID NO: 2996142 - RNA, 19 nt, Human
cuugaacuccuggccucaa

SEQ ID NO: 2996143 - RNA, 20 nt, Human
cuugaacuggguacuugugg

SEQ ID NO: 2996144 - RNA, 18 nt, Human
cuugaacuggguacuugu

SEQ ID NO: 2996145 - RNA, 15 nt, Human
cuugaacuuugaccu

SEQ ID NO: 2996146 - RNA, 19 nt, Human
cuucuuuccacagaagcuc

SEQ ID NO: 2996147 - RNA, 13 nt, Human
cuucuuuccacag

SEQ ID NO: 2996148 - RNA, 22 nt, Human
cuucuuuauaauucuacuuuga

SEQ ID NO: 2996149 - RNA, 19 nt, Human
cuugaaauauaggaacuua

SEQ ID NO: 2996150 - RNA, 17 nt, Human
cuuucccuuggugcccu

SEQ ID NO: 2996151 - RNA, 12 nt, Human
cuuucccuuggu

SEQ ID NO: 2996152 - RNA, 16 nt, Human
cuuuccaaaugcccag

SEQ ID NO: 2996153 - RNA, 22 nt, Human
cuuuccaaaguacacuguuuca

SEQ ID NO: 2996154 - RNA, 16 nt, Human
cuuuccaaaguacacu

SEQ ID NO: 2996155 - RNA, 14 nt, Human
cuuuccaggaaggc

SEQ ID NO: 2996156 - RNA, 21 nt, Human
cuuguggacacagcucuucuc

SEQ ID NO: 2996157 - RNA, 21 nt, Human
cuuuauuuucuauaauuuaaa

SEQ ID NO: 2996158 - RNA, 17 nt, Human
cuuuccugaggcugggc

SEQ ID NO: 2996159 - RNA, 16 nt, Human
cuuuccugaggcuggg

SEQ ID NO: 2996160 - RNA, 20 nt, Human
cuuuccugaggcugggcucc

SEQ ID NO: 2996161 - RNA, 21 nt, Human
cuuuccugaggcugggcuccc

SEQ ID NO: 2996162 - RNA, 19 nt, Human
cuuuggaaagaguaggaag

SEQ ID NO: 2996163 - RNA, 23 nt, Human
cuuuggaaagaguaggaagacuu

SEQ ID NO: 2996164 - RNA, 15 nt, Human
cuuugcagacaggca

SEQ ID NO: 2996165 - RNA, 14 nt, Human
cuuugcagacaggc

SEQ ID NO: 2996166 - RNA, 11 nt, Human
cuuuuaaacuc

SEQ ID NO: 2996167 - RNA, 17 nt, Human
cuuuuaagacuuugguu

SEQ ID NO: 2996168 - RNA, 14 nt, Human
cuuuuaagaaucaa

SEQ ID NO: 2996169 - RNA, 21 nt, Human
cuuuucgcaggauucuuccuc

SEQ ID NO: 2996170 - RNA, 20 nt, Human
cuuuucgcaggauucuuccu

SEQ ID NO: 2996171 - RNA, 13 nt, Human
cuuuuccaacccu

SEQ ID NO: 2996172 - RNA, 23 nt, Human
cuuuuccaacccucaucaccaac

SEQ ID NO: 2996173 - RNA, 22 nt, Human
cuuuucauuuaggugaggaagc

SEQ ID NO: 2996174 - RNA, 15 nt, Human
cuuuugcauauugca

SEQ ID NO: 2996175 - RNA, 22 nt, Human
cuuuuuaauauugauaugcuua

SEQ ID NO: 2996176 - RNA, 17 nt, Human
cuuuucuuucagccaag

SEQ ID NO: 2996177 - RNA, 13 nt, Human
cuuuucuuuucuu

SEQ ID NO: 2996178 - RNA, 22 nt, Human
cuuuuuauauucucagcagagu

SEQ ID NO: 2996179 - RNA, 16 nt, Human
cuuuuuauaacuuuuu

SEQ ID NO: 2996180 - RNA, 18 nt, Human
cuuuuuauauucucagca

SEQ ID NO: 2996181 - RNA, 12 nt, Human
cuuuuuauaacu

SEQ ID NO: 2996182 - RNA, 17 nt, Human
cuuuuuuauacauaaac

SEQ ID NO: 2996183 - RNA, 16 nt, Human
cuuuuuuauacauaaa

SEQ ID NO: 2996184 - RNA, 15 nt, Human
cuuuuuuauacauaa

SEQ ID NO: 2996185 - RNA, 11 nt, Human
gaaaaagaaaa

SEQ ID NO: 2996186 - RNA, 16 nt, Human
gaaaaagaaaaaauau

SEQ ID NO: 2996187 - RNA, 18 nt, Human
cuuuuuuauacauaaaca

SEQ ID NO: 2996188 - RNA, 20 nt, Human
gaaaggaaugcaaagaugaa

SEQ ID NO: 2996189 - RNA, 21 nt, Human
gaaaggaagugggacuggcac

SEQ ID NO: 2996190 - RNA, 22 nt, Human
gaaaguacuucuccacccugcu

SEQ ID NO: 2996191 - RNA, 11 nt, Human
gaaaggaaaga

SEQ ID NO: 2996192 - RNA, 16 nt, Human
gaaaggaaagaggcuc

SEQ ID NO: 2996193 - RNA, 21 nt, Human
gaaagcuugcccuggugccuc

SEQ ID NO: 2996194 - RNA, 17 nt, Human
gaaaguugcaaggcaaa

SEQ ID NO: 2996195 - RNA, 21 nt, Human
gaaaguugcaaggcaaauguu

SEQ ID NO: 2996196 - RNA, 22 nt, Human
gaaaguugcaaggcaaauguuu

SEQ ID NO: 2996197 - RNA, 16 nt, Human
gaaacugacacaugcu

SEQ ID NO: 2996198 - RNA, 13 nt, Human
gaaacugccagca

SEQ ID NO: 2996199 - RNA, 15 nt, Human
gaaacugccagcaac

SEQ ID NO: 2996200 - RNA, 16 nt, Human
gaaaaaugagccuggc

SEQ ID NO: 2996201 - RNA, 22 nt, Human
gaaagacuauucaaacagucuc

SEQ ID NO: 2996202 - RNA, 23 nt, Human
gaaagacuauucaaacagucuca

SEQ ID NO: 2996203 - RNA, 19 nt, Human
gaaagacuauucaaacagu

SEQ ID NO: 2996204 - RNA, 13 nt, Human
gaaagcagaacag

SEQ ID NO: 2996205 - RNA, 16 nt, Human
gaaagaucaaaagguu

SEQ ID NO: 2996206 - RNA, 22 nt, Human
gaacaguaacauagcugugauu

SEQ ID NO: 2996207 - RNA, 20 nt, Human
gaacaguuguguuugaagca

SEQ ID NO: 2996208 - RNA, 24 nt, Human
gaacaguuaccucugccucagaaa

SEQ ID NO: 2996209 - RNA, 17 nt, Human
gaacaggauauucucac

SEQ ID NO: 2996210 - RNA, 22 nt, Human
gaacagacuggaagcacagcuu

SEQ ID NO: 2996211 - RNA, 22 nt, Human
gaacaguuguguuugaagcaca

SEQ ID NO: 2996212 - RNA, 21 nt, Human
gaacacucuauaacaaaggau

SEQ ID NO: 2996213 - RNA, 15 nt, Human
gaacacucuauaaca

SEQ ID NO: 2996214 - RNA, 17 nt, Human
gaacacuccuucacaga

SEQ ID NO: 2996215 - RNA, 19 nt, Human
gaacagacuggaagcacag

SEQ ID NO: 2996216 - RNA, 20 nt, Human
gaacagacuggaagcacagc

SEQ ID NO: 2996217 - RNA, 15 nt, Human
gaacacuccuucaca

SEQ ID NO: 2996218 - RNA, 16 nt, Human
gaacacuccuucacag

SEQ ID NO: 2996219 - RNA, 21 nt, Human
gaaauuuccugggagcuuuug

SEQ ID NO: 2996220 - RNA, 17 nt, Human
gaaauuagguugaaaca

SEQ ID NO: 2996221 - RNA, 19 nt, Human
gaaauuagguugaaacaua

SEQ ID NO: 2996222 - RNA, 18 nt, Human
gaaauuagguugaaacau

SEQ ID NO: 2996223 - RNA, 20 nt, Human
gaaauuagguugaaacauau

SEQ ID NO: 2996224 - RNA, 17 nt, Human
gaaaugggcagagcaga

SEQ ID NO: 2996225 - RNA, 19 nt, Human
gaaaugggcagagcagaga

SEQ ID NO: 2996226 - RNA, 17 nt, Human
gaaauguacagcaagga

SEQ ID NO: 2996227 - RNA, 22 nt, Human
gaaauguaagggaaacugccag

SEQ ID NO: 2996228 - RNA, 17 nt, Human
gaaaugucaguucugau

SEQ ID NO: 2996229 - RNA, 16 nt, Human
gaaaugggcagagcag

SEQ ID NO: 2996230 - RNA, 15 nt, Human
gaaaugggcagagca

SEQ ID NO: 2996231 - RNA, 11 nt, Human
gaaaugagcug

SEQ ID NO: 2996232 - RNA, 18 nt, Human
gaaaugaggucagagccu

SEQ ID NO: 2996233 - RNA, 17 nt, Human
gaaauaaacgucuuaaa

SEQ ID NO: 2996234 - RNA, 16 nt, Human
gaaauaaacgucuuaa

SEQ ID NO: 2996235 - RNA, 14 nt, Human
gaaauaaacgucuu

SEQ ID NO: 2996236 - RNA, 21 nt, Human
gaaauaaacgucuuaaauauu

SEQ ID NO: 2996237 - RNA, 18 nt, Human
gaaauaaacgucuuaaau

SEQ ID NO: 2996238 - RNA, 17 nt, Human
gaaauauaggaacuuaa

SEQ ID NO: 2996239 - RNA, 19 nt, Human
gaaauaucugaaaauguau

SEQ ID NO: 2996240 - RNA, 18 nt, Human
gaaauaucugaaaaugua

SEQ ID NO: 2996241 - RNA, 13 nt, Human
gaaauauuuauuu

SEQ ID NO: 2996242 - RNA, 16 nt, Human
gaaauauuuauuuuaa

SEQ ID NO: 2996243 - RNA, 15 nt, Human
gaaauauuuauuuua

SEQ ID NO: 2996244 - RNA, 18 nt, Human
gaaguccccucuccucca

SEQ ID NO: 2996245 - RNA, 23 nt, Human
gaaguccaagcauuuagauguau

SEQ ID NO: 2996246 - RNA, 23 nt, Human
gaaguccccucuccuccacauuu

SEQ ID NO: 2996247 - RNA, 18 nt, Human
gaagucuuagauguauau

SEQ ID NO: 2996248 - RNA, 20 nt, Human
gaagucacauuccugaacag

SEQ ID NO: 2996249 - RNA, 16 nt, Human
gaagucacauuccuga

SEQ ID NO: 2996250 - RNA, 21 nt, Human
gaagucacauuccugaacagg

SEQ ID NO: 2996251 - RNA, 18 nt, Human
gaagucaaggcuuagacc

SEQ ID NO: 2996252 - RNA, 13 nt, Human
gaagucacacagu

SEQ ID NO: 2996253 - RNA, 20 nt, Human
gaaguaauaugcacacauuu

SEQ ID NO: 2996254 - RNA, 19 nt, Human
gaaguaauaugcacacauu

SEQ ID NO: 2996255 - RNA, 19 nt, Human
gaaggucuguuuuguguac

SEQ ID NO: 2996256 - RNA, 20 nt, Human
gaagguagaauguuuucaaa

SEQ ID NO: 2996257 - RNA, 13 nt, Human
gaagggggcuggg

SEQ ID NO: 2996258 - RNA, 20 nt, Human
gaaggcauggacuucuggau

SEQ ID NO: 2996259 - RNA, 14 nt, Human
gaaggaugcugucu

SEQ ID NO: 2996260 - RNA, 18 nt, Human
gaagccgcuggggccagu

SEQ ID NO: 2996261 - RNA, 20 nt, Human
gaagccgcuggggccaguug

SEQ ID NO: 2996262 - RNA, 14 nt, Human
gaagccgcuggggc

SEQ ID NO: 2996263 - RNA, 19 nt, Human
gaaggaaacccagcucugg

SEQ ID NO: 2996264 - RNA, 20 nt, Human
gaaggaaacccagcucuggu

SEQ ID NO: 2996265 - RNA, 21 nt, Human
gaaggacauugcggacagcca

SEQ ID NO: 2996266 - RNA, 20 nt, Human
gaaggacauugcggacagcc

SEQ ID NO: 2996267 - RNA, 19 nt, Human
gaaggacauugcggacagc

SEQ ID NO: 2996268 - RNA, 21 nt, Human
gaaggaaacccagcucugguc

SEQ ID NO: 2996269 - RNA, 22 nt, Human
gaaggaaacccagcucuggucc

SEQ ID NO: 2996270 - RNA, 15 nt, Human
gaaggaacguccccu

SEQ ID NO: 2996271 - RNA, 19 nt, Human
gaaggaagacuucaucccu

SEQ ID NO: 2996272 - RNA, 20 nt, Human
gaagauucuuguauuuauua

SEQ ID NO: 2996273 - RNA, 18 nt, Human
gaagcauuuacuuugugu

SEQ ID NO: 2996274 - RNA, 15 nt, Human
gaagagcuguucaca

SEQ ID NO: 2996275 - RNA, 20 nt, Human
gaagagcuguucacagccag

SEQ ID NO: 2996276 - RNA, 13 nt, Human
gaagagcuguuca

SEQ ID NO: 2996277 - RNA, 23 nt, Human
gaagagcuguucacagccagacu

SEQ ID NO: 2996278 - RNA, 12 nt, Human
gaagagccuugc

SEQ ID NO: 2996279 - RNA, 17 nt, Human
gaagacuucaucccucu

SEQ ID NO: 2996280 - RNA, 19 nt, Human
gaagacuucaucccucugg

SEQ ID NO: 2996281 - RNA, 15 nt, Human
gaagacuucaucccu

SEQ ID NO: 2996282 - RNA, 16 nt, Human
gaagacuucaucccuc

SEQ ID NO: 2996283 - RNA, 16 nt, Human
gaacucccuuucaaca

SEQ ID NO: 2996284 - RNA, 15 nt, Human
gaacucccuuucaac

SEQ ID NO: 2996285 - RNA, 15 nt, Human
gaaccacaagacugc

SEQ ID NO: 2996286 - RNA, 14 nt, Human
gaaccacaagacug

SEQ ID NO: 2996287 - RNA, 18 nt, Human
gaaccacaucuugcucug

SEQ ID NO: 2996288 - RNA, 17 nt, Human
gaacuuggcgcugcccc

SEQ ID NO: 2996289 - RNA, 14 nt, Human
gaacuuaaauaaug

SEQ ID NO: 2996290 - RNA, 17 nt, Human
gaacuuaaauaauguga

SEQ ID NO: 2996291 - RNA, 17 nt, Human
gaacuugggccacugug

SEQ ID NO: 2996292 - RNA, 18 nt, Human
gaacuuggcgcugccccu

SEQ ID NO: 2996293 - RNA, 22 nt, Human
gaacuuguaaaggaauuuaaaa

SEQ ID NO: 2996294 - RNA, 17 nt, Human
gaacuuuccaggaaggc

SEQ ID NO: 2996295 - RNA, 22 nt, Human
gaacuuugaccucugcagcaau

SEQ ID NO: 2996296 - RNA, 16 nt, Human
gaacuuugaccucugc

SEQ ID NO: 2996297 - RNA, 14 nt, Human
gaagaagcucucuc

SEQ ID NO: 2996298 - RNA, 21 nt, Human
cugguacucugccacuuuauu

SEQ ID NO: 2996299 - RNA, 23 nt, Human
cuggucucaaacucuugaccuca

SEQ ID NO: 2996300 - RNA, 13 nt, Human
cuggucccacuca

SEQ ID NO: 2996301 - RNA, 21 nt, Human
cugguccauagagagcaagac

SEQ ID NO: 2996302 - RNA, 19 nt, Human
cugggcucccuucccaccu

SEQ ID NO: 2996303 - RNA, 20 nt, Human
cugggcucccuucccaccuc

SEQ ID NO: 2996304 - RNA, 21 nt, Human
cugggcucccuucccaccucu

SEQ ID NO: 2996305 - RNA, 22 nt, Human
cugggcucccuucccaccucuc

SEQ ID NO: 2996306 - RNA, 14 nt, Human
cuggguacuugugg

SEQ ID NO: 2996307 - RNA, 16 nt, Human
cuggguacuuguggac

SEQ ID NO: 2996308 - RNA, 18 nt, Human
cuggguacuuguggacac

SEQ ID NO: 2996309 - RNA, 15 nt, Human
cuggguuggagggug

SEQ ID NO: 2996310 - RNA, 21 nt, Human
cuguaaguuacaugaaggcag

SEQ ID NO: 2996311 - RNA, 17 nt, Human
cuguaauuugugauaca

SEQ ID NO: 2996312 - RNA, 18 nt, Human
cuguaauuugugauacaa

SEQ ID NO: 2996313 - RNA, 22 nt, Human
cuguaauuugugauacaaugcu

SEQ ID NO: 2996314 - RNA, 21 nt, Human
cuguaauuugugauacaaugc

SEQ ID NO: 2996315 - RNA, 23 nt, Human
cuguacagagcccacgcccccac

SEQ ID NO: 2996316 - RNA, 16 nt, Human
cuguacauacuuuuug

SEQ ID NO: 2996317 - RNA, 21 nt, Human
cuguaccucuugagccuugaa

SEQ ID NO: 2996318 - RNA, 15 nt, Human
cuguacauacuuuuu

SEQ ID NO: 2996319 - RNA, 23 nt, Human
cuguacaugaaaacacauuuuuc

SEQ ID NO: 2996320 - RNA, 22 nt, Human
cuguacaugaaaacacauuuuu

SEQ ID NO: 2996321 - RNA, 20 nt, Human
cugguucaggguuggccccu

SEQ ID NO: 2996322 - RNA, 13 nt, Human
cugguggcagcuc

SEQ ID NO: 2996323 - RNA, 14 nt, Human
cugguggcagcuca

SEQ ID NO: 2996324 - RNA, 12 nt, Human
cugguggcagcu

SEQ ID NO: 2996325 - RNA, 17 nt, Human
cugucuccucucucugu

SEQ ID NO: 2996326 - RNA, 20 nt, Human
cugucuccucucucuguaau

SEQ ID NO: 2996327 - RNA, 18 nt, Human
cugucucuacuaaaaaua

SEQ ID NO: 2996328 - RNA, 15 nt, Human
cuguccuauuauauu

SEQ ID NO: 2996329 - RNA, 21 nt, Human
cuguccuauuauauucauucu

SEQ ID NO: 2996330 - RNA, 22 nt, Human
cugucucaaaaaaagaaaaaga

SEQ ID NO: 2996331 - RNA, 21 nt, Human
cuguccuacucugugucaggu

SEQ ID NO: 2996332 - RNA, 13 nt, Human
cugucccccugac

SEQ ID NO: 2996333 - RNA, 14 nt, Human
cugucccccugaca

SEQ ID NO: 2996334 - RNA, 20 nt, Human
cuguccuacucugugucagg

SEQ ID NO: 2996335 - RNA, 18 nt, Human
cuguccuacucuguguca

SEQ ID NO: 2996336 - RNA, 17 nt, Human
cuguccuacucuguguc

SEQ ID NO: 2996337 - RNA, 16 nt, Human
cuguccuacucugugu

SEQ ID NO: 2996338 - RNA, 22 nt, Human
cugucccuuacgugaguccugg

SEQ ID NO: 2996339 - RNA, 15 nt, Human
cuguaugauucccag

SEQ ID NO: 2996340 - RNA, 18 nt, Human
cuguaucccaugagccuc

SEQ ID NO: 2996341 - RNA, 22 nt, Human
cuguaccucuugagccuugaac

SEQ ID NO: 2996342 - RNA, 15 nt, Human
cuguaucccaugagc

SEQ ID NO: 2996343 - RNA, 14 nt, Human
cuguaucccaugag

SEQ ID NO: 2996344 - RNA, 22 nt, Human
cugucccagugccgagaaggaa

SEQ ID NO: 2996345 - RNA, 16 nt, Human
cuguauuuuaaaagaa

SEQ ID NO: 2996346 - RNA, 13 nt, Human
cuguauuuuaaaa

SEQ ID NO: 2996347 - RNA, 23 nt, Human
cugucauuugagcagggcucagc

SEQ ID NO: 2996348 - RNA, 20 nt, Human
cugggaaagggauuuucagc

SEQ ID NO: 2996349 - RNA, 17 nt, Human
cugggagagccuuccag

SEQ ID NO: 2996350 - RNA, 18 nt, Human
cugggagagccuuccagg

SEQ ID NO: 2996351 - RNA, 19 nt, Human
cugggagagccuuccaggg

SEQ ID NO: 2996352 - RNA, 20 nt, Human
cugggagagccuuccagggg

SEQ ID NO: 2996353 - RNA, 21 nt, Human
cugggagagccuuccaggggu

SEQ ID NO: 2996354 - RNA, 15 nt, Human
cuggcuuucagagua

SEQ ID NO: 2996355 - RNA, 20 nt, Human
cuggcugguuagagguuccc

SEQ ID NO: 2996356 - RNA, 17 nt, Human
cuggcuguuggcugggg

SEQ ID NO: 2996357 - RNA, 16 nt, Human
cuggcuguuggcuggg

SEQ ID NO: 2996358 - RNA, 20 nt, Human
cugggaucccucauccucau

SEQ ID NO: 2996359 - RNA, 18 nt, Human
cugggaugauuggagggg

SEQ ID NO: 2996360 - RNA, 20 nt, Human
cugggauuacaggugugaac

SEQ ID NO: 2996361 - RNA, 17 nt, Human
cugggauuacaggugug

SEQ ID NO: 2996362 - RNA, 19 nt, Human
cugggaggucaaggcugca

SEQ ID NO: 2996363 - RNA, 21 nt, Human
cugggaggucaaggcugcagu

SEQ ID NO: 2996364 - RNA, 20 nt, Human
cugggagguuaaaaagaaaa

SEQ ID NO: 2996365 - RNA, 16 nt, Human
cuggccuggccccuca

SEQ ID NO: 2996366 - RNA, 17 nt, Human
cuggccuggccccucag

SEQ ID NO: 2996367 - RNA, 14 nt, Human
cuggccugugucua

SEQ ID NO: 2996368 - RNA, 15 nt, Human
cuggccuucggccuc

SEQ ID NO: 2996369 - RNA, 21 nt, Human
cuggccuucggccuccauccu

SEQ ID NO: 2996370 - RNA, 18 nt, Human
cuggccuucggccuccau

SEQ ID NO: 2996371 - RNA, 17 nt, Human
cuggccuucggccucca

SEQ ID NO: 2996372 - RNA, 16 nt, Human
cuggccuucggccucc

SEQ ID NO: 2996373 - RNA, 15 nt, Human
cuggccugagcuggg

SEQ ID NO: 2996374 - RNA, 18 nt, Human
cuggccugagcugggaug

SEQ ID NO: 2996375 - RNA, 14 nt, Human
cuggccuggccccu

SEQ ID NO: 2996376 - RNA, 13 nt, Human
cuggccuggcccc

SEQ ID NO: 2996377 - RNA, 13 nt, Human
cuggccucugcac

SEQ ID NO: 2996378 - RNA, 14 nt, Human
cuggccucugcacu

SEQ ID NO: 2996379 - RNA, 16 nt, Human
cuggccugagcuggga

SEQ ID NO: 2996380 - RNA, 22 nt, Human
cuggccucaagugauucuccug

SEQ ID NO: 2996381 - RNA, 12 nt, Human
cuggccucugca

SEQ ID NO: 2996382 - RNA, 23 nt, Human
cuggccucaagugauucuccugc

SEQ ID NO: 2996383 - RNA, 22 nt, Human
cuggccagaugcaccagcccuu

SEQ ID NO: 2996384 - RNA, 24 nt, Human
cuggcaugggaaugaaugucagug

SEQ ID NO: 2996385 - RNA, 16 nt, Human
cuggcaugggaaugaa

SEQ ID NO: 2996386 - RNA, 18 nt, Human
cuggcaugggaaugaaug

SEQ ID NO: 2996387 - RNA, 19 nt, Human
cuggcaugggaaugaaugu

SEQ ID NO: 2996388 - RNA, 22 nt, Human
cuggcaugggaaugaaugucag

SEQ ID NO: 2996389 - RNA, 16 nt, Human
cuggcacuauaaugua

SEQ ID NO: 2996390 - RNA, 15 nt, Human
cuggcacuauaaugu

SEQ ID NO: 2996391 - RNA, 14 nt, Human
cuggcaagaaugug

SEQ ID NO: 2996392 - RNA, 18 nt, Human
cuggaauauauaaccagu

SEQ ID NO: 2996393 - RNA, 22 nt, Human
cuggcacccggccccugcuggu

SEQ ID NO: 2996394 - RNA, 18 nt, Human
cuggcacccggccccugc

SEQ ID NO: 2996395 - RNA, 17 nt, Human
cuggcacccggccccug

SEQ ID NO: 2996396 - RNA, 16 nt, Human
cuggcacccggccccu

SEQ ID NO: 2996397 - RNA, 20 nt, Human
cugcaguuuuuuuccuucaa

SEQ ID NO: 2996398 - RNA, 13 nt, Human
cugcaguugccag

SEQ ID NO: 2996399 - RNA, 16 nt, Human
cugcaguugccaguca

SEQ ID NO: 2996400 - RNA, 17 nt, Human
cugcagcaauaaagcag

SEQ ID NO: 2996401 - RNA, 21 nt, Human
cugcacuccccugcugggugu

SEQ ID NO: 2996402 - RNA, 18 nt, Human
cugcacuccccugcuggg

SEQ ID NO: 2996403 - RNA, 12 nt, Human
cugcacugucaa

SEQ ID NO: 2996404 - RNA, 10 nt, Human
cugcagaggg

SEQ ID NO: 2996405 - RNA, 16 nt, Human
cugcagcaauaaagca

SEQ ID NO: 2996406 - RNA, 15 nt, Human
cugcagcaauaaagc

SEQ ID NO: 2996407 - RNA, 13 nt, Human
cugcagagggcac

SEQ ID NO: 2996408 - RNA, 19 nt, Human
cugcacuccccugcugggu

SEQ ID NO: 2996409 - RNA, 20 nt, Human
cugcacuccccugcugggug

SEQ ID NO: 2996410 - RNA, 13 nt, Human
cugcacuccccug

SEQ ID NO: 2996411 - RNA, 20 nt, Human
cugcacuccagccuggguga

SEQ ID NO: 2996412 - RNA, 18 nt, Human
cugcaccgggccacagag

SEQ ID NO: 2996413 - RNA, 22 nt, Human
cugaggcccuucucuccagccc

SEQ ID NO: 2996414 - RNA, 23 nt, Human
cugaggcccuucucuccagcccc

SEQ ID NO: 2996415 - RNA, 14 nt, Human
cugcaccggcuggc

SEQ ID NO: 2996416 - RNA, 15 nt, Human
cugcaccggcuggcc

SEQ ID NO: 2996417 - RNA, 16 nt, Human
cugcaccggcuggccu

SEQ ID NO: 2996418 - RNA, 15 nt, Human
cugcaccgggccaca

SEQ ID NO: 2996419 - RNA, 14 nt, Human
cugcaccgggccac

SEQ ID NO: 2996420 - RNA, 22 nt, Human
cugcaguuuuuuuccuucaaga

SEQ ID NO: 2996421 - RNA, 23 nt, Human
cugcaguuuuuuuccuucaagaa

SEQ ID NO: 2996422 - RNA, 15 nt, Human
cugcauaugaaagga

SEQ ID NO: 2996423 - RNA, 20 nt, Human
cugcaucaagaugugacaug

SEQ ID NO: 2996424 - RNA, 12 nt, Human
cugccacccugg

SEQ ID NO: 2996425 - RNA, 21 nt, Human
cugccacccuggggagaaagu

SEQ ID NO: 2996426 - RNA, 13 nt, Human
cugccaggaagcc

SEQ ID NO: 2996427 - RNA, 14 nt, Human
cugccaggaagcca

SEQ ID NO: 2996428 - RNA, 20 nt, Human
cugccaggaagccagcaggc

SEQ ID NO: 2996429 - RNA, 21 nt, Human
cugccaggaagccagcaggcu

SEQ ID NO: 2996430 - RNA, 15 nt, Human
cugccagcaacgcag

SEQ ID NO: 2996431 - RNA, 22 nt, Human
cugccaggaagccagcaggcuc

SEQ ID NO: 2996432 - RNA, 15 nt, Human
cugccauccucccaa

SEQ ID NO: 2996433 - RNA, 21 nt, Human
cugccauccagguucagcuug

SEQ ID NO: 2996434 - RNA, 20 nt, Human
cugccauccuggcccagggc

SEQ ID NO: 2996435 - RNA, 19 nt, Human
cugccauccuggcccaggg

SEQ ID NO: 2996436 - RNA, 18 nt, Human
cugccauccuggcccagg

SEQ ID NO: 2996437 - RNA, 17 nt, Human
cugccauccuggcccag

SEQ ID NO: 2996438 - RNA, 16 nt, Human
cugccauccuggccca

SEQ ID NO: 2996439 - RNA, 13 nt, Human
cugccauccuggc

SEQ ID NO: 2996440 - RNA, 22 nt, Human
cugccauccuggcccagggcau

SEQ ID NO: 2996441 - RNA, 21 nt, Human
cugccauccuggcccagggca

SEQ ID NO: 2996442 - RNA, 23 nt, Human
cugccauccuggcccagggcauc

SEQ ID NO: 2996443 - RNA, 18 nt, Human
cugccccuggcagccccu

SEQ ID NO: 2996444 - RNA, 17 nt, Human
cugccccuggcagcccc

SEQ ID NO: 2996445 - RNA, 19 nt, Human
cugccccuggcagccccug

SEQ ID NO: 2996446 - RNA, 13 nt, Human
cugcccggcaggg

SEQ ID NO: 2996447 - RNA, 15 nt, Human
cugccauuucugaga

SEQ ID NO: 2996448 - RNA, 15 nt, Human
cugcccaggccccug

SEQ ID NO: 2996449 - RNA, 14 nt, Human
cugcccaggccccu

SEQ ID NO: 2996450 - RNA, 12 nt, Human
cugcccaccugg

SEQ ID NO: 2996451 - RNA, 20 nt, Human
cugcccaggccccugccacc

SEQ ID NO: 2996452 - RNA, 19 nt, Human
cugcccaggccccugccac

SEQ ID NO: 2996453 - RNA, 18 nt, Human
cugcccaggccccugcca

SEQ ID NO: 2996454 - RNA, 16 nt, Human
cugcccaggccccugc

SEQ ID NO: 2996455 - RNA, 20 nt, Human
cugcccugcccaccuggccu

SEQ ID NO: 2996456 - RNA, 17 nt, Human
cugcccugcccaccugg

SEQ ID NO: 2996457 - RNA, 14 nt, Human
cugcccucuccugg

SEQ ID NO: 2996458 - RNA, 13 nt, Human
cugcccucuccug

SEQ ID NO: 2996459 - RNA, 12 nt, Human
cugcccucuccu

SEQ ID NO: 2996460 - RNA, 21 nt, Human
cugcccugcccaccuggccuc

SEQ ID NO: 2996461 - RNA, 16 nt, Human
cugccugaagucacac

SEQ ID NO: 2996462 - RNA, 18 nt, Human
cugccugaagucacacag

SEQ ID NO: 2996463 - RNA, 19 nt, Human
cugccugaagucacacagu

SEQ ID NO: 2996464 - RNA, 18 nt, Human
cugcggugcuaucucccc

SEQ ID NO: 2996465 - RNA, 19 nt, Human
cugcggugcuaucuccccc

SEQ ID NO: 2996466 - RNA, 23 nt, Human
cugcgguccacccaggagccccg

SEQ ID NO: 2996467 - RNA, 18 nt, Human
cugcgggggcagugcuca

SEQ ID NO: 2996468 - RNA, 15 nt, Human
cugcucuccgaccag

SEQ ID NO: 2996469 - RNA, 20 nt, Human
cugcuccucuccccagcaag

SEQ ID NO: 2996470 - RNA, 19 nt, Human
cugcuccucuccccagcaa

SEQ ID NO: 2996471 - RNA, 23 nt, Human
cugcuccucuccccagcaaguga

SEQ ID NO: 2996472 - RNA, 20 nt, Human
cugcggugcuaucuccccca

SEQ ID NO: 2996473 - RNA, 21 nt, Human
cugcggugcuaucucccccag

SEQ ID NO: 2996474 - RNA, 22 nt, Human
cugcggugcuaucucccccagc

SEQ ID NO: 2996475 - RNA, 23 nt, Human
cugcggugcuaucucccccagcc

SEQ ID NO: 2996476 - RNA, 19 nt, Human
cugcucccaccuggcucug

SEQ ID NO: 2996477 - RNA, 18 nt, Human
cugcucccaccuggcucu

SEQ ID NO: 2996478 - RNA, 20 nt, Human
cugcucccaccuggcucugu

SEQ ID NO: 2996479 - RNA, 17 nt, Human
cugcucccaccuggcuc

SEQ ID NO: 2996480 - RNA, 21 nt, Human
cugcgggggcagugcucaccc

SEQ ID NO: 2996481 - RNA, 16 nt, Human
cugcucccaccuggcu

SEQ ID NO: 2996482 - RNA, 15 nt, Human
cugcugcaguugcca

SEQ ID NO: 2996483 - RNA, 14 nt, Human
cugcugcaguugcc

SEQ ID NO: 2996484 - RNA, 10 nt, Human
cugcugcagu

SEQ ID NO: 2996485 - RNA, 13 nt, Human
cugcugcaguugc

SEQ ID NO: 2996486 - RNA, 12 nt, Human
cugcucugguua

SEQ ID NO: 2996487 - RNA, 13 nt, Human
cugcuugaggcaa

SEQ ID NO: 2996488 - RNA, 20 nt, Human
cugcuugaggcaacucaucu

SEQ ID NO: 2996489 - RNA, 21 nt, Human
cugcuugaggcaacucaucuu

SEQ ID NO: 2996490 - RNA, 17 nt, Human
cugcuggguguggcgca

SEQ ID NO: 2996491 - RNA, 14 nt, Human
cugcuggguguggc

SEQ ID NO: 2996492 - RNA, 15 nt, Human
cugcuggguguggcg

SEQ ID NO: 2996493 - RNA, 12 nt, Human
cugcugcuggcu

SEQ ID NO: 2996494 - RNA, 13 nt, Human
cugcugcuggcug

SEQ ID NO: 2996495 - RNA, 18 nt, Human
cugcugggagguuaaaaa

SEQ ID NO: 2996496 - RNA, 22 nt, Human
cugcugggagguuaaaaagaaa

SEQ ID NO: 2996497 - RNA, 17 nt, Human
cugcuuuuggucugugu

SEQ ID NO: 2996498 - RNA, 15 nt, Human
cugcuuuuggucugu

SEQ ID NO: 2996499 - RNA, 20 nt, Human
cugcuugcuugcuuuuuaau

SEQ ID NO: 2996500 - RNA, 22 nt, Human
cugcuugccaucccucccucca

SEQ ID NO: 2996501 - RNA, 20 nt, Human
cugcuugccaucccucccuc

SEQ ID NO: 2996502 - RNA, 19 nt, Human
cugcuugccaucccucccu

SEQ ID NO: 2996503 - RNA, 18 nt, Human
cugcuugccaucccuccc

SEQ ID NO: 2996504 - RNA, 15 nt, Human
cugcuugccaucccu

SEQ ID NO: 2996505 - RNA, 16 nt, Human
cugcuugccaucccuc

SEQ ID NO: 2996506 - RNA, 22 nt, Human
cugcuugaggcaacucaucuua

SEQ ID NO: 2996507 - RNA, 13 nt, Human
cugcuugggcuuc

SEQ ID NO: 2996508 - RNA, 15 nt, Human
cugcuugggcuucau

SEQ ID NO: 2996509 - RNA, 17 nt, Human
cugcuugggcuucaucc

SEQ ID NO: 2996510 - RNA, 18 nt, Human
cugcuugggcuucauccu

SEQ ID NO: 2996511 - RNA, 19 nt, Human
cugcuugggcuucauccuc

SEQ ID NO: 2996512 - RNA, 19 nt, Human
cugcuugugaaaggaaaga

SEQ ID NO: 2996513 - RNA, 16 nt, Human
cugaaauaaggaauga

SEQ ID NO: 2996514 - RNA, 23 nt, Human
cugaaagcccugagcuuucugcu

SEQ ID NO: 2996515 - RNA, 21 nt, Human
cugaaauaaacgucuuaaaua

SEQ ID NO: 2996516 - RNA, 16 nt, Human
cugaaagcccugagcu

SEQ ID NO: 2996517 - RNA, 17 nt, Human
cugaaagcccugagcuu

SEQ ID NO: 2996518 - RNA, 18 nt, Human
cugaaagcccugagcuuu

SEQ ID NO: 2996519 - RNA, 19 nt, Human
cugaaagcccugagcuuuc

SEQ ID NO: 2996520 - RNA, 15 nt, Human
cugaaagcccugagc

SEQ ID NO: 2996521 - RNA, 23 nt, Human
cugaagaagcaccaaucaugaau

SEQ ID NO: 2996522 - RNA, 19 nt, Human
cugaagaauugaaaaacca

SEQ ID NO: 2996523 - RNA, 14 nt, Human
cugaagaagauggu

SEQ ID NO: 2996524 - RNA, 16 nt, Human
cugaaauuuccuggga

SEQ ID NO: 2996525 - RNA, 23 nt, Human
cugaaauuuccugggagcuuuug

SEQ ID NO: 2996526 - RNA, 13 nt, Human
cugaaauuuccug

SEQ ID NO: 2996527 - RNA, 17 nt, Human
cucuuucccucccuucc

SEQ ID NO: 2996528 - RNA, 13 nt, Human
cucuuucccuccc

SEQ ID NO: 2996529 - RNA, 23 nt, Human
cucuuuaaugucacaggcagguc

SEQ ID NO: 2996530 - RNA, 22 nt, Human
cucuuuaaugucacaggcaggu

SEQ ID NO: 2996531 - RNA, 21 nt, Human
cucuuuaaugucacaggcagg

SEQ ID NO: 2996532 - RNA, 20 nt, Human
cucuuuaaugucacaggcag

SEQ ID NO: 2996533 - RNA, 13 nt, Human
cucuugguccugc

SEQ ID NO: 2996534 - RNA, 15 nt, Human
cucuugguccugcug

SEQ ID NO: 2996535 - RNA, 16 nt, Human
cucuugguccugcugc

SEQ ID NO: 2996536 - RNA, 17 nt, Human
cucuugguccugcugca

SEQ ID NO: 2996537 - RNA, 18 nt, Human
cucuuuaaugucacaggc

SEQ ID NO: 2996538 - RNA, 22 nt, Human
cucuucuuuaaagggauggcaa

SEQ ID NO: 2996539 - RNA, 22 nt, Human
cucuugaaauauaggaacuuaa

SEQ ID NO: 2996540 - RNA, 19 nt, Human
cucuuggguucaagcgauu

SEQ ID NO: 2996541 - RNA, 21 nt, Human
cucuuggguucaagcgauucu

SEQ ID NO: 2996542 - RNA, 15 nt, Human
cucugugucaggugg

SEQ ID NO: 2996543 - RNA, 16 nt, Human
cucuguggcgagccau

SEQ ID NO: 2996544 - RNA, 13 nt, Human
cucuuagaaaaac

SEQ ID NO: 2996545 - RNA, 15 nt, Human
cucuuagaaaaacca

SEQ ID NO: 2996546 - RNA, 14 nt, Human
cucuuccaggcugg

SEQ ID NO: 2996547 - RNA, 15 nt, Human
cucuuccaggcuggg

SEQ ID NO: 2996548 - RNA, 13 nt, Human
cucuuccaggcug

SEQ ID NO: 2996549 - RNA, 19 nt, Human
cucuggccuucggccucca

SEQ ID NO: 2996550 - RNA, 15 nt, Human
cucuggcagcucaga

SEQ ID NO: 2996551 - RNA, 16 nt, Human
cucuggcagcucagag

SEQ ID NO: 2996552 - RNA, 12 nt, Human
cucuggccuucg

SEQ ID NO: 2996553 - RNA, 22 nt, Human
cucuggacaggcauguucucug

SEQ ID NO: 2996554 - RNA, 16 nt, Human
cucuggacaggcaugu

SEQ ID NO: 2996555 - RNA, 14 nt, Human
cucuggacaggcau

SEQ ID NO: 2996556 - RNA, 12 nt, Human
cucuggcagcuc

SEQ ID NO: 2996557 - RNA, 14 nt, Human
cucuggcagcucag

SEQ ID NO: 2996558 - RNA, 20 nt, Human
cucugcuugccaucccuccc

SEQ ID NO: 2996559 - RNA, 17 nt, Human
cucugcuugccaucccu

SEQ ID NO: 2996560 - RNA, 14 nt, Human
cucugcuugccauc

SEQ ID NO: 2996561 - RNA, 12 nt, Human
cucugcuugcca

SEQ ID NO: 2996562 - RNA, 15 nt, Human
cucuggacaggcaug

SEQ ID NO: 2996563 - RNA, 21 nt, Human
cucugccugaagucacacagu

SEQ ID NO: 2996564 - RNA, 10 nt, Human
cucugccuga

SEQ ID NO: 2996565 - RNA, 22 nt, Human
cucugccugaagucacacagug

SEQ ID NO: 2996566 - RNA, 13 nt, Human
cucucuccucccu

SEQ ID NO: 2996567 - RNA, 20 nt, Human
cugagcgacagugagacucu

SEQ ID NO: 2996568 - RNA, 16 nt, Human
cugagcgacagugaga

SEQ ID NO: 2996569 - RNA, 16 nt, Human
cugagacagcccgggc

SEQ ID NO: 2996570 - RNA, 17 nt, Human
cugagacagcccgggcu

SEQ ID NO: 2996571 - RNA, 18 nt, Human
cugagacagcccgggcuc

SEQ ID NO: 2996572 - RNA, 17 nt, Human
cugagccagauuucacu

SEQ ID NO: 2996573 - RNA, 18 nt, Human
cugagccagauuucacuc

SEQ ID NO: 2996574 - RNA, 19 nt, Human
cugagccagauuucacucu

SEQ ID NO: 2996575 - RNA, 20 nt, Human
cugagccagauuucacucuc

SEQ ID NO: 2996576 - RNA, 21 nt, Human
cugagccagauuucacucucc

SEQ ID NO: 2996577 - RNA, 15 nt, Human
cugagccagauuuca

SEQ ID NO: 2996578 - RNA, 15 nt, Human
cugagccucacagca

SEQ ID NO: 2996579 - RNA, 19 nt, Human
cugagccucacagcaguga

SEQ ID NO: 2996580 - RNA, 17 nt, Human
cugagccucacagcagu

SEQ ID NO: 2996581 - RNA, 16 nt, Human
cugagccucacagcag

SEQ ID NO: 2996582 - RNA, 12 nt, Human
cugaggcccaga

SEQ ID NO: 2996583 - RNA, 13 nt, Human
cugaggcccagag

SEQ ID NO: 2996584 - RNA, 14 nt, Human
cugaggcccagagg

SEQ ID NO: 2996585 - RNA, 15 nt, Human
cugaggcccagaggg

SEQ ID NO: 2996586 - RNA, 16 nt, Human
cugaggcccagagggc

SEQ ID NO: 2996587 - RNA, 17 nt, Human
cugaggcccagagggcc

SEQ ID NO: 2996588 - RNA, 18 nt, Human
cugaggcccagagggccu

SEQ ID NO: 2996589 - RNA, 19 nt, Human
cugaggcccagagggccug

SEQ ID NO: 2996590 - RNA, 21 nt, Human
cugaggcccagagggccugca

SEQ ID NO: 2996591 - RNA, 23 nt, Human
cugaggcccagagggccugcaag

SEQ ID NO: 2996592 - RNA, 14 nt, Human
cugaggcccuucuc

SEQ ID NO: 2996593 - RNA, 15 nt, Human
cugaggcccuucucu

SEQ ID NO: 2996594 - RNA, 18 nt, Human
cugaggcccuucucucca

SEQ ID NO: 2996595 - RNA, 19 nt, Human
cugaggcccuucucuccag

SEQ ID NO: 2996596 - RNA, 20 nt, Human
cugaggcccuucucuccagc

SEQ ID NO: 2996597 - RNA, 17 nt, Human
cugaggcaggagacugg

SEQ ID NO: 2996598 - RNA, 18 nt, Human
cugaggcaggagacuggc

SEQ ID NO: 2996599 - RNA, 22 nt, Human
cugagaaagacuauucaaacag

SEQ ID NO: 2996600 - RNA, 23 nt, Human
cugagaaagacuauucaaacagu

SEQ ID NO: 2996601 - RNA, 14 nt, Human
cugagacagcccgg

SEQ ID NO: 2996602 - RNA, 15 nt, Human
cugagacagcccggg

SEQ ID NO: 2996603 - RNA, 13 nt, Human
cugacuucuaagu

SEQ ID NO: 2996604 - RNA, 15 nt, Human
cugacuucuaaguaa

SEQ ID NO: 2996605 - RNA, 18 nt, Human
cugacuguuuucucuuga

SEQ ID NO: 2996606 - RNA, 16 nt, Human
cugacuucuaaguaaa

SEQ ID NO: 2996607 - RNA, 17 nt, Human
cugacucuuaagaagac

SEQ ID NO: 2996608 - RNA, 16 nt, Human
cugacuguuuucucuu

SEQ ID NO: 2996609 - RNA, 13 nt, Human
cugacccaugcug

SEQ ID NO: 2996610 - RNA, 14 nt, Human
cugacccacugcuu

SEQ ID NO: 2996611 - RNA, 13 nt, Human
cugacccacugcu

SEQ ID NO: 2996612 - RNA, 14 nt, Human
cugacccaugcugc

SEQ ID NO: 2996613 - RNA, 15 nt, Human
cugacccaugcugcc

SEQ ID NO: 2996614 - RNA, 16 nt, Human
cugacccaugcugccc

SEQ ID NO: 2996615 - RNA, 12 nt, Human
cugacccacugc

SEQ ID NO: 2996616 - RNA, 22 nt, Human
cugacauuguuggccaaagcca

SEQ ID NO: 2996617 - RNA, 21 nt, Human
cugacaggcaaugcuggcugu

SEQ ID NO: 2996618 - RNA, 21 nt, Human
cugacauuguuggccaaagcc

SEQ ID NO: 2996619 - RNA, 13 nt, Human
cuccuccacauuu

SEQ ID NO: 2996620 - RNA, 22 nt, Human
cuccuccagccgccaugcuccu

SEQ ID NO: 2996621 - RNA, 22 nt, Human
cuccucuccccagcaagugaga

SEQ ID NO: 2996622 - RNA, 17 nt, Human
cucccuuucuucccuac

SEQ ID NO: 2996623 - RNA, 17 nt, Human
cucccuccaccucccug

SEQ ID NO: 2996624 - RNA, 15 nt, Human
cucccuccaccuccc

SEQ ID NO: 2996625 - RNA, 18 nt, Human
cucccucagucuggcccu

SEQ ID NO: 2996626 - RNA, 15 nt, Human
cuccgaccagacacc

SEQ ID NO: 2996627 - RNA, 15 nt, Human
cuccugccucagccu

SEQ ID NO: 2996628 - RNA, 22 nt, Human
cuccugccucgaacuggcugca

SEQ ID NO: 2996629 - RNA, 19 nt, Human
cuccugugugugcgccuac

SEQ ID NO: 2996630 - RNA, 16 nt, Human
cuccugugugugcgcc

SEQ ID NO: 2996631 - RNA, 11 nt, Human
cuccugcaggc

SEQ ID NO: 2996632 - RNA, 16 nt, Human
cuccugcaggcagcca

SEQ ID NO: 2996633 - RNA, 17 nt, Human
cuccugcaggcagccag

SEQ ID NO: 2996634 - RNA, 14 nt, Human
cuccugccucagcc

SEQ ID NO: 2996635 - RNA, 13 nt, Human
cuccugccucagc

SEQ ID NO: 2996636 - RNA, 11 nt, Human
cuccugcccuu

SEQ ID NO: 2996637 - RNA, 18 nt, Human
cuccugcaggcagccagg

SEQ ID NO: 2996638 - RNA, 20 nt, Human
cuccugcaggcagccaggcc

SEQ ID NO: 2996639 - RNA, 12 nt, Human
cuccccugcugg

SEQ ID NO: 2996640 - RNA, 20 nt, Human
cuccccagccccaucccaaa

SEQ ID NO: 2996641 - RNA, 20 nt, Human
cuccccagcaagugagagcu

SEQ ID NO: 2996642 - RNA, 12 nt, Human
cuccccagcaag

SEQ ID NO: 2996643 - RNA, 22 nt, Human
cucccaugagggagaugccaug

SEQ ID NO: 2996644 - RNA, 20 nt, Human
cucccaugagggagaugcca

SEQ ID NO: 2996645 - RNA, 18 nt, Human
cucccaugagggagaugc

SEQ ID NO: 2996646 - RNA, 17 nt, Human
cucccgaguagcuggga

SEQ ID NO: 2996647 - RNA, 16 nt, Human
cucccgaguagcuggg

SEQ ID NO: 2996648 - RNA, 18 nt, Human
cucccgaauagcugggac

SEQ ID NO: 2996649 - RNA, 15 nt, Human
cucccgaguagcugg

SEQ ID NO: 2996650 - RNA, 13 nt, Human
cuccccugcuggg

SEQ ID NO: 2996651 - RNA, 16 nt, Human
cucccgaauagcuggg

SEQ ID NO: 2996652 - RNA, 17 nt, Human
cucccgaauagcuggga

SEQ ID NO: 2996653 - RNA, 21 nt, Human
cucccaucucacacaugagca

SEQ ID NO: 2996654 - RNA, 11 nt, Human
cucccaucugu

SEQ ID NO: 2996655 - RNA, 14 nt, Human
cucccaucugugaa

SEQ ID NO: 2996656 - RNA, 15 nt, Human
cucccaucugugaaa

SEQ ID NO: 2996657 - RNA, 18 nt, Human
cucccaucugugaaagga

SEQ ID NO: 2996658 - RNA, 23 nt, Human
cucccaucugugaaaggaaagag

SEQ ID NO: 2996659 - RNA, 16 nt, Human
cucccaacucacccca

SEQ ID NO: 2996660 - RNA, 17 nt, Human
cucccaacucaccccag

SEQ ID NO: 2996661 - RNA, 18 nt, Human
cucccaaagugcugggau

SEQ ID NO: 2996662 - RNA, 22 nt, Human
cucccaacucaccccagcccca

SEQ ID NO: 2996663 - RNA, 16 nt, Human
cuccauccugaggcuc

SEQ ID NO: 2996664 - RNA, 14 nt, Human
cuccauccugaggc

SEQ ID NO: 2996665 - RNA, 18 nt, Human
cuccauccugaggcucca

SEQ ID NO: 2996666 - RNA, 18 nt, Human
cucacuauguugcccagg

SEQ ID NO: 2996667 - RNA, 13 nt, Human
cuccaugugggcu

SEQ ID NO: 2996668 - RNA, 17 nt, Human
cucccaaagugcuggga

SEQ ID NO: 2996669 - RNA, 20 nt, Human
cucuccugggcagcugccuc

SEQ ID NO: 2996670 - RNA, 19 nt, Human
cucuccugggcagcugccu

SEQ ID NO: 2996671 - RNA, 18 nt, Human
cucuccugggcagcugcc

SEQ ID NO: 2996672 - RNA, 16 nt, Human
cucuccugggcagcug

SEQ ID NO: 2996673 - RNA, 15 nt, Human
cucuccugggcagcu

SEQ ID NO: 2996674 - RNA, 12 nt, Human
cucuccugggca

SEQ ID NO: 2996675 - RNA, 12 nt, Human
cucucucacucc

SEQ ID NO: 2996676 - RNA, 13 nt, Human
cucucucaggcca

SEQ ID NO: 2996677 - RNA, 13 nt, Human
cucuccccagcaa

SEQ ID NO: 2996678 - RNA, 19 nt, Human
cucuccagccccuggaugc

SEQ ID NO: 2996679 - RNA, 12 nt, Human
cucuccucugcu

SEQ ID NO: 2996680 - RNA, 24 nt, Human
cucuccccagcaagugagagcugg

SEQ ID NO: 2996681 - RNA, 22 nt, Human
cucuccccagcaagugagagcu

SEQ ID NO: 2996682 - RNA, 14 nt, Human
cucuccccagcaag

SEQ ID NO: 2996683 - RNA, 13 nt, Human
cucuccucugcug

SEQ ID NO: 2996684 - RNA, 14 nt, Human
cucuccucugcugc

SEQ ID NO: 2996685 - RNA, 15 nt, Human
cucuccucugcugcu

SEQ ID NO: 2996686 - RNA, 18 nt, Human
cucuccucugcugcuggc

SEQ ID NO: 2996687 - RNA, 17 nt, Human
cucucaggccagcugcu

SEQ ID NO: 2996688 - RNA, 18 nt, Human
cucucaggccagcugcuu

SEQ ID NO: 2996689 - RNA, 19 nt, Human
cucucaggccagcugcuug

SEQ ID NO: 2996690 - RNA, 21 nt, Human
cucucaggccagcugcuuggg

SEQ ID NO: 2996691 - RNA, 15 nt, Human
cucuccagccccugg

SEQ ID NO: 2996692 - RNA, 16 nt, Human
cucuccagccccugga

SEQ ID NO: 2996693 - RNA, 17 nt, Human
cucuccagccccuggau

SEQ ID NO: 2996694 - RNA, 18 nt, Human
cucuccagccccuggaug

SEQ ID NO: 2996695 - RNA, 14 nt, Human
cucuccagccccug

SEQ ID NO: 2996696 - RNA, 22 nt, Human
cucucaggccaaacucaccugc

SEQ ID NO: 2996697 - RNA, 23 nt, Human
cucucaggccaaacucaccugcc

SEQ ID NO: 2996698 - RNA, 13 nt, Human
cucucaggccagc

SEQ ID NO: 2996699 - RNA, 15 nt, Human
cucucaggccagcug

SEQ ID NO: 2996700 - RNA, 20 nt, Human
cucucaggccaaacucaccu

SEQ ID NO: 2996701 - RNA, 21 nt, Human
cucucaggccaaacucaccug

SEQ ID NO: 2996702 - RNA, 12 nt, Human
cucucaggccaa

SEQ ID NO: 2996703 - RNA, 21 nt, Human
cucuaguuugauuaaauucuu

SEQ ID NO: 2996704 - RNA, 20 nt, Human
cucuaguuugauuaaauucu

SEQ ID NO: 2996705 - RNA, 19 nt, Human
cucuaguuugauuaaauuc

SEQ ID NO: 2996706 - RNA, 15 nt, Human
cucuaguuugauuaa

SEQ ID NO: 2996707 - RNA, 15 nt, Human
cucuaggaaauauuu

SEQ ID NO: 2996708 - RNA, 17 nt, Human
cucuaggaaauauuuau

SEQ ID NO: 2996709 - RNA, 23 nt, Human
cucuagggaaaaaccagcgugug

SEQ ID NO: 2996710 - RNA, 20 nt, Human
cucuagugaauguaggcugg

SEQ ID NO: 2996711 - RNA, 13 nt, Human
cucuacccuggca

SEQ ID NO: 2996712 - RNA, 21 nt, Human
cucuacccaucuuaaaaacaa

SEQ ID NO: 2996713 - RNA, 20 nt, Human
cucuaccauccccuguagag

SEQ ID NO: 2996714 - RNA, 22 nt, Human
cucuacccaucuuaaaaacaac

SEQ ID NO: 2996715 - RNA, 16 nt, Human
cuccuucacagauggg

SEQ ID NO: 2996716 - RNA, 17 nt, Human
cuccuucacagaugggu

SEQ ID NO: 2996717 - RNA, 14 nt, Human
cuccugugugugcg

SEQ ID NO: 2996718 - RNA, 20 nt, Human
cuccugugugugcgccuaca

SEQ ID NO: 2996719 - RNA, 19 nt, Human
cuccuucacagaugggugc

SEQ ID NO: 2996720 - RNA, 13 nt, Human
cucuacaaaaagc

SEQ ID NO: 2996721 - RNA, 16 nt, Human
cucuacagaggccaug

SEQ ID NO: 2996722 - RNA, 14 nt, Human
cucuacagaggcca

SEQ ID NO: 2996723 - RNA, 19 nt, Human
cucuacagaggccaugggc

SEQ ID NO: 2996724 - RNA, 13 nt, Human
cucuacagaggcc

SEQ ID NO: 2996725 - RNA, 22 nt, Human
cgccagcucaccccaucauccc

SEQ ID NO: 2996726 - RNA, 22 nt, Human
cgccagauucuuuccugaggcu

SEQ ID NO: 2996727 - RNA, 17 nt, Human
ccucugcccacucccug

SEQ ID NO: 2996728 - RNA, 19 nt, Human
ccucugcccacucccugca

SEQ ID NO: 2996729 - RNA, 20 nt, Human
ccucugcccacucccugcaa

SEQ ID NO: 2996730 - RNA, 23 nt, Human
cgccaggggaaaaucagccugcu

SEQ ID NO: 2996731 - RNA, 14 nt, Human
cgccaucccagccc

SEQ ID NO: 2996732 - RNA, 16 nt, Human
cgccaucccagcccca

SEQ ID NO: 2996733 - RNA, 22 nt, Human
cgcccaggcuuagucacugaga

SEQ ID NO: 2996734 - RNA, 18 nt, Human
cgcucucuggccuucggc

SEQ ID NO: 2996735 - RNA, 22 nt, Human
cgcugucagccauuccuguucc

SEQ ID NO: 2996736 - RNA, 16 nt, Human
cgcugugcugcccugc

SEQ ID NO: 2996737 - RNA, 17 nt, Human
cgcugugcugcccugcc

SEQ ID NO: 2996738 - RNA, 15 nt, Human
cgcugugcugcccug

SEQ ID NO: 2996739 - RNA, 18 nt, Human
cgcugugcugcccugccc

SEQ ID NO: 2996740 - RNA, 20 nt, Human
cggaaaacaugcuacacacu

SEQ ID NO: 2996741 - RNA, 15 nt, Human
cggaaaacaugcuac

SEQ ID NO: 2996742 - RNA, 15 nt, Human
cgcucucuggccuuc

SEQ ID NO: 2996743 - RNA, 14 nt, Human
cgcucucuggccuu

SEQ ID NO: 2996744 - RNA, 16 nt, Human
cgcuacccgggaaggg

SEQ ID NO: 2996745 - RNA, 22 nt, Human
cgcuaagagggagggagggcuc

SEQ ID NO: 2996746 - RNA, 12 nt, Human
cggccuccaucc

SEQ ID NO: 2996747 - RNA, 24 nt, Human
cggccaggccagagggagugacag

SEQ ID NO: 2996748 - RNA, 19 nt, Human
cggccccugcugguucagg

SEQ ID NO: 2996749 - RNA, 18 nt, Human
cggccccugcugguucag

SEQ ID NO: 2996750 - RNA, 13 nt, Human
cggccccugcugg

SEQ ID NO: 2996751 - RNA, 13 nt, Human
cggaagagccuug

SEQ ID NO: 2996752 - RNA, 20 nt, Human
cggaagaccugaagaguggu

SEQ ID NO: 2996753 - RNA, 11 nt, Human
cggccaccugc

SEQ ID NO: 2996754 - RNA, 15 nt, Human
cggccaccugcggug

SEQ ID NO: 2996755 - RNA, 16 nt, Human
cggccaccugcggugc

SEQ ID NO: 2996756 - RNA, 17 nt, Human
cggccaccugcggugcu

SEQ ID NO: 2996757 - RNA, 21 nt, Human
cggguuuuauuguuuaaaauc

SEQ ID NO: 2996758 - RNA, 20 nt, Human
cgguccacccaggagccccg

SEQ ID NO: 2996759 - RNA, 16 nt, Human
cgguccacccaggagc

SEQ ID NO: 2996760 - RNA, 15 nt, Human
cgguccacccaggag

SEQ ID NO: 2996761 - RNA, 14 nt, Human
cgguccacccagga

SEQ ID NO: 2996762 - RNA, 22 nt, Human
cggucggguuuuauuguuuaaa

SEQ ID NO: 2996763 - RNA, 17 nt, Human
cggugagcuacaaaugc

SEQ ID NO: 2996764 - RNA, 21 nt, Human
cggugagaggggaacagacug

SEQ ID NO: 2996765 - RNA, 20 nt, Human
cggugagaggggaacagacu

SEQ ID NO: 2996766 - RNA, 23 nt, Human
cggcuggccuggccccucagggu

SEQ ID NO: 2996767 - RNA, 22 nt, Human
cggcuggccuggccccucaggg

SEQ ID NO: 2996768 - RNA, 19 nt, Human
cggcuggccuggccccuca

SEQ ID NO: 2996769 - RNA, 22 nt, Human
cgggcacucagaagacacugau

SEQ ID NO: 2996770 - RNA, 14 nt, Human
cgggcacucagaag

SEQ ID NO: 2996771 - RNA, 22 nt, Human
cggggacagcuccuucuguccu

SEQ ID NO: 2996772 - RNA, 18 nt, Human
cgggaggucgaggcagga

SEQ ID NO: 2996773 - RNA, 20 nt, Human
cgggaggucgaggcaggagg

SEQ ID NO: 2996774 - RNA, 15 nt, Human
cgggggcagagaggg

SEQ ID NO: 2996775 - RNA, 22 nt, Human
cgggggcagugcucacccacac

SEQ ID NO: 2996776 - RNA, 14 nt, Human
cgggggcagugcuc

SEQ ID NO: 2996777 - RNA, 23 nt, Human
cggggacagcuccuucuguccua

SEQ ID NO: 2996778 - RNA, 18 nt, Human
cgugcacgcacacugucu

SEQ ID NO: 2996779 - RNA, 14 nt, Human
cgugcacacaccag

SEQ ID NO: 2996780 - RNA, 19 nt, Human
cgugcacacaccagagccc

SEQ ID NO: 2996781 - RNA, 18 nt, Human
cgugcacacaccagagcc

SEQ ID NO: 2996782 - RNA, 23 nt, Human
cgugcauaccacuuuuguucuug

SEQ ID NO: 2996783 - RNA, 21 nt, Human
cgugcaguggugcgaucuggg

SEQ ID NO: 2996784 - RNA, 16 nt, Human
cgugcacacaccagag

SEQ ID NO: 2996785 - RNA, 22 nt, Human
cgucugacaggcaaugcuggcu

SEQ ID NO: 2996786 - RNA, 21 nt, Human
cgucugacaggcaaugcuggc

SEQ ID NO: 2996787 - RNA, 20 nt, Human
cgucugacaggcaaugcugg

SEQ ID NO: 2996788 - RNA, 22 nt, Human
cggugcuaucucccccagcccc

SEQ ID NO: 2996789 - RNA, 20 nt, Human
cggugcuaucucccccagcc

SEQ ID NO: 2996790 - RNA, 21 nt, Human
cggugcuaucucccccagccc

SEQ ID NO: 2996791 - RNA, 18 nt, Human
cggugcuaucucccccag

SEQ ID NO: 2996792 - RNA, 16 nt, Human
cgucucauacucaccu

SEQ ID NO: 2996793 - RNA, 16 nt, Human
cgucuaccugaggggc

SEQ ID NO: 2996794 - RNA, 14 nt, Human
cgucuccagcugcu

SEQ ID NO: 2996795 - RNA, 13 nt, Human
cuaaaauguucua

SEQ ID NO: 2996796 - RNA, 22 nt, Human
cuaaaaaugcaaaaaaaauuag

SEQ ID NO: 2996797 - RNA, 17 nt, Human
cuaaaacaacagaugua

SEQ ID NO: 2996798 - RNA, 18 nt, Human
cuaaauggaaccacucua

SEQ ID NO: 2996799 - RNA, 17 nt, Human
cuaaauggaaccacucu

SEQ ID NO: 2996800 - RNA, 16 nt, Human
cuaaauggaaccacuc

SEQ ID NO: 2996801 - RNA, 20 nt, Human
cuaaaucuccaaaauaaaac

SEQ ID NO: 2996802 - RNA, 15 nt, Human
cuaaauggaaccacu

SEQ ID NO: 2996803 - RNA, 15 nt, Human
cuaacauggaaguac

SEQ ID NO: 2996804 - RNA, 17 nt, Human
cuaacauggaaguacua

SEQ ID NO: 2996805 - RNA, 23 nt, Human
cuaaauugacacuuaaaaauggu

SEQ ID NO: 2996806 - RNA, 16 nt, Human
cuaaauguugaaagau

SEQ ID NO: 2996807 - RNA, 18 nt, Human
cuacacaccuaacuuaug

SEQ ID NO: 2996808 - RNA, 15 nt, Human
cuacacacugcaugu

SEQ ID NO: 2996809 - RNA, 13 nt, Human
cuacacacugcau

SEQ ID NO: 2996810 - RNA, 18 nt, Human
cuacacugugcugagucu

SEQ ID NO: 2996811 - RNA, 17 nt, Human
cuacacuccagugagac

SEQ ID NO: 2996812 - RNA, 16 nt, Human
cuacacuccagugaga

SEQ ID NO: 2996813 - RNA, 15 nt, Human
cuacagaggccaugg

SEQ ID NO: 2996814 - RNA, 22 nt, Human
cuacccacccuccuuucaccac

SEQ ID NO: 2996815 - RNA, 13 nt, Human
cuacccacccucc

SEQ ID NO: 2996816 - RNA, 17 nt, Human
cuacccacccuccuuuc

SEQ ID NO: 2996817 - RNA, 19 nt, Human
cuacccagcgagcccuggu

SEQ ID NO: 2996818 - RNA, 20 nt, Human
cuacccagcgagcccuggug

SEQ ID NO: 2996819 - RNA, 16 nt, Human
cuaauguacugcauau

SEQ ID NO: 2996820 - RNA, 14 nt, Human
cuaauguacugcau

SEQ ID NO: 2996821 - RNA, 21 nt, Human
cuaauaaaauuuaaaagucuu

SEQ ID NO: 2996822 - RNA, 16 nt, Human
cuaaggugugcucuga

SEQ ID NO: 2996823 - RNA, 20 nt, Human
cuaauaaaauuuaaaagucu

SEQ ID NO: 2996824 - RNA, 18 nt, Human
cuaauauguaacaagcca

SEQ ID NO: 2996825 - RNA, 18 nt, Human
cuaagcaaaaugugauau

SEQ ID NO: 2996826 - RNA, 15 nt, Human
cuaagcaaaauguga

SEQ ID NO: 2996827 - RNA, 14 nt, Human
cuaagcaaaaugug

SEQ ID NO: 2996828 - RNA, 17 nt, Human
cuaaccagcagaaaugc

SEQ ID NO: 2996829 - RNA, 17 nt, Human
cuaaccacgcuggaccu

SEQ ID NO: 2996830 - RNA, 16 nt, Human
cuaaccagcagaaaug

SEQ ID NO: 2996831 - RNA, 21 nt, Human
cuaagcuauucaguaauaacu

SEQ ID NO: 2996832 - RNA, 19 nt, Human
cuaagcuauucaguaauaa

SEQ ID NO: 2996833 - RNA, 15 nt, Human
cuaaggugugcucug

SEQ ID NO: 2996834 - RNA, 17 nt, Human
cuagcacuuugggaggc

SEQ ID NO: 2996835 - RNA, 17 nt, Human
cuagagugaacuugggc

SEQ ID NO: 2996836 - RNA, 21 nt, Human
cuagagugaacuugggccacu

SEQ ID NO: 2996837 - RNA, 20 nt, Human
cuagacgagcaggcuucuuc

SEQ ID NO: 2996838 - RNA, 21 nt, Human
cuagacgagcaggcuucuucc

SEQ ID NO: 2996839 - RNA, 19 nt, Human
cuacuugggaggcugagau

SEQ ID NO: 2996840 - RNA, 18 nt, Human
cuacuugggaggcugaga

SEQ ID NO: 2996841 - RNA, 15 nt, Human
cuacuugggaggcug

SEQ ID NO: 2996842 - RNA, 22 nt, Human
cuacuuauuguagcauccugga

SEQ ID NO: 2996843 - RNA, 14 nt, Human
cuacccgggaaggg

SEQ ID NO: 2996844 - RNA, 15 nt, Human
cuacccgggaagggg

SEQ ID NO: 2996845 - RNA, 20 nt, Human
cuacccgggaagggggcugg

SEQ ID NO: 2996846 - RNA, 21 nt, Human
cuacccgggaagggggcuggg

SEQ ID NO: 2996847 - RNA, 21 nt, Human
cuacucugugucagguggggc

SEQ ID NO: 2996848 - RNA, 16 nt, Human
cuacucugugucaggu

SEQ ID NO: 2996849 - RNA, 13 nt, Human
cuacucuguguca

SEQ ID NO: 2996850 - RNA, 16 nt, Human
cuacuguaauuuguga

SEQ ID NO: 2996851 - RNA, 17 nt, Human
cuacuguaauuugugau

SEQ ID NO: 2996852 - RNA, 14 nt, Human
cuacugaggugcua

SEQ ID NO: 2996853 - RNA, 17 nt, Human
cuaguaucaaaagaaag

SEQ ID NO: 2996854 - RNA, 15 nt, Human
cuaguaucaaaagaa

SEQ ID NO: 2996855 - RNA, 23 nt, Human
cuaguaucaaaagaaagaaaauc

SEQ ID NO: 2996856 - RNA, 20 nt, Human
cuaguauuucuaugaaauau

SEQ ID NO: 2996857 - RNA, 19 nt, Human
cuaguauuucuaugaaaua

SEQ ID NO: 2996858 - RNA, 22 nt, Human
cuaguauuucuaugaaauauua

SEQ ID NO: 2996859 - RNA, 21 nt, Human
cuaggcauuugcugaauacag

SEQ ID NO: 2996860 - RNA, 21 nt, Human
cuagugugguguuuccuggca

SEQ ID NO: 2996861 - RNA, 22 nt, Human
cuagugugguguuuccuggcac

SEQ ID NO: 2996862 - RNA, 23 nt, Human
cuagugugguguuuccuggcacu

SEQ ID NO: 2996863 - RNA, 19 nt, Human
cuagugugguguuuccugg

SEQ ID NO: 2996864 - RNA, 21 nt, Human
cuaggaagacuuuggaaagag

SEQ ID NO: 2996865 - RNA, 13 nt, Human
cuaggaacacucc

SEQ ID NO: 2996866 - RNA, 15 nt, Human
cuaggaacacuccuu

SEQ ID NO: 2996867 - RNA, 22 nt, Human
cuaggaaauauuuauuuuaaua

SEQ ID NO: 2996868 - RNA, 17 nt, Human
cuaggaggucucuaaga

SEQ ID NO: 2996869 - RNA, 14 nt, Human
cuaggagguaauga

SEQ ID NO: 2996870 - RNA, 22 nt, Human
cuaggacugaauuaugaaacuu

SEQ ID NO: 2996871 - RNA, 23 nt, Human
cuaggacccgucuccagcugcug

SEQ ID NO: 2996872 - RNA, 22 nt, Human
cuaggacccgucuccagcugcu

SEQ ID NO: 2996873 - RNA, 22 nt, Human
cuaggaccccuccaugugggcu

SEQ ID NO: 2996874 - RNA, 21 nt, Human
cuaggacccgucuccagcugc

SEQ ID NO: 2996875 - RNA, 20 nt, Human
cuaggacccgucuccagcug

SEQ ID NO: 2996876 - RNA, 23 nt, Human
cuauauuguuuucaguguacaug

SEQ ID NO: 2996877 - RNA, 20 nt, Human
cuauauuuuuuguuaaauga

SEQ ID NO: 2996878 - RNA, 22 nt, Human
cuauauuguuuucaguguacau

SEQ ID NO: 2996879 - RNA, 19 nt, Human
cuauauuguuugcuaagca

SEQ ID NO: 2996880 - RNA, 18 nt, Human
cuauauuguuugcuaagc

SEQ ID NO: 2996881 - RNA, 22 nt, Human
cuaguguuuucaauuuuaaaca

SEQ ID NO: 2996882 - RNA, 18 nt, Human
cuaguguuuucaauuuua

SEQ ID NO: 2996883 - RNA, 13 nt, Human
cuaugaaauauua

SEQ ID NO: 2996884 - RNA, 14 nt, Human
cuaugacacaugca

SEQ ID NO: 2996885 - RNA, 20 nt, Human
cuaucaaguauuauaccuuu

SEQ ID NO: 2996886 - RNA, 22 nt, Human
cuauauuuuuuguuaaaugauu

SEQ ID NO: 2996887 - RNA, 12 nt, Human
cuaugcauuuga

SEQ ID NO: 2996888 - RNA, 11 nt, Human
cuaugcauuug

SEQ ID NO: 2996889 - RNA, 17 nt, Human
cucaccccuugccauaa

SEQ ID NO: 2996890 - RNA, 17 nt, Human
cucacuauguugcccag

SEQ ID NO: 2996891 - RNA, 16 nt, Human
cucacuauguugccca

SEQ ID NO: 2996892 - RNA, 12 nt, Human
cucaccccagcc

SEQ ID NO: 2996893 - RNA, 13 nt, Human
cucaccccagccc

SEQ ID NO: 2996894 - RNA, 14 nt, Human
cucaccccagcccc

SEQ ID NO: 2996895 - RNA, 19 nt, Human
cucaccagccccagugccc

SEQ ID NO: 2996896 - RNA, 21 nt, Human
cucaccagccccagugcccac

SEQ ID NO: 2996897 - RNA, 20 nt, Human
cucaccagccccagugccca

SEQ ID NO: 2996898 - RNA, 20 nt, Human
cucaagugauucuccugccu

SEQ ID NO: 2996899 - RNA, 19 nt, Human
cucaagugauucuccugcc

SEQ ID NO: 2996900 - RNA, 18 nt, Human
cucaagugauucuccugc

SEQ ID NO: 2996901 - RNA, 23 nt, Human
cucacaguccuuaccagcagagc

SEQ ID NO: 2996902 - RNA, 19 nt, Human
cucaacucuccuccagagu

SEQ ID NO: 2996903 - RNA, 15 nt, Human
cucaagagcaaagua

SEQ ID NO: 2996904 - RNA, 20 nt, Human
cucaacucuccuccagaguc

SEQ ID NO: 2996905 - RNA, 21 nt, Human
cucaacucuccuccagaguca

SEQ ID NO: 2996906 - RNA, 14 nt, Human
cuaugcauuugaaa

SEQ ID NO: 2996907 - RNA, 14 nt, Human
cccucaugcugcca

SEQ ID NO: 2996908 - RNA, 17 nt, Human
cccucaugcugccaaua

SEQ ID NO: 2996909 - RNA, 22 nt, Human
cccucauccucauacccacccc

SEQ ID NO: 2996910 - RNA, 21 nt, Human
cccuccaagaccuucuccuuc

SEQ ID NO: 2996911 - RNA, 17 nt, Human
cccucauccucauaccc

SEQ ID NO: 2996912 - RNA, 20 nt, Human
cccucauccucauacccacc

SEQ ID NO: 2996913 - RNA, 22 nt, Human
cccucaucaccaacgucugugc

SEQ ID NO: 2996914 - RNA, 20 nt, Human
cccucagucuggcccuuccu

SEQ ID NO: 2996915 - RNA, 21 nt, Human
cccucagggucccugguggca

SEQ ID NO: 2996916 - RNA, 13 nt, Human
cccucccucuuuc

SEQ ID NO: 2996917 - RNA, 20 nt, Human
cccucccuccaccucccugc

SEQ ID NO: 2996918 - RNA, 12 nt, Human
cccucccuccac

SEQ ID NO: 2996919 - RNA, 13 nt, Human
cccucccuccacc

SEQ ID NO: 2996920 - RNA, 17 nt, Human
cccuccaugugggcuag

SEQ ID NO: 2996921 - RNA, 21 nt, Human
cccuccagagccccacagccc

SEQ ID NO: 2996922 - RNA, 19 nt, Human
cccuccagagccccacagc

SEQ ID NO: 2996923 - RNA, 18 nt, Human
cccuccagagccccacag

SEQ ID NO: 2996924 - RNA, 16 nt, Human
cccggcaggguccuag

SEQ ID NO: 2996925 - RNA, 17 nt, Human
cccuaaaguguauuuuu

SEQ ID NO: 2996926 - RNA, 22 nt, Human
cccuaaaguguauuuuuuuacu

SEQ ID NO: 2996927 - RNA, 16 nt, Human
cccucagggucccugg

SEQ ID NO: 2996928 - RNA, 17 nt, Human
cccucagggucccuggu

SEQ ID NO: 2996929 - RNA, 18 nt, Human
cccucagggucccuggug

SEQ ID NO: 2996930 - RNA, 19 nt, Human
cccucagggucccuggugg

SEQ ID NO: 2996931 - RNA, 15 nt, Human
cccucagggucccug

SEQ ID NO: 2996932 - RNA, 22 nt, Human
ccccaggugguuauggagaggg

SEQ ID NO: 2996933 - RNA, 14 nt, Human
ccccaggugccagu

SEQ ID NO: 2996934 - RNA, 12 nt, Human
ccccuggcagcc

SEQ ID NO: 2996935 - RNA, 14 nt, Human
ccccuggcagcccc

SEQ ID NO: 2996936 - RNA, 15 nt, Human
ccccuggcagccccu

SEQ ID NO: 2996937 - RNA, 12 nt, Human
ccccaggaggcc

SEQ ID NO: 2996938 - RNA, 16 nt, Human
ccccagccccauccca

SEQ ID NO: 2996939 - RNA, 12 nt, Human
ccccacagcccc

SEQ ID NO: 2996940 - RNA, 15 nt, Human
ccccagccccauccu

SEQ ID NO: 2996941 - RNA, 13 nt, Human
ccccaccagugcc

SEQ ID NO: 2996942 - RNA, 14 nt, Human
ccccaccagugccu

SEQ ID NO: 2996943 - RNA, 13 nt, Human
ccccagccugcua

SEQ ID NO: 2996944 - RNA, 15 nt, Human
cccgaggccuucucu

SEQ ID NO: 2996945 - RNA, 20 nt, Human
cccgaggccuucucugaagg

SEQ ID NO: 2996946 - RNA, 22 nt, Human
cccgauggaggacuccaggcag

SEQ ID NO: 2996947 - RNA, 23 nt, Human
cccgauggaggacuccaggcagc

SEQ ID NO: 2996948 - RNA, 22 nt, Human
cccgcuaagagggagggagggc

SEQ ID NO: 2996949 - RNA, 20 nt, Human
ccccuguucuggcagaguug

SEQ ID NO: 2996950 - RNA, 22 nt, Human
ccccuguccccgcacugggcuu

SEQ ID NO: 2996951 - RNA, 14 nt, Human
cccugguggcagcu

SEQ ID NO: 2996952 - RNA, 22 nt, Human
cccugcaaccugauugugucuc

SEQ ID NO: 2996953 - RNA, 16 nt, Human
cccugcaaccugauug

SEQ ID NO: 2996954 - RNA, 15 nt, Human
cccugcaauaaaaug

SEQ ID NO: 2996955 - RNA, 14 nt, Human
cccugcaauaaaau

SEQ ID NO: 2996956 - RNA, 18 nt, Human
cccugcagagggcacaga

SEQ ID NO: 2996957 - RNA, 12 nt, Human
cccugcagaggg

SEQ ID NO: 2996958 - RNA, 22 nt, Human
cccugcacuugcagacucuaca

SEQ ID NO: 2996959 - RNA, 21 nt, Human
cccugauuuaauaugcaaagu

SEQ ID NO: 2996960 - RNA, 14 nt, Human
cccugccuccuuug

SEQ ID NO: 2996961 - RNA, 16 nt, Human
cccugccuccuuugug

SEQ ID NO: 2996962 - RNA, 23 nt, Human
cccugccuccuuugugaggaagc

SEQ ID NO: 2996963 - RNA, 18 nt, Human
cccugccacccuggggag

SEQ ID NO: 2996964 - RNA, 17 nt, Human
cccugccacccugggga

SEQ ID NO: 2996965 - RNA, 15 nt, Human
cccugccacccuggg

SEQ ID NO: 2996966 - RNA, 14 nt, Human
cccugccacccugg

SEQ ID NO: 2996967 - RNA, 12 nt, Human
cccugccacccu

SEQ ID NO: 2996968 - RNA, 22 nt, Human
cccugguggcagugggagcugc

SEQ ID NO: 2996969 - RNA, 13 nt, Human
cccugcugguuca

SEQ ID NO: 2996970 - RNA, 20 nt, Human
cccugcugguucaggguugg

SEQ ID NO: 2996971 - RNA, 19 nt, Human
cccugcugguucaggguug

SEQ ID NO: 2996972 - RNA, 16 nt, Human
ccucccccuggcacug

SEQ ID NO: 2996973 - RNA, 15 nt, Human
ccucccaacucaccc

SEQ ID NO: 2996974 - RNA, 13 nt, Human
ccuccccuccucu

SEQ ID NO: 2996975 - RNA, 12 nt, Human
ccuccccuccuc

SEQ ID NO: 2996976 - RNA, 18 nt, Human
ccucccgaauagcuggga

SEQ ID NO: 2996977 - RNA, 20 nt, Human
ccucccgaauagcugggacu

SEQ ID NO: 2996978 - RNA, 19 nt, Human
ccucccgaauagcugggac

SEQ ID NO: 2996979 - RNA, 21 nt, Human
ccucccgaauagcugggacua

SEQ ID NO: 2996980 - RNA, 18 nt, Human
ccucccgaguagcuggga

SEQ ID NO: 2996981 - RNA, 17 nt, Human
ccucccgaguagcuggg

SEQ ID NO: 2996982 - RNA, 12 nt, Human
ccuccuccagcc

SEQ ID NO: 2996983 - RNA, 11 nt, Human
ccuccucagau

SEQ ID NO: 2996984 - RNA, 13 nt, Human
ccucccucuuucc

SEQ ID NO: 2996985 - RNA, 13 nt, Human
ccuccauccugag

SEQ ID NO: 2996986 - RNA, 12 nt, Human
ccuccauccuga

SEQ ID NO: 2996987 - RNA, 14 nt, Human
ccucccaacucacc

SEQ ID NO: 2996988 - RNA, 17 nt, Human
ccucccaaagugcuggg

SEQ ID NO: 2996989 - RNA, 15 nt, Human
ccuccaugugggcua

SEQ ID NO: 2996990 - RNA, 12 nt, Human
ccuccauguggg

SEQ ID NO: 2996991 - RNA, 17 nt, Human
ccuccaggugcacaagc

SEQ ID NO: 2996992 - RNA, 11 nt, Human
ccuccaggugc

SEQ ID NO: 2996993 - RNA, 12 nt, Human
ccuccaggugca

SEQ ID NO: 2996994 - RNA, 17 nt, Human
ccucaggugagaagcag

SEQ ID NO: 2996995 - RNA, 18 nt, Human
ccucaggugagaagcaga

SEQ ID NO: 2996996 - RNA, 20 nt, Human
ccucaggugagaagcagagg

SEQ ID NO: 2996997 - RNA, 14 nt, Human
ccucuccuccacau

SEQ ID NO: 2996998 - RNA, 13 nt, Human
ccucugacacaca

SEQ ID NO: 2996999 - RNA, 20 nt, Human
ccucugacacacagcucugu

SEQ ID NO: 2997000 - RNA, 19 nt, Human
ccucugacacacagcucug

SEQ ID NO: 2997001 - RNA, 14 nt, Human
ccucugacacacag

SEQ ID NO: 2997002 - RNA, 21 nt, Human
ccucugacacacagcucuguc

SEQ ID NO: 2997003 - RNA, 19 nt, Human
ccucugcagcaauaaagca

SEQ ID NO: 2997004 - RNA, 13 nt, Human
ccucugcccacuc

SEQ ID NO: 2997005 - RNA, 16 nt, Human
ccucugcccacucccu

SEQ ID NO: 2997006 - RNA, 18 nt, Human
ccucugcagcaauaaagc

SEQ ID NO: 2997007 - RNA, 14 nt, Human
ccucugcagcaaua

SEQ ID NO: 2997008 - RNA, 23 nt, Human
ccucugcacuccccugcugggug

SEQ ID NO: 2997009 - RNA, 18 nt, Human
ccucugcacuccccugcu

SEQ ID NO: 2997010 - RNA, 16 nt, Human
ccucugcacuccccug

SEQ ID NO: 2997011 - RNA, 17 nt, Human
ccucugcacuccccugc

SEQ ID NO: 2997012 - RNA, 15 nt, Human
ccucugcacuccccu

SEQ ID NO: 2997013 - RNA, 20 nt, Human
ccucuccccagcaagugaga

SEQ ID NO: 2997014 - RNA, 13 nt, Human
ccucucccuugga

SEQ ID NO: 2997015 - RNA, 22 nt, Human
ccucucccuuggauuguccccg

SEQ ID NO: 2997016 - RNA, 14 nt, Human
ccucucccugcugc

SEQ ID NO: 2997017 - RNA, 19 nt, Human
ccucucccugcugcuccua

SEQ ID NO: 2997018 - RNA, 17 nt, Human
ccucucccugcugcucc

SEQ ID NO: 2997019 - RNA, 15 nt, Human
ccucucccugcugcu

SEQ ID NO: 2997020 - RNA, 23 nt, Human
ccucucccugcugcuccuaggac

SEQ ID NO: 2997021 - RNA, 15 nt, Human
ccucuccccagcaag

SEQ ID NO: 2997022 - RNA, 21 nt, Human
ccuccuccagccgccaugcuc

SEQ ID NO: 2997023 - RNA, 18 nt, Human
ccucgguguggagaagcg

SEQ ID NO: 2997024 - RNA, 20 nt, Human
ccucagaugcacaugagcug

SEQ ID NO: 2997025 - RNA, 16 nt, Human
ccucagaucuucugug

SEQ ID NO: 2997026 - RNA, 16 nt, Human
ccucagggucccuggu

SEQ ID NO: 2997027 - RNA, 17 nt, Human
ccucagggucccuggug

SEQ ID NO: 2997028 - RNA, 20 nt, Human
ccucagggucccugguggca

SEQ ID NO: 2997029 - RNA, 23 nt, Human
ccucaggccugggggcugggcag

SEQ ID NO: 2997030 - RNA, 17 nt, Human
ccuauuagagaagagau

SEQ ID NO: 2997031 - RNA, 16 nt, Human
ccuauuagagaagaga

SEQ ID NO: 2997032 - RNA, 24 nt, Human
ccucacaguccuuaccagcagagc

SEQ ID NO: 2997033 - RNA, 23 nt, Human
ccucacaguccuuaccagcagag

SEQ ID NO: 2997034 - RNA, 15 nt, Human
ccuaggugacagagu

SEQ ID NO: 2997035 - RNA, 15 nt, Human
cccuuggacauuuua

SEQ ID NO: 2997036 - RNA, 14 nt, Human
cccuuggacauuuu

SEQ ID NO: 2997037 - RNA, 17 nt, Human
cccuuggauuguccccg

SEQ ID NO: 2997038 - RNA, 17 nt, Human
cccuucuuuccacagaa

SEQ ID NO: 2997039 - RNA, 22 nt, Human
cccuugguuaggcauuguggga

SEQ ID NO: 2997040 - RNA, 23 nt, Human
cccuugguuaggcauugugggaa

SEQ ID NO: 2997041 - RNA, 22 nt, Human
cccuugucggccccaccagugc

SEQ ID NO: 2997042 - RNA, 19 nt, Human
cccuugucggccccaccag

SEQ ID NO: 2997043 - RNA, 22 nt, Human
cccuuguggucccaccccacac

SEQ ID NO: 2997044 - RNA, 20 nt, Human
cccuuguggucccaccccac

SEQ ID NO: 2997045 - RNA, 13 nt, Human
cccuucccaccuc

SEQ ID NO: 2997046 - RNA, 12 nt, Human
cccuucccaccu

SEQ ID NO: 2997047 - RNA, 17 nt, Human
ccgggaagggggcuggg

SEQ ID NO: 2997048 - RNA, 12 nt, Human
ccguuauuaaaa

SEQ ID NO: 2997049 - RNA, 13 nt, Human
ccuaaacauauga

SEQ ID NO: 2997050 - RNA, 15 nt, Human
ccuaaaauucagugg

SEQ ID NO: 2997051 - RNA, 16 nt, Human
ccuaaaauucagugga

SEQ ID NO: 2997052 - RNA, 19 nt, Human
ccuacagcuugaccgugag

SEQ ID NO: 2997053 - RNA, 22 nt, Human
ccuacaguugaaaaacagcuga

SEQ ID NO: 2997054 - RNA, 19 nt, Human
ccuacuguaauuugugaua

SEQ ID NO: 2997055 - RNA, 18 nt, Human
ccuacccacccuccuuuc

SEQ ID NO: 2997056 - RNA, 13 nt, Human
ccuacccacccuc

SEQ ID NO: 2997057 - RNA, 13 nt, Human
ccuaggugacaga

SEQ ID NO: 2997058 - RNA, 21 nt, Human
ccuagaaauuccccacccuga

SEQ ID NO: 2997059 - RNA, 16 nt, Human
cccaguguuuuaggag

SEQ ID NO: 2997060 - RNA, 17 nt, Human
cccaguguuuuaggagc

SEQ ID NO: 2997061 - RNA, 14 nt, Human
cccaguuagcucuc

SEQ ID NO: 2997062 - RNA, 20 nt, Human
cccagugguuccuaauccuc

SEQ ID NO: 2997063 - RNA, 19 nt, Human
cccagucuggaaugcagug

SEQ ID NO: 2997064 - RNA, 18 nt, Human
cccagucuggaaugcagu

SEQ ID NO: 2997065 - RNA, 10 nt, Human
cccagucugg

SEQ ID NO: 2997066 - RNA, 21 nt, Human
cccagugcccacaggaucagu

SEQ ID NO: 2997067 - RNA, 15 nt, Human
cccagugccgagaag

SEQ ID NO: 2997068 - RNA, 13 nt, Human
cccagguuucuau

SEQ ID NO: 2997069 - RNA, 15 nt, Human
cccaguccugcccgc

SEQ ID NO: 2997070 - RNA, 15 nt, Human
cccaggaggccagcc

SEQ ID NO: 2997071 - RNA, 16 nt, Human
cccaggaggccagccu

SEQ ID NO: 2997072 - RNA, 15 nt, Human
cccaggcauucccca

SEQ ID NO: 2997073 - RNA, 23 nt, Human
cccaggcaggucuugaacuccug

SEQ ID NO: 2997074 - RNA, 17 nt, Human
cccaggcauuccccagg

SEQ ID NO: 2997075 - RNA, 14 nt, Human
cccaggguggccac

SEQ ID NO: 2997076 - RNA, 13 nt, Human
cccaggguggcca

SEQ ID NO: 2997077 - RNA, 19 nt, Human
cccaggguggccacaccuc

SEQ ID NO: 2997078 - RNA, 15 nt, Human
cccaggguggccaca

SEQ ID NO: 2997079 - RNA, 16 nt, Human
cccaugagccucagca

SEQ ID NO: 2997080 - RNA, 15 nt, Human
cccaugagccucagc

SEQ ID NO: 2997081 - RNA, 20 nt, Human
cccaugagccucagcauccu

SEQ ID NO: 2997082 - RNA, 12 nt, Human
cccaugcugccc

SEQ ID NO: 2997083 - RNA, 13 nt, Human
cccaugcugcccu

SEQ ID NO: 2997084 - RNA, 14 nt, Human
cccaugcugcccug

SEQ ID NO: 2997085 - RNA, 12 nt, Human
cccaucugugaa

SEQ ID NO: 2997086 - RNA, 18 nt, Human
cccaucucacacaugagc

SEQ ID NO: 2997087 - RNA, 13 nt, Human
cccaucucacaca

SEQ ID NO: 2997088 - RNA, 20 nt, Human
cccaucugugaaaggaaaga

SEQ ID NO: 2997089 - RNA, 20 nt, Human
cccauuaugcgcuguggcca

SEQ ID NO: 2997090 - RNA, 21 nt, Human
ccccaaauggaaaugggcaga

SEQ ID NO: 2997091 - RNA, 23 nt, Human
ccauggcacucuauguucuaaga

SEQ ID NO: 2997092 - RNA, 13 nt, Human
ccaugugccaggu

SEQ ID NO: 2997093 - RNA, 14 nt, Human
ccauguuggccagg

SEQ ID NO: 2997094 - RNA, 13 nt, Human
ccauguuggccag

SEQ ID NO: 2997095 - RNA, 13 nt, Human
ccaugcuccuggc

SEQ ID NO: 2997096 - RNA, 10 nt, Human
ccaugaaaga

SEQ ID NO: 2997097 - RNA, 16 nt, Human
ccaugcugcccuguga

SEQ ID NO: 2997098 - RNA, 17 nt, Human
ccaugcugcccugugag

SEQ ID NO: 2997099 - RNA, 15 nt, Human
ccaugcuccuggccc

SEQ ID NO: 2997100 - RNA, 18 nt, Human
ccaugcuccuggcccacu

SEQ ID NO: 2997101 - RNA, 15 nt, Human
ccaugcugcccugug

SEQ ID NO: 2997102 - RNA, 13 nt, Human
cccacgcccccac

SEQ ID NO: 2997103 - RNA, 14 nt, Human
cccacgcccccacu

SEQ ID NO: 2997104 - RNA, 15 nt, Human
cccacgcccccacug

SEQ ID NO: 2997105 - RNA, 19 nt, Human
cccaccuuggcugcaggga

SEQ ID NO: 2997106 - RNA, 17 nt, Human
cccaccuuggcugcagg

SEQ ID NO: 2997107 - RNA, 16 nt, Human
cccaccuuggcugcag

SEQ ID NO: 2997108 - RNA, 12 nt, Human
cccaccuggccu

SEQ ID NO: 2997109 - RNA, 15 nt, Human
cccaccuggccucug

SEQ ID NO: 2997110 - RNA, 15 nt, Human
ccauguuggccaggc

SEQ ID NO: 2997111 - RNA, 18 nt, Human
ccauguuggccaggcugg

SEQ ID NO: 2997112 - RNA, 21 nt, Human
ccauguuggccaggcuggucu

SEQ ID NO: 2997113 - RNA, 19 nt, Human
ccauguuggccaggcuggu

SEQ ID NO: 2997114 - RNA, 18 nt, Human
cccaggaggccagccuug

SEQ ID NO: 2997115 - RNA, 23 nt, Human
cccagauugcaacaggcugggcu

SEQ ID NO: 2997116 - RNA, 17 nt, Human
cccagccccaaugaaca

SEQ ID NO: 2997117 - RNA, 11 nt, Human
cccagccccau

SEQ ID NO: 2997118 - RNA, 12 nt, Human
cccagccccauc

SEQ ID NO: 2997119 - RNA, 13 nt, Human
cccagccccaaug

SEQ ID NO: 2997120 - RNA, 18 nt, Human
cccagccccauccucugu

SEQ ID NO: 2997121 - RNA, 19 nt, Human
cccagccccauccucugua

SEQ ID NO: 2997122 - RNA, 18 nt, Human
cccagccccuucugaccc

SEQ ID NO: 2997123 - RNA, 13 nt, Human
cccagccccaucc

SEQ ID NO: 2997124 - RNA, 14 nt, Human
cccagccccauccc

SEQ ID NO: 2997125 - RNA, 14 nt, Human
cccagccccauccu

SEQ ID NO: 2997126 - RNA, 15 nt, Human
cccagccccauccuc

SEQ ID NO: 2997127 - RNA, 13 nt, Human
cccagcucugguc

SEQ ID NO: 2997128 - RNA, 14 nt, Human
cccagcucuggucc

SEQ ID NO: 2997129 - RNA, 12 nt, Human
cccagcucuggu

SEQ ID NO: 2997130 - RNA, 15 nt, Human
cccagcucuggucca

SEQ ID NO: 2997131 - RNA, 16 nt, Human
cccagcucugguccau

SEQ ID NO: 2997132 - RNA, 18 nt, Human
cccagcucugguccauag

SEQ ID NO: 2997133 - RNA, 14 nt, Human
cccagcgagcccug

SEQ ID NO: 2997134 - RNA, 20 nt, Human
cccagcuacucgggaggcug

SEQ ID NO: 2997135 - RNA, 22 nt, Human
cccagcuacucgggaggcugag

SEQ ID NO: 2997136 - RNA, 14 nt, Human
cccaggaggccagc

SEQ ID NO: 2997137 - RNA, 14 nt, Human
cccaggagccccga

SEQ ID NO: 2997138 - RNA, 13 nt, Human
cccaggagccccg

SEQ ID NO: 2997139 - RNA, 17 nt, Human
ccagccuggaugccauc

SEQ ID NO: 2997140 - RNA, 13 nt, Human
ccagccuggaugc

SEQ ID NO: 2997141 - RNA, 15 nt, Human
ccagccuggaugcca

SEQ ID NO: 2997142 - RNA, 16 nt, Human
ccagcugcuugggcuu

SEQ ID NO: 2997143 - RNA, 18 nt, Human
ccagcugcuugggcuuca

SEQ ID NO: 2997144 - RNA, 13 nt, Human
ccagcugcuuggg

SEQ ID NO: 2997145 - RNA, 15 nt, Human
ccagcugcuugggcu

SEQ ID NO: 2997146 - RNA, 21 nt, Human
ccagcugugcucuggacaggc

SEQ ID NO: 2997147 - RNA, 20 nt, Human
ccagcugugcucuggacagg

SEQ ID NO: 2997148 - RNA, 18 nt, Human
ccagcugugcucuggaca

SEQ ID NO: 2997149 - RNA, 12 nt, Human
ccaggagcagcc

SEQ ID NO: 2997150 - RNA, 13 nt, Human
ccaggagcagcca

SEQ ID NO: 2997151 - RNA, 14 nt, Human
ccaggaagccagca

SEQ ID NO: 2997152 - RNA, 15 nt, Human
ccaggaagccagcag

SEQ ID NO: 2997153 - RNA, 17 nt, Human
ccaggaagccagcaggc

SEQ ID NO: 2997154 - RNA, 19 nt, Human
ccaggaagccagcaggcuc

SEQ ID NO: 2997155 - RNA, 23 nt, Human
ccagcugugcucuggacaggcau

SEQ ID NO: 2997156 - RNA, 22 nt, Human
ccagcugugcucuggacaggca

SEQ ID NO: 2997157 - RNA, 16 nt, Human
ccaggcccucugccca

SEQ ID NO: 2997158 - RNA, 17 nt, Human
ccaggcccucugcccac

SEQ ID NO: 2997159 - RNA, 18 nt, Human
ccaggcccucugcccacu

SEQ ID NO: 2997160 - RNA, 19 nt, Human
ccaggcccucugcccacuc

SEQ ID NO: 2997161 - RNA, 13 nt, Human
ccaggccuccuac

SEQ ID NO: 2997162 - RNA, 18 nt, Human
ccaggccuccuacagcuu

SEQ ID NO: 2997163 - RNA, 19 nt, Human
ccaggccuccuacagcuug

SEQ ID NO: 2997164 - RNA, 14 nt, Human
ccaggagcagccac

SEQ ID NO: 2997165 - RNA, 21 nt, Human
ccaggccagagggagugacag

SEQ ID NO: 2997166 - RNA, 14 nt, Human
ccaggccagaggga

SEQ ID NO: 2997167 - RNA, 23 nt, Human
ccaggccccugccacccugggga

SEQ ID NO: 2997168 - RNA, 21 nt, Human
ccaggccccugccacccuggg

SEQ ID NO: 2997169 - RNA, 19 nt, Human
ccaggccccugccacccug

SEQ ID NO: 2997170 - RNA, 23 nt, Human
ccagggacagaggggguggccuc

SEQ ID NO: 2997171 - RNA, 14 nt, Human
ccagugccugggug

SEQ ID NO: 2997172 - RNA, 13 nt, Human
ccagugccugggu

SEQ ID NO: 2997173 - RNA, 21 nt, Human
ccagugccucucccugcugcu

SEQ ID NO: 2997174 - RNA, 19 nt, Human
ccagugccucucccugcug

SEQ ID NO: 2997175 - RNA, 16 nt, Human
ccagugccucucccug

SEQ ID NO: 2997176 - RNA, 14 nt, Human
ccagugccucuccc

SEQ ID NO: 2997177 - RNA, 12 nt, Human
ccaucacccgcu

SEQ ID NO: 2997178 - RNA, 18 nt, Human
ccauauucuguuggccag

SEQ ID NO: 2997179 - RNA, 15 nt, Human
ccauauucuguuggc

SEQ ID NO: 2997180 - RNA, 19 nt, Human
ccauauuaccacagacaua

SEQ ID NO: 2997181 - RNA, 23 nt, Human
ccauagagagcaagacgcugugc

SEQ ID NO: 2997182 - RNA, 21 nt, Human
ccauccucuguacagagccca

SEQ ID NO: 2997183 - RNA, 15 nt, Human
ccauccugaggcucc

SEQ ID NO: 2997184 - RNA, 22 nt, Human
ccauccuggcccagggcaucug

SEQ ID NO: 2997185 - RNA, 20 nt, Human
ccauccuggcccagggcauc

SEQ ID NO: 2997186 - RNA, 19 nt, Human
ccauccuggcccagggcau

SEQ ID NO: 2997187 - RNA, 18 nt, Human
ccauccuggcccagggca

SEQ ID NO: 2997188 - RNA, 17 nt, Human
ccauccuggcccagggc

SEQ ID NO: 2997189 - RNA, 16 nt, Human
ccaucaugucuggcua

SEQ ID NO: 2997190 - RNA, 14 nt, Human
ccaucaugucuggc

SEQ ID NO: 2997191 - RNA, 22 nt, Human
cauugacuauuuuuguuuuuau

SEQ ID NO: 2997192 - RNA, 13 nt, Human
cauugaccugagg

SEQ ID NO: 2997193 - RNA, 22 nt, Human
cauugaccugaggcccuucucu

SEQ ID NO: 2997194 - RNA, 14 nt, Human
cauugacagauuga

SEQ ID NO: 2997195 - RNA, 22 nt, Human
cauugaaaucuaggaaaauuau

SEQ ID NO: 2997196 - RNA, 19 nt, Human
cauugaaaucuuuuugcuu

SEQ ID NO: 2997197 - RNA, 16 nt, Human
cauuucucauguugaa

SEQ ID NO: 2997198 - RNA, 17 nt, Human
cauuucucauguugaaa

SEQ ID NO: 2997199 - RNA, 21 nt, Human
cauuucuuccacaagagccca

SEQ ID NO: 2997200 - RNA, 23 nt, Human
cauuucugcaucagcugcugaaa

SEQ ID NO: 2997201 - RNA, 19 nt, Human
cauuuaaagcuuauuaaaa

SEQ ID NO: 2997202 - RNA, 21 nt, Human
cauuuacuuuguguucaccuu

SEQ ID NO: 2997203 - RNA, 17 nt, Human
cauuuacuuuguguuca

SEQ ID NO: 2997204 - RNA, 12 nt, Human
cauuuccaagca

SEQ ID NO: 2997205 - RNA, 15 nt, Human
cauuuacuuaagacu

SEQ ID NO: 2997206 - RNA, 14 nt, Human
cauuuacuuaagac

SEQ ID NO: 2997207 - RNA, 13 nt, Human
cauuuacuuaaga

SEQ ID NO: 2997208 - RNA, 17 nt, Human
cauuuacuuaagacuua

SEQ ID NO: 2997209 - RNA, 16 nt, Human
cauuuacuuaagacuu

SEQ ID NO: 2997210 - RNA, 21 nt, Human
cauuuaaaagauacaguuacu

SEQ ID NO: 2997211 - RNA, 17 nt, Human
ccaaagaaauguaaggg

SEQ ID NO: 2997212 - RNA, 21 nt, Human
ccaaaauaaaacuuuuuaaaa

SEQ ID NO: 2997213 - RNA, 18 nt, Human
ccaaaauaaaacuuuuua

SEQ ID NO: 2997214 - RNA, 20 nt, Human
cauuuuuaguagagacaggg

SEQ ID NO: 2997215 - RNA, 14 nt, Human
cauuugcucaugga

SEQ ID NO: 2997216 - RNA, 15 nt, Human
cauuugcucauggaa

SEQ ID NO: 2997217 - RNA, 12 nt, Human
cauuuuaaacaa

SEQ ID NO: 2997218 - RNA, 16 nt, Human
cauuugcucauggaau

SEQ ID NO: 2997219 - RNA, 17 nt, Human
cauuuuaaacaaaauag

SEQ ID NO: 2997220 - RNA, 16 nt, Human
cauuuuaaacaaaaua

SEQ ID NO: 2997221 - RNA, 13 nt, Human
cauuuuaaacaaa

SEQ ID NO: 2997222 - RNA, 23 nt, Human
cauuuuaaacaaaauagaaaguu

SEQ ID NO: 2997223 - RNA, 22 nt, Human
cauuuuaaacaaaauagaaagu

SEQ ID NO: 2997224 - RNA, 21 nt, Human
cauuuuauuuuauuaugcaug

SEQ ID NO: 2997225 - RNA, 19 nt, Human
cauuuuauuuuauuaugca

SEQ ID NO: 2997226 - RNA, 20 nt, Human
cauuuuuaagugcugcauuu

SEQ ID NO: 2997227 - RNA, 15 nt, Human
cauuuuuaagugcug

SEQ ID NO: 2997228 - RNA, 18 nt, Human
cauuuuuaguagagacag

SEQ ID NO: 2997229 - RNA, 19 nt, Human
cauuuuuaguagagacagg

SEQ ID NO: 2997230 - RNA, 23 nt, Human
cauuuugggguacccacugcucu

SEQ ID NO: 2997231 - RNA, 18 nt, Human
cauuuugcuaaaugugaa

SEQ ID NO: 2997232 - RNA, 21 nt, Human
cauuuugcuaaaugugaauga

SEQ ID NO: 2997233 - RNA, 24 nt, Human
cauuuugcuaaaugugaaugauga

SEQ ID NO: 2997234 - RNA, 22 nt, Human
cauuuugggguacccacugcuc

SEQ ID NO: 2997235 - RNA, 21 nt, Human
cauuuugggguacccacugcu

SEQ ID NO: 2997236 - RNA, 20 nt, Human
cauuuugggguacccacugc

SEQ ID NO: 2997237 - RNA, 23 nt, Human
cauuucuuccacaagagcccagg

SEQ ID NO: 2997238 - RNA, 14 nt, Human
cauuugagcagggc

SEQ ID NO: 2997239 - RNA, 19 nt, Human
cauuugaggucuguucuuu

SEQ ID NO: 2997240 - RNA, 18 nt, Human
cauuugaggucuguucuu

SEQ ID NO: 2997241 - RNA, 17 nt, Human
cauuugaggucuguucu

SEQ ID NO: 2997242 - RNA, 20 nt, Human
ccaauuugcacauuaaauga

SEQ ID NO: 2997243 - RNA, 19 nt, Human
ccaauuugcacauuaaaug

SEQ ID NO: 2997244 - RNA, 16 nt, Human
ccacaagacccuugug

SEQ ID NO: 2997245 - RNA, 13 nt, Human
ccacaagagccca

SEQ ID NO: 2997246 - RNA, 22 nt, Human
ccacaagaaaugaaagcaggga

SEQ ID NO: 2997247 - RNA, 16 nt, Human
ccacaagaaaugaaag

SEQ ID NO: 2997248 - RNA, 18 nt, Human
ccacaaaggagagcuagc

SEQ ID NO: 2997249 - RNA, 20 nt, Human
ccaauauucauagcagcuua

SEQ ID NO: 2997250 - RNA, 23 nt, Human
ccaagugccaaagaagcagacca

SEQ ID NO: 2997251 - RNA, 19 nt, Human
ccaaggcugauuaaaccaa

SEQ ID NO: 2997252 - RNA, 14 nt, Human
ccaaggcuggggga

SEQ ID NO: 2997253 - RNA, 18 nt, Human
ccaaggugggaggauugc

SEQ ID NO: 2997254 - RNA, 18 nt, Human
ccaaggcuagaaccaccu

SEQ ID NO: 2997255 - RNA, 19 nt, Human
ccaaggccuuccccuggca

SEQ ID NO: 2997256 - RNA, 13 nt, Human
ccaaggccuuccc

SEQ ID NO: 2997257 - RNA, 12 nt, Human
ccaagcucccag

SEQ ID NO: 2997258 - RNA, 13 nt, Human
ccaagcucccagg

SEQ ID NO: 2997259 - RNA, 23 nt, Human
ccaagcagagguugggaggccau

SEQ ID NO: 2997260 - RNA, 14 nt, Human
ccaagcaggacaug

SEQ ID NO: 2997261 - RNA, 16 nt, Human
ccacaagagcccaggc

SEQ ID NO: 2997262 - RNA, 17 nt, Human
ccacaagagcccaggcc

SEQ ID NO: 2997263 - RNA, 18 nt, Human
ccacaagagcccaggccu

SEQ ID NO: 2997264 - RNA, 19 nt, Human
ccacaagagcccaggccuc

SEQ ID NO: 2997265 - RNA, 20 nt, Human
ccacaagagcccaggccucc

SEQ ID NO: 2997266 - RNA, 21 nt, Human
ccacaagagcccaggccuccu

SEQ ID NO: 2997267 - RNA, 20 nt, Human
ccacaaguuaaauaaaucau

SEQ ID NO: 2997268 - RNA, 15 nt, Human
ccacaaguuaaauaa

SEQ ID NO: 2997269 - RNA, 14 nt, Human
ccaaagaugcagcc

SEQ ID NO: 2997270 - RNA, 13 nt, Human
ccaaagaugcagc

SEQ ID NO: 2997271 - RNA, 12 nt, Human
ccaagacuccca

SEQ ID NO: 2997272 - RNA, 19 nt, Human
ccaagacucccaugaggga

SEQ ID NO: 2997273 - RNA, 15 nt, Human
ccaagacucccauga

SEQ ID NO: 2997274 - RNA, 14 nt, Human
ccaagacucccaug

SEQ ID NO: 2997275 - RNA, 13 nt, Human
ccaacccucauca

SEQ ID NO: 2997276 - RNA, 15 nt, Human
ccaacccucaucacc

SEQ ID NO: 2997277 - RNA, 15 nt, Human
ccaagaccuucuccu

SEQ ID NO: 2997278 - RNA, 14 nt, Human
ccaacacgagcagg

SEQ ID NO: 2997279 - RNA, 22 nt, Human
ccaaauucuuucaguggcuacc

SEQ ID NO: 2997280 - RNA, 15 nt, Human
ccaaauucuuucagu

SEQ ID NO: 2997281 - RNA, 16 nt, Human
ccaacaucaacaucuu

SEQ ID NO: 2997282 - RNA, 14 nt, Human
ccaacauacuccca

SEQ ID NO: 2997283 - RNA, 13 nt, Human
ccaacaucaacau

SEQ ID NO: 2997284 - RNA, 21 nt, Human
ccaacacgagcaggcuacugu

SEQ ID NO: 2997285 - RNA, 17 nt, Human
cauuaaagguacuuugc

SEQ ID NO: 2997286 - RNA, 18 nt, Human
cauuaaaugacucuuccc

SEQ ID NO: 2997287 - RNA, 14 nt, Human
cauuaaaugacucu

SEQ ID NO: 2997288 - RNA, 13 nt, Human
cauuaaaugacuc

SEQ ID NO: 2997289 - RNA, 15 nt, Human
cauguuuuguuuacg

SEQ ID NO: 2997290 - RNA, 21 nt, Human
cauuaaagccugaguuugcuu

SEQ ID NO: 2997291 - RNA, 18 nt, Human
cauguuuuucuucucccu

SEQ ID NO: 2997292 - RNA, 14 nt, Human
caugucuuuucuug

SEQ ID NO: 2997293 - RNA, 19 nt, Human
caugucuuuucuugcauga

SEQ ID NO: 2997294 - RNA, 21 nt, Human
caugucuuuucuugcaugagg

SEQ ID NO: 2997295 - RNA, 23 nt, Human
caugucuuuucuugcaugaggcu

SEQ ID NO: 2997296 - RNA, 21 nt, Human
cauguaauuaaguacuaugua

SEQ ID NO: 2997297 - RNA, 18 nt, Human
cauguaauuaaguacuau

SEQ ID NO: 2997298 - RNA, 16 nt, Human
cauggucggaaaacau

SEQ ID NO: 2997299 - RNA, 15 nt, Human
caugugcacaugcac

SEQ ID NO: 2997300 - RNA, 21 nt, Human
caugugccagguuuuuggucu

SEQ ID NO: 2997301 - RNA, 15 nt, Human
cauguuuaugagaaa

SEQ ID NO: 2997302 - RNA, 23 nt, Human
cauguuugauguaucugagcagg

SEQ ID NO: 2997303 - RNA, 15 nt, Human
cauguuugugauuga

SEQ ID NO: 2997304 - RNA, 17 nt, Human
caugccuaccaauauuu

SEQ ID NO: 2997305 - RNA, 14 nt, Human
caugccucucucag

SEQ ID NO: 2997306 - RNA, 15 nt, Human
caugccucucucagg

SEQ ID NO: 2997307 - RNA, 16 nt, Human
caugccucucucaggc

SEQ ID NO: 2997308 - RNA, 17 nt, Human
caugccucucucaggcc

SEQ ID NO: 2997309 - RNA, 18 nt, Human
caugccucucucaggcca

SEQ ID NO: 2997310 - RNA, 19 nt, Human
caugccucucucaggccaa

SEQ ID NO: 2997311 - RNA, 13 nt, Human
caugccuggaugg

SEQ ID NO: 2997312 - RNA, 22 nt, Human
caugggaaugaaugucagugug

SEQ ID NO: 2997313 - RNA, 17 nt, Human
caugggacagggaggac

SEQ ID NO: 2997314 - RNA, 15 nt, Human
caugggccuccugug

SEQ ID NO: 2997315 - RNA, 17 nt, Human
caugggccuccugugug

SEQ ID NO: 2997316 - RNA, 16 nt, Human
caugggccuccugugu

SEQ ID NO: 2997317 - RNA, 11 nt, Human
cauggacuuug

SEQ ID NO: 2997318 - RNA, 13 nt, Human
cauggacuuuguu

SEQ ID NO: 2997319 - RNA, 17 nt, Human
cauggagguuugaagau

SEQ ID NO: 2997320 - RNA, 16 nt, Human
cauggaguauauguca

SEQ ID NO: 2997321 - RNA, 18 nt, Human
caugggaaugaaugucag

SEQ ID NO: 2997322 - RNA, 17 nt, Human
caugcugucccuuacgu

SEQ ID NO: 2997323 - RNA, 20 nt, Human
caugcuguucaugaaagauu

SEQ ID NO: 2997324 - RNA, 22 nt, Human
caugcugucccuuacgugaguc

SEQ ID NO: 2997325 - RNA, 23 nt, Human
caugcugucuacacuaagagaga

SEQ ID NO: 2997326 - RNA, 17 nt, Human
caugcgggcuuccuccu

SEQ ID NO: 2997327 - RNA, 18 nt, Human
caugccuggauggggcug

SEQ ID NO: 2997328 - RNA, 21 nt, Human
caugccuggauggggcugcac

SEQ ID NO: 2997329 - RNA, 23 nt, Human
caugccuggauggggcugcaccg

SEQ ID NO: 2997330 - RNA, 18 nt, Human
cauggacaugaucuucuu

SEQ ID NO: 2997331 - RNA, 17 nt, Human
cauggacuucuggaugc

SEQ ID NO: 2997332 - RNA, 16 nt, Human
cauggaauaacaugua

SEQ ID NO: 2997333 - RNA, 20 nt, Human
cauggaaguacuauaauuua

SEQ ID NO: 2997334 - RNA, 22 nt, Human
cauggaaguacuauaauuuacc

SEQ ID NO: 2997335 - RNA, 13 nt, Human
caugccccugaac

SEQ ID NO: 2997336 - RNA, 20 nt, Human
caugccagggccaugucaga

SEQ ID NO: 2997337 - RNA, 19 nt, Human
caugccagcuuaucucagg

SEQ ID NO: 2997338 - RNA, 20 nt, Human
caugccagcuuaucucaggg

SEQ ID NO: 2997339 - RNA, 20 nt, Human
caugcauagagugugaugua

SEQ ID NO: 2997340 - RNA, 18 nt, Human
cauacuuuuuggguuuau

SEQ ID NO: 2997341 - RNA, 16 nt, Human
cauacuuuuuggguuu

SEQ ID NO: 2997342 - RNA, 12 nt, Human
cauacuuuuugg

SEQ ID NO: 2997343 - RNA, 23 nt, Human
cauagagagcaagacgcugugcu

SEQ ID NO: 2997344 - RNA, 19 nt, Human
cauagagagcaagacgcug

SEQ ID NO: 2997345 - RNA, 21 nt, Human
cauagagagcaagacgcugug

SEQ ID NO: 2997346 - RNA, 18 nt, Human
cauacuauuaaacaugcu

SEQ ID NO: 2997347 - RNA, 11 nt, Human
cauacucugcu

SEQ ID NO: 2997348 - RNA, 16 nt, Human
cauacucccaucugug

SEQ ID NO: 2997349 - RNA, 15 nt, Human
cauacucccaucugu

SEQ ID NO: 2997350 - RNA, 18 nt, Human
cauacucccaucugugaa

SEQ ID NO: 2997351 - RNA, 20 nt, Human
cauacucccaucugugaaag

SEQ ID NO: 2997352 - RNA, 20 nt, Human
cauauauaacaaugcuguau

SEQ ID NO: 2997353 - RNA, 21 nt, Human
cauauauuuuuuaaaauaagu

SEQ ID NO: 2997354 - RNA, 20 nt, Human
cauauauuuuuuaaaauaag

SEQ ID NO: 2997355 - RNA, 16 nt, Human
cauauauuuuuuaaaa

SEQ ID NO: 2997356 - RNA, 15 nt, Human
cauauauuuuuuaaa

SEQ ID NO: 2997357 - RNA, 22 nt, Human
cauauauauguuuuaagaggca

SEQ ID NO: 2997358 - RNA, 14 nt, Human
cauauccaaguuug

SEQ ID NO: 2997359 - RNA, 16 nt, Human
cauauccaaguuugaa

SEQ ID NO: 2997360 - RNA, 22 nt, Human
cauaguggcuuaaaacaacacu

SEQ ID NO: 2997361 - RNA, 21 nt, Human
cauaguuugggcuuguaccac

SEQ ID NO: 2997362 - RNA, 19 nt, Human
cauaguaugguggcugggu

SEQ ID NO: 2997363 - RNA, 18 nt, Human
cauaguaugguggcuggg

SEQ ID NO: 2997364 - RNA, 20 nt, Human
cauaguaugguggcuggguu

SEQ ID NO: 2997365 - RNA, 17 nt, Human
cauaguaugguggcugg

SEQ ID NO: 2997366 - RNA, 18 nt, Human
caucaaugaaugaaugaa

SEQ ID NO: 2997367 - RNA, 22 nt, Human
caucaagucuuucacauuuaaa

SEQ ID NO: 2997368 - RNA, 14 nt, Human
caucaagaugugac

SEQ ID NO: 2997369 - RNA, 12 nt, Human
cauauuuucaug

SEQ ID NO: 2997370 - RNA, 17 nt, Human
cauauuuacuucuuaua

SEQ ID NO: 2997371 - RNA, 16 nt, Human
cauauuuacuucuuau

SEQ ID NO: 2997372 - RNA, 20 nt, Human
cauauuuacuucuuauacau

SEQ ID NO: 2997373 - RNA, 14 nt, Human
cauauuuacuucuu

SEQ ID NO: 2997374 - RNA, 14 nt, Human
caucauuucaagaa

SEQ ID NO: 2997375 - RNA, 12 nt, Human
caucauuucaag

SEQ ID NO: 2997376 - RNA, 14 nt, Human
caucauugaaaucu

SEQ ID NO: 2997377 - RNA, 15 nt, Human
caucauugaaaucuu

SEQ ID NO: 2997378 - RNA, 20 nt, Human
caucauugaaaucuuuuugc

SEQ ID NO: 2997379 - RNA, 21 nt, Human
caucauugaaaucuuuuugcu

SEQ ID NO: 2997380 - RNA, 13 nt, Human
caucauugaaauc

SEQ ID NO: 2997381 - RNA, 15 nt, Human
caucaccaacgucug

SEQ ID NO: 2997382 - RNA, 11 nt, Human
caucccugaag

SEQ ID NO: 2997383 - RNA, 13 nt, Human
caucccugaaggc

SEQ ID NO: 2997384 - RNA, 19 nt, Human
caucccucuggggcuguuc

SEQ ID NO: 2997385 - RNA, 14 nt, Human
caucccucccucca

SEQ ID NO: 2997386 - RNA, 13 nt, Human
caucccucccucc

SEQ ID NO: 2997387 - RNA, 12 nt, Human
caucccucccuc

SEQ ID NO: 2997388 - RNA, 15 nt, Human
cauccagguucagcu

SEQ ID NO: 2997389 - RNA, 17 nt, Human
caucccugaaggccccg

SEQ ID NO: 2997390 - RNA, 18 nt, Human
caucccugaaggccccgc

SEQ ID NO: 2997391 - RNA, 19 nt, Human
caucccugaaggccccgcc

SEQ ID NO: 2997392 - RNA, 21 nt, Human
caucccugaaggccccgccca

SEQ ID NO: 2997393 - RNA, 22 nt, Human
caucuuccaaggguacuaagga

SEQ ID NO: 2997394 - RNA, 13 nt, Human
caucuugcucugc

SEQ ID NO: 2997395 - RNA, 14 nt, Human
caucuugcucugcu

SEQ ID NO: 2997396 - RNA, 20 nt, Human
caucuugcucugcugacaga

SEQ ID NO: 2997397 - RNA, 17 nt, Human
cauccucauacccaccc

SEQ ID NO: 2997398 - RNA, 18 nt, Human
cauccucauacccacccc

SEQ ID NO: 2997399 - RNA, 21 nt, Human
cauccucauacccacccccac

SEQ ID NO: 2997400 - RNA, 22 nt, Human
cauccucauacccacccccacc

SEQ ID NO: 2997401 - RNA, 13 nt, Human
cauccucccaagg

SEQ ID NO: 2997402 - RNA, 15 nt, Human
cauccuccucagauc

SEQ ID NO: 2997403 - RNA, 16 nt, Human
cauccuccucagaucu

SEQ ID NO: 2997404 - RNA, 18 nt, Human
cauccuccucagaucuuc

SEQ ID NO: 2997405 - RNA, 19 nt, Human
cauccuccucagaucuucu

SEQ ID NO: 2997406 - RNA, 11 nt, Human
cauccuccuca

SEQ ID NO: 2997407 - RNA, 12 nt, Human
cauccuccucag

SEQ ID NO: 2997408 - RNA, 15 nt, Human
cauccucauacccac

SEQ ID NO: 2997409 - RNA, 16 nt, Human
cauccucauacccacc

SEQ ID NO: 2997410 - RNA, 22 nt, Human
caucuagugagcagucaggaaa

SEQ ID NO: 2997411 - RNA, 16 nt, Human
caucucacacaugagc

SEQ ID NO: 2997412 - RNA, 17 nt, Human
caucucacacaugagca

SEQ ID NO: 2997413 - RNA, 20 nt, Human
caucucacacaugagcauca

SEQ ID NO: 2997414 - RNA, 15 nt, Human
cauccucuguacaga

SEQ ID NO: 2997415 - RNA, 18 nt, Human
cauccucuguacagagcc

SEQ ID NO: 2997416 - RNA, 19 nt, Human
cauccucuguacagagccc

SEQ ID NO: 2997417 - RNA, 15 nt, Human
caucuacccuccgau

SEQ ID NO: 2997418 - RNA, 14 nt, Human
caucuagugagcag

SEQ ID NO: 2997419 - RNA, 14 nt, Human
cauacuauuaaaca

SEQ ID NO: 2997420 - RNA, 21 nt, Human
cauacuaaccagcagaaaugc

SEQ ID NO: 2997421 - RNA, 14 nt, Human
cauacuaaccagca

SEQ ID NO: 2997422 - RNA, 18 nt, Human
cauacguacacauuuuau

SEQ ID NO: 2997423 - RNA, 17 nt, Human
cauacguacacauuuua

SEQ ID NO: 2997424 - RNA, 16 nt, Human
cauacguacacauuuu

SEQ ID NO: 2997425 - RNA, 15 nt, Human
cauacguacacauuu

SEQ ID NO: 2997426 - RNA, 13 nt, Human
cauacguacacau

SEQ ID NO: 2997427 - RNA, 14 nt, Human
cauacccaccccca

SEQ ID NO: 2997428 - RNA, 17 nt, Human
cauacccacccccaccc

SEQ ID NO: 2997429 - RNA, 18 nt, Human
cauacccacccccaccca

SEQ ID NO: 2997430 - RNA, 21 nt, Human
cauacccacccccacccaagg

SEQ ID NO: 2997431 - RNA, 18 nt, Human
caguuggguuuuuuaagg

SEQ ID NO: 2997432 - RNA, 16 nt, Human
caguuggguuuuuuaa

SEQ ID NO: 2997433 - RNA, 11 nt, Human
caguuggguuu

SEQ ID NO: 2997434 - RNA, 18 nt, Human
caguuggucccccuucca

SEQ ID NO: 2997435 - RNA, 19 nt, Human
caguuggguggaugccugg

SEQ ID NO: 2997436 - RNA, 18 nt, Human
caguuggguggaugccug

SEQ ID NO: 2997437 - RNA, 19 nt, Human
caguuggucccccuuccau

SEQ ID NO: 2997438 - RNA, 20 nt, Human
caguuggucccccuuccaug

SEQ ID NO: 2997439 - RNA, 21 nt, Human
caguuggucccccuuccaugg

SEQ ID NO: 2997440 - RNA, 22 nt, Human
caguuggucccccuuccaugga

SEQ ID NO: 2997441 - RNA, 23 nt, Human
caguugccagucaccccggccac

SEQ ID NO: 2997442 - RNA, 16 nt, Human
caguuggguggaugcc

SEQ ID NO: 2997443 - RNA, 19 nt, Human
caguuuuuuuccuucaaga

SEQ ID NO: 2997444 - RNA, 19 nt, Human
caguuuucugagaaagacu

SEQ ID NO: 2997445 - RNA, 20 nt, Human
caguuuucugagaaagacua

SEQ ID NO: 2997446 - RNA, 14 nt, Human
caguuuucugagaa

SEQ ID NO: 2997447 - RNA, 15 nt, Human
caguuuucugagaaa

SEQ ID NO: 2997448 - RNA, 17 nt, Human
caguuguuagugugucu

SEQ ID NO: 2997449 - RNA, 14 nt, Human
caguugaaaagacu

SEQ ID NO: 2997450 - RNA, 18 nt, Human
caguugaaaagacuccaa

SEQ ID NO: 2997451 - RNA, 21 nt, Human
caguugaaaagacuccaaaga

SEQ ID NO: 2997452 - RNA, 22 nt, Human
caguugaaaagacuccaaagaa

SEQ ID NO: 2997453 - RNA, 23 nt, Human
caguugaaaagacuccaaagaaa

SEQ ID NO: 2997454 - RNA, 22 nt, Human
cauaagugcuauugcagagccg

SEQ ID NO: 2997455 - RNA, 22 nt, Human
cauaaguccucuagugaaugua

SEQ ID NO: 2997456 - RNA, 18 nt, Human
cauaagugcuauugcaga

SEQ ID NO: 2997457 - RNA, 20 nt, Human
cauaagcuacugccauccug

SEQ ID NO: 2997458 - RNA, 14 nt, Human
cauaagauaaaugu

SEQ ID NO: 2997459 - RNA, 17 nt, Human
cauaagcuacugccauc

SEQ ID NO: 2997460 - RNA, 16 nt, Human
cauaagcuacugccau

SEQ ID NO: 2997461 - RNA, 14 nt, Human
cauaagcuacugcc

SEQ ID NO: 2997462 - RNA, 20 nt, Human
cauaagccaaaacugagcau

SEQ ID NO: 2997463 - RNA, 17 nt, Human
cauaccaacacgagcag

SEQ ID NO: 2997464 - RNA, 18 nt, Human
cauaccacuuuuguucuu

SEQ ID NO: 2997465 - RNA, 15 nt, Human
cauaccacuuuuguu

SEQ ID NO: 2997466 - RNA, 14 nt, Human
cauaccacuuuugu

SEQ ID NO: 2997467 - RNA, 13 nt, Human
cauaccacuuuug

SEQ ID NO: 2997468 - RNA, 11 nt, Human
cauacccaccc

SEQ ID NO: 2997469 - RNA, 12 nt, Human
cauacccacccc

SEQ ID NO: 2997470 - RNA, 19 nt, Human
cauaccacuuuuguucuug

SEQ ID NO: 2997471 - RNA, 21 nt, Human
cauaaacaagaccacguuucu

SEQ ID NO: 2997472 - RNA, 20 nt, Human
cauaaacaagaccacguuuc

SEQ ID NO: 2997473 - RNA, 22 nt, Human
cauaaacaagaccacguuucua

SEQ ID NO: 2997474 - RNA, 21 nt, Human
cauaaaaauuagccaagugug

SEQ ID NO: 2997475 - RNA, 16 nt, Human
cauaaccuagccuuag

SEQ ID NO: 2997476 - RNA, 20 nt, Human
cauaaauuuaguauuuuguu

SEQ ID NO: 2997477 - RNA, 19 nt, Human
cauaaauuuaguauuuugu

SEQ ID NO: 2997478 - RNA, 20 nt, Human
caguguuuuaggagcaugag

SEQ ID NO: 2997479 - RNA, 16 nt, Human
caguguuuuaggagca

SEQ ID NO: 2997480 - RNA, 22 nt, Human
caguguuguggauuuaacagaa

SEQ ID NO: 2997481 - RNA, 20 nt, Human
caguguuguggauuuaacag

SEQ ID NO: 2997482 - RNA, 19 nt, Human
caguguuguggauuuaaca

SEQ ID NO: 2997483 - RNA, 21 nt, Human
caguuaccucugccucagaaa

SEQ ID NO: 2997484 - RNA, 14 nt, Human
caguuacucagaau

SEQ ID NO: 2997485 - RNA, 13 nt, Human
caguuaagagaaa

SEQ ID NO: 2997486 - RNA, 14 nt, Human
caguuaagagaaau

SEQ ID NO: 2997487 - RNA, 14 nt, Human
caguucugaagaag

SEQ ID NO: 2997488 - RNA, 13 nt, Human
caguucugaagaa

SEQ ID NO: 2997489 - RNA, 22 nt, Human
caguucucuccuucuucccccc

SEQ ID NO: 2997490 - RNA, 12 nt, Human
caguucugaaga

SEQ ID NO: 2997491 - RNA, 16 nt, Human
caguucugaagaagau

SEQ ID NO: 2997492 - RNA, 15 nt, Human
caguucugaagaaga

SEQ ID NO: 2997493 - RNA, 22 nt, Human
caguucugaagaagaugguacc

SEQ ID NO: 2997494 - RNA, 22 nt, Human
caguucggugagcuacaaaugc

SEQ ID NO: 2997495 - RNA, 14 nt, Human
caguucucuccuuc

SEQ ID NO: 2997496 - RNA, 15 nt, Human
caguucucuccuucu

SEQ ID NO: 2997497 - RNA, 13 nt, Human
caguucucuccuu

SEQ ID NO: 2997498 - RNA, 12 nt, Human
caguugaaaaac

SEQ ID NO: 2997499 - RNA, 18 nt, Human
caguugaaaaacagcuga

SEQ ID NO: 2997500 - RNA, 19 nt, Human
caguugaaaaacagcugag

SEQ ID NO: 2997501 - RNA, 13 nt, Human
cagugcuuggccc

SEQ ID NO: 2997502 - RNA, 14 nt, Human
cagugcuuggccca

SEQ ID NO: 2997503 - RNA, 15 nt, Human
cagugcuuggcccag

SEQ ID NO: 2997504 - RNA, 16 nt, Human
cagugcuuggcccagg

SEQ ID NO: 2997505 - RNA, 12 nt, Human
cagugcuuggcc

SEQ ID NO: 2997506 - RNA, 17 nt, Human
cagugcuuggcccagga

SEQ ID NO: 2997507 - RNA, 18 nt, Human
cagugcuuggcccaggag

SEQ ID NO: 2997508 - RNA, 19 nt, Human
cagugcuuggcccaggagu

SEQ ID NO: 2997509 - RNA, 20 nt, Human
cagugcuuggcccaggaguu

SEQ ID NO: 2997510 - RNA, 16 nt, Human
caguggcagcugcuuu

SEQ ID NO: 2997511 - RNA, 15 nt, Human
caguggcagcugcuu

SEQ ID NO: 2997512 - RNA, 14 nt, Human
caguggcagcugcu

SEQ ID NO: 2997513 - RNA, 13 nt, Human
caguggcagcugc

SEQ ID NO: 2997514 - RNA, 12 nt, Human
caguggcagcug

SEQ ID NO: 2997515 - RNA, 22 nt, Human
cagugguuccuaauccucuagg

SEQ ID NO: 2997516 - RNA, 17 nt, Human
caguguguggucaacau

SEQ ID NO: 2997517 - RNA, 21 nt, Human
caguguguggucaacauuucu

SEQ ID NO: 2997518 - RNA, 12 nt, Human
cagugugacuga

SEQ ID NO: 2997519 - RNA, 14 nt, Human
cagugugacaagga

SEQ ID NO: 2997520 - RNA, 14 nt, Human
cagugucaaugcag

SEQ ID NO: 2997521 - RNA, 23 nt, Human
caguguacauggaauaacaugua

SEQ ID NO: 2997522 - RNA, 20 nt, Human
caguguacauggaauaacau

SEQ ID NO: 2997523 - RNA, 16 nt, Human
caguguacauggaaua

SEQ ID NO: 2997524 - RNA, 16 nt, Human
caccaugggauuaaua

SEQ ID NO: 2997525 - RNA, 16 nt, Human
caccaucaagccacca

SEQ ID NO: 2997526 - RNA, 17 nt, Human
caccaucaagccaccaa

SEQ ID NO: 2997527 - RNA, 19 nt, Human
caccaucaagccaccaaca

SEQ ID NO: 2997528 - RNA, 24 nt, Human
caccaucaagccaccaacauacuc

SEQ ID NO: 2997529 - RNA, 17 nt, Human
caccaucaugucuggcu

SEQ ID NO: 2997530 - RNA, 15 nt, Human
caccaucaugucugg

SEQ ID NO: 2997531 - RNA, 18 nt, Human
caccaucaugucuggcua

SEQ ID NO: 2997532 - RNA, 11 nt, Human
caccagugccu

SEQ ID NO: 2997533 - RNA, 17 nt, Human
caccagugccucucccu

SEQ ID NO: 2997534 - RNA, 14 nt, Human
caccagugccucuc

SEQ ID NO: 2997535 - RNA, 13 nt, Human
caccagugccucu

SEQ ID NO: 2997536 - RNA, 12 nt, Human
caccagugccuc

SEQ ID NO: 2997537 - RNA, 19 nt, Human
caccauaagcuacugccau

SEQ ID NO: 2997538 - RNA, 18 nt, Human
caccauaagcuacugcca

SEQ ID NO: 2997539 - RNA, 16 nt, Human
caccauaagcuacugc

SEQ ID NO: 2997540 - RNA, 21 nt, Human
caccauauuaccacagacaua

SEQ ID NO: 2997541 - RNA, 21 nt, Human
caccauaagcuacugccaucc

SEQ ID NO: 2997542 - RNA, 20 nt, Human
caccauaagcuacugccauc

SEQ ID NO: 2997543 - RNA, 14 nt, Human
caccaucaagccac

SEQ ID NO: 2997544 - RNA, 15 nt, Human
caccaucaagccacc

SEQ ID NO: 2997545 - RNA, 13 nt, Human
caccaucaagcca

SEQ ID NO: 2997546 - RNA, 18 nt, Human
cacauguccaagaagccc

SEQ ID NO: 2997547 - RNA, 19 nt, Human
cacauguccaagaagccca

SEQ ID NO: 2997548 - RNA, 21 nt, Human
cacauguccaagaagcccagg

SEQ ID NO: 2997549 - RNA, 22 nt, Human
cacauguccaagaagcccagga

SEQ ID NO: 2997550 - RNA, 17 nt, Human
caccaacgucugugcca

SEQ ID NO: 2997551 - RNA, 13 nt, Human
caccaagcccagu

SEQ ID NO: 2997552 - RNA, 12 nt, Human
caccaagcccag

SEQ ID NO: 2997553 - RNA, 15 nt, Human
caccagagcccaccu

SEQ ID NO: 2997554 - RNA, 22 nt, Human
caccagagcccaccuuggcuca

SEQ ID NO: 2997555 - RNA, 20 nt, Human
caccagagcccaccuuggcu

SEQ ID NO: 2997556 - RNA, 18 nt, Human
caccagagcccaccuugg

SEQ ID NO: 2997557 - RNA, 17 nt, Human
caccagagcccaccuug

SEQ ID NO: 2997558 - RNA, 19 nt, Human
caccacacccagcccacuu

SEQ ID NO: 2997559 - RNA, 20 nt, Human
cacaguuuucugagaaagac

SEQ ID NO: 2997560 - RNA, 16 nt, Human
cacaugaaguccaagc

SEQ ID NO: 2997561 - RNA, 20 nt, Human
cacaugaaguccaagcauuu

SEQ ID NO: 2997562 - RNA, 17 nt, Human
cacaugaaguccaagca

SEQ ID NO: 2997563 - RNA, 21 nt, Human
cacaguuuucugagaaagacu

SEQ ID NO: 2997564 - RNA, 22 nt, Human
cacaguuuucugagaaagacua

SEQ ID NO: 2997565 - RNA, 18 nt, Human
cacaugagcaucaggcca

SEQ ID NO: 2997566 - RNA, 19 nt, Human
cacaugagcaucaggccag

SEQ ID NO: 2997567 - RNA, 20 nt, Human
cacaugagcaucaggccagg

SEQ ID NO: 2997568 - RNA, 21 nt, Human
cacaugagcaucaggccaggc

SEQ ID NO: 2997569 - RNA, 13 nt, Human
cacaugagcauca

SEQ ID NO: 2997570 - RNA, 17 nt, Human
cacaugagcaucaggcc

SEQ ID NO: 2997571 - RNA, 19 nt, Human
cacaugcaaggucauuuuu

SEQ ID NO: 2997572 - RNA, 17 nt, Human
cacaugcaaggucauuu

SEQ ID NO: 2997573 - RNA, 20 nt, Human
cacaugcaaggucauuuuuu

SEQ ID NO: 2997574 - RNA, 18 nt, Human
cacaugcacgugugugca

SEQ ID NO: 2997575 - RNA, 16 nt, Human
cacauguccaagaagc

SEQ ID NO: 2997576 - RNA, 17 nt, Human
cacauguccaagaagcc

SEQ ID NO: 2997577 - RNA, 20 nt, Human
cacaugccucucucaggcca

SEQ ID NO: 2997578 - RNA, 21 nt, Human
cacaugccucucucaggccaa

SEQ ID NO: 2997579 - RNA, 19 nt, Human
cacaggcagguccaggguu

SEQ ID NO: 2997580 - RNA, 23 nt, Human
cacaguccuuaccagcagagcac

SEQ ID NO: 2997581 - RNA, 14 nt, Human
cacaggcccggcuc

SEQ ID NO: 2997582 - RNA, 20 nt, Human
cacagcucuucuccaggcug

SEQ ID NO: 2997583 - RNA, 19 nt, Human
cacagcucuucuccaggcu

SEQ ID NO: 2997584 - RNA, 17 nt, Human
cacaggaucagucugau

SEQ ID NO: 2997585 - RNA, 18 nt, Human
cacagcucuucuccaggc

SEQ ID NO: 2997586 - RNA, 22 nt, Human
cacacggacacucaaaagcugg

SEQ ID NO: 2997587 - RNA, 13 nt, Human
cacccaagggccu

SEQ ID NO: 2997588 - RNA, 12 nt, Human
caauauccuaau

SEQ ID NO: 2997589 - RNA, 13 nt, Human
caauauccuaaua

SEQ ID NO: 2997590 - RNA, 14 nt, Human
caauauccuaauaa

SEQ ID NO: 2997591 - RNA, 15 nt, Human
caauauccuaauaaa

SEQ ID NO: 2997592 - RNA, 16 nt, Human
caauauccuaauaaaa

SEQ ID NO: 2997593 - RNA, 18 nt, Human
caauauccuaauaaaaag

SEQ ID NO: 2997594 - RNA, 19 nt, Human
caauauccuaauaaaaagg

SEQ ID NO: 2997595 - RNA, 20 nt, Human
caauauccuaauaaaaaggu

SEQ ID NO: 2997596 - RNA, 15 nt, Human
caaugaccuuucaau

SEQ ID NO: 2997597 - RNA, 16 nt, Human
caaugaccuuucaaua

SEQ ID NO: 2997598 - RNA, 13 nt, Human
caaugauggucac

SEQ ID NO: 2997599 - RNA, 14 nt, Human
caaugaccuuucaa

SEQ ID NO: 2997600 - RNA, 13 nt, Human
caaugaccuuuca

SEQ ID NO: 2997601 - RNA, 21 nt, Human
caaugcaaaccaucauugaaa

SEQ ID NO: 2997602 - RNA, 22 nt, Human
caaugcaaaccaucauugaaau

SEQ ID NO: 2997603 - RNA, 14 nt, Human
caaugauggucacc

SEQ ID NO: 2997604 - RNA, 14 nt, Human
caaugcaaaccauc

SEQ ID NO: 2997605 - RNA, 13 nt, Human
caaugcacuuugu

SEQ ID NO: 2997606 - RNA, 14 nt, Human
caaugcacugacau

SEQ ID NO: 2997607 - RNA, 23 nt, Human
caaugcaaaccaucauugaaauc

SEQ ID NO: 2997608 - RNA, 20 nt, Human
caaugcaaaccaucauugaa

SEQ ID NO: 2997609 - RNA, 13 nt, Human
cacacccagccca

SEQ ID NO: 2997610 - RNA, 22 nt, Human
cacaccagagcccaccuuggcu

SEQ ID NO: 2997611 - RNA, 21 nt, Human
cacaccagagcccaccuuggc

SEQ ID NO: 2997612 - RNA, 15 nt, Human
cacacagcucugucc

SEQ ID NO: 2997613 - RNA, 14 nt, Human
cacacagcucuguc

SEQ ID NO: 2997614 - RNA, 13 nt, Human
cacacagcucugu

SEQ ID NO: 2997615 - RNA, 20 nt, Human
cacacccagcccacuucugc

SEQ ID NO: 2997616 - RNA, 14 nt, Human
cacacccagcccac

SEQ ID NO: 2997617 - RNA, 17 nt, Human
cacaccgggcacucaga

SEQ ID NO: 2997618 - RNA, 21 nt, Human
cacacagaggcugccucuccc

SEQ ID NO: 2997619 - RNA, 14 nt, Human
cacacacuuuggcu

SEQ ID NO: 2997620 - RNA, 20 nt, Human
cacacaccagagcccaccuu

SEQ ID NO: 2997621 - RNA, 16 nt, Human
cacacaccagagccca

SEQ ID NO: 2997622 - RNA, 15 nt, Human
cacacaccagagccc

SEQ ID NO: 2997623 - RNA, 18 nt, Human
caaugguuuucuugugug

SEQ ID NO: 2997624 - RNA, 14 nt, Human
caaugcacuuuguu

SEQ ID NO: 2997625 - RNA, 14 nt, Human
caauuaugaaaaua

SEQ ID NO: 2997626 - RNA, 11 nt, Human
caauuaugaaa

SEQ ID NO: 2997627 - RNA, 15 nt, Human
cacaaacagaggccg

SEQ ID NO: 2997628 - RNA, 17 nt, Human
cacaaacgggcucagca

SEQ ID NO: 2997629 - RNA, 15 nt, Human
caauuaugaaaauaa

SEQ ID NO: 2997630 - RNA, 13 nt, Human
cacaagaaaugaa

SEQ ID NO: 2997631 - RNA, 15 nt, Human
cacaagaaaugaaag

SEQ ID NO: 2997632 - RNA, 17 nt, Human
cacaaagguagcuuuuc

SEQ ID NO: 2997633 - RNA, 18 nt, Human
cacaaaguaauuuggaaa

SEQ ID NO: 2997634 - RNA, 23 nt, Human
cacaagaaaugaaagcagggacu

SEQ ID NO: 2997635 - RNA, 23 nt, Human
cacaagacccaaaaggcagaagc

SEQ ID NO: 2997636 - RNA, 23 nt, Human
caacugggguggguggggcagug

SEQ ID NO: 2997637 - RNA, 20 nt, Human
caacugcaucaagaugugac

SEQ ID NO: 2997638 - RNA, 23 nt, Human
caacugcaucaagaugugacaug

SEQ ID NO: 2997639 - RNA, 17 nt, Human
caacugcaucaagaugu

SEQ ID NO: 2997640 - RNA, 19 nt, Human
caaccugauugugucucuu

SEQ ID NO: 2997641 - RNA, 21 nt, Human
caaccugauugugucucuugg

SEQ ID NO: 2997642 - RNA, 17 nt, Human
caaccugauugugucuc

SEQ ID NO: 2997643 - RNA, 17 nt, Human
caacauaacucaagucu

SEQ ID NO: 2997644 - RNA, 14 nt, Human
caacauacucccau

SEQ ID NO: 2997645 - RNA, 15 nt, Human
caacauacucccauc

SEQ ID NO: 2997646 - RNA, 16 nt, Human
caacauacucccaucu

SEQ ID NO: 2997647 - RNA, 17 nt, Human
caaauuuacagagacag

SEQ ID NO: 2997648 - RNA, 16 nt, Human
caaauuuacagagaca

SEQ ID NO: 2997649 - RNA, 23 nt, Human
caaauuuacagagacagaaagca

SEQ ID NO: 2997650 - RNA, 14 nt, Human
caacaggcugggcu

SEQ ID NO: 2997651 - RNA, 17 nt, Human
caacaggcugggcuuca

SEQ ID NO: 2997652 - RNA, 13 nt, Human
caacaggcugggc

SEQ ID NO: 2997653 - RNA, 16 nt, Human
caacagugagagacuc

SEQ ID NO: 2997654 - RNA, 13 nt, Human
caagaccuucucc

SEQ ID NO: 2997655 - RNA, 19 nt, Human
caagacgcugugcugcccu

SEQ ID NO: 2997656 - RNA, 20 nt, Human
caagacgcugugcugcccug

SEQ ID NO: 2997657 - RNA, 21 nt, Human
caagacgcugugcugcccugc

SEQ ID NO: 2997658 - RNA, 22 nt, Human
caagacgcugugcugcccugcc

SEQ ID NO: 2997659 - RNA, 19 nt, Human
caagacugcacaucaaaau

SEQ ID NO: 2997660 - RNA, 13 nt, Human
caagaaaugaaag

SEQ ID NO: 2997661 - RNA, 23 nt, Human
caagacccuuguggucccacccc

SEQ ID NO: 2997662 - RNA, 17 nt, Human
caagagggucugaggaa

SEQ ID NO: 2997663 - RNA, 16 nt, Human
caagagggucugagga

SEQ ID NO: 2997664 - RNA, 12 nt, Human
caagagggucug

SEQ ID NO: 2997665 - RNA, 17 nt, Human
caagagcccaggccucc

SEQ ID NO: 2997666 - RNA, 16 nt, Human
caagcauaccaacacg

SEQ ID NO: 2997667 - RNA, 21 nt, Human
caagcauaccaacacgagcag

SEQ ID NO: 2997668 - RNA, 21 nt, Human
caagcauguauuuuugucaau

SEQ ID NO: 2997669 - RNA, 15 nt, Human
caagcauguauuuuu

SEQ ID NO: 2997670 - RNA, 19 nt, Human
caagcauuuagauguauag

SEQ ID NO: 2997671 - RNA, 16 nt, Human
caagcauuuagaugua

SEQ ID NO: 2997672 - RNA, 14 nt, Human
caaggauccugagc

SEQ ID NO: 2997673 - RNA, 15 nt, Human
caaggauccugagcc

SEQ ID NO: 2997674 - RNA, 16 nt, Human
caaggauccugagcca

SEQ ID NO: 2997675 - RNA, 17 nt, Human
caaggauccugagccag

SEQ ID NO: 2997676 - RNA, 18 nt, Human
caaggcugggggaagaag

SEQ ID NO: 2997677 - RNA, 21 nt, Human
caaggcugggggaagaagcuc

SEQ ID NO: 2997678 - RNA, 13 nt, Human
caaggcugucaau

SEQ ID NO: 2997679 - RNA, 14 nt, Human
caaggcugucaauu

SEQ ID NO: 2997680 - RNA, 23 nt, Human
caaggggaauguuugccucugcc

SEQ ID NO: 2997681 - RNA, 13 nt, Human
caagggccuggcc

SEQ ID NO: 2997682 - RNA, 14 nt, Human
caagggccuggccu

SEQ ID NO: 2997683 - RNA, 15 nt, Human
caagggccuggccug

SEQ ID NO: 2997684 - RNA, 21 nt, Human
caaggggaauguuugccucug

SEQ ID NO: 2997685 - RNA, 20 nt, Human
caagugauucuccugccuca

SEQ ID NO: 2997686 - RNA, 15 nt, Human
caagugagacccugu

SEQ ID NO: 2997687 - RNA, 19 nt, Human
caagugagacccugucuca

SEQ ID NO: 2997688 - RNA, 18 nt, Human
caagugauucuccugccu

SEQ ID NO: 2997689 - RNA, 19 nt, Human
caagugauucuccugccuc

SEQ ID NO: 2997690 - RNA, 22 nt, Human
caagugaaaaaggaggaagaga

SEQ ID NO: 2997691 - RNA, 17 nt, Human
caagguuuaaguuauua

SEQ ID NO: 2997692 - RNA, 15 nt, Human
caagguuuaaguuau

SEQ ID NO: 2997693 - RNA, 23 nt, Human
caagugaaaaaggaggaagagaa

SEQ ID NO: 2997694 - RNA, 14 nt, Human
caagugagacccug

SEQ ID NO: 2997695 - RNA, 20 nt, Human
caacaggcugggcuucagug

SEQ ID NO: 2997696 - RNA, 14 nt, Human
caaaggagauugga

SEQ ID NO: 2997697 - RNA, 20 nt, Human
caaaggagauuggaaggaac

SEQ ID NO: 2997698 - RNA, 16 nt, Human
caaaguggugagaggc

SEQ ID NO: 2997699 - RNA, 17 nt, Human
caaaguggugagaggca

SEQ ID NO: 2997700 - RNA, 23 nt, Human
caaaggguaucaggugcugccau

SEQ ID NO: 2997701 - RNA, 21 nt, Human
caaaggguaucaggugcugcc

SEQ ID NO: 2997702 - RNA, 20 nt, Human
caaaggguaucaggugcugc

SEQ ID NO: 2997703 - RNA, 18 nt, Human
caaauguuuauuuaaaag

SEQ ID NO: 2997704 - RNA, 17 nt, Human
caaauguuuauuuaaaa

SEQ ID NO: 2997705 - RNA, 16 nt, Human
caaauguuuauuuaaa

SEQ ID NO: 2997706 - RNA, 16 nt, Human
auuuuaauaauguuuc

SEQ ID NO: 2997707 - RNA, 19 nt, Human
auuuuaauaauguuucaaa

SEQ ID NO: 2997708 - RNA, 18 nt, Human
auuuuaauaauguuucaa

SEQ ID NO: 2997709 - RNA, 14 nt, Human
caaagagguuuuaa

SEQ ID NO: 2997710 - RNA, 21 nt, Human
caaagagguuuuaaaaaaauc

SEQ ID NO: 2997711 - RNA, 14 nt, Human
caaagaaauguaag

SEQ ID NO: 2997712 - RNA, 19 nt, Human
agcaucgcuuaggagaagu

SEQ ID NO: 2997713 - RNA, 16 nt, Human
agcaucuaugugagac

SEQ ID NO: 2997714 - RNA, 22 nt, Human
agccagcaggcucucaggccag

SEQ ID NO: 2997715 - RNA, 21 nt, Human
agccagcaggcucucaggcca

SEQ ID NO: 2997716 - RNA, 23 nt, Human
agccagcaggcucucaggccagc

SEQ ID NO: 2997717 - RNA, 14 nt, Human
agccagcaguucag

SEQ ID NO: 2997718 - RNA, 19 nt, Human
agccauuugucccaagugc

SEQ ID NO: 2997719 - RNA, 17 nt, Human
agcccacgcccccacug

SEQ ID NO: 2997720 - RNA, 18 nt, Human
agcccacgcccccacugg

SEQ ID NO: 2997721 - RNA, 15 nt, Human
agcccacgcccccac

SEQ ID NO: 2997722 - RNA, 19 nt, Human
agcccacgcccccacuggu

SEQ ID NO: 2997723 - RNA, 23 nt, Human
agcccaccccucaacaccucugc

SEQ ID NO: 2997724 - RNA, 13 nt, Human
agcccaccuuggc

SEQ ID NO: 2997725 - RNA, 14 nt, Human
agccagauuucacu

SEQ ID NO: 2997726 - RNA, 17 nt, Human
agccagauuucacucuc

SEQ ID NO: 2997727 - RNA, 20 nt, Human
agccagauuucacucuccuu

SEQ ID NO: 2997728 - RNA, 22 nt, Human
agccagauuucacucuccuugg

SEQ ID NO: 2997729 - RNA, 16 nt, Human
agcagccuggacccug

SEQ ID NO: 2997730 - RNA, 19 nt, Human
agcacugacuucuaaguaa

SEQ ID NO: 2997731 - RNA, 17 nt, Human
agcacugacuucuaagu

SEQ ID NO: 2997732 - RNA, 13 nt, Human
agcagugcaugcu

SEQ ID NO: 2997733 - RNA, 16 nt, Human
agcagugcaugcuguc

SEQ ID NO: 2997734 - RNA, 19 nt, Human
agcagcguuucuaugacac

SEQ ID NO: 2997735 - RNA, 18 nt, Human
agcagcguuucuaugaca

SEQ ID NO: 2997736 - RNA, 20 nt, Human
agcagccuggacccugugga

SEQ ID NO: 2997737 - RNA, 17 nt, Human
agcagugcaugcugucc

SEQ ID NO: 2997738 - RNA, 21 nt, Human
agcacagacccugcccugugg

SEQ ID NO: 2997739 - RNA, 20 nt, Human
agcacuaaggugugcucuga

SEQ ID NO: 2997740 - RNA, 18 nt, Human
agauucuauguuaauauu

SEQ ID NO: 2997741 - RNA, 14 nt, Human
agauucuuuccuga

SEQ ID NO: 2997742 - RNA, 20 nt, Human
agaugggugcuuggaggaag

SEQ ID NO: 2997743 - RNA, 22 nt, Human
agaugggugcuuggaggaagga

SEQ ID NO: 2997744 - RNA, 11 nt, Human
agaugaauguc

SEQ ID NO: 2997745 - RNA, 18 nt, Human
agaugacaucugucuagg

SEQ ID NO: 2997746 - RNA, 15 nt, Human
agaugaaugucaguu

SEQ ID NO: 2997747 - RNA, 18 nt, Human
agaugacauugacuauuu

SEQ ID NO: 2997748 - RNA, 23 nt, Human
agaugacauugacuauuuuuguu

SEQ ID NO: 2997749 - RNA, 13 nt, Human
agcaaaucaguuu

SEQ ID NO: 2997750 - RNA, 19 nt, Human
agcaaauucuguuuuucua

SEQ ID NO: 2997751 - RNA, 20 nt, Human
agcaaaguagaucaugcaua

SEQ ID NO: 2997752 - RNA, 16 nt, Human
agauugcaacaggcug

SEQ ID NO: 2997753 - RNA, 15 nt, Human
agauucuuuccugag

SEQ ID NO: 2997754 - RNA, 16 nt, Human
agauucuuuccugagg

SEQ ID NO: 2997755 - RNA, 16 nt, Human
agauugcaccacugca

SEQ ID NO: 2997756 - RNA, 17 nt, Human
agauugcaacaggcugg

SEQ ID NO: 2997757 - RNA, 16 nt, Human
agauugcucaaaucag

SEQ ID NO: 2997758 - RNA, 14 nt, Human
agauugcucaaauc

SEQ ID NO: 2997759 - RNA, 14 nt, Human
agauaugauucaaa

SEQ ID NO: 2997760 - RNA, 15 nt, Human
agauaugauucaaau

SEQ ID NO: 2997761 - RNA, 20 nt, Human
agauagauaggucagugcaa

SEQ ID NO: 2997762 - RNA, 20 nt, Human
agauagccaaggccaaagga

SEQ ID NO: 2997763 - RNA, 13 nt, Human
agaguugaagaca

SEQ ID NO: 2997764 - RNA, 14 nt, Human
agaguugaagacag

SEQ ID NO: 2997765 - RNA, 15 nt, Human
agaguugaagacaga

SEQ ID NO: 2997766 - RNA, 23 nt, Human
agaggggguggccucccaacuca

SEQ ID NO: 2997767 - RNA, 20 nt, Human
agagggucugaggaauccag

SEQ ID NO: 2997768 - RNA, 23 nt, Human
agaaugcaguacuaacauuuauu

SEQ ID NO: 2997769 - RNA, 18 nt, Human
agaaugcucuuuacuuca

SEQ ID NO: 2997770 - RNA, 23 nt, Human
agaaugcacaaacagaggccgcc

SEQ ID NO: 2997771 - RNA, 17 nt, Human
agaaucucaaauaacua

SEQ ID NO: 2997772 - RNA, 16 nt, Human
agaagucaaggcuuag

SEQ ID NO: 2997773 - RNA, 17 nt, Human
agaagucaaggcuuaga

SEQ ID NO: 2997774 - RNA, 18 nt, Human
agaagucaaggcuuagac

SEQ ID NO: 2997775 - RNA, 19 nt, Human
agaagucaaggcuuagacc

SEQ ID NO: 2997776 - RNA, 14 nt, Human
agaagucacacagu

SEQ ID NO: 2997777 - RNA, 18 nt, Human
agaagucuucuauuuauu

SEQ ID NO: 2997778 - RNA, 19 nt, Human
agaagucuuagauguauau

SEQ ID NO: 2997779 - RNA, 17 nt, Human
agaagucuuagauguau

SEQ ID NO: 2997780 - RNA, 21 nt, Human
agaagacugcauuauauuuau

SEQ ID NO: 2997781 - RNA, 18 nt, Human
agaagacugcauuauauu

SEQ ID NO: 2997782 - RNA, 21 nt, Human
agaaccaaaaagaggcuaugu

SEQ ID NO: 2997783 - RNA, 20 nt, Human
agaagagcuguucacagcca

SEQ ID NO: 2997784 - RNA, 13 nt, Human
agaagauagcagg

SEQ ID NO: 2997785 - RNA, 15 nt, Human
agaagagaaugcaca

SEQ ID NO: 2997786 - RNA, 23 nt, Human
agaagagaaugcacaaacagagg

SEQ ID NO: 2997787 - RNA, 13 nt, Human
agaagagcuguuc

SEQ ID NO: 2997788 - RNA, 22 nt, Human
agaacagugauuaccagggacu

SEQ ID NO: 2997789 - RNA, 17 nt, Human
agaaccaaaaagaggcu

SEQ ID NO: 2997790 - RNA, 18 nt, Human
agaaccaaaaagaggcua

SEQ ID NO: 2997791 - RNA, 19 nt, Human
agacaaggaaaaaauaaca

SEQ ID NO: 2997792 - RNA, 23 nt, Human
agacaaugacuuacuguacauga

SEQ ID NO: 2997793 - RNA, 20 nt, Human
agacaaugugaaaagaaaaa

SEQ ID NO: 2997794 - RNA, 20 nt, Human
agacgcugugcugcccugcc

SEQ ID NO: 2997795 - RNA, 18 nt, Human
agacgcugugcugcccug

SEQ ID NO: 2997796 - RNA, 19 nt, Human
agacgcugugcugcccugc

SEQ ID NO: 2997797 - RNA, 17 nt, Human
agacgcugugcugcccu

SEQ ID NO: 2997798 - RNA, 18 nt, Human
agaccauuggggcuccca

SEQ ID NO: 2997799 - RNA, 15 nt, Human
agaccauccuggcua

SEQ ID NO: 2997800 - RNA, 14 nt, Human
agaccacguuucua

SEQ ID NO: 2997801 - RNA, 23 nt, Human
agaccaucccugaaggccccgcc

SEQ ID NO: 2997802 - RNA, 23 nt, Human
agaccauuggggcucccagccag

SEQ ID NO: 2997803 - RNA, 22 nt, Human
agaccauuggggcucccagcca

SEQ ID NO: 2997804 - RNA, 20 nt, Human
agaccauuggggcucccagc

SEQ ID NO: 2997805 - RNA, 19 nt, Human
agaccauuggggcucccag

SEQ ID NO: 2997806 - RNA, 21 nt, Human
agacagcccgggcucugccuc

SEQ ID NO: 2997807 - RNA, 14 nt, Human
agacaauuuauuau

SEQ ID NO: 2997808 - RNA, 22 nt, Human
agacagcccgggcucugccucc

SEQ ID NO: 2997809 - RNA, 23 nt, Human
agacagcccgggcucugccuccc

SEQ ID NO: 2997810 - RNA, 16 nt, Human
agacucuuuggacacu

SEQ ID NO: 2997811 - RNA, 11 nt, Human
agagagcaaga

SEQ ID NO: 2997812 - RNA, 19 nt, Human
agagagcaagacgcugugc

SEQ ID NO: 2997813 - RNA, 23 nt, Human
agagagcaagacgcugugcugcc

SEQ ID NO: 2997814 - RNA, 18 nt, Human
agagcccacgcccccacu

SEQ ID NO: 2997815 - RNA, 17 nt, Human
agagcccacgcccccac

SEQ ID NO: 2997816 - RNA, 18 nt, Human
agagaaaguacuucucca

SEQ ID NO: 2997817 - RNA, 22 nt, Human
aggcuuagacccucaugcugcc

SEQ ID NO: 2997818 - RNA, 14 nt, Human
aggcuuagacccuc

SEQ ID NO: 2997819 - RNA, 21 nt, Human
aggcuuagacccucaugcugc

SEQ ID NO: 2997820 - RNA, 12 nt, Human
aggcuuagaccc

SEQ ID NO: 2997821 - RNA, 17 nt, Human
agggacaggauaagagg

SEQ ID NO: 2997822 - RNA, 24 nt, Human
aggcuguaucccaugagccucagc

SEQ ID NO: 2997823 - RNA, 11 nt, Human
aggcugccagu

SEQ ID NO: 2997824 - RNA, 12 nt, Human
aggcugucaauu

SEQ ID NO: 2997825 - RNA, 17 nt, Human
aggcugcagugagccga

SEQ ID NO: 2997826 - RNA, 19 nt, Human
aggcugcagugagccgaga

SEQ ID NO: 2997827 - RNA, 23 nt, Human
aggcuguaucccaugagccucag

SEQ ID NO: 2997828 - RNA, 17 nt, Human
aggcuagauguauguac

SEQ ID NO: 2997829 - RNA, 19 nt, Human
aggcccucugcccacuccc

SEQ ID NO: 2997830 - RNA, 20 nt, Human
aggcccucugcccacucccu

SEQ ID NO: 2997831 - RNA, 20 nt, Human
agggauuagggagagaagau

SEQ ID NO: 2997832 - RNA, 18 nt, Human
agggccuggcucaggugg

SEQ ID NO: 2997833 - RNA, 13 nt, Human
agggccuggcuca

SEQ ID NO: 2997834 - RNA, 14 nt, Human
agggccuggcucag

SEQ ID NO: 2997835 - RNA, 18 nt, Human
agggccuggccugagcug

SEQ ID NO: 2997836 - RNA, 14 nt, Human
aggagugagcacua

SEQ ID NO: 2997837 - RNA, 12 nt, Human
aggagugagcac

SEQ ID NO: 2997838 - RNA, 15 nt, Human
aggaggucucuaaga

SEQ ID NO: 2997839 - RNA, 22 nt, Human
aggagguaaugaccaugaaaga

SEQ ID NO: 2997840 - RNA, 14 nt, Human
aggaggucucuaag

SEQ ID NO: 2997841 - RNA, 19 nt, Human
aggaaguacuggagaaaau

SEQ ID NO: 2997842 - RNA, 20 nt, Human
aggcagagguugcagugagc

SEQ ID NO: 2997843 - RNA, 13 nt, Human
aggcagauacagg

SEQ ID NO: 2997844 - RNA, 15 nt, Human
aggcagccaggccac

SEQ ID NO: 2997845 - RNA, 16 nt, Human
aggcagccaggccaca

SEQ ID NO: 2997846 - RNA, 14 nt, Human
aggcagccaggcca

SEQ ID NO: 2997847 - RNA, 15 nt, Human
aggcacuuuaaaaca

SEQ ID NO: 2997848 - RNA, 13 nt, Human
aggccagcugcuu

SEQ ID NO: 2997849 - RNA, 14 nt, Human
aggccagcugcuug

SEQ ID NO: 2997850 - RNA, 16 nt, Human
aggccagcugcuuggg

SEQ ID NO: 2997851 - RNA, 16 nt, Human
aggccaggcccucugc

SEQ ID NO: 2997852 - RNA, 17 nt, Human
aggccaggcccucugcc

SEQ ID NO: 2997853 - RNA, 18 nt, Human
aggccaggcccucugccc

SEQ ID NO: 2997854 - RNA, 19 nt, Human
aggccaggcccucugccca

SEQ ID NO: 2997855 - RNA, 23 nt, Human
aggccaggcccucugcccacucc

SEQ ID NO: 2997856 - RNA, 23 nt, Human
aggccaugggcacuguggguaga

SEQ ID NO: 2997857 - RNA, 20 nt, Human
aggccaggcgcgguggcuca

SEQ ID NO: 2997858 - RNA, 17 nt, Human
aggcccucugcccacuc

SEQ ID NO: 2997859 - RNA, 15 nt, Human
aggcccucugcccac

SEQ ID NO: 2997860 - RNA, 16 nt, Human
aggccaugggccuccu

SEQ ID NO: 2997861 - RNA, 14 nt, Human
aggccaugggccuc

SEQ ID NO: 2997862 - RNA, 23 nt, Human
aggcaugugaugagaggaaauca

SEQ ID NO: 2997863 - RNA, 24 nt, Human
aggcaugugaugagaggaaaucac

SEQ ID NO: 2997864 - RNA, 22 nt, Human
aggcauguucucugaggacacu

SEQ ID NO: 2997865 - RNA, 20 nt, Human
aggcauguucucugaggaca

SEQ ID NO: 2997866 - RNA, 21 nt, Human
aggcauuccccaggaggccag

SEQ ID NO: 2997867 - RNA, 22 nt, Human
aggcauuccccaggaggccagc

SEQ ID NO: 2997868 - RNA, 23 nt, Human
aggcauuccccaggaggccagcc

SEQ ID NO: 2997869 - RNA, 12 nt, Human
aggccagcugcu

SEQ ID NO: 2997870 - RNA, 13 nt, Human
agcuacaaaugca

SEQ ID NO: 2997871 - RNA, 21 nt, Human
agcucaccagccccagugccc

SEQ ID NO: 2997872 - RNA, 14 nt, Human
agcucaccagcccc

SEQ ID NO: 2997873 - RNA, 13 nt, Human
agcucaccagccc

SEQ ID NO: 2997874 - RNA, 12 nt, Human
agcuacaaaugc

SEQ ID NO: 2997875 - RNA, 15 nt, Human
agcuaaugggacacu

SEQ ID NO: 2997876 - RNA, 14 nt, Human
agcuaaugggacac

SEQ ID NO: 2997877 - RNA, 13 nt, Human
agcuaaugggaca

SEQ ID NO: 2997878 - RNA, 15 nt, Human
agcgacagugagacu

SEQ ID NO: 2997879 - RNA, 13 nt, Human
agcgacagugaga

SEQ ID NO: 2997880 - RNA, 15 nt, Human
agcgauucuucugcu

SEQ ID NO: 2997881 - RNA, 19 nt, Human
agcgauucuucugcuucag

SEQ ID NO: 2997882 - RNA, 17 nt, Human
agcgauucuucugcuuc

SEQ ID NO: 2997883 - RNA, 19 nt, Human
agcuaacauggaaguacua

SEQ ID NO: 2997884 - RNA, 16 nt, Human
agcuaaagaaguuuga

SEQ ID NO: 2997885 - RNA, 20 nt, Human
agcuaacauggaaguacuau

SEQ ID NO: 2997886 - RNA, 18 nt, Human
agccugggcaaugugaua

SEQ ID NO: 2997887 - RNA, 21 nt, Human
agccugggcaacagagcaaga

SEQ ID NO: 2997888 - RNA, 20 nt, Human
agccugggaggucaaggcug

SEQ ID NO: 2997889 - RNA, 14 nt, Human
agccuggacccugu

SEQ ID NO: 2997890 - RNA, 16 nt, Human
agccuggaugccaucc

SEQ ID NO: 2997891 - RNA, 15 nt, Human
agccuggaugccauc

SEQ ID NO: 2997892 - RNA, 13 nt, Human
agccuggaugcca

SEQ ID NO: 2997893 - RNA, 11 nt, Human
agccuggaugc

SEQ ID NO: 2997894 - RNA, 10 nt, Human
agccuggaug

SEQ ID NO: 2997895 - RNA, 14 nt, Human
agcugcugaaacaa

SEQ ID NO: 2997896 - RNA, 15 nt, Human
agcugcugaaacaac

SEQ ID NO: 2997897 - RNA, 16 nt, Human
agcugcugaaacaaca

SEQ ID NO: 2997898 - RNA, 20 nt, Human
agcugcugaaacaacaaaua

SEQ ID NO: 2997899 - RNA, 22 nt, Human
agcugccuguucagcuccagcu

SEQ ID NO: 2997900 - RNA, 14 nt, Human
agcuguaugauucc

SEQ ID NO: 2997901 - RNA, 15 nt, Human
agcuggucccacuca

SEQ ID NO: 2997902 - RNA, 15 nt, Human
agcugacuuuucugu

SEQ ID NO: 2997903 - RNA, 21 nt, Human
agcugacuuuucuguccgagc

SEQ ID NO: 2997904 - RNA, 23 nt, Human
agcucaccagccccagugcccac

SEQ ID NO: 2997905 - RNA, 22 nt, Human
agcucaccagccccagugccca

SEQ ID NO: 2997906 - RNA, 18 nt, Human
agcuguaugauucccagc

SEQ ID NO: 2997907 - RNA, 17 nt, Human
agcuguaugauucccag

SEQ ID NO: 2997908 - RNA, 18 nt, Human
aggaaaaaauaacaauga

SEQ ID NO: 2997909 - RNA, 22 nt, Human
agcuuuuuucucugauacagaa

SEQ ID NO: 2997910 - RNA, 20 nt, Human
agcuuuuuucucugauacag

SEQ ID NO: 2997911 - RNA, 19 nt, Human
agcuuuuuucucugauaca

SEQ ID NO: 2997912 - RNA, 23 nt, Human
agcuuuuuucucugauacagaaa

SEQ ID NO: 2997913 - RNA, 21 nt, Human
agcuuuguuuguugucagcug

SEQ ID NO: 2997914 - RNA, 15 nt, Human
aggaacacuccuuca

SEQ ID NO: 2997915 - RNA, 23 nt, Human
aggaacuuaaauaaugugaaacu

SEQ ID NO: 2997916 - RNA, 12 nt, Human
aggaacacuccu

SEQ ID NO: 2997917 - RNA, 23 nt, Human
aggaacaaggcaaggcugucaau

SEQ ID NO: 2997918 - RNA, 14 nt, Human
aggaagguagaaau

SEQ ID NO: 2997919 - RNA, 11 nt, Human
aggaaguacug

SEQ ID NO: 2997920 - RNA, 15 nt, Human
aggaaguacuggaga

SEQ ID NO: 2997921 - RNA, 14 nt, Human
augagcuuaagaaa

SEQ ID NO: 2997922 - RNA, 23 nt, Human
augagcuuaagaaauuuguggaa

SEQ ID NO: 2997923 - RNA, 15 nt, Human
augaccuuucaauag

SEQ ID NO: 2997924 - RNA, 13 nt, Human
augaccuuucaau

SEQ ID NO: 2997925 - RNA, 11 nt, Human
augagccuggc

SEQ ID NO: 2997926 - RNA, 19 nt, Human
augagccucagcauccugg

SEQ ID NO: 2997927 - RNA, 21 nt, Human
augagccucagcauccuggca

SEQ ID NO: 2997928 - RNA, 21 nt, Human
augaaguaauaugcacacauu

SEQ ID NO: 2997929 - RNA, 14 nt, Human
augaaguaauaugc

SEQ ID NO: 2997930 - RNA, 23 nt, Human
augaaguaauaugcacacauuuu

SEQ ID NO: 2997931 - RNA, 12 nt, Human
augaaagacugu

SEQ ID NO: 2997932 - RNA, 16 nt, Human
augaaacuuuuggaag

SEQ ID NO: 2997933 - RNA, 23 nt, Human
augaagcauuuacuuuguguuca

SEQ ID NO: 2997934 - RNA, 23 nt, Human
aucuaggaagacuuuggaaagag

SEQ ID NO: 2997935 - RNA, 23 nt, Human
auggcuuccuggcaauagucaaa

SEQ ID NO: 2997936 - RNA, 14 nt, Human
augggaaagcauug

SEQ ID NO: 2997937 - RNA, 20 nt, Human
augggaaagcauuguaaaug

SEQ ID NO: 2997938 - RNA, 21 nt, Human
augggaaugaaugucagugug

SEQ ID NO: 2997939 - RNA, 20 nt, Human
augggacauuugcucaugga

SEQ ID NO: 2997940 - RNA, 15 nt, Human
augggacagggagga

SEQ ID NO: 2997941 - RNA, 14 nt, Human
augcuucuucagag

SEQ ID NO: 2997942 - RNA, 17 nt, Human
augcuucuucagagacu

SEQ ID NO: 2997943 - RNA, 20 nt, Human
augcuucuucagagacuccu

SEQ ID NO: 2997944 - RNA, 21 nt, Human
augcuucuguuuuauaauuuu

SEQ ID NO: 2997945 - RNA, 19 nt, Human
augcucugcauguuacaua

SEQ ID NO: 2997946 - RNA, 18 nt, Human
augcucugcauguuacau

SEQ ID NO: 2997947 - RNA, 15 nt, Human
augcucugcauguua

SEQ ID NO: 2997948 - RNA, 16 nt, Human
augcuuugaucccuuc

SEQ ID NO: 2997949 - RNA, 18 nt, Human
augccugguggcagcugc

SEQ ID NO: 2997950 - RNA, 19 nt, Human
augccugguggcagcugcg

SEQ ID NO: 2997951 - RNA, 14 nt, Human
augccugguggcag

SEQ ID NO: 2997952 - RNA, 13 nt, Human
augccugguggca

SEQ ID NO: 2997953 - RNA, 12 nt, Human
augccugguggc

SEQ ID NO: 2997954 - RNA, 11 nt, Human
augccuggugg

SEQ ID NO: 2997955 - RNA, 21 nt, Human
augccugguggcagcugcggu

SEQ ID NO: 2997956 - RNA, 16 nt, Human
augcauagagugugau

SEQ ID NO: 2997957 - RNA, 16 nt, Human
auagcaagacauuaua

SEQ ID NO: 2997958 - RNA, 14 nt, Human
auagcacagacccu

SEQ ID NO: 2997959 - RNA, 19 nt, Human
auauuuuuuucugaaauuu

SEQ ID NO: 2997960 - RNA, 14 nt, Human
aucaaaagaaagaa

SEQ ID NO: 2997961 - RNA, 18 nt, Human
auauuuuuuucuuuucuu

SEQ ID NO: 2997962 - RNA, 18 nt, Human
auauuuuuuucugaaauu

SEQ ID NO: 2997963 - RNA, 16 nt, Human
auauuuuuuucugaaa

SEQ ID NO: 2997964 - RNA, 14 nt, Human
auauuuuuuucuga

SEQ ID NO: 2997965 - RNA, 19 nt, Human
aucaaagagguuuuaaaaa

SEQ ID NO: 2997966 - RNA, 20 nt, Human
aucaaaagguuaauaaagua

SEQ ID NO: 2997967 - RNA, 19 nt, Human
aucaucccuuucccuuggu

SEQ ID NO: 2997968 - RNA, 15 nt, Human
aucaucccuuucccu

SEQ ID NO: 2997969 - RNA, 20 nt, Human
aucaugacaaagacugagua

SEQ ID NO: 2997970 - RNA, 21 nt, Human
aucaugaauuaguuuuauaug

SEQ ID NO: 2997971 - RNA, 15 nt, Human
aucauccuaagcuau

SEQ ID NO: 2997972 - RNA, 15 nt, Human
aucaugcauagagug

SEQ ID NO: 2997973 - RNA, 14 nt, Human
aucaugcauagagu

SEQ ID NO: 2997974 - RNA, 20 nt, Human
auccacuggguguaaacaca

SEQ ID NO: 2997975 - RNA, 21 nt, Human
auccacugugccaugugccag

SEQ ID NO: 2997976 - RNA, 21 nt, Human
auccacuggguguaaacacau

SEQ ID NO: 2997977 - RNA, 22 nt, Human
aucuaggaagacuuuggaaaga

SEQ ID NO: 2997978 - RNA, 12 nt, Human
auccuugaagau

SEQ ID NO: 2997979 - RNA, 18 nt, Human
agugauguaauuaugguu

SEQ ID NO: 2997980 - RNA, 13 nt, Human
agugauuaccagg

SEQ ID NO: 2997981 - RNA, 19 nt, Human
agugaugucacuagggcag

SEQ ID NO: 2997982 - RNA, 22 nt, Human
agugauccucccaccucagccu

SEQ ID NO: 2997983 - RNA, 20 nt, Human
agugauccucccaccucagc

SEQ ID NO: 2997984 - RNA, 19 nt, Human
agugauccucccaccucag

SEQ ID NO: 2997985 - RNA, 22 nt, Human
agugcuacacaccuaacuuaug

SEQ ID NO: 2997986 - RNA, 19 nt, Human
agugccuuauggaacacuc

SEQ ID NO: 2997987 - RNA, 20 nt, Human
agugccuuauggaacacucu

SEQ ID NO: 2997988 - RNA, 21 nt, Human
agugccuuauggaacacucug

SEQ ID NO: 2997989 - RNA, 22 nt, Human
agugccuuauggaacacucuga

SEQ ID NO: 2997990 - RNA, 18 nt, Human
agugccuuauggaacacu

SEQ ID NO: 2997991 - RNA, 20 nt, Human
agugauucuccugccucagc

SEQ ID NO: 2997992 - RNA, 18 nt, Human
agugauucuccugccuca

SEQ ID NO: 2997993 - RNA, 19 nt, Human
agugauucuccugccucag

SEQ ID NO: 2997994 - RNA, 14 nt, Human
agugacagaggcag

SEQ ID NO: 2997995 - RNA, 17 nt, Human
agugaauaaccugagga

SEQ ID NO: 2997996 - RNA, 19 nt, Human
agugacagaggcagcccca

SEQ ID NO: 2997997 - RNA, 16 nt, Human
agugacagaggcagcc

SEQ ID NO: 2997998 - RNA, 22 nt, Human
agucuggcagacuuucuucucu

SEQ ID NO: 2997999 - RNA, 18 nt, Human
agucuggcccuuccuuuu

SEQ ID NO: 2998000 - RNA, 16 nt, Human
agucgaggacagggag

SEQ ID NO: 2998001 - RNA, 12 nt, Human
agucugauuuaa

SEQ ID NO: 2998002 - RNA, 18 nt, Human
agucuggaaugcaguggu

SEQ ID NO: 2998003 - RNA, 11 nt, Human
agucugauuua

SEQ ID NO: 2998004 - RNA, 20 nt, Human
agucugauucccaagcucug

SEQ ID NO: 2998005 - RNA, 22 nt, Human
agucugauucccaagcucugcu

SEQ ID NO: 2998006 - RNA, 21 nt, Human
agucugauucccaagcucugc

SEQ ID NO: 2998007 - RNA, 13 nt, Human
agucauuuaauaa

SEQ ID NO: 2998008 - RNA, 16 nt, Human
aguccuuaccagcaga

SEQ ID NO: 2998009 - RNA, 18 nt, Human
aguccuuaccagcagagc

SEQ ID NO: 2998010 - RNA, 14 nt, Human
aguccucuuuucug

SEQ ID NO: 2998011 - RNA, 16 nt, Human
aguaucaaguauagaa

SEQ ID NO: 2998012 - RNA, 17 nt, Human
aguaucaaguauagaaa

SEQ ID NO: 2998013 - RNA, 13 nt, Human
aguacucauacau

SEQ ID NO: 2998014 - RNA, 15 nt, Human
aguacuggagaaaau

SEQ ID NO: 2998015 - RNA, 21 nt, Human
aguacuucuccacccugcucu

SEQ ID NO: 2998016 - RNA, 19 nt, Human
aguacuucuccacccugcu

SEQ ID NO: 2998017 - RNA, 20 nt, Human
aguacuucuccacccugcuc

SEQ ID NO: 2998018 - RNA, 18 nt, Human
aguaaaugggggugcauu

SEQ ID NO: 2998019 - RNA, 20 nt, Human
aguaaaugggggugcauuug

SEQ ID NO: 2998020 - RNA, 19 nt, Human
aguaaaugggggugcauuu

SEQ ID NO: 2998021 - RNA, 21 nt, Human
aguaaaugggggugcauuuga

SEQ ID NO: 2998022 - RNA, 17 nt, Human
aguaacuuacuuaggug

SEQ ID NO: 2998023 - RNA, 21 nt, Human
auaagugcuauugcagagccg

SEQ ID NO: 2998024 - RNA, 15 nt, Human
auacaccacuacauu

SEQ ID NO: 2998025 - RNA, 20 nt, Human
auacacacucaaaucaagaa

SEQ ID NO: 2998026 - RNA, 23 nt, Human
auacaaugcugugcccuaaagug

SEQ ID NO: 2998027 - RNA, 12 nt, Human
auaauguuaaca

SEQ ID NO: 2998028 - RNA, 16 nt, Human
auaagcuacugccauc

SEQ ID NO: 2998029 - RNA, 14 nt, Human
auaagcuacugcca

SEQ ID NO: 2998030 - RNA, 21 nt, Human
auaaagaugagugagcaugcc

SEQ ID NO: 2998031 - RNA, 17 nt, Human
auacaccacuacauucu

SEQ ID NO: 2998032 - RNA, 14 nt, Human
agugcuauugcaga

SEQ ID NO: 2998033 - RNA, 18 nt, Human
agugcucacccacaccau

SEQ ID NO: 2998034 - RNA, 17 nt, Human
agugcucacccacacca

SEQ ID NO: 2998035 - RNA, 16 nt, Human
aguguuuucaauuuua

SEQ ID NO: 2998036 - RNA, 18 nt, Human
aguguuuucaauuuuaaa

SEQ ID NO: 2998037 - RNA, 14 nt, Human
aguucauacccugu

SEQ ID NO: 2998038 - RNA, 18 nt, Human
aguuccaccaucaagcca

SEQ ID NO: 2998039 - RNA, 21 nt, Human
aguuccaccaucaagccacca

SEQ ID NO: 2998040 - RNA, 18 nt, Human
aguugaaaaacagcugag

SEQ ID NO: 2998041 - RNA, 16 nt, Human
aguugaagacagagcu

SEQ ID NO: 2998042 - RNA, 17 nt, Human
aguugaagacagagcua

SEQ ID NO: 2998043 - RNA, 17 nt, Human
aguugaaaaacagcuga

SEQ ID NO: 2998044 - RNA, 17 nt, Human
aguuguuauuuauugaa

SEQ ID NO: 2998045 - RNA, 17 nt, Human
aguuguuagugugucuu

SEQ ID NO: 2998046 - RNA, 22 nt, Human
aguuguuagugugucuuagugu

SEQ ID NO: 2998047 - RNA, 13 nt, Human
aguuugcagagua

SEQ ID NO: 2998048 - RNA, 11 nt, Human
aguuugcaguu

SEQ ID NO: 2998049 - RNA, 14 nt, Human
aguuugauuaaauu

SEQ ID NO: 2998050 - RNA, 16 nt, Human
auaaaagacagugaaa

SEQ ID NO: 2998051 - RNA, 15 nt, Human
auaaaagacagugaa

SEQ ID NO: 2998052 - RNA, 14 nt, Human
acgcacacugucug

SEQ ID NO: 2998053 - RNA, 19 nt, Human
acgauuucuguuuagauaa

SEQ ID NO: 2998054 - RNA, 23 nt, Human
acgauuucuguuuagauaauaca

SEQ ID NO: 2998055 - RNA, 20 nt, Human
acgauuucuguuuagauaau

SEQ ID NO: 2998056 - RNA, 22 nt, Human
acgcugugcugcccugcccacc

SEQ ID NO: 2998057 - RNA, 19 nt, Human
acgcugugcugcccugccc

SEQ ID NO: 2998058 - RNA, 12 nt, Human
acgucugugcca

SEQ ID NO: 2998059 - RNA, 13 nt, Human
acgucugugccau

SEQ ID NO: 2998060 - RNA, 14 nt, Human
acgucuuaaauauu

SEQ ID NO: 2998061 - RNA, 13 nt, Human
acgucuuaaauau

SEQ ID NO: 2998062 - RNA, 19 nt, Human
acggaauaguuggcuagga

SEQ ID NO: 2998063 - RNA, 17 nt, Human
acggacacucaaaagcu

SEQ ID NO: 2998064 - RNA, 18 nt, Human
acuaauggggcggugaga

SEQ ID NO: 2998065 - RNA, 20 nt, Human
acuaauguguaagacaaaaa

SEQ ID NO: 2998066 - RNA, 20 nt, Human
accucugccucagaaaacaa

SEQ ID NO: 2998067 - RNA, 12 nt, Human
accucugccuga

SEQ ID NO: 2998068 - RNA, 23 nt, Human
accucugccugaagucacacagu

SEQ ID NO: 2998069 - RNA, 20 nt, Human
accucugccugaagucacac

SEQ ID NO: 2998070 - RNA, 19 nt, Human
accugccaggaagccagca

SEQ ID NO: 2998071 - RNA, 23 nt, Human
accugccaggaagccagcaggcu

SEQ ID NO: 2998072 - RNA, 21 nt, Human
accugccaggaagccagcagg

SEQ ID NO: 2998073 - RNA, 22 nt, Human
accugccaggaagccagcaggc

SEQ ID NO: 2998074 - RNA, 12 nt, Human
accugccccuca

SEQ ID NO: 2998075 - RNA, 15 nt, Human
accugccccucaacu

SEQ ID NO: 2998076 - RNA, 20 nt, Human
acccucagaugcacaugagc

SEQ ID NO: 2998077 - RNA, 13 nt, Human
acccucaggcagg

SEQ ID NO: 2998078 - RNA, 14 nt, Human
acccucaggcaggu

SEQ ID NO: 2998079 - RNA, 15 nt, Human
acccucaggcaggug

SEQ ID NO: 2998080 - RNA, 16 nt, Human
acccucaggcaggugg

SEQ ID NO: 2998081 - RNA, 13 nt, Human
acccucaucacca

SEQ ID NO: 2998082 - RNA, 14 nt, Human
acccucaugcugcc

SEQ ID NO: 2998083 - RNA, 16 nt, Human
acccucaugcugccaa

SEQ ID NO: 2998084 - RNA, 23 nt, Human
acccucaucaccaacgucugugc

SEQ ID NO: 2998085 - RNA, 22 nt, Human
acccucaugcugccaauauccu

SEQ ID NO: 2998086 - RNA, 23 nt, Human
acccuggcacuauaauguaagcu

SEQ ID NO: 2998087 - RNA, 21 nt, Human
acccugucucuacuaaaaaua

SEQ ID NO: 2998088 - RNA, 16 nt, Human
acccugugauggggcc

SEQ ID NO: 2998089 - RNA, 16 nt, Human
acccuggggagaaagu

SEQ ID NO: 2998090 - RNA, 14 nt, Human
acccuauugcugcu

SEQ ID NO: 2998091 - RNA, 19 nt, Human
acccuauugcugcuugagg

SEQ ID NO: 2998092 - RNA, 13 nt, Human
acccuauugcugc

SEQ ID NO: 2998093 - RNA, 17 nt, Human
acccgucuccagcugcu

SEQ ID NO: 2998094 - RNA, 21 nt, Human
accucaggugauccacccacc

SEQ ID NO: 2998095 - RNA, 20 nt, Human
accucaggugauccacccac

SEQ ID NO: 2998096 - RNA, 11 nt, Human
accucaggccu

SEQ ID NO: 2998097 - RNA, 17 nt, Human
acccugugauggggccc

SEQ ID NO: 2998098 - RNA, 19 nt, Human
acccugugauggggcccug

SEQ ID NO: 2998099 - RNA, 20 nt, Human
acccugugauggggcccugc

SEQ ID NO: 2998100 - RNA, 21 nt, Human
acccugugauggggcccugcc

SEQ ID NO: 2998101 - RNA, 16 nt, Human
accgggcacucagaag

SEQ ID NO: 2998102 - RNA, 20 nt, Human
accgggccacagagaaagua

SEQ ID NO: 2998103 - RNA, 14 nt, Human
accgggcacucaga

SEQ ID NO: 2998104 - RNA, 12 nt, Human
accgggcacuca

SEQ ID NO: 2998105 - RNA, 11 nt, Human
accucagccuc

SEQ ID NO: 2998106 - RNA, 12 nt, Human
accucagccucc

SEQ ID NO: 2998107 - RNA, 23 nt, Human
accgugaggccagagacacaagc

SEQ ID NO: 2998108 - RNA, 18 nt, Human
accgugaggccagagaca

SEQ ID NO: 2998109 - RNA, 13 nt, Human
acugacacaugcu

SEQ ID NO: 2998110 - RNA, 23 nt, Human
acugaauuucuuuugccguuauu

SEQ ID NO: 2998111 - RNA, 18 nt, Human
acugacauuguuggccaa

SEQ ID NO: 2998112 - RNA, 17 nt, Human
acugacauuguuggcca

SEQ ID NO: 2998113 - RNA, 12 nt, Human
acugaauuucuu

SEQ ID NO: 2998114 - RNA, 20 nt, Human
acugaauuaugaaacuuuug

SEQ ID NO: 2998115 - RNA, 15 nt, Human
acugaauuaugaaac

SEQ ID NO: 2998116 - RNA, 14 nt, Human
acugaauuaugaaa

SEQ ID NO: 2998117 - RNA, 13 nt, Human
acugaauuaugaa

SEQ ID NO: 2998118 - RNA, 17 nt, Human
acugaauggacuuugca

SEQ ID NO: 2998119 - RNA, 22 nt, Human
acugaauggacuuugcacacuu

SEQ ID NO: 2998120 - RNA, 21 nt, Human
acugaucauguuuaugagaaa

SEQ ID NO: 2998121 - RNA, 19 nt, Human
acugauaugggucuugaua

SEQ ID NO: 2998122 - RNA, 23 nt, Human
acugaucauguuuaugagaaacu

SEQ ID NO: 2998123 - RNA, 23 nt, Human
acugaugggcaacccccagccug

SEQ ID NO: 2998124 - RNA, 17 nt, Human
acugauuuuuuuuuccu

SEQ ID NO: 2998125 - RNA, 18 nt, Human
acugauuuuuuuuuccuu

SEQ ID NO: 2998126 - RNA, 19 nt, Human
acugauuuuuuuuuccuuc

SEQ ID NO: 2998127 - RNA, 20 nt, Human
acugauuuuuuuuuccuuca

SEQ ID NO: 2998128 - RNA, 16 nt, Human
acugauuuuuuuuucc

SEQ ID NO: 2998129 - RNA, 14 nt, Human
acucccuuucaaca

SEQ ID NO: 2998130 - RNA, 16 nt, Human
acuccggcccuccaga

SEQ ID NO: 2998131 - RNA, 22 nt, Human
acucccaucugugaaaggaaag

SEQ ID NO: 2998132 - RNA, 23 nt, Human
acucccaugagggagaugccaug

SEQ ID NO: 2998133 - RNA, 22 nt, Human
acucccaugagggagaugccau

SEQ ID NO: 2998134 - RNA, 17 nt, Human
acucccaugagggagau

SEQ ID NO: 2998135 - RNA, 19 nt, Human
acuccggcccuccagagcc

SEQ ID NO: 2998136 - RNA, 19 nt, Human
acucguuaauuuguagugu

SEQ ID NO: 2998137 - RNA, 14 nt, Human
acucguuaauuugu

SEQ ID NO: 2998138 - RNA, 15 nt, Human
acucuacagaggcca

SEQ ID NO: 2998139 - RNA, 19 nt, Human
acuggaacacucuauaaca

SEQ ID NO: 2998140 - RNA, 17 nt, Human
acuguaaaauaauaacu

SEQ ID NO: 2998141 - RNA, 14 nt, Human
acugccaugccagc

SEQ ID NO: 2998142 - RNA, 16 nt, Human
acugugaagagaacca

SEQ ID NO: 2998143 - RNA, 16 nt, Human
acugugccaugugcca

SEQ ID NO: 2998144 - RNA, 18 nt, Human
acugugccaugugccagg

SEQ ID NO: 2998145 - RNA, 17 nt, Human
acugugccaugugccag

SEQ ID NO: 2998146 - RNA, 21 nt, Human
acuucagacauagaauuaaca

SEQ ID NO: 2998147 - RNA, 23 nt, Human
acuuggggggcugaggugggagg

SEQ ID NO: 2998148 - RNA, 21 nt, Human
acuuaaaaaugguuuaaaugg

SEQ ID NO: 2998149 - RNA, 22 nt, Human
acuuaaaaaugguuuaaauggu

SEQ ID NO: 2998150 - RNA, 18 nt, Human
acuucaaauccuugaaga

SEQ ID NO: 2998151 - RNA, 12 nt, Human
acuucagacaua

SEQ ID NO: 2998152 - RNA, 17 nt, Human
acuucaaauccuugaag

SEQ ID NO: 2998153 - RNA, 18 nt, Human
acuguuucaaacuuuacu

SEQ ID NO: 2998154 - RNA, 15 nt, Human
acuguuucaaacuuu

SEQ ID NO: 2998155 - RNA, 13 nt, Human
acuguuucaaacu

SEQ ID NO: 2998156 - RNA, 19 nt, Human
acuguuucaaacuuuacua

SEQ ID NO: 2998157 - RNA, 14 nt, Human
acaucauuucaaga

SEQ ID NO: 2998158 - RNA, 16 nt, Human
acauacaauuccaaac

SEQ ID NO: 2998159 - RNA, 20 nt, Human
acauacaggaagguagaaau

SEQ ID NO: 2998160 - RNA, 20 nt, Human
acauaaauuuaguauuuugu

SEQ ID NO: 2998161 - RNA, 22 nt, Human
acauguguguauauguagaugu

SEQ ID NO: 2998162 - RNA, 20 nt, Human
acaugccucucucaggccaa

SEQ ID NO: 2998163 - RNA, 13 nt, Human
acaugcacgugug

SEQ ID NO: 2998164 - RNA, 23 nt, Human
acaugcacagcuaacauggaagu

SEQ ID NO: 2998165 - RNA, 19 nt, Human
acauguuuuucuucucccu

SEQ ID NO: 2998166 - RNA, 19 nt, Human
acauuuguauaaaauaauu

SEQ ID NO: 2998167 - RNA, 16 nt, Human
acauuuguauaaaaua

SEQ ID NO: 2998168 - RNA, 15 nt, Human
acauuugcucaugga

SEQ ID NO: 2998169 - RNA, 14 nt, Human
accaacgucugugc

SEQ ID NO: 2998170 - RNA, 17 nt, Human
accaacgucugugccau

SEQ ID NO: 2998171 - RNA, 21 nt, Human
accaacgucugugccauuuug

SEQ ID NO: 2998172 - RNA, 12 nt, Human
accaagcccagu

SEQ ID NO: 2998173 - RNA, 16 nt, Human
accacgcuggaccuug

SEQ ID NO: 2998174 - RNA, 14 nt, Human
accacgcuggaccu

SEQ ID NO: 2998175 - RNA, 18 nt, Human
accacgcuggaccuugaa

SEQ ID NO: 2998176 - RNA, 14 nt, Human
accacguuucuaaa

SEQ ID NO: 2998177 - RNA, 13 nt, Human
accacguuucuaa

SEQ ID NO: 2998178 - RNA, 14 nt, Human
accagagcugccac

SEQ ID NO: 2998179 - RNA, 16 nt, Human
accagagcugccaccu

SEQ ID NO: 2998180 - RNA, 13 nt, Human
accagagcugcca

SEQ ID NO: 2998181 - RNA, 12 nt, Human
accagagcugcc

SEQ ID NO: 2998182 - RNA, 22 nt, Human
acaggaugguucccuugaugaa

SEQ ID NO: 2998183 - RNA, 24 nt, Human
acaggaugguucccuugaugaaga

SEQ ID NO: 2998184 - RNA, 17 nt, Human
acaggcaaugcuggcug

SEQ ID NO: 2998185 - RNA, 14 nt, Human
acaggcacccacca

SEQ ID NO: 2998186 - RNA, 16 nt, Human
acaggcaaugcuggcu

SEQ ID NO: 2998187 - RNA, 15 nt, Human
acaggcaaugcuggc

SEQ ID NO: 2998188 - RNA, 18 nt, Human
acagcucuucuccaggcu

SEQ ID NO: 2998189 - RNA, 20 nt, Human
acagcucuucuccaggcugu

SEQ ID NO: 2998190 - RNA, 19 nt, Human
acagcucuucuccaggcug

SEQ ID NO: 2998191 - RNA, 19 nt, Human
acagugauuaccagggacu

SEQ ID NO: 2998192 - RNA, 23 nt, Human
acagugaucaaguuauuuuuaau

SEQ ID NO: 2998193 - RNA, 23 nt, Human
acaggcacccaccaucaugucug

SEQ ID NO: 2998194 - RNA, 20 nt, Human
aauuaugguuaguagaggua

SEQ ID NO: 2998195 - RNA, 13 nt, Human
aauuccuguuuuu

SEQ ID NO: 2998196 - RNA, 22 nt, Human
aauuccuguuuuuauuauuaac

SEQ ID NO: 2998197 - RNA, 21 nt, Human
aauuccuguuuuuauuauuaa

SEQ ID NO: 2998198 - RNA, 19 nt, Human
aauuccuguuuuuauuauu

SEQ ID NO: 2998199 - RNA, 13 nt, Human
aauuaugaaaaua

SEQ ID NO: 2998200 - RNA, 12 nt, Human
aauuaugaaacu

SEQ ID NO: 2998201 - RNA, 15 nt, Human
aauuaugaaacuuuu

SEQ ID NO: 2998202 - RNA, 13 nt, Human
aauuaugaaacuu

SEQ ID NO: 2998203 - RNA, 19 nt, Human
aauuaugaguuauuuuuau

SEQ ID NO: 2998204 - RNA, 18 nt, Human
aauuaugaaacuuuugga

SEQ ID NO: 2998205 - RNA, 19 nt, Human
aauucucagaaucucaaau

SEQ ID NO: 2998206 - RNA, 14 nt, Human
aauucuacuuugag

SEQ ID NO: 2998207 - RNA, 17 nt, Human
aauucucuaguuugauu

SEQ ID NO: 2998208 - RNA, 15 nt, Human
aauucucuaguuuga

SEQ ID NO: 2998209 - RNA, 15 nt, Human
aauucucuuauccaa

SEQ ID NO: 2998210 - RNA, 21 nt, Human
aauucucauuugucacacacu

SEQ ID NO: 2998211 - RNA, 14 nt, Human
aauucuguuuuucu

SEQ ID NO: 2998212 - RNA, 18 nt, Human
aauucuguuuuucuaggc

SEQ ID NO: 2998213 - RNA, 15 nt, Human
aauuggagcucgugg

SEQ ID NO: 2998214 - RNA, 18 nt, Human
aauugggcacuauuuauu

SEQ ID NO: 2998215 - RNA, 16 nt, Human
aauugggcacuauuua

SEQ ID NO: 2998216 - RNA, 22 nt, Human
aauuguaaggaaugauuaauua

SEQ ID NO: 2998217 - RNA, 15 nt, Human
aauugggcacuauuu

SEQ ID NO: 2998218 - RNA, 15 nt, Human
aauuuccugggagcu

SEQ ID NO: 2998219 - RNA, 12 nt, Human
aauuuccuggga

SEQ ID NO: 2998220 - RNA, 15 nt, Human
aauuucccaaagcag

SEQ ID NO: 2998221 - RNA, 17 nt, Human
aauuucccaaagcagug

SEQ ID NO: 2998222 - RNA, 21 nt, Human
aauuuccauuuacuuaagacu

SEQ ID NO: 2998223 - RNA, 22 nt, Human
aauuuccauuuacuuaagacuu

SEQ ID NO: 2998224 - RNA, 11 nt, Human
aauuguaauag

SEQ ID NO: 2998225 - RNA, 22 nt, Human
aauuucauaccuaucaucuuaa

SEQ ID NO: 2998226 - RNA, 15 nt, Human
acaccaauauucaua

SEQ ID NO: 2998227 - RNA, 13 nt, Human
acaccagagccca

SEQ ID NO: 2998228 - RNA, 23 nt, Human
acaccagagcccaccuuggcuca

SEQ ID NO: 2998229 - RNA, 18 nt, Human
acaccagagcccaccuug

SEQ ID NO: 2998230 - RNA, 18 nt, Human
acacagcucuucuccagg

SEQ ID NO: 2998231 - RNA, 16 nt, Human
acacagcucuucucca

SEQ ID NO: 2998232 - RNA, 14 nt, Human
acacagcucuucuc

SEQ ID NO: 2998233 - RNA, 21 nt, Human
acaaacaaggccugucagcua

SEQ ID NO: 2998234 - RNA, 16 nt, Human
acaaggcaaggcuguc

SEQ ID NO: 2998235 - RNA, 17 nt, Human
acaaggcaaggcuguca

SEQ ID NO: 2998236 - RNA, 19 nt, Human
acaaggcaaggcugucaau

SEQ ID NO: 2998237 - RNA, 15 nt, Human
acaaggcaaggcugu

SEQ ID NO: 2998238 - RNA, 15 nt, Human
acaaguuaaauaaau

SEQ ID NO: 2998239 - RNA, 18 nt, Human
aaggcaggggaauguaug

SEQ ID NO: 2998240 - RNA, 20 nt, Human
aaggcaggggaauguaugug

SEQ ID NO: 2998241 - RNA, 15 nt, Human
aaggcaaggcuguca

SEQ ID NO: 2998242 - RNA, 13 nt, Human
aaggcaaggcugu

SEQ ID NO: 2998243 - RNA, 13 nt, Human
aagcugcacccuc

SEQ ID NO: 2998244 - RNA, 19 nt, Human
aagcugcacccucaggcag

SEQ ID NO: 2998245 - RNA, 13 nt, Human
aagcuacuuauug

SEQ ID NO: 2998246 - RNA, 15 nt, Human
aagcgugagccacug

SEQ ID NO: 2998247 - RNA, 14 nt, Human
aagcggcuggcagc

SEQ ID NO: 2998248 - RNA, 17 nt, Human
aagauacaguuacucag

SEQ ID NO: 2998249 - RNA, 19 nt, Human
aagauaauauuaaggaaga

SEQ ID NO: 2998250 - RNA, 21 nt, Human
aagauaauauuaaggaagaca

SEQ ID NO: 2998251 - RNA, 14 nt, Human
aagauaaaugugcu

SEQ ID NO: 2998252 - RNA, 22 nt, Human
aagacagagccccacccucaga

SEQ ID NO: 2998253 - RNA, 23 nt, Human
aagacagauacuccuccaagguu

SEQ ID NO: 2998254 - RNA, 13 nt, Human
aagagaaaaaaua

SEQ ID NO: 2998255 - RNA, 19 nt, Human
aagacuuuucuuucagcca

SEQ ID NO: 2998256 - RNA, 21 nt, Human
aagacuuuuccaacccucauc

SEQ ID NO: 2998257 - RNA, 12 nt, Human
aagacuuuucuu

SEQ ID NO: 2998258 - RNA, 17 nt, Human
aagaccacguuucuaaa

SEQ ID NO: 2998259 - RNA, 15 nt, Human
aagaccacguuucua

SEQ ID NO: 2998260 - RNA, 17 nt, Human
aagacuuuuccaacccu

SEQ ID NO: 2998261 - RNA, 20 nt, Human
aacgcaggcccccaggugcc

SEQ ID NO: 2998262 - RNA, 13 nt, Human
aagaacugaaauc

SEQ ID NO: 2998263 - RNA, 12 nt, Human
aagaacugaaau

SEQ ID NO: 2998264 - RNA, 11 nt, Human
aagaacugaaa

SEQ ID NO: 2998265 - RNA, 15 nt, Human
aagaacugaaaucau

SEQ ID NO: 2998266 - RNA, 20 nt, Human
aagacaaugugaaaagaaaa

SEQ ID NO: 2998267 - RNA, 19 nt, Human
aagacaaugugaaaagaaa

SEQ ID NO: 2998268 - RNA, 22 nt, Human
aagacaaugacuuacuguacau

SEQ ID NO: 2998269 - RNA, 15 nt, Human
aagaagacugcauua

SEQ ID NO: 2998270 - RNA, 21 nt, Human
aagacaaggaaaaaauaacaa

SEQ ID NO: 2998271 - RNA, 20 nt, Human
aagaagacugcauuauauuu

SEQ ID NO: 2998272 - RNA, 20 nt, Human
aagaguaggaagacuuugga

SEQ ID NO: 2998273 - RNA, 19 nt, Human
aauaauguuaacauggaca

SEQ ID NO: 2998274 - RNA, 14 nt, Human
aauaaagcagcguu

SEQ ID NO: 2998275 - RNA, 22 nt, Human
aauaaugugaaacuggauuaaa

SEQ ID NO: 2998276 - RNA, 17 nt, Human
aauaaugugaaacugga

SEQ ID NO: 2998277 - RNA, 22 nt, Human
aagugcugcauuuaaaagauac

SEQ ID NO: 2998278 - RNA, 14 nt, Human
aagugcugcauuua

SEQ ID NO: 2998279 - RNA, 12 nt, Human
aagugcugggau

SEQ ID NO: 2998280 - RNA, 13 nt, Human
aauauuaagaaag

SEQ ID NO: 2998281 - RNA, 23 nt, Human
aauauguggaguucaucuugaau

SEQ ID NO: 2998282 - RNA, 23 nt, Human
aaucaccgaaaacguggcugcuu

SEQ ID NO: 2998283 - RNA, 21 nt, Human
aaucaccgaaaacguggcugc

SEQ ID NO: 2998284 - RNA, 21 nt, Human
aaucaaucaugucagucugcu

SEQ ID NO: 2998285 - RNA, 16 nt, Human
aaucucaauauuucag

SEQ ID NO: 2998286 - RNA, 20 nt, Human
aaugaauacuuuauaaagga

SEQ ID NO: 2998287 - RNA, 20 nt, Human
aaugaugccaugaggaacaa

SEQ ID NO: 2998288 - RNA, 20 nt, Human
aaugaaagacuguacaaagu

SEQ ID NO: 2998289 - RNA, 18 nt, Human
aaugaaagacuguacaaa

SEQ ID NO: 2998290 - RNA, 21 nt, Human
aaugaaagacuguacaaagua

SEQ ID NO: 2998291 - RNA, 20 nt, Human
aaugaagauacugaaauaaa

SEQ ID NO: 2998292 - RNA, 14 nt, Human
aaauagaugacauu

SEQ ID NO: 2998293 - RNA, 21 nt, Human
aaauagaugacauugacuauu

SEQ ID NO: 2998294 - RNA, 22 nt, Human
aaauagcagcccucaauuguga

SEQ ID NO: 2998295 - RNA, 21 nt, Human
aaauauuuauuuuaauaaugu

SEQ ID NO: 2998296 - RNA, 18 nt, Human
aaaucucaauauuucaga

SEQ ID NO: 2998297 - RNA, 13 nt, Human
aaaucuuuuugcu

SEQ ID NO: 2998298 - RNA, 14 nt, Human
aaaucuuuuugcuu

SEQ ID NO: 2998299 - RNA, 19 nt, Human
aaaugcuguaacuuucuga

SEQ ID NO: 2998300 - RNA, 14 nt, Human
aaaggaugcacaga

SEQ ID NO: 2998301 - RNA, 20 nt, Human
aaaggaugcccaaagaugca

SEQ ID NO: 2998302 - RNA, 22 nt, Human
aaauguugacaugggacauuug

SEQ ID NO: 2998303 - RNA, 13 nt, Human
aaauguucaucaa

SEQ ID NO: 2998304 - RNA, 23 nt, Human
aaauguugacaugggacauuugc

SEQ ID NO: 2998305 - RNA, 22 nt, Human
aaauguuuugcucaauagauug

SEQ ID NO: 2998306 - RNA, 11 nt, Human
aaauguuuugc

SEQ ID NO: 2998307 - RNA, 15 nt, Human
aaauucuugcaaagu

SEQ ID NO: 2998308 - RNA, 23 nt, Human
aaauucuucuccacuuucuagcc

SEQ ID NO: 2998309 - RNA, 11 nt, Human
aacaggcagau

SEQ ID NO: 2998310 - RNA, 22 nt, Human
aacauggccuuugcuugaaaga

SEQ ID NO: 2998311 - RNA, 16 nt, Human
aaccuuuugagugccu

SEQ ID NO: 2998312 - RNA, 23 nt, Human
aaccuuuugagugccuuacacaa

SEQ ID NO: 2998313 - RNA, 23 nt, Human
aacauggccuuugcuugaaagaa

SEQ ID NO: 2998314 - RNA, 18 nt, Human
aaaaucucaaauuucuaa

SEQ ID NO: 2998315 - RNA, 16 nt, Human
aaaaucucaaauuucu

SEQ ID NO: 2998316 - RNA, 15 nt, Human
aaaaucucaaauuuc

SEQ ID NO: 2998317 - RNA, 21 nt, Human
aaaaucauuucugcaucagcu

SEQ ID NO: 2998318 - RNA, 15 nt, Human
aaaccgccaaggcug

SEQ ID NO: 2998319 - RNA, 16 nt, Human
aaaccgccaaggcugg

SEQ ID NO: 2998320 - RNA, 12 nt, Human
aaacccagcucu

SEQ ID NO: 2998321 - RNA, 16 nt, Human
aaacccagcucugguc

SEQ ID NO: 2998322 - RNA, 22 nt, Human
aaaccgaacugauguaaguaaa

SEQ ID NO: 2998323 - RNA, 19 nt, Human
aaacccuugccaugugcua

SEQ ID NO: 2998324 - RNA, 12 nt, Human
aaacucuuaaaa

SEQ ID NO: 2998325 - RNA, 23 nt, Human
aaacucuuaaaacccaagugccu

SEQ ID NO: 2998326 - RNA, 22 nt, Human
aaacugauuuuuuuuuccuuca

SEQ ID NO: 2998327 - RNA, 23 nt, Human
aaacugauuuuuuuuuccuucag

SEQ ID NO: 2998328 - RNA, 15 nt, Human
aaacugcacugucaa

SEQ ID NO: 2998329 - RNA, 20 nt, Human
aaagauauuuugcuuuguga

SEQ ID NO: 2998330 - RNA, 15 nt, Human
aaagcauuguaaaug

SEQ ID NO: 2998331 - RNA, 17 nt, Human
aaagcauuguaaaugug

SEQ ID NO: 2998332 - RNA, 16 nt, Human
aaagccucuguuuuga

SEQ ID NO: 2998333 - RNA, 17 nt, Human
aaagccucuguuuugau

SEQ ID NO: 2998334 - RNA, 16 nt, Human
aaagccuccuccagcc

SEQ ID NO: 2998335 - RNA, 13 nt, Human
aaaaucagccugc

SEQ ID NO: 2998336 - RNA, 16 nt, Human
aaaauaaaacuuuuua

SEQ ID NO: 2998337 - RNA, 17 nt, Human
aaaaucagccugcucca

SEQ ID NO: 2998338 - RNA, 21 nt, Human
aaaaucagccugcuccagcug

SEQ ID NO: 2998339 - RNA, 11 nt, Human
aaaaucauuuc

SEQ ID NO: 2998340 - RNA, 12 nt, Human
aaaaucauuucu

SEQ ID NO: 2998341 - RNA, 10 nt, Human
aaaaucauuu

SEQ ID NO: 2998342 - RNA, 18 nt, Human
aaaaguugaauuuuacau

SEQ ID NO: 2998343 - RNA, 13 nt, Human
aaaaguugaauuu

SEQ ID NO: 2998344 - RNA, 14 nt, Human
aaaauaaaacuuuu

SEQ ID NO: 2998345 - RNA, 17 nt, Human
aaaagaaagaaaaucag

SEQ ID NO: 2998346 - RNA, 13 nt, Human
aaaagaaaaguuu

SEQ ID NO: 2998347 - RNA, 12 nt, Human
aaaagaauauuu

SEQ ID NO: 2998348 - RNA, 20 nt, Human
aaaagacaaggaaaaaauaa

SEQ ID NO: 2998349 - RNA, 13 nt, Human
aaaagaauauuuu

SEQ ID NO: 2998350 - RNA, 11 nt, Human
aaaagaaugau

SEQ ID NO: 2998351 - RNA, 13 nt, Human
aaaagacuccaaa

SEQ ID NO: 2998352 - RNA, 11 nt, Human
aaaagaaaaag

SEQ ID NO: 2998353 - RNA, 19 nt, Human
aaaacacuguucucugccc

SEQ ID NO: 2998354 - RNA, 17 nt, Human
aaaacacauuuuucuua

SEQ ID NO: 2998355 - RNA, 15 nt, Human
auuuaaauagaugac

SEQ ID NO: 2998356 - RNA, 16 nt, Human
auuuaaauagcuuuuu

SEQ ID NO: 2998357 - RNA, 14 nt, Human
auuuaaauagauga

SEQ ID NO: 2998358 - RNA, 22 nt, Human
auuuacaacugggggaggguga

SEQ ID NO: 2998359 - RNA, 15 nt, Human
auuuaccacuugugu

SEQ ID NO: 2998360 - RNA, 22 nt, Human
auuuaccacuuguguuuugcaa

SEQ ID NO: 2998361 - RNA, 19 nt, Human
auuguuuucaguguacaug

SEQ ID NO: 2998362 - RNA, 18 nt, Human
auuguuuucaguguacau

SEQ ID NO: 2998363 - RNA, 17 nt, Human
auuuaaaaaaaaaccug

SEQ ID NO: 2998364 - RNA, 14 nt, Human
auuuaaaaaaaauc

SEQ ID NO: 2998365 - RNA, 17 nt, Human
auuguagcauccuggaa

SEQ ID NO: 2998366 - RNA, 16 nt, Human
auuguaguccuguaau

SEQ ID NO: 2998367 - RNA, 20 nt, Human
auuguagcauccuggaauau

SEQ ID NO: 2998368 - RNA, 17 nt, Human
auuguuuucaguguaca

SEQ ID NO: 2998369 - RNA, 15 nt, Human
auuuacuuuaaacua

SEQ ID NO: 2998370 - RNA, 20 nt, Human
auuuacuucuuauacauuug

SEQ ID NO: 2998371 - RNA, 19 nt, Human
auuuacuucuuauacauuu

SEQ ID NO: 2998372 - RNA, 12 nt, Human
auuuauuacaac

SEQ ID NO: 2998373 - RNA, 13 nt, Human
auuuauugaaaug

SEQ ID NO: 2998374 - RNA, 15 nt, Human
auuuauugaaaugau

SEQ ID NO: 2998375 - RNA, 22 nt, Human
auuuauugaaaugauuucacag

SEQ ID NO: 2998376 - RNA, 20 nt, Human
auuuauuacuguaagaaaau

SEQ ID NO: 2998377 - RNA, 19 nt, Human
auuuauuacuguaagaaaa

SEQ ID NO: 2998378 - RNA, 17 nt, Human
auuuccguuaaaauacc

SEQ ID NO: 2998379 - RNA, 14 nt, Human
auuucccaaagcag

SEQ ID NO: 2998380 - RNA, 16 nt, Human
auuucccaaagcagug

SEQ ID NO: 2998381 - RNA, 20 nt, Human
auuuccauuuacuuaagacu

SEQ ID NO: 2998382 - RNA, 19 nt, Human
auuuccauuuacuuaagac

SEQ ID NO: 2998383 - RNA, 22 nt, Human
auuuccauuuacuuaagacuua

SEQ ID NO: 2998384 - RNA, 21 nt, Human
auuuauuuuaauaauguuuca

SEQ ID NO: 2998385 - RNA, 18 nt, Human
auuuccauuuacuuaaga

SEQ ID NO: 2998386 - RNA, 18 nt, Human
auuugauaugugaacagu

SEQ ID NO: 2998387 - RNA, 19 nt, Human
auuugauaugugaacaguu

SEQ ID NO: 2998388 - RNA, 21 nt, Human
auuugaggucuguucuuucca

SEQ ID NO: 2998389 - RNA, 14 nt, Human
auuugguuuucaca

SEQ ID NO: 2998390 - RNA, 12 nt, Human
auuugguuuuca

SEQ ID NO: 2998391 - RNA, 21 nt, Human
auuuggugguuucagaaaugu

SEQ ID NO: 2998392 - RNA, 18 nt, Human
auuugaggucuguucuuu

SEQ ID NO: 2998393 - RNA, 17 nt, Human
auuugaggucuguucuu

SEQ ID NO: 2998394 - RNA, 15 nt, Human
auuugaggucuguuc

SEQ ID NO: 2998395 - RNA, 15 nt, Human
auuugagcagggcuc

SEQ ID NO: 2998396 - RNA, 20 nt, Human
auuucuugagguaaaagcau

SEQ ID NO: 2998397 - RNA, 16 nt, Human
auuucuuccacaagag

SEQ ID NO: 2998398 - RNA, 17 nt, Human
auugcaccuggauguac

SEQ ID NO: 2998399 - RNA, 16 nt, Human
auugcaacaggcuggg

SEQ ID NO: 2998400 - RNA, 17 nt, Human
auugcauacuauuaaac

SEQ ID NO: 2998401 - RNA, 18 nt, Human
auugcauacuauuaaaca

SEQ ID NO: 2998402 - RNA, 18 nt, Human
auugcaacaggcugggcu

SEQ ID NO: 2998403 - RNA, 17 nt, Human
auugcaacaggcugggc

SEQ ID NO: 2998404 - RNA, 12 nt, Human
auugcaccacug

SEQ ID NO: 2998405 - RNA, 19 nt, Human
auugcaacaggcugggcuu

SEQ ID NO: 2998406 - RNA, 13 nt, Human
auugauguuuuca

SEQ ID NO: 2998407 - RNA, 16 nt, Human
auugauguuuucauag

SEQ ID NO: 2998408 - RNA, 17 nt, Human
auugauguuuucauaga

SEQ ID NO: 2998409 - RNA, 14 nt, Human
auugaaguaaaaug

SEQ ID NO: 2998410 - RNA, 17 nt, Human
auugaaggaugcugucu

SEQ ID NO: 2998411 - RNA, 24 nt, Human
auuccuagaaacugacacaugcug

SEQ ID NO: 2998412 - RNA, 15 nt, Human
auugaaguaaaaugu

SEQ ID NO: 2998413 - RNA, 21 nt, Human
auugccuuuuuauaacuuuuu

SEQ ID NO: 2998414 - RNA, 20 nt, Human
auugccuuuuuauaacuuuu

SEQ ID NO: 2998415 - RNA, 19 nt, Human
auugccuuuuuauaacuuu

SEQ ID NO: 2998416 - RNA, 13 nt, Human
auuggaaacaagu

SEQ ID NO: 2998417 - RNA, 14 nt, Human
auuggaaacaaguc

SEQ ID NO: 2998418 - RNA, 20 nt, Human
auugcauacuauuaaacaug

SEQ ID NO: 2998419 - RNA, 19 nt, Human
auugcauacuauuaaacau

SEQ ID NO: 2998420 - RNA, 22 nt, Human
auugcauacuauuaaacaugcu

SEQ ID NO: 2998421 - RNA, 17 nt, Human
auuggagcucgugggac

SEQ ID NO: 2998422 - RNA, 16 nt, Human
auuggagcucguggaa

SEQ ID NO: 2998423 - RNA, 22 nt, Human
auuggcuagagguucaaagaua

SEQ ID NO: 2998424 - RNA, 20 nt, Human
auuggcuagagguucaaaga

SEQ ID NO: 2998425 - RNA, 19 nt, Human
auuggcuagagguucaaag

SEQ ID NO: 2998426 - RNA, 14 nt, Human
auuggggcucccag

SEQ ID NO: 2998427 - RNA, 23 nt, Human
auuggcuagagguucaaagauau

SEQ ID NO: 2998428 - RNA, 14 nt, Human
auguugcuaacagc

SEQ ID NO: 2998429 - RNA, 21 nt, Human
uuuuagacccuauugcugcuu

SEQ ID NO: 2998430 - RNA, 17 nt, Human
uuuuagaguugauacua

SEQ ID NO: 2998431 - RNA, 15 nt, Human
auguugcccaggcag

SEQ ID NO: 2998432 - RNA, 14 nt, Human
auguugcccaggca

SEQ ID NO: 2998433 - RNA, 18 nt, Human
auguugaaagaucaaaag

SEQ ID NO: 2998434 - RNA, 13 nt, Human
auguugcccaggc

SEQ ID NO: 2998435 - RNA, 12 nt, Human
auguugaaagau

SEQ ID NO: 2998436 - RNA, 19 nt, Human
auguuacauaagauaaaug

SEQ ID NO: 2998437 - RNA, 20 nt, Human
auguuacauaagauaaaugu

SEQ ID NO: 2998438 - RNA, 17 nt, Human
uuuguuuuuauuaaaag

SEQ ID NO: 2998439 - RNA, 18 nt, Human
uuuuaaaaaacugcugac

SEQ ID NO: 2998440 - RNA, 20 nt, Human
augugcuaguaauuggaaag

SEQ ID NO: 2998441 - RNA, 21 nt, Human
augugcuaguaauuggaaagg

SEQ ID NO: 2998442 - RNA, 13 nt, Human
uuuucuguucuuu

SEQ ID NO: 2998443 - RNA, 17 nt, Human
auguuggccaggcuggu

SEQ ID NO: 2998444 - RNA, 23 nt, Human
auuaaaaaucucaaauuucuaaa

SEQ ID NO: 2998445 - RNA, 19 nt, Human
auuaaaacacaacaucuuu

SEQ ID NO: 2998446 - RNA, 17 nt, Human
uuuucucugauacagaa

SEQ ID NO: 2998447 - RNA, 16 nt, Human
uuuucucuaggaaaua

SEQ ID NO: 2998448 - RNA, 20 nt, Human
uuuucaggcuagauguaugu

SEQ ID NO: 2998449 - RNA, 21 nt, Human
uuuuauggcuuuugugcauua

SEQ ID NO: 2998450 - RNA, 12 nt, Human
uuuuauuaaauu

SEQ ID NO: 2998451 - RNA, 19 nt, Human
uuuuauggcuuuugugcau

SEQ ID NO: 2998452 - RNA, 18 nt, Human
uuuuauggcuuuugugca

SEQ ID NO: 2998453 - RNA, 22 nt, Human
uuuuauggcacuaguauuucua

SEQ ID NO: 2998454 - RNA, 15 nt, Human
uuuuaguagagacag

SEQ ID NO: 2998455 - RNA, 23 nt, Human
uuugagaaauuuuuuuuuccagu

SEQ ID NO: 2998456 - RNA, 13 nt, Human
uuugagacagagu

SEQ ID NO: 2998457 - RNA, 18 nt, Human
uuugaccucugcagcaau

SEQ ID NO: 2998458 - RNA, 15 nt, Human
uuugauccaagcugg

SEQ ID NO: 2998459 - RNA, 14 nt, Human
uuugauccaagcug

SEQ ID NO: 2998460 - RNA, 15 nt, Human
uuugauucagacagc

SEQ ID NO: 2998461 - RNA, 23 nt, Human
uuucccucccuuccucuuuccau

SEQ ID NO: 2998462 - RNA, 21 nt, Human
uuugaccucugcagcaauaaa

SEQ ID NO: 2998463 - RNA, 19 nt, Human
uuugaccucugcagcaaua

SEQ ID NO: 2998464 - RNA, 14 nt, Human
uuugacaaggggca

SEQ ID NO: 2998465 - RNA, 12 nt, Human
uuuggcugcuga

SEQ ID NO: 2998466 - RNA, 13 nt, Human
uuuggcugcugaa

SEQ ID NO: 2998467 - RNA, 21 nt, Human
uuugggguacccacugcucug

SEQ ID NO: 2998468 - RNA, 22 nt, Human
uuugggguacccacugcucugg

SEQ ID NO: 2998469 - RNA, 19 nt, Human
uuugcuggggccgaaagaa

SEQ ID NO: 2998470 - RNA, 22 nt, Human
uuugcuggggccgaaagaacag

SEQ ID NO: 2998471 - RNA, 20 nt, Human
uuugcuggagcucugcccau

SEQ ID NO: 2998472 - RNA, 22 nt, Human
uuuggauuggaugaauuccaaa

SEQ ID NO: 2998473 - RNA, 18 nt, Human
uuugauucagacagcugc

SEQ ID NO: 2998474 - RNA, 23 nt, Human
augucgucaaagcugaaauggac

SEQ ID NO: 2998475 - RNA, 13 nt, Human
augugagaccauu

SEQ ID NO: 2998476 - RNA, 14 nt, Human
augugagacugguu

SEQ ID NO: 2998477 - RNA, 19 nt, Human
auguauauuuuauaucaau

SEQ ID NO: 2998478 - RNA, 12 nt, Human
auguaucaauga

SEQ ID NO: 2998479 - RNA, 16 nt, Human
auguccaagaagccca

SEQ ID NO: 2998480 - RNA, 17 nt, Human
auguccaagaagcccag

SEQ ID NO: 2998481 - RNA, 14 nt, Human
uuuguacagacaac

SEQ ID NO: 2998482 - RNA, 16 nt, Human
uuuguaauuuuuuuau

SEQ ID NO: 2998483 - RNA, 23 nt, Human
uuugucuuaaaaaguggaaaaau

SEQ ID NO: 2998484 - RNA, 16 nt, Human
uuugugauacaaugcu

SEQ ID NO: 2998485 - RNA, 13 nt, Human
uuugucuuaaaaa

SEQ ID NO: 2998486 - RNA, 14 nt, Human
uuugucuuaaaaag

SEQ ID NO: 2998487 - RNA, 19 nt, Human
uuugugcauuaucuagaua

SEQ ID NO: 2998488 - RNA, 22 nt, Human
uuugugauacaaugcugugccc

SEQ ID NO: 2998489 - RNA, 15 nt, Human
uuugugauacaaugc

SEQ ID NO: 2998490 - RNA, 22 nt, Human
uuugugcauuaucuagauacug

SEQ ID NO: 2998491 - RNA, 14 nt, Human
uuuguuucugaaag

SEQ ID NO: 2998492 - RNA, 16 nt, Human
uuuguuucugaaaggg

SEQ ID NO: 2998493 - RNA, 21 nt, Human
auuccuaacuaucacugguuu

SEQ ID NO: 2998494 - RNA, 22 nt, Human
auuccccaggaggccagccuug

SEQ ID NO: 2998495 - RNA, 19 nt, Human
auucccaagcucugcuccu

SEQ ID NO: 2998496 - RNA, 18 nt, Human
auucccaagcucugcucc

SEQ ID NO: 2998497 - RNA, 20 nt, Human
auuccccaggaggccagccu

SEQ ID NO: 2998498 - RNA, 17 nt, Human
auuccaagugauugaaa

SEQ ID NO: 2998499 - RNA, 17 nt, Human
auucccaagcucugcuc

SEQ ID NO: 2998500 - RNA, 21 nt, Human
auuaguuuugaagauucuaug

SEQ ID NO: 2998501 - RNA, 20 nt, Human
auuauauggcuugaguuuaa

SEQ ID NO: 2998502 - RNA, 17 nt, Human
auuauugauguuuucau

SEQ ID NO: 2998503 - RNA, 22 nt, Human
auucaaacagucucaggaaauc

SEQ ID NO: 2998504 - RNA, 21 nt, Human
auucaccuccuaaaacaacag

SEQ ID NO: 2998505 - RNA, 18 nt, Human
auucaccuccuaaaacaa

SEQ ID NO: 2998506 - RNA, 19 nt, Human
auucaccuccuaaaacaac

SEQ ID NO: 2998507 - RNA, 15 nt, Human
uuuuugguauuugaa

SEQ ID NO: 2998508 - RNA, 13 nt, Human
auuaaggaagaca

SEQ ID NO: 2998509 - RNA, 19 nt, Human
auuaaguacuauguaucaa

SEQ ID NO: 2998510 - RNA, 16 nt, Human
auuaaguacuauguau

SEQ ID NO: 2998511 - RNA, 18 nt, Human
auuaaguacuauguauca

SEQ ID NO: 2998512 - RNA, 18 nt, Human
uuuuuggaaaagaauaaa

SEQ ID NO: 2998513 - RNA, 15 nt, Human
uuuuugaagcuguau

SEQ ID NO: 2998514 - RNA, 12 nt, Human
uuuuguguacuu

SEQ ID NO: 2998515 - RNA, 23 nt, Human
uuuugugcauuaucuagauacug

SEQ ID NO: 2998516 - RNA, 14 nt, Human
uuuugugaagcaaa

SEQ ID NO: 2998517 - RNA, 14 nt, Human
uuuuggaaaagaau

SEQ ID NO: 2998518 - RNA, 22 nt, Human
uuuuuauauucucagcagagug

SEQ ID NO: 2998519 - RNA, 21 nt, Human
uuuuuauauucucagcagagu

SEQ ID NO: 2998520 - RNA, 23 nt, Human
uuuuuauacauaaacaagaccac

SEQ ID NO: 2998521 - RNA, 20 nt, Human
uuuuguuuuuauuaaaagga

SEQ ID NO: 2998522 - RNA, 15 nt, Human
uuuuguuuucauuau

SEQ ID NO: 2998523 - RNA, 16 nt, Human
uuuuguuuuugucuua

SEQ ID NO: 2998524 - RNA, 16 nt, Human
auuacuguaagaaaau

SEQ ID NO: 2998525 - RNA, 15 nt, Human
auuacuguaagaaaa

SEQ ID NO: 2998526 - RNA, 13 nt, Human
auuagagaagaga

SEQ ID NO: 2998527 - RNA, 13 nt, Human
auuacuucugcua

SEQ ID NO: 2998528 - RNA, 12 nt, Human
auuacuucugcu

SEQ ID NO: 2998529 - RNA, 14 nt, Human
auuacuucugcuac

SEQ ID NO: 2998530 - RNA, 16 nt, Human
uuuaagacuuugguua

SEQ ID NO: 2998531 - RNA, 12 nt, Human
uuuaagagaaau

SEQ ID NO: 2998532 - RNA, 21 nt, Human
uuuaagcuguuacugucuuca

SEQ ID NO: 2998533 - RNA, 19 nt, Human
uuuaaggaugcuuguacau

SEQ ID NO: 2998534 - RNA, 15 nt, Human
uuuaaucuuuuauga

SEQ ID NO: 2998535 - RNA, 13 nt, Human
uuuaaucuuuuau

SEQ ID NO: 2998536 - RNA, 16 nt, Human
uuuaaugaaagacugu

SEQ ID NO: 2998537 - RNA, 21 nt, Human
uuuaagggcccuuuuucaaua

SEQ ID NO: 2998538 - RNA, 20 nt, Human
uuuaagggcccuuuuucaau

SEQ ID NO: 2998539 - RNA, 18 nt, Human
uuuaagggcccuuuuuca

SEQ ID NO: 2998540 - RNA, 21 nt, Human
uuuaaggaugcuuguacauaa

SEQ ID NO: 2998541 - RNA, 20 nt, Human
uuuaaggaugcuuguacaua

SEQ ID NO: 2998542 - RNA, 22 nt, Human
uuuaaggaugcuuguacauaau

SEQ ID NO: 2998543 - RNA, 21 nt, Human
uuuaaauauaugcuaagucuu

SEQ ID NO: 2998544 - RNA, 11 nt, Human
uuuaaaugcac

SEQ ID NO: 2998545 - RNA, 20 nt, Human
augcaaagaugaaggucugu

SEQ ID NO: 2998546 - RNA, 14 nt, Human
augcaaagcacuga

SEQ ID NO: 2998547 - RNA, 12 nt, Human
augcaaagcacu

SEQ ID NO: 2998548 - RNA, 13 nt, Human
augcaaagcacug

SEQ ID NO: 2998549 - RNA, 21 nt, Human
augcacuuuguucuggcucuu

SEQ ID NO: 2998550 - RNA, 18 nt, Human
uuuaaaaaaauuccaagu

SEQ ID NO: 2998551 - RNA, 23 nt, Human
augcacuuuguucuggcucuucc

SEQ ID NO: 2998552 - RNA, 13 nt, Human
augauuucauuca

SEQ ID NO: 2998553 - RNA, 16 nt, Human
augcaaaaaaaauuag

SEQ ID NO: 2998554 - RNA, 19 nt, Human
uuguucuugguuuguaaau

SEQ ID NO: 2998555 - RNA, 17 nt, Human
uuguucuugguuuguaa

SEQ ID NO: 2998556 - RNA, 16 nt, Human
uuguguacuuuuaaga

SEQ ID NO: 2998557 - RNA, 22 nt, Human
uugugaaugcagguuuuaucag

SEQ ID NO: 2998558 - RNA, 15 nt, Human
uuguccccgacccuu

SEQ ID NO: 2998559 - RNA, 16 nt, Human
uuguccccgacccuug

SEQ ID NO: 2998560 - RNA, 18 nt, Human
uuguccccaccgcagaca

SEQ ID NO: 2998561 - RNA, 20 nt, Human
uuguccccaccgcagacagg

SEQ ID NO: 2998562 - RNA, 15 nt, Human
uugucccaagugcca

SEQ ID NO: 2998563 - RNA, 17 nt, Human
uugugaggaagccgcug

SEQ ID NO: 2998564 - RNA, 18 nt, Human
uugugaggaagccgcugg

SEQ ID NO: 2998565 - RNA, 20 nt, Human
uugugauacaaugcugugcc

SEQ ID NO: 2998566 - RNA, 19 nt, Human
uugugauacaaugcugugc

SEQ ID NO: 2998567 - RNA, 13 nt, Human
uugugaggaagcc

SEQ ID NO: 2998568 - RNA, 15 nt, Human
augagguacugagag

SEQ ID NO: 2998569 - RNA, 18 nt, Human
augagguacugagaguga

SEQ ID NO: 2998570 - RNA, 17 nt, Human
augagguacugagagug

SEQ ID NO: 2998571 - RNA, 18 nt, Human
uuguagcauccuggaaua

SEQ ID NO: 2998572 - RNA, 16 nt, Human
uuguagcauccuggaa

SEQ ID NO: 2998573 - RNA, 18 nt, Human
augaggucagagccugca

SEQ ID NO: 2998574 - RNA, 16 nt, Human
augaggucagagccug

SEQ ID NO: 2998575 - RNA, 15 nt, Human
augaggucagagccu

SEQ ID NO: 2998576 - RNA, 20 nt, Human
augaggucagagccugcagu

SEQ ID NO: 2998577 - RNA, 19 nt, Human
augaggucagagccugcag

SEQ ID NO: 2998578 - RNA, 20 nt, Human
uugucaauaaaauccauaca

SEQ ID NO: 2998579 - RNA, 23 nt, Human
augaguccccuguuuguuucuga

SEQ ID NO: 2998580 - RNA, 13 nt, Human
augaguccccugu

SEQ ID NO: 2998581 - RNA, 17 nt, Human
uugucacacacuuuggc

SEQ ID NO: 2998582 - RNA, 21 nt, Human
uugucauauaagauucauauu

SEQ ID NO: 2998583 - RNA, 18 nt, Human
uuuaucagaacuauguuu

SEQ ID NO: 2998584 - RNA, 14 nt, Human
uuuaucagaauucu

SEQ ID NO: 2998585 - RNA, 18 nt, Human
augcuggcuguuggcugg

SEQ ID NO: 2998586 - RNA, 14 nt, Human
augcuccuggccca

SEQ ID NO: 2998587 - RNA, 19 nt, Human
augcuccuggcccacugca

SEQ ID NO: 2998588 - RNA, 16 nt, Human
augcuucucacugcca

SEQ ID NO: 2998589 - RNA, 20 nt, Human
augcuucucacugccaugcc

SEQ ID NO: 2998590 - RNA, 17 nt, Human
auggaagacagcucuua

SEQ ID NO: 2998591 - RNA, 18 nt, Human
auggaagacagcucuuau

SEQ ID NO: 2998592 - RNA, 22 nt, Human
augcuguauuuuaaaagaauga

SEQ ID NO: 2998593 - RNA, 19 nt, Human
augcuguauuuuaaaagaa

SEQ ID NO: 2998594 - RNA, 20 nt, Human
augcuggcuguuggcugggg

SEQ ID NO: 2998595 - RNA, 19 nt, Human
augcuggcuguuggcuggg

SEQ ID NO: 2998596 - RNA, 23 nt, Human
augcuguauuuuaaaagaaugau

SEQ ID NO: 2998597 - RNA, 23 nt, Human
augcuguucaugaaagauucaau

SEQ ID NO: 2998598 - RNA, 12 nt, Human
uuucagaaaugu

SEQ ID NO: 2998599 - RNA, 11 nt, Human
uuucagaaaug

SEQ ID NO: 2998600 - RNA, 19 nt, Human
uuucaugcuguucaugaaa

SEQ ID NO: 2998601 - RNA, 21 nt, Human
uuucaugcuguucaugaaaga

SEQ ID NO: 2998602 - RNA, 16 nt, Human
uuucccuauuagagaa

SEQ ID NO: 2998603 - RNA, 17 nt, Human
uuuccauuuacuuaaga

SEQ ID NO: 2998604 - RNA, 13 nt, Human
uuucacauuggaa

SEQ ID NO: 2998605 - RNA, 19 nt, Human
uuucacauuggaaacaagu

SEQ ID NO: 2998606 - RNA, 14 nt, Human
uuucacauuggaaa

SEQ ID NO: 2998607 - RNA, 12 nt, Human
uuucaaacuuua

SEQ ID NO: 2998608 - RNA, 19 nt, Human
uuucaaacauauauaacaa

SEQ ID NO: 2998609 - RNA, 20 nt, Human
auggaauucacaaaguaauu

SEQ ID NO: 2998610 - RNA, 17 nt, Human
uuucaaacauauauaac

SEQ ID NO: 2998611 - RNA, 16 nt, Human
auggaauucacaaagu

SEQ ID NO: 2998612 - RNA, 17 nt, Human
auggaauucacaaagua

SEQ ID NO: 2998613 - RNA, 15 nt, Human
augcccagugagacu

SEQ ID NO: 2998614 - RNA, 16 nt, Human
augcccagugagacug

SEQ ID NO: 2998615 - RNA, 17 nt, Human
augcccagccccuucug

SEQ ID NO: 2998616 - RNA, 20 nt, Human
augccccugaauuuaaauag

SEQ ID NO: 2998617 - RNA, 15 nt, Human
augccccugaauuua

SEQ ID NO: 2998618 - RNA, 21 nt, Human
augccaugaggaacaaggcaa

SEQ ID NO: 2998619 - RNA, 16 nt, Human
augcccagccccuucu

SEQ ID NO: 2998620 - RNA, 15 nt, Human
augcccagccccuuc

SEQ ID NO: 2998621 - RNA, 18 nt, Human
uuuaaucuuuuaugauug

SEQ ID NO: 2998622 - RNA, 23 nt, Human
uuuaaugaaagacuguacaaagu

SEQ ID NO: 2998623 - RNA, 21 nt, Human
uuuaaugaaagacuguacaaa

SEQ ID NO: 2998624 - RNA, 21 nt, Human
augccagggccaugucagaca

SEQ ID NO: 2998625 - RNA, 23 nt, Human
augccagggccaugucagacaca

SEQ ID NO: 2998626 - RNA, 22 nt, Human
augccuuuucccaacuccagaa

SEQ ID NO: 2998627 - RNA, 20 nt, Human
augccuuuucccaacuccag

SEQ ID NO: 2998628 - RNA, 15 nt, Human
augccucucucaggc

SEQ ID NO: 2998629 - RNA, 14 nt, Human
augccuuuucccaa

SEQ ID NO: 2998630 - RNA, 13 nt, Human
augccucucucag

SEQ ID NO: 2998631 - RNA, 14 nt, Human
augccucucucagg

SEQ ID NO: 2998632 - RNA, 18 nt, Human
augcuacaggauuugaaa

SEQ ID NO: 2998633 - RNA, 22 nt, Human
augcgugcauaccacuuuuguu

SEQ ID NO: 2998634 - RNA, 20 nt, Human
augcgugcauaccacuuuug

SEQ ID NO: 2998635 - RNA, 17 nt, Human
uuuaucagaacuauguu

SEQ ID NO: 2998636 - RNA, 16 nt, Human
uuuaucagaacuaugu

SEQ ID NO: 2998637 - RNA, 21 nt, Human
uuuauaugcuucuguuuuaua

SEQ ID NO: 2998638 - RNA, 19 nt, Human
uuuauaugcuucuguuuua

SEQ ID NO: 2998639 - RNA, 17 nt, Human
uuuagggguagcauuug

SEQ ID NO: 2998640 - RNA, 13 nt, Human
uuuacuucuuaua

SEQ ID NO: 2998641 - RNA, 12 nt, Human
uuuacuuaagac

SEQ ID NO: 2998642 - RNA, 14 nt, Human
uuuacuuaagacuu

SEQ ID NO: 2998643 - RNA, 14 nt, Human
uuuacuucuuauac

SEQ ID NO: 2998644 - RNA, 18 nt, Human
uuuaccugaagucuuugu

SEQ ID NO: 2998645 - RNA, 17 nt, Human
augcuacaguaauaaau

SEQ ID NO: 2998646 - RNA, 15 nt, Human
augcuacaguaauaa

SEQ ID NO: 2998647 - RNA, 16 nt, Human
uuuacugcagcuuugu

SEQ ID NO: 2998648 - RNA, 11 nt, Human
uuuacuuaaac

SEQ ID NO: 2998649 - RNA, 23 nt, Human
uugccaauuugcacauuaaauga

SEQ ID NO: 2998650 - RNA, 22 nt, Human
uugccaauuugcacauuaaaug

SEQ ID NO: 2998651 - RNA, 19 nt, Human
uugccaauuugcacauuaa

SEQ ID NO: 2998652 - RNA, 18 nt, Human
uugcccaggcaggucuug

SEQ ID NO: 2998653 - RNA, 16 nt, Human
uugcccaggcaggucu

SEQ ID NO: 2998654 - RNA, 14 nt, Human
uugcccaggcaggu

SEQ ID NO: 2998655 - RNA, 13 nt, Human
uugcccaggcagg

SEQ ID NO: 2998656 - RNA, 23 nt, Human
uugcccaggcuggcgugcagugg

SEQ ID NO: 2998657 - RNA, 14 nt, Human
uugcccaggcuggc

SEQ ID NO: 2998658 - RNA, 12 nt, Human
uugcccaggcug

SEQ ID NO: 2998659 - RNA, 11 nt, Human
uugcccaggcu

SEQ ID NO: 2998660 - RNA, 14 nt, Human
uugcaugaggcuag

SEQ ID NO: 2998661 - RNA, 12 nt, Human
uugcaugaggcu

SEQ ID NO: 2998662 - RNA, 19 nt, Human
uugcaugguuuggagcuga

SEQ ID NO: 2998663 - RNA, 14 nt, Human
uugcaauggcagcc

SEQ ID NO: 2998664 - RNA, 21 nt, Human
uugcaccacugcacuccagcc

SEQ ID NO: 2998665 - RNA, 17 nt, Human
aucucaaauuucuaaau

SEQ ID NO: 2998666 - RNA, 16 nt, Human
aucucaaauuucuaaa

SEQ ID NO: 2998667 - RNA, 23 nt, Human
aucucacacaugagcaucaggcc

SEQ ID NO: 2998668 - RNA, 18 nt, Human
aucucuugagccugggag

SEQ ID NO: 2998669 - RNA, 23 nt, Human
uugauguucuuucacccuuuucu

SEQ ID NO: 2998670 - RNA, 21 nt, Human
uugauuaaauucuugcaaagu

SEQ ID NO: 2998671 - RNA, 20 nt, Human
uugauuaaauucuugcaaag

SEQ ID NO: 2998672 - RNA, 16 nt, Human
uugauuaaauucuugc

SEQ ID NO: 2998673 - RNA, 15 nt, Human
uugauuaaauucuug

SEQ ID NO: 2998674 - RNA, 16 nt, Human
aucccuuucccuuggu

SEQ ID NO: 2998675 - RNA, 20 nt, Human
aucccuuggacauuuuaugu

SEQ ID NO: 2998676 - RNA, 21 nt, Human
aucccuuggacauuuuauguc

SEQ ID NO: 2998677 - RNA, 17 nt, Human
aucccuuggacauuuua

SEQ ID NO: 2998678 - RNA, 19 nt, Human
aucccuuggacauuuuaug

SEQ ID NO: 2998679 - RNA, 13 nt, Human
uugacaucaacug

SEQ ID NO: 2998680 - RNA, 16 nt, Human
uugacaucaacugcau

SEQ ID NO: 2998681 - RNA, 13 nt, Human
uugacaugggaca

SEQ ID NO: 2998682 - RNA, 12 nt, Human
uugacagggcac

SEQ ID NO: 2998683 - RNA, 10 nt, Human
uugacagggc

SEQ ID NO: 2998684 - RNA, 19 nt, Human
uugacaggauuauuggaaa

SEQ ID NO: 2998685 - RNA, 12 nt, Human
uugacuuuuuau

SEQ ID NO: 2998686 - RNA, 23 nt, Human
uugacauugaaaucuaggaaaau

SEQ ID NO: 2998687 - RNA, 14 nt, Human
uugacauugaaauc

SEQ ID NO: 2998688 - RNA, 16 nt, Human
uugagcagggcucagc

SEQ ID NO: 2998689 - RNA, 12 nt, Human
uugagcagggcu

SEQ ID NO: 2998690 - RNA, 11 nt, Human
uugagacagag

SEQ ID NO: 2998691 - RNA, 14 nt, Human
uugagugucaagcu

SEQ ID NO: 2998692 - RNA, 21 nt, Human
uugagugcugucuccauguuu

SEQ ID NO: 2998693 - RNA, 11 nt, Human
uugagugccuu

SEQ ID NO: 2998694 - RNA, 17 nt, Human
uugauacuacaguuugu

SEQ ID NO: 2998695 - RNA, 15 nt, Human
uugauacuacaguuu

SEQ ID NO: 2998696 - RNA, 18 nt, Human
uugauagcacagacccug

SEQ ID NO: 2998697 - RNA, 18 nt, Human
aucuagauacuguaucau

SEQ ID NO: 2998698 - RNA, 23 nt, Human
aucuaauauguaacaagccaccc

SEQ ID NO: 2998699 - RNA, 20 nt, Human
aucuaauauguaacaagcca

SEQ ID NO: 2998700 - RNA, 21 nt, Human
aucucaaauaacuaaaaggua

SEQ ID NO: 2998701 - RNA, 14 nt, Human
aucucaaauaacua

SEQ ID NO: 2998702 - RNA, 23 nt, Human
aucucaaauaacuaaaagguaug

SEQ ID NO: 2998703 - RNA, 14 nt, Human
aucucaaauuucua

SEQ ID NO: 2998704 - RNA, 19 nt, Human
aucucaaaacugcacuguc

SEQ ID NO: 2998705 - RNA, 20 nt, Human
aucucaaaacugcacuguca

SEQ ID NO: 2998706 - RNA, 15 nt, Human
aucucaaaacugcac

SEQ ID NO: 2998707 - RNA, 17 nt, Human
aucuaggaagacuuugg

SEQ ID NO: 2998708 - RNA, 18 nt, Human
aucuaggaagacuuugga

SEQ ID NO: 2998709 - RNA, 19 nt, Human
aucuaggaagacuuuggaa

SEQ ID NO: 2998710 - RNA, 14 nt, Human
aucuaggaaaauua

SEQ ID NO: 2998711 - RNA, 16 nt, Human
aucuaggaaaauuauu

SEQ ID NO: 2998712 - RNA, 19 nt, Human
aucuagauacuguaucaug

SEQ ID NO: 2998713 - RNA, 19 nt, Human
aucugugaugacauucccu

SEQ ID NO: 2998714 - RNA, 21 nt, Human
aucugugaugacauucccugc

SEQ ID NO: 2998715 - RNA, 21 nt, Human
aucuuaaaaacaacgaaagaa

SEQ ID NO: 2998716 - RNA, 14 nt, Human
aucuuaaaaacaac

SEQ ID NO: 2998717 - RNA, 13 nt, Human
aucuuaaaaacaa

SEQ ID NO: 2998718 - RNA, 22 nt, Human
aucugucauuugagcagggcuc

SEQ ID NO: 2998719 - RNA, 17 nt, Human
aucugucauuugagcag

SEQ ID NO: 2998720 - RNA, 12 nt, Human
aucugucauuug

SEQ ID NO: 2998721 - RNA, 15 nt, Human
aucuuauaauuuaaa

SEQ ID NO: 2998722 - RNA, 16 nt, Human
aucuuauaauuuaaaa

SEQ ID NO: 2998723 - RNA, 14 nt, Human
aucuugcucugcug

SEQ ID NO: 2998724 - RNA, 14 nt, Human
aucuuauaauuuaa

SEQ ID NO: 2998725 - RNA, 16 nt, Human
aucuugcucugcugac

SEQ ID NO: 2998726 - RNA, 15 nt, Human
aucuugcucugcuga

SEQ ID NO: 2998727 - RNA, 22 nt, Human
uuggagaagaacugaaaucaua

SEQ ID NO: 2998728 - RNA, 17 nt, Human
uuggagaagaacugaaa

SEQ ID NO: 2998729 - RNA, 15 nt, Human
uuggagaagaacuga

SEQ ID NO: 2998730 - RNA, 17 nt, Human
uuggaaaauaaauuauu

SEQ ID NO: 2998731 - RNA, 20 nt, Human
uugcuuugugauuuuuguaa

SEQ ID NO: 2998732 - RNA, 15 nt, Human
uugcuuugugauuuu

SEQ ID NO: 2998733 - RNA, 12 nt, Human
aucuuuaaaaua

SEQ ID NO: 2998734 - RNA, 15 nt, Human
aucuuuaaaauacac

SEQ ID NO: 2998735 - RNA, 13 nt, Human
uuggcccaggagu

SEQ ID NO: 2998736 - RNA, 14 nt, Human
uuggcccaggaguu

SEQ ID NO: 2998737 - RNA, 15 nt, Human
uuggcccaggaguuu

SEQ ID NO: 2998738 - RNA, 20 nt, Human
uuggcccaggaguuuggcca

SEQ ID NO: 2998739 - RNA, 21 nt, Human
uuggcccaggaguuuggccag

SEQ ID NO: 2998740 - RNA, 22 nt, Human
uuggcccaggaguuuggccaga

SEQ ID NO: 2998741 - RNA, 20 nt, Human
uuggcccaggauuauuguca

SEQ ID NO: 2998742 - RNA, 22 nt, Human
augaaccacaucuugcucugcu

SEQ ID NO: 2998743 - RNA, 23 nt, Human
augaaccacaucuugcucugcug

SEQ ID NO: 2998744 - RNA, 18 nt, Human
augaacuuguaaaggaau

SEQ ID NO: 2998745 - RNA, 17 nt, Human
augaaugaaacauuuug

SEQ ID NO: 2998746 - RNA, 21 nt, Human
augaaugucacuucuggauau

SEQ ID NO: 2998747 - RNA, 19 nt, Human
augaaugucacuucuggau

SEQ ID NO: 2998748 - RNA, 20 nt, Human
uugguuuucacauuggaaac

SEQ ID NO: 2998749 - RNA, 14 nt, Human
uugguuuguaaauu

SEQ ID NO: 2998750 - RNA, 18 nt, Human
uuggugucgggcaugaca

SEQ ID NO: 2998751 - RNA, 19 nt, Human
uuggugucgggcaugacac

SEQ ID NO: 2998752 - RNA, 17 nt, Human
uuggugucgggcaugac

SEQ ID NO: 2998753 - RNA, 16 nt, Human
augaaugucaguguga

SEQ ID NO: 2998754 - RNA, 18 nt, Human
augaaugucagugugacu

SEQ ID NO: 2998755 - RNA, 19 nt, Human
uuggugguuucagaaaugu

SEQ ID NO: 2998756 - RNA, 18 nt, Human
uuggugguuucagaaaug

SEQ ID NO: 2998757 - RNA, 13 nt, Human
auauaagguuuuu

SEQ ID NO: 2998758 - RNA, 19 nt, Human
auauaagcuuguauuccuu

SEQ ID NO: 2998759 - RNA, 15 nt, Human
auauaacaaugcugu

SEQ ID NO: 2998760 - RNA, 12 nt, Human
auauaacaaugc

SEQ ID NO: 2998761 - RNA, 18 nt, Human
auauauaacaaugcugua

SEQ ID NO: 2998762 - RNA, 17 nt, Human
auauauaacaaugcugu

SEQ ID NO: 2998763 - RNA, 14 nt, Human
auauauaacaaugc

SEQ ID NO: 2998764 - RNA, 18 nt, Human
auagucaaauugugugaa

SEQ ID NO: 2998765 - RNA, 17 nt, Human
auagucaaauuguguga

SEQ ID NO: 2998766 - RNA, 15 nt, Human
uucagcccucagaau

SEQ ID NO: 2998767 - RNA, 14 nt, Human
uucagccaagaauu

SEQ ID NO: 2998768 - RNA, 19 nt, Human
uucagccaagaauucuuaa

SEQ ID NO: 2998769 - RNA, 17 nt, Human
uucagaucucuaacuuc

SEQ ID NO: 2998770 - RNA, 18 nt, Human
uucacugguacucugcca

SEQ ID NO: 2998771 - RNA, 11 nt, Human
uucauagagaa

SEQ ID NO: 2998772 - RNA, 18 nt, Human
uucauagagaauauaaaa

SEQ ID NO: 2998773 - RNA, 21 nt, Human
uucauauuuacuucuuauaca

SEQ ID NO: 2998774 - RNA, 16 nt, Human
uucauauuuacuucuu

SEQ ID NO: 2998775 - RNA, 14 nt, Human
uucaguaauaacuc

SEQ ID NO: 2998776 - RNA, 20 nt, Human
uucauauuuaauuugaaggu

SEQ ID NO: 2998777 - RNA, 18 nt, Human
uucaucauccuaagcuau

SEQ ID NO: 2998778 - RNA, 21 nt, Human
uucaucauccuaagcuauuca

SEQ ID NO: 2998779 - RNA, 14 nt, Human
auauauuauuugca

SEQ ID NO: 2998780 - RNA, 22 nt, Human
auaucuauauuuuacauaaauu

SEQ ID NO: 2998781 - RNA, 20 nt, Human
auaucuauauuuuacauaaa

SEQ ID NO: 2998782 - RNA, 16 nt, Human
auaucuauauuuuaca

SEQ ID NO: 2998783 - RNA, 17 nt, Human
auaucuauauuuuacau

SEQ ID NO: 2998784 - RNA, 22 nt, Human
auaucugaaaauguauguguaa

SEQ ID NO: 2998785 - RNA, 20 nt, Human
auaugauuuaaaucagccgu

SEQ ID NO: 2998786 - RNA, 22 nt, Human
auaugauucaaaugucuauaaa

SEQ ID NO: 2998787 - RNA, 13 nt, Human
auaugauucaaau

SEQ ID NO: 2998788 - RNA, 12 nt, Human
auaugauucaaa

SEQ ID NO: 2998789 - RNA, 13 nt, Human
auaugugaacagu

SEQ ID NO: 2998790 - RNA, 14 nt, Human
auaugucaagccau

SEQ ID NO: 2998791 - RNA, 16 nt, Human
auaugcaaagcacuga

SEQ ID NO: 2998792 - RNA, 15 nt, Human
auaugcaaagcacug

SEQ ID NO: 2998793 - RNA, 23 nt, Human
auaugcaaagcacugacuucuaa

SEQ ID NO: 2998794 - RNA, 21 nt, Human
uuauuucucucaucuguuaca

SEQ ID NO: 2998795 - RNA, 17 nt, Human
uucaaaauaaaaaugag

SEQ ID NO: 2998796 - RNA, 15 nt, Human
uucaaacauauauaa

SEQ ID NO: 2998797 - RNA, 14 nt, Human
uucaaacauauaua

SEQ ID NO: 2998798 - RNA, 16 nt, Human
uucaaggauccugagc

SEQ ID NO: 2998799 - RNA, 18 nt, Human
uucaaggauccugagcca

SEQ ID NO: 2998800 - RNA, 19 nt, Human
uucaaggauccugagccag

SEQ ID NO: 2998801 - RNA, 21 nt, Human
uucaaggauccugagccagau

SEQ ID NO: 2998802 - RNA, 15 nt, Human
uucaaggauccugag

SEQ ID NO: 2998803 - RNA, 22 nt, Human
auagcugugauuuuugguauuu

SEQ ID NO: 2998804 - RNA, 21 nt, Human
auaggaauugacccacaagaa

SEQ ID NO: 2998805 - RNA, 19 nt, Human
auaggaacuuaaauaaugu

SEQ ID NO: 2998806 - RNA, 17 nt, Human
auaggcacuuuaaaaca

SEQ ID NO: 2998807 - RNA, 22 nt, Human
uucaccacaugugcacaugcac

SEQ ID NO: 2998808 - RNA, 14 nt, Human
uucacauuggaaac

SEQ ID NO: 2998809 - RNA, 17 nt, Human
uucacauauugauuucc

SEQ ID NO: 2998810 - RNA, 13 nt, Human
uucacauuggaaa

SEQ ID NO: 2998811 - RNA, 12 nt, Human
auaacuuuuuau

SEQ ID NO: 2998812 - RNA, 18 nt, Human
auagccugccucuucucu

SEQ ID NO: 2998813 - RNA, 17 nt, Human
auaagauaaaugugcug

SEQ ID NO: 2998814 - RNA, 13 nt, Human
auaagauaaaugu

SEQ ID NO: 2998815 - RNA, 14 nt, Human
auagcuacuaauuu

SEQ ID NO: 2998816 - RNA, 17 nt, Human
auagcuacuaauuuuaa

SEQ ID NO: 2998817 - RNA, 18 nt, Human
auagcuacuaauuuuaaa

SEQ ID NO: 2998818 - RNA, 22 nt, Human
auagcuaggugacauauacaua

SEQ ID NO: 2998819 - RNA, 19 nt, Human
auagcucaggugucccugc

SEQ ID NO: 2998820 - RNA, 12 nt, Human
auagcugggacu

SEQ ID NO: 2998821 - RNA, 21 nt, Human
auagcucaggugucccugcac

SEQ ID NO: 2998822 - RNA, 20 nt, Human
auagcucaggugucccugca

SEQ ID NO: 2998823 - RNA, 22 nt, Human
auagcucaggugucccugcacu

SEQ ID NO: 2998824 - RNA, 19 nt, Human
auagcugugauuuuuggua

SEQ ID NO: 2998825 - RNA, 17 nt, Human
uuauuguuuaaaaucau

SEQ ID NO: 2998826 - RNA, 22 nt, Human
auagcuggucuuauuuguaaag

SEQ ID NO: 2998827 - RNA, 17 nt, Human
auagcugggacuacagg

SEQ ID NO: 2998828 - RNA, 23 nt, Human
auagcuggucuuauuuguaaagc

SEQ ID NO: 2998829 - RNA, 13 nt, Human
uuauuuaaauaga

SEQ ID NO: 2998830 - RNA, 14 nt, Human
uuauuuaaauuuua

SEQ ID NO: 2998831 - RNA, 22 nt, Human
uuauuuaaugaaagacuguaca

SEQ ID NO: 2998832 - RNA, 18 nt, Human
uuauuuaaugaaagacug

SEQ ID NO: 2998833 - RNA, 11 nt, Human
uuauuuauuga

SEQ ID NO: 2998834 - RNA, 14 nt, Human
uuauuuacaaaugu

SEQ ID NO: 2998835 - RNA, 16 nt, Human
uuauuuaguuccuuga

SEQ ID NO: 2998836 - RNA, 13 nt, Human
uucucacagaaga

SEQ ID NO: 2998837 - RNA, 23 nt, Human
uucucagaaucucaaauaacuaa

SEQ ID NO: 2998838 - RNA, 22 nt, Human
uucucagaaucucaaauaacua

SEQ ID NO: 2998839 - RNA, 19 nt, Human
uucucagaaucucaaauaa

SEQ ID NO: 2998840 - RNA, 13 nt, Human
uucucagaaucuc

SEQ ID NO: 2998841 - RNA, 18 nt, Human
uucucaacuccaaacuga

SEQ ID NO: 2998842 - RNA, 14 nt, Human
uucucaacuccaaa

SEQ ID NO: 2998843 - RNA, 13 nt, Human
uucuaggccuggg

SEQ ID NO: 2998844 - RNA, 23 nt, Human
uucuaggacugaauuaugaaacu

SEQ ID NO: 2998845 - RNA, 14 nt, Human
aucauugaaaucuu

SEQ ID NO: 2998846 - RNA, 15 nt, Human
aucauugaaaucuuu

SEQ ID NO: 2998847 - RNA, 13 nt, Human
aucauugaaaucu

SEQ ID NO: 2998848 - RNA, 22 nt, Human
aucauuaaagccugaguuugcu

SEQ ID NO: 2998849 - RNA, 17 nt, Human
aucauguuuaugagaaa

SEQ ID NO: 2998850 - RNA, 18 nt, Human
aucagcacgauuucuguu

SEQ ID NO: 2998851 - RNA, 17 nt, Human
aucagcacgauuucugu

SEQ ID NO: 2998852 - RNA, 16 nt, Human
aucagcacgauuucug

SEQ ID NO: 2998853 - RNA, 15 nt, Human
aucagcacgauuucu

SEQ ID NO: 2998854 - RNA, 13 nt, Human
aucccucccucca

SEQ ID NO: 2998855 - RNA, 11 nt, Human
aucccucccuc

SEQ ID NO: 2998856 - RNA, 23 nt, Human
aucccucccuccaccucccugca

SEQ ID NO: 2998857 - RNA, 21 nt, Human
aucccucccuccaccucccug

SEQ ID NO: 2998858 - RNA, 17 nt, Human
aucccauaugccugggc

SEQ ID NO: 2998859 - RNA, 16 nt, Human
aucccauaugccuggg

SEQ ID NO: 2998860 - RNA, 20 nt, Human
aucauuucugcaucagcugc

SEQ ID NO: 2998861 - RNA, 16 nt, Human
auccagguucagcuug

SEQ ID NO: 2998862 - RNA, 15 nt, Human
auccagguucagcuu

SEQ ID NO: 2998863 - RNA, 22 nt, Human
uucugggacacaguucaauucu

SEQ ID NO: 2998864 - RNA, 11 nt, Human
uucugggacac

SEQ ID NO: 2998865 - RNA, 10 nt, Human
uucugggaca

SEQ ID NO: 2998866 - RNA, 23 nt, Human
uucugccgcagcccugcagaggg

SEQ ID NO: 2998867 - RNA, 16 nt, Human
uucugccgcagcccug

SEQ ID NO: 2998868 - RNA, 20 nt, Human
uucugaaaugucaguucuga

SEQ ID NO: 2998869 - RNA, 21 nt, Human
uucugaaauuuccugggagcu

SEQ ID NO: 2998870 - RNA, 23 nt, Human
uucugaacuuggcgcugccccug

SEQ ID NO: 2998871 - RNA, 13 nt, Human
uucugaagaagau

SEQ ID NO: 2998872 - RNA, 12 nt, Human
uucugaagaaga

SEQ ID NO: 2998873 - RNA, 23 nt, Human
uucugcaucagcugcugaaacaa

SEQ ID NO: 2998874 - RNA, 16 nt, Human
uucugcaucagcugcu

SEQ ID NO: 2998875 - RNA, 19 nt, Human
aucauugaaaucuuuuugc

SEQ ID NO: 2998876 - RNA, 15 nt, Human
uucugaaagggacgc

SEQ ID NO: 2998877 - RNA, 23 nt, Human
auauuucugaggagccugcaaca

SEQ ID NO: 2998878 - RNA, 13 nt, Human
auauuugaaauau

SEQ ID NO: 2998879 - RNA, 20 nt, Human
auauuguuuucaguguacau

SEQ ID NO: 2998880 - RNA, 17 nt, Human
auauuguuuucagugua

SEQ ID NO: 2998881 - RNA, 20 nt, Human
auauugcauacuauuaaaca

SEQ ID NO: 2998882 - RNA, 22 nt, Human
auauugcauacuauuaaacaug

SEQ ID NO: 2998883 - RNA, 16 nt, Human
auauugccaaugcuac

SEQ ID NO: 2998884 - RNA, 17 nt, Human
auauugcugauggugca

SEQ ID NO: 2998885 - RNA, 21 nt, Human
auauugcugauggugcaauga

SEQ ID NO: 2998886 - RNA, 12 nt, Human
auauuuuaacuu

SEQ ID NO: 2998887 - RNA, 22 nt, Human
auauuuguaucacaaaucuuaa

SEQ ID NO: 2998888 - RNA, 19 nt, Human
auauuugaaauauugacuu

SEQ ID NO: 2998889 - RNA, 14 nt, Human
auauuugaaauauu

SEQ ID NO: 2998890 - RNA, 23 nt, Human
auauuugaaauauugacuuuuua

SEQ ID NO: 2998891 - RNA, 18 nt, Human
auauucucagcagagugc

SEQ ID NO: 2998892 - RNA, 17 nt, Human
auauucucagcagagug

SEQ ID NO: 2998893 - RNA, 15 nt, Human
auauucucagcagag

SEQ ID NO: 2998894 - RNA, 16 nt, Human
auauucucagcagagu

SEQ ID NO: 2998895 - RNA, 21 nt, Human
auauucucacagcuccaagaa

SEQ ID NO: 2998896 - RNA, 16 nt, Human
auauucuguuggccag

SEQ ID NO: 2998897 - RNA, 23 nt, Human
auauucucacagcuccaagaauu

SEQ ID NO: 2998898 - RNA, 22 nt, Human
auauucucacagcuccaagaau

SEQ ID NO: 2998899 - RNA, 22 nt, Human
auauugauuuccguuaaaauac

SEQ ID NO: 2998900 - RNA, 21 nt, Human
auauugauuuccguuaaaaua

SEQ ID NO: 2998901 - RNA, 19 nt, Human
auauugauuuccguuaaaa

SEQ ID NO: 2998902 - RNA, 22 nt, Human
auauuaaggaagacaaugugaa

SEQ ID NO: 2998903 - RNA, 24 nt, Human
auauuaagaaagacuaucuaaaug

SEQ ID NO: 2998904 - RNA, 18 nt, Human
auauguuucacacaaaca

SEQ ID NO: 2998905 - RNA, 14 nt, Human
auauguuucacaca

SEQ ID NO: 2998906 - RNA, 21 nt, Human
auauguuucacacaaacaagg

SEQ ID NO: 2998907 - RNA, 18 nt, Human
auauguuuuaagaggcag

SEQ ID NO: 2998908 - RNA, 20 nt, Human
auauguuuuaagaggcaggg

SEQ ID NO: 2998909 - RNA, 19 nt, Human
aucaauuuuucuuauuuca

SEQ ID NO: 2998910 - RNA, 22 nt, Human
aucacggcucacugcagccuca

SEQ ID NO: 2998911 - RNA, 18 nt, Human
aucaaguauuauaccuuu

SEQ ID NO: 2998912 - RNA, 14 nt, Human
aucaaguauuauac

SEQ ID NO: 2998913 - RNA, 13 nt, Human
aucaaguauuaua

SEQ ID NO: 2998914 - RNA, 13 nt, Human
aucaaguauagaa

SEQ ID NO: 2998915 - RNA, 16 nt, Human
aucaaguauagaaaau

SEQ ID NO: 2998916 - RNA, 15 nt, Human
aucaaguauagaaaa

SEQ ID NO: 2998917 - RNA, 21 nt, Human
aucaaguauagaaaaucuuca

SEQ ID NO: 2998918 - RNA, 19 nt, Human
aucaaguauagaaaaucuu

SEQ ID NO: 2998919 - RNA, 17 nt, Human
aucaaguauagaaaauc

SEQ ID NO: 2998920 - RNA, 13 nt, Human
uuccuaauccucu

SEQ ID NO: 2998921 - RNA, 15 nt, Human
uuccuaauccucuag

SEQ ID NO: 2998922 - RNA, 15 nt, Human
uuccugggagcuuuu

SEQ ID NO: 2998923 - RNA, 11 nt, Human
uuccucuuucc

SEQ ID NO: 2998924 - RNA, 16 nt, Human
uuccugggagcuuuug

SEQ ID NO: 2998925 - RNA, 17 nt, Human
uuccuguucccaugaga

SEQ ID NO: 2998926 - RNA, 11 nt, Human
uuccuucagug

SEQ ID NO: 2998927 - RNA, 14 nt, Human
uuccuucagugccu

SEQ ID NO: 2998928 - RNA, 21 nt, Human
auauuuucaugcuguucauga

SEQ ID NO: 2998929 - RNA, 18 nt, Human
auauuuucaugcuguuca

SEQ ID NO: 2998930 - RNA, 18 nt, Human
ugugaugacauucccugc

SEQ ID NO: 2998931 - RNA, 19 nt, Human
ugugauggggcccugccuc

SEQ ID NO: 2998932 - RNA, 20 nt, Human
ugugauggggcccugccucc

SEQ ID NO: 2998933 - RNA, 18 nt, Human
ugugauggggcccugccu

SEQ ID NO: 2998934 - RNA, 16 nt, Human
agugaacaaauuuaca

SEQ ID NO: 2998935 - RNA, 15 nt, Human
agugaaagaaaauaa

SEQ ID NO: 2998936 - RNA, 16 nt, Human
ugugccaugugccagg

SEQ ID NO: 2998937 - RNA, 12 nt, Human
ugugccaugugc

SEQ ID NO: 2998938 - RNA, 20 nt, Human
ugugccagguuuuuggucug

SEQ ID NO: 2998939 - RNA, 23 nt, Human
ugugcauuuggugguuucagaaa

SEQ ID NO: 2998940 - RNA, 17 nt, Human
uguggaguucaucuuga

SEQ ID NO: 2998941 - RNA, 21 nt, Human
uguggaguucaucuugaauug

SEQ ID NO: 2998942 - RNA, 21 nt, Human
ugugcccccauguaagcaccc

SEQ ID NO: 2998943 - RNA, 19 nt, Human
agugaggcucugcccuugg

SEQ ID NO: 2998944 - RNA, 20 nt, Human
agugaggcucugcccuuggu

SEQ ID NO: 2998945 - RNA, 21 nt, Human
agugaggcucugcccuugguu

SEQ ID NO: 2998946 - RNA, 21 nt, Human
agugaguugauagcacagacc

SEQ ID NO: 2998947 - RNA, 15 nt, Human
agugagucgaggaca

SEQ ID NO: 2998948 - RNA, 15 nt, Human
agugaggcucugccc

SEQ ID NO: 2998949 - RNA, 14 nt, Human
agugaggcucugcc

SEQ ID NO: 2998950 - RNA, 16 nt, Human
agugaggcucugcccu

SEQ ID NO: 2998951 - RNA, 17 nt, Human
agugaggcucugcccuu

SEQ ID NO: 2998952 - RNA, 21 nt, Human
agucuucaguuugcagaguag

SEQ ID NO: 2998953 - RNA, 20 nt, Human
agucuucaguuugcagagua

SEQ ID NO: 2998954 - RNA, 18 nt, Human
agucuucaguuugcagag

SEQ ID NO: 2998955 - RNA, 23 nt, Human
agucuuagauguauauauuuccu

SEQ ID NO: 2998956 - RNA, 18 nt, Human
agucuuucacauuuaaau

SEQ ID NO: 2998957 - RNA, 20 nt, Human
agugaaacucguuaauuugu

SEQ ID NO: 2998958 - RNA, 14 nt, Human
agucuuuguacaga

SEQ ID NO: 2998959 - RNA, 16 nt, Human
agucucaggaaaucaa

SEQ ID NO: 2998960 - RNA, 22 nt, Human
agucucaggaaaucaaauaugc

SEQ ID NO: 2998961 - RNA, 19 nt, Human
ugugagaugcuagaacucc

SEQ ID NO: 2998962 - RNA, 15 nt, Human
ugugagaugcuagaa

SEQ ID NO: 2998963 - RNA, 15 nt, Human
ugugacugaauuucu

SEQ ID NO: 2998964 - RNA, 16 nt, Human
ugugacugaauuucuu

SEQ ID NO: 2998965 - RNA, 12 nt, Human
ugucagacacag

SEQ ID NO: 2998966 - RNA, 13 nt, Human
ugucagacacaga

SEQ ID NO: 2998967 - RNA, 14 nt, Human
ugucagacacagau

SEQ ID NO: 2998968 - RNA, 18 nt, Human
ugugaaaggaaagaggcu

SEQ ID NO: 2998969 - RNA, 21 nt, Human
ugugaaaggaaagagggaggu

SEQ ID NO: 2998970 - RNA, 15 nt, Human
ugugaaaggaaagag

SEQ ID NO: 2998971 - RNA, 17 nt, Human
ugugaaccaccacaccc

SEQ ID NO: 2998972 - RNA, 21 nt, Human
ugugaaccaccacacccagcc

SEQ ID NO: 2998973 - RNA, 20 nt, Human
ugugaaccaccacacccagc

SEQ ID NO: 2998974 - RNA, 20 nt, Human
ugugaacaguuguguuugaa

SEQ ID NO: 2998975 - RNA, 19 nt, Human
ugugaaccaccacacccag

SEQ ID NO: 2998976 - RNA, 23 nt, Human
uguggguuucuaaagcugccagc

SEQ ID NO: 2998977 - RNA, 20 nt, Human
uguggucacaggaaguagag

SEQ ID NO: 2998978 - RNA, 21 nt, Human
uguggguuucuaaagcugcca

SEQ ID NO: 2998979 - RNA, 14 nt, Human
ugugguguuuccug

SEQ ID NO: 2998980 - RNA, 16 nt, Human
ugugguguuuccuggc

SEQ ID NO: 2998981 - RNA, 18 nt, Human
uguguaagacaaaaagcu

SEQ ID NO: 2998982 - RNA, 13 nt, Human
uguggucccaccc

SEQ ID NO: 2998983 - RNA, 15 nt, Human
uguggucccacccca

SEQ ID NO: 2998984 - RNA, 22 nt, Human
agugaguugauagcacagaccc

SEQ ID NO: 2998985 - RNA, 23 nt, Human
agugaguugauagcacagacccu

SEQ ID NO: 2998986 - RNA, 13 nt, Human
agugcugcauuua

SEQ ID NO: 2998987 - RNA, 12 nt, Human
agugcugcauuu

SEQ ID NO: 2998988 - RNA, 21 nt, Human
agugcugggauuacaggugug

SEQ ID NO: 2998989 - RNA, 17 nt, Human
agugcugcauuuaaaag

SEQ ID NO: 2998990 - RNA, 16 nt, Human
agugcugcauuuaaaa

SEQ ID NO: 2998991 - RNA, 19 nt, Human
agugcugcauuuaaaagau

SEQ ID NO: 2998992 - RNA, 20 nt, Human
agugcugggauuacaggugu

SEQ ID NO: 2998993 - RNA, 17 nt, Human
ugugucucuugguccug

SEQ ID NO: 2998994 - RNA, 20 nt, Human
ugugucucuugguccugcug

SEQ ID NO: 2998995 - RNA, 13 nt, Human
uguguaaguagau

SEQ ID NO: 2998996 - RNA, 21 nt, Human
ugugucucuugguccugcugc

SEQ ID NO: 2998997 - RNA, 20 nt, Human
ugugucuugcaauggcagcc

SEQ ID NO: 2998998 - RNA, 21 nt, Human
ugugucuugcaauggcagccu

SEQ ID NO: 2998999 - RNA, 16 nt, Human
ugugucucuugguccu

SEQ ID NO: 2999000 - RNA, 19 nt, Human
uguguguuuauugucaaag

SEQ ID NO: 2999001 - RNA, 23 nt, Human
uguguguuuauugucaaaguggu

SEQ ID NO: 2999002 - RNA, 13 nt, Human
uguguugaagagg

SEQ ID NO: 2999003 - RNA, 16 nt, Human
agugugguguuuccug

SEQ ID NO: 2999004 - RNA, 19 nt, Human
agugugguguuuccuggca

SEQ ID NO: 2999005 - RNA, 17 nt, Human
agugugguguuuccugg

SEQ ID NO: 2999006 - RNA, 22 nt, Human
agugugauguauguguaauaaa

SEQ ID NO: 2999007 - RNA, 18 nt, Human
agugugauguauguguaa

SEQ ID NO: 2999008 - RNA, 23 nt, Human
agugugauguauguguaauaaau

SEQ ID NO: 2999009 - RNA, 23 nt, Human
aguggugguuuucuguucuuucu

SEQ ID NO: 2999010 - RNA, 21 nt, Human
aguggugguuuucuguucuuu

SEQ ID NO: 2999011 - RNA, 20 nt, Human
aguggugguuuucuguucuu

SEQ ID NO: 2999012 - RNA, 19 nt, Human
aguggugguuuucuguucu

SEQ ID NO: 2999013 - RNA, 18 nt, Human
aguggugguuuucuguuc

SEQ ID NO: 2999014 - RNA, 17 nt, Human
aguggugguuuucuguu

SEQ ID NO: 2999015 - RNA, 21 nt, Human
agugguggugaacagaacaaa

SEQ ID NO: 2999016 - RNA, 14 nt, Human
aguggaauaagaca

SEQ ID NO: 2999017 - RNA, 17 nt, Human
aguggugcgaucugggu

SEQ ID NO: 2999018 - RNA, 16 nt, Human
aguggugcgaucuggg

SEQ ID NO: 2999019 - RNA, 18 nt, Human
uguugcccaggcaggucu

SEQ ID NO: 2999020 - RNA, 17 nt, Human
uguugcccaggcagguc

SEQ ID NO: 2999021 - RNA, 16 nt, Human
uguugcccaggcaggu

SEQ ID NO: 2999022 - RNA, 15 nt, Human
uguugcccaggcagg

SEQ ID NO: 2999023 - RNA, 12 nt, Human
uguugcccaggc

SEQ ID NO: 2999024 - RNA, 13 nt, Human
uguugcccaggca

SEQ ID NO: 2999025 - RNA, 14 nt, Human
uguuccuagugaaa

SEQ ID NO: 2999026 - RNA, 18 nt, Human
uguuccuagugaaagagg

SEQ ID NO: 2999027 - RNA, 16 nt, Human
uguucugggacacagu

SEQ ID NO: 2999028 - RNA, 15 nt, Human
uguuauaaucuuuca

SEQ ID NO: 2999029 - RNA, 12 nt, Human
uguuauaaucuu

SEQ ID NO: 2999030 - RNA, 20 nt, Human
agugugucuuagugugugca

SEQ ID NO: 2999031 - RNA, 20 nt, Human
uguuccacaaguuaaauaaa

SEQ ID NO: 2999032 - RNA, 15 nt, Human
aguuggguuuuuuaa

SEQ ID NO: 2999033 - RNA, 18 nt, Human
aguuggucccccuuccau

SEQ ID NO: 2999034 - RNA, 21 nt, Human
aguuguuugauucagacagcu

SEQ ID NO: 2999035 - RNA, 23 nt, Human
aguuguuugauucagacagcugc

SEQ ID NO: 2999036 - RNA, 16 nt, Human
aguuuagcuggaaaag

SEQ ID NO: 2999037 - RNA, 21 nt, Human
aguuggguggaugccuggugg

SEQ ID NO: 2999038 - RNA, 17 nt, Human
aguuggguggaugccug

SEQ ID NO: 2999039 - RNA, 16 nt, Human
aguuggcuaggacccc

SEQ ID NO: 2999040 - RNA, 20 nt, Human
uuaaaaagaaaaguuuauaa

SEQ ID NO: 2999041 - RNA, 22 nt, Human
uuaaaaacaacgaaagaaggca

SEQ ID NO: 2999042 - RNA, 13 nt, Human
aguuuauaaaagu

SEQ ID NO: 2999043 - RNA, 20 nt, Human
uuaaagcuuccauuguuguc

SEQ ID NO: 2999044 - RNA, 20 nt, Human
uuaaauucuugcaaaguauc

SEQ ID NO: 2999045 - RNA, 14 nt, Human
uguugcuaacagca

SEQ ID NO: 2999046 - RNA, 19 nt, Human
uguugcccaggcaggucuu

SEQ ID NO: 2999047 - RNA, 17 nt, Human
uguuuauugucaaagug

SEQ ID NO: 2999048 - RNA, 19 nt, Human
uguuuauugucaaaguggu

SEQ ID NO: 2999049 - RNA, 22 nt, Human
uguuugagcaucgcuuaggaga

SEQ ID NO: 2999050 - RNA, 17 nt, Human
uguuugauucagacagc

SEQ ID NO: 2999051 - RNA, 22 nt, Human
uguuugauucagacagcugccu

SEQ ID NO: 2999052 - RNA, 16 nt, Human
aguucugcagauaaac

SEQ ID NO: 2999053 - RNA, 21 nt, Human
aguucugcagauaaacaguag

SEQ ID NO: 2999054 - RNA, 22 nt, Human
uguuuugccaauuugcacauua

SEQ ID NO: 2999055 - RNA, 21 nt, Human
uguuuugccaauuugcacauu

SEQ ID NO: 2999056 - RNA, 16 nt, Human
aguucugaagaagaug

SEQ ID NO: 2999057 - RNA, 17 nt, Human
uguuuugccaauuugca

SEQ ID NO: 2999058 - RNA, 19 nt, Human
uguuuugccaauuugcaca

SEQ ID NO: 2999059 - RNA, 14 nt, Human
uguuuugcaagcca

SEQ ID NO: 2999060 - RNA, 14 nt, Human
aguucugguuccua

SEQ ID NO: 2999061 - RNA, 21 nt, Human
uguuuuauauagcaagacauu

SEQ ID NO: 2999062 - RNA, 16 nt, Human
uguuuuaucuucuaua

SEQ ID NO: 2999063 - RNA, 21 nt, Human
uguuuuauuuuaauucaguug

SEQ ID NO: 2999064 - RNA, 21 nt, Human
uguuuuauuuaaccucuaaau

SEQ ID NO: 2999065 - RNA, 20 nt, Human
uguuuuccaugaguccccug

SEQ ID NO: 2999066 - RNA, 19 nt, Human
uguuuucauuaucucaaaa

SEQ ID NO: 2999067 - RNA, 18 nt, Human
auaaauauguuucacaca

SEQ ID NO: 2999068 - RNA, 14 nt, Human
uuacaggaaguacu

SEQ ID NO: 2999069 - RNA, 16 nt, Human
auaacuaaaagguaug

SEQ ID NO: 2999070 - RNA, 12 nt, Human
auaaaugaaugu

SEQ ID NO: 2999071 - RNA, 15 nt, Human
auaaaugaaugucac

SEQ ID NO: 2999072 - RNA, 15 nt, Human
uuacuguaagaaaau

SEQ ID NO: 2999073 - RNA, 14 nt, Human
uuagaaauauaauu

SEQ ID NO: 2999074 - RNA, 12 nt, Human
uuagaaauauaa

SEQ ID NO: 2999075 - RNA, 11 nt, Human
uuagaaauaua

SEQ ID NO: 2999076 - RNA, 16 nt, Human
uuagaaauaacagaag

SEQ ID NO: 2999077 - RNA, 11 nt, Human
uuagacagagu

SEQ ID NO: 2999078 - RNA, 23 nt, Human
uuacucagaauucucuaguuuga

SEQ ID NO: 2999079 - RNA, 18 nt, Human
uuacucagaauucucuag

SEQ ID NO: 2999080 - RNA, 19 nt, Human
uuacuauggcccuggccua

SEQ ID NO: 2999081 - RNA, 15 nt, Human
uuacuauuucuugug

SEQ ID NO: 2999082 - RNA, 12 nt, Human
uuacuauuucuu

SEQ ID NO: 2999083 - RNA, 20 nt, Human
uuacauaagauaaaugugcu

SEQ ID NO: 2999084 - RNA, 12 nt, Human
uuaccugggaaa

SEQ ID NO: 2999085 - RNA, 14 nt, Human
uuaccuuacagaag

SEQ ID NO: 2999086 - RNA, 20 nt, Human
uuaaugaaagacuguacaaa

SEQ ID NO: 2999087 - RNA, 23 nt, Human
uuaaugaaagacuguacaaagua

SEQ ID NO: 2999088 - RNA, 15 nt, Human
uuaauucuuagcuca

SEQ ID NO: 2999089 - RNA, 22 nt, Human
auaaacaagaccacguuucuaa

SEQ ID NO: 2999090 - RNA, 15 nt, Human
auaaacaagaccacg

SEQ ID NO: 2999091 - RNA, 23 nt, Human
auaaacaagaccacguuucuaaa

SEQ ID NO: 2999092 - RNA, 19 nt, Human
uuaauuuuuuugagacaga

SEQ ID NO: 2999093 - RNA, 22 nt, Human
uuaagaagacugcauuauauuu

SEQ ID NO: 2999094 - RNA, 20 nt, Human
uuaagaagacugcauuauau

SEQ ID NO: 2999095 - RNA, 13 nt, Human
uuaagaggcaggg

SEQ ID NO: 2999096 - RNA, 16 nt, Human
uuaagaggcagggucu

SEQ ID NO: 2999097 - RNA, 15 nt, Human
uuaagaggcaggguc

SEQ ID NO: 2999098 - RNA, 17 nt, Human
uuaaguacuauguauca

SEQ ID NO: 2999099 - RNA, 18 nt, Human
uuaaguaaugauaacugg

SEQ ID NO: 2999100 - RNA, 22 nt, Human
uuaagugcugcauuuaaaagau

SEQ ID NO: 2999101 - RNA, 19 nt, Human
auaaaauccauacauuugu

SEQ ID NO: 2999102 - RNA, 18 nt, Human
auaaaauccauacauuug

SEQ ID NO: 2999103 - RNA, 21 nt, Human
auaaaauaauuuuuauauuug

SEQ ID NO: 2999104 - RNA, 16 nt, Human
auaaaauaauuuuuau

SEQ ID NO: 2999105 - RNA, 15 nt, Human
auaaaauaauuuuua

SEQ ID NO: 2999106 - RNA, 17 nt, Human
agggcccuuuuucaaua

SEQ ID NO: 2999107 - RNA, 23 nt, Human
agggcucagcggggacagcuccu

SEQ ID NO: 2999108 - RNA, 22 nt, Human
agggcucagcggggacagcucc

SEQ ID NO: 2999109 - RNA, 20 nt, Human
agggcucagcggggacagcu

SEQ ID NO: 2999110 - RNA, 19 nt, Human
agggcucagcggggacagc

SEQ ID NO: 2999111 - RNA, 14 nt, Human
agggagggcuccag

SEQ ID NO: 2999112 - RNA, 15 nt, Human
agggagggcuccaga

SEQ ID NO: 2999113 - RNA, 16 nt, Human
agggagggcuccagac

SEQ ID NO: 2999114 - RNA, 11 nt, Human
ugggcagagca

SEQ ID NO: 2999115 - RNA, 12 nt, Human
ugggcagagcag

SEQ ID NO: 2999116 - RNA, 18 nt, Human
ugggccaggagccuccug

SEQ ID NO: 2999117 - RNA, 12 nt, Human
ugggcagaagga

SEQ ID NO: 2999118 - RNA, 20 nt, Human
ugggaggaucucuugagccu

SEQ ID NO: 2999119 - RNA, 21 nt, Human
ugggaggaucucuugagccug

SEQ ID NO: 2999120 - RNA, 19 nt, Human
ugggaggccaaggugggag

SEQ ID NO: 2999121 - RNA, 20 nt, Human
ugggaggccaaggugggagg

SEQ ID NO: 2999122 - RNA, 20 nt, Human
ugggcacuauuuauuuacaa

SEQ ID NO: 2999123 - RNA, 21 nt, Human
ugggcccccaaauggaaaugg

SEQ ID NO: 2999124 - RNA, 16 nt, Human
ugggcccccaaaugga

SEQ ID NO: 2999125 - RNA, 15 nt, Human
agggagggagggcuc

SEQ ID NO: 2999126 - RNA, 13 nt, Human
agggagggcucca

SEQ ID NO: 2999127 - RNA, 22 nt, Human
agggaggacgcucucuggccuu

SEQ ID NO: 2999128 - RNA, 21 nt, Human
agggaggacgcucucuggccu

SEQ ID NO: 2999129 - RNA, 23 nt, Human
agggaggacgcucucuggccuuc

SEQ ID NO: 2999130 - RNA, 16 nt, Human
ugggacuacaggcacc

SEQ ID NO: 2999131 - RNA, 15 nt, Human
ugggacuacaggcac

SEQ ID NO: 2999132 - RNA, 14 nt, Human
ugggacuacaggca

SEQ ID NO: 2999133 - RNA, 19 nt, Human
ugggagagaagagaaugca

SEQ ID NO: 2999134 - RNA, 21 nt, Human
ugggagagaagagaaugcaca

SEQ ID NO: 2999135 - RNA, 18 nt, Human
ugggaggaucucuugagc

SEQ ID NO: 2999136 - RNA, 16 nt, Human
ugggagagccuuccag

SEQ ID NO: 2999137 - RNA, 20 nt, Human
ugggacucaaugcacugaca

SEQ ID NO: 2999138 - RNA, 22 nt, Human
ugggagaaccaaaaagaggcua

SEQ ID NO: 2999139 - RNA, 22 nt, Human
agggaaggauacaaaagcaugu

SEQ ID NO: 2999140 - RNA, 13 nt, Human
agggaaauuucag

SEQ ID NO: 2999141 - RNA, 20 nt, Human
aggcccggcuccaggcuccu

SEQ ID NO: 2999142 - RNA, 18 nt, Human
aggcccggcuccaggcuc

SEQ ID NO: 2999143 - RNA, 21 nt, Human
aggcccggcuccaggcuccuu

SEQ ID NO: 2999144 - RNA, 12 nt, Human
agggcuccagac

SEQ ID NO: 2999145 - RNA, 14 nt, Human
uggggaccucaggc

SEQ ID NO: 2999146 - RNA, 15 nt, Human
uggggaccucaggcc

SEQ ID NO: 2999147 - RNA, 16 nt, Human
uggggaccucaggccu

SEQ ID NO: 2999148 - RNA, 17 nt, Human
uggggaccucaggccug

SEQ ID NO: 2999149 - RNA, 21 nt, Human
uggggccaguuggucccccuu

SEQ ID NO: 2999150 - RNA, 12 nt, Human
uggggcccugcc

SEQ ID NO: 2999151 - RNA, 22 nt, Human
uggggcugcaccggcuggccug

SEQ ID NO: 2999152 - RNA, 23 nt, Human
uggggcugcaccggcuggccugg

SEQ ID NO: 2999153 - RNA, 23 nt, Human
uggggcucccagccaggcccuug

SEQ ID NO: 2999154 - RNA, 21 nt, Human
uggggcucccagccaggcccu

SEQ ID NO: 2999155 - RNA, 20 nt, Human
uggggcucccagccaggccc

SEQ ID NO: 2999156 - RNA, 19 nt, Human
uggggcucccagccaggcc

SEQ ID NO: 2999157 - RNA, 18 nt, Human
uggggcucccagccaggc

SEQ ID NO: 2999158 - RNA, 15 nt, Human
uggggcucccagcca

SEQ ID NO: 2999159 - RNA, 13 nt, Human
uggggcucccagc

SEQ ID NO: 2999160 - RNA, 12 nt, Human
uggggcucccag

SEQ ID NO: 2999161 - RNA, 22 nt, Human
uggggucacucuggcagcucag

SEQ ID NO: 2999162 - RNA, 16 nt, Human
uggggucacucuggca

SEQ ID NO: 2999163 - RNA, 20 nt, Human
uggggucacucuggcagcuc

SEQ ID NO: 2999164 - RNA, 13 nt, Human
uggggucacucug

SEQ ID NO: 2999165 - RNA, 14 nt, Human
uggggucacucugg

SEQ ID NO: 2999166 - RNA, 15 nt, Human
ugggguaugggagag

SEQ ID NO: 2999167 - RNA, 19 nt, Human
ugggguacccacugcucug

SEQ ID NO: 2999168 - RNA, 18 nt, Human
ugggguacccacugcucu

SEQ ID NO: 2999169 - RNA, 17 nt, Human
ugggguacccacugcuc

SEQ ID NO: 2999170 - RNA, 13 nt, Human
aggggaauguuug

SEQ ID NO: 2999171 - RNA, 18 nt, Human
aggggaaaaucagccugc

SEQ ID NO: 2999172 - RNA, 22 nt, Human
aggggaaaaucagccugcucca

SEQ ID NO: 2999173 - RNA, 14 nt, Human
aggggaacagacug

SEQ ID NO: 2999174 - RNA, 13 nt, Human
aggggaaaagagg

SEQ ID NO: 2999175 - RNA, 18 nt, Human
aggggagcaugggaagug

SEQ ID NO: 2999176 - RNA, 20 nt, Human
aggggaauguuugccucugc

SEQ ID NO: 2999177 - RNA, 19 nt, Human
aggggaauguuugccucug

SEQ ID NO: 2999178 - RNA, 21 nt, Human
aggggaauguuugccucugcc

SEQ ID NO: 2999179 - RNA, 15 nt, Human
agggggccuggaugc

SEQ ID NO: 2999180 - RNA, 17 nt, Human
agggggccuggaugccc

SEQ ID NO: 2999181 - RNA, 22 nt, Human
agggggcugcucccaccuggcu

SEQ ID NO: 2999182 - RNA, 19 nt, Human
agggggcugcucccaccug

SEQ ID NO: 2999183 - RNA, 16 nt, Human
agggggcugcucccac

SEQ ID NO: 2999184 - RNA, 15 nt, Human
agggggcugcuccca

SEQ ID NO: 2999185 - RNA, 14 nt, Human
agggggcugcuccc

SEQ ID NO: 2999186 - RNA, 16 nt, Human
agggucucacucuguc

SEQ ID NO: 2999187 - RNA, 15 nt, Human
agggucucacucugu

SEQ ID NO: 2999188 - RNA, 14 nt, Human
agggucucacucug

SEQ ID NO: 2999189 - RNA, 15 nt, Human
aggguaaggcugugg

SEQ ID NO: 2999190 - RNA, 20 nt, Human
aggggguggccucccaacuc

SEQ ID NO: 2999191 - RNA, 18 nt, Human
aggggugggacacccugu

SEQ ID NO: 2999192 - RNA, 15 nt, Human
agggugggagugggc

SEQ ID NO: 2999193 - RNA, 16 nt, Human
aggguggugaccucug

SEQ ID NO: 2999194 - RNA, 20 nt, Human
ugguagagugugccugaagu

SEQ ID NO: 2999195 - RNA, 19 nt, Human
ugguagcauuuuaaacaaa

SEQ ID NO: 2999196 - RNA, 18 nt, Human
ugguagcauuuuaaacaa

SEQ ID NO: 2999197 - RNA, 12 nt, Human
ugguagcauuuu

SEQ ID NO: 2999198 - RNA, 17 nt, Human
uggguggcaccagcagc

SEQ ID NO: 2999199 - RNA, 20 nt, Human
uggguggcaccagcagccug

SEQ ID NO: 2999200 - RNA, 21 nt, Human
uggguggcaccagcagccugg

SEQ ID NO: 2999201 - RNA, 19 nt, Human
ugucaagcugaccuugcug

SEQ ID NO: 2999202 - RNA, 20 nt, Human
uguauucucuccuguaccuc

SEQ ID NO: 2999203 - RNA, 19 nt, Human
uguauucucuccuguaccu

SEQ ID NO: 2999204 - RNA, 16 nt, Human
uguauuuuuuuacuaa

SEQ ID NO: 2999205 - RNA, 22 nt, Human
uguauuacaaauccaaugaaau

SEQ ID NO: 2999206 - RNA, 13 nt, Human
uguauuacaaauc

SEQ ID NO: 2999207 - RNA, 15 nt, Human
uguaguguuggagaa

SEQ ID NO: 2999208 - RNA, 14 nt, Human
uguaguguuggaga

SEQ ID NO: 2999209 - RNA, 15 nt, Human
uguaucacaaaucuu

SEQ ID NO: 2999210 - RNA, 18 nt, Human
uguaucacaaaucuuaac

SEQ ID NO: 2999211 - RNA, 17 nt, Human
uguaucaaugaguaaca

SEQ ID NO: 2999212 - RNA, 16 nt, Human
aguaugguggcugggu

SEQ ID NO: 2999213 - RNA, 15 nt, Human
aguaugguggcuggg

SEQ ID NO: 2999214 - RNA, 18 nt, Human
aguauuagaauaccacag

SEQ ID NO: 2999215 - RNA, 18 nt, Human
aguauuacuucugcuaca

SEQ ID NO: 2999216 - RNA, 17 nt, Human
aguaugguggcuggguu

SEQ ID NO: 2999217 - RNA, 15 nt, Human
aguauuacuucugcu

SEQ ID NO: 2999218 - RNA, 20 nt, Human
aguaggggucugucuuuuaa

SEQ ID NO: 2999219 - RNA, 18 nt, Human
aguaggggucugucuuuu

SEQ ID NO: 2999220 - RNA, 17 nt, Human
ugucaauuacaggaagu

SEQ ID NO: 2999221 - RNA, 14 nt, Human
ugucaauuacagga

SEQ ID NO: 2999222 - RNA, 15 nt, Human
ugucaauuacaggaa

SEQ ID NO: 2999223 - RNA, 15 nt, Human
agucaccucauggaa

SEQ ID NO: 2999224 - RNA, 14 nt, Human
agucaccucaugga

SEQ ID NO: 2999225 - RNA, 17 nt, Human
agucaccucauggaauu

SEQ ID NO: 2999226 - RNA, 23 nt, Human
agucacacagugagucgaggaca

SEQ ID NO: 2999227 - RNA, 15 nt, Human
agucacacagugagu

SEQ ID NO: 2999228 - RNA, 19 nt, Human
agucaccccggccaccugc

SEQ ID NO: 2999229 - RNA, 16 nt, Human
aguauuucuaugaaau

SEQ ID NO: 2999230 - RNA, 17 nt, Human
aguauuucuaugaaaua

SEQ ID NO: 2999231 - RNA, 18 nt, Human
aguauuucuaugaaauau

SEQ ID NO: 2999232 - RNA, 23 nt, Human
agucacacaguauuacuucugcu

SEQ ID NO: 2999233 - RNA, 14 nt, Human
aguaugguggcugg

SEQ ID NO: 2999234 - RNA, 16 nt, Human
aguaaaauguggcagg

SEQ ID NO: 2999235 - RNA, 15 nt, Human
aguaauaugcacaca

SEQ ID NO: 2999236 - RNA, 14 nt, Human
aguaauaugcacac

SEQ ID NO: 2999237 - RNA, 20 nt, Human
aguaaugauaacuggaaacu

SEQ ID NO: 2999238 - RNA, 18 nt, Human
aguaaugauaacuggaaa

SEQ ID NO: 2999239 - RNA, 17 nt, Human
aguaaugauaacuggaa

SEQ ID NO: 2999240 - RNA, 13 nt, Human
aguaaugauaacu

SEQ ID NO: 2999241 - RNA, 13 nt, Human
aguaaaauccaca

SEQ ID NO: 2999242 - RNA, 20 nt, Human
aguaaaaccacagcaguuga

SEQ ID NO: 2999243 - RNA, 18 nt, Human
uguagagccagggucuca

SEQ ID NO: 2999244 - RNA, 16 nt, Human
uguagagccagggucu

SEQ ID NO: 2999245 - RNA, 17 nt, Human
uguaggcauaaagucag

SEQ ID NO: 2999246 - RNA, 20 nt, Human
uguaggcauaaagucagggg

SEQ ID NO: 2999247 - RNA, 11 nt, Human
aguagagacag

SEQ ID NO: 2999248 - RNA, 20 nt, Human
aguagaagucuuagauguau

SEQ ID NO: 2999249 - RNA, 19 nt, Human
aguagaagucuuagaugua

SEQ ID NO: 2999250 - RNA, 21 nt, Human
aguagaagucuuagauguaua

SEQ ID NO: 2999251 - RNA, 17 nt, Human
aguagaagucuuagaug

SEQ ID NO: 2999252 - RNA, 21 nt, Human
ugguuaguagagguacacuug

SEQ ID NO: 2999253 - RNA, 16 nt, Human
ugguuauaacuuaaug

SEQ ID NO: 2999254 - RNA, 17 nt, Human
ugguuauaacuuaauga

SEQ ID NO: 2999255 - RNA, 14 nt, Human
ugguuauggagagg

SEQ ID NO: 2999256 - RNA, 17 nt, Human
ugguuuucaaaauaaaa

SEQ ID NO: 2999257 - RNA, 15 nt, Human
ugguuuucaaaauaa

SEQ ID NO: 2999258 - RNA, 14 nt, Human
ugguuuucaaaaua

SEQ ID NO: 2999259 - RNA, 15 nt, Human
ugguuuguaaauuaa

SEQ ID NO: 2999260 - RNA, 16 nt, Human
uguaaaggaauuuaaa

SEQ ID NO: 2999261 - RNA, 16 nt, Human
uguaaauagcucaggu

SEQ ID NO: 2999262 - RNA, 15 nt, Human
uguaaauagcucagg

SEQ ID NO: 2999263 - RNA, 16 nt, Human
aggugggauccuccag

SEQ ID NO: 2999264 - RNA, 17 nt, Human
aggugggauccuccagg

SEQ ID NO: 2999265 - RNA, 23 nt, Human
agguggggcagcuugaggguugg

SEQ ID NO: 2999266 - RNA, 18 nt, Human
aggugggauccuccaggu

SEQ ID NO: 2999267 - RNA, 16 nt, Human
agguggggcagcuuga

SEQ ID NO: 2999268 - RNA, 18 nt, Human
aggugccucaagagaagg

SEQ ID NO: 2999269 - RNA, 15 nt, Human
aggugggauccucca

SEQ ID NO: 2999270 - RNA, 20 nt, Human
aggugauccacccaccucag

SEQ ID NO: 2999271 - RNA, 14 nt, Human
aggugauccaccca

SEQ ID NO: 2999272 - RNA, 20 nt, Human
aggugugcucugaucaucca

SEQ ID NO: 2999273 - RNA, 15 nt, Human
aggugugcucugauc

SEQ ID NO: 2999274 - RNA, 17 nt, Human
aggugugaaccaccaca

SEQ ID NO: 2999275 - RNA, 19 nt, Human
agguggggucacucuggca

SEQ ID NO: 2999276 - RNA, 20 nt, Human
aggugucccugcacuugcag

SEQ ID NO: 2999277 - RNA, 14 nt, Human
agguuuaagcuguu

SEQ ID NO: 2999278 - RNA, 12 nt, Human
aggugugcucug

SEQ ID NO: 2999279 - RNA, 17 nt, Human
uggugcgaucuggguuc

SEQ ID NO: 2999280 - RNA, 16 nt, Human
uggugcgaucuggguu

SEQ ID NO: 2999281 - RNA, 19 nt, Human
uggugucgggcaugacacg

SEQ ID NO: 2999282 - RNA, 15 nt, Human
ugguggcagcugcgg

SEQ ID NO: 2999283 - RNA, 13 nt, Human
ugguggcagcugc

SEQ ID NO: 2999284 - RNA, 14 nt, Human
ugguggcagcugcg

SEQ ID NO: 2999285 - RNA, 18 nt, Human
ugguuaggcauuguggga

SEQ ID NO: 2999286 - RNA, 20 nt, Human
ugguuaggcauugugggaag

SEQ ID NO: 2999287 - RNA, 16 nt, Human
aggugagaagcagagg

SEQ ID NO: 2999288 - RNA, 21 nt, Human
aggugagaagcagaggaagga

SEQ ID NO: 2999289 - RNA, 23 nt, Human
aggugagaagcagaggaaggaga

SEQ ID NO: 2999290 - RNA, 15 nt, Human
aggugacagagugag

SEQ ID NO: 2999291 - RNA, 13 nt, Human
aggugacagagug

SEQ ID NO: 2999292 - RNA, 17 nt, Human
aggucuugaacuccugg

SEQ ID NO: 2999293 - RNA, 13 nt, Human
aggugaccccagg

SEQ ID NO: 2999294 - RNA, 15 nt, Human
aggugacauauacau

SEQ ID NO: 2999295 - RNA, 22 nt, Human
aggugacagagugagacucugu

SEQ ID NO: 2999296 - RNA, 18 nt, Human
aggucagagccugcaguu

SEQ ID NO: 2999297 - RNA, 17 nt, Human
aggucagagccugcagu

SEQ ID NO: 2999298 - RNA, 15 nt, Human
aggucagagccugca

SEQ ID NO: 2999299 - RNA, 14 nt, Human
aggucagagccugc

SEQ ID NO: 2999300 - RNA, 15 nt, Human
uggucagauuugaac

SEQ ID NO: 2999301 - RNA, 16 nt, Human
uggucagauuugaacu

SEQ ID NO: 2999302 - RNA, 13 nt, Human
aggucagagccug

SEQ ID NO: 2999303 - RNA, 16 nt, Human
aggucuugaacuccug

SEQ ID NO: 2999304 - RNA, 21 nt, Human
aggucaggagaucgagaccau

SEQ ID NO: 2999305 - RNA, 20 nt, Human
agcuuaagaaauuuguggaa

SEQ ID NO: 2999306 - RNA, 20 nt, Human
agcuuaaaggggcuagagug

SEQ ID NO: 2999307 - RNA, 11 nt, Human
ugcuacacacu

SEQ ID NO: 2999308 - RNA, 14 nt, Human
ugcuacaaaaacac

SEQ ID NO: 2999309 - RNA, 13 nt, Human
ugcuacaguaaua

SEQ ID NO: 2999310 - RNA, 15 nt, Human
ugcgguccacccagg

SEQ ID NO: 2999311 - RNA, 14 nt, Human
ugcgguccacccag

SEQ ID NO: 2999312 - RNA, 19 nt, Human
ugccuuuucccaacuccag

SEQ ID NO: 2999313 - RNA, 17 nt, Human
ugccuuuucccaacucc

SEQ ID NO: 2999314 - RNA, 14 nt, Human
aggaaaagcugcug

SEQ ID NO: 2999315 - RNA, 20 nt, Human
agcuugcccuggugccucac

SEQ ID NO: 2999316 - RNA, 23 nt, Human
agcuugaccgugaggccagagac

SEQ ID NO: 2999317 - RNA, 22 nt, Human
agcuugaggguugggcuggugu

SEQ ID NO: 2999318 - RNA, 20 nt, Human
agcuugaccgugaggccaga

SEQ ID NO: 2999319 - RNA, 22 nt, Human
agcuugaccgugaggccagaga

SEQ ID NO: 2999320 - RNA, 16 nt, Human
agcuugcccuguuaaa

SEQ ID NO: 2999321 - RNA, 18 nt, Human
agcuugcccuguuaaaag

SEQ ID NO: 2999322 - RNA, 19 nt, Human
agcuugcccuguuaaaaga

SEQ ID NO: 2999323 - RNA, 21 nt, Human
aggaaaucaaauaugcaaagc

SEQ ID NO: 2999324 - RNA, 22 nt, Human
aggaaaucaaauaugcaaagca

SEQ ID NO: 2999325 - RNA, 20 nt, Human
aggaaaucaaauaugcaaag

SEQ ID NO: 2999326 - RNA, 19 nt, Human
aggaaaucaaauaugcaaa

SEQ ID NO: 2999327 - RNA, 23 nt, Human
aggaaaggcuccaggagcagcca

SEQ ID NO: 2999328 - RNA, 21 nt, Human
ugcugagccucacagcaguga

SEQ ID NO: 2999329 - RNA, 19 nt, Human
ugcugagccucacagcagu

SEQ ID NO: 2999330 - RNA, 18 nt, Human
ugcugagauccuggacug

SEQ ID NO: 2999331 - RNA, 14 nt, Human
ugcugagauccugg

SEQ ID NO: 2999332 - RNA, 18 nt, Human
ugcugagccucacagcag

SEQ ID NO: 2999333 - RNA, 13 nt, Human
aggaagcucaggg

SEQ ID NO: 2999334 - RNA, 14 nt, Human
aggaagcucagggc

SEQ ID NO: 2999335 - RNA, 16 nt, Human
aggaagcucagggccu

SEQ ID NO: 2999336 - RNA, 15 nt, Human
aggaagcucagggcc

SEQ ID NO: 2999337 - RNA, 21 nt, Human
ugcuccagcuguucagcuggu

SEQ ID NO: 2999338 - RNA, 20 nt, Human
ugcuccagcuguucagcugg

SEQ ID NO: 2999339 - RNA, 15 nt, Human
ugcuccauccuccug

SEQ ID NO: 2999340 - RNA, 15 nt, Human
ugcucccaccuggcu

SEQ ID NO: 2999341 - RNA, 15 nt, Human
ugcucugcugacaga

SEQ ID NO: 2999342 - RNA, 14 nt, Human
ugcucugcugacag

SEQ ID NO: 2999343 - RNA, 14 nt, Human
ugcuaucuccccca

SEQ ID NO: 2999344 - RNA, 17 nt, Human
ugcuaucucccccagcc

SEQ ID NO: 2999345 - RNA, 13 nt, Human
ugcuaucuccccc

SEQ ID NO: 2999346 - RNA, 16 nt, Human
aggaaaagcugcugac

SEQ ID NO: 2999347 - RNA, 21 nt, Human
aggaaaauuauucuauaauuu

SEQ ID NO: 2999348 - RNA, 11 nt, Human
aggaaaauuau

SEQ ID NO: 2999349 - RNA, 15 nt, Human
agcugcccucuccug

SEQ ID NO: 2999350 - RNA, 14 nt, Human
agcugcccucuccu

SEQ ID NO: 2999351 - RNA, 13 nt, Human
agcugcccucucc

SEQ ID NO: 2999352 - RNA, 20 nt, Human
ugcccuguuaaaagaugaaa

SEQ ID NO: 2999353 - RNA, 19 nt, Human
ugcccuguuaaaagaugaa

SEQ ID NO: 2999354 - RNA, 18 nt, Human
ugcccuuaccugccagga

SEQ ID NO: 2999355 - RNA, 14 nt, Human
ugccgcagcccugc

SEQ ID NO: 2999356 - RNA, 12 nt, Human
ugccgcagcccu

SEQ ID NO: 2999357 - RNA, 13 nt, Human
ugccucagccucc

SEQ ID NO: 2999358 - RNA, 12 nt, Human
ugccucagccuc

SEQ ID NO: 2999359 - RNA, 21 nt, Human
agcucuguccugggagugagc

SEQ ID NO: 2999360 - RNA, 16 nt, Human
agcucuguccugggag

SEQ ID NO: 2999361 - RNA, 20 nt, Human
agcugccagccgagauagcc

SEQ ID NO: 2999362 - RNA, 14 nt, Human
agcugccagccgag

SEQ ID NO: 2999363 - RNA, 23 nt, Human
agcucccaggcauuccccaggag

SEQ ID NO: 2999364 - RNA, 15 nt, Human
agcuccuucuguccu

SEQ ID NO: 2999365 - RNA, 13 nt, Human
agcucccaggcau

SEQ ID NO: 2999366 - RNA, 12 nt, Human
agcucuggucca

SEQ ID NO: 2999367 - RNA, 17 nt, Human
agcucugguccauagag

SEQ ID NO: 2999368 - RNA, 14 nt, Human
agcucuguccuggg

SEQ ID NO: 2999369 - RNA, 21 nt, Human
agcuccuucuguccuacucug

SEQ ID NO: 2999370 - RNA, 16 nt, Human
agcuccuucuguccua

SEQ ID NO: 2999371 - RNA, 19 nt, Human
agcuguuacugucuucagu

SEQ ID NO: 2999372 - RNA, 14 nt, Human
agcuguucacagcc

SEQ ID NO: 2999373 - RNA, 16 nt, Human
ugccuguugggccagg

SEQ ID NO: 2999374 - RNA, 17 nt, Human
ugccuguugggccagga

SEQ ID NO: 2999375 - RNA, 20 nt, Human
ugccuuacccucauguucuu

SEQ ID NO: 2999376 - RNA, 16 nt, Human
ugccuuggggacaaga

SEQ ID NO: 2999377 - RNA, 21 nt, Human
ugccuuacccucauguucuua

SEQ ID NO: 2999378 - RNA, 18 nt, Human
agcuguuacugucuucag

SEQ ID NO: 2999379 - RNA, 14 nt, Human
agcuguuacugucu

SEQ ID NO: 2999380 - RNA, 23 nt, Human
agcugugcucuggacaggcaugu

SEQ ID NO: 2999381 - RNA, 18 nt, Human
agcugugcucuggacagg

SEQ ID NO: 2999382 - RNA, 17 nt, Human
agcugugcucuggacag

SEQ ID NO: 2999383 - RNA, 22 nt, Human
agcugggguggggaccucaggc

SEQ ID NO: 2999384 - RNA, 23 nt, Human
agcugggguggggaccucaggcc

SEQ ID NO: 2999385 - RNA, 20 nt, Human
agcugggguggggaccucag

SEQ ID NO: 2999386 - RNA, 16 nt, Human
agcugggacuacaggu

SEQ ID NO: 2999387 - RNA, 23 nt, Human
agcugggacuacaggcacccacc

SEQ ID NO: 2999388 - RNA, 20 nt, Human
agcugggacuacaggcaccc

SEQ ID NO: 2999389 - RNA, 17 nt, Human
ugccucugccucugaca

SEQ ID NO: 2999390 - RNA, 20 nt, Human
ugccucugccucugacacac

SEQ ID NO: 2999391 - RNA, 18 nt, Human
ugccucugccucugacac

SEQ ID NO: 2999392 - RNA, 14 nt, Human
ugccucagccuccc

SEQ ID NO: 2999393 - RNA, 23 nt, Human
ugccugcccaggccccugccacc

SEQ ID NO: 2999394 - RNA, 22 nt, Human
ugccugcccaggccccugccac

SEQ ID NO: 2999395 - RNA, 20 nt, Human
ugccugcccaggccccugcc

SEQ ID NO: 2999396 - RNA, 16 nt, Human
ugccuggauggggcug

SEQ ID NO: 2999397 - RNA, 17 nt, Human
ugccuggauggggcugc

SEQ ID NO: 2999398 - RNA, 20 nt, Human
ugccuggauggggcugcacc

SEQ ID NO: 2999399 - RNA, 21 nt, Human
ugccuggauggggcugcaccg

SEQ ID NO: 2999400 - RNA, 16 nt, Human
agcugccuguucagcu

SEQ ID NO: 2999401 - RNA, 14 nt, Human
agcugccuguucag

SEQ ID NO: 2999402 - RNA, 18 nt, Human
agcugccuguucagcucc

SEQ ID NO: 2999403 - RNA, 20 nt, Human
agcugcugagauccuggacu

SEQ ID NO: 2999404 - RNA, 20 nt, Human
agcugcuugggcuucauccu

SEQ ID NO: 2999405 - RNA, 16 nt, Human
agcugcuugggcuuca

SEQ ID NO: 2999406 - RNA, 21 nt, Human
agcugcugagauccuggacug

SEQ ID NO: 2999407 - RNA, 16 nt, Human
aggcaggggaauguau

SEQ ID NO: 2999408 - RNA, 19 nt, Human
aggcaggggaauguaugug

SEQ ID NO: 2999409 - RNA, 14 nt, Human
aggcaggggaaugu

SEQ ID NO: 2999410 - RNA, 20 nt, Human
aggcagcucuaaaugucaau

SEQ ID NO: 2999411 - RNA, 15 nt, Human
aggcagcuugaaacu

SEQ ID NO: 2999412 - RNA, 22 nt, Human
aggcauaaagucagggguuccc

SEQ ID NO: 2999413 - RNA, 18 nt, Human
aggcauugugggaagggg

SEQ ID NO: 2999414 - RNA, 20 nt, Human
aggcauuuaggccaugggac

SEQ ID NO: 2999415 - RNA, 17 nt, Human
aggcaggugggauggau

SEQ ID NO: 2999416 - RNA, 15 nt, Human
aggcauaaagucagg

SEQ ID NO: 2999417 - RNA, 12 nt, Human
aggcagggucuc

SEQ ID NO: 2999418 - RNA, 22 nt, Human
aggcaggucuugaacuccuggc

SEQ ID NO: 2999419 - RNA, 21 nt, Human
uggagcucguggaacaguuac

SEQ ID NO: 2999420 - RNA, 17 nt, Human
uggagcucguggaacag

SEQ ID NO: 2999421 - RNA, 17 nt, Human
aggcaagcaccuccugc

SEQ ID NO: 2999422 - RNA, 14 nt, Human
uggagcucguggaa

SEQ ID NO: 2999423 - RNA, 20 nt, Human
aggcaagcaccuccugccuc

SEQ ID NO: 2999424 - RNA, 19 nt, Human
aggcaagcaccuccugccu

SEQ ID NO: 2999425 - RNA, 18 nt, Human
aggcaagcaccuccugcc

SEQ ID NO: 2999426 - RNA, 17 nt, Human
aggcaaggcugucaauu

SEQ ID NO: 2999427 - RNA, 16 nt, Human
aggcaaggcugucaau

SEQ ID NO: 2999428 - RNA, 14 nt, Human
uggagaaaauggac

SEQ ID NO: 2999429 - RNA, 11 nt, Human
uggacuucugg

SEQ ID NO: 2999430 - RNA, 17 nt, Human
aggauugcuacuguccu

SEQ ID NO: 2999431 - RNA, 15 nt, Human
aggauugcuacuguc

SEQ ID NO: 2999432 - RNA, 18 nt, Human
aggauugcuacuguccua

SEQ ID NO: 2999433 - RNA, 19 nt, Human
uggacuucuggaugcccau

SEQ ID NO: 2999434 - RNA, 20 nt, Human
uggaguuauugaagcagagu

SEQ ID NO: 2999435 - RNA, 14 nt, Human
uggaguugaaaauc

SEQ ID NO: 2999436 - RNA, 14 nt, Human
uggagugcagugag

SEQ ID NO: 2999437 - RNA, 16 nt, Human
aggcauuugcugaaua

SEQ ID NO: 2999438 - RNA, 20 nt, Human
aggcauuugcugaauacaga

SEQ ID NO: 2999439 - RNA, 20 nt, Human
uggagguacgaaaagagggg

SEQ ID NO: 2999440 - RNA, 14 nt, Human
uggauucauauuua

SEQ ID NO: 2999441 - RNA, 17 nt, Human
uggauucauauuuaauu

SEQ ID NO: 2999442 - RNA, 23 nt, Human
uggaugccugguggcagcugcgg

SEQ ID NO: 2999443 - RNA, 21 nt, Human
uggaugccugguggcagcugc

SEQ ID NO: 2999444 - RNA, 20 nt, Human
uggaugccugguggcagcug

SEQ ID NO: 2999445 - RNA, 21 nt, Human
uggcacaucagcacgauuucu

SEQ ID NO: 2999446 - RNA, 23 nt, Human
uggcacaucagcacgauuucugu

SEQ ID NO: 2999447 - RNA, 15 nt, Human
aggcccccaggugcc

SEQ ID NO: 2999448 - RNA, 14 nt, Human
aggccccgcccagg

SEQ ID NO: 2999449 - RNA, 17 nt, Human
aggcccggcuccaggcu

SEQ ID NO: 2999450 - RNA, 13 nt, Human
aggcccggcucca

SEQ ID NO: 2999451 - RNA, 13 nt, Human
aggcccagagggc

SEQ ID NO: 2999452 - RNA, 13 nt, Human
aggccagccuuga

SEQ ID NO: 2999453 - RNA, 15 nt, Human
aggccagccuugacc

SEQ ID NO: 2999454 - RNA, 13 nt, Human
uggcagcucagag

SEQ ID NO: 2999455 - RNA, 23 nt, Human
uggcagcucaccucucccuugga

SEQ ID NO: 2999456 - RNA, 21 nt, Human
uggcagcucaccucucccuug

SEQ ID NO: 2999457 - RNA, 22 nt, Human
uggcagcucaccucucccuugg

SEQ ID NO: 2999458 - RNA, 20 nt, Human
uggcacccggccccugcugg

SEQ ID NO: 2999459 - RNA, 19 nt, Human
uggcacccggccccugcug

SEQ ID NO: 2999460 - RNA, 18 nt, Human
uggcacccggccccugcu

SEQ ID NO: 2999461 - RNA, 16 nt, Human
uggcacccggccccug

SEQ ID NO: 2999462 - RNA, 13 nt, Human
aggaucagucuga

SEQ ID NO: 2999463 - RNA, 19 nt, Human
aggauucuuccucccuccc

SEQ ID NO: 2999464 - RNA, 17 nt, Human
aggauucuuccucccuc

SEQ ID NO: 2999465 - RNA, 22 nt, Human
aggaugaucuaggaagacuuug

SEQ ID NO: 2999466 - RNA, 23 nt, Human
aggaugaucuaggaagacuuugg

SEQ ID NO: 2999467 - RNA, 22 nt, Human
aggaugcacagaguuguuacau

SEQ ID NO: 2999468 - RNA, 16 nt, Human
aggauucuuccucccu

SEQ ID NO: 2999469 - RNA, 18 nt, Human
ugcuuuuggucuguguga

SEQ ID NO: 2999470 - RNA, 23 nt, Human
ugcuuuuuaauauugauaugcuu

SEQ ID NO: 2999471 - RNA, 20 nt, Human
ugcuuuugucuaugggacuc

SEQ ID NO: 2999472 - RNA, 22 nt, Human
ugcuuugugauuuuuguaauuu

SEQ ID NO: 2999473 - RNA, 17 nt, Human
ugcuuugugauuuuugu

SEQ ID NO: 2999474 - RNA, 17 nt, Human
aggagccuccugcccuu

SEQ ID NO: 2999475 - RNA, 15 nt, Human
ugcuugagcucagga

SEQ ID NO: 2999476 - RNA, 23 nt, Human
uggaaauuuguuauaaugaauga

SEQ ID NO: 2999477 - RNA, 21 nt, Human
uggaaauuuguuauaaugaau

SEQ ID NO: 2999478 - RNA, 16 nt, Human
uggaagacagcucuua

SEQ ID NO: 2999479 - RNA, 15 nt, Human
uggaagacagcucuu

SEQ ID NO: 2999480 - RNA, 20 nt, Human
aggacgcucucuggccuucg

SEQ ID NO: 2999481 - RNA, 19 nt, Human
aggacgcucucuggccuuc

SEQ ID NO: 2999482 - RNA, 17 nt, Human
aggacgcucucuggccu

SEQ ID NO: 2999483 - RNA, 16 nt, Human
aggacgcucucuggcc

SEQ ID NO: 2999484 - RNA, 14 nt, Human
aggacgcucucugg

SEQ ID NO: 2999485 - RNA, 13 nt, Human
aggacgcucucug

SEQ ID NO: 2999486 - RNA, 23 nt, Human
aggacuccaggcagcagacacau

SEQ ID NO: 2999487 - RNA, 19 nt, Human
aggacuccaggcagcagac

SEQ ID NO: 2999488 - RNA, 14 nt, Human
aggacuccaggcag

SEQ ID NO: 2999489 - RNA, 18 nt, Human
aggacuccaggcagcaga

SEQ ID NO: 2999490 - RNA, 16 nt, Human
aggagccuccugcccu

SEQ ID NO: 2999491 - RNA, 17 nt, Human
aggagccccgaggccuu

SEQ ID NO: 2999492 - RNA, 12 nt, Human
aggagcagccac

SEQ ID NO: 2999493 - RNA, 13 nt, Human
aggagcagccaca

SEQ ID NO: 2999494 - RNA, 20 nt, Human
aggagaucgagaccauccug

SEQ ID NO: 2999495 - RNA, 19 nt, Human
aggagaaacuggaacucuc

SEQ ID NO: 2999496 - RNA, 18 nt, Human
aggagaaacuggaacucu

SEQ ID NO: 2999497 - RNA, 17 nt, Human
aggagaaacuggaacuc

SEQ ID NO: 2999498 - RNA, 22 nt, Human
aggacuuuucuuuguggcuucc

SEQ ID NO: 2999499 - RNA, 19 nt, Human
aggacuuuucuuuguggcu

SEQ ID NO: 2999500 - RNA, 17 nt, Human
aggacuuuucuuugugg

SEQ ID NO: 2999501 - RNA, 13 nt, Human
ugcacauuaaaug

SEQ ID NO: 2999502 - RNA, 18 nt, Human
ugcacauuaaaugacucu

SEQ ID NO: 2999503 - RNA, 15 nt, Human
ugcacauuaaaugac

SEQ ID NO: 2999504 - RNA, 15 nt, Human
ugcaccacugcacuc

SEQ ID NO: 2999505 - RNA, 21 nt, Human
ugcaccacugcacuccagccu

SEQ ID NO: 2999506 - RNA, 13 nt, Human
ugcaccagcccuu

SEQ ID NO: 2999507 - RNA, 22 nt, Human
ugcagaagacaguauggcagcu

SEQ ID NO: 2999508 - RNA, 17 nt, Human
ugcacuccagccugagc

SEQ ID NO: 2999509 - RNA, 15 nt, Human
ugcacuccagccugg

SEQ ID NO: 2999510 - RNA, 16 nt, Human
ugcacuccagccuggg

SEQ ID NO: 2999511 - RNA, 15 nt, Human
ugcacuccagccuga

SEQ ID NO: 2999512 - RNA, 14 nt, Human
ugcacuccagccug

SEQ ID NO: 2999513 - RNA, 16 nt, Human
ugcaccggcuggccug

SEQ ID NO: 2999514 - RNA, 14 nt, Human
ugcaccggcuggcc

SEQ ID NO: 2999515 - RNA, 15 nt, Human
ugcaccggcuggccu

SEQ ID NO: 2999516 - RNA, 19 nt, Human
agccccuucugacccaugc

SEQ ID NO: 2999517 - RNA, 13 nt, Human
agcccgggcucug

SEQ ID NO: 2999518 - RNA, 14 nt, Human
agcccgggcucugc

SEQ ID NO: 2999519 - RNA, 15 nt, Human
agcccgggcucugcc

SEQ ID NO: 2999520 - RNA, 15 nt, Human
agccccuucugaccc

SEQ ID NO: 2999521 - RNA, 16 nt, Human
agccccuucugaccca

SEQ ID NO: 2999522 - RNA, 14 nt, Human
agccccuucugacc

SEQ ID NO: 2999523 - RNA, 14 nt, Human
agcccugcagaggg

SEQ ID NO: 2999524 - RNA, 15 nt, Human
agcccugcagagggc

SEQ ID NO: 2999525 - RNA, 16 nt, Human
agcccugcagagggca

SEQ ID NO: 2999526 - RNA, 19 nt, Human
agcccugcagagggcacag

SEQ ID NO: 2999527 - RNA, 16 nt, Human
agcccgggcucugccu

SEQ ID NO: 2999528 - RNA, 14 nt, Human
agcccaggccuccu

SEQ ID NO: 2999529 - RNA, 19 nt, Human
agcccaggccuccuacagc

SEQ ID NO: 2999530 - RNA, 14 nt, Human
agccccgaggccuu

SEQ ID NO: 2999531 - RNA, 22 nt, Human
agccccuggaugcagccucaca

SEQ ID NO: 2999532 - RNA, 12 nt, Human
ugcaaagaugaa

SEQ ID NO: 2999533 - RNA, 23 nt, Human
ugcaaagaugaaggucuguuuug

SEQ ID NO: 2999534 - RNA, 18 nt, Human
ugcaaagcacugacuucu

SEQ ID NO: 2999535 - RNA, 20 nt, Human
ugcaaagcacugacuucuaa

SEQ ID NO: 2999536 - RNA, 22 nt, Human
ugcaaagcacugacuucuaagu

SEQ ID NO: 2999537 - RNA, 16 nt, Human
ugcaaacuucagaguu

SEQ ID NO: 2999538 - RNA, 18 nt, Human
ugcaaaccaucauugaaa

SEQ ID NO: 2999539 - RNA, 20 nt, Human
ugcaaaccaucauugaaauc

SEQ ID NO: 2999540 - RNA, 20 nt, Human
ugcaaaguaucccuacugua

SEQ ID NO: 2999541 - RNA, 21 nt, Human
ugcaaaggguaucaggugcug

SEQ ID NO: 2999542 - RNA, 14 nt, Human
ugauuucacagugu

SEQ ID NO: 2999543 - RNA, 16 nt, Human
ugauuucacagugugu

SEQ ID NO: 2999544 - RNA, 13 nt, Human
ugauuucauucaa

SEQ ID NO: 2999545 - RNA, 18 nt, Human
agccacggccaggccaga

SEQ ID NO: 2999546 - RNA, 17 nt, Human
agccacggccaggccag

SEQ ID NO: 2999547 - RNA, 12 nt, Human
ugcaaaccauca

SEQ ID NO: 2999548 - RNA, 13 nt, Human
ugcaaaccaucau

SEQ ID NO: 2999549 - RNA, 21 nt, Human
ugcaagccagauuuuccugaa

SEQ ID NO: 2999550 - RNA, 15 nt, Human
ugcaagccagauuuu

SEQ ID NO: 2999551 - RNA, 13 nt, Human
ugcaacaggcugg

SEQ ID NO: 2999552 - RNA, 18 nt, Human
ugcaaauaaguguauuuu

SEQ ID NO: 2999553 - RNA, 15 nt, Human
ugcaaauaaguguau

SEQ ID NO: 2999554 - RNA, 23 nt, Human
ugcaaauaaguguauuuugaaau

SEQ ID NO: 2999555 - RNA, 21 nt, Human
ugcaaauaaguguauuuugaa

SEQ ID NO: 2999556 - RNA, 15 nt, Human
ugcaaggucauuuuu

SEQ ID NO: 2999557 - RNA, 14 nt, Human
ugcaaggcaaaugu

SEQ ID NO: 2999558 - RNA, 12 nt, Human
agcccaggccuc

SEQ ID NO: 2999559 - RNA, 21 nt, Human
ugcaauaaaauggguuuuacu

SEQ ID NO: 2999560 - RNA, 17 nt, Human
ugcaauaaaauggguuu

SEQ ID NO: 2999561 - RNA, 18 nt, Human
ugcaucuagccucaagcu

SEQ ID NO: 2999562 - RNA, 17 nt, Human
ugcaucguuucaucuuc

SEQ ID NO: 2999563 - RNA, 19 nt, Human
ugcaugcugucccuuacgu

SEQ ID NO: 2999564 - RNA, 21 nt, Human
ugcaugcugucccuuacguga

SEQ ID NO: 2999565 - RNA, 18 nt, Human
ugcaugcugucccuuacg

SEQ ID NO: 2999566 - RNA, 14 nt, Human
ugcauaccacuuuu

SEQ ID NO: 2999567 - RNA, 13 nt, Human
ugcauacucauua

SEQ ID NO: 2999568 - RNA, 19 nt, Human
ugcauacucauuaggaugg

SEQ ID NO: 2999569 - RNA, 20 nt, Human
ugcauagauucccugagcag

SEQ ID NO: 2999570 - RNA, 20 nt, Human
ugcauaccacuuuuguucuu

SEQ ID NO: 2999571 - RNA, 18 nt, Human
ugcauaccacuuuuguuc

SEQ ID NO: 2999572 - RNA, 16 nt, Human
ugcauaccacuuuugu

SEQ ID NO: 2999573 - RNA, 13 nt, Human
ugcaguauagaau

SEQ ID NO: 2999574 - RNA, 14 nt, Human
ugcaguauagaaua

SEQ ID NO: 2999575 - RNA, 17 nt, Human
ugcagccucacaguccu

SEQ ID NO: 2999576 - RNA, 21 nt, Human
ugcagccucacaguccuuacc

SEQ ID NO: 2999577 - RNA, 18 nt, Human
ugcagccucacaguccuu

SEQ ID NO: 2999578 - RNA, 14 nt, Human
agccucuguuuuga

SEQ ID NO: 2999579 - RNA, 17 nt, Human
agccucuguuuugauau

SEQ ID NO: 2999580 - RNA, 21 nt, Human
ugcagacaggcaagcaccucc

SEQ ID NO: 2999581 - RNA, 13 nt, Human
ugcagacaggcaa

SEQ ID NO: 2999582 - RNA, 12 nt, Human
ugcagacaggca

SEQ ID NO: 2999583 - RNA, 14 nt, Human
agccuccugcccuu

SEQ ID NO: 2999584 - RNA, 18 nt, Human
agccuccugcccuuaccu

SEQ ID NO: 2999585 - RNA, 13 nt, Human
agccuccugcccu

SEQ ID NO: 2999586 - RNA, 13 nt, Human
ugccauaauuacu

SEQ ID NO: 2999587 - RNA, 17 nt, Human
ugccaguuauggcuaua

SEQ ID NO: 2999588 - RNA, 17 nt, Human
ugccagccgagauagcc

SEQ ID NO: 2999589 - RNA, 22 nt, Human
ugccagccgagauagccaaggc

SEQ ID NO: 2999590 - RNA, 16 nt, Human
ugcauuuaaaagauac

SEQ ID NO: 2999591 - RNA, 13 nt, Human
ugccaauggacua

SEQ ID NO: 2999592 - RNA, 14 nt, Human
ugccaaugggagcu

SEQ ID NO: 2999593 - RNA, 22 nt, Human
ugccaaugcuacaguaauaaau

SEQ ID NO: 2999594 - RNA, 17 nt, Human
ugccaaugcuacaguaa

SEQ ID NO: 2999595 - RNA, 19 nt, Human
agccugagcgacagugaga

SEQ ID NO: 2999596 - RNA, 19 nt, Human
agccugugccucugggacu

SEQ ID NO: 2999597 - RNA, 18 nt, Human
agccugugccucugggac

SEQ ID NO: 2999598 - RNA, 17 nt, Human
agccugugccucuggga

SEQ ID NO: 2999599 - RNA, 23 nt, Human
agccuugaacuuugaccucugca

SEQ ID NO: 2999600 - RNA, 20 nt, Human
agccuuagaagucacacagu

SEQ ID NO: 2999601 - RNA, 19 nt, Human
agccuugcggaagguucua

SEQ ID NO: 2999602 - RNA, 21 nt, Human
agccuugaccauucuccaccu

SEQ ID NO: 2999603 - RNA, 18 nt, Human
agccuugaccauucucca

SEQ ID NO: 2999604 - RNA, 19 nt, Human
agccuugaccauucuccac

SEQ ID NO: 2999605 - RNA, 22 nt, Human
ugagugcaaacuucagaguucu

SEQ ID NO: 2999606 - RNA, 20 nt, Human
ugagugcaaacuucagaguu

SEQ ID NO: 2999607 - RNA, 18 nt, Human
ugagugcaaacuucagag

SEQ ID NO: 2999608 - RNA, 20 nt, Human
ugaguacguugugcauuugg

SEQ ID NO: 2999609 - RNA, 18 nt, Human
ugagucaccaagcccagu

SEQ ID NO: 2999610 - RNA, 14 nt, Human
ugaguggaguuacu

SEQ ID NO: 2999611 - RNA, 17 nt, Human
ugagugcagcucuggag

SEQ ID NO: 2999612 - RNA, 13 nt, Human
ugagugccuuaca

SEQ ID NO: 2999613 - RNA, 14 nt, Human
ugagugccuuacac

SEQ ID NO: 2999614 - RNA, 21 nt, Human
ugagugggggaucacagccuc

SEQ ID NO: 2999615 - RNA, 18 nt, Human
ugagugucuuaauuaaaa

SEQ ID NO: 2999616 - RNA, 18 nt, Human
ugaguucauacccuguua

SEQ ID NO: 2999617 - RNA, 15 nt, Human
ugauacaaugcugug

SEQ ID NO: 2999618 - RNA, 14 nt, Human
ugauacaaugcugu

SEQ ID NO: 2999619 - RNA, 22 nt, Human
agcaguuugguuucuagcauga

SEQ ID NO: 2999620 - RNA, 23 nt, Human
agcaguuugguuucuagcaugaa

SEQ ID NO: 2999621 - RNA, 19 nt, Human
agcauaaaaauuagccaag

SEQ ID NO: 2999622 - RNA, 20 nt, Human
agcaguuugguuucuagcau

SEQ ID NO: 2999623 - RNA, 19 nt, Human
agcagucaggaaagagaac

SEQ ID NO: 2999624 - RNA, 18 nt, Human
agcagucaggaaagagaa

SEQ ID NO: 2999625 - RNA, 17 nt, Human
agcagucaggaaagaga

SEQ ID NO: 2999626 - RNA, 19 nt, Human
agcauaccaacacgagcag

SEQ ID NO: 2999627 - RNA, 22 nt, Human
agcauaccaacacgagcaggcu

SEQ ID NO: 2999628 - RNA, 13 nt, Human
agcauaccaacac

SEQ ID NO: 2999629 - RNA, 23 nt, Human
agcauaaaaauuagccaagugug

SEQ ID NO: 2999630 - RNA, 19 nt, Human
ugaguacguugugcauuug

SEQ ID NO: 2999631 - RNA, 18 nt, Human
ugaguacguugugcauuu

SEQ ID NO: 2999632 - RNA, 17 nt, Human
ugaguacguugugcauu

SEQ ID NO: 2999633 - RNA, 16 nt, Human
ugaguacguugugcau

SEQ ID NO: 2999634 - RNA, 20 nt, Human
agcaggaagcugugagagca

SEQ ID NO: 2999635 - RNA, 13 nt, Human
agcaggacaugga

SEQ ID NO: 2999636 - RNA, 11 nt, Human
agcagccacau

SEQ ID NO: 2999637 - RNA, 16 nt, Human
agcagcagggagggcu

SEQ ID NO: 2999638 - RNA, 20 nt, Human
ugacccaugcugcccuguga

SEQ ID NO: 2999639 - RNA, 18 nt, Human
ugacccaugcugcccugu

SEQ ID NO: 2999640 - RNA, 19 nt, Human
ugacccaugcugcccugug

SEQ ID NO: 2999641 - RNA, 17 nt, Human
ugacccaugcugcccug

SEQ ID NO: 2999642 - RNA, 16 nt, Human
agcaggcuacugucag

SEQ ID NO: 2999643 - RNA, 17 nt, Human
agcaggcuacugucagc

SEQ ID NO: 2999644 - RNA, 19 nt, Human
agcaggcuacugucagcuc

SEQ ID NO: 2999645 - RNA, 20 nt, Human
agcaggcuacugucagcucc

SEQ ID NO: 2999646 - RNA, 14 nt, Human
agcaggcuacuguc

SEQ ID NO: 2999647 - RNA, 19 nt, Human
agcagggcauggcugggaa

SEQ ID NO: 2999648 - RNA, 20 nt, Human
agcagggagggcuucugcca

SEQ ID NO: 2999649 - RNA, 15 nt, Human
agcagggcucagcgg

SEQ ID NO: 2999650 - RNA, 14 nt, Human
agcagggcucagcg

SEQ ID NO: 2999651 - RNA, 13 nt, Human
agcagggcucagc

SEQ ID NO: 2999652 - RNA, 22 nt, Human
agcagggcucagcggggacagc

SEQ ID NO: 2999653 - RNA, 17 nt, Human
agcaggcucgggcuccc

SEQ ID NO: 2999654 - RNA, 13 nt, Human
agcaggcucucag

SEQ ID NO: 2999655 - RNA, 14 nt, Human
agcaggcucucagg

SEQ ID NO: 2999656 - RNA, 15 nt, Human
agcaggcucucaggc

SEQ ID NO: 2999657 - RNA, 16 nt, Human
agcaggcucucaggcc

SEQ ID NO: 2999658 - RNA, 17 nt, Human
agcaggcucucaggcca

SEQ ID NO: 2999659 - RNA, 18 nt, Human
agcaggcucucaggccag

SEQ ID NO: 2999660 - RNA, 19 nt, Human
agcaggcucucaggccagc

SEQ ID NO: 2999661 - RNA, 21 nt, Human
agcaggcucucaggccagcug

SEQ ID NO: 2999662 - RNA, 22 nt, Human
agcaggcucucaggccagcugc

SEQ ID NO: 2999663 - RNA, 23 nt, Human
agcaggcucucaggccagcugcu

SEQ ID NO: 2999664 - RNA, 22 nt, Human
agcaggcugccagugccugggu

SEQ ID NO: 2999665 - RNA, 20 nt, Human
agcaggcugccagugccugg

SEQ ID NO: 2999666 - RNA, 18 nt, Human
agcaggcugccagugccu

SEQ ID NO: 2999667 - RNA, 17 nt, Human
agcaggcugccagugcc

SEQ ID NO: 2999668 - RNA, 14 nt, Human
agcaggcugccagu

SEQ ID NO: 2999669 - RNA, 13 nt, Human
agcaggcugccag

SEQ ID NO: 2999670 - RNA, 15 nt, Human
agcagggaaacagcu

SEQ ID NO: 2999671 - RNA, 14 nt, Human
agcagggaaacagc

SEQ ID NO: 2999672 - RNA, 13 nt, Human
agcagggaaacag

SEQ ID NO: 2999673 - RNA, 16 nt, Human
ugauuaaguaaugaua

SEQ ID NO: 2999674 - RNA, 16 nt, Human
agccacggccaggcca

SEQ ID NO: 2999675 - RNA, 15 nt, Human
ugauuaaguaaugau

SEQ ID NO: 2999676 - RNA, 16 nt, Human
ugauuaaauucuugca

SEQ ID NO: 2999677 - RNA, 13 nt, Human
ugauuaaauucuu

SEQ ID NO: 2999678 - RNA, 17 nt, Human
ugauuaaauucuugcaa

SEQ ID NO: 2999679 - RNA, 20 nt, Human
ugauuaaccacuucagcuga

SEQ ID NO: 2999680 - RNA, 21 nt, Human
ugauguuuuaaggaugcuugu

SEQ ID NO: 2999681 - RNA, 17 nt, Human
ugauguuuuccaugagu

SEQ ID NO: 2999682 - RNA, 19 nt, Human
ugauguuuuccaugagucc

SEQ ID NO: 2999683 - RNA, 22 nt, Human
ugauggggcccugccuccuuug

SEQ ID NO: 2999684 - RNA, 20 nt, Human
ugaugaucuuugcagacagg

SEQ ID NO: 2999685 - RNA, 19 nt, Human
ugaugaucuuugcagacag

SEQ ID NO: 2999686 - RNA, 23 nt, Human
ugaugaaaugaggucagagccug

SEQ ID NO: 2999687 - RNA, 14 nt, Human
ugaucuaggaagac

SEQ ID NO: 2999688 - RNA, 15 nt, Human
ugaucuaggaagacu

SEQ ID NO: 2999689 - RNA, 22 nt, Human
ugaugaaaugaggucagagccu

SEQ ID NO: 2999690 - RNA, 21 nt, Human
ugaugaucuuugcagacaggc

SEQ ID NO: 2999691 - RNA, 13 nt, Human
ugauggggcccug

SEQ ID NO: 2999692 - RNA, 22 nt, Human
ugaugggcaacccccagccugc

SEQ ID NO: 2999693 - RNA, 21 nt, Human
ugaugggcaacccccagccug

SEQ ID NO: 2999694 - RNA, 18 nt, Human
ugauccucccaccucagc

SEQ ID NO: 2999695 - RNA, 20 nt, Human
ugauccucccaccucagccu

SEQ ID NO: 2999696 - RNA, 19 nt, Human
ugauccucccaccucagcc

SEQ ID NO: 2999697 - RNA, 13 nt, Human
ugaucuaggaaga

SEQ ID NO: 2999698 - RNA, 16 nt, Human
ugauccucccaccuca

SEQ ID NO: 2999699 - RNA, 17 nt, Human
agcauauucaggaagcu

SEQ ID NO: 2999700 - RNA, 19 nt, Human
agcauauucaggaagcuca

SEQ ID NO: 2999701 - RNA, 21 nt, Human
agcauauucaggaagcucagg

SEQ ID NO: 2999702 - RNA, 20 nt, Human
agcaucacaugaacuuguaa

SEQ ID NO: 2999703 - RNA, 14 nt, Human
ugaucacggcucac

SEQ ID NO: 2999704 - RNA, 13 nt, Human
ugaucacggcuca

SEQ ID NO: 2999705 - RNA, 15 nt, Human
ugaucacggcucacu

SEQ ID NO: 2999706 - RNA, 21 nt, Human
ugauacagaaaaguugaauuu

SEQ ID NO: 2999707 - RNA, 13 nt, Human
agcauggcugcca

SEQ ID NO: 2999708 - RNA, 15 nt, Human
agcauccuggaauau

SEQ ID NO: 2999709 - RNA, 14 nt, Human
agcauccuggaaua

SEQ ID NO: 2999710 - RNA, 13 nt, Human
agcauccuggaau

SEQ ID NO: 2999711 - RNA, 16 nt, Human
agcauauucaggaagc

SEQ ID NO: 2999712 - RNA, 22 nt, Human
agcaucaggccaggcccucugc

SEQ ID NO: 2999713 - RNA, 21 nt, Human
agcaucaggccaggcccucug

SEQ ID NO: 2999714 - RNA, 23 nt, Human
agcaucaggccaggcccucugcc

SEQ ID NO: 2999715 - RNA, 15 nt, Human
agcauuuugcuaaau

SEQ ID NO: 2999716 - RNA, 22 nt, Human
agcauuuugcuaaaugugaaug

SEQ ID NO: 2999717 - RNA, 15 nt, Human
agccaaaacugagca

SEQ ID NO: 2999718 - RNA, 15 nt, Human
agcauuuuuuaaccu

SEQ ID NO: 2999719 - RNA, 19 nt, Human
agcauuuuaaacaaaauag

SEQ ID NO: 2999720 - RNA, 17 nt, Human
agcauuuuaaacaaaau

SEQ ID NO: 2999721 - RNA, 15 nt, Human
agcauuuuaaacaaa

SEQ ID NO: 2999722 - RNA, 13 nt, Human
agcauuuuaaaca

SEQ ID NO: 2999723 - RNA, 18 nt, Human
agcauuuguguugaagag

SEQ ID NO: 2999724 - RNA, 17 nt, Human
agcauuuguguugaaga

SEQ ID NO: 2999725 - RNA, 20 nt, Human
agcauuuuaaacaaaauaga

SEQ ID NO: 2999726 - RNA, 19 nt, Human
agcauggcugccaauggga

SEQ ID NO: 2999727 - RNA, 22 nt, Human
agcauuuagauguauagguuga

SEQ ID NO: 2999728 - RNA, 18 nt, Human
ugaaauaaggaaugauau

SEQ ID NO: 2999729 - RNA, 14 nt, Human
ugaaauaaggaaug

SEQ ID NO: 2999730 - RNA, 15 nt, Human
ugaaauuguauuaca

SEQ ID NO: 2999731 - RNA, 23 nt, Human
ugaaauuuccugggagcuuuugu

SEQ ID NO: 2999732 - RNA, 23 nt, Human
ugaaauaagccagacaucaacag

SEQ ID NO: 2999733 - RNA, 20 nt, Human
ugaaauaagccagacaucaa

SEQ ID NO: 2999734 - RNA, 18 nt, Human
ugaaauaagccagacauc

SEQ ID NO: 2999735 - RNA, 17 nt, Human
ugaaauaagccagacau

SEQ ID NO: 2999736 - RNA, 14 nt, Human
ugaaauaagccaga

SEQ ID NO: 2999737 - RNA, 14 nt, Human
agagcugcccucuc

SEQ ID NO: 2999738 - RNA, 13 nt, Human
agagcugcccucu

SEQ ID NO: 2999739 - RNA, 18 nt, Human
agagcugccaccugccug

SEQ ID NO: 2999740 - RNA, 17 nt, Human
ucuuuggacccugaggc

SEQ ID NO: 2999741 - RNA, 21 nt, Human
ucuuuggacccugaggcccag

SEQ ID NO: 2999742 - RNA, 16 nt, Human
agagauugugguuuca

SEQ ID NO: 2999743 - RNA, 12 nt, Human
agagcagagacc

SEQ ID NO: 2999744 - RNA, 17 nt, Human
agagcagagaccauccc

SEQ ID NO: 2999745 - RNA, 18 nt, Human
agagcagagaccaucccu

SEQ ID NO: 2999746 - RNA, 20 nt, Human
agagcagagaccaucccuga

SEQ ID NO: 2999747 - RNA, 21 nt, Human
agagcaggccaggcgcggugg

SEQ ID NO: 2999748 - RNA, 15 nt, Human
agagcaggccaggcg

SEQ ID NO: 2999749 - RNA, 13 nt, Human
agagcaggccagg

SEQ ID NO: 2999750 - RNA, 21 nt, Human
agagccuugcggaagguucua

SEQ ID NO: 2999751 - RNA, 11 nt, Human
agagccuugcg

SEQ ID NO: 2999752 - RNA, 15 nt, Human
agagguugcagugag

SEQ ID NO: 2999753 - RNA, 18 nt, Human
agagguacacuugugaau

SEQ ID NO: 2999754 - RNA, 22 nt, Human
ugaagcacagugaucaaguuau

SEQ ID NO: 2999755 - RNA, 12 nt, Human
agagguuuuaaa

SEQ ID NO: 2999756 - RNA, 13 nt, Human
agaggcagggucu

SEQ ID NO: 2999757 - RNA, 10 nt, Human
agaggcaggg

SEQ ID NO: 2999758 - RNA, 17 nt, Human
agaggcuaugugagcac

SEQ ID NO: 2999759 - RNA, 19 nt, Human
agaggccaugggccuccug

SEQ ID NO: 2999760 - RNA, 19 nt, Human
agaggcagccccauucugc

SEQ ID NO: 2999761 - RNA, 13 nt, Human
agaggcagcccca

SEQ ID NO: 2999762 - RNA, 24 nt, Human
agaggcagccccauucugccugcc

SEQ ID NO: 2999763 - RNA, 21 nt, Human
agagcuguucacagccagacu

SEQ ID NO: 2999764 - RNA, 19 nt, Human
agagcuguucacagccaga

SEQ ID NO: 2999765 - RNA, 22 nt, Human
ugaacuuugaccucugcagcaa

SEQ ID NO: 2999766 - RNA, 17 nt, Human
ugaacuuugaccucugc

SEQ ID NO: 2999767 - RNA, 20 nt, Human
ugaacuuugaccucugcagc

SEQ ID NO: 2999768 - RNA, 19 nt, Human
ugaacuuugaccucugcag

SEQ ID NO: 2999769 - RNA, 22 nt, Human
agagcugcccucuccugggcag

SEQ ID NO: 2999770 - RNA, 23 nt, Human
ugaacuagaguuuagcuggaaaa

SEQ ID NO: 2999771 - RNA, 12 nt, Human
ugaacuccuggc

SEQ ID NO: 2999772 - RNA, 11 nt, Human
ugaacuccugg

SEQ ID NO: 2999773 - RNA, 15 nt, Human
ugaacuccuggccuc

SEQ ID NO: 2999774 - RNA, 14 nt, Human
ugaacuccuggccu

SEQ ID NO: 2999775 - RNA, 15 nt, Human
ugaaauuuuuauuaa

SEQ ID NO: 2999776 - RNA, 18 nt, Human
ugaacaaauuuacagaga

SEQ ID NO: 2999777 - RNA, 20 nt, Human
ugaacaaauuuacagagaca

SEQ ID NO: 2999778 - RNA, 19 nt, Human
ugaacaaauuuacagagac

SEQ ID NO: 2999779 - RNA, 22 nt, Human
ugaaccgaugagaaauaaaguu

SEQ ID NO: 2999780 - RNA, 15 nt, Human
ugaaugucaguuguu

SEQ ID NO: 2999781 - RNA, 19 nt, Human
ugaaugucagugugacuga

SEQ ID NO: 2999782 - RNA, 16 nt, Human
ugaagcagaguggcag

SEQ ID NO: 2999783 - RNA, 13 nt, Human
ugaagcagagugg

SEQ ID NO: 2999784 - RNA, 12 nt, Human
ugaagcagagug

SEQ ID NO: 2999785 - RNA, 20 nt, Human
ugaaugguuuucaaaauaaa

SEQ ID NO: 2999786 - RNA, 22 nt, Human
agagucagaaguuucugccgca

SEQ ID NO: 2999787 - RNA, 17 nt, Human
agaguuuagcuggaaaa

SEQ ID NO: 2999788 - RNA, 16 nt, Human
agaguuuagcuggaaa

SEQ ID NO: 2999789 - RNA, 21 nt, Human
agaguuguuacauuuuuaagu

SEQ ID NO: 2999790 - RNA, 12 nt, Human
agaguuguuaca

SEQ ID NO: 2999791 - RNA, 22 nt, Human
agaguugauacuacaguuuguu

SEQ ID NO: 2999792 - RNA, 20 nt, Human
agaguugauacuacaguuug

SEQ ID NO: 2999793 - RNA, 17 nt, Human
agaguugauacuacagu

SEQ ID NO: 2999794 - RNA, 16 nt, Human
agaucacgccacugca

SEQ ID NO: 2999795 - RNA, 15 nt, Human
agaucacgccacugc

SEQ ID NO: 2999796 - RNA, 14 nt, Human
agaucacgccacug

SEQ ID NO: 2999797 - RNA, 16 nt, Human
agauaugauucaaaug

SEQ ID NO: 2999798 - RNA, 15 nt, Human
agauacugaaauaaa

SEQ ID NO: 2999799 - RNA, 13 nt, Human
agauacugaaaua

SEQ ID NO: 2999800 - RNA, 12 nt, Human
agauacugaaau

SEQ ID NO: 2999801 - RNA, 12 nt, Human
agauaaaugugc

SEQ ID NO: 2999802 - RNA, 15 nt, Human
agaguuuagcccuga

SEQ ID NO: 2999803 - RNA, 18 nt, Human
agaucacgccacugcacu

SEQ ID NO: 2999804 - RNA, 17 nt, Human
agaucacgccacugcac

SEQ ID NO: 2999805 - RNA, 15 nt, Human
ugaauuucuuuugcc

SEQ ID NO: 2999806 - RNA, 16 nt, Human
ugaauuuuacauggcu

SEQ ID NO: 2999807 - RNA, 20 nt, Human
ugacacacagcucuguccug

SEQ ID NO: 2999808 - RNA, 14 nt, Human
agaugcuagaacuc

SEQ ID NO: 2999809 - RNA, 19 nt, Human
agaugcaguucugaagaag

SEQ ID NO: 2999810 - RNA, 18 nt, Human
agaugcaguucugaagaa

SEQ ID NO: 2999811 - RNA, 17 nt, Human
agaugcaguucugaaga

SEQ ID NO: 2999812 - RNA, 15 nt, Human
agaugcaccagcccu

SEQ ID NO: 2999813 - RNA, 14 nt, Human
agaugcaccagccc

SEQ ID NO: 2999814 - RNA, 23 nt, Human
ugaccauucuccaccugccaggg

SEQ ID NO: 2999815 - RNA, 17 nt, Human
ugacccacaagaaauga

SEQ ID NO: 2999816 - RNA, 13 nt, Human
ugacccacugcuu

SEQ ID NO: 2999817 - RNA, 12 nt, Human
ugacccacugcu

SEQ ID NO: 2999818 - RNA, 15 nt, Human
agaugcuucucacug

SEQ ID NO: 2999819 - RNA, 18 nt, Human
ugaccaaugauggucacc

SEQ ID NO: 2999820 - RNA, 21 nt, Human
ugacauuguuggccaaagcca

SEQ ID NO: 2999821 - RNA, 20 nt, Human
ugacauuguuggccaaagcc

SEQ ID NO: 2999822 - RNA, 13 nt, Human
agaucagccuggg

SEQ ID NO: 2999823 - RNA, 15 nt, Human
agaucagccugggca

SEQ ID NO: 2999824 - RNA, 14 nt, Human
agaucaugcauaga

SEQ ID NO: 2999825 - RNA, 21 nt, Human
ugacacacagcucuguccugg

SEQ ID NO: 2999826 - RNA, 20 nt, Human
ugacaggcaaugcuggcugu

SEQ ID NO: 2999827 - RNA, 20 nt, Human
ugacagggcacaccgggcac

SEQ ID NO: 2999828 - RNA, 16 nt, Human
ugacagggcacaccgg

SEQ ID NO: 2999829 - RNA, 11 nt, Human
ugacagggcac

SEQ ID NO: 2999830 - RNA, 14 nt, Human
agacccggcugcgu

SEQ ID NO: 2999831 - RNA, 23 nt, Human
agacuauucaaacagucucagga

SEQ ID NO: 2999832 - RNA, 22 nt, Human
agaccugcccucaagagcaaag

SEQ ID NO: 2999833 - RNA, 17 nt, Human
ucuugagccuugaacuu

SEQ ID NO: 2999834 - RNA, 19 nt, Human
ucuugagccuugaacuuug

SEQ ID NO: 2999835 - RNA, 18 nt, Human
ucuugagccuugaacuuu

SEQ ID NO: 2999836 - RNA, 17 nt, Human
ucuuauuuaaugaaaga

SEQ ID NO: 2999837 - RNA, 15 nt, Human
ucuuauuucauuucu

SEQ ID NO: 2999838 - RNA, 16 nt, Human
ucuuauuucauuucuu

SEQ ID NO: 2999839 - RNA, 22 nt, Human
ucuucuguacgucugacaggca

SEQ ID NO: 2999840 - RNA, 21 nt, Human
ucuucuguacgucugacaggc

SEQ ID NO: 2999841 - RNA, 19 nt, Human
ucuucugcuucagccuccc

SEQ ID NO: 2999842 - RNA, 22 nt, Human
ucuucugcuucagccucccgag

SEQ ID NO: 2999843 - RNA, 23 nt, Human
agacauacuaaccagcagaaaug

SEQ ID NO: 2999844 - RNA, 20 nt, Human
ucuucuguacgucugacagg

SEQ ID NO: 2999845 - RNA, 15 nt, Human
agagacagaaagcag

SEQ ID NO: 2999846 - RNA, 24 nt, Human
agagacagaaagcagaacagugau

SEQ ID NO: 2999847 - RNA, 19 nt, Human
agacuuuucuuucagccaa

SEQ ID NO: 2999848 - RNA, 22 nt, Human
agagaaaaaauauuuuccugcc

SEQ ID NO: 2999849 - RNA, 22 nt, Human
agacuucucuacccaucuuaaa

SEQ ID NO: 2999850 - RNA, 14 nt, Human
agacuuuaaaagca

SEQ ID NO: 2999851 - RNA, 16 nt, Human
agacuguacaaaguag

SEQ ID NO: 2999852 - RNA, 15 nt, Human
agacuguacaaagua

SEQ ID NO: 2999853 - RNA, 14 nt, Human
agacuguacaaagu

SEQ ID NO: 2999854 - RNA, 20 nt, Human
agacucgcgacaaugcaaac

SEQ ID NO: 2999855 - RNA, 21 nt, Human
agacuuaaugagacuuuaaaa

SEQ ID NO: 2999856 - RNA, 20 nt, Human
agacuuaaugagacuuuaaa

SEQ ID NO: 2999857 - RNA, 20 nt, Human
ucuuuauaauucuacuuuga

SEQ ID NO: 2999858 - RNA, 13 nt, Human
ucuuucugcuuug

SEQ ID NO: 2999859 - RNA, 18 nt, Human
ucuuucuggcuaugcauu

SEQ ID NO: 2999860 - RNA, 15 nt, Human
agacucgcgacaaug

SEQ ID NO: 2999861 - RNA, 17 nt, Human
agacucgcgacaaugca

SEQ ID NO: 2999862 - RNA, 18 nt, Human
agacucgcgacaaugcaa

SEQ ID NO: 2999863 - RNA, 19 nt, Human
agacucgcgacaaugcaaa

SEQ ID NO: 2999864 - RNA, 20 nt, Human
ucuuuaaugucacaggcagg

SEQ ID NO: 2999865 - RNA, 16 nt, Human
ucuugguuuguaaauu

SEQ ID NO: 2999866 - RNA, 22 nt, Human
ucuuuaaugucacaggcagguc

SEQ ID NO: 2999867 - RNA, 14 nt, Human
ucuugguuuguaaa

SEQ ID NO: 2999868 - RNA, 12 nt, Human
agaauguuuuca

SEQ ID NO: 2999869 - RNA, 23 nt, Human
agaauuaacacaugauccugcaa

SEQ ID NO: 2999870 - RNA, 19 nt, Human
agaauuaguggcacuugcu

SEQ ID NO: 2999871 - RNA, 21 nt, Human
agaauguguuuaaacuugguu

SEQ ID NO: 2999872 - RNA, 23 nt, Human
agaaccccaggguccuguagccc

SEQ ID NO: 2999873 - RNA, 14 nt, Human
agaauucucuaguu

SEQ ID NO: 2999874 - RNA, 20 nt, Human
agaauuauaauuaguuccuc

SEQ ID NO: 2999875 - RNA, 20 nt, Human
agaauucucagaaucucaaa

SEQ ID NO: 2999876 - RNA, 15 nt, Human
ucuguauguguucua

SEQ ID NO: 2999877 - RNA, 12 nt, Human
ucuguauguguu

SEQ ID NO: 2999878 - RNA, 18 nt, Human
ucuguacgucugacaggc

SEQ ID NO: 2999879 - RNA, 17 nt, Human
ucugugaugacauuccc

SEQ ID NO: 2999880 - RNA, 20 nt, Human
ucugugaugacauucccugc

SEQ ID NO: 2999881 - RNA, 19 nt, Human
ucuguuuagauaauacacc

SEQ ID NO: 2999882 - RNA, 16 nt, Human
ucuguuuagauaauac

SEQ ID NO: 2999883 - RNA, 23 nt, Human
ucuguuuagauaauacaccacua

SEQ ID NO: 2999884 - RNA, 13 nt, Human
ucuguuuagauaa

SEQ ID NO: 2999885 - RNA, 14 nt, Human
agacaguuggguuu

SEQ ID NO: 2999886 - RNA, 12 nt, Human
agacagucccug

SEQ ID NO: 2999887 - RNA, 15 nt, Human
agacagcugccuggg

SEQ ID NO: 2999888 - RNA, 16 nt, Human
agacagcugccuggga

SEQ ID NO: 2999889 - RNA, 13 nt, Human
agacagucccugc

SEQ ID NO: 2999890 - RNA, 19 nt, Human
agacagucccugccaaugg

SEQ ID NO: 2999891 - RNA, 15 nt, Human
ucuuacaucugaaau

SEQ ID NO: 2999892 - RNA, 12 nt, Human
ucuuagauguau

SEQ ID NO: 2999893 - RNA, 23 nt, Human
ucuuagaugcaguucugaagaag

SEQ ID NO: 2999894 - RNA, 22 nt, Human
ucuuagaugcaguucugaagaa

SEQ ID NO: 2999895 - RNA, 18 nt, Human
ucuuaugggcuggguucu

SEQ ID NO: 2999896 - RNA, 16 nt, Human
agacacacugaagaag

SEQ ID NO: 2999897 - RNA, 17 nt, Human
agacacacugaagaagc

SEQ ID NO: 2999898 - RNA, 17 nt, Human
agacacaggcccggcuc

SEQ ID NO: 2999899 - RNA, 22 nt, Human
agacacaggcccggcuccaggc

SEQ ID NO: 2999900 - RNA, 21 nt, Human
agacacaggcccggcuccagg

SEQ ID NO: 2999901 - RNA, 20 nt, Human
agacacaggcccggcuccag

SEQ ID NO: 2999902 - RNA, 19 nt, Human
agacacaggcccggcucca

SEQ ID NO: 2999903 - RNA, 14 nt, Human
agacacaagccuuc

SEQ ID NO: 2999904 - RNA, 15 nt, Human
agacacacaugaagu

SEQ ID NO: 2999905 - RNA, 13 nt, Human
agacacaagccuu

SEQ ID NO: 2999906 - RNA, 19 nt, Human
agaauucucuaguuugauu

SEQ ID NO: 2999907 - RNA, 18 nt, Human
agaauucucuaguuugau

SEQ ID NO: 2999908 - RNA, 17 nt, Human
agaauucucuuauccaa

SEQ ID NO: 2999909 - RNA, 13 nt, Human
agacagcugccug

SEQ ID NO: 2999910 - RNA, 14 nt, Human
agacagcugccugg

SEQ ID NO: 2999911 - RNA, 21 nt, Human
agacacauguccaagaagccc

SEQ ID NO: 2999912 - RNA, 22 nt, Human
agacacauguccaagaagccca

SEQ ID NO: 2999913 - RNA, 23 nt, Human
agacacaggcccggcuccaggcu

SEQ ID NO: 2999914 - RNA, 24 nt, Human
agacacauguccaagaagcccagg

SEQ ID NO: 2999915 - RNA, 19 nt, Human
agacaccuugacagggcac

SEQ ID NO: 2999916 - RNA, 22 nt, Human
agacaccuugacagggcacacc

SEQ ID NO: 2999917 - RNA, 21 nt, Human
ucuauuucuggaugaaugccc

SEQ ID NO: 2999918 - RNA, 23 nt, Human
ucucacacaugagcaucaggcca

SEQ ID NO: 2999919 - RNA, 11 nt, Human
acuucagcuga

SEQ ID NO: 2999920 - RNA, 16 nt, Human
acuucagcugacuuuu

SEQ ID NO: 2999921 - RNA, 15 nt, Human
ucuauuuauuuguga

SEQ ID NO: 2999922 - RNA, 11 nt, Human
ucucacuccuu

SEQ ID NO: 2999923 - RNA, 23 nt, Human
acuucuaaguaaaaccacagcag

SEQ ID NO: 2999924 - RNA, 14 nt, Human
acuucuccacccug

SEQ ID NO: 2999925 - RNA, 21 nt, Human
acuucuaaguaaaaccacagc

SEQ ID NO: 2999926 - RNA, 12 nt, Human
ucucacucuguc

SEQ ID NO: 2999927 - RNA, 13 nt, Human
ucucacuccuuga

SEQ ID NO: 2999928 - RNA, 22 nt, Human
acuucgggaggucgaggcagga

SEQ ID NO: 2999929 - RNA, 20 nt, Human
acuugaacccgggaggcaga

SEQ ID NO: 2999930 - RNA, 19 nt, Human
acuugaacccgggaggcag

SEQ ID NO: 2999931 - RNA, 21 nt, Human
acuugaacccauauuuguaca

SEQ ID NO: 2999932 - RNA, 16 nt, Human
acuucuccacccugcu

SEQ ID NO: 2999933 - RNA, 15 nt, Human
acuucuccacccugc

SEQ ID NO: 2999934 - RNA, 19 nt, Human
acuugagcccagagugaac

SEQ ID NO: 2999935 - RNA, 16 nt, Human
acuugucaauaaaauc

SEQ ID NO: 2999936 - RNA, 18 nt, Human
acuuguggacacagcucu

SEQ ID NO: 2999937 - RNA, 17 nt, Human
acuuguggacacagcuc

SEQ ID NO: 2999938 - RNA, 16 nt, Human
acuuguggacacagcu

SEQ ID NO: 2999939 - RNA, 11 nt, Human
acuuuaaacua

SEQ ID NO: 2999940 - RNA, 16 nt, Human
acuuguguuuugcaag

SEQ ID NO: 2999941 - RNA, 21 nt, Human
ucuccuccuuuucacaguucu

SEQ ID NO: 2999942 - RNA, 16 nt, Human
acuuucuagccagagg

SEQ ID NO: 2999943 - RNA, 17 nt, Human
acuuucuagccagagga

SEQ ID NO: 2999944 - RNA, 14 nt, Human
acuuugaccucugc

SEQ ID NO: 2999945 - RNA, 16 nt, Human
ucuccauguuugaugu

SEQ ID NO: 2999946 - RNA, 16 nt, Human
ucuccaggcuguaucc

SEQ ID NO: 2999947 - RNA, 13 nt, Human
ucuccaaaauaaa

SEQ ID NO: 2999948 - RNA, 22 nt, Human
ucuccaaaauaaaacuuuuuaa

SEQ ID NO: 2999949 - RNA, 19 nt, Human
ucuccaaaauaaaacuuuu

SEQ ID NO: 2999950 - RNA, 17 nt, Human
ucuccaaaauaaaacuu

SEQ ID NO: 2999951 - RNA, 11 nt, Human
ucuccaggcug

SEQ ID NO: 2999952 - RNA, 14 nt, Human
ucucagggccuggu

SEQ ID NO: 2999953 - RNA, 15 nt, Human
ucucagggccugguc

SEQ ID NO: 2999954 - RNA, 19 nt, Human
ucucagggccuggucguuu

SEQ ID NO: 2999955 - RNA, 15 nt, Human
acuuguggacacagc

SEQ ID NO: 2999956 - RNA, 12 nt, Human
ucucagggccug

SEQ ID NO: 2999957 - RNA, 13 nt, Human
ucucagggccugg

SEQ ID NO: 2999958 - RNA, 18 nt, Human
ucucucaucuguuacaca

SEQ ID NO: 2999959 - RNA, 17 nt, Human
ucucuccagccccugga

SEQ ID NO: 2999960 - RNA, 16 nt, Human
ucucuccagccccugg

SEQ ID NO: 2999961 - RNA, 18 nt, Human
ucucuccagccccuggau

SEQ ID NO: 2999962 - RNA, 19 nt, Human
ucucuccagccccuggaug

SEQ ID NO: 2999963 - RNA, 16 nt, Human
acuuugaccucugcag

SEQ ID NO: 2999964 - RNA, 15 nt, Human
acuuugaccucugca

SEQ ID NO: 2999965 - RNA, 18 nt, Human
acuuugaccucugcagca

SEQ ID NO: 2999966 - RNA, 13 nt, Human
ucucucacuccuu

SEQ ID NO: 2999967 - RNA, 15 nt, Human
ucucucacuccuuga

SEQ ID NO: 2999968 - RNA, 21 nt, Human
ucucucaggccaaacucaccu

SEQ ID NO: 2999969 - RNA, 17 nt, Human
ucucucacuuguuuuau

SEQ ID NO: 2999970 - RNA, 12 nt, Human
ucucuggccuuc

SEQ ID NO: 2999971 - RNA, 11 nt, Human
ucucugcccuc

SEQ ID NO: 2999972 - RNA, 15 nt, Human
ucucugcccuccaag

SEQ ID NO: 2999973 - RNA, 16 nt, Human
ucucugcccuccaaga

SEQ ID NO: 2999974 - RNA, 17 nt, Human
ucucugcccuccaagac

SEQ ID NO: 2999975 - RNA, 14 nt, Human
ucucuccuguaccu

SEQ ID NO: 2999976 - RNA, 16 nt, Human
ucucuccuguaccucu

SEQ ID NO: 2999977 - RNA, 23 nt, Human
agaaacuuaagguuaccuuuguu

SEQ ID NO: 2999978 - RNA, 17 nt, Human
agaaaaaggaugcacag

SEQ ID NO: 2999979 - RNA, 17 nt, Human
ucucuugagccugggag

SEQ ID NO: 2999980 - RNA, 22 nt, Human
ucucuggccuucggccuccauc

SEQ ID NO: 2999981 - RNA, 21 nt, Human
ucucuggccuucggccuccau

SEQ ID NO: 2999982 - RNA, 14 nt, Human
ucucuugauucaua

SEQ ID NO: 2999983 - RNA, 16 nt, Human
ucucuugauucauaau

SEQ ID NO: 2999984 - RNA, 18 nt, Human
ucucuugagccugggagg

SEQ ID NO: 2999985 - RNA, 21 nt, Human
ucucuuuaaugucacaggcag

SEQ ID NO: 2999986 - RNA, 20 nt, Human
ucucuuuaaugucacaggca

SEQ ID NO: 2999987 - RNA, 13 nt, Human
agaaaaagaaaaa

SEQ ID NO: 2999988 - RNA, 12 nt, Human
ucugacuauaac

SEQ ID NO: 2999989 - RNA, 22 nt, Human
ucugagacucgcgacaaugcaa

SEQ ID NO: 2999990 - RNA, 23 nt, Human
ucugagacucgcgacaaugcaaa

SEQ ID NO: 2999991 - RNA, 18 nt, Human
ucugcacuccccugcugg

SEQ ID NO: 2999992 - RNA, 19 nt, Human
ucugcacuccccugcuggg

SEQ ID NO: 2999993 - RNA, 17 nt, Human
ucugcacuccccugcug

SEQ ID NO: 2999994 - RNA, 20 nt, Human
ucugcacuccccugcugggu

SEQ ID NO: 2999995 - RNA, 18 nt, Human
ucugcagcaauaaagcag

SEQ ID NO: 2999996 - RNA, 19 nt, Human
agaaauaucugaaaaugua

SEQ ID NO: 2999997 - RNA, 14 nt, Human
agaaauauaauuga

SEQ ID NO: 2999998 - RNA, 20 nt, Human
agaaauaucugaaaauguau

SEQ ID NO: 2999999 - RNA, 12 nt, Human
ucugaagaagau

SEQ ID NO: 3000000 - RNA, 18 nt, Human
ucgcuccaccuugcagcu

SEQ ID NO: 3000001 - RNA, 16 nt, Human
ucgcgacaaugcaaac

SEQ ID NO: 3000002 - RNA, 14 nt, Human
ucgcgacaaugcaa

SEQ ID NO: 3000003 - RNA, 19 nt, Human
ucgcgacaaugcaaaccau

SEQ ID NO: 3000004 - RNA, 16 nt, Human
ucgagcaugccuggau

SEQ ID NO: 3000005 - RNA, 18 nt, Human
ucgagcaugccuggaugg

SEQ ID NO: 3000006 - RNA, 15 nt, Human
ucgagcaugccugga

SEQ ID NO: 3000007 - RNA, 23 nt, Human
uccuuuagcgcccaguugggugg

SEQ ID NO: 3000008 - RNA, 22 nt, Human
uccuuuagcgcccaguugggug

SEQ ID NO: 3000009 - RNA, 23 nt, Human
uccuuguguuacuaaguuuuuau

SEQ ID NO: 3000010 - RNA, 14 nt, Human
uccuuguguuacua

SEQ ID NO: 3000011 - RNA, 19 nt, Human
uccuuuagcgcccaguugg

SEQ ID NO: 3000012 - RNA, 15 nt, Human
uccuuuagcgcccag

SEQ ID NO: 3000013 - RNA, 16 nt, Human
uccuucagugccuuau

SEQ ID NO: 3000014 - RNA, 17 nt, Human
uccuucagugccuuaug

SEQ ID NO: 3000015 - RNA, 14 nt, Human
uccuucagugccuu

SEQ ID NO: 3000016 - RNA, 15 nt, Human
uccuucagugccuua

SEQ ID NO: 3000017 - RNA, 14 nt, Human
acugcauuauauuu

SEQ ID NO: 3000018 - RNA, 15 nt, Human
acugcauuauauuua

SEQ ID NO: 3000019 - RNA, 16 nt, Human
acugcauaugaaagga

SEQ ID NO: 3000020 - RNA, 21 nt, Human
uccuagaaauuccccacccug

SEQ ID NO: 3000021 - RNA, 22 nt, Human
uccuagaaauuccccacccuga

SEQ ID NO: 3000022 - RNA, 16 nt, Human
acugcauguuugugau

SEQ ID NO: 3000023 - RNA, 15 nt, Human
acugcauguuuguga

SEQ ID NO: 3000024 - RNA, 20 nt, Human
acugcaucaagaugugacau

SEQ ID NO: 3000025 - RNA, 22 nt, Human
acugcaucaagaugugacaugu

SEQ ID NO: 3000026 - RNA, 19 nt, Human
acugccuucucaacuccaa

SEQ ID NO: 3000027 - RNA, 13 nt, Human
acugccuucucaa

SEQ ID NO: 3000028 - RNA, 18 nt, Human
acugcuuaacuucacaua

SEQ ID NO: 3000029 - RNA, 19 nt, Human
acuggcacaguuuucugag

SEQ ID NO: 3000030 - RNA, 20 nt, Human
acuggcacaguuuucugaga

SEQ ID NO: 3000031 - RNA, 13 nt, Human
acuggcacaguuu

SEQ ID NO: 3000032 - RNA, 15 nt, Human
acuggauuaaacuua

SEQ ID NO: 3000033 - RNA, 21 nt, Human
acugcuugugaaaggaaagag

SEQ ID NO: 3000034 - RNA, 17 nt, Human
acugcuuccagugaggc

SEQ ID NO: 3000035 - RNA, 20 nt, Human
acugcuuaacuucacauauu

SEQ ID NO: 3000036 - RNA, 13 nt, Human
ucuaaagcugcca

SEQ ID NO: 3000037 - RNA, 14 nt, Human
ucuaaagcugccag

SEQ ID NO: 3000038 - RNA, 20 nt, Human
ucuaaagccauuguaguccu

SEQ ID NO: 3000039 - RNA, 15 nt, Human
ucuaaagcugccagc

SEQ ID NO: 3000040 - RNA, 16 nt, Human
ucuaaagcugccagcc

SEQ ID NO: 3000041 - RNA, 21 nt, Human
ucuaaguaaaaccacagcagu

SEQ ID NO: 3000042 - RNA, 22 nt, Human
ucuaaguaaaaccacagcaguu

SEQ ID NO: 3000043 - RNA, 20 nt, Human
ucuaaguaaaaccacagcag

SEQ ID NO: 3000044 - RNA, 16 nt, Human
ucuacauacuauggaa

SEQ ID NO: 3000045 - RNA, 23 nt, Human
ucuaaguaaaaccacagcaguug

SEQ ID NO: 3000046 - RNA, 14 nt, Human
acuguucucugccc

SEQ ID NO: 3000047 - RNA, 15 nt, Human
acuguucucugcccu

SEQ ID NO: 3000048 - RNA, 20 nt, Human
acuguucucugcccuccaag

SEQ ID NO: 3000049 - RNA, 21 nt, Human
acuguucucugcccuccaaga

SEQ ID NO: 3000050 - RNA, 19 nt, Human
acuguucucugcccuccaa

SEQ ID NO: 3000051 - RNA, 15 nt, Human
acuuaaauaauguga

SEQ ID NO: 3000052 - RNA, 16 nt, Human
acuuaaauaaugugaa

SEQ ID NO: 3000053 - RNA, 18 nt, Human
acuuaaauaaugugaaac

SEQ ID NO: 3000054 - RNA, 17 nt, Human
acuuaaauaaugugaaa

SEQ ID NO: 3000055 - RNA, 14 nt, Human
acuguugcccaggc

SEQ ID NO: 3000056 - RNA, 13 nt, Human
acuguugcccagg

SEQ ID NO: 3000057 - RNA, 12 nt, Human
acuguugcccag

SEQ ID NO: 3000058 - RNA, 18 nt, Human
acuguugcccaggcuggc

SEQ ID NO: 3000059 - RNA, 17 nt, Human
acuguugcccaggcugg

SEQ ID NO: 3000060 - RNA, 16 nt, Human
acuuaaucuaaaugga

SEQ ID NO: 3000061 - RNA, 15 nt, Human
acuuaaucuaaaugg

SEQ ID NO: 3000062 - RNA, 13 nt, Human
acuuaaucuaaau

SEQ ID NO: 3000063 - RNA, 22 nt, Human
ucggguuuuauuguuuaaaauc

SEQ ID NO: 3000064 - RNA, 11 nt, Human
ucgggcaugac

SEQ ID NO: 3000065 - RNA, 12 nt, Human
ucgggcaugaca

SEQ ID NO: 3000066 - RNA, 19 nt, Human
ucgggaggucgaggcagga

SEQ ID NO: 3000067 - RNA, 21 nt, Human
ucgggaggucgaggcaggagg

SEQ ID NO: 3000068 - RNA, 17 nt, Human
ucgggaggucgaggcag

SEQ ID NO: 3000069 - RNA, 18 nt, Human
acuguggguagacacaca

SEQ ID NO: 3000070 - RNA, 13 nt, Human
acuguggguagac

SEQ ID NO: 3000071 - RNA, 17 nt, Human
acuguccuacccacccu

SEQ ID NO: 3000072 - RNA, 18 nt, Human
acuguccuacccacccuc

SEQ ID NO: 3000073 - RNA, 18 nt, Human
acugggacaggggagaac

SEQ ID NO: 3000074 - RNA, 21 nt, Human
acugucagcuccccucggaga

SEQ ID NO: 3000075 - RNA, 22 nt, Human
uccaaucugugaugacauuccc

SEQ ID NO: 3000076 - RNA, 17 nt, Human
uccacccaccucagccu

SEQ ID NO: 3000077 - RNA, 19 nt, Human
uccacccaccucagccucc

SEQ ID NO: 3000078 - RNA, 18 nt, Human
uccacccaccucagccuc

SEQ ID NO: 3000079 - RNA, 15 nt, Human
uccacccaggagccc

SEQ ID NO: 3000080 - RNA, 14 nt, Human
uccacccaggagcc

SEQ ID NO: 3000081 - RNA, 12 nt, Human
uccacccaggag

SEQ ID NO: 3000082 - RNA, 22 nt, Human
accuggauugugccuaaugugu

SEQ ID NO: 3000083 - RNA, 16 nt, Human
accuggccucugcacu

SEQ ID NO: 3000084 - RNA, 17 nt, Human
accuggccucugcacuc

SEQ ID NO: 3000085 - RNA, 14 nt, Human
accuggccucugca

SEQ ID NO: 3000086 - RNA, 19 nt, Human
accuuagacagucccugcc

SEQ ID NO: 3000087 - RNA, 20 nt, Human
accuuagacagucccugcca

SEQ ID NO: 3000088 - RNA, 18 nt, Human
accuuagacagucccugc

SEQ ID NO: 3000089 - RNA, 19 nt, Human
accuguuucugcagccacu

SEQ ID NO: 3000090 - RNA, 23 nt, Human
accuggcucuguggcgagccauu

SEQ ID NO: 3000091 - RNA, 14 nt, Human
accuggcucugugg

SEQ ID NO: 3000092 - RNA, 23 nt, Human
accuggccucugcacuccccugc

SEQ ID NO: 3000093 - RNA, 18 nt, Human
accuggccucugcacucc

SEQ ID NO: 3000094 - RNA, 20 nt, Human
accuggccucugcacucccc

SEQ ID NO: 3000095 - RNA, 21 nt, Human
uccaacuaucucauuuccaag

SEQ ID NO: 3000096 - RNA, 20 nt, Human
uccaagcuggucccacucag

SEQ ID NO: 3000097 - RNA, 16 nt, Human
uccaagcuggucccac

SEQ ID NO: 3000098 - RNA, 12 nt, Human
uccaagaagccc

SEQ ID NO: 3000099 - RNA, 18 nt, Human
uccaaggguacuaaggaa

SEQ ID NO: 3000100 - RNA, 21 nt, Human
uccaagcuggucccacucagu

SEQ ID NO: 3000101 - RNA, 23 nt, Human
uccaacccucaucaccaacgucu

SEQ ID NO: 3000102 - RNA, 16 nt, Human
uccaacccucaucacc

SEQ ID NO: 3000103 - RNA, 17 nt, Human
uccaacccucaucacca

SEQ ID NO: 3000104 - RNA, 14 nt, Human
uccaacccucauca

SEQ ID NO: 3000105 - RNA, 15 nt, Human
accugccaggaagcc

SEQ ID NO: 3000106 - RNA, 12 nt, Human
accugccaggaa

SEQ ID NO: 3000107 - RNA, 14 nt, Human
accugccaggaagc

SEQ ID NO: 3000108 - RNA, 14 nt, Human
acgagaaaacaaua

SEQ ID NO: 3000109 - RNA, 21 nt, Human
accuuuuuuauacauaaacaa

SEQ ID NO: 3000110 - RNA, 20 nt, Human
accuuuuuuauacauaaaca

SEQ ID NO: 3000111 - RNA, 19 nt, Human
accuuuuuuauacauaaac

SEQ ID NO: 3000112 - RNA, 21 nt, Human
uccaggcuguaucccaugagc

SEQ ID NO: 3000113 - RNA, 19 nt, Human
acgagcaggcuacugucag

SEQ ID NO: 3000114 - RNA, 20 nt, Human
acgagcaggcuacugucagc

SEQ ID NO: 3000115 - RNA, 19 nt, Human
acgccagauucuuuccuga

SEQ ID NO: 3000116 - RNA, 17 nt, Human
acgccagauucuuuccu

SEQ ID NO: 3000117 - RNA, 16 nt, Human
acgagcaggcuucuuc

SEQ ID NO: 3000118 - RNA, 14 nt, Human
uccaggcuguaucc

SEQ ID NO: 3000119 - RNA, 17 nt, Human
uccaggcagcagacaca

SEQ ID NO: 3000120 - RNA, 18 nt, Human
uccaggcagcagacacau

SEQ ID NO: 3000121 - RNA, 12 nt, Human
uccagccccugg

SEQ ID NO: 3000122 - RNA, 13 nt, Human
uccagccccugga

SEQ ID NO: 3000123 - RNA, 17 nt, Human
accuuuugagugccuua

SEQ ID NO: 3000124 - RNA, 20 nt, Human
accuuuugagugccuuacac

SEQ ID NO: 3000125 - RNA, 14 nt, Human
accuuuugagugcc

SEQ ID NO: 3000126 - RNA, 16 nt, Human
uccagaauuucccaaa

SEQ ID NO: 3000127 - RNA, 20 nt, Human
uccagaauuucccaaagcag

SEQ ID NO: 3000128 - RNA, 22 nt, Human
uccagaauuucccaaagcagug

SEQ ID NO: 3000129 - RNA, 14 nt, Human
uccagacccggcug

SEQ ID NO: 3000130 - RNA, 18 nt, Human
uccagacccggcugcgug

SEQ ID NO: 3000131 - RNA, 15 nt, Human
uccagacccggcugc

SEQ ID NO: 3000132 - RNA, 19 nt, Human
uccagacccggcugcgugg

SEQ ID NO: 3000133 - RNA, 21 nt, Human
ucauucuuuuugaaaugucaa

SEQ ID NO: 3000134 - RNA, 12 nt, Human
ucauucuucugu

SEQ ID NO: 3000135 - RNA, 12 nt, Human
ucauugaaaucu

SEQ ID NO: 3000136 - RNA, 13 nt, Human
ucauugaaaucuu

SEQ ID NO: 3000137 - RNA, 12 nt, Human
ucauuacuaaaa

SEQ ID NO: 3000138 - RNA, 19 nt, Human
accucggugccuuccucuu

SEQ ID NO: 3000139 - RNA, 13 nt, Human
accuccugggcua

SEQ ID NO: 3000140 - RNA, 22 nt, Human
ucauugaaaucuuuuugcuuug

SEQ ID NO: 3000141 - RNA, 12 nt, Human
ucauugaccuga

SEQ ID NO: 3000142 - RNA, 14 nt, Human
ucauugaccugagg

SEQ ID NO: 3000143 - RNA, 15 nt, Human
ucauugaccugaggc

SEQ ID NO: 3000144 - RNA, 14 nt, Human
accugaggcccuuc

SEQ ID NO: 3000145 - RNA, 15 nt, Human
accugaggcccuucu

SEQ ID NO: 3000146 - RNA, 16 nt, Human
accugaggcccuucuc

SEQ ID NO: 3000147 - RNA, 20 nt, Human
accugaggcccuucucucca

SEQ ID NO: 3000148 - RNA, 21 nt, Human
accugaggcccuucucuccag

SEQ ID NO: 3000149 - RNA, 22 nt, Human
accugaggcccuucucuccagc

SEQ ID NO: 3000150 - RNA, 16 nt, Human
accugaggggccucuu

SEQ ID NO: 3000151 - RNA, 15 nt, Human
accugauugugucuc

SEQ ID NO: 3000152 - RNA, 17 nt, Human
accugauugugucucuu

SEQ ID NO: 3000153 - RNA, 18 nt, Human
accugauugugucucuug

SEQ ID NO: 3000154 - RNA, 14 nt, Human
accugauugugucu

SEQ ID NO: 3000155 - RNA, 16 nt, Human
ucaugaauuaguuuua

SEQ ID NO: 3000156 - RNA, 22 nt, Human
ucauccuucuggaauaaggaga

SEQ ID NO: 3000157 - RNA, 13 nt, Human
ucauccuccucag

SEQ ID NO: 3000158 - RNA, 19 nt, Human
ucauccuccucagaucuuc

SEQ ID NO: 3000159 - RNA, 18 nt, Human
ucauccucauacccaccc

SEQ ID NO: 3000160 - RNA, 14 nt, Human
ucauccuucuggaa

SEQ ID NO: 3000161 - RNA, 13 nt, Human
accucccugcaau

SEQ ID NO: 3000162 - RNA, 12 nt, Human
accucccugcaa

SEQ ID NO: 3000163 - RNA, 12 nt, Human
accuccugccuc

SEQ ID NO: 3000164 - RNA, 13 nt, Human
accuccugccucg

SEQ ID NO: 3000165 - RNA, 15 nt, Human
ucauccuaagcuauu

SEQ ID NO: 3000166 - RNA, 23 nt, Human
accuccugccucgaacuggcugc

SEQ ID NO: 3000167 - RNA, 21 nt, Human
accuagggugauauuaaccag

SEQ ID NO: 3000168 - RNA, 16 nt, Human
accuagggugauauua

SEQ ID NO: 3000169 - RNA, 22 nt, Human
ucaggaaaucaaauaugcaaag

SEQ ID NO: 3000170 - RNA, 23 nt, Human
ucaggaaaucaaauaugcaaagc

SEQ ID NO: 3000171 - RNA, 12 nt, Human
ucaggaagcuca

SEQ ID NO: 3000172 - RNA, 13 nt, Human
ucaggaagcucag

SEQ ID NO: 3000173 - RNA, 14 nt, Human
ucaggaagcucagg

SEQ ID NO: 3000174 - RNA, 15 nt, Human
ucaggaagcucaggg

SEQ ID NO: 3000175 - RNA, 15 nt, Human
accgccuugcccagc

SEQ ID NO: 3000176 - RNA, 17 nt, Human
accgccuugcccagccu

SEQ ID NO: 3000177 - RNA, 16 nt, Human
accgccuugcccagcc

SEQ ID NO: 3000178 - RNA, 22 nt, Human
accgccuugcccagccuggaug

SEQ ID NO: 3000179 - RNA, 18 nt, Human
acuaacaggcuuagugau

SEQ ID NO: 3000180 - RNA, 17 nt, Human
acuaacaggcuuaguga

SEQ ID NO: 3000181 - RNA, 12 nt, Human
acuaacaggcuu

SEQ ID NO: 3000182 - RNA, 18 nt, Human
acuaacauuuauuugagu

SEQ ID NO: 3000183 - RNA, 12 nt, Human
acuaaccacgcu

SEQ ID NO: 3000184 - RNA, 14 nt, Human
acuacaguuuguua

SEQ ID NO: 3000185 - RNA, 13 nt, Human
acuacaguuuguu

SEQ ID NO: 3000186 - RNA, 17 nt, Human
acuacaguccucccauc

SEQ ID NO: 3000187 - RNA, 15 nt, Human
acuacaggcacccac

SEQ ID NO: 3000188 - RNA, 11 nt, Human
acuacaggcac

SEQ ID NO: 3000189 - RNA, 18 nt, Human
ucccagccagcaguucag

SEQ ID NO: 3000190 - RNA, 17 nt, Human
ucccagccagcaguuca

SEQ ID NO: 3000191 - RNA, 23 nt, Human
ucccagcacuuugggaggcugag

SEQ ID NO: 3000192 - RNA, 17 nt, Human
ucccagcugugcucugg

SEQ ID NO: 3000193 - RNA, 15 nt, Human
ucccagccaggcccu

SEQ ID NO: 3000194 - RNA, 14 nt, Human
ucccagccaggccc

SEQ ID NO: 3000195 - RNA, 13 nt, Human
ucccagccaggcc

SEQ ID NO: 3000196 - RNA, 12 nt, Human
ucccagccccaa

SEQ ID NO: 3000197 - RNA, 13 nt, Human
acuacauucuguu

SEQ ID NO: 3000198 - RNA, 12 nt, Human
acuacauucugu

SEQ ID NO: 3000199 - RNA, 11 nt, Human
acuacauucug

SEQ ID NO: 3000200 - RNA, 15 nt, Human
acuacaguuuguuag

SEQ ID NO: 3000201 - RNA, 14 nt, Human
acuacauucuguua

SEQ ID NO: 3000202 - RNA, 22 nt, Human
ucccagcacuuugggaggcuga

SEQ ID NO: 3000203 - RNA, 13 nt, Human
ucccagcacuuug

SEQ ID NO: 3000204 - RNA, 14 nt, Human
ucccagucauuuaa

SEQ ID NO: 3000205 - RNA, 22 nt, Human
ucccagucauuuaauaaaugug

SEQ ID NO: 3000206 - RNA, 15 nt, Human
ucccaucacccgcua

SEQ ID NO: 3000207 - RNA, 16 nt, Human
ucccauaugccugggc

SEQ ID NO: 3000208 - RNA, 22 nt, Human
ucccauaugccugggcagaagg

SEQ ID NO: 3000209 - RNA, 18 nt, Human
uccccaccgcagacagga

SEQ ID NO: 3000210 - RNA, 21 nt, Human
uccccaccgcagacaggacca

SEQ ID NO: 3000211 - RNA, 17 nt, Human
uccccaccgcagacagg

SEQ ID NO: 3000212 - RNA, 15 nt, Human
acuacauucuguuaa

SEQ ID NO: 3000213 - RNA, 22 nt, Human
acgccagauucuuuccugaggc

SEQ ID NO: 3000214 - RNA, 23 nt, Human
acgccagauucuuuccugaggcu

SEQ ID NO: 3000215 - RNA, 21 nt, Human
uccauccugaggcuccacuug

SEQ ID NO: 3000216 - RNA, 20 nt, Human
uccauccugaggcuccacuu

SEQ ID NO: 3000217 - RNA, 19 nt, Human
uccauccugaggcuccacu

SEQ ID NO: 3000218 - RNA, 21 nt, Human
uccaugaagauguagaggaga

SEQ ID NO: 3000219 - RNA, 13 nt, Human
uccaugaagaugu

SEQ ID NO: 3000220 - RNA, 20 nt, Human
uccauuuacuuaagacuuaa

SEQ ID NO: 3000221 - RNA, 19 nt, Human
uccauuuacuuaagacuua

SEQ ID NO: 3000222 - RNA, 17 nt, Human
uccauuuacuuaagacu

SEQ ID NO: 3000223 - RNA, 21 nt, Human
ucccaaagcagugcaugcugu

SEQ ID NO: 3000224 - RNA, 17 nt, Human
ucccaaagcagugcaug

SEQ ID NO: 3000225 - RNA, 18 nt, Human
ucccaaagcagugcaugc

SEQ ID NO: 3000226 - RNA, 14 nt, Human
ucccaaagugcugg

SEQ ID NO: 3000227 - RNA, 13 nt, Human
ucccaaagugcug

SEQ ID NO: 3000228 - RNA, 18 nt, Human
ucccaaacccuucagugc

SEQ ID NO: 3000229 - RNA, 16 nt, Human
ucccaaagcagugcau

SEQ ID NO: 3000230 - RNA, 22 nt, Human
uccauuuacuuaagacuuaaug

SEQ ID NO: 3000231 - RNA, 15 nt, Human
acgguuuuacugcag

SEQ ID NO: 3000232 - RNA, 17 nt, Human
acgguuuuacugcagcu

SEQ ID NO: 3000233 - RNA, 23 nt, Human
acguggcugcuucaaggauccug

SEQ ID NO: 3000234 - RNA, 20 nt, Human
acgugggcauucaaauguau

SEQ ID NO: 3000235 - RNA, 17 nt, Human
acgugggcauucaaaug

SEQ ID NO: 3000236 - RNA, 15 nt, Human
ucccaccccacacac

SEQ ID NO: 3000237 - RNA, 20 nt, Human
ucccaccccacacacgccag

SEQ ID NO: 3000238 - RNA, 16 nt, Human
ucccacaaaggagagc

SEQ ID NO: 3000239 - RNA, 23 nt, Human
ucccaagugccaaagaagcagac

SEQ ID NO: 3000240 - RNA, 15 nt, Human
ucccaagugccaaag

SEQ ID NO: 3000241 - RNA, 13 nt, Human
ucccaagugccaa

SEQ ID NO: 3000242 - RNA, 12 nt, Human
ucccaagugcca

SEQ ID NO: 3000243 - RNA, 20 nt, Human
acgggaggguaaggcugugg

SEQ ID NO: 3000244 - RNA, 16 nt, Human
ucccugugucauuuca

SEQ ID NO: 3000245 - RNA, 17 nt, Human
ucccugugucauuucaa

SEQ ID NO: 3000246 - RNA, 17 nt, Human
ucccuuacgugaguccu

SEQ ID NO: 3000247 - RNA, 15 nt, Human
ucccuuucccuuggu

SEQ ID NO: 3000248 - RNA, 21 nt, Human
acuccugcaggcagccaggcc

SEQ ID NO: 3000249 - RNA, 12 nt, Human
ucccugucccag

SEQ ID NO: 3000250 - RNA, 15 nt, Human
ucccugguggcagcu

SEQ ID NO: 3000251 - RNA, 11 nt, Human
uccuaaauagc

SEQ ID NO: 3000252 - RNA, 17 nt, Human
uccggucccugucccag

SEQ ID NO: 3000253 - RNA, 16 nt, Human
uccuagaaauucccca

SEQ ID NO: 3000254 - RNA, 12 nt, Human
ucccuuuuccuu

SEQ ID NO: 3000255 - RNA, 13 nt, Human
acuccagccuggg

SEQ ID NO: 3000256 - RNA, 12 nt, Human
acuccagccugg

SEQ ID NO: 3000257 - RNA, 23 nt, Human
acuccagaauuucccaaagcagu

SEQ ID NO: 3000258 - RNA, 18 nt, Human
acuccugcaggcagccag

SEQ ID NO: 3000259 - RNA, 19 nt, Human
acuccugcaggcagccagg

SEQ ID NO: 3000260 - RNA, 17 nt, Human
acuccugcaggcagcca

SEQ ID NO: 3000261 - RNA, 15 nt, Human
acuccaaagaaaugu

SEQ ID NO: 3000262 - RNA, 18 nt, Human
acuccaaagaaauguaag

SEQ ID NO: 3000263 - RNA, 15 nt, Human
acucauugaccugag

SEQ ID NO: 3000264 - RNA, 14 nt, Human
acuccaaagaaaug

SEQ ID NO: 3000265 - RNA, 15 nt, Human
acuccagaauuuccc

SEQ ID NO: 3000266 - RNA, 17 nt, Human
acuccagaauuucccaa

SEQ ID NO: 3000267 - RNA, 18 nt, Human
acuccagaaagugacaag

SEQ ID NO: 3000268 - RNA, 14 nt, Human
acucauugaccuga

SEQ ID NO: 3000269 - RNA, 15 nt, Human
acucauucuucugua

SEQ ID NO: 3000270 - RNA, 14 nt, Human
uccccucuccucca

SEQ ID NO: 3000271 - RNA, 17 nt, Human
uccccucggagaagagc

SEQ ID NO: 3000272 - RNA, 16 nt, Human
uccccucggagaagag

SEQ ID NO: 3000273 - RNA, 17 nt, Human
ucccgaguagcugggac

SEQ ID NO: 3000274 - RNA, 16 nt, Human
ucccgaguagcuggga

SEQ ID NO: 3000275 - RNA, 18 nt, Human
ucccgaguagcugggacu

SEQ ID NO: 3000276 - RNA, 15 nt, Human
ucccgaguagcuggg

SEQ ID NO: 3000277 - RNA, 20 nt, Human
ucccgaauagcugggacuac

SEQ ID NO: 3000278 - RNA, 21 nt, Human
acucacauuuauucugcucac

SEQ ID NO: 3000279 - RNA, 12 nt, Human
acucaccccagc

SEQ ID NO: 3000280 - RNA, 17 nt, Human
acuacucccccaggugg

SEQ ID NO: 3000281 - RNA, 21 nt, Human
ucccucuuucccucccuuccu

SEQ ID NO: 3000282 - RNA, 11 nt, Human
ucccugaaggc

SEQ ID NO: 3000283 - RNA, 15 nt, Human
ucccugaaggccccg

SEQ ID NO: 3000284 - RNA, 20 nt, Human
ucccucuuucccucccuucc

SEQ ID NO: 3000285 - RNA, 18 nt, Human
ucccucuuucccucccuu

SEQ ID NO: 3000286 - RNA, 14 nt, Human
ucccucuuucccuc

SEQ ID NO: 3000287 - RNA, 16 nt, Human
ucccucccuccaccuc

SEQ ID NO: 3000288 - RNA, 15 nt, Human
ucccucccuccaccu

SEQ ID NO: 3000289 - RNA, 14 nt, Human
ucccucccuccacc

SEQ ID NO: 3000290 - RNA, 13 nt, Human
ucccucccuccac

SEQ ID NO: 3000291 - RNA, 16 nt, Human
ucccggcuuuggugcg

SEQ ID NO: 3000292 - RNA, 23 nt, Human
ucccuccaccucccugcaauaaa

SEQ ID NO: 3000293 - RNA, 21 nt, Human
ucccuccaccucccugcaaua

SEQ ID NO: 3000294 - RNA, 11 nt, Human
ucccugagcag

SEQ ID NO: 3000295 - RNA, 16 nt, Human
ucccugaaggccccgc

SEQ ID NO: 3000296 - RNA, 13 nt, Human
ucccugauuuaau

SEQ ID NO: 3000297 - RNA, 23 nt, Human
accaauauuuaaucuuuuaugau

SEQ ID NO: 3000298 - RNA, 20 nt, Human
accaauauuuaaucuuuuau

SEQ ID NO: 3000299 - RNA, 13 nt, Human
accaaucaugaau

SEQ ID NO: 3000300 - RNA, 15 nt, Human
accaauguucucucu

SEQ ID NO: 3000301 - RNA, 15 nt, Human
accaaucaugaauua

SEQ ID NO: 3000302 - RNA, 16 nt, Human
accaauauuuaaucuu

SEQ ID NO: 3000303 - RNA, 17 nt, Human
accaauauuuaaucuuu

SEQ ID NO: 3000304 - RNA, 17 nt, Human
accaacauacucccauc

SEQ ID NO: 3000305 - RNA, 19 nt, Human
accaacauacucccaucug

SEQ ID NO: 3000306 - RNA, 21 nt, Human
accaacauacucccaucugug

SEQ ID NO: 3000307 - RNA, 22 nt, Human
accaacauacucccaucuguga

SEQ ID NO: 3000308 - RNA, 23 nt, Human
ucaagugaaaaaggaggaagaga

SEQ ID NO: 3000309 - RNA, 15 nt, Human
ucaagugaaaaagga

SEQ ID NO: 3000310 - RNA, 15 nt, Human
ucaauucuugccaaa

SEQ ID NO: 3000311 - RNA, 20 nt, Human
ucaauuuuucuuauuucauu

SEQ ID NO: 3000312 - RNA, 23 nt, Human
ucaauuuuucuuauuucauuucu

SEQ ID NO: 3000313 - RNA, 14 nt, Human
accaauugccaaag

SEQ ID NO: 3000314 - RNA, 15 nt, Human
ucaccccggccaccu

SEQ ID NO: 3000315 - RNA, 14 nt, Human
ucaccccagcccca

SEQ ID NO: 3000316 - RNA, 20 nt, Human
ucaccccagccccaaaacuc

SEQ ID NO: 3000317 - RNA, 13 nt, Human
ucaccccagcccc

SEQ ID NO: 3000318 - RNA, 13 nt, Human
ucacccaguccug

SEQ ID NO: 3000319 - RNA, 19 nt, Human
ucacccaguccugcccgcc

SEQ ID NO: 3000320 - RNA, 15 nt, Human
ucacaguucucuccu

SEQ ID NO: 3000321 - RNA, 15 nt, Human
ucacauaucugucau

SEQ ID NO: 3000322 - RNA, 12 nt, Human
ucacauaucugu

SEQ ID NO: 3000323 - RNA, 15 nt, Human
ucaccucucccuugg

SEQ ID NO: 3000324 - RNA, 13 nt, Human
ucaccugccccuc

SEQ ID NO: 3000325 - RNA, 15 nt, Human
ucaccugccccucaa

SEQ ID NO: 3000326 - RNA, 19 nt, Human
ucacuauguugcccaggca

SEQ ID NO: 3000327 - RNA, 17 nt, Human
ucacuauguugcccagg

SEQ ID NO: 3000328 - RNA, 18 nt, Human
ucacuauguugcccaggc

SEQ ID NO: 3000329 - RNA, 21 nt, Human
accacuuuuguucuugguuug

SEQ ID NO: 3000330 - RNA, 16 nt, Human
accacuuuuguucuug

SEQ ID NO: 3000331 - RNA, 15 nt, Human
accacuuuuguucuu

SEQ ID NO: 3000332 - RNA, 18 nt, Human
accacuuguguuuugcaa

SEQ ID NO: 3000333 - RNA, 17 nt, Human
accacugcacuccagcc

SEQ ID NO: 3000334 - RNA, 20 nt, Human
accacugcacuccagccugg

SEQ ID NO: 3000335 - RNA, 17 nt, Human
ucaccccggccaccugc

SEQ ID NO: 3000336 - RNA, 18 nt, Human
ucaccccggccaccugcg

SEQ ID NO: 3000337 - RNA, 21 nt, Human
accacugcacuccagccuggg

SEQ ID NO: 3000338 - RNA, 22 nt, Human
accacuuuuguucuugguuugu

SEQ ID NO: 3000339 - RNA, 16 nt, Human
accagagcccaccuug

SEQ ID NO: 3000340 - RNA, 14 nt, Human
accagagcccaccu

SEQ ID NO: 3000341 - RNA, 12 nt, Human
accagagcccac

SEQ ID NO: 3000342 - RNA, 11 nt, Human
accagacaggu

SEQ ID NO: 3000343 - RNA, 14 nt, Human
accagacaccuuga

SEQ ID NO: 3000344 - RNA, 23 nt, Human
accauuucuugagguaaaagcau

SEQ ID NO: 3000345 - RNA, 11 nt, Human
acccacugcuc

SEQ ID NO: 3000346 - RNA, 10 nt, Human
acccacugcu

SEQ ID NO: 3000347 - RNA, 11 nt, Human
acccacugcuu

SEQ ID NO: 3000348 - RNA, 15 nt, Human
acccacugcucuggu

SEQ ID NO: 3000349 - RNA, 14 nt, Human
acccacugcucugg

SEQ ID NO: 3000350 - RNA, 13 nt, Human
acccacugcucug

SEQ ID NO: 3000351 - RNA, 22 nt, Human
accauggucggaaaacaugcua

SEQ ID NO: 3000352 - RNA, 23 nt, Human
ucacucuuauugcccacgcugga

SEQ ID NO: 3000353 - RNA, 21 nt, Human
ucacucuuauugcccacgcug

SEQ ID NO: 3000354 - RNA, 18 nt, Human
accauuggggcucccagc

SEQ ID NO: 3000355 - RNA, 17 nt, Human
accauuggggcucccag

SEQ ID NO: 3000356 - RNA, 16 nt, Human
accauuggggcuccca

SEQ ID NO: 3000357 - RNA, 19 nt, Human
ucagaaguuucugccgcag

SEQ ID NO: 3000358 - RNA, 22 nt, Human
ucagaaguuucugccgcagccc

SEQ ID NO: 3000359 - RNA, 14 nt, Human
ucagaagacacuga

SEQ ID NO: 3000360 - RNA, 18 nt, Human
ucagagccugcaguuauu

SEQ ID NO: 3000361 - RNA, 15 nt, Human
ucagagccugcaguu

SEQ ID NO: 3000362 - RNA, 14 nt, Human
ucagagccugcagu

SEQ ID NO: 3000363 - RNA, 13 nt, Human
ucagagccugcag

SEQ ID NO: 3000364 - RNA, 16 nt, Human
ucagagagggugggag

SEQ ID NO: 3000365 - RNA, 21 nt, Human
ucagagagggugggagugggc

SEQ ID NO: 3000366 - RNA, 23 nt, Human
ucagagagggugggagugggccc

SEQ ID NO: 3000367 - RNA, 12 nt, Human
ucagagccugca

SEQ ID NO: 3000368 - RNA, 17 nt, Human
ucagagacuccugcagg

SEQ ID NO: 3000369 - RNA, 20 nt, Human
ucagagacuccugcaggcag

SEQ ID NO: 3000370 - RNA, 21 nt, Human
ucagagacuccugcaggcagc

SEQ ID NO: 3000371 - RNA, 16 nt, Human
ucagagacuccugcag

SEQ ID NO: 3000372 - RNA, 19 nt, Human
ucagaaucucaaauaacua

SEQ ID NO: 3000373 - RNA, 18 nt, Human
ucagaaucucaaauaacu

SEQ ID NO: 3000374 - RNA, 13 nt, Human
ucaggaaagagaa

SEQ ID NO: 3000375 - RNA, 20 nt, Human
ucaggaaaucaaauaugcaa

SEQ ID NO: 3000376 - RNA, 21 nt, Human
ucaggaaaucaaauaugcaaa

SEQ ID NO: 3000377 - RNA, 19 nt, Human
ucaggaaagagaacuucca

SEQ ID NO: 3000378 - RNA, 20 nt, Human
ucagcuuguaaauagcucag

SEQ ID NO: 3000379 - RNA, 14 nt, Human
ucagcggggacagc

SEQ ID NO: 3000380 - RNA, 12 nt, Human
acccccacccaa

SEQ ID NO: 3000381 - RNA, 15 nt, Human
accccuucgcuccug

SEQ ID NO: 3000382 - RNA, 14 nt, Human
accccuucgcuccu

SEQ ID NO: 3000383 - RNA, 16 nt, Human
accccuucgcuccugu

SEQ ID NO: 3000384 - RNA, 24 nt, Human
acccagcgagcccugguggcagug

SEQ ID NO: 3000385 - RNA, 23 nt, Human
acccagcgagcccugguggcagu

SEQ ID NO: 3000386 - RNA, 19 nt, Human
acccagcgagcccuggugg

SEQ ID NO: 3000387 - RNA, 23 nt, Human
ucagccguguaaccauggaccca

SEQ ID NO: 3000388 - RNA, 12 nt, Human
ucagagcugccc

SEQ ID NO: 3000389 - RNA, 22 nt, Human
ucagccaagaauucuuaaauau

SEQ ID NO: 3000390 - RNA, 14 nt, Human
acauagcugugauu

SEQ ID NO: 3000391 - RNA, 18 nt, Human
acauagaauuaacacaug

SEQ ID NO: 3000392 - RNA, 14 nt, Human
acauagaauuaaca

SEQ ID NO: 3000393 - RNA, 19 nt, Human
acauauauaacaaugcugu

SEQ ID NO: 3000394 - RNA, 22 nt, Human
acauauacauacuuacaugugu

SEQ ID NO: 3000395 - RNA, 17 nt, Human
acauauacauacuuaca

SEQ ID NO: 3000396 - RNA, 13 nt, Human
acauauacauacu

SEQ ID NO: 3000397 - RNA, 19 nt, Human
acauaucucuuaucuuacg

SEQ ID NO: 3000398 - RNA, 20 nt, Human
acauauauuuuuuaaaauaa

SEQ ID NO: 3000399 - RNA, 19 nt, Human
acauauauuuuuuaaaaua

SEQ ID NO: 3000400 - RNA, 18 nt, Human
acauauauuuuuuaaaau

SEQ ID NO: 3000401 - RNA, 22 nt, Human
acauauugauuuccguuaaaau

SEQ ID NO: 3000402 - RNA, 18 nt, Human
acauauugauuuccguua

SEQ ID NO: 3000403 - RNA, 23 nt, Human
acauauugauuuccguuaaaaua

SEQ ID NO: 3000404 - RNA, 16 nt, Human
acauauugauuuccgu

SEQ ID NO: 3000405 - RNA, 14 nt, Human
acauauugauuucc

SEQ ID NO: 3000406 - RNA, 13 nt, Human
acaucuguuuugu

SEQ ID NO: 3000407 - RNA, 13 nt, Human
acaucuugcucug

SEQ ID NO: 3000408 - RNA, 19 nt, Human
acaucuugcucugcugaca

SEQ ID NO: 3000409 - RNA, 18 nt, Human
acaucuugcucugcugac

SEQ ID NO: 3000410 - RNA, 17 nt, Human
acaugaaaacacauuuu

SEQ ID NO: 3000411 - RNA, 21 nt, Human
acaucuugcucugcugacaga

SEQ ID NO: 3000412 - RNA, 19 nt, Human
acaugaaaacacauuuuuc

SEQ ID NO: 3000413 - RNA, 18 nt, Human
acaugaaaacacauuuuu

SEQ ID NO: 3000414 - RNA, 16 nt, Human
acaugaaaacacauuu

SEQ ID NO: 3000415 - RNA, 18 nt, Human
acaucaacaucuugguca

SEQ ID NO: 3000416 - RNA, 16 nt, Human
acaucaacaucuuggu

SEQ ID NO: 3000417 - RNA, 13 nt, Human
acaucaacagaua

SEQ ID NO: 3000418 - RNA, 16 nt, Human
acaucuaguaguuguu

SEQ ID NO: 3000419 - RNA, 20 nt, Human
acaucuaguaguuguucuga

SEQ ID NO: 3000420 - RNA, 16 nt, Human
acaguuggguuuuuua

SEQ ID NO: 3000421 - RNA, 18 nt, Human
acaguuggguuuuuuaag

SEQ ID NO: 3000422 - RNA, 15 nt, Human
acaguugaaaaacag

SEQ ID NO: 3000423 - RNA, 16 nt, Human
acaguugaaaaacagc

SEQ ID NO: 3000424 - RNA, 20 nt, Human
acaguugaaaaacagcugag

SEQ ID NO: 3000425 - RNA, 13 nt, Human
uauuucauuucuu

SEQ ID NO: 3000426 - RNA, 22 nt, Human
uauuucccucaccuuucccauc

SEQ ID NO: 3000427 - RNA, 23 nt, Human
uauuuccuauauuguuuucagug

SEQ ID NO: 3000428 - RNA, 20 nt, Human
acauacuuuuuggguuuauu

SEQ ID NO: 3000429 - RNA, 17 nt, Human
acauacuuuuuggguuu

SEQ ID NO: 3000430 - RNA, 13 nt, Human
acauacuuuuugg

SEQ ID NO: 3000431 - RNA, 11 nt, Human
acauacuuuuu

SEQ ID NO: 3000432 - RNA, 14 nt, Human
acauacucugcuua

SEQ ID NO: 3000433 - RNA, 17 nt, Human
acauacucccaucugug

SEQ ID NO: 3000434 - RNA, 13 nt, Human
acauacucccauc

SEQ ID NO: 3000435 - RNA, 22 nt, Human
acauacuaaccagcagaaaugc

SEQ ID NO: 3000436 - RNA, 21 nt, Human
acauacuaaccagcagaaaug

SEQ ID NO: 3000437 - RNA, 13 nt, Human
acauacuaaccag

SEQ ID NO: 3000438 - RNA, 16 nt, Human
acaguuuucugagaaa

SEQ ID NO: 3000439 - RNA, 17 nt, Human
acaguuuucugagaaag

SEQ ID NO: 3000440 - RNA, 15 nt, Human
acaguuuucugagaa

SEQ ID NO: 3000441 - RNA, 20 nt, Human
acaguuuguuaguaugaggc

SEQ ID NO: 3000442 - RNA, 16 nt, Human
acaguuuguuaguaug

SEQ ID NO: 3000443 - RNA, 18 nt, Human
acaguuuucugagaaaga

SEQ ID NO: 3000444 - RNA, 19 nt, Human
acaguuuucugagaaagac

SEQ ID NO: 3000445 - RNA, 20 nt, Human
acaguuuucugagaaagacu

SEQ ID NO: 3000446 - RNA, 21 nt, Human
acaguuuucugagaaagacua

SEQ ID NO: 3000447 - RNA, 14 nt, Human
ucaaggcuuagacc

SEQ ID NO: 3000448 - RNA, 22 nt, Human
ucaagaugaugaugaucuuuaa

SEQ ID NO: 3000449 - RNA, 21 nt, Human
ucaaguauuauaccuuuuuua

SEQ ID NO: 3000450 - RNA, 16 nt, Human
ucaaguauuauaccuu

SEQ ID NO: 3000451 - RNA, 23 nt, Human
ucaaguauuauaccuuuuuuaga

SEQ ID NO: 3000452 - RNA, 15 nt, Human
ucaaguauuauaccu

SEQ ID NO: 3000453 - RNA, 17 nt, Human
ucaaguauagaaaaucu

SEQ ID NO: 3000454 - RNA, 15 nt, Human
ucaaguauagaaaau

SEQ ID NO: 3000455 - RNA, 11 nt, Human
ucaaguauuau

SEQ ID NO: 3000456 - RNA, 16 nt, Human
ucaagaaugcaguacu

SEQ ID NO: 3000457 - RNA, 16 nt, Human
ucaacagugagagacu

SEQ ID NO: 3000458 - RNA, 21 nt, Human
acauuaaaugacucuucccuc

SEQ ID NO: 3000459 - RNA, 19 nt, Human
acauuaaaugacucuuccc

SEQ ID NO: 3000460 - RNA, 15 nt, Human
acauuaaaugacucu

SEQ ID NO: 3000461 - RNA, 19 nt, Human
acaugcuguacauacuuuu

SEQ ID NO: 3000462 - RNA, 17 nt, Human
acaugcuguacauacuu

SEQ ID NO: 3000463 - RNA, 19 nt, Human
acauguccaagaagcccag

SEQ ID NO: 3000464 - RNA, 21 nt, Human
acauguccaagaagcccagga

SEQ ID NO: 3000465 - RNA, 14 nt, Human
acaugcugaacauc

SEQ ID NO: 3000466 - RNA, 21 nt, Human
acaugcugaacaucacagcuu

SEQ ID NO: 3000467 - RNA, 17 nt, Human
acauuagguugugaaug

SEQ ID NO: 3000468 - RNA, 16 nt, Human
acauuagguugugaau

SEQ ID NO: 3000469 - RNA, 15 nt, Human
acauuagguugugaa

SEQ ID NO: 3000470 - RNA, 16 nt, Human
ucaacagguuuuccug

SEQ ID NO: 3000471 - RNA, 17 nt, Human
ucaaauuucuaaaucuc

SEQ ID NO: 3000472 - RNA, 14 nt, Human
ucaaauuucuaaau

SEQ ID NO: 3000473 - RNA, 15 nt, Human
acauucuguuaauca

SEQ ID NO: 3000474 - RNA, 16 nt, Human
ucaaauuucuaaaucu

SEQ ID NO: 3000475 - RNA, 15 nt, Human
ucaaauuucuaaauc

SEQ ID NO: 3000476 - RNA, 12 nt, Human
acauucuguuaa

SEQ ID NO: 3000477 - RNA, 15 nt, Human
uauuugugagacugu

SEQ ID NO: 3000478 - RNA, 18 nt, Human
ucaaaagaaagaaaauca

SEQ ID NO: 3000479 - RNA, 23 nt, Human
ucaaaauaccaugccauuuaaag

SEQ ID NO: 3000480 - RNA, 21 nt, Human
ucaaaauaugccccauucaac

SEQ ID NO: 3000481 - RNA, 21 nt, Human
ucaaaauaccaugccauuuaa

SEQ ID NO: 3000482 - RNA, 17 nt, Human
acaugagcaucaggcca

SEQ ID NO: 3000483 - RNA, 18 nt, Human
acaugagcaucaggccag

SEQ ID NO: 3000484 - RNA, 19 nt, Human
acaugagcaucaggccagg

SEQ ID NO: 3000485 - RNA, 19 nt, Human
acaugauccugcaauucca

SEQ ID NO: 3000486 - RNA, 17 nt, Human
acaugaucuucuuuaua

SEQ ID NO: 3000487 - RNA, 15 nt, Human
acaugaucuucuuua

SEQ ID NO: 3000488 - RNA, 22 nt, Human
acaugcuacacacugcauguuu

SEQ ID NO: 3000489 - RNA, 20 nt, Human
acaugagcaucaggccaggc

SEQ ID NO: 3000490 - RNA, 18 nt, Human
ucaaauaacuaaaaggua

SEQ ID NO: 3000491 - RNA, 14 nt, Human
ucaaagcugaaaug

SEQ ID NO: 3000492 - RNA, 20 nt, Human
uauccuagucauucuucccu

SEQ ID NO: 3000493 - RNA, 17 nt, Human
uaucucaaaacugcacu

SEQ ID NO: 3000494 - RNA, 13 nt, Human
uaucucagggccu

SEQ ID NO: 3000495 - RNA, 15 nt, Human
uaucucagggccugg

SEQ ID NO: 3000496 - RNA, 19 nt, Human
uauauuuauuacuguaaga

SEQ ID NO: 3000497 - RNA, 15 nt, Human
uauauuuauuacugu

SEQ ID NO: 3000498 - RNA, 20 nt, Human
uaucccuacuguaauuugug

SEQ ID NO: 3000499 - RNA, 19 nt, Human
uaucccuacuguaauuugu

SEQ ID NO: 3000500 - RNA, 20 nt, Human
acagaguuguuacauuuuua

SEQ ID NO: 3000501 - RNA, 19 nt, Human
acagaguuguuacauuuuu

SEQ ID NO: 3000502 - RNA, 18 nt, Human
acagaguuguuacauuuu

SEQ ID NO: 3000503 - RNA, 17 nt, Human
acagaguuguuacauuu

SEQ ID NO: 3000504 - RNA, 16 nt, Human
acagaguuguuacauu

SEQ ID NO: 3000505 - RNA, 21 nt, Human
acagagcaagugagacccugu

SEQ ID NO: 3000506 - RNA, 12 nt, Human
acagagcaagac

SEQ ID NO: 3000507 - RNA, 18 nt, Human
acagagcuacacagggga

SEQ ID NO: 3000508 - RNA, 17 nt, Human
acagcaacacaaagcuu

SEQ ID NO: 3000509 - RNA, 20 nt, Human
acagcccgggcucugccucc

SEQ ID NO: 3000510 - RNA, 21 nt, Human
acagcccgggcucugccuccc

SEQ ID NO: 3000511 - RNA, 22 nt, Human
acagcccgggcucugccuccca

SEQ ID NO: 3000512 - RNA, 20 nt, Human
acagcaacacaaagcuuuug

SEQ ID NO: 3000513 - RNA, 23 nt, Human
acagcccgggcucugccucccau

SEQ ID NO: 3000514 - RNA, 21 nt, Human
acagcccuucuuuccacagaa

SEQ ID NO: 3000515 - RNA, 20 nt, Human
acagcccuucuuuccacaga

SEQ ID NO: 3000516 - RNA, 19 nt, Human
acagcccuucuuuccacag

SEQ ID NO: 3000517 - RNA, 23 nt, Human
acagaugggugcuuggaggaagg

SEQ ID NO: 3000518 - RNA, 20 nt, Human
acagauacuccuccaagguu

SEQ ID NO: 3000519 - RNA, 20 nt, Human
acagauagauauaugcucug

SEQ ID NO: 3000520 - RNA, 22 nt, Human
acagaguuguuacauuuuuaag

SEQ ID NO: 3000521 - RNA, 21 nt, Human
acagaguuguuacauuuuuaa

SEQ ID NO: 3000522 - RNA, 15 nt, Human
acagaguuguuacau

SEQ ID NO: 3000523 - RNA, 15 nt, Human
acacucuauaacaaa

SEQ ID NO: 3000524 - RNA, 13 nt, Human
acacucugagacu

SEQ ID NO: 3000525 - RNA, 11 nt, Human
acacucugaga

SEQ ID NO: 3000526 - RNA, 14 nt, Human
acacuccagugaga

SEQ ID NO: 3000527 - RNA, 13 nt, Human
acacuccuucaca

SEQ ID NO: 3000528 - RNA, 22 nt, Human
acacucacauuuauucugcuca

SEQ ID NO: 3000529 - RNA, 22 nt, Human
acacuguucucugcccuccaag

SEQ ID NO: 3000530 - RNA, 23 nt, Human
acacuguucucugcccuccaaga

SEQ ID NO: 3000531 - RNA, 16 nt, Human
acacuguucucugccc

SEQ ID NO: 3000532 - RNA, 17 nt, Human
acacuguucucugcccu

SEQ ID NO: 3000533 - RNA, 18 nt, Human
acacuguucucugcccuc

SEQ ID NO: 3000534 - RNA, 20 nt, Human
acacuguucucugcccucca

SEQ ID NO: 3000535 - RNA, 14 nt, Human
acacuguucucugc

SEQ ID NO: 3000536 - RNA, 15 nt, Human
acacuguucucugcc

SEQ ID NO: 3000537 - RNA, 14 nt, Human
acacugaagaagca

SEQ ID NO: 3000538 - RNA, 12 nt, Human
acacugaagaag

SEQ ID NO: 3000539 - RNA, 13 nt, Human
acacuugugaaua

SEQ ID NO: 3000540 - RNA, 12 nt, Human
acacuugugaau

SEQ ID NO: 3000541 - RNA, 23 nt, Human
acacuguuucaaacuuuacuaug

SEQ ID NO: 3000542 - RNA, 18 nt, Human
acacuugugaauaaagag

SEQ ID NO: 3000543 - RNA, 15 nt, Human
acacuuaaaaauggu

SEQ ID NO: 3000544 - RNA, 13 nt, Human
acacuuaaaaaug

SEQ ID NO: 3000545 - RNA, 15 nt, Human
acacuguuucaaacu

SEQ ID NO: 3000546 - RNA, 18 nt, Human
acagaaaauucuucucca

SEQ ID NO: 3000547 - RNA, 18 nt, Human
acacuuuggcccagggug

SEQ ID NO: 3000548 - RNA, 17 nt, Human
acacuuuggcccagggu

SEQ ID NO: 3000549 - RNA, 20 nt, Human
uauauucauucuuuuugaaa

SEQ ID NO: 3000550 - RNA, 19 nt, Human
uauauucauucuuuuugaa

SEQ ID NO: 3000551 - RNA, 14 nt, Human
uauauuauuugcag

SEQ ID NO: 3000552 - RNA, 12 nt, Human
uauauuuacaaa

SEQ ID NO: 3000553 - RNA, 15 nt, Human
acagacacaggcccg

SEQ ID NO: 3000554 - RNA, 17 nt, Human
acagacacaggcccggc

SEQ ID NO: 3000555 - RNA, 22 nt, Human
acagacacaggcccggcuccag

SEQ ID NO: 3000556 - RNA, 18 nt, Human
acagacacaggcccggcu

SEQ ID NO: 3000557 - RNA, 19 nt, Human
acagacuggaagcacagcu

SEQ ID NO: 3000558 - RNA, 17 nt, Human
acagacuggaagcacag

SEQ ID NO: 3000559 - RNA, 21 nt, Human
acagacuggaagcacagcuuc

SEQ ID NO: 3000560 - RNA, 18 nt, Human
acacaugcugaacaucac

SEQ ID NO: 3000561 - RNA, 18 nt, Human
acacauguccaagaagcc

SEQ ID NO: 3000562 - RNA, 19 nt, Human
acacauguccaagaagccc

SEQ ID NO: 3000563 - RNA, 13 nt, Human
acacauguccaag

SEQ ID NO: 3000564 - RNA, 21 nt, Human
acacauguccaagaagcccag

SEQ ID NO: 3000565 - RNA, 22 nt, Human
acacauguccaagaagcccagg

SEQ ID NO: 3000566 - RNA, 13 nt, Human
acacccagcccac

SEQ ID NO: 3000567 - RNA, 12 nt, Human
acacccagccca

SEQ ID NO: 3000568 - RNA, 23 nt, Human
uaguucaaucuggauucauauuu

SEQ ID NO: 3000569 - RNA, 23 nt, Human
uauaaaauaauuuuuauauuuga

SEQ ID NO: 3000570 - RNA, 18 nt, Human
acaccucugcacaagcug

SEQ ID NO: 3000571 - RNA, 16 nt, Human
acaccuugacagggca

SEQ ID NO: 3000572 - RNA, 15 nt, Human
acaccuugacagggc

SEQ ID NO: 3000573 - RNA, 14 nt, Human
acaccuugacaggg

SEQ ID NO: 3000574 - RNA, 17 nt, Human
acacuaagagagaauga

SEQ ID NO: 3000575 - RNA, 19 nt, Human
acacuaaccacgcuggacc

SEQ ID NO: 3000576 - RNA, 17 nt, Human
acacuaaccacgcugga

SEQ ID NO: 3000577 - RNA, 16 nt, Human
acacuaaccacgcugg

SEQ ID NO: 3000578 - RNA, 18 nt, Human
acacuaagagagaaugag

SEQ ID NO: 3000579 - RNA, 14 nt, Human
acacuaagagagaa

SEQ ID NO: 3000580 - RNA, 22 nt, Human
uauaaccaguguuguggauuua

SEQ ID NO: 3000581 - RNA, 14 nt, Human
acacaccuaacuua

SEQ ID NO: 3000582 - RNA, 18 nt, Human
acacacauauauuauuug

SEQ ID NO: 3000583 - RNA, 20 nt, Human
acacacucaaaucaagaaac

SEQ ID NO: 3000584 - RNA, 13 nt, Human
acacacugaagaa

SEQ ID NO: 3000585 - RNA, 19 nt, Human
acacacagcucuguccugg

SEQ ID NO: 3000586 - RNA, 12 nt, Human
acacacagcucu

SEQ ID NO: 3000587 - RNA, 11 nt, Human
acacacagcuc

SEQ ID NO: 3000588 - RNA, 17 nt, Human
acacaacuauauuguuu

SEQ ID NO: 3000589 - RNA, 14 nt, Human
acacaacuauauug

SEQ ID NO: 3000590 - RNA, 21 nt, Human
acaaugguuuucuuguguguu

SEQ ID NO: 3000591 - RNA, 17 nt, Human
acaaugcuguauuuuaa

SEQ ID NO: 3000592 - RNA, 14 nt, Human
acaaugcuguauuu

SEQ ID NO: 3000593 - RNA, 15 nt, Human
acaaugguuuucuug

SEQ ID NO: 3000594 - RNA, 24 nt, Human
acaaugcaguacaggacauauauu

SEQ ID NO: 3000595 - RNA, 12 nt, Human
uagguugugaau

SEQ ID NO: 3000596 - RNA, 21 nt, Human
uagguuggcaaaaaggcagga

SEQ ID NO: 3000597 - RNA, 14 nt, Human
acacacugaagaag

SEQ ID NO: 3000598 - RNA, 22 nt, Human
acacagcucuucuccaggcugu

SEQ ID NO: 3000599 - RNA, 11 nt, Human
acacagugagu

SEQ ID NO: 3000600 - RNA, 22 nt, Human
acacaguauuacuucugcuaca

SEQ ID NO: 3000601 - RNA, 12 nt, Human
uaguguuggaga

SEQ ID NO: 3000602 - RNA, 16 nt, Human
uaguguuggagaagaa

SEQ ID NO: 3000603 - RNA, 13 nt, Human
uaguagagacagg

SEQ ID NO: 3000604 - RNA, 19 nt, Human
aauugauugggcacaucau

SEQ ID NO: 3000605 - RNA, 23 nt, Human
aauugauugggcacaucauuuca

SEQ ID NO: 3000606 - RNA, 20 nt, Human
aauugauugggcacaucauu

SEQ ID NO: 3000607 - RNA, 18 nt, Human
aauugaggacacugauau

SEQ ID NO: 3000608 - RNA, 23 nt, Human
uacuguaauuugugauacaaugc

SEQ ID NO: 3000609 - RNA, 14 nt, Human
uacugaacaguaac

SEQ ID NO: 3000610 - RNA, 22 nt, Human
uacugaaauaaacgucuuaaau

SEQ ID NO: 3000611 - RNA, 19 nt, Human
uacugaaauaaacgucuua

SEQ ID NO: 3000612 - RNA, 17 nt, Human
uacugagagugaacaaa

SEQ ID NO: 3000613 - RNA, 23 nt, Human
uacugggaaagggauuuucagcc

SEQ ID NO: 3000614 - RNA, 17 nt, Human
uacuguaauuugugaua

SEQ ID NO: 3000615 - RNA, 16 nt, Human
uacuguaauuugugau

SEQ ID NO: 3000616 - RNA, 15 nt, Human
uacuguaauuuguga

SEQ ID NO: 3000617 - RNA, 21 nt, Human
uacuaaaaguuuugagaaauu

SEQ ID NO: 3000618 - RNA, 16 nt, Human
uacuaaaaaugcaaaa

SEQ ID NO: 3000619 - RNA, 18 nt, Human
uacuaaaaauacaaaaaa

SEQ ID NO: 3000620 - RNA, 13 nt, Human
uacgugaguccug

SEQ ID NO: 3000621 - RNA, 14 nt, Human
uacuaaaaauacaa

SEQ ID NO: 3000622 - RNA, 16 nt, Human
uacgucugacaggcaa

SEQ ID NO: 3000623 - RNA, 16 nt, Human
uacucuacccucuuag

SEQ ID NO: 3000624 - RNA, 22 nt, Human
uacucuacccucuuagaaaaac

SEQ ID NO: 3000625 - RNA, 12 nt, Human
uacuauuucuug

SEQ ID NO: 3000626 - RNA, 21 nt, Human
uacuauuucuugugguuauaa

SEQ ID NO: 3000627 - RNA, 22 nt, Human
uacuauuucuugugguuauaac

SEQ ID NO: 3000628 - RNA, 15 nt, Human
uacgucugacaggca

SEQ ID NO: 3000629 - RNA, 18 nt, Human
aauugacauugaaaucua

SEQ ID NO: 3000630 - RNA, 17 nt, Human
aauugacauugaaaucu

SEQ ID NO: 3000631 - RNA, 18 nt, Human
aauuuacuuuaaacuaca

SEQ ID NO: 3000632 - RNA, 13 nt, Human
aauuuaguauuuu

SEQ ID NO: 3000633 - RNA, 15 nt, Human
aauuuacuuuaaacu

SEQ ID NO: 3000634 - RNA, 16 nt, Human
aauuuacuuuaaacua

SEQ ID NO: 3000635 - RNA, 15 nt, Human
aauuuaccugaaguc

SEQ ID NO: 3000636 - RNA, 17 nt, Human
aauuuaccugaagucuu

SEQ ID NO: 3000637 - RNA, 18 nt, Human
aauuuacagagacagaaa

SEQ ID NO: 3000638 - RNA, 17 nt, Human
aauuuacagagacagaa

SEQ ID NO: 3000639 - RNA, 23 nt, Human
aauuucuaggacugaauuaugaa

SEQ ID NO: 3000640 - RNA, 14 nt, Human
aauuuauuauggca

SEQ ID NO: 3000641 - RNA, 13 nt, Human
aauuuauuauggc

SEQ ID NO: 3000642 - RNA, 22 nt, Human
aauuucuaggacugaauuauga

SEQ ID NO: 3000643 - RNA, 18 nt, Human
aauuucuaggacugaauu

SEQ ID NO: 3000644 - RNA, 17 nt, Human
aauuucuaggacugaau

SEQ ID NO: 3000645 - RNA, 14 nt, Human
aauuugcacauuaa

SEQ ID NO: 3000646 - RNA, 21 nt, Human
uacuuauuuaaauagaugaca

SEQ ID NO: 3000647 - RNA, 14 nt, Human
uacuuauuuaaaua

SEQ ID NO: 3000648 - RNA, 12 nt, Human
uacuuauuuaaa

SEQ ID NO: 3000649 - RNA, 12 nt, Human
aauuugcacauu

SEQ ID NO: 3000650 - RNA, 16 nt, Human
uacuucaugcugucua

SEQ ID NO: 3000651 - RNA, 18 nt, Human
uacuucuccacccugcuc

SEQ ID NO: 3000652 - RNA, 13 nt, Human
uacuucuccaccc

SEQ ID NO: 3000653 - RNA, 16 nt, Human
uacuucuuauacauuu

SEQ ID NO: 3000654 - RNA, 15 nt, Human
uacuucuuauacauu

SEQ ID NO: 3000655 - RNA, 14 nt, Human
uacuucuuauacau

SEQ ID NO: 3000656 - RNA, 19 nt, Human
uacuucuuaggguuaugau

SEQ ID NO: 3000657 - RNA, 15 nt, Human
uacuucugcuacaua

SEQ ID NO: 3000658 - RNA, 20 nt, Human
uacuucuccacccugcucuc

SEQ ID NO: 3000659 - RNA, 10 nt, Human
uacuuuuugg

SEQ ID NO: 3000660 - RNA, 16 nt, Human
aauuugcacauuaaau

SEQ ID NO: 3000661 - RNA, 23 nt, Human
aauuugccuaauaugaugacugu

SEQ ID NO: 3000662 - RNA, 13 nt, Human
aauuugguuuuca

SEQ ID NO: 3000663 - RNA, 20 nt, Human
aauuugugauacaaugcugu

SEQ ID NO: 3000664 - RNA, 21 nt, Human
aauuugguuuucacauuggaa

SEQ ID NO: 3000665 - RNA, 15 nt, Human
aauuugguuuucaca

SEQ ID NO: 3000666 - RNA, 16 nt, Human
aauuuguuauaaugaa

SEQ ID NO: 3000667 - RNA, 22 nt, Human
aauuuuuucucuaggaaauauu

SEQ ID NO: 3000668 - RNA, 21 nt, Human
aauuuuucuuauuucauuucu

SEQ ID NO: 3000669 - RNA, 20 nt, Human
uagaugaaugucaguuguua

SEQ ID NO: 3000670 - RNA, 20 nt, Human
uagaugcaguucugaagaag

SEQ ID NO: 3000671 - RNA, 21 nt, Human
uagaugcaguucugaagaaga

SEQ ID NO: 3000672 - RNA, 22 nt, Human
uagauaggucagugcaaauacu

SEQ ID NO: 3000673 - RNA, 17 nt, Human
uagauaggccaugggca

SEQ ID NO: 3000674 - RNA, 23 nt, Human
acaaaggauacuuauuuaaauag

SEQ ID NO: 3000675 - RNA, 21 nt, Human
acaaaggauacuuauuuaaau

SEQ ID NO: 3000676 - RNA, 23 nt, Human
acaaagcuuuugcauauugcaua

SEQ ID NO: 3000677 - RNA, 22 nt, Human
acaaagcuuuugcauauugcau

SEQ ID NO: 3000678 - RNA, 15 nt, Human
acaaagcuuuugcau

SEQ ID NO: 3000679 - RNA, 14 nt, Human
acaaaacuuuucua

SEQ ID NO: 3000680 - RNA, 21 nt, Human
acaaagcgugguggacaugca

SEQ ID NO: 3000681 - RNA, 13 nt, Human
acaagcuccaagc

SEQ ID NO: 3000682 - RNA, 22 nt, Human
acaagcucacagaccuuugaac

SEQ ID NO: 3000683 - RNA, 17 nt, Human
acaagcgugagccacug

SEQ ID NO: 3000684 - RNA, 22 nt, Human
acaagagcccaggccuccuaca

SEQ ID NO: 3000685 - RNA, 18 nt, Human
acaagagcccaggccucc

SEQ ID NO: 3000686 - RNA, 17 nt, Human
acaagaccacguuucua

SEQ ID NO: 3000687 - RNA, 16 nt, Human
acaagaccacguuucu

SEQ ID NO: 3000688 - RNA, 17 nt, Human
acaacaucuuuuucuac

SEQ ID NO: 3000689 - RNA, 17 nt, Human
acaaauuuacagagaca

SEQ ID NO: 3000690 - RNA, 16 nt, Human
uagcuacuaauuuuaa

SEQ ID NO: 3000691 - RNA, 16 nt, Human
uagcucaggugucccu

SEQ ID NO: 3000692 - RNA, 15 nt, Human
acaagcuccaagcuc

SEQ ID NO: 3000693 - RNA, 16 nt, Human
acaagcuccaagcucc

SEQ ID NO: 3000694 - RNA, 17 nt, Human
acaagcuccaagcuccc

SEQ ID NO: 3000695 - RNA, 19 nt, Human
acaagcuccaagcucccag

SEQ ID NO: 3000696 - RNA, 22 nt, Human
acaagcuccaagcucccaggca

SEQ ID NO: 3000697 - RNA, 21 nt, Human
aauaucccuuggacauuuuau

SEQ ID NO: 3000698 - RNA, 20 nt, Human
aauaucccuuggacauuuua

SEQ ID NO: 3000699 - RNA, 22 nt, Human
aauaucccuuggacauuuuaug

SEQ ID NO: 3000700 - RNA, 12 nt, Human
aauauccuaaua

SEQ ID NO: 3000701 - RNA, 13 nt, Human
aauauccuaauaa

SEQ ID NO: 3000702 - RNA, 14 nt, Human
aauauccuaauaaa

SEQ ID NO: 3000703 - RNA, 20 nt, Human
aauauccaauugcugcuugu

SEQ ID NO: 3000704 - RNA, 15 nt, Human
aauaucacuugucaa

SEQ ID NO: 3000705 - RNA, 12 nt, Human
aauaucacuugu

SEQ ID NO: 3000706 - RNA, 15 nt, Human
aauauccuaauaaaa

SEQ ID NO: 3000707 - RNA, 19 nt, Human
aauauccuaauaaaaaggu

SEQ ID NO: 3000708 - RNA, 14 nt, Human
uaacauggaaguac

SEQ ID NO: 3000709 - RNA, 14 nt, Human
uaacuaaaagguau

SEQ ID NO: 3000710 - RNA, 15 nt, Human
uaacuaaaagguaug

SEQ ID NO: 3000711 - RNA, 15 nt, Human
uaacauggaaguacu

SEQ ID NO: 3000712 - RNA, 16 nt, Human
uaaccucuaaauucuu

SEQ ID NO: 3000713 - RNA, 22 nt, Human
aauagaugacauugacuauuuu

SEQ ID NO: 3000714 - RNA, 21 nt, Human
aauagaugacauugacuauuu

SEQ ID NO: 3000715 - RNA, 19 nt, Human
aauagaugacauugacuau

SEQ ID NO: 3000716 - RNA, 20 nt, Human
aauagcauguccuaaugcuu

SEQ ID NO: 3000717 - RNA, 19 nt, Human
aauagauugcucaaaucag

SEQ ID NO: 3000718 - RNA, 22 nt, Human
aauagauugcucaaaucagguu

SEQ ID NO: 3000719 - RNA, 14 nt, Human
aauagcugggacua

SEQ ID NO: 3000720 - RNA, 13 nt, Human
aauagcugggacu

SEQ ID NO: 3000721 - RNA, 23 nt, Human
aauagacaauuuauuauggcaca

SEQ ID NO: 3000722 - RNA, 18 nt, Human
aauagacaauuuauuaug

SEQ ID NO: 3000723 - RNA, 18 nt, Human
aauaggcguaacuaauuu

SEQ ID NO: 3000724 - RNA, 17 nt, Human
aauaggcacuuuaaaac

SEQ ID NO: 3000725 - RNA, 15 nt, Human
aauaggcacuuuaaa

SEQ ID NO: 3000726 - RNA, 14 nt, Human
aauaggcacuuuaa

SEQ ID NO: 3000727 - RNA, 18 nt, Human
aauaggcacuuuaaaaca

SEQ ID NO: 3000728 - RNA, 15 nt, Human
aauaggaaaaacuga

SEQ ID NO: 3000729 - RNA, 16 nt, Human
aauaggaaaaacugau

SEQ ID NO: 3000730 - RNA, 17 nt, Human
aauaggaaaaacugauu

SEQ ID NO: 3000731 - RNA, 18 nt, Human
aauaggaaaaacugauuu

SEQ ID NO: 3000732 - RNA, 19 nt, Human
aauaggaaaaacugauuuu

SEQ ID NO: 3000733 - RNA, 24 nt, Human
aauagcuuuuuucucugauacaga

SEQ ID NO: 3000734 - RNA, 21 nt, Human
aauauccuaauaaaaagguga

SEQ ID NO: 3000735 - RNA, 21 nt, Human
aauaucuccgucaacucauau

SEQ ID NO: 3000736 - RNA, 16 nt, Human
aauaucuccgucaacu

SEQ ID NO: 3000737 - RNA, 19 nt, Human
aauaucugaaaauguaugu

SEQ ID NO: 3000738 - RNA, 18 nt, Human
aauaucugaaaauguaug

SEQ ID NO: 3000739 - RNA, 17 nt, Human
aauaucugaaaauguau

SEQ ID NO: 3000740 - RNA, 16 nt, Human
aauaucugaaaaugua

SEQ ID NO: 3000741 - RNA, 20 nt, Human
aauaucugaaaauguaugug

SEQ ID NO: 3000742 - RNA, 19 nt, Human
aauaucuuuuuuuuaauaa

SEQ ID NO: 3000743 - RNA, 18 nt, Human
uaacuuuuauaaacuuua

SEQ ID NO: 3000744 - RNA, 17 nt, Human
uaacuuuuauaaacuuu

SEQ ID NO: 3000745 - RNA, 15 nt, Human
uaacuuuuauaaacu

SEQ ID NO: 3000746 - RNA, 17 nt, Human
aauaugaugacuguuuu

SEQ ID NO: 3000747 - RNA, 16 nt, Human
aauaugaugacuguuu

SEQ ID NO: 3000748 - RNA, 15 nt, Human
aauaugcaaagcacu

SEQ ID NO: 3000749 - RNA, 17 nt, Human
aauaugcaaagcacuga

SEQ ID NO: 3000750 - RNA, 15 nt, Human
aauaugcacacauuu

SEQ ID NO: 3000751 - RNA, 24 nt, Human
aauaugcaaagcacugacuucuaa

SEQ ID NO: 3000752 - RNA, 18 nt, Human
aauauugauaugcuuaua

SEQ ID NO: 3000753 - RNA, 17 nt, Human
aauauugauaugcuuau

SEQ ID NO: 3000754 - RNA, 18 nt, Human
aauaugcaaagucuaggu

SEQ ID NO: 3000755 - RNA, 14 nt, Human
aauaugcaaagucu

SEQ ID NO: 3000756 - RNA, 23 nt, Human
aauauugccaaugcuacaguaau

SEQ ID NO: 3000757 - RNA, 11 nt, Human
aauauugcuga

SEQ ID NO: 3000758 - RNA, 12 nt, Human
aauauugcugau

SEQ ID NO: 3000759 - RNA, 13 nt, Human
aauauugcugaug

SEQ ID NO: 3000760 - RNA, 15 nt, Human
aauauugcugauggu

SEQ ID NO: 3000761 - RNA, 18 nt, Human
aauauugcugauggugca

SEQ ID NO: 3000762 - RNA, 21 nt, Human
aauauugcugauggugcaaug

SEQ ID NO: 3000763 - RNA, 22 nt, Human
aauauugcugauggugcaauga

SEQ ID NO: 3000764 - RNA, 21 nt, Human
aauauuuuagguguaaaauaa

SEQ ID NO: 3000765 - RNA, 21 nt, Human
aauauugguugggaugacuug

SEQ ID NO: 3000766 - RNA, 15 nt, Human
aauauugguugggau

SEQ ID NO: 3000767 - RNA, 15 nt, Human
aauauuucagauaau

SEQ ID NO: 3000768 - RNA, 14 nt, Human
aauauuucagauaa

SEQ ID NO: 3000769 - RNA, 21 nt, Human
uaaauagaugacauugacuau

SEQ ID NO: 3000770 - RNA, 19 nt, Human
uaaauagaugacauugacu

SEQ ID NO: 3000771 - RNA, 14 nt, Human
uaaauagaugacau

SEQ ID NO: 3000772 - RNA, 18 nt, Human
uaaaucuccaaaauaaaa

SEQ ID NO: 3000773 - RNA, 15 nt, Human
uaaaucuccaaaaua

SEQ ID NO: 3000774 - RNA, 14 nt, Human
uaaaucuccaaaau

SEQ ID NO: 3000775 - RNA, 22 nt, Human
uaaaucuccaaaauaaaacuuu

SEQ ID NO: 3000776 - RNA, 23 nt, Human
uaaaugcaccuggaauauauaac

SEQ ID NO: 3000777 - RNA, 20 nt, Human
uaaauguugaaagaucaaaa

SEQ ID NO: 3000778 - RNA, 15 nt, Human
uaaauguugaaagau

SEQ ID NO: 3000779 - RNA, 16 nt, Human
uaaauuaacuuuuaua

SEQ ID NO: 3000780 - RNA, 15 nt, Human
uaaauuaacuuuuau

SEQ ID NO: 3000781 - RNA, 17 nt, Human
uaaauuaacuuuuauaa

SEQ ID NO: 3000782 - RNA, 14 nt, Human
uaaauuaacuuuua

SEQ ID NO: 3000783 - RNA, 12 nt, Human
uaaauuaacuuu

SEQ ID NO: 3000784 - RNA, 20 nt, Human
aauaauuuuuauauuugaaa

SEQ ID NO: 3000785 - RNA, 19 nt, Human
uaaauaaugugaaacugga

SEQ ID NO: 3000786 - RNA, 16 nt, Human
aauaauuuuuauauuu

SEQ ID NO: 3000787 - RNA, 19 nt, Human
aauaauuuuuauauuugaa

SEQ ID NO: 3000788 - RNA, 17 nt, Human
aauaauuuuuauauuug

SEQ ID NO: 3000789 - RNA, 16 nt, Human
aauaaaaaggugacca

SEQ ID NO: 3000790 - RNA, 12 nt, Human
aauaaaaaggug

SEQ ID NO: 3000791 - RNA, 13 nt, Human
aauaaaaagguga

SEQ ID NO: 3000792 - RNA, 20 nt, Human
aaguuuuuauggcuuuugug

SEQ ID NO: 3000793 - RNA, 16 nt, Human
guuuugaagauucuau

SEQ ID NO: 3000794 - RNA, 17 nt, Human
guuuugaagauucuaug

SEQ ID NO: 3000795 - RNA, 20 nt, Human
guuuugaagauucuauguua

SEQ ID NO: 3000796 - RNA, 14 nt, Human
guuuucuuuuaaga

SEQ ID NO: 3000797 - RNA, 17 nt, Human
aauaacuggaacacucu

SEQ ID NO: 3000798 - RNA, 22 nt, Human
aauaacauguaauuaaguacua

SEQ ID NO: 3000799 - RNA, 21 nt, Human
aauaacaaugaaaguugauaa

SEQ ID NO: 3000800 - RNA, 16 nt, Human
aauaaaucauaaaacu

SEQ ID NO: 3000801 - RNA, 23 nt, Human
aauaaaugaaugucacuucugga

SEQ ID NO: 3000802 - RNA, 15 nt, Human
aauaaaacuuuuuaa

SEQ ID NO: 3000803 - RNA, 14 nt, Human
aauaaaacuuuuua

SEQ ID NO: 3000804 - RNA, 12 nt, Human
aauaaaacuuuu

SEQ ID NO: 3000805 - RNA, 18 nt, Human
aauaaaacuuuuuaaaau

SEQ ID NO: 3000806 - RNA, 18 nt, Human
aaugcaguacuaacauuu

SEQ ID NO: 3000807 - RNA, 20 nt, Human
aaugcaguacaggacauaua

SEQ ID NO: 3000808 - RNA, 22 nt, Human
aaugcaguacaggacauauauu

SEQ ID NO: 3000809 - RNA, 14 nt, Human
aaugcccagccccu

SEQ ID NO: 3000810 - RNA, 15 nt, Human
aaugcccagccccuu

SEQ ID NO: 3000811 - RNA, 13 nt, Human
aaugcccagcccc

SEQ ID NO: 3000812 - RNA, 20 nt, Human
aaugcccagccccuucugac

SEQ ID NO: 3000813 - RNA, 22 nt, Human
aaugcccagccccuucugaccc

SEQ ID NO: 3000814 - RNA, 23 nt, Human
aaugcccagccccuucugaccca

SEQ ID NO: 3000815 - RNA, 24 nt, Human
aaugcccagccccuucugacccau

SEQ ID NO: 3000816 - RNA, 21 nt, Human
aaugcugugcccuaaagugua

SEQ ID NO: 3000817 - RNA, 20 nt, Human
aaugcugugcccuaaagugu

SEQ ID NO: 3000818 - RNA, 13 nt, Human
aaugcugugcccu

SEQ ID NO: 3000819 - RNA, 21 nt, Human
aaugccccugaauuuaaauag

SEQ ID NO: 3000820 - RNA, 16 nt, Human
aauggacguguuauga

SEQ ID NO: 3000821 - RNA, 18 nt, Human
aauggaagacagcucuua

SEQ ID NO: 3000822 - RNA, 14 nt, Human
aaugagcuuaagaa

SEQ ID NO: 3000823 - RNA, 14 nt, Human
aaugagccuggcaa

SEQ ID NO: 3000824 - RNA, 18 nt, Human
uaauuauugauguuuuca

SEQ ID NO: 3000825 - RNA, 15 nt, Human
uacaaaaagcauaaa

SEQ ID NO: 3000826 - RNA, 15 nt, Human
uacaaaaacacagca

SEQ ID NO: 3000827 - RNA, 20 nt, Human
uacaaaaagcauaaaaauua

SEQ ID NO: 3000828 - RNA, 15 nt, Human
uacaaaagcauguga

SEQ ID NO: 3000829 - RNA, 13 nt, Human
uacaaaaacacag

SEQ ID NO: 3000830 - RNA, 14 nt, Human
uacaaaaacacagc

SEQ ID NO: 3000831 - RNA, 16 nt, Human
uaauuuccauuuacuu

SEQ ID NO: 3000832 - RNA, 11 nt, Human
aaugugauaug

SEQ ID NO: 3000833 - RNA, 18 nt, Human
aauguacugcauaugaaa

SEQ ID NO: 3000834 - RNA, 14 nt, Human
aauguacugcauau

SEQ ID NO: 3000835 - RNA, 14 nt, Human
aauguauguguaag

SEQ ID NO: 3000836 - RNA, 12 nt, Human
aauguaugugua

SEQ ID NO: 3000837 - RNA, 15 nt, Human
uacaguaucucaggg

SEQ ID NO: 3000838 - RNA, 17 nt, Human
uacauaaugcgugcaua

SEQ ID NO: 3000839 - RNA, 20 nt, Human
uacauaaugcgugcauacca

SEQ ID NO: 3000840 - RNA, 19 nt, Human
uacauaaugcgugcauacc

SEQ ID NO: 3000841 - RNA, 15 nt, Human
uacauaaugcgugca

SEQ ID NO: 3000842 - RNA, 12 nt, Human
aauguacugcau

SEQ ID NO: 3000843 - RNA, 19 nt, Human
uacacuaagagagaaugag

SEQ ID NO: 3000844 - RNA, 18 nt, Human
uacacuaagagagaauga

SEQ ID NO: 3000845 - RNA, 23 nt, Human
uacagagcccacgcccccacugg

SEQ ID NO: 3000846 - RNA, 13 nt, Human
uacaguaauaaau

SEQ ID NO: 3000847 - RNA, 19 nt, Human
aauggacuuuuguacauag

SEQ ID NO: 3000848 - RNA, 18 nt, Human
aauggacuuugcacacuu

SEQ ID NO: 3000849 - RNA, 23 nt, Human
aauggacuuugcacacuuuggcc

SEQ ID NO: 3000850 - RNA, 18 nt, Human
uacaccacuacauucugu

SEQ ID NO: 3000851 - RNA, 17 nt, Human
uacaccacuacauucug

SEQ ID NO: 3000852 - RNA, 16 nt, Human
uacaccacuacauucu

SEQ ID NO: 3000853 - RNA, 15 nt, Human
uacaccacuacauuc

SEQ ID NO: 3000854 - RNA, 20 nt, Human
uacaccacuacauucuguua

SEQ ID NO: 3000855 - RNA, 19 nt, Human
uacaccacuacauucuguu

SEQ ID NO: 3000856 - RNA, 13 nt, Human
aaugacucuuccc

SEQ ID NO: 3000857 - RNA, 17 nt, Human
aaugaaaacaaugcagu

SEQ ID NO: 3000858 - RNA, 15 nt, Human
aaugagccuggcaag

SEQ ID NO: 3000859 - RNA, 21 nt, Human
aaugagagacacacugaagaa

SEQ ID NO: 3000860 - RNA, 20 nt, Human
aaugagacuuuaaaagcauu

SEQ ID NO: 3000861 - RNA, 17 nt, Human
aaugagacuuuaaaagc

SEQ ID NO: 3000862 - RNA, 16 nt, Human
aaugagacuuuaaaag

SEQ ID NO: 3000863 - RNA, 17 nt, Human
aaugacuuacuguacau

SEQ ID NO: 3000864 - RNA, 14 nt, Human
aaugacuuacugua

SEQ ID NO: 3000865 - RNA, 18 nt, Human
aaugacuuacuguacaug

SEQ ID NO: 3000866 - RNA, 18 nt, Human
uaaugguaguuuuacagu

SEQ ID NO: 3000867 - RNA, 13 nt, Human
uaaugaggaaacu

SEQ ID NO: 3000868 - RNA, 16 nt, Human
uaaugauaacuggaaa

SEQ ID NO: 3000869 - RNA, 16 nt, Human
uaaugguaguuuuaca

SEQ ID NO: 3000870 - RNA, 12 nt, Human
aaugaaaacaau

SEQ ID NO: 3000871 - RNA, 16 nt, Human
aaugaaaacaaugcag

SEQ ID NO: 3000872 - RNA, 18 nt, Human
uaaugagcuuaagaaauu

SEQ ID NO: 3000873 - RNA, 14 nt, Human
uaaugagacuuuaa

SEQ ID NO: 3000874 - RNA, 20 nt, Human
uaaugaccaugaaagacuuc

SEQ ID NO: 3000875 - RNA, 19 nt, Human
uaaugagacuuuaaaagca

SEQ ID NO: 3000876 - RNA, 21 nt, Human
uaaugacuuaagcacacuuga

SEQ ID NO: 3000877 - RNA, 15 nt, Human
uaaugacuuaagcac

SEQ ID NO: 3000878 - RNA, 18 nt, Human
uaaugaccaugaaagacu

SEQ ID NO: 3000879 - RNA, 16 nt, Human
uaaugaccaugaaaga

SEQ ID NO: 3000880 - RNA, 14 nt, Human
uaaugaccaugaaa

SEQ ID NO: 3000881 - RNA, 23 nt, Human
uaaugaaagacuguacaaaguag

SEQ ID NO: 3000882 - RNA, 22 nt, Human
uaaugaaagacuguacaaagua

SEQ ID NO: 3000883 - RNA, 19 nt, Human
uaaugaaagacuguacaaa

SEQ ID NO: 3000884 - RNA, 18 nt, Human
uaaugaaagacuguacaa

SEQ ID NO: 3000885 - RNA, 17 nt, Human
uaaugaaagacuguaca

SEQ ID NO: 3000886 - RNA, 14 nt, Human
uaaugaaagacugu

SEQ ID NO: 3000887 - RNA, 13 nt, Human
aaucuucugaacu

SEQ ID NO: 3000888 - RNA, 20 nt, Human
aaucuucugaacuuggcgcu

SEQ ID NO: 3000889 - RNA, 21 nt, Human
aaucuucauggaauucacaaa

SEQ ID NO: 3000890 - RNA, 23 nt, Human
aaucuucauggaauucacaaagu

SEQ ID NO: 3000891 - RNA, 19 nt, Human
uaauagguuuggacaaaau

SEQ ID NO: 3000892 - RNA, 14 nt, Human
uaauagguuuggac

SEQ ID NO: 3000893 - RNA, 13 nt, Human
aauccuugaagau

SEQ ID NO: 3000894 - RNA, 12 nt, Human
aaucuaaaugga

SEQ ID NO: 3000895 - RNA, 15 nt, Human
aaucuaaauggaacc

SEQ ID NO: 3000896 - RNA, 13 nt, Human
aaucuaaauggaa

SEQ ID NO: 3000897 - RNA, 18 nt, Human
aaucuaaauggaaccacu

SEQ ID NO: 3000898 - RNA, 14 nt, Human
aaucuuauaauuua

SEQ ID NO: 3000899 - RNA, 15 nt, Human
aaucucaaauaacua

SEQ ID NO: 3000900 - RNA, 12 nt, Human
aaucucaaauuu

SEQ ID NO: 3000901 - RNA, 14 nt, Human
aaucucaaauuucu

SEQ ID NO: 3000902 - RNA, 13 nt, Human
aaucucaaauaac

SEQ ID NO: 3000903 - RNA, 15 nt, Human
aaucuaggaaaauua

SEQ ID NO: 3000904 - RNA, 23 nt, Human
uaaguuauuaagagguaagacuu

SEQ ID NO: 3000905 - RNA, 22 nt, Human
uaaguuauuaagagguaagacu

SEQ ID NO: 3000906 - RNA, 20 nt, Human
uaaguuuuuauggcuuuugu

SEQ ID NO: 3000907 - RNA, 19 nt, Human
uaaguacuauguaucaaug

SEQ ID NO: 3000908 - RNA, 17 nt, Human
uaaguaucaaguauaga

SEQ ID NO: 3000909 - RNA, 20 nt, Human
uaaguaucaaguauagaaaa

SEQ ID NO: 3000910 - RNA, 19 nt, Human
uaaguaucaaguauagaaa

SEQ ID NO: 3000911 - RNA, 15 nt, Human
aaucaucaagucuuu

SEQ ID NO: 3000912 - RNA, 20 nt, Human
uaaguuauuaagagguaaga

SEQ ID NO: 3000913 - RNA, 17 nt, Human
aaucaugaauuaguuuu

SEQ ID NO: 3000914 - RNA, 19 nt, Human
aaucaugaauuaguuuuau

SEQ ID NO: 3000915 - RNA, 23 nt, Human
aaucaugaauuaguuuuauaugc

SEQ ID NO: 3000916 - RNA, 23 nt, Human
aaucaugucagucugcuuagaaa

SEQ ID NO: 3000917 - RNA, 22 nt, Human
aaucaugucagucugcuuagaa

SEQ ID NO: 3000918 - RNA, 21 nt, Human
aacuuuaagaacuaaaauguu

SEQ ID NO: 3000919 - RNA, 13 nt, Human
aacuuuaccuuuu

SEQ ID NO: 3000920 - RNA, 18 nt, Human
aacuugucuuuggacccu

SEQ ID NO: 3000921 - RNA, 11 nt, Human
gugccuuaugg

SEQ ID NO: 3000922 - RNA, 17 nt, Human
aacuuggcgcugccccu

SEQ ID NO: 3000923 - RNA, 15 nt, Human
gugccuaauguguuu

SEQ ID NO: 3000924 - RNA, 15 nt, Human
gugccucaagagaag

SEQ ID NO: 3000925 - RNA, 22 nt, Human
gugccgagaaggaagccuccca

SEQ ID NO: 3000926 - RNA, 21 nt, Human
gugaaccaccacacccagccc

SEQ ID NO: 3000927 - RNA, 21 nt, Human
gugccuuauggaacacucuga

SEQ ID NO: 3000928 - RNA, 23 nt, Human
gugccuuauggaacacucugaga

SEQ ID NO: 3000929 - RNA, 14 nt, Human
gugccuuauggaac

SEQ ID NO: 3000930 - RNA, 13 nt, Human
gugccucugggac

SEQ ID NO: 3000931 - RNA, 12 nt, Human
gugccucuggga

SEQ ID NO: 3000932 - RNA, 22 nt, Human
aagaagugaaaaucuacacucc

SEQ ID NO: 3000933 - RNA, 16 nt, Human
aagaagugaaaaucua

SEQ ID NO: 3000934 - RNA, 21 nt, Human
gugcuaucucccccagcccca

SEQ ID NO: 3000935 - RNA, 22 nt, Human
gugcuaggaacacuccuucaca

SEQ ID NO: 3000936 - RNA, 17 nt, Human
gugcuaggaacacuccu

SEQ ID NO: 3000937 - RNA, 18 nt, Human
gugcuaggaacacuccuu

SEQ ID NO: 3000938 - RNA, 18 nt, Human
aagaaaaaggaugcacag

SEQ ID NO: 3000939 - RNA, 17 nt, Human
aagaaaaaggaugcaca

SEQ ID NO: 3000940 - RNA, 15 nt, Human
aagaaaaaggaugca

SEQ ID NO: 3000941 - RNA, 22 nt, Human
aagaaagacuaucuaaauguug

SEQ ID NO: 3000942 - RNA, 20 nt, Human
aagaaagacuaucuaaaugu

SEQ ID NO: 3000943 - RNA, 24 nt, Human
aagaaugcaguacuaacauuuauu

SEQ ID NO: 3000944 - RNA, 18 nt, Human
aagaaugauuaugaauua

SEQ ID NO: 3000945 - RNA, 16 nt, Human
aagaauugaagcagga

SEQ ID NO: 3000946 - RNA, 23 nt, Human
aagaauugauugggcacaucauu

SEQ ID NO: 3000947 - RNA, 23 nt, Human
aagacaaaaagcuacuuauugua

SEQ ID NO: 3000948 - RNA, 20 nt, Human
aagacaaaaagcuacuuauu

SEQ ID NO: 3000949 - RNA, 17 nt, Human
aagacccucucaaacua

SEQ ID NO: 3000950 - RNA, 14 nt, Human
aagacaaacugcau

SEQ ID NO: 3000951 - RNA, 16 nt, Human
aagacaaaaagcuacu

SEQ ID NO: 3000952 - RNA, 16 nt, Human
aagaaugauuaugaau

SEQ ID NO: 3000953 - RNA, 14 nt, Human
guggcagcucaccu

SEQ ID NO: 3000954 - RNA, 16 nt, Human
guggcagcucaccucu

SEQ ID NO: 3000955 - RNA, 20 nt, Human
guggcagcucaccucucccu

SEQ ID NO: 3000956 - RNA, 18 nt, Human
guggcaccagcagccugg

SEQ ID NO: 3000957 - RNA, 19 nt, Human
guggauuuaacagaaaugu

SEQ ID NO: 3000958 - RNA, 18 nt, Human
guggauuuaacagaaaug

SEQ ID NO: 3000959 - RNA, 19 nt, Human
guggcaccagcagccugga

SEQ ID NO: 3000960 - RNA, 21 nt, Human
guggaugccugguggcagcug

SEQ ID NO: 3000961 - RNA, 20 nt, Human
guggaugcugcugccccugc

SEQ ID NO: 3000962 - RNA, 22 nt, Human
guggacacagcucuucuccagg

SEQ ID NO: 3000963 - RNA, 18 nt, Human
guggacacagcucuucuc

SEQ ID NO: 3000964 - RNA, 23 nt, Human
guggacacagcucuucuccaggc

SEQ ID NO: 3000965 - RNA, 17 nt, Human
guggacacagcucuucu

SEQ ID NO: 3000966 - RNA, 20 nt, Human
gugcugggauuacaggugug

SEQ ID NO: 3000967 - RNA, 22 nt, Human
gugcugggauuacaagcgugag

SEQ ID NO: 3000968 - RNA, 21 nt, Human
gugcugggauuacaagcguga

SEQ ID NO: 3000969 - RNA, 12 nt, Human
gugcuauguucu

SEQ ID NO: 3000970 - RNA, 19 nt, Human
gugcuaucucccccagccc

SEQ ID NO: 3000971 - RNA, 22 nt, Human
gugcuaucucccccagccccau

SEQ ID NO: 3000972 - RNA, 22 nt, Human
gugggacacccugugauggggc

SEQ ID NO: 3000973 - RNA, 21 nt, Human
gugggacagucaccucaugga

SEQ ID NO: 3000974 - RNA, 22 nt, Human
guggcgcagcauauucaggaag

SEQ ID NO: 3000975 - RNA, 23 nt, Human
guggcgcagcauauucaggaagc

SEQ ID NO: 3000976 - RNA, 13 nt, Human
gugggagugggcc

SEQ ID NO: 3000977 - RNA, 14 nt, Human
gugggagugggccc

SEQ ID NO: 3000978 - RNA, 13 nt, Human
gugggauccucca

SEQ ID NO: 3000979 - RNA, 23 nt, Human
gugggaggaucucuugagccugg

SEQ ID NO: 3000980 - RNA, 14 nt, Human
guggugguuuucug

SEQ ID NO: 3000981 - RNA, 16 nt, Human
gugguuucagaaaugu

SEQ ID NO: 3000982 - RNA, 20 nt, Human
gugggggaucacagccucug

SEQ ID NO: 3000983 - RNA, 14 nt, Human
guggguacgggagg

SEQ ID NO: 3000984 - RNA, 19 nt, Human
aagagcuguucacagccag

SEQ ID NO: 3000985 - RNA, 16 nt, Human
aagacuuaaugagacu

SEQ ID NO: 3000986 - RNA, 13 nt, Human
aagagcaaaguag

SEQ ID NO: 3000987 - RNA, 16 nt, Human
aagacuguacaaagua

SEQ ID NO: 3000988 - RNA, 21 nt, Human
aagacugaguacguugugcau

SEQ ID NO: 3000989 - RNA, 17 nt, Human
aagacuguacaaaguag

SEQ ID NO: 3000990 - RNA, 17 nt, Human
aagacugaguacguugu

SEQ ID NO: 3000991 - RNA, 18 nt, Human
aagacuaucuaaauguug

SEQ ID NO: 3000992 - RNA, 17 nt, Human
aagacuaucuaaauguu

SEQ ID NO: 3000993 - RNA, 16 nt, Human
aagacuaucuaaaugu

SEQ ID NO: 3000994 - RNA, 18 nt, Human
aagacccuugugguccca

SEQ ID NO: 3000995 - RNA, 21 nt, Human
aagacccuuguggucccaccc

SEQ ID NO: 3000996 - RNA, 22 nt, Human
aagacccuuguggucccacccc

SEQ ID NO: 3000997 - RNA, 17 nt, Human
gugugacuacuccccca

SEQ ID NO: 3000998 - RNA, 21 nt, Human
gugugaccacugcagaagaca

SEQ ID NO: 3000999 - RNA, 18 nt, Human
gugucuuuuuucacuaca

SEQ ID NO: 3001000 - RNA, 18 nt, Human
gugucuugcaauggcagc

SEQ ID NO: 3001001 - RNA, 17 nt, Human
gugucuugcaauggcag

SEQ ID NO: 3001002 - RNA, 23 nt, Human
guguuuccuggcacugcuuccag

SEQ ID NO: 3001003 - RNA, 17 nt, Human
gugguuuucuguucuuu

SEQ ID NO: 3001004 - RNA, 18 nt, Human
aagagguuuuaaaaaaau

SEQ ID NO: 3001005 - RNA, 18 nt, Human
aagagguuuuaaagcuuc

SEQ ID NO: 3001006 - RNA, 14 nt, Human
aagagguuuuaaag

SEQ ID NO: 3001007 - RNA, 12 nt, Human
aagaugcagccg

SEQ ID NO: 3001008 - RNA, 12 nt, Human
aagcaaaggaga

SEQ ID NO: 3001009 - RNA, 13 nt, Human
aagcaaaggagau

SEQ ID NO: 3001010 - RNA, 14 nt, Human
aagaugugacaugu

SEQ ID NO: 3001011 - RNA, 18 nt, Human
aagaugugacauguuuua

SEQ ID NO: 3001012 - RNA, 14 nt, Human
guuacacaaagaac

SEQ ID NO: 3001013 - RNA, 17 nt, Human
guuaguaugaggcauuu

SEQ ID NO: 3001014 - RNA, 20 nt, Human
guuaguaugaggcauuuguu

SEQ ID NO: 3001015 - RNA, 18 nt, Human
guuaaugauagcuacugu

SEQ ID NO: 3001016 - RNA, 22 nt, Human
aagcuaggccuggccagaugca

SEQ ID NO: 3001017 - RNA, 16 nt, Human
aagcuaggccuggcca

SEQ ID NO: 3001018 - RNA, 18 nt, Human
aagcuaggccuggccaga

SEQ ID NO: 3001019 - RNA, 17 nt, Human
aagcuaggccuggccag

SEQ ID NO: 3001020 - RNA, 19 nt, Human
aagccuccuccagccgcca

SEQ ID NO: 3001021 - RNA, 19 nt, Human
guucaggguuggccccugc

SEQ ID NO: 3001022 - RNA, 18 nt, Human
guucaggguuggccccug

SEQ ID NO: 3001023 - RNA, 17 nt, Human
guucaggguuggccccu

SEQ ID NO: 3001024 - RNA, 17 nt, Human
guucagcuccagcucac

SEQ ID NO: 3001025 - RNA, 16 nt, Human
guucagcuccagcuca

SEQ ID NO: 3001026 - RNA, 18 nt, Human
guucagcuccagcucacc

SEQ ID NO: 3001027 - RNA, 15 nt, Human
guucagcuccagcuc

SEQ ID NO: 3001028 - RNA, 18 nt, Human
guugacaugggacauuug

SEQ ID NO: 3001029 - RNA, 14 nt, Human
guugacaugggaca

SEQ ID NO: 3001030 - RNA, 22 nt, Human
guugaugaucuuugcagacagg

SEQ ID NO: 3001031 - RNA, 13 nt, Human
guugacaugggac

SEQ ID NO: 3001032 - RNA, 17 nt, Human
guucuuaguuugcaguu

SEQ ID NO: 3001033 - RNA, 21 nt, Human
guucuugguuuguaaauuaac

SEQ ID NO: 3001034 - RNA, 23 nt, Human
guucugggacacaguucaauucu

SEQ ID NO: 3001035 - RNA, 20 nt, Human
guucccuuugacgccauccc

SEQ ID NO: 3001036 - RNA, 21 nt, Human
guucccuuugacgccauccca

SEQ ID NO: 3001037 - RNA, 22 nt, Human
guucccuuugacgccaucccag

SEQ ID NO: 3001038 - RNA, 16 nt, Human
guucuacccaggugcu

SEQ ID NO: 3001039 - RNA, 20 nt, Human
guucccauuugcuccuuucu

SEQ ID NO: 3001040 - RNA, 16 nt, Human
guucccauuugcuccu

SEQ ID NO: 3001041 - RNA, 20 nt, Human
guuccauggccucuucagau

SEQ ID NO: 3001042 - RNA, 22 nt, Human
aagcuauucaguaauaacucua

SEQ ID NO: 3001043 - RNA, 23 nt, Human
aagcuuguauuccuuuuucucuc

SEQ ID NO: 3001044 - RNA, 18 nt, Human
aagcuuauuaaaacucau

SEQ ID NO: 3001045 - RNA, 20 nt, Human
guuuaaugguaguuuuacag

SEQ ID NO: 3001046 - RNA, 10 nt, Human
guuuaaaauc

SEQ ID NO: 3001047 - RNA, 16 nt, Human
guuuaaaaucauuucu

SEQ ID NO: 3001048 - RNA, 18 nt, Human
guuguaccgcaaugugac

SEQ ID NO: 3001049 - RNA, 18 nt, Human
guuggucccccuuccaug

SEQ ID NO: 3001050 - RNA, 13 nt, Human
guuggguggaugc

SEQ ID NO: 3001051 - RNA, 17 nt, Human
guugcccaggcuggcgu

SEQ ID NO: 3001052 - RNA, 15 nt, Human
guugcccaggcaggu

SEQ ID NO: 3001053 - RNA, 21 nt, Human
guugcccaggcuggcgugcag

SEQ ID NO: 3001054 - RNA, 19 nt, Human
guugcccaggcaggucuug

SEQ ID NO: 3001055 - RNA, 18 nt, Human
guugcccaggcaggucuu

SEQ ID NO: 3001056 - RNA, 14 nt, Human
aaggcuccaggagc

SEQ ID NO: 3001057 - RNA, 17 nt, Human
guugcccaggcaggucu

SEQ ID NO: 3001058 - RNA, 18 nt, Human
aaggccaaaggaagcaca

SEQ ID NO: 3001059 - RNA, 19 nt, Human
aaggcuaccuuuguauucu

SEQ ID NO: 3001060 - RNA, 15 nt, Human
aaggauccugagcca

SEQ ID NO: 3001061 - RNA, 17 nt, Human
aaggauccugagccaga

SEQ ID NO: 3001062 - RNA, 18 nt, Human
aaggaugaucuaggaaga

SEQ ID NO: 3001063 - RNA, 23 nt, Human
aaggaugaucuaggaagacuuug

SEQ ID NO: 3001064 - RNA, 14 nt, Human
aaggauccugagcc

SEQ ID NO: 3001065 - RNA, 13 nt, Human
aaggauccugagc

SEQ ID NO: 3001066 - RNA, 23 nt, Human
guugaugaucuuugcagacaggc

SEQ ID NO: 3001067 - RNA, 16 nt, Human
aaggaugcuuguacau

SEQ ID NO: 3001068 - RNA, 15 nt, Human
aaggaugcuuguaca

SEQ ID NO: 3001069 - RNA, 18 nt, Human
aaggaugcacagaguugu

SEQ ID NO: 3001070 - RNA, 19 nt, Human
aaggaugcuuguacauaau

SEQ ID NO: 3001071 - RNA, 17 nt, Human
aaggaugcuuguacaua

SEQ ID NO: 3001072 - RNA, 14 nt, Human
guuuuacaguguuu

SEQ ID NO: 3001073 - RNA, 11 nt, Human
guuuucuguuc

SEQ ID NO: 3001074 - RNA, 23 nt, Human
guuuucugagaaagacuauucaa

SEQ ID NO: 3001075 - RNA, 19 nt, Human
guuuucuguucuuucuggc

SEQ ID NO: 3001076 - RNA, 16 nt, Human
guuugccucugccucu

SEQ ID NO: 3001077 - RNA, 13 nt, Human
guuugccucugcc

SEQ ID NO: 3001078 - RNA, 23 nt, Human
guuucuaaaggcuaccuuuguau

SEQ ID NO: 3001079 - RNA, 22 nt, Human
guuucuaaaggcuaccuuugua

SEQ ID NO: 3001080 - RNA, 22 nt, Human
guuugauucagacagcugccug

SEQ ID NO: 3001081 - RNA, 21 nt, Human
guuucaaacauauauaacaau

SEQ ID NO: 3001082 - RNA, 13 nt, Human
aagggccuggccu

SEQ ID NO: 3001083 - RNA, 19 nt, Human
aagggccuggccugagcug

SEQ ID NO: 3001084 - RNA, 14 nt, Human
aagggccuggccug

SEQ ID NO: 3001085 - RNA, 17 nt, Human
aagggccuggccugagc

SEQ ID NO: 3001086 - RNA, 23 nt, Human
aaggggaauguuugccucugccu

SEQ ID NO: 3001087 - RNA, 22 nt, Human
aaggggaauguuugccucugcc

SEQ ID NO: 3001088 - RNA, 12 nt, Human
aaguaauaugca

SEQ ID NO: 3001089 - RNA, 19 nt, Human
guuucuaaaggcuaccuuu

SEQ ID NO: 3001090 - RNA, 20 nt, Human
guuucuaaagcugccagccg

SEQ ID NO: 3001091 - RNA, 16 nt, Human
aaguaauaugcacaca

SEQ ID NO: 3001092 - RNA, 15 nt, Human
aaguaauaugcacac

SEQ ID NO: 3001093 - RNA, 16 nt, Human
aaggguaucaggugcu

SEQ ID NO: 3001094 - RNA, 16 nt, Human
aaccccaaguuaguuc

SEQ ID NO: 3001095 - RNA, 20 nt, Human
aacccauauuuguacaccaa

SEQ ID NO: 3001096 - RNA, 17 nt, Human
aacccagcucuggucca

SEQ ID NO: 3001097 - RNA, 23 nt, Human
aaccauuuugcugucccuuuucc

SEQ ID NO: 3001098 - RNA, 13 nt, Human
aacccaaauguuc

SEQ ID NO: 3001099 - RNA, 13 nt, Human
aacccagcucugg

SEQ ID NO: 3001100 - RNA, 14 nt, Human
aacccagcucuggu

SEQ ID NO: 3001101 - RNA, 11 nt, Human
aacccagcucu

SEQ ID NO: 3001102 - RNA, 18 nt, Human
aacccaaauguucaucaa

SEQ ID NO: 3001103 - RNA, 20 nt, Human
aaccuagggugauauuaacc

SEQ ID NO: 3001104 - RNA, 17 nt, Human
aaccuagggugauauua

SEQ ID NO: 3001105 - RNA, 15 nt, Human
aacccccagccugcu

SEQ ID NO: 3001106 - RNA, 14 nt, Human
aacccccagccugc

SEQ ID NO: 3001107 - RNA, 13 nt, Human
aacccccagccug

SEQ ID NO: 3001108 - RNA, 24 nt, Human
aaccucuaaauucuuucauuuuag

SEQ ID NO: 3001109 - RNA, 14 nt, Human
aaccuccugggcua

SEQ ID NO: 3001110 - RNA, 17 nt, Human
aaccuccgccucuuggg

SEQ ID NO: 3001111 - RNA, 12 nt, Human
aaccacagcagu

SEQ ID NO: 3001112 - RNA, 18 nt, Human
aaccacaucuugcucugc

SEQ ID NO: 3001113 - RNA, 21 nt, Human
aaccaucauugaaaucuuuuu

SEQ ID NO: 3001114 - RNA, 19 nt, Human
aaccaucauugaaaucuuu

SEQ ID NO: 3001115 - RNA, 20 nt, Human
aaccaucauugaaaucuuuu

SEQ ID NO: 3001116 - RNA, 22 nt, Human
aaccacaucuugcucugcugac

SEQ ID NO: 3001117 - RNA, 20 nt, Human
aaccacaucuugcucugcug

SEQ ID NO: 3001118 - RNA, 16 nt, Human
aacauuuugucauaua

SEQ ID NO: 3001119 - RNA, 19 nt, Human
gucuuaauuaaaagaauau

SEQ ID NO: 3001120 - RNA, 21 nt, Human
gucuuaauuaaaagaauauuu

SEQ ID NO: 3001121 - RNA, 22 nt, Human
gucuuaauuaaaagaauauuuu

SEQ ID NO: 3001122 - RNA, 12 nt, Human
gucugcuuagaa

SEQ ID NO: 3001123 - RNA, 14 nt, Human
gucuuuggacccug

SEQ ID NO: 3001124 - RNA, 15 nt, Human
gucuuuggacccuga

SEQ ID NO: 3001125 - RNA, 17 nt, Human
gucuuuggacccugagg

SEQ ID NO: 3001126 - RNA, 14 nt, Human
gucuuuucuugcau

SEQ ID NO: 3001127 - RNA, 19 nt, Human
gucuuuucuugcaugaggc

SEQ ID NO: 3001128 - RNA, 24 nt, Human
gucuuuucuugcaugaggcuagug

SEQ ID NO: 3001129 - RNA, 15 nt, Human
gucuuagauguauau

SEQ ID NO: 3001130 - RNA, 14 nt, Human
aacuccagaaagug

SEQ ID NO: 3001131 - RNA, 21 nt, Human
aacuccagaaagugacaagcu

SEQ ID NO: 3001132 - RNA, 14 nt, Human
aacucccuuucaac

SEQ ID NO: 3001133 - RNA, 13 nt, Human
aacucccuuucaa

SEQ ID NO: 3001134 - RNA, 18 nt, Human
aacucguuaauuuguagu

SEQ ID NO: 3001135 - RNA, 15 nt, Human
gugaacacaucagcu

SEQ ID NO: 3001136 - RNA, 19 nt, Human
gugaaccaccacacccagc

SEQ ID NO: 3001137 - RNA, 22 nt, Human
aacguggcugcuucaaggaucc

SEQ ID NO: 3001138 - RNA, 16 nt, Human
aacguggcugcuucaa

SEQ ID NO: 3001139 - RNA, 19 nt, Human
aacguggcugcuucaagga

SEQ ID NO: 3001140 - RNA, 15 nt, Human
aacguggcugcuuca

SEQ ID NO: 3001141 - RNA, 18 nt, Human
aacacugguuuuaaauau

SEQ ID NO: 3001142 - RNA, 22 nt, Human
aacacugguuuuaaauauuuug

SEQ ID NO: 3001143 - RNA, 15 nt, Human
aacacuguucucugc

SEQ ID NO: 3001144 - RNA, 20 nt, Human
aacacuguucucugcccucc

SEQ ID NO: 3001145 - RNA, 21 nt, Human
aacacucuauaacaaaggaua

SEQ ID NO: 3001146 - RNA, 14 nt, Human
aacacucugagacu

SEQ ID NO: 3001147 - RNA, 12 nt, Human
aacacucugaga

SEQ ID NO: 3001148 - RNA, 13 nt, Human
aacacucugagac

SEQ ID NO: 3001149 - RNA, 17 nt, Human
aacacucauugaccuga

SEQ ID NO: 3001150 - RNA, 21 nt, Human
aacacucauugaccugaggcc

SEQ ID NO: 3001151 - RNA, 12 nt, Human
aacacuccuuca

SEQ ID NO: 3001152 - RNA, 11 nt, Human
aacacucugag

SEQ ID NO: 3001153 - RNA, 21 nt, Human
guccaagcauuuagauguaua

SEQ ID NO: 3001154 - RNA, 24 nt, Human
guccaagcauaccaacacgagcag

SEQ ID NO: 3001155 - RNA, 22 nt, Human
gucauuugagcagggcucagcg

SEQ ID NO: 3001156 - RNA, 21 nt, Human
gucauuugagcagggcucagc

SEQ ID NO: 3001157 - RNA, 21 nt, Human
aacacuguucucugcccucca

SEQ ID NO: 3001158 - RNA, 21 nt, Human
aacaagccuccuuuuaaagua

SEQ ID NO: 3001159 - RNA, 15 nt, Human
aacaaggaugaauua

SEQ ID NO: 3001160 - RNA, 17 nt, Human
aacaagaccacguuucu

SEQ ID NO: 3001161 - RNA, 16 nt, Human
aacaagaccacguuuc

SEQ ID NO: 3001162 - RNA, 19 nt, Human
aacaagaccacguuucuaa

SEQ ID NO: 3001163 - RNA, 15 nt, Human
gucacaggcaggucc

SEQ ID NO: 3001164 - RNA, 13 nt, Human
gucacaggcaggu

SEQ ID NO: 3001165 - RNA, 16 nt, Human
gucacaggcaggucca

SEQ ID NO: 3001166 - RNA, 23 nt, Human
aacaaggcaaggcugucaauuac

SEQ ID NO: 3001167 - RNA, 23 nt, Human
aacaaggccugucagcuaaagaa

SEQ ID NO: 3001168 - RNA, 15 nt, Human
aacaagucagucauu

SEQ ID NO: 3001169 - RNA, 18 nt, Human
aacaagucagucauucag

SEQ ID NO: 3001170 - RNA, 22 nt, Human
aacauuuauuugaguggaguua

SEQ ID NO: 3001171 - RNA, 18 nt, Human
aacauuugguaaggggaa

SEQ ID NO: 3001172 - RNA, 14 nt, Human
aacauacucccauc

SEQ ID NO: 3001173 - RNA, 15 nt, Human
aacauacucccaucu

SEQ ID NO: 3001174 - RNA, 19 nt, Human
aacauuuggguuacuauuu

SEQ ID NO: 3001175 - RNA, 15 nt, Human
aacaguaacauagcu

SEQ ID NO: 3001176 - RNA, 22 nt, Human
aacaguagugauaguuguaccg

SEQ ID NO: 3001177 - RNA, 18 nt, Human
aacaggcuuagugaugua

SEQ ID NO: 3001178 - RNA, 19 nt, Human
aacagguuuuccugaagaa

SEQ ID NO: 3001179 - RNA, 23 nt, Human
aacaggcugggcuucaguggcag

SEQ ID NO: 3001180 - RNA, 13 nt, Human
aacaggcugggcu

SEQ ID NO: 3001181 - RNA, 22 nt, Human
aacaggcugggcuucaguggca

SEQ ID NO: 3001182 - RNA, 19 nt, Human
aacagacuggaagcacagc

SEQ ID NO: 3001183 - RNA, 22 nt, Human
aacaguaacauagcugugauuu

SEQ ID NO: 3001184 - RNA, 19 nt, Human
aacaguuguguuugaagca

SEQ ID NO: 3001185 - RNA, 15 nt, Human
aacagaaauguacag

SEQ ID NO: 3001186 - RNA, 10 nt, Human
aacagaaaug

SEQ ID NO: 3001187 - RNA, 21 nt, Human
aacagaaauguacagcaagga

SEQ ID NO: 3001188 - RNA, 21 nt, Human
guccggucccugucccagugc

SEQ ID NO: 3001189 - RNA, 13 nt, Human
guccgagcuuuga

SEQ ID NO: 3001190 - RNA, 15 nt, Human
aaaugauuucacagu

SEQ ID NO: 3001191 - RNA, 15 nt, Human
aaaugcaaaaaaaau

SEQ ID NO: 3001192 - RNA, 14 nt, Human
aaaugcaccuggaa

SEQ ID NO: 3001193 - RNA, 18 nt, Human
aaaugcaaaaaaaauuag

SEQ ID NO: 3001194 - RNA, 17 nt, Human
aaaugcaaaaaaaauua

SEQ ID NO: 3001195 - RNA, 22 nt, Human
aaaugcaccuggaauauauaac

SEQ ID NO: 3001196 - RNA, 18 nt, Human
aaaugcaccuggaauaua

SEQ ID NO: 3001197 - RNA, 13 nt, Human
aaaugcccagcuu

SEQ ID NO: 3001198 - RNA, 18 nt, Human
aaaugcccagccccuucu

SEQ ID NO: 3001199 - RNA, 14 nt, Human
aaaugcccagcccc

SEQ ID NO: 3001200 - RNA, 15 nt, Human
aaaugcccagccccu

SEQ ID NO: 3001201 - RNA, 14 nt, Human
aaaugcauuucuaa

SEQ ID NO: 3001202 - RNA, 13 nt, Human
aaaugcccagccc

SEQ ID NO: 3001203 - RNA, 18 nt, Human
aaauggcuuccuggcaau

SEQ ID NO: 3001204 - RNA, 19 nt, Human
aaauggcuuccuggcaaua

SEQ ID NO: 3001205 - RNA, 18 nt, Human
aaaugggcagagcagaga

SEQ ID NO: 3001206 - RNA, 20 nt, Human
aaaugggcagagcagagacc

SEQ ID NO: 3001207 - RNA, 15 nt, Human
aaaugggcagagcag

SEQ ID NO: 3001208 - RNA, 23 nt, Human
aaaugagguacucuccuggaaau

SEQ ID NO: 3001209 - RNA, 16 nt, Human
aaaugagguacucucc

SEQ ID NO: 3001210 - RNA, 19 nt, Human
aaaugaggucagagccugc

SEQ ID NO: 3001211 - RNA, 17 nt, Human
aaaugaggucagagccu

SEQ ID NO: 3001212 - RNA, 13 nt, Human
aaaugagccuggc

SEQ ID NO: 3001213 - RNA, 19 nt, Human
aaaugagccuggcaagaau

SEQ ID NO: 3001214 - RNA, 22 nt, Human
aaaugaaagcagggacuugaac

SEQ ID NO: 3001215 - RNA, 21 nt, Human
aaaugaaagcagggacuugaa

SEQ ID NO: 3001216 - RNA, 21 nt, Human
aaaugaaugucacuucuggau

SEQ ID NO: 3001217 - RNA, 19 nt, Human
aaaugaaugucacuucugg

SEQ ID NO: 3001218 - RNA, 14 nt, Human
aaaugaaugucacu

SEQ ID NO: 3001219 - RNA, 15 nt, Human
aaaggauacuuauuu

SEQ ID NO: 3001220 - RNA, 17 nt, Human
aaaggauacuuauuuaa

SEQ ID NO: 3001221 - RNA, 21 nt, Human
guagcugggacuacaggcacc

SEQ ID NO: 3001222 - RNA, 19 nt, Human
guagcugggacuacaggca

SEQ ID NO: 3001223 - RNA, 18 nt, Human
guagcugggacuacaggc

SEQ ID NO: 3001224 - RNA, 12 nt, Human
guagcugggacu

SEQ ID NO: 3001225 - RNA, 18 nt, Human
aaauccauacauuugugu

SEQ ID NO: 3001226 - RNA, 18 nt, Human
guaggaagguuaauguuc

SEQ ID NO: 3001227 - RNA, 15 nt, Human
guaggaagacuuugg

SEQ ID NO: 3001228 - RNA, 15 nt, Human
aaaucccauuuaaaa

SEQ ID NO: 3001229 - RNA, 18 nt, Human
aaaucccuuaccucggug

SEQ ID NO: 3001230 - RNA, 13 nt, Human
aaaucgaugcagu

SEQ ID NO: 3001231 - RNA, 14 nt, Human
aaauccuugaagau

SEQ ID NO: 3001232 - RNA, 19 nt, Human
aaaucuacacuccagugag

SEQ ID NO: 3001233 - RNA, 17 nt, Human
aaaucuaggaaaauuau

SEQ ID NO: 3001234 - RNA, 22 nt, Human
aaaucuaggaaaauuauucuau

SEQ ID NO: 3001235 - RNA, 19 nt, Human
aaaucucaaauuucuaaau

SEQ ID NO: 3001236 - RNA, 17 nt, Human
aaaucucaaauuucuaa

SEQ ID NO: 3001237 - RNA, 16 nt, Human
aaaucucaaauuucua

SEQ ID NO: 3001238 - RNA, 15 nt, Human
aaaucucaaauuucu

SEQ ID NO: 3001239 - RNA, 17 nt, Human
aaaugaaaaucgugaca

SEQ ID NO: 3001240 - RNA, 13 nt, Human
gucaacauuucuc

SEQ ID NO: 3001241 - RNA, 17 nt, Human
gucaacauuucucaugu

SEQ ID NO: 3001242 - RNA, 20 nt, Human
gucacacaguauuacuucug

SEQ ID NO: 3001243 - RNA, 16 nt, Human
gucacacacuuuggcu

SEQ ID NO: 3001244 - RNA, 19 nt, Human
gucaacucauauuuucaug

SEQ ID NO: 3001245 - RNA, 19 nt, Human
gucaaaguggugagaggca

SEQ ID NO: 3001246 - RNA, 18 nt, Human
gucaaaguggugagaggc

SEQ ID NO: 3001247 - RNA, 21 nt, Human
guauuuuuuuacuaauagaca

SEQ ID NO: 3001248 - RNA, 17 nt, Human
guauuuuuuuacuaaua

SEQ ID NO: 3001249 - RNA, 20 nt, Human
aaauuuacuuuaaacuacau

SEQ ID NO: 3001250 - RNA, 17 nt, Human
aaauuuacuuuaaacua

SEQ ID NO: 3001251 - RNA, 20 nt, Human
aaauuuaguauuuuguuuca

SEQ ID NO: 3001252 - RNA, 17 nt, Human
aaauuucagcagcugca

SEQ ID NO: 3001253 - RNA, 18 nt, Human
aaauuucagcagcugcag

SEQ ID NO: 3001254 - RNA, 15 nt, Human
guauuuuuuuacuaa

SEQ ID NO: 3001255 - RNA, 14 nt, Human
guauuuuuuuacua

SEQ ID NO: 3001256 - RNA, 22 nt, Human
aaauuuccugggagcuuuugua

SEQ ID NO: 3001257 - RNA, 23 nt, Human
aaauuaacuuuuauaaacuuuac

SEQ ID NO: 3001258 - RNA, 22 nt, Human
aaauuaacuuuuauaaacuuua

SEQ ID NO: 3001259 - RNA, 21 nt, Human
aaauuaacuuuuauaaacuuu

SEQ ID NO: 3001260 - RNA, 19 nt, Human
aaauuaacuuuuauaaacu

SEQ ID NO: 3001261 - RNA, 22 nt, Human
guauuggcuagagguucaaaga

SEQ ID NO: 3001262 - RNA, 20 nt, Human
guauuuaauagguuuggaca

SEQ ID NO: 3001263 - RNA, 16 nt, Human
aaauuccccacccuga

SEQ ID NO: 3001264 - RNA, 14 nt, Human
aaauucaugcugcu

SEQ ID NO: 3001265 - RNA, 14 nt, Human
guaugauucccagc

SEQ ID NO: 3001266 - RNA, 14 nt, Human
guaugcacacacau

SEQ ID NO: 3001267 - RNA, 14 nt, Human
guaugggagagaag

SEQ ID NO: 3001268 - RNA, 21 nt, Human
guaucccaugagccucagcau

SEQ ID NO: 3001269 - RNA, 18 nt, Human
guaucaaguauagaaaau

SEQ ID NO: 3001270 - RNA, 22 nt, Human
guaugaucacggcucacugcag

SEQ ID NO: 3001271 - RNA, 15 nt, Human
guaucccuacuguaa

SEQ ID NO: 3001272 - RNA, 21 nt, Human
guauucucuccuguaccucuu

SEQ ID NO: 3001273 - RNA, 15 nt, Human
guauguguaauaaau

SEQ ID NO: 3001274 - RNA, 15 nt, Human
guauucuuauuuaau

SEQ ID NO: 3001275 - RNA, 15 nt, Human
guaugggagagaaga

SEQ ID NO: 3001276 - RNA, 16 nt, Human
aaaugggggugcauuu

SEQ ID NO: 3001277 - RNA, 15 nt, Human
aaaugggggugcauu

SEQ ID NO: 3001278 - RNA, 18 nt, Human
aaaugggggugcauuuga

SEQ ID NO: 3001279 - RNA, 17 nt, Human
aaaugggggugcauuug

SEQ ID NO: 3001280 - RNA, 22 nt, Human
aaauguaagggaaacugccagc

SEQ ID NO: 3001281 - RNA, 22 nt, Human
cugcugauuuaaacacauuaaa

SEQ ID NO: 3001282 - RNA, 16 nt, Human
cugcugauuuaaacac

SEQ ID NO: 3001283 - RNA, 13 nt, Human
cugcugaaggcuc

SEQ ID NO: 3001284 - RNA, 14 nt, Human
cugcugaaggcucg

SEQ ID NO: 3001285 - RNA, 15 nt, Human
cugcugaaggcucga

SEQ ID NO: 3001286 - RNA, 12 nt, Human
cugcugacagug

SEQ ID NO: 3001287 - RNA, 11 nt, Human
cugcugacagu

SEQ ID NO: 3001288 - RNA, 15 nt, Human
cugcugacaguguug

SEQ ID NO: 3001289 - RNA, 13 nt, Human
cugcugacagugu

SEQ ID NO: 3001290 - RNA, 19 nt, Human
cugcucacauaucugucau

SEQ ID NO: 3001291 - RNA, 16 nt, Human
cugcucacauaucugu

SEQ ID NO: 3001292 - RNA, 12 nt, Human
cugcugaaggcu

SEQ ID NO: 3001293 - RNA, 14 nt, Human
cugcucacauaucu

SEQ ID NO: 3001294 - RNA, 20 nt, Human
cugcuuaacuucacauauug

SEQ ID NO: 3001295 - RNA, 20 nt, Human
cugcuuauccguuagccgug

SEQ ID NO: 3001296 - RNA, 23 nt, Human
cugcuuagaaauaacagaagaaa

SEQ ID NO: 3001297 - RNA, 16 nt, Human
cuggaguucugguucc

SEQ ID NO: 3001298 - RNA, 17 nt, Human
cuggaguucugguuccu

SEQ ID NO: 3001299 - RNA, 15 nt, Human
cuggaguucugguuc

SEQ ID NO: 3001300 - RNA, 22 nt, Human
cuggaugcagccucacaguccu

SEQ ID NO: 3001301 - RNA, 19 nt, Human
cuggaugcccccuguggau

SEQ ID NO: 3001302 - RNA, 18 nt, Human
cuggaugcccccugugga

SEQ ID NO: 3001303 - RNA, 17 nt, Human
cuggaugcccccugugg

SEQ ID NO: 3001304 - RNA, 23 nt, Human
cuggaugcccauccacugggugu

SEQ ID NO: 3001305 - RNA, 12 nt, Human
cuggaugccauc

SEQ ID NO: 3001306 - RNA, 22 nt, Human
cuggaugcccccuguggaugcu

SEQ ID NO: 3001307 - RNA, 13 nt, Human
cuggggagaaagu

SEQ ID NO: 3001308 - RNA, 18 nt, Human
cuggguggcaccagcagc

SEQ ID NO: 3001309 - RNA, 20 nt, Human
cuggguggcaccagcagccu

SEQ ID NO: 3001310 - RNA, 16 nt, Human
cuggguggaugggcca

SEQ ID NO: 3001311 - RNA, 15 nt, Human
cugggcagcugccuc

SEQ ID NO: 3001312 - RNA, 14 nt, Human
cugggcagcugccu

SEQ ID NO: 3001313 - RNA, 20 nt, Human
cugggcagguuggugggggc

SEQ ID NO: 3001314 - RNA, 13 nt, Human
cugggcagcugcc

SEQ ID NO: 3001315 - RNA, 20 nt, Human
cugggcagaggaaagcaaag

SEQ ID NO: 3001316 - RNA, 13 nt, Human
cugggcagaggaa

SEQ ID NO: 3001317 - RNA, 16 nt, Human
cugggcagaggaaagc

SEQ ID NO: 3001318 - RNA, 12 nt, Human
cugggcagagga

SEQ ID NO: 3001319 - RNA, 15 nt, Human
cuggguguaaacaca

SEQ ID NO: 3001320 - RNA, 14 nt, Human
cuggguguggcgca

SEQ ID NO: 3001321 - RNA, 21 nt, Human
cuggguggcaccagcagccug

SEQ ID NO: 3001322 - RNA, 15 nt, Human
cuggguguggcgcag

SEQ ID NO: 3001323 - RNA, 16 nt, Human
cuggguguaaacacau

SEQ ID NO: 3001324 - RNA, 21 nt, Human
cuggugccucaccccuugcca

SEQ ID NO: 3001325 - RNA, 12 nt, Human
cuggugccucac

SEQ ID NO: 3001326 - RNA, 18 nt, Human
cugggacaugggaaaggg

SEQ ID NO: 3001327 - RNA, 22 nt, Human
cugggacaugggaaaggggaag

SEQ ID NO: 3001328 - RNA, 14 nt, Human
cugggacaugggaa

SEQ ID NO: 3001329 - RNA, 22 nt, Human
cugggagaaccaaaaagaggcu

SEQ ID NO: 3001330 - RNA, 15 nt, Human
cugggacuacaggca

SEQ ID NO: 3001331 - RNA, 13 nt, Human
cugggacuacagg

SEQ ID NO: 3001332 - RNA, 14 nt, Human
cuggcuaugcauuu

SEQ ID NO: 3001333 - RNA, 13 nt, Human
cuggcuaugcauu

SEQ ID NO: 3001334 - RNA, 16 nt, Human
cuggcuaugcauuuga

SEQ ID NO: 3001335 - RNA, 15 nt, Human
cuggcuaugcauuug

SEQ ID NO: 3001336 - RNA, 22 nt, Human
cuggcuaugcauuugaaaauuu

SEQ ID NO: 3001337 - RNA, 13 nt, Human
cuggcucacccag

SEQ ID NO: 3001338 - RNA, 14 nt, Human
cuggcucacccagu

SEQ ID NO: 3001339 - RNA, 12 nt, Human
cuggcccuuccu

SEQ ID NO: 3001340 - RNA, 15 nt, Human
cugcacuccagccug

SEQ ID NO: 3001341 - RNA, 16 nt, Human
cugcacuccagccuga

SEQ ID NO: 3001342 - RNA, 20 nt, Human
cugcacuccagccugagcga

SEQ ID NO: 3001343 - RNA, 17 nt, Human
cugcacuccagccugag

SEQ ID NO: 3001344 - RNA, 13 nt, Human
cugcacuccagcc

SEQ ID NO: 3001345 - RNA, 23 nt, Human
cugcacuauagccuaggugacag

SEQ ID NO: 3001346 - RNA, 22 nt, Human
cugcacuauagccuaggugaca

SEQ ID NO: 3001347 - RNA, 20 nt, Human
cugcacuauagccuagguga

SEQ ID NO: 3001348 - RNA, 18 nt, Human
cugcacuauagccuaggu

SEQ ID NO: 3001349 - RNA, 17 nt, Human
cugcacuauagccuagg

SEQ ID NO: 3001350 - RNA, 16 nt, Human
cugcacuauagccuag

SEQ ID NO: 3001351 - RNA, 17 nt, Human
cugcacuccagccuggg

SEQ ID NO: 3001352 - RNA, 16 nt, Human
cugcacuccagccugg

SEQ ID NO: 3001353 - RNA, 18 nt, Human
cugcacuccagccugggu

SEQ ID NO: 3001354 - RNA, 24 nt, Human
cugcagccucaaccuccugggcua

SEQ ID NO: 3001355 - RNA, 19 nt, Human
cugcacuccagccugggug

SEQ ID NO: 3001356 - RNA, 23 nt, Human
cugcagccucaaccuccugggcu

SEQ ID NO: 3001357 - RNA, 13 nt, Human
cugcaggcagcca

SEQ ID NO: 3001358 - RNA, 14 nt, Human
cugcaggcagccag

SEQ ID NO: 3001359 - RNA, 15 nt, Human
cugcaggcagccagg

SEQ ID NO: 3001360 - RNA, 16 nt, Human
cugcaggcagccaggc

SEQ ID NO: 3001361 - RNA, 17 nt, Human
cugcaggcagccaggcc

SEQ ID NO: 3001362 - RNA, 18 nt, Human
cugcaggcagccaggcca

SEQ ID NO: 3001363 - RNA, 19 nt, Human
cugcaggcagccaggccac

SEQ ID NO: 3001364 - RNA, 20 nt, Human
cugcaggcagccaggccaca

SEQ ID NO: 3001365 - RNA, 12 nt, Human
cugcagcuuugu

SEQ ID NO: 3001366 - RNA, 16 nt, Human
cugaugcuucuucaga

SEQ ID NO: 3001367 - RNA, 17 nt, Human
cugaugcuucuucagag

SEQ ID NO: 3001368 - RNA, 14 nt, Human
cucuuaugggcugg

SEQ ID NO: 3001369 - RNA, 18 nt, Human
cucuuauaucuauauuuu

SEQ ID NO: 3001370 - RNA, 15 nt, Human
cucuuauaucuauau

SEQ ID NO: 3001371 - RNA, 15 nt, Human
cucuuaugggcuggg

SEQ ID NO: 3001372 - RNA, 21 nt, Human
cugaugggcaacccccagccu

SEQ ID NO: 3001373 - RNA, 18 nt, Human
cugaugggcaacccccag

SEQ ID NO: 3001374 - RNA, 18 nt, Human
cugaugcuucuucagaga

SEQ ID NO: 3001375 - RNA, 19 nt, Human
cugaugcuucuucagagac

SEQ ID NO: 3001376 - RNA, 20 nt, Human
cugaugcuucuucagagacu

SEQ ID NO: 3001377 - RNA, 22 nt, Human
cugcaaaggguaucaggugcug

SEQ ID NO: 3001378 - RNA, 21 nt, Human
cugcaaaggguaucaggugcu

SEQ ID NO: 3001379 - RNA, 23 nt, Human
cugaugggcaacccccagccugc

SEQ ID NO: 3001380 - RNA, 22 nt, Human
cugaugggcaacccccagccug

SEQ ID NO: 3001381 - RNA, 24 nt, Human
cugaugggcaacccccagccugcu

SEQ ID NO: 3001382 - RNA, 20 nt, Human
cugcaagaauugaagcagga

SEQ ID NO: 3001383 - RNA, 12 nt, Human
cugcaagggagu

SEQ ID NO: 3001384 - RNA, 23 nt, Human
cugcaccgggccacagagaaagu

SEQ ID NO: 3001385 - RNA, 20 nt, Human
cugcaccgggccacagagaa

SEQ ID NO: 3001386 - RNA, 19 nt, Human
cugcaaccugauugugucu

SEQ ID NO: 3001387 - RNA, 21 nt, Human
cugcaaccugauugugucucu

SEQ ID NO: 3001388 - RNA, 14 nt, Human
cugcaaccugauug

SEQ ID NO: 3001389 - RNA, 22 nt, Human
cugcaaccuccgccucuugggu

SEQ ID NO: 3001390 - RNA, 20 nt, Human
cugcaaccuccgccucuugg

SEQ ID NO: 3001391 - RNA, 18 nt, Human
cugcaagaauugaagcag

SEQ ID NO: 3001392 - RNA, 22 nt, Human
cugcaaccugauugugucucuu

SEQ ID NO: 3001393 - RNA, 18 nt, Human
cugcauuuaaaagauaca

SEQ ID NO: 3001394 - RNA, 17 nt, Human
cugcauuuaaaagauac

SEQ ID NO: 3001395 - RNA, 20 nt, Human
cugccagggacagagggggu

SEQ ID NO: 3001396 - RNA, 22 nt, Human
cugccagggacagagggggugg

SEQ ID NO: 3001397 - RNA, 23 nt, Human
cugccagggacagaggggguggc

SEQ ID NO: 3001398 - RNA, 12 nt, Human
cugccagugccu

SEQ ID NO: 3001399 - RNA, 16 nt, Human
cugccagugccugggu

SEQ ID NO: 3001400 - RNA, 13 nt, Human
cugccagugccug

SEQ ID NO: 3001401 - RNA, 17 nt, Human
cugccagugccugggug

SEQ ID NO: 3001402 - RNA, 19 nt, Human
cugccauccagguucagcu

SEQ ID NO: 3001403 - RNA, 18 nt, Human
cugccauccagguucagc

SEQ ID NO: 3001404 - RNA, 16 nt, Human
cugccauccagguuca

SEQ ID NO: 3001405 - RNA, 16 nt, Human
cugccauauucuguug

SEQ ID NO: 3001406 - RNA, 12 nt, Human
cugccauccagg

SEQ ID NO: 3001407 - RNA, 16 nt, Human
cugcccuuaccugcca

SEQ ID NO: 3001408 - RNA, 17 nt, Human
cugcccuuaccugccag

SEQ ID NO: 3001409 - RNA, 12 nt, Human
cugcccuuaccu

SEQ ID NO: 3001410 - RNA, 19 nt, Human
cugcccugugggcccccaa

SEQ ID NO: 3001411 - RNA, 13 nt, Human
cugcauuggcuuu

SEQ ID NO: 3001412 - RNA, 14 nt, Human
cugcauuuaaaaga

SEQ ID NO: 3001413 - RNA, 13 nt, Human
cuuggcccaggag

SEQ ID NO: 3001414 - RNA, 23 nt, Human
cuugaaugaugccaugaggaaca

SEQ ID NO: 3001415 - RNA, 20 nt, Human
cuugccgucuaccugagggg

SEQ ID NO: 3001416 - RNA, 12 nt, Human
cuugacagggca

SEQ ID NO: 3001417 - RNA, 23 nt, Human
cuugccgucuaccugaggggccu

SEQ ID NO: 3001418 - RNA, 12 nt, Human
cuugcucugcug

SEQ ID NO: 3001419 - RNA, 20 nt, Human
cuucuguuuuauaauuuugu

SEQ ID NO: 3001420 - RNA, 15 nt, Human
cuucuguuuuauaau

SEQ ID NO: 3001421 - RNA, 20 nt, Human
cuucuucagagacuccugca

SEQ ID NO: 3001422 - RNA, 21 nt, Human
cuucuucagagacuccugcag

SEQ ID NO: 3001423 - RNA, 18 nt, Human
cuucuucagagacuccug

SEQ ID NO: 3001424 - RNA, 22 nt, Human
cuucuucagagacuccugcagg

SEQ ID NO: 3001425 - RNA, 20 nt, Human
cuugaaugaugccaugagga

SEQ ID NO: 3001426 - RNA, 15 nt, Human
cuuuuauaaacuuua

SEQ ID NO: 3001427 - RNA, 18 nt, Human
cuuuuauaaacuuuaccu

SEQ ID NO: 3001428 - RNA, 16 nt, Human
cuuuuauaaacuuuac

SEQ ID NO: 3001429 - RNA, 14 nt, Human
cuuuuauaaacuuu

SEQ ID NO: 3001430 - RNA, 16 nt, Human
cuuuggucuacacugu

SEQ ID NO: 3001431 - RNA, 20 nt, Human
cuuuggucuacacugugcug

SEQ ID NO: 3001432 - RNA, 15 nt, Human
cuuuucaaaacauuu

SEQ ID NO: 3001433 - RNA, 21 nt, Human
cuuugagugucuuaauuaaaa

SEQ ID NO: 3001434 - RNA, 18 nt, Human
cuuugacgccaucccagc

SEQ ID NO: 3001435 - RNA, 19 nt, Human
cuuugacgccaucccagcc

SEQ ID NO: 3001436 - RNA, 21 nt, Human
cuuugacgccaucccagcccc

SEQ ID NO: 3001437 - RNA, 22 nt, Human
cuuugacgccaucccagcccca

SEQ ID NO: 3001438 - RNA, 20 nt, Human
cuuuaaagggauggcaagau

SEQ ID NO: 3001439 - RNA, 15 nt, Human
cuuguggacacagcu

SEQ ID NO: 3001440 - RNA, 14 nt, Human
cuuguggacacagc

SEQ ID NO: 3001441 - RNA, 13 nt, Human
cuuguggacacag

SEQ ID NO: 3001442 - RNA, 18 nt, Human
cuuucaauaggaaaaacu

SEQ ID NO: 3001443 - RNA, 20 nt, Human
cuuucaauaggaaaaacuga

SEQ ID NO: 3001444 - RNA, 21 nt, Human
cuuucaauaggaaaaacugau

SEQ ID NO: 3001445 - RNA, 22 nt, Human
cuuucaauaggaaaaacugauu

SEQ ID NO: 3001446 - RNA, 18 nt, Human
cuuagcagggaaacagcu

SEQ ID NO: 3001447 - RNA, 13 nt, Human
cuuauugcccacg

SEQ ID NO: 3001448 - RNA, 12 nt, Human
cuuauugcccac

SEQ ID NO: 3001449 - RNA, 22 nt, Human
cuuaugggcuggguucuaccca

SEQ ID NO: 3001450 - RNA, 23 nt, Human
cuuaugggcuggguucuacccag

SEQ ID NO: 3001451 - RNA, 14 nt, Human
cuuaugggcugggu

SEQ ID NO: 3001452 - RNA, 21 nt, Human
cuuaugggcuggguucuaccc

SEQ ID NO: 3001453 - RNA, 21 nt, Human
cuuauggaacacucugagacu

SEQ ID NO: 3001454 - RNA, 23 nt, Human
cuucaugcugucuacacuaagag

SEQ ID NO: 3001455 - RNA, 21 nt, Human
cuucauggaauucacaaagua

SEQ ID NO: 3001456 - RNA, 16 nt, Human
cuucauccuccucaga

SEQ ID NO: 3001457 - RNA, 23 nt, Human
cuucagagacuccugcaggcagc

SEQ ID NO: 3001458 - RNA, 18 nt, Human
cuucaguggcagcugcuu

SEQ ID NO: 3001459 - RNA, 13 nt, Human
cuucaucccucug

SEQ ID NO: 3001460 - RNA, 15 nt, Human
cuucauccuccucag

SEQ ID NO: 3001461 - RNA, 16 nt, Human
cuucagagacuccugc

SEQ ID NO: 3001462 - RNA, 21 nt, Human
cuucagagacuccugcaggca

SEQ ID NO: 3001463 - RNA, 22 nt, Human
cuucagagacuccugcaggcag

SEQ ID NO: 3001464 - RNA, 11 nt, Human
cuucagacaua

SEQ ID NO: 3001465 - RNA, 17 nt, Human
cuucaccuuugucccca

SEQ ID NO: 3001466 - RNA, 20 nt, Human
cuucaccuuuguccccaccg

SEQ ID NO: 3001467 - RNA, 18 nt, Human
cuuauugcccacgcugga

SEQ ID NO: 3001468 - RNA, 14 nt, Human
cuucaccuuugucc

SEQ ID NO: 3001469 - RNA, 18 nt, Human
cuuccagugaggcucugc

SEQ ID NO: 3001470 - RNA, 17 nt, Human
cuuccagugaggcucug

SEQ ID NO: 3001471 - RNA, 19 nt, Human
cuuccagugaggcucugcc

SEQ ID NO: 3001472 - RNA, 20 nt, Human
cuuccagugaggcucugccc

SEQ ID NO: 3001473 - RNA, 16 nt, Human
cuuccauggacuuugu

SEQ ID NO: 3001474 - RNA, 17 nt, Human
cuuccauggacuuuguu

SEQ ID NO: 3001475 - RNA, 13 nt, Human
cuuacacaauggu

SEQ ID NO: 3001476 - RNA, 17 nt, Human
cuguugggccaggagcc

SEQ ID NO: 3001477 - RNA, 20 nt, Human
cuguugggccaggagccucc

SEQ ID NO: 3001478 - RNA, 16 nt, Human
cuguugggccaggagc

SEQ ID NO: 3001479 - RNA, 19 nt, Human
cuuacccucauguucuuaa

SEQ ID NO: 3001480 - RNA, 18 nt, Human
cuuacccucauguucuua

SEQ ID NO: 3001481 - RNA, 17 nt, Human
cuuacccucauguucuu

SEQ ID NO: 3001482 - RNA, 13 nt, Human
cuuaccucggugc

SEQ ID NO: 3001483 - RNA, 19 nt, Human
cuuaccucggugccuuccu

SEQ ID NO: 3001484 - RNA, 21 nt, Human
cuuaccucggugccuuccucu

SEQ ID NO: 3001485 - RNA, 19 nt, Human
cuuagauguauauauuucc

SEQ ID NO: 3001486 - RNA, 19 nt, Human
cugugucuugcaauggcag

SEQ ID NO: 3001487 - RNA, 16 nt, Human
cugugucuugcaaugg

SEQ ID NO: 3001488 - RNA, 13 nt, Human
cuguucagcucca

SEQ ID NO: 3001489 - RNA, 20 nt, Human
cugugcugagucugaaggcu

SEQ ID NO: 3001490 - RNA, 22 nt, Human
cugugcugagucugaaggcugg

SEQ ID NO: 3001491 - RNA, 11 nt, Human
cugugcugccc

SEQ ID NO: 3001492 - RNA, 19 nt, Human
cugugcugagucugaaggc

SEQ ID NO: 3001493 - RNA, 14 nt, Human
cugugucucccuuc

SEQ ID NO: 3001494 - RNA, 19 nt, Human
cugugucucccuucauccu

SEQ ID NO: 3001495 - RNA, 14 nt, Human
cugugucuugcaau

SEQ ID NO: 3001496 - RNA, 21 nt, Human
cugugucagguggggcagcuu

SEQ ID NO: 3001497 - RNA, 20 nt, Human
cugugucagcauagaaguaa

SEQ ID NO: 3001498 - RNA, 19 nt, Human
cugugucagguggggcagc

SEQ ID NO: 3001499 - RNA, 13 nt, Human
gacucuucccuca

SEQ ID NO: 3001500 - RNA, 21 nt, Human
gacucuuaagaagacugcauu

SEQ ID NO: 3001501 - RNA, 18 nt, Human
gacucuuaagaagacugc

SEQ ID NO: 3001502 - RNA, 14 nt, Human
gacucuuaagaaga

SEQ ID NO: 3001503 - RNA, 19 nt, Human
gacucugucucaaaaaaac

SEQ ID NO: 3001504 - RNA, 20 nt, Human
gacugaauuaugaaacuuuu

SEQ ID NO: 3001505 - RNA, 14 nt, Human
gacugaauuucuuu

SEQ ID NO: 3001506 - RNA, 14 nt, Human
gacugaauuaugaa

SEQ ID NO: 3001507 - RNA, 16 nt, Human
gacugaauggacuuug

SEQ ID NO: 3001508 - RNA, 14 nt, Human
gaccucugcagcaa

SEQ ID NO: 3001509 - RNA, 13 nt, Human
gaccucugccuga

SEQ ID NO: 3001510 - RNA, 20 nt, Human
gaccaucccugaaggccccg

SEQ ID NO: 3001511 - RNA, 11 nt, Human
gaccugaggcc

SEQ ID NO: 3001512 - RNA, 13 nt, Human
gaccugaggcccu

SEQ ID NO: 3001513 - RNA, 14 nt, Human
gaccugaggcccuu

SEQ ID NO: 3001514 - RNA, 16 nt, Human
gacgccaucccagccc

SEQ ID NO: 3001515 - RNA, 16 nt, Human
gaccugaagagugguc

SEQ ID NO: 3001516 - RNA, 16 nt, Human
gacgcuacccgggaag

SEQ ID NO: 3001517 - RNA, 18 nt, Human
gacgcuacccgggaaggg

SEQ ID NO: 3001518 - RNA, 19 nt, Human
gacgcuacccgggaagggg

SEQ ID NO: 3001519 - RNA, 15 nt, Human
gacgcucucuggccu

SEQ ID NO: 3001520 - RNA, 17 nt, Human
gacgccaucccagcccc

SEQ ID NO: 3001521 - RNA, 18 nt, Human
gacgccaucccagcccca

SEQ ID NO: 3001522 - RNA, 15 nt, Human
gacgccaucccagcc

SEQ ID NO: 3001523 - RNA, 17 nt, Human
gacgcucucuggccuuc

SEQ ID NO: 3001524 - RNA, 16 nt, Human
gacgcucucuggccuu

SEQ ID NO: 3001525 - RNA, 12 nt, Human
gacauucccugc

SEQ ID NO: 3001526 - RNA, 21 nt, Human
gacagugagacucugucucag

SEQ ID NO: 3001527 - RNA, 18 nt, Human
gacagcccgggcucugcc

SEQ ID NO: 3001528 - RNA, 19 nt, Human
gacagcccgggcucugccu

SEQ ID NO: 3001529 - RNA, 20 nt, Human
gacagcccgggcucugccuc

SEQ ID NO: 3001530 - RNA, 14 nt, Human
gacagugaaagaaa

SEQ ID NO: 3001531 - RNA, 14 nt, Human
gacauugacuauuu

SEQ ID NO: 3001532 - RNA, 22 nt, Human
gacauugacuauuuuuguuuuu

SEQ ID NO: 3001533 - RNA, 14 nt, Human
gacauugaaaucua

SEQ ID NO: 3001534 - RNA, 15 nt, Human
gacauugcggacagc

SEQ ID NO: 3001535 - RNA, 14 nt, Human
gacauugcggacag

SEQ ID NO: 3001536 - RNA, 21 nt, Human
gacauugaaaucuaggaaaau

SEQ ID NO: 3001537 - RNA, 19 nt, Human
gacauuguuggccaaagcc

SEQ ID NO: 3001538 - RNA, 17 nt, Human
gacauuugcucauggaa

SEQ ID NO: 3001539 - RNA, 16 nt, Human
gacauuugcucaugga

SEQ ID NO: 3001540 - RNA, 12 nt, Human
gaccaucccuga

SEQ ID NO: 3001541 - RNA, 13 nt, Human
gaccaucccugaa

SEQ ID NO: 3001542 - RNA, 18 nt, Human
gaccaucccugaaggccc

SEQ ID NO: 3001543 - RNA, 19 nt, Human
gaccaucccugaaggcccc

SEQ ID NO: 3001544 - RNA, 20 nt, Human
gaccagggauuuccaugaug

SEQ ID NO: 3001545 - RNA, 18 nt, Human
gaccagggauuuccauga

SEQ ID NO: 3001546 - RNA, 16 nt, Human
gacacagcucuucucc

SEQ ID NO: 3001547 - RNA, 14 nt, Human
gacacagcucuucu

SEQ ID NO: 3001548 - RNA, 13 nt, Human
gacacagcucuuc

SEQ ID NO: 3001549 - RNA, 16 nt, Human
gacacacugaagaagc

SEQ ID NO: 3001550 - RNA, 15 nt, Human
gacacacugaagaag

SEQ ID NO: 3001551 - RNA, 14 nt, Human
gacacacugaagaa

SEQ ID NO: 3001552 - RNA, 23 nt, Human
gacacagcucuucuccaggcugu

SEQ ID NO: 3001553 - RNA, 22 nt, Human
gacacagcucuucuccaggcug

SEQ ID NO: 3001554 - RNA, 21 nt, Human
gacagaaagcagaacagugau

SEQ ID NO: 3001555 - RNA, 17 nt, Human
gacagcccgggcucugc

SEQ ID NO: 3001556 - RNA, 16 nt, Human
gaaguucuauuuauuu

SEQ ID NO: 3001557 - RNA, 16 nt, Human
gaaguucuaguguuuu

SEQ ID NO: 3001558 - RNA, 15 nt, Human
gaaguucuaguguuu

SEQ ID NO: 3001559 - RNA, 22 nt, Human
gaaggggagauaaggguaucug

SEQ ID NO: 3001560 - RNA, 19 nt, Human
gaauauugcugauggugca

SEQ ID NO: 3001561 - RNA, 20 nt, Human
gaauauugcugauggugcaa

SEQ ID NO: 3001562 - RNA, 14 nt, Human
gaauauugcugaug

SEQ ID NO: 3001563 - RNA, 15 nt, Human
gaauauugcugaugg

SEQ ID NO: 3001564 - RNA, 20 nt, Human
gaaggcuggguucugauccu

SEQ ID NO: 3001565 - RNA, 22 nt, Human
gaaggcuggguucugauccuag

SEQ ID NO: 3001566 - RNA, 15 nt, Human
gaaggcuggguucug

SEQ ID NO: 3001567 - RNA, 19 nt, Human
gaaggcuggguucugaucc

SEQ ID NO: 3001568 - RNA, 19 nt, Human
gaaggcucgagcaugccug

SEQ ID NO: 3001569 - RNA, 18 nt, Human
gaaggccccgcccaggcu

SEQ ID NO: 3001570 - RNA, 19 nt, Human
gaaggccccgcccaggcuu

SEQ ID NO: 3001571 - RNA, 21 nt, Human
gaaggcucgagcaugccugga

SEQ ID NO: 3001572 - RNA, 17 nt, Human
gaaggccccgcccaggc

SEQ ID NO: 3001573 - RNA, 22 nt, Human
gaagcuccgcuuucuacccagc

SEQ ID NO: 3001574 - RNA, 19 nt, Human
gaagcuccgcuuucuaccc

SEQ ID NO: 3001575 - RNA, 12 nt, Human
gaagcagagugg

SEQ ID NO: 3001576 - RNA, 11 nt, Human
gaagcagagug

SEQ ID NO: 3001577 - RNA, 23 nt, Human
gaagcagaccauuggggcuccca

SEQ ID NO: 3001578 - RNA, 15 nt, Human
gaagcagaggaagga

SEQ ID NO: 3001579 - RNA, 14 nt, Human
gaagcacaugccuc

SEQ ID NO: 3001580 - RNA, 14 nt, Human
gaagcaaaauuuuu

SEQ ID NO: 3001581 - RNA, 23 nt, Human
gaagauuuugaaauuuuuauuaa

SEQ ID NO: 3001582 - RNA, 23 nt, Human
gaagacaaugugaaaagaaaaau

SEQ ID NO: 3001583 - RNA, 22 nt, Human
gaagacaaugacuuacuguaca

SEQ ID NO: 3001584 - RNA, 16 nt, Human
gaagacaaugacuuac

SEQ ID NO: 3001585 - RNA, 23 nt, Human
gaagcaacccaaauguucaucaa

SEQ ID NO: 3001586 - RNA, 17 nt, Human
gaagcacaugccucucu

SEQ ID NO: 3001587 - RNA, 20 nt, Human
gaagcacaugccucucucag

SEQ ID NO: 3001588 - RNA, 15 nt, Human
gaagcacaugccucu

SEQ ID NO: 3001589 - RNA, 12 nt, Human
gaacuggcugca

SEQ ID NO: 3001590 - RNA, 11 nt, Human
gaacuggcugc

SEQ ID NO: 3001591 - RNA, 13 nt, Human
gaacugaaaucau

SEQ ID NO: 3001592 - RNA, 14 nt, Human
gaacugaaaucaua

SEQ ID NO: 3001593 - RNA, 15 nt, Human
gaacuccuggccuca

SEQ ID NO: 3001594 - RNA, 22 nt, Human
gaaccgagggggcugcucccac

SEQ ID NO: 3001595 - RNA, 21 nt, Human
gaaccgagggggcugcuccca

SEQ ID NO: 3001596 - RNA, 20 nt, Human
gaaccgagggggcugcuccc

SEQ ID NO: 3001597 - RNA, 19 nt, Human
gaacccgggaggcagaggu

SEQ ID NO: 3001598 - RNA, 13 nt, Human
gcacaucauuuca

SEQ ID NO: 3001599 - RNA, 14 nt, Human
gcaccgggccacag

SEQ ID NO: 3001600 - RNA, 23 nt, Human
gcacaucagcacgauuucuguuu

SEQ ID NO: 3001601 - RNA, 22 nt, Human
gcacaucagcacgauuucuguu

SEQ ID NO: 3001602 - RNA, 23 nt, Human
gcaccgggccacagagaaaguac

SEQ ID NO: 3001603 - RNA, 17 nt, Human
gcacuccccugcugggu

SEQ ID NO: 3001604 - RNA, 16 nt, Human
gcacucagaagacacu

SEQ ID NO: 3001605 - RNA, 13 nt, Human
gcacucagaagac

SEQ ID NO: 3001606 - RNA, 22 nt, Human
gcacuccccugcuggguguggc

SEQ ID NO: 3001607 - RNA, 16 nt, Human
gcacuccccugcuggg

SEQ ID NO: 3001608 - RNA, 22 nt, Human
gcacaagcugcacccucaggca

SEQ ID NO: 3001609 - RNA, 14 nt, Human
gcacaccgggcacu

SEQ ID NO: 3001610 - RNA, 14 nt, Human
gcacacauuuuuua

SEQ ID NO: 3001611 - RNA, 20 nt, Human
gcacaguuuucugagaaaga

SEQ ID NO: 3001612 - RNA, 22 nt, Human
gcacaguuuucugagaaagacu

SEQ ID NO: 3001613 - RNA, 23 nt, Human
gcacaguuuucugagaaagacua

SEQ ID NO: 3001614 - RNA, 19 nt, Human
gcaagugagagcugggugu

SEQ ID NO: 3001615 - RNA, 22 nt, Human
gcaauagucaaauugugugaaa

SEQ ID NO: 3001616 - RNA, 20 nt, Human
gcaaguauuagaauaccaca

SEQ ID NO: 3001617 - RNA, 20 nt, Human
gauguaugcacacacauaua

SEQ ID NO: 3001618 - RNA, 12 nt, Human
gauuauuggaaa

SEQ ID NO: 3001619 - RNA, 18 nt, Human
gauucuuccucccucccu

SEQ ID NO: 3001620 - RNA, 17 nt, Human
gauucuuccucccuccc

SEQ ID NO: 3001621 - RNA, 15 nt, Human
gauuuaccacuugug

SEQ ID NO: 3001622 - RNA, 16 nt, Human
gauuuaccacuugugu

SEQ ID NO: 3001623 - RNA, 17 nt, Human
gauucuccugccucagc

SEQ ID NO: 3001624 - RNA, 15 nt, Human
gauucuccugccuca

SEQ ID NO: 3001625 - RNA, 18 nt, Human
gauucuccugccucagcc

SEQ ID NO: 3001626 - RNA, 18 nt, Human
gauguagaggagaaacug

SEQ ID NO: 3001627 - RNA, 17 nt, Human
gauguagaggagaaacu

SEQ ID NO: 3001628 - RNA, 22 nt, Human
gaugguucccuugaugaagaag

SEQ ID NO: 3001629 - RNA, 16 nt, Human
gaugagugagcaugcc

SEQ ID NO: 3001630 - RNA, 21 nt, Human
gaugaucuaggaagacuuugg

SEQ ID NO: 3001631 - RNA, 16 nt, Human
gaugaucuuuaaaaua

SEQ ID NO: 3001632 - RNA, 15 nt, Human
gaugaucuaggaaga

SEQ ID NO: 3001633 - RNA, 11 nt, Human
gaguggaguua

SEQ ID NO: 3001634 - RNA, 20 nt, Human
gagugacagaggcagcccca

SEQ ID NO: 3001635 - RNA, 17 nt, Human
gaguggaguuacugaac

SEQ ID NO: 3001636 - RNA, 22 nt, Human
gaguugauagcacagacccugc

SEQ ID NO: 3001637 - RNA, 15 nt, Human
gaguugauucagcuc

SEQ ID NO: 3001638 - RNA, 16 nt, Human
gaguugauucagcucu

SEQ ID NO: 3001639 - RNA, 17 nt, Human
gaguugauucagcucug

SEQ ID NO: 3001640 - RNA, 17 nt, Human
gagucaccaagcccagu

SEQ ID NO: 3001641 - RNA, 16 nt, Human
gagucaccaagcccag

SEQ ID NO: 3001642 - RNA, 15 nt, Human
gagucaccaagccca

SEQ ID NO: 3001643 - RNA, 22 nt, Human
gagucagaaguuucugccgcag

SEQ ID NO: 3001644 - RNA, 18 nt, Human
gagugacagaggcagccc

SEQ ID NO: 3001645 - RNA, 12 nt, Human
gagucccaccuu

SEQ ID NO: 3001646 - RNA, 15 nt, Human
gaggucgaggcagga

SEQ ID NO: 3001647 - RNA, 23 nt, Human
gaggugaccccagguuucuaugu

SEQ ID NO: 3001648 - RNA, 22 nt, Human
gaguuguuacauuuuuaagugc

SEQ ID NO: 3001649 - RNA, 18 nt, Human
gaguugauucagcucugc

SEQ ID NO: 3001650 - RNA, 23 nt, Human
gaggcuccacuuggucugugaga

SEQ ID NO: 3001651 - RNA, 18 nt, Human
gaggcugaggcaggagac

SEQ ID NO: 3001652 - RNA, 16 nt, Human
gaggcugaggcaggag

SEQ ID NO: 3001653 - RNA, 18 nt, Human
gaggcuccacuuggucug

SEQ ID NO: 3001654 - RNA, 19 nt, Human
gaggcuccacuuggucugu

SEQ ID NO: 3001655 - RNA, 13 nt, Human
gaggccagagaca

SEQ ID NO: 3001656 - RNA, 14 nt, Human
gaggccagagacac

SEQ ID NO: 3001657 - RNA, 19 nt, Human
gaggccagagacacaagcc

SEQ ID NO: 3001658 - RNA, 22 nt, Human
gaggcuagugugguguuuccug

SEQ ID NO: 3001659 - RNA, 15 nt, Human
gaggacgcucucugg

SEQ ID NO: 3001660 - RNA, 14 nt, Human
gaggcagggucuca

SEQ ID NO: 3001661 - RNA, 17 nt, Human
gaggccaaggugggagg

SEQ ID NO: 3001662 - RNA, 22 nt, Human
gaggccaaggugggaggauugc

SEQ ID NO: 3001663 - RNA, 22 nt, Human
gaggcagggucucacucugucg

SEQ ID NO: 3001664 - RNA, 15 nt, Human
gaggcagggucucac

SEQ ID NO: 3001665 - RNA, 13 nt, Human
gagccuugaacuu

SEQ ID NO: 3001666 - RNA, 23 nt, Human
gagccuuccaggggugggacacc

SEQ ID NO: 3001667 - RNA, 20 nt, Human
gagccuuccaggggugggac

SEQ ID NO: 3001668 - RNA, 16 nt, Human
gcuguacauacuuuuu

SEQ ID NO: 3001669 - RNA, 15 nt, Human
gcuguacauacuuuu

SEQ ID NO: 3001670 - RNA, 14 nt, Human
gcuguacauacuuu

SEQ ID NO: 3001671 - RNA, 13 nt, Human
gcuguacauacuu

SEQ ID NO: 3001672 - RNA, 17 nt, Human
gcuguacauacuuuuug

SEQ ID NO: 3001673 - RNA, 19 nt, Human
gcuguaucccaugagccuc

SEQ ID NO: 3001674 - RNA, 23 nt, Human
gcuguaucccaugagccucagca

SEQ ID NO: 3001675 - RNA, 20 nt, Human
gcuguaucccaugagccuca

SEQ ID NO: 3001676 - RNA, 15 nt, Human
gcuggguucuaccca

SEQ ID NO: 3001677 - RNA, 15 nt, Human
gcuggguucugaucc

SEQ ID NO: 3001678 - RNA, 21 nt, Human
gcuggguuggaggguguccca

SEQ ID NO: 3001679 - RNA, 14 nt, Human
gcuggguuggaggg

SEQ ID NO: 3001680 - RNA, 19 nt, Human
gcugugcugcccugcccac

SEQ ID NO: 3001681 - RNA, 22 nt, Human
gcugugcugcccugcccaccug

SEQ ID NO: 3001682 - RNA, 22 nt, Human
gcuguuggcugggggccucagu

SEQ ID NO: 3001683 - RNA, 21 nt, Human
gcuguuggcugggggccucag

SEQ ID NO: 3001684 - RNA, 12 nt, Human
gcugugcugccc

SEQ ID NO: 3001685 - RNA, 21 nt, Human
gcugugcucuggacaggcaug

SEQ ID NO: 3001686 - RNA, 13 nt, Human
gcugugcugcccu

SEQ ID NO: 3001687 - RNA, 18 nt, Human
gcugugcucuggacaggc

SEQ ID NO: 3001688 - RNA, 22 nt, Human
gcuucaaggauccugagccaga

SEQ ID NO: 3001689 - RNA, 19 nt, Human
gcuucacggaagagccuug

SEQ ID NO: 3001690 - RNA, 20 nt, Human
gcuucacggaagagccuugc

SEQ ID NO: 3001691 - RNA, 16 nt, Human
gcuuguacauaaugcg

SEQ ID NO: 3001692 - RNA, 14 nt, Human
gcuuguacauaaug

SEQ ID NO: 3001693 - RNA, 16 nt, Human
gcugcugauuuaaaca

SEQ ID NO: 3001694 - RNA, 13 nt, Human
gcugcugccccug

SEQ ID NO: 3001695 - RNA, 23 nt, Human
gcugcugccccugcacagcaggc

SEQ ID NO: 3001696 - RNA, 15 nt, Human
gcugcugccccugca

SEQ ID NO: 3001697 - RNA, 14 nt, Human
gcugcugccccugc

SEQ ID NO: 3001698 - RNA, 22 nt, Human
gcugcuccuaggacccgucucc

SEQ ID NO: 3001699 - RNA, 19 nt, Human
gcugccugggaucccucau

SEQ ID NO: 3001700 - RNA, 16 nt, Human
gcugccugggaucccu

SEQ ID NO: 3001701 - RNA, 18 nt, Human
gcugccugggaucccuca

SEQ ID NO: 3001702 - RNA, 22 nt, Human
gcugccuccccuccucugcuug

SEQ ID NO: 3001703 - RNA, 21 nt, Human
gcugccuccccuccucugcuu

SEQ ID NO: 3001704 - RNA, 20 nt, Human
gcugccuccccuccucugcu

SEQ ID NO: 3001705 - RNA, 17 nt, Human
gcugccuccccuccucu

SEQ ID NO: 3001706 - RNA, 16 nt, Human
gcugccuccccuccuc

SEQ ID NO: 3001707 - RNA, 14 nt, Human
gcugccuccccucc

SEQ ID NO: 3001708 - RNA, 13 nt, Human
gcugccugggauc

SEQ ID NO: 3001709 - RNA, 19 nt, Human
gcugccagccgagauagcc

SEQ ID NO: 3001710 - RNA, 21 nt, Human
gcugccagccgagauagccaa

SEQ ID NO: 3001711 - RNA, 23 nt, Human
gcugccauccagguucagcuugu

SEQ ID NO: 3001712 - RNA, 21 nt, Human
gcugccauccagguucagcuu

SEQ ID NO: 3001713 - RNA, 14 nt, Human
gcugcaccggcugg

SEQ ID NO: 3001714 - RNA, 16 nt, Human
gcugcaccggcuggcc

SEQ ID NO: 3001715 - RNA, 17 nt, Human
gcugcaccggcuggccu

SEQ ID NO: 3001716 - RNA, 18 nt, Human
gcugcaccggcuggccug

SEQ ID NO: 3001717 - RNA, 19 nt, Human
gcugcaccggcuggccugg

SEQ ID NO: 3001718 - RNA, 22 nt, Human
gcugcaccggcuggccuggccc

SEQ ID NO: 3001719 - RNA, 18 nt, Human
gcuggccuggccccucag

SEQ ID NO: 3001720 - RNA, 19 nt, Human
gcuggccuggccccucagg

SEQ ID NO: 3001721 - RNA, 16 nt, Human
gcugggauuacaggug

SEQ ID NO: 3001722 - RNA, 16 nt, Human
gcuggccuggccccuc

SEQ ID NO: 3001723 - RNA, 17 nt, Human
gcuggccuggccccuca

SEQ ID NO: 3001724 - RNA, 15 nt, Human
gcuggagugcaguga

SEQ ID NO: 3001725 - RNA, 14 nt, Human
gcuggagugcagug

SEQ ID NO: 3001726 - RNA, 14 nt, Human
gcugggcagaggaa

SEQ ID NO: 3001727 - RNA, 15 nt, Human
gcugggcagaggaaa

SEQ ID NO: 3001728 - RNA, 13 nt, Human
gcugggcagagga

SEQ ID NO: 3001729 - RNA, 18 nt, Human
gcugggauuacaggugug

SEQ ID NO: 3001730 - RNA, 19 nt, Human
gcugggauuacagguguga

SEQ ID NO: 3001731 - RNA, 19 nt, Human
gcugggcagaggaaagcaa

SEQ ID NO: 3001732 - RNA, 16 nt, Human
gcugggcagaggaaag

SEQ ID NO: 3001733 - RNA, 17 nt, Human
gcugggcagaggaaagc

SEQ ID NO: 3001734 - RNA, 12 nt, Human
gcugggcucccu

SEQ ID NO: 3001735 - RNA, 16 nt, Human
gcugggcucccuuccc

SEQ ID NO: 3001736 - RNA, 17 nt, Human
gcugggcucccuuccca

SEQ ID NO: 3001737 - RNA, 20 nt, Human
gcugggcucccuucccaccu

SEQ ID NO: 3001738 - RNA, 15 nt, Human
gcuggguguggcgca

SEQ ID NO: 3001739 - RNA, 14 nt, Human
gcuggagcucugcc

SEQ ID NO: 3001740 - RNA, 17 nt, Human
gcuggagcucugcccau

SEQ ID NO: 3001741 - RNA, 12 nt, Human
gcuggagugcag

SEQ ID NO: 3001742 - RNA, 21 nt, Human
gcuaguaauuggaaaggcagc

SEQ ID NO: 3001743 - RNA, 16 nt, Human
gcuaguaucaaaagaa

SEQ ID NO: 3001744 - RNA, 15 nt, Human
gcuaggccuggccag

SEQ ID NO: 3001745 - RNA, 14 nt, Human
gcuaggccuggcca

SEQ ID NO: 3001746 - RNA, 22 nt, Human
gcuaggaccccuccaugugggc

SEQ ID NO: 3001747 - RNA, 19 nt, Human
gcuaggaacacuccuucac

SEQ ID NO: 3001748 - RNA, 21 nt, Human
gcuaggaacacuccuucacag

SEQ ID NO: 3001749 - RNA, 18 nt, Human
gcuaggaacacuccuuca

SEQ ID NO: 3001750 - RNA, 16 nt, Human
gcuaggaacacuccuu

SEQ ID NO: 3001751 - RNA, 19 nt, Human
gccuguucagcuccagcuc

SEQ ID NO: 3001752 - RNA, 20 nt, Human
gccuguucagcuccagcuca

SEQ ID NO: 3001753 - RNA, 22 nt, Human
gcucagagagggugggaguggg

SEQ ID NO: 3001754 - RNA, 18 nt, Human
gcucagagagggugggag

SEQ ID NO: 3001755 - RNA, 20 nt, Human
gcucagagagggugggagug

SEQ ID NO: 3001756 - RNA, 15 nt, Human
gcucagagagggugg

SEQ ID NO: 3001757 - RNA, 13 nt, Human
gcucagggccugg

SEQ ID NO: 3001758 - RNA, 16 nt, Human
gcucagggccuggcuc

SEQ ID NO: 3001759 - RNA, 12 nt, Human
gcucagggccug

SEQ ID NO: 3001760 - RNA, 21 nt, Human
gcucagguggggucacucugg

SEQ ID NO: 3001761 - RNA, 22 nt, Human
gcucagguggggucacucuggc

SEQ ID NO: 3001762 - RNA, 15 nt, Human
gcuccccucggagaa

SEQ ID NO: 3001763 - RNA, 20 nt, Human
gcucccaggcauuccccagg

SEQ ID NO: 3001764 - RNA, 21 nt, Human
gcucccaggcauuccccagga

SEQ ID NO: 3001765 - RNA, 14 nt, Human
gcuccccagcccca

SEQ ID NO: 3001766 - RNA, 22 nt, Human
gcucccaggcauuccccaggag

SEQ ID NO: 3001767 - RNA, 17 nt, Human
gcucccaggcauucccc

SEQ ID NO: 3001768 - RNA, 13 nt, Human
gcucucaggccag

SEQ ID NO: 3001769 - RNA, 14 nt, Human
gcucucaggccagc

SEQ ID NO: 3001770 - RNA, 15 nt, Human
gcucucaggccagcu

SEQ ID NO: 3001771 - RNA, 16 nt, Human
gcucucaggccagcug

SEQ ID NO: 3001772 - RNA, 16 nt, Human
gcucuguccugggagu

SEQ ID NO: 3001773 - RNA, 14 nt, Human
gcucuguccuggga

SEQ ID NO: 3001774 - RNA, 15 nt, Human
gcucuguccugggag

SEQ ID NO: 3001775 - RNA, 15 nt, Human
gcucuuccaggcugg

SEQ ID NO: 3001776 - RNA, 16 nt, Human
gcucuuccaggcuggg

SEQ ID NO: 3001777 - RNA, 12 nt, Human
gcucuuccaggc

SEQ ID NO: 3001778 - RNA, 22 nt, Human
gcugaauacagaggcaacugca

SEQ ID NO: 3001779 - RNA, 17 nt, Human
gcugaaugguuuucaaa

SEQ ID NO: 3001780 - RNA, 12 nt, Human
gcugaaggcucg

SEQ ID NO: 3001781 - RNA, 20 nt, Human
gcugaaggcucgagcaugcc

SEQ ID NO: 3001782 - RNA, 16 nt, Human
gcugacagacacaggc

SEQ ID NO: 3001783 - RNA, 15 nt, Human
gcugacagacacagg

SEQ ID NO: 3001784 - RNA, 14 nt, Human
gcugacagacacag

SEQ ID NO: 3001785 - RNA, 23 nt, Human
gccagaagucaaggcuuagaccc

SEQ ID NO: 3001786 - RNA, 22 nt, Human
gccagacaucaacagauaaaua

SEQ ID NO: 3001787 - RNA, 16 nt, Human
gccagaagucaaggcu

SEQ ID NO: 3001788 - RNA, 20 nt, Human
gccagaagucaaggcuuaga

SEQ ID NO: 3001789 - RNA, 22 nt, Human
gccagaagucaaggcuuagacc

SEQ ID NO: 3001790 - RNA, 19 nt, Human
gccagauuuuccugaaaac

SEQ ID NO: 3001791 - RNA, 17 nt, Human
gccagcaggcucucagg

SEQ ID NO: 3001792 - RNA, 18 nt, Human
gccagcaggcucucaggc

SEQ ID NO: 3001793 - RNA, 19 nt, Human
gccagcaggcucucaggcc

SEQ ID NO: 3001794 - RNA, 20 nt, Human
gccagcaggcucucaggcca

SEQ ID NO: 3001795 - RNA, 21 nt, Human
gccagcaggcucucaggccag

SEQ ID NO: 3001796 - RNA, 23 nt, Human
gccagcaggcucucaggccagcu

SEQ ID NO: 3001797 - RNA, 21 nt, Human
gccagcaguucagagcugccc

SEQ ID NO: 3001798 - RNA, 23 nt, Human
gccagcaguucagagcugcccuc

SEQ ID NO: 3001799 - RNA, 22 nt, Human
gccagcaguucagagcugcccu

SEQ ID NO: 3001800 - RNA, 13 nt, Human
gccagcaggcucu

SEQ ID NO: 3001801 - RNA, 16 nt, Human
gccagcaggcucucag

SEQ ID NO: 3001802 - RNA, 12 nt, Human
gccaggccagag

SEQ ID NO: 3001803 - RNA, 23 nt, Human
gccaggccacaagacccuugugg

SEQ ID NO: 3001804 - RNA, 19 nt, Human
gccaggcccucugcccacu

SEQ ID NO: 3001805 - RNA, 20 nt, Human
gccaggcccucugcccacuc

SEQ ID NO: 3001806 - RNA, 21 nt, Human
gccaggcccucugcccacucc

SEQ ID NO: 3001807 - RNA, 21 nt, Human
gccaggcccuugucggcccca

SEQ ID NO: 3001808 - RNA, 16 nt, Human
gccaggcccucugccc

SEQ ID NO: 3001809 - RNA, 17 nt, Human
gccaggcccucugccca

SEQ ID NO: 3001810 - RNA, 15 nt, Human
gccaggcccucugcc

SEQ ID NO: 3001811 - RNA, 13 nt, Human
gccaggccagagg

SEQ ID NO: 3001812 - RNA, 24 nt, Human
gccauguuggccaggcuggucuca

SEQ ID NO: 3001813 - RNA, 22 nt, Human
gccauguuggccaggcuggucu

SEQ ID NO: 3001814 - RNA, 20 nt, Human
gccauguuggccaggcuggu

SEQ ID NO: 3001815 - RNA, 19 nt, Human
gccauguuggccaggcugg

SEQ ID NO: 3001816 - RNA, 13 nt, Human
gcccacgccccca

SEQ ID NO: 3001817 - RNA, 14 nt, Human
gcccacgcccccac

SEQ ID NO: 3001818 - RNA, 18 nt, Human
gcccaccuuggcucaagu

SEQ ID NO: 3001819 - RNA, 17 nt, Human
gcccaccuuggcucaag

SEQ ID NO: 3001820 - RNA, 17 nt, Human
gcccacgcuggagugca

SEQ ID NO: 3001821 - RNA, 16 nt, Human
gcccacgcuggagugc

SEQ ID NO: 3001822 - RNA, 15 nt, Human
gcccacgcuggagug

SEQ ID NO: 3001823 - RNA, 18 nt, Human
gccauguuggccaggcug

SEQ ID NO: 3001824 - RNA, 17 nt, Human
gccauguuggccaggcu

SEQ ID NO: 3001825 - RNA, 16 nt, Human
gccauguuggccaggc

SEQ ID NO: 3001826 - RNA, 15 nt, Human
gccauguuggccagg

SEQ ID NO: 3001827 - RNA, 14 nt, Human
gccauguuggccag

SEQ ID NO: 3001828 - RNA, 16 nt, Human
gccaugucagacacag

SEQ ID NO: 3001829 - RNA, 14 nt, Human
gccaugucagacac

SEQ ID NO: 3001830 - RNA, 15 nt, Human
gccaugucagacaca

SEQ ID NO: 3001831 - RNA, 20 nt, Human
gccauauucuguuggccagu

SEQ ID NO: 3001832 - RNA, 19 nt, Human
gccauauucuguuggccag

SEQ ID NO: 3001833 - RNA, 16 nt, Human
gccauaugaaaaggcu

SEQ ID NO: 3001834 - RNA, 14 nt, Human
gccacuuuauuucu

SEQ ID NO: 3001835 - RNA, 20 nt, Human
gccagaaaccuuccugcuga

SEQ ID NO: 3001836 - RNA, 18 nt, Human
gccacugugaagagaacc

SEQ ID NO: 3001837 - RNA, 19 nt, Human
gccacugugaagagaacca

SEQ ID NO: 3001838 - RNA, 19 nt, Human
gccacugugcuccagccug

SEQ ID NO: 3001839 - RNA, 23 nt, Human
gccacugcaccgggccacagaga

SEQ ID NO: 3001840 - RNA, 19 nt, Human
gccacccuggggagaaagu

SEQ ID NO: 3001841 - RNA, 13 nt, Human
gccacccugggga

SEQ ID NO: 3001842 - RNA, 21 nt, Human
gccacugcacuauagccuagg

SEQ ID NO: 3001843 - RNA, 22 nt, Human
gccacugcaccgggccacagag

SEQ ID NO: 3001844 - RNA, 22 nt, Human
gccaccaacauacucccaucug

SEQ ID NO: 3001845 - RNA, 20 nt, Human
gccaccaacauacucccauc

SEQ ID NO: 3001846 - RNA, 21 nt, Human
gccaccaacauacucccaucu

SEQ ID NO: 3001847 - RNA, 19 nt, Human
gccaccaacauacucccau

SEQ ID NO: 3001848 - RNA, 16 nt, Human
gccacauuccugaugc

SEQ ID NO: 3001849 - RNA, 20 nt, Human
gccacauuccugaugcuucu

SEQ ID NO: 3001850 - RNA, 15 nt, Human
gccuaccaauauuua

SEQ ID NO: 3001851 - RNA, 12 nt, Human
gccucuucucua

SEQ ID NO: 3001852 - RNA, 23 nt, Human
gccucuucucuacucuagggaaa

SEQ ID NO: 3001853 - RNA, 19 nt, Human
gccugcccaggccccugcc

SEQ ID NO: 3001854 - RNA, 18 nt, Human
gccugcccaggccccugc

SEQ ID NO: 3001855 - RNA, 17 nt, Human
gccugcccaggccccug

SEQ ID NO: 3001856 - RNA, 12 nt, Human
gccucugggacu

SEQ ID NO: 3001857 - RNA, 18 nt, Human
gccuccugcccuuaccug

SEQ ID NO: 3001858 - RNA, 13 nt, Human
gccuccuccagcc

SEQ ID NO: 3001859 - RNA, 16 nt, Human
gccugccucuucucua

SEQ ID NO: 3001860 - RNA, 18 nt, Human
gccugggaucccucaucc

SEQ ID NO: 3001861 - RNA, 22 nt, Human
gccugggaggucaaggcugcag

SEQ ID NO: 3001862 - RNA, 14 nt, Human
gccugggaucccuc

SEQ ID NO: 3001863 - RNA, 21 nt, Human
gccugggaggucaaggcugca

SEQ ID NO: 3001864 - RNA, 20 nt, Human
gccuggccccucaggguccc

SEQ ID NO: 3001865 - RNA, 22 nt, Human
gccuggccccucagggucccug

SEQ ID NO: 3001866 - RNA, 10 nt, Human
gccuggccug

SEQ ID NO: 3001867 - RNA, 15 nt, Human
gccuggccccucagg

SEQ ID NO: 3001868 - RNA, 16 nt, Human
gccuggccccucaggg

SEQ ID NO: 3001869 - RNA, 17 nt, Human
gccuggccccucagggu

SEQ ID NO: 3001870 - RNA, 19 nt, Human
gccccaaaacucuccucug

SEQ ID NO: 3001871 - RNA, 16 nt, Human
gcccccaggugccagu

SEQ ID NO: 3001872 - RNA, 18 nt, Human
gccccaaaacucuccucu

SEQ ID NO: 3001873 - RNA, 14 nt, Human
gccccugcccggcu

SEQ ID NO: 3001874 - RNA, 13 nt, Human
gccccugcccggc

SEQ ID NO: 3001875 - RNA, 16 nt, Human
gccccuggaugcagcc

SEQ ID NO: 3001876 - RNA, 18 nt, Human
gccccuggaugcagccuc

SEQ ID NO: 3001877 - RNA, 22 nt, Human
gccccuggaugcagccucacag

SEQ ID NO: 3001878 - RNA, 22 nt, Human
gcccuaaaguguauuuuuuuac

SEQ ID NO: 3001879 - RNA, 14 nt, Human
gcccacucccugca

SEQ ID NO: 3001880 - RNA, 15 nt, Human
gcccacucccugcaa

SEQ ID NO: 3001881 - RNA, 19 nt, Human
gcccacucccugcaaccug

SEQ ID NO: 3001882 - RNA, 13 nt, Human
gcccacucccugc

SEQ ID NO: 3001883 - RNA, 13 nt, Human
gcccuguuaaaag

SEQ ID NO: 3001884 - RNA, 14 nt, Human
gcccuguuaaaaga

SEQ ID NO: 3001885 - RNA, 17 nt, Human
gcccuguuaaaagauga

SEQ ID NO: 3001886 - RNA, 21 nt, Human
gcccugugggcccccaaaugg

SEQ ID NO: 3001887 - RNA, 14 nt, Human
gcccugccuccuuu

SEQ ID NO: 3001888 - RNA, 16 nt, Human
gcccugccuccuuugu

SEQ ID NO: 3001889 - RNA, 22 nt, Human
gcccugccuccuuugugaggaa

SEQ ID NO: 3001890 - RNA, 15 nt, Human
gccgccaugcuccug

SEQ ID NO: 3001891 - RNA, 16 nt, Human
gcccuuaccugccagg

SEQ ID NO: 3001892 - RNA, 20 nt, Human
gcccuuaccugccaggaagc

SEQ ID NO: 3001893 - RNA, 16 nt, Human
gccgccaugcuccugg

SEQ ID NO: 3001894 - RNA, 13 nt, Human
gccgcccaaggcc

SEQ ID NO: 3001895 - RNA, 22 nt, Human
ggcccaggaguuuggccagaag

SEQ ID NO: 3001896 - RNA, 23 nt, Human
ggcccaggaguuuggccagaagu

SEQ ID NO: 3001897 - RNA, 15 nt, Human
ggcccagggcaucug

SEQ ID NO: 3001898 - RNA, 12 nt, Human
ggcccagggcau

SEQ ID NO: 3001899 - RNA, 21 nt, Human
ggcccaggaguuuggccagaa

SEQ ID NO: 3001900 - RNA, 15 nt, Human
ggcccuccagagccc

SEQ ID NO: 3001901 - RNA, 14 nt, Human
ggcccuccagagcc

SEQ ID NO: 3001902 - RNA, 21 nt, Human
ggcccuccagagccccacagc

SEQ ID NO: 3001903 - RNA, 17 nt, Human
ggcccuccagagcccca

SEQ ID NO: 3001904 - RNA, 23 nt, Human
ggcccuccagagccccacagccc

SEQ ID NO: 3001905 - RNA, 16 nt, Human
ggcccagggcaucugg

SEQ ID NO: 3001906 - RNA, 15 nt, Human
ggccccaccagugcc

SEQ ID NO: 3001907 - RNA, 16 nt, Human
ggccccaccagugccu

SEQ ID NO: 3001908 - RNA, 13 nt, Human
ggccucccaacuc

SEQ ID NO: 3001909 - RNA, 14 nt, Human
ggccucccaacuca

SEQ ID NO: 3001910 - RNA, 16 nt, Human
ggccuccauccugagg

SEQ ID NO: 3001911 - RNA, 20 nt, Human
ggccagaugcaccagcccuu

SEQ ID NO: 3001912 - RNA, 19 nt, Human
ggccagaugcaccagcccu

SEQ ID NO: 3001913 - RNA, 17 nt, Human
ggccagaugcaccagcc

SEQ ID NO: 3001914 - RNA, 23 nt, Human
ggccagagggagugacagaggca

SEQ ID NO: 3001915 - RNA, 22 nt, Human
ggccagagggagugacagaggc

SEQ ID NO: 3001916 - RNA, 13 nt, Human
ggccaagguggga

SEQ ID NO: 3001917 - RNA, 12 nt, Human
ggcauuguggga

SEQ ID NO: 3001918 - RNA, 21 nt, Human
ggccaaacucaccugccccuc

SEQ ID NO: 3001919 - RNA, 12 nt, Human
ggccaaaggaag

SEQ ID NO: 3001920 - RNA, 15 nt, Human
ggccaaagccaaagc

SEQ ID NO: 3001921 - RNA, 21 nt, Human
ggccaaaggaagcacaugccu

SEQ ID NO: 3001922 - RNA, 12 nt, Human
ggauuuucagcc

SEQ ID NO: 3001923 - RNA, 21 nt, Human
ggauuuugauccaagcugguc

SEQ ID NO: 3001924 - RNA, 23 nt, Human
ggauuaaacuuaaucuaaaugga

SEQ ID NO: 3001925 - RNA, 18 nt, Human
ggcaaacagggccucugc

SEQ ID NO: 3001926 - RNA, 17 nt, Human
ggcaaacagggccucug

SEQ ID NO: 3001927 - RNA, 14 nt, Human
ggcaaacagggccu

SEQ ID NO: 3001928 - RNA, 17 nt, Human
ggcaacagagcaagacu

SEQ ID NO: 3001929 - RNA, 16 nt, Human
ggcaacagagcaagac

SEQ ID NO: 3001930 - RNA, 16 nt, Human
ggcaaauguuuauuua

SEQ ID NO: 3001931 - RNA, 22 nt, Human
ggauguugaaaaaguucugcag

SEQ ID NO: 3001932 - RNA, 23 nt, Human
ggaugguucccuugaugaagaag

SEQ ID NO: 3001933 - RNA, 22 nt, Human
ggaugguucccuugaugaagaa

SEQ ID NO: 3001934 - RNA, 22 nt, Human
ggaugagaaagguugaagcacc

SEQ ID NO: 3001935 - RNA, 12 nt, Human
ggaugagaaagg

SEQ ID NO: 3001936 - RNA, 21 nt, Human
ggaugaauuccaaauucugcu

SEQ ID NO: 3001937 - RNA, 20 nt, Human
ggcaacagagcaagacucca

SEQ ID NO: 3001938 - RNA, 14 nt, Human
ggcagccaggccac

SEQ ID NO: 3001939 - RNA, 10 nt, Human
ggcagagcag

SEQ ID NO: 3001940 - RNA, 15 nt, Human
ggcagccaggccaca

SEQ ID NO: 3001941 - RNA, 17 nt, Human
ggcagccaggccacaag

SEQ ID NO: 3001942 - RNA, 12 nt, Human
ggcagaaggaag

SEQ ID NO: 3001943 - RNA, 20 nt, Human
ggacuacaggugugagucac

SEQ ID NO: 3001944 - RNA, 22 nt, Human
ggacucaaugcacugacauugu

SEQ ID NO: 3001945 - RNA, 18 nt, Human
ggacucaaugcacugaca

SEQ ID NO: 3001946 - RNA, 22 nt, Human
ggagaaccaaaaagaggcuaug

SEQ ID NO: 3001947 - RNA, 17 nt, Human
ggacuuggaagcuccgc

SEQ ID NO: 3001948 - RNA, 15 nt, Human
ggacuuggaagcucc

SEQ ID NO: 3001949 - RNA, 19 nt, Human
ggagaaaauggacguguua

SEQ ID NO: 3001950 - RNA, 9 nt, Human
ggacuuugu

SEQ ID NO: 3001951 - RNA, 22 nt, Human
ggagagccuuccagggguggga

SEQ ID NO: 3001952 - RNA, 17 nt, Human
ggagagccuuccagggg

SEQ ID NO: 3001953 - RNA, 18 nt, Human
ggagagccuuccaggggu

SEQ ID NO: 3001954 - RNA, 13 nt, Human
ggagagccuucca

SEQ ID NO: 3001955 - RNA, 16 nt, Human
ggagagccuuccaggg

SEQ ID NO: 3001956 - RNA, 15 nt, Human
ggagagcuagcagca

SEQ ID NO: 3001957 - RNA, 15 nt, Human
ggacccugaggccca

SEQ ID NO: 3001958 - RNA, 18 nt, Human
ggacccugaggcccagag

SEQ ID NO: 3001959 - RNA, 14 nt, Human
ggacccugaggccc

SEQ ID NO: 3001960 - RNA, 19 nt, Human
ggacccugaggcccagagg

SEQ ID NO: 3001961 - RNA, 19 nt, Human
gcuuguacauaaugcgugc

SEQ ID NO: 3001962 - RNA, 22 nt, Human
gcuuguaccacuuuugcaaaua

SEQ ID NO: 3001963 - RNA, 19 nt, Human
gcuuguaccacuuuugcaa

SEQ ID NO: 3001964 - RNA, 16 nt, Human
ggagcugaguggggga

SEQ ID NO: 3001965 - RNA, 22 nt, Human
ggagcugccuguucagcuccag

SEQ ID NO: 3001966 - RNA, 12 nt, Human
ggaggccagccu

SEQ ID NO: 3001967 - RNA, 18 nt, Human
ggaggccaaggugggagg

SEQ ID NO: 3001968 - RNA, 13 nt, Human
ggaggccagccuu

SEQ ID NO: 3001969 - RNA, 21 nt, Human
ggaggcaugugaugagaggaa

SEQ ID NO: 3001970 - RNA, 12 nt, Human
ggaggaagagaa

SEQ ID NO: 3001971 - RNA, 20 nt, Human
ggaggaaccgagggggcugc

SEQ ID NO: 3001972 - RNA, 19 nt, Human
ggaggcugagaugggagaa

SEQ ID NO: 3001973 - RNA, 15 nt, Human
ggaggcugagauggg

SEQ ID NO: 3001974 - RNA, 15 nt, Human
ggaggucgaggcagg

SEQ ID NO: 3001975 - RNA, 16 nt, Human
ggaggucgaggcagga

SEQ ID NO: 3001976 - RNA, 14 nt, Human
ggaggucgaggcag

SEQ ID NO: 3001977 - RNA, 12 nt, Human
ggaggcugaggc

SEQ ID NO: 3001978 - RNA, 18 nt, Human
ggaggucgaggcaggagg

SEQ ID NO: 3001979 - RNA, 13 nt, Human
ggagcagccacau

SEQ ID NO: 3001980 - RNA, 21 nt, Human
ggagcagccacauuccugaug

SEQ ID NO: 3001981 - RNA, 19 nt, Human
aaagaugaaggucuguuuu

SEQ ID NO: 3001982 - RNA, 20 nt, Human
aaagaggcagcuugaaacug

SEQ ID NO: 3001983 - RNA, 13 nt, Human
aaagaggcuaugu

SEQ ID NO: 3001984 - RNA, 18 nt, Human
aaagaggcuaugugagca

SEQ ID NO: 3001985 - RNA, 15 nt, Human
aaagaugagugagca

SEQ ID NO: 3001986 - RNA, 15 nt, Human
aaagacuguacaaag

SEQ ID NO: 3001987 - RNA, 13 nt, Human
aaagacuccaaag

SEQ ID NO: 3001988 - RNA, 23 nt, Human
aaagacuauucaaacagucucag

SEQ ID NO: 3001989 - RNA, 22 nt, Human
aaagacuauucaaacagucuca

SEQ ID NO: 3001990 - RNA, 18 nt, Human
aaagagaacuuccagauc

SEQ ID NO: 3001991 - RNA, 19 nt, Human
aaagacuuuuccaacccuc

SEQ ID NO: 3001992 - RNA, 23 nt, Human
aaagacuucucuacccaucuuaa

SEQ ID NO: 3001993 - RNA, 16 nt, Human
aaagaaugauuaugaa

SEQ ID NO: 3001994 - RNA, 14 nt, Human
aaacuuuaccuuuu

SEQ ID NO: 3001995 - RNA, 12 nt, Human
ggucccacccca

SEQ ID NO: 3001996 - RNA, 22 nt, Human
gguccacccaggagccccgagg

SEQ ID NO: 3001997 - RNA, 20 nt, Human
gguccacccaggagccccga

SEQ ID NO: 3001998 - RNA, 23 nt, Human
gguauuggcuagagguucaaaga

SEQ ID NO: 3001999 - RNA, 19 nt, Human
gguccacccaggagccccg

SEQ ID NO: 3002000 - RNA, 22 nt, Human
aaaggaaugcaaagaugaaggu

SEQ ID NO: 3002001 - RNA, 19 nt, Human
aaaggaaugcaaagaugaa

SEQ ID NO: 3002002 - RNA, 11 nt, Human
aaaggaaagag

SEQ ID NO: 3002003 - RNA, 13 nt, Human
aaaggaauuuaaa

SEQ ID NO: 3002004 - RNA, 13 nt, Human
aaagcuuauuaaa

SEQ ID NO: 3002005 - RNA, 17 nt, Human
aaagcagugcaugcugu

SEQ ID NO: 3002006 - RNA, 21 nt, Human
aaagcagugcaugcugucccu

SEQ ID NO: 3002007 - RNA, 22 nt, Human
aaagcagugcaugcugucccuu

SEQ ID NO: 3002008 - RNA, 16 nt, Human
aaagcagugcaugcug

SEQ ID NO: 3002009 - RNA, 18 nt, Human
aaagcuaggccuggccag

SEQ ID NO: 3002010 - RNA, 17 nt, Human
aaagcuaggccuggcca

SEQ ID NO: 3002011 - RNA, 17 nt, Human
aaagcuacuuauuguag

SEQ ID NO: 3002012 - RNA, 16 nt, Human
aaagcuacuuauugua

SEQ ID NO: 3002013 - RNA, 13 nt, Human
ggucugucuuuua

SEQ ID NO: 3002014 - RNA, 14 nt, Human
ggucugucuuuuaa

SEQ ID NO: 3002015 - RNA, 12 nt, Human
ggucuguucuuu

SEQ ID NO: 3002016 - RNA, 24 nt, Human
ggucugugagaugcuagaacuccc

SEQ ID NO: 3002017 - RNA, 14 nt, Human
ggucugugagaugc

SEQ ID NO: 3002018 - RNA, 19 nt, Human
ggucuguucuuuccaaagu

SEQ ID NO: 3002019 - RNA, 17 nt, Human
ggucuguucuuuccaaa

SEQ ID NO: 3002020 - RNA, 22 nt, Human
ggucuugaacuccuggccucaa

SEQ ID NO: 3002021 - RNA, 21 nt, Human
ggucuugaacuccuggccuca

SEQ ID NO: 3002022 - RNA, 20 nt, Human
ggugauuuagcaggaagcug

SEQ ID NO: 3002023 - RNA, 16 nt, Human
ggugcacaagcuccaa

SEQ ID NO: 3002024 - RNA, 22 nt, Human
ggugcacaagcuccaagcuccc

SEQ ID NO: 3002025 - RNA, 15 nt, Human
ggugccaguuauggc

SEQ ID NO: 3002026 - RNA, 18 nt, Human
aaacaugcuguacauacu

SEQ ID NO: 3002027 - RNA, 16 nt, Human
aaacaugcuguacaua

SEQ ID NO: 3002028 - RNA, 15 nt, Human
aaacaugcuguacau

SEQ ID NO: 3002029 - RNA, 14 nt, Human
aaacauaucucuua

SEQ ID NO: 3002030 - RNA, 19 nt, Human
aaacauauccaaguuugaa

SEQ ID NO: 3002031 - RNA, 22 nt, Human
aaacaugcuacacacugcaugu

SEQ ID NO: 3002032 - RNA, 16 nt, Human
aaacaugcuacacacu

SEQ ID NO: 3002033 - RNA, 21 nt, Human
aaacauauauaacaaugcugu

SEQ ID NO: 3002034 - RNA, 19 nt, Human
aaacauauauaacaaugcu

SEQ ID NO: 3002035 - RNA, 16 nt, Human
aaacauauauaacaau

SEQ ID NO: 3002036 - RNA, 13 nt, Human
aaacauauauaac

SEQ ID NO: 3002037 - RNA, 14 nt, Human
aaacacaacuauau

SEQ ID NO: 3002038 - RNA, 19 nt, Human
aaacaagucagucauucag

SEQ ID NO: 3002039 - RNA, 21 nt, Human
aaacaugcuguacauacuuuu

SEQ ID NO: 3002040 - RNA, 20 nt, Human
aaacaugcuguacauacuuu

SEQ ID NO: 3002041 - RNA, 24 nt, Human
ggggaaaaucagccugcuccagcu

SEQ ID NO: 3002042 - RNA, 22 nt, Human
aaacaugcuguacauacuuuuu

SEQ ID NO: 3002043 - RNA, 13 nt, Human
ggggaccucaggc

SEQ ID NO: 3002044 - RNA, 15 nt, Human
ggggaccucaggccu

SEQ ID NO: 3002045 - RNA, 16 nt, Human
ggggaccucaggccug

SEQ ID NO: 3002046 - RNA, 17 nt, Human
ggggaccucaggccugg

SEQ ID NO: 3002047 - RNA, 17 nt, Human
ggggccaguuggucccc

SEQ ID NO: 3002048 - RNA, 16 nt, Human
ggggcccugccuccuu

SEQ ID NO: 3002049 - RNA, 15 nt, Human
ggggcccugccuccu

SEQ ID NO: 3002050 - RNA, 19 nt, Human
ggggcccugccuccuuugu

SEQ ID NO: 3002051 - RNA, 23 nt, Human
ggggcccugccuccuuugugagg

SEQ ID NO: 3002052 - RNA, 17 nt, Human
aaacaaggaugaauuaa

SEQ ID NO: 3002053 - RNA, 19 nt, Human
aaaauuuuuucucuaggaa

SEQ ID NO: 3002054 - RNA, 16 nt, Human
aaacaaaauagaaagu

SEQ ID NO: 3002055 - RNA, 21 nt, Human
aaaauggacguguuaugacuc

SEQ ID NO: 3002056 - RNA, 12 nt, Human
aaaauggaauac

SEQ ID NO: 3002057 - RNA, 21 nt, Human
aaaauguaggguuauaauaau

SEQ ID NO: 3002058 - RNA, 20 nt, Human
aaaauggaagacagcucuua

SEQ ID NO: 3002059 - RNA, 20 nt, Human
aaacuacauuagguugugaa

SEQ ID NO: 3002060 - RNA, 22 nt, Human
aaacuacauuagguugugaaug

SEQ ID NO: 3002061 - RNA, 21 nt, Human
aaacuacauuagguugugaau

SEQ ID NO: 3002062 - RNA, 16 nt, Human
aaacguggcugcuuca

SEQ ID NO: 3002063 - RNA, 15 nt, Human
aaacgucuuaaauau

SEQ ID NO: 3002064 - RNA, 17 nt, Human
aaacguggcugcuucaa

SEQ ID NO: 3002065 - RNA, 16 nt, Human
aaaccacagcaguuga

SEQ ID NO: 3002066 - RNA, 15 nt, Human
aaaccacagcaguug

SEQ ID NO: 3002067 - RNA, 16 nt, Human
aaacucauuucuagca

SEQ ID NO: 3002068 - RNA, 18 nt, Human
aaacuacauugacagauu

SEQ ID NO: 3002069 - RNA, 16 nt, Human
aaacuggauuaaacuu

SEQ ID NO: 3002070 - RNA, 16 nt, Human
aaacuggcaaagcaga

SEQ ID NO: 3002071 - RNA, 15 nt, Human
aaacuggcaaagcag

SEQ ID NO: 3002072 - RNA, 20 nt, Human
ggguaucaggugcugccauc

SEQ ID NO: 3002073 - RNA, 22 nt, Human
gggucacucuggcagcucagag

SEQ ID NO: 3002074 - RNA, 23 nt, Human
gggucucacuauguugcccaggc

SEQ ID NO: 3002075 - RNA, 22 nt, Human
gggucucacuauguugcccagg

SEQ ID NO: 3002076 - RNA, 17 nt, Human
gggauugaaggaugcug

SEQ ID NO: 3002077 - RNA, 21 nt, Human
gggauuuucagcccucagaau

SEQ ID NO: 3002078 - RNA, 23 nt, Human
gggcagagcagagaccaucccug

SEQ ID NO: 3002079 - RNA, 15 nt, Human
gggauuuccaugaug

SEQ ID NO: 3002080 - RNA, 19 nt, Human
gggcagcugccuccccucc

SEQ ID NO: 3002081 - RNA, 14 nt, Human
gggcagcugccucc

SEQ ID NO: 3002082 - RNA, 13 nt, Human
gggcagcugccuc

SEQ ID NO: 3002083 - RNA, 12 nt, Human
gggcagcugccu

SEQ ID NO: 3002084 - RNA, 23 nt, Human
gggcagcugccuccccuccucug

SEQ ID NO: 3002085 - RNA, 20 nt, Human
gggcagcugccuccccuccu

SEQ ID NO: 3002086 - RNA, 12 nt, Human
aaaauaaauuau

SEQ ID NO: 3002087 - RNA, 20 nt, Human
aaaauaauuuuuauauuuga

SEQ ID NO: 3002088 - RNA, 23 nt, Human
aaaauaauuuuuauauuugaaau

SEQ ID NO: 3002089 - RNA, 21 nt, Human
aaaauaauuuuuauauuugaa

SEQ ID NO: 3002090 - RNA, 14 nt, Human
aaaauaccagccag

SEQ ID NO: 3002091 - RNA, 15 nt, Human
aaaauaccagccagu

SEQ ID NO: 3002092 - RNA, 14 nt, Human
aaaauaccaaggaa

SEQ ID NO: 3002093 - RNA, 12 nt, Human
aaaauagccugc

SEQ ID NO: 3002094 - RNA, 18 nt, Human
aaaauaguggugugauuu

SEQ ID NO: 3002095 - RNA, 22 nt, Human
aaaacuugauguguuaucucuu

SEQ ID NO: 3002096 - RNA, 21 nt, Human
aaaacuuuaugcuaagugaaa

SEQ ID NO: 3002097 - RNA, 20 nt, Human
aaaagccucuguuuugauau

SEQ ID NO: 3002098 - RNA, 22 nt, Human
aaaagcuccauuuuuagugaaa

SEQ ID NO: 3002099 - RNA, 14 nt, Human
aaaagcugggcagg

SEQ ID NO: 3002100 - RNA, 11 nt, Human
gggaggcagag

SEQ ID NO: 3002101 - RNA, 20 nt, Human
gggaggcagagguugcagug

SEQ ID NO: 3002102 - RNA, 11 nt, Human
gggagggcucc

SEQ ID NO: 3002103 - RNA, 13 nt, Human
gggagggcuccag

SEQ ID NO: 3002104 - RNA, 20 nt, Human
aaaaaucucaaauuucuaaa

SEQ ID NO: 3002105 - RNA, 19 nt, Human
aaaaaucucaaauuucuaa

SEQ ID NO: 3002106 - RNA, 17 nt, Human
aaaaaucucaaauuucu

SEQ ID NO: 3002107 - RNA, 22 nt, Human
gggaacagacuggaagcacagc

SEQ ID NO: 3002108 - RNA, 14 nt, Human
gggaacagacugga

SEQ ID NO: 3002109 - RNA, 14 nt, Human
aaaacguggcugcu

SEQ ID NO: 3002110 - RNA, 16 nt, Human
aaaacguggcugcuuc

SEQ ID NO: 3002111 - RNA, 17 nt, Human
aaaacguggcugcuuca

SEQ ID NO: 3002112 - RNA, 18 nt, Human
aaaacguggcugcuucaa

SEQ ID NO: 3002113 - RNA, 15 nt, Human
aaaaccaauguucuc

SEQ ID NO: 3002114 - RNA, 18 nt, Human
aaaacugauuuuuuuuuc

SEQ ID NO: 3002115 - RNA, 22 nt, Human
aaaacugauuuuuuuuuccuuc

SEQ ID NO: 3002116 - RNA, 21 nt, Human
aaaacguggcugcuucaagga

SEQ ID NO: 3002117 - RNA, 23 nt, Human
gggaaaaucagccugcuccagcu

SEQ ID NO: 3002118 - RNA, 13 nt, Human
gggaaaaucagcc

SEQ ID NO: 3002119 - RNA, 16 nt, Human
ggcuucaguggcagcu

SEQ ID NO: 3002120 - RNA, 16 nt, Human
ggcuggugucaccuga

SEQ ID NO: 3002121 - RNA, 19 nt, Human
ggcuguaucccaugagccu

SEQ ID NO: 3002122 - RNA, 15 nt, Human
ggcugucaauuacag

SEQ ID NO: 3002123 - RNA, 23 nt, Human
ggcuguaucccaugagccucagc

SEQ ID NO: 3002124 - RNA, 22 nt, Human
ggcuguaucccaugagccucag

SEQ ID NO: 3002125 - RNA, 20 nt, Human
ggcuguaucccaugagccuc

SEQ ID NO: 3002126 - RNA, 15 nt, Human
ggcuucaguggcagc

SEQ ID NO: 3002127 - RNA, 13 nt, Human
aaaaaaacacaaa

SEQ ID NO: 3002128 - RNA, 17 nt, Human
ggcuggccuggccccuc

SEQ ID NO: 3002129 - RNA, 22 nt, Human
ggcuggccuggccccucagggu

SEQ ID NO: 3002130 - RNA, 20 nt, Human
ggcuggcgugcaguggugcg

SEQ ID NO: 3002131 - RNA, 16 nt, Human
ggcuggcgugcagugg

SEQ ID NO: 3002132 - RNA, 14 nt, Human
ggcuggcgugcagu

SEQ ID NO: 3002133 - RNA, 18 nt, Human
ggcugccagugccugggu

SEQ ID NO: 3002134 - RNA, 17 nt, Human
ggcugccagugccuggg

SEQ ID NO: 3002135 - RNA, 15 nt, Human
ggcugccagugccug

SEQ ID NO: 3002136 - RNA, 20 nt, Human
ggcucuuccaggcugggaga

SEQ ID NO: 3002137 - RNA, 23 nt, Human
ggcucuuccaggcugggagagcc

SEQ ID NO: 3002138 - RNA, 24 nt, Human
ggcucuuccaggcugggagagccu

SEQ ID NO: 3002139 - RNA, 18 nt, Human
ggcucgagcaugccugga

SEQ ID NO: 3002140 - RNA, 17 nt, Human
ggcugcagggaguccga

SEQ ID NO: 3002141 - RNA, 20 nt, Human
ggcugcaugcgggcuuccuc

SEQ ID NO: 3002142 - RNA, 14 nt, Human
ggcugccagugccu

SEQ ID NO: 3002143 - RNA, 20 nt, Human
ggcucccuucccaccucucu

SEQ ID NO: 3002144 - RNA, 22 nt, Human
ggcucccuucccaccucucuca

SEQ ID NO: 3002145 - RNA, 17 nt, Human
ggcucccuucccaccuc

SEQ ID NO: 3002146 - RNA, 18 nt, Human
ggcucccuucccaccucu

SEQ ID NO: 3002147 - RNA, 16 nt, Human
ggcucccuucccaccu

SEQ ID NO: 3002148 - RNA, 16 nt, Human
auucauucuuuuugaa

SEQ ID NO: 3002149 - RNA, 21 nt, Human
auucauucuuuuugaaauguc

SEQ ID NO: 3002150 - RNA, 15 nt, Human
auucauucuuuuuga

SEQ ID NO: 3002151 - RNA, 14 nt, Human
auucucuuauccaa

SEQ ID NO: 3002152 - RNA, 12 nt, Human
auucucuuaucc

SEQ ID NO: 3002153 - RNA, 23 nt, Human
auucucuaguuugauuaaauucu

SEQ ID NO: 3002154 - RNA, 19 nt, Human
auucucuaguuugauuaaa

SEQ ID NO: 3002155 - RNA, 20 nt, Human
auucucuaguuugauuaaau

SEQ ID NO: 3002156 - RNA, 15 nt, Human
auucucuuauccaac

SEQ ID NO: 3002157 - RNA, 22 nt, Human
auugaggacacugauauggguc

SEQ ID NO: 3002158 - RNA, 14 nt, Human
auucauuaguuuug

SEQ ID NO: 3002159 - RNA, 15 nt, Human
auucauuaguuuuga

SEQ ID NO: 3002160 - RNA, 14 nt, Human
auucauauuuacuu

SEQ ID NO: 3002161 - RNA, 22 nt, Human
auuacaagcgugagccacugca

SEQ ID NO: 3002162 - RNA, 17 nt, Human
auuucucucaucuguua

SEQ ID NO: 3002163 - RNA, 19 nt, Human
auuucuguuuagauaauac

SEQ ID NO: 3002164 - RNA, 20 nt, Human
auuucuguuuagauaauaca

SEQ ID NO: 3002165 - RNA, 21 nt, Human
auuucuguuuagauaauacac

SEQ ID NO: 3002166 - RNA, 19 nt, Human
auuugcacauuaaaugacu

SEQ ID NO: 3002167 - RNA, 17 nt, Human
auuugcacauuaaauga

SEQ ID NO: 3002168 - RNA, 15 nt, Human
auuugcacauuaaau

SEQ ID NO: 3002169 - RNA, 14 nt, Human
auuugcacauuaaa

SEQ ID NO: 3002170 - RNA, 13 nt, Human
auuuaauuugaag

SEQ ID NO: 3002171 - RNA, 15 nt, Human
auuuaauuugaaggu

SEQ ID NO: 3002172 - RNA, 22 nt, Human
auuuaauuugaagguagaaugu

SEQ ID NO: 3002173 - RNA, 19 nt, Human
auuuaauugggcacuauuu

SEQ ID NO: 3002174 - RNA, 22 nt, Human
auuuaauagguuuggacaaaau

SEQ ID NO: 3002175 - RNA, 17 nt, Human
auuucacaguguguggu

SEQ ID NO: 3002176 - RNA, 12 nt, Human
auuuauccucug

SEQ ID NO: 3002177 - RNA, 16 nt, Human
auuuauccucuguuga

SEQ ID NO: 3002178 - RNA, 14 nt, Human
auuucacucuccuu

SEQ ID NO: 3002179 - RNA, 16 nt, Human
auuucagcagcugcag

SEQ ID NO: 3002180 - RNA, 12 nt, Human
auuucacucucc

SEQ ID NO: 3002181 - RNA, 21 nt, Human
auuugcacauuaaaugacucu

SEQ ID NO: 3002182 - RNA, 20 nt, Human
auuugcacauuaaaugacuc

SEQ ID NO: 3002183 - RNA, 15 nt, Human
auuuguguugaagag

SEQ ID NO: 3002184 - RNA, 14 nt, Human
auuuguguugaaga

SEQ ID NO: 3002185 - RNA, 22 nt, Human
auuuguguugaagagguuuuaa

SEQ ID NO: 3002186 - RNA, 18 nt, Human
auuuguguugaagagguu

SEQ ID NO: 3002187 - RNA, 14 nt, Human
auuuguuauaauga

SEQ ID NO: 3002188 - RNA, 17 nt, Human
auuuucuccaaauguuc

SEQ ID NO: 3002189 - RNA, 19 nt, Human
auuuucuauaauuuaaaua

SEQ ID NO: 3002190 - RNA, 17 nt, Human
auuuucuauaauuuaaa

SEQ ID NO: 3002191 - RNA, 18 nt, Human
auuuucuauaauuuaaau

SEQ ID NO: 3002192 - RNA, 13 nt, Human
caaaagcauguga

SEQ ID NO: 3002193 - RNA, 19 nt, Human
caaaagcaucuaugugaga

SEQ ID NO: 3002194 - RNA, 21 nt, Human
caaaagguauuuuaaucacca

SEQ ID NO: 3002195 - RNA, 20 nt, Human
caaaagguuaauaaaguaau

SEQ ID NO: 3002196 - RNA, 17 nt, Human
caaacauauauaacaau

SEQ ID NO: 3002197 - RNA, 19 nt, Human
auuuuuauauuugaaauau

SEQ ID NO: 3002198 - RNA, 16 nt, Human
auuuuuauauuugaaa

SEQ ID NO: 3002199 - RNA, 22 nt, Human
auuuuguuuuugucuuaaaaag

SEQ ID NO: 3002200 - RNA, 21 nt, Human
auuuuguuuuugucuuaaaaa

SEQ ID NO: 3002201 - RNA, 17 nt, Human
auuuuuuucugaaauuu

SEQ ID NO: 3002202 - RNA, 16 nt, Human
auuuuuuucugaaauu

SEQ ID NO: 3002203 - RNA, 16 nt, Human
auuuuuauuaaauuau

SEQ ID NO: 3002204 - RNA, 17 nt, Human
caaaccaucauugaaau

SEQ ID NO: 3002205 - RNA, 14 nt, Human
caaaccaucauuga

SEQ ID NO: 3002206 - RNA, 16 nt, Human
caaaccaucauugaaa

SEQ ID NO: 3002207 - RNA, 23 nt, Human
caauugugaaaaaauuuacuuua

SEQ ID NO: 3002208 - RNA, 20 nt, Human
caauuuauuauggcacauca

SEQ ID NO: 3002209 - RNA, 13 nt, Human
caauuuauuaugg

SEQ ID NO: 3002210 - RNA, 17 nt, Human
cacaaggaaauaaaauu

SEQ ID NO: 3002211 - RNA, 22 nt, Human
caauugugaaaaaauuuacuuu

SEQ ID NO: 3002212 - RNA, 15 nt, Human
caauggcagccuugg

SEQ ID NO: 3002213 - RNA, 14 nt, Human
caauggcagccuug

SEQ ID NO: 3002214 - RNA, 13 nt, Human
caauggcagccuu

SEQ ID NO: 3002215 - RNA, 17 nt, Human
caaucagccuaguugau

SEQ ID NO: 3002216 - RNA, 14 nt, Human
caaucaaaucugcu

SEQ ID NO: 3002217 - RNA, 18 nt, Human
caauauuuaaucuuuuau

SEQ ID NO: 3002218 - RNA, 21 nt, Human
caauauuucagauaaucacaa

SEQ ID NO: 3002219 - RNA, 20 nt, Human
caaguuauuuuuaauuuggu

SEQ ID NO: 3002220 - RNA, 20 nt, Human
caaggauugcuacuguccua

SEQ ID NO: 3002221 - RNA, 19 nt, Human
caaggauugcuacuguccu

SEQ ID NO: 3002222 - RNA, 14 nt, Human
caaggcaaggcugu

SEQ ID NO: 3002223 - RNA, 13 nt, Human
caaggcaaauguu

SEQ ID NO: 3002224 - RNA, 22 nt, Human
caaguauuauaccuuuuuuaga

SEQ ID NO: 3002225 - RNA, 17 nt, Human
caaguauuauaccuuuu

SEQ ID NO: 3002226 - RNA, 13 nt, Human
caaguauuauacc

SEQ ID NO: 3002227 - RNA, 17 nt, Human
caagcuccaagcuccca

SEQ ID NO: 3002228 - RNA, 18 nt, Human
caagcuccaagcucccag

SEQ ID NO: 3002229 - RNA, 19 nt, Human
caagcuccaagcucccagg

SEQ ID NO: 3002230 - RNA, 21 nt, Human
caagcuccaagcucccaggca

SEQ ID NO: 3002231 - RNA, 12 nt, Human
caagcucccagg

SEQ ID NO: 3002232 - RNA, 14 nt, Human
caagcucccaggca

SEQ ID NO: 3002233 - RNA, 15 nt, Human
caagcucccaggcau

SEQ ID NO: 3002234 - RNA, 17 nt, Human
caagcucccaggcauuc

SEQ ID NO: 3002235 - RNA, 16 nt, Human
caagcucugcuccucu

SEQ ID NO: 3002236 - RNA, 15 nt, Human
caagcucugcuccuc

SEQ ID NO: 3002237 - RNA, 14 nt, Human
caagcaccuccugc

SEQ ID NO: 3002238 - RNA, 13 nt, Human
caagcaccuccug

SEQ ID NO: 3002239 - RNA, 16 nt, Human
caagaccacguuucua

SEQ ID NO: 3002240 - RNA, 14 nt, Human
caagaccacguuuc

SEQ ID NO: 3002241 - RNA, 14 nt, Human
caagcaaguauuag

SEQ ID NO: 3002242 - RNA, 12 nt, Human
caacuccagaaa

SEQ ID NO: 3002243 - RNA, 15 nt, Human
caagaagcccaggaa

SEQ ID NO: 3002244 - RNA, 18 nt, Human
caagaagcccaggaaagg

SEQ ID NO: 3002245 - RNA, 17 nt, Human
caagaaggaugauucaa

SEQ ID NO: 3002246 - RNA, 14 nt, Human
caacccccagccug

SEQ ID NO: 3002247 - RNA, 16 nt, Human
caaccccuucgcuccu

SEQ ID NO: 3002248 - RNA, 14 nt, Human
caaccccuucgcuc

SEQ ID NO: 3002249 - RNA, 17 nt, Human
caaccccuucgcuccug

SEQ ID NO: 3002250 - RNA, 19 nt, Human
caacuaucucauuuccaag

SEQ ID NO: 3002251 - RNA, 19 nt, Human
caacuauauuguuugcuaa

SEQ ID NO: 3002252 - RNA, 13 nt, Human
cacaucagcuugc

SEQ ID NO: 3002253 - RNA, 23 nt, Human
cacaucagcuugcccuguuaaaa

SEQ ID NO: 3002254 - RNA, 22 nt, Human
cacaucuugcucugcugacaga

SEQ ID NO: 3002255 - RNA, 21 nt, Human
cacaucuugcucugcugacag

SEQ ID NO: 3002256 - RNA, 20 nt, Human
cacaucuugcucugcugaca

SEQ ID NO: 3002257 - RNA, 15 nt, Human
cacaucuugcucugc

SEQ ID NO: 3002258 - RNA, 14 nt, Human
cacaucuugcucug

SEQ ID NO: 3002259 - RNA, 13 nt, Human
cacaucuugcucu

SEQ ID NO: 3002260 - RNA, 19 nt, Human
caccagcccuuagcaggga

SEQ ID NO: 3002261 - RNA, 22 nt, Human
caccagccccagugcccacagg

SEQ ID NO: 3002262 - RNA, 21 nt, Human
caccagccccagugcccacag

SEQ ID NO: 3002263 - RNA, 18 nt, Human
caccagccccagugccca

SEQ ID NO: 3002264 - RNA, 17 nt, Human
caccagccccagugccc

SEQ ID NO: 3002265 - RNA, 18 nt, Human
cacauuuauucugcucac

SEQ ID NO: 3002266 - RNA, 17 nt, Human
cacauuuauucugcuca

SEQ ID NO: 3002267 - RNA, 19 nt, Human
cacaucuugcucugcugac

SEQ ID NO: 3002268 - RNA, 23 nt, Human
cacaucuugcucugcugacagac

SEQ ID NO: 3002269 - RNA, 12 nt, Human
cacccagcccac

SEQ ID NO: 3002270 - RNA, 19 nt, Human
cacccaguccugcccgcca

SEQ ID NO: 3002271 - RNA, 17 nt, Human
caccugcggugcuaucu

SEQ ID NO: 3002272 - RNA, 19 nt, Human
caccugcggugcuaucucc

SEQ ID NO: 3002273 - RNA, 16 nt, Human
caccugcggugcuauc

SEQ ID NO: 3002274 - RNA, 12 nt, Human
cacccuccuuuc

SEQ ID NO: 3002275 - RNA, 12 nt, Human
cacccugcucuc

SEQ ID NO: 3002276 - RNA, 18 nt, Human
caccugccccucaacucu

SEQ ID NO: 3002277 - RNA, 21 nt, Human
caccugccccucaacucuccu

SEQ ID NO: 3002278 - RNA, 11 nt, Human
caccugccagg

SEQ ID NO: 3002279 - RNA, 12 nt, Human
caccugccaggg

SEQ ID NO: 3002280 - RNA, 17 nt, Human
cacccuggggagaaagu

SEQ ID NO: 3002281 - RNA, 21 nt, Human
cacuccagugagacagcucug

SEQ ID NO: 3002282 - RNA, 16 nt, Human
cacuccagugagacag

SEQ ID NO: 3002283 - RNA, 23 nt, Human
cacugaagaagcaccaaucauga

SEQ ID NO: 3002284 - RNA, 11 nt, Human
cacugaagaag

SEQ ID NO: 3002285 - RNA, 15 nt, Human
cacgcuggagugcag

SEQ ID NO: 3002286 - RNA, 20 nt, Human
cacgcuggagugcagugagc

SEQ ID NO: 3002287 - RNA, 18 nt, Human
cacgcuggagugcaguga

SEQ ID NO: 3002288 - RNA, 17 nt, Human
cacgcuggagugcagug

SEQ ID NO: 3002289 - RNA, 16 nt, Human
cacgcuggagugcagu

SEQ ID NO: 3002290 - RNA, 21 nt, Human
cacgcuggagugcagugagcc

SEQ ID NO: 3002291 - RNA, 14 nt, Human
cacuacauucuguu

SEQ ID NO: 3002292 - RNA, 13 nt, Human
cacuacauucugu

SEQ ID NO: 3002293 - RNA, 21 nt, Human
cacuacauuauaaaugucucu

SEQ ID NO: 3002294 - RNA, 16 nt, Human
cacggaagagccuugc

SEQ ID NO: 3002295 - RNA, 22 nt, Human
cacggaagagccuugcggaagg

SEQ ID NO: 3002296 - RNA, 15 nt, Human
cacuacauucuguua

SEQ ID NO: 3002297 - RNA, 19 nt, Human
cagacuggauaguccgucu

SEQ ID NO: 3002298 - RNA, 22 nt, Human
cagacuggcacaguuuucugag

SEQ ID NO: 3002299 - RNA, 23 nt, Human
cagacuggcacaguuuucugaga

SEQ ID NO: 3002300 - RNA, 17 nt, Human
cagacuggcacaguuuu

SEQ ID NO: 3002301 - RNA, 18 nt, Human
cagacuggcacaguuuuc

SEQ ID NO: 3002302 - RNA, 21 nt, Human
cagacuggaagcacagcuuca

SEQ ID NO: 3002303 - RNA, 20 nt, Human
cagacuggaagcacagcuuc

SEQ ID NO: 3002304 - RNA, 18 nt, Human
cagacuggaagcacagcu

SEQ ID NO: 3002305 - RNA, 17 nt, Human
cagacuggaagcacagc

SEQ ID NO: 3002306 - RNA, 16 nt, Human
cagacuggaagcacag

SEQ ID NO: 3002307 - RNA, 14 nt, Human
cagacuggaagcac

SEQ ID NO: 3002308 - RNA, 13 nt, Human
cagacuggaagca

SEQ ID NO: 3002309 - RNA, 23 nt, Human
cagacaggcaagcaccuccugcc

SEQ ID NO: 3002310 - RNA, 22 nt, Human
cagacaggcaagcaccuccugc

SEQ ID NO: 3002311 - RNA, 17 nt, Human
cagacucuacagaggcc

SEQ ID NO: 3002312 - RNA, 21 nt, Human
cagacucuacagaggccaugg

SEQ ID NO: 3002313 - RNA, 20 nt, Human
cagacucuacagaggccaug

SEQ ID NO: 3002314 - RNA, 19 nt, Human
cagacucuacagaggccau

SEQ ID NO: 3002315 - RNA, 18 nt, Human
cagacucuacagaggcca

SEQ ID NO: 3002316 - RNA, 23 nt, Human
cagacucuacagaggccaugggc

SEQ ID NO: 3002317 - RNA, 13 nt, Human
cagacagcugccu

SEQ ID NO: 3002318 - RNA, 14 nt, Human
cagacagcugccug

SEQ ID NO: 3002319 - RNA, 13 nt, Human
cagacaggaccag

SEQ ID NO: 3002320 - RNA, 15 nt, Human
cagacaggaccaggg

SEQ ID NO: 3002321 - RNA, 16 nt, Human
cagacaggaccaggga

SEQ ID NO: 3002322 - RNA, 15 nt, Human
cagacagcugccugg

SEQ ID NO: 3002323 - RNA, 16 nt, Human
cagacagcugccuggg

SEQ ID NO: 3002324 - RNA, 17 nt, Human
cagacagcugccuggga

SEQ ID NO: 3002325 - RNA, 18 nt, Human
cagacagcugccugggau

SEQ ID NO: 3002326 - RNA, 21 nt, Human
cagacaggcaagcaccuccug

SEQ ID NO: 3002327 - RNA, 20 nt, Human
cagacaggcaagcaccuccu

SEQ ID NO: 3002328 - RNA, 18 nt, Human
cagacaggcaagcaccuc

SEQ ID NO: 3002329 - RNA, 13 nt, Human
cagacaggcaagc

SEQ ID NO: 3002330 - RNA, 17 nt, Human
cagacaggaccagggau

SEQ ID NO: 3002331 - RNA, 24 nt, Human
cagacaggaccagggauuuccaug

SEQ ID NO: 3002332 - RNA, 11 nt, Human
cagacaggcaa

SEQ ID NO: 3002333 - RNA, 12 nt, Human
cagccaggcccu

SEQ ID NO: 3002334 - RNA, 15 nt, Human
cagccagacuggcac

SEQ ID NO: 3002335 - RNA, 18 nt, Human
cagccagacuggcacagu

SEQ ID NO: 3002336 - RNA, 23 nt, Human
cagccagcaguucagagcugccc

SEQ ID NO: 3002337 - RNA, 22 nt, Human
cagccagcaguucagagcugcc

SEQ ID NO: 3002338 - RNA, 14 nt, Human
cagccagacuggca

SEQ ID NO: 3002339 - RNA, 15 nt, Human
cagcacgauuucugu

SEQ ID NO: 3002340 - RNA, 14 nt, Human
cagcacgauuucug

SEQ ID NO: 3002341 - RNA, 20 nt, Human
cagcacgauuucuguuuaga

SEQ ID NO: 3002342 - RNA, 18 nt, Human
cagauugcaacaggcugg

SEQ ID NO: 3002343 - RNA, 20 nt, Human
cagauugcaacaggcugggc

SEQ ID NO: 3002344 - RNA, 19 nt, Human
cagauugcaacaggcuggg

SEQ ID NO: 3002345 - RNA, 20 nt, Human
cagauuucacucuccuuggu

SEQ ID NO: 3002346 - RNA, 19 nt, Human
cagcaccaucucuccuccu

SEQ ID NO: 3002347 - RNA, 17 nt, Human
cagcaccaucucuccuc

SEQ ID NO: 3002348 - RNA, 19 nt, Human
cagauuucacucuccuugg

SEQ ID NO: 3002349 - RNA, 21 nt, Human
cagagcugcccucuccugggc

SEQ ID NO: 3002350 - RNA, 20 nt, Human
cagagcugcccucuccuggg

SEQ ID NO: 3002351 - RNA, 19 nt, Human
cagagcugcccucuccugg

SEQ ID NO: 3002352 - RNA, 18 nt, Human
cagagcugcccucuccug

SEQ ID NO: 3002353 - RNA, 17 nt, Human
cagaggaaagcaaagga

SEQ ID NO: 3002354 - RNA, 19 nt, Human
cagaggaaagcaaaggaga

SEQ ID NO: 3002355 - RNA, 13 nt, Human
cagaggggguggc

SEQ ID NO: 3002356 - RNA, 13 nt, Human
cagagcugccacc

SEQ ID NO: 3002357 - RNA, 17 nt, Human
cagagcugcccucuccu

SEQ ID NO: 3002358 - RNA, 20 nt, Human
cagagagguuaaggugggua

SEQ ID NO: 3002359 - RNA, 23 nt, Human
cagagaggguggugaccucugcc

SEQ ID NO: 3002360 - RNA, 23 nt, Human
cagagagggugggagugggccca

SEQ ID NO: 3002361 - RNA, 22 nt, Human
cagagaggguggugaccucugc

SEQ ID NO: 3002362 - RNA, 20 nt, Human
cagagaggguggugaccucu

SEQ ID NO: 3002363 - RNA, 17 nt, Human
cagagaggguggugacc

SEQ ID NO: 3002364 - RNA, 12 nt, Human
cagagagggugg

SEQ ID NO: 3002365 - RNA, 23 nt, Human
cagagacuccugcaggcagccag

SEQ ID NO: 3002366 - RNA, 14 nt, Human
cagaggggguggcc

SEQ ID NO: 3002367 - RNA, 16 nt, Human
cagaggggguggccuc

SEQ ID NO: 3002368 - RNA, 19 nt, Human
cagauacuuggggggcuga

SEQ ID NO: 3002369 - RNA, 19 nt, Human
cagauagauauaugcucug

SEQ ID NO: 3002370 - RNA, 14 nt, Human
cagauaugauucaa

SEQ ID NO: 3002371 - RNA, 11 nt, Human
caggcuacugu

SEQ ID NO: 3002372 - RNA, 21 nt, Human
caggcugggagagccuuccag

SEQ ID NO: 3002373 - RNA, 20 nt, Human
caggcugggagagccuucca

SEQ ID NO: 3002374 - RNA, 12 nt, Human
caggccuccuac

SEQ ID NO: 3002375 - RNA, 14 nt, Human
caggccuccuacag

SEQ ID NO: 3002376 - RNA, 14 nt, Human
caggggaaaagagg

SEQ ID NO: 3002377 - RNA, 16 nt, Human
caggggaaaagaggag

SEQ ID NO: 3002378 - RNA, 22 nt, Human
caggcugggagagccuuccagg

SEQ ID NO: 3002379 - RNA, 23 nt, Human
caggcugggagagccuuccaggg

SEQ ID NO: 3002380 - RNA, 21 nt, Human
caggaccagggauuuccauga

SEQ ID NO: 3002381 - RNA, 16 nt, Human
caggaccucaggugag

SEQ ID NO: 3002382 - RNA, 23 nt, Human
caggaccucaggugagaagcaga

SEQ ID NO: 3002383 - RNA, 16 nt, Human
caggcaaugcuggcug

SEQ ID NO: 3002384 - RNA, 15 nt, Human
caggcaaugcuggcu

SEQ ID NO: 3002385 - RNA, 14 nt, Human
caggcaaugcuggc

SEQ ID NO: 3002386 - RNA, 18 nt, Human
caggaggccagccuugac

SEQ ID NO: 3002387 - RNA, 19 nt, Human
caggaggccagccuugacc

SEQ ID NO: 3002388 - RNA, 22 nt, Human
caggaggccagccuugaccauu

SEQ ID NO: 3002389 - RNA, 19 nt, Human
caggaggaucacuugaguc

SEQ ID NO: 3002390 - RNA, 11 nt, Human
caggccaggcc

SEQ ID NO: 3002391 - RNA, 12 nt, Human
caggccaggccc

SEQ ID NO: 3002392 - RNA, 19 nt, Human
caggcaccuguagucccag

SEQ ID NO: 3002393 - RNA, 16 nt, Human
caggaaaggcuccagg

SEQ ID NO: 3002394 - RNA, 17 nt, Human
caggaaaggcuccagga

SEQ ID NO: 3002395 - RNA, 16 nt, Human
caggaaagagaacuuc

SEQ ID NO: 3002396 - RNA, 19 nt, Human
caggaaaggcuccaggagc

SEQ ID NO: 3002397 - RNA, 20 nt, Human
caggaaaggcuccaggagca

SEQ ID NO: 3002398 - RNA, 14 nt, Human
cagcuuauugucua

SEQ ID NO: 3002399 - RNA, 20 nt, Human
cagcuguaugauucccagcc

SEQ ID NO: 3002400 - RNA, 20 nt, Human
cagcuuauugucuagugaaa

SEQ ID NO: 3002401 - RNA, 17 nt, Human
cagcuuauucacaagac

SEQ ID NO: 3002402 - RNA, 19 nt, Human
cagcuguaugauucccagc

SEQ ID NO: 3002403 - RNA, 19 nt, Human
cagcugccuccccuccucu

SEQ ID NO: 3002404 - RNA, 18 nt, Human
cagcugccuccccuccuc

SEQ ID NO: 3002405 - RNA, 17 nt, Human
cagcugccuccccuccu

SEQ ID NO: 3002406 - RNA, 16 nt, Human
cagcugccuccccucc

SEQ ID NO: 3002407 - RNA, 15 nt, Human
cagcugccuccccuc

SEQ ID NO: 3002408 - RNA, 14 nt, Human
cagcugccuccccu

SEQ ID NO: 3002409 - RNA, 9 nt, Human
cagcugccu

SEQ ID NO: 3002410 - RNA, 11 nt, Human
cagcugccucc

SEQ ID NO: 3002411 - RNA, 10 nt, Human
cagcugccuc

SEQ ID NO: 3002412 - RNA, 21 nt, Human
cagcugacuuuucuguccgag

SEQ ID NO: 3002413 - RNA, 15 nt, Human
cagcuaacauggaag

SEQ ID NO: 3002414 - RNA, 22 nt, Human
cagcuaaagaaguuugaacauu

SEQ ID NO: 3002415 - RNA, 19 nt, Human
cagcguuucuaugacacau

SEQ ID NO: 3002416 - RNA, 16 nt, Human
cagccugcuccagcug

SEQ ID NO: 3002417 - RNA, 17 nt, Human
cagccugcuccagcugu

SEQ ID NO: 3002418 - RNA, 19 nt, Human
cagccugcuccagcuguuc

SEQ ID NO: 3002419 - RNA, 15 nt, Human
cagccugcuccagcu

SEQ ID NO: 3002420 - RNA, 14 nt, Human
caguuguuauuuau

SEQ ID NO: 3002421 - RNA, 19 nt, Human
caguuguuauuuauugaaa

SEQ ID NO: 3002422 - RNA, 22 nt, Human
caguuguuagugugucuuagug

SEQ ID NO: 3002423 - RNA, 18 nt, Human
caguuguuagugugucuu

SEQ ID NO: 3002424 - RNA, 21 nt, Human
caguuguuauuuauugaaaug

SEQ ID NO: 3002425 - RNA, 23 nt, Human
caguuuguuaguaugaggcauuu

SEQ ID NO: 3002426 - RNA, 21 nt, Human
caguuuguuaguaugaggcau

SEQ ID NO: 3002427 - RNA, 19 nt, Human
cauagcagcuuauucacaa

SEQ ID NO: 3002428 - RNA, 23 nt, Human
cauagcagagaaugaaagggccc

SEQ ID NO: 3002429 - RNA, 22 nt, Human
cauauuaccacagacauacuaa

SEQ ID NO: 3002430 - RNA, 23 nt, Human
cauacaggaagguagaaauaucu

SEQ ID NO: 3002431 - RNA, 16 nt, Human
cauacaguuugcacuu

SEQ ID NO: 3002432 - RNA, 23 nt, Human
cauaaugcgugcauaccacuuuu

SEQ ID NO: 3002433 - RNA, 19 nt, Human
cauccugaggcuccacuug

SEQ ID NO: 3002434 - RNA, 18 nt, Human
cauccugaggcuccacuu

SEQ ID NO: 3002435 - RNA, 11 nt, Human
caucccagccc

SEQ ID NO: 3002436 - RNA, 20 nt, Human
caucccaaacccuucagugc

SEQ ID NO: 3002437 - RNA, 21 nt, Human
cauccucuguacagagcccac

SEQ ID NO: 3002438 - RNA, 22 nt, Human
cauccucuguacagagcccacg

SEQ ID NO: 3002439 - RNA, 19 nt, Human
caucccaaacccuucagug

SEQ ID NO: 3002440 - RNA, 19 nt, Human
caucagcacgauuucuguu

SEQ ID NO: 3002441 - RNA, 21 nt, Human
caucagcacgauuucuguuua

SEQ ID NO: 3002442 - RNA, 17 nt, Human
caguucagagcugcccu

SEQ ID NO: 3002443 - RNA, 16 nt, Human
caguucagagcugccc

SEQ ID NO: 3002444 - RNA, 15 nt, Human
caguucagagcugcc

SEQ ID NO: 3002445 - RNA, 22 nt, Human
caguuauuauauuuacaaaugg

SEQ ID NO: 3002446 - RNA, 22 nt, Human
caguucagagcugcccucuccu

SEQ ID NO: 3002447 - RNA, 21 nt, Human
caguucagagcugcccucucc

SEQ ID NO: 3002448 - RNA, 19 nt, Human
caguucagagcugcccucu

SEQ ID NO: 3002449 - RNA, 18 nt, Human
caguucagagcugcccuc

SEQ ID NO: 3002450 - RNA, 24 nt, Human
caguucagagcugcccucuccugg

SEQ ID NO: 3002451 - RNA, 23 nt, Human
caguucagagcugcccucuccug

SEQ ID NO: 3002452 - RNA, 22 nt, Human
cagucugauucccaagcucugc

SEQ ID NO: 3002453 - RNA, 21 nt, Human
cagucugauucccaagcucug

SEQ ID NO: 3002454 - RNA, 22 nt, Human
cagugauuaccagggacugagg

SEQ ID NO: 3002455 - RNA, 23 nt, Human
cagucugauucccaagcucugcu

SEQ ID NO: 3002456 - RNA, 22 nt, Human
cagugcccacaggaucagucug

SEQ ID NO: 3002457 - RNA, 18 nt, Human
cagugcccacaggaucag

SEQ ID NO: 3002458 - RNA, 21 nt, Human
cagugcccacaggaucagucu

SEQ ID NO: 3002459 - RNA, 20 nt, Human
cagugguaugaucacggcuc

SEQ ID NO: 3002460 - RNA, 18 nt, Human
cagugggagcugccuguu

SEQ ID NO: 3002461 - RNA, 17 nt, Human
cagugggagcugccugu

SEQ ID NO: 3002462 - RNA, 15 nt, Human
cagugggagcugccu

SEQ ID NO: 3002463 - RNA, 16 nt, Human
cagugggagcugccug

SEQ ID NO: 3002464 - RNA, 17 nt, Human
caguuauuauauuuaca

SEQ ID NO: 3002465 - RNA, 21 nt, Human
caguuauuauauuuacaaaug

SEQ ID NO: 3002466 - RNA, 19 nt, Human
caguuauggcuauaggugc

SEQ ID NO: 3002467 - RNA, 20 nt, Human
caguuauggcuauaggugcu

SEQ ID NO: 3002468 - RNA, 13 nt, Human
caguuauggcuau

SEQ ID NO: 3002469 - RNA, 19 nt, Human
caguggugcgaucuggguu

SEQ ID NO: 3002470 - RNA, 21 nt, Human
cagugguaugaucacggcuca

SEQ ID NO: 3002471 - RNA, 20 nt, Human
caguuacucagaauucucua

SEQ ID NO: 3002472 - RNA, 17 nt, Human
cauuauguuaauauuuc

SEQ ID NO: 3002473 - RNA, 14 nt, Human
cauuauguuaauau

SEQ ID NO: 3002474 - RNA, 15 nt, Human
cauuauguuaauauu

SEQ ID NO: 3002475 - RNA, 16 nt, Human
cauuauguuaauauuu

SEQ ID NO: 3002476 - RNA, 17 nt, Human
cauucuccaccugccag

SEQ ID NO: 3002477 - RNA, 18 nt, Human
cauucuccaccugccagg

SEQ ID NO: 3002478 - RNA, 19 nt, Human
cauucuccaccugccaggg

SEQ ID NO: 3002479 - RNA, 21 nt, Human
cauucuccaccugccagggac

SEQ ID NO: 3002480 - RNA, 20 nt, Human
cauucuccuuguguuacuaa

SEQ ID NO: 3002481 - RNA, 17 nt, Human
cauguuacauaagauaa

SEQ ID NO: 3002482 - RNA, 16 nt, Human
cauguuacauaagaua

SEQ ID NO: 3002483 - RNA, 15 nt, Human
cauguccaagaagcc

SEQ ID NO: 3002484 - RNA, 16 nt, Human
cauguccaagaagccc

SEQ ID NO: 3002485 - RNA, 16 nt, Human
cauguucuuaauucuu

SEQ ID NO: 3002486 - RNA, 13 nt, Human
cauguucuuaauu

SEQ ID NO: 3002487 - RNA, 21 nt, Human
cauguuacauaagauaaaugu

SEQ ID NO: 3002488 - RNA, 19 nt, Human
caugucagucugcuuagaa

SEQ ID NO: 3002489 - RNA, 17 nt, Human
cauguuggccaggcugg

SEQ ID NO: 3002490 - RNA, 18 nt, Human
cauguuggccaggcuggu

SEQ ID NO: 3002491 - RNA, 18 nt, Human
cauguucuuaauucuuag

SEQ ID NO: 3002492 - RNA, 19 nt, Human
cauuauauuuauuacugua

SEQ ID NO: 3002493 - RNA, 21 nt, Human
cauggccucuucagaucucua

SEQ ID NO: 3002494 - RNA, 18 nt, Human
caugggaaaggggaaguu

SEQ ID NO: 3002495 - RNA, 14 nt, Human
caugcuccuggccc

SEQ ID NO: 3002496 - RNA, 16 nt, Human
caugcuccuggcccac

SEQ ID NO: 3002497 - RNA, 17 nt, Human
caugcuccuggcccacu

SEQ ID NO: 3002498 - RNA, 13 nt, Human
caugacaaagacu

SEQ ID NO: 3002499 - RNA, 15 nt, Human
caugcaaggucauuu

SEQ ID NO: 3002500 - RNA, 12 nt, Human
caugcaagguca

SEQ ID NO: 3002501 - RNA, 14 nt, Human
ccaaaaggcagaag

SEQ ID NO: 3002502 - RNA, 16 nt, Human
cauuuguauaaaauaa

SEQ ID NO: 3002503 - RNA, 14 nt, Human
cauuuguauaaaau

SEQ ID NO: 3002504 - RNA, 20 nt, Human
cauuuguguugaagagguuu

SEQ ID NO: 3002505 - RNA, 23 nt, Human
cauuuuuuuuaagaaaaaggaug

SEQ ID NO: 3002506 - RNA, 16 nt, Human
cauuuaggugaggaag

SEQ ID NO: 3002507 - RNA, 21 nt, Human
cauuggggcucccagccaggc

SEQ ID NO: 3002508 - RNA, 19 nt, Human
cauuggggcucccagccag

SEQ ID NO: 3002509 - RNA, 18 nt, Human
cauuggggcucccagcca

SEQ ID NO: 3002510 - RNA, 17 nt, Human
cauuggggcucccagcc

SEQ ID NO: 3002511 - RNA, 22 nt, Human
cauuggggcucccagccaggcc

SEQ ID NO: 3002512 - RNA, 18 nt, Human
cauuuaggugaggaagca

SEQ ID NO: 3002513 - RNA, 16 nt, Human
cauuggggcucccagc

SEQ ID NO: 3002514 - RNA, 15 nt, Human
cauuggggcucccag

SEQ ID NO: 3002515 - RNA, 21 nt, Human
ccaacuccagaaagugacaag

SEQ ID NO: 3002516 - RNA, 21 nt, Human
ccaacucaccccagccccaaa

SEQ ID NO: 3002517 - RNA, 15 nt, Human
ccaagcucugcuccu

SEQ ID NO: 3002518 - RNA, 14 nt, Human
ccaagcucugcucc

SEQ ID NO: 3002519 - RNA, 16 nt, Human
ccaagcucugcuccuc

SEQ ID NO: 3002520 - RNA, 13 nt, Human
ccaacucacccca

SEQ ID NO: 3002521 - RNA, 23 nt, Human
ccaaaucagcugcuacuacuccu

SEQ ID NO: 3002522 - RNA, 15 nt, Human
ccaaaucagcugcua

SEQ ID NO: 3002523 - RNA, 23 nt, Human
ccaauggacuaacuugucuuugg

SEQ ID NO: 3002524 - RNA, 22 nt, Human
ccaaaguacacuguuucaaacu

SEQ ID NO: 3002525 - RNA, 14 nt, Human
ccaggaguuuggcc

SEQ ID NO: 3002526 - RNA, 15 nt, Human
ccaggaguuuggcca

SEQ ID NO: 3002527 - RNA, 16 nt, Human
ccaggaguuuggccag

SEQ ID NO: 3002528 - RNA, 17 nt, Human
ccaggaguuuggccaga

SEQ ID NO: 3002529 - RNA, 18 nt, Human
ccaggaguuuggccagaa

SEQ ID NO: 3002530 - RNA, 17 nt, Human
ccaggcagcagacacau

SEQ ID NO: 3002531 - RNA, 15 nt, Human
ccaggcagcagacac

SEQ ID NO: 3002532 - RNA, 15 nt, Human
ccaggggccaugaau

SEQ ID NO: 3002533 - RNA, 19 nt, Human
ccaggggugggacacccug

SEQ ID NO: 3002534 - RNA, 20 nt, Human
ccaggggugggacacccugu

SEQ ID NO: 3002535 - RNA, 21 nt, Human
ccaggggugggacacccugug

SEQ ID NO: 3002536 - RNA, 22 nt, Human
ccaggggugggacacccuguga

SEQ ID NO: 3002537 - RNA, 13 nt, Human
ccaguaucuugaa

SEQ ID NO: 3002538 - RNA, 19 nt, Human
ccaguaucuugaagacuuu

SEQ ID NO: 3002539 - RNA, 22 nt, Human
ccaguaucuugaagacuuuucu

SEQ ID NO: 3002540 - RNA, 16 nt, Human
ccagucaccccggcca

SEQ ID NO: 3002541 - RNA, 17 nt, Human
ccagucaccccggccac

SEQ ID NO: 3002542 - RNA, 18 nt, Human
ccagucaccccggccacc

SEQ ID NO: 3002543 - RNA, 16 nt, Human
ccaguccugcccgcca

SEQ ID NO: 3002544 - RNA, 22 nt, Human
ccagcagaaaugccuuacccuc

SEQ ID NO: 3002545 - RNA, 17 nt, Human
ccagcagaaaugccuua

SEQ ID NO: 3002546 - RNA, 16 nt, Human
ccagcagaaaugccuu

SEQ ID NO: 3002547 - RNA, 11 nt, Human
ccagcagccug

SEQ ID NO: 3002548 - RNA, 12 nt, Human
ccagcagccugg

SEQ ID NO: 3002549 - RNA, 12 nt, Human
ccagcagaaaug

SEQ ID NO: 3002550 - RNA, 13 nt, Human
ccagccccuggau

SEQ ID NO: 3002551 - RNA, 14 nt, Human
ccagccccuggaug

SEQ ID NO: 3002552 - RNA, 15 nt, Human
ccagccccuggaugc

SEQ ID NO: 3002553 - RNA, 13 nt, Human
ccagcagccugga

SEQ ID NO: 3002554 - RNA, 23 nt, Human
ccagccccauccucuguacagag

SEQ ID NO: 3002555 - RNA, 18 nt, Human
ccagccccauccucugua

SEQ ID NO: 3002556 - RNA, 18 nt, Human
ccagccccuggaugcagc

SEQ ID NO: 3002557 - RNA, 15 nt, Human
ccagccccuucugac

SEQ ID NO: 3002558 - RNA, 16 nt, Human
ccagccccuucugacc

SEQ ID NO: 3002559 - RNA, 17 nt, Human
ccagccccuucugaccc

SEQ ID NO: 3002560 - RNA, 18 nt, Human
ccagccccuucugaccca

SEQ ID NO: 3002561 - RNA, 21 nt, Human
ccagcgagcccugguggcagu

SEQ ID NO: 3002562 - RNA, 20 nt, Human
ccaggaaaggcuccaggagc

SEQ ID NO: 3002563 - RNA, 18 nt, Human
ccaggaaaggcuccagga

SEQ ID NO: 3002564 - RNA, 19 nt, Human
ccaggaaaggcuccaggag

SEQ ID NO: 3002565 - RNA, 17 nt, Human
ccaggaaaggcuccagg

SEQ ID NO: 3002566 - RNA, 18 nt, Human
ccacuugagugucaagcu

SEQ ID NO: 3002567 - RNA, 12 nt, Human
ccacuuggucug

SEQ ID NO: 3002568 - RNA, 19 nt, Human
ccacugcaccgggccacag

SEQ ID NO: 3002569 - RNA, 17 nt, Human
ccacugcaccgggccac

SEQ ID NO: 3002570 - RNA, 14 nt, Human
ccacugcaccgggc

SEQ ID NO: 3002571 - RNA, 13 nt, Human
ccacugcaccggg

SEQ ID NO: 3002572 - RNA, 20 nt, Human
ccacugcacuauagccuagg

SEQ ID NO: 3002573 - RNA, 19 nt, Human
ccacugcacuauagccuag

SEQ ID NO: 3002574 - RNA, 19 nt, Human
ccacuuggucugugagaug

SEQ ID NO: 3002575 - RNA, 17 nt, Human
ccacuuggucugugaga

SEQ ID NO: 3002576 - RNA, 16 nt, Human
ccacuuggucugugag

SEQ ID NO: 3002577 - RNA, 15 nt, Human
ccacuuggucuguga

SEQ ID NO: 3002578 - RNA, 22 nt, Human
ccacuuggucugugagaugcua

SEQ ID NO: 3002579 - RNA, 20 nt, Human
ccacuuggucugugagaugc

SEQ ID NO: 3002580 - RNA, 20 nt, Human
ccacuuucuagccagaggag

SEQ ID NO: 3002581 - RNA, 18 nt, Human
ccacuuucuagccagagg

SEQ ID NO: 3002582 - RNA, 19 nt, Human
ccacuuucuagccagagga

SEQ ID NO: 3002583 - RNA, 13 nt, Human
ccacuuucuagcc

SEQ ID NO: 3002584 - RNA, 22 nt, Human
ccacuuuuguucuugguuugua

SEQ ID NO: 3002585 - RNA, 21 nt, Human
ccacuuuuguucuugguuugu

SEQ ID NO: 3002586 - RNA, 15 nt, Human
ccacuuuuguucuug

SEQ ID NO: 3002587 - RNA, 14 nt, Human
ccacuuuuguucuu

SEQ ID NO: 3002588 - RNA, 16 nt, Human
ccagacccggcugcgu

SEQ ID NO: 3002589 - RNA, 17 nt, Human
ccagacccggcugcgug

SEQ ID NO: 3002590 - RNA, 16 nt, Human
ccagagacacaagccu

SEQ ID NO: 3002591 - RNA, 18 nt, Human
ccagagacacaagccuuc

SEQ ID NO: 3002592 - RNA, 13 nt, Human
ccagagagggugg

SEQ ID NO: 3002593 - RNA, 14 nt, Human
ccagaugcaccagc

SEQ ID NO: 3002594 - RNA, 13 nt, Human
ccagaugcaccag

SEQ ID NO: 3002595 - RNA, 14 nt, Human
cccauucuuggccc

SEQ ID NO: 3002596 - RNA, 23 nt, Human
cccauucugccugcccaggcccc

SEQ ID NO: 3002597 - RNA, 15 nt, Human
ccccauuguggucac

SEQ ID NO: 3002598 - RNA, 14 nt, Human
cccccuuccaugga

SEQ ID NO: 3002599 - RNA, 20 nt, Human
cccccuguggaugcugcugc

SEQ ID NO: 3002600 - RNA, 12 nt, Human
ccccgcccaggc

SEQ ID NO: 3002601 - RNA, 14 nt, Human
ccccgcccaggcuu

SEQ ID NO: 3002602 - RNA, 14 nt, Human
ccccggccaccugc

SEQ ID NO: 3002603 - RNA, 18 nt, Human
ccccggccaccugcggug

SEQ ID NO: 3002604 - RNA, 13 nt, Human
ccccggccaccug

SEQ ID NO: 3002605 - RNA, 18 nt, Human
ccccaaaacucuccucug

SEQ ID NO: 3002606 - RNA, 20 nt, Human
ccccaaaacucuccucugcu

SEQ ID NO: 3002607 - RNA, 14 nt, Human
ccccagccccaucc

SEQ ID NO: 3002608 - RNA, 14 nt, Human
ccccagccccaaaa

SEQ ID NO: 3002609 - RNA, 21 nt, Human
ccccauucugccugcccaggc

SEQ ID NO: 3002610 - RNA, 10 nt, Human
ccccagcccc

SEQ ID NO: 3002611 - RNA, 12 nt, Human
ccccagccccaa

SEQ ID NO: 3002612 - RNA, 20 nt, Human
cccauccucuguacagagcc

SEQ ID NO: 3002613 - RNA, 15 nt, Human
cccauccucuguaca

SEQ ID NO: 3002614 - RNA, 19 nt, Human
cccauccucuguacagagc

SEQ ID NO: 3002615 - RNA, 14 nt, Human
cccauccucuguac

SEQ ID NO: 3002616 - RNA, 17 nt, Human
cccagggcaucugggag

SEQ ID NO: 3002617 - RNA, 16 nt, Human
cccagggcaucuggga

SEQ ID NO: 3002618 - RNA, 18 nt, Human
cccaggcuggcgugcagu

SEQ ID NO: 3002619 - RNA, 20 nt, Human
cccaggcuggcgugcagugg

SEQ ID NO: 3002620 - RNA, 19 nt, Human
cccaggcuggcgugcagug

SEQ ID NO: 3002621 - RNA, 21 nt, Human
cccagccccaaaacucuccuc

SEQ ID NO: 3002622 - RNA, 23 nt, Human
cccagccccaaaacucuccucug

SEQ ID NO: 3002623 - RNA, 19 nt, Human
cccagcccacuucugccau

SEQ ID NO: 3002624 - RNA, 17 nt, Human
cccagcccacuucugcc

SEQ ID NO: 3002625 - RNA, 16 nt, Human
ccaugaggaacaaggc

SEQ ID NO: 3002626 - RNA, 17 nt, Human
ccaugaggaacaaggca

SEQ ID NO: 3002627 - RNA, 18 nt, Human
ccaugaggaacaaggcaa

SEQ ID NO: 3002628 - RNA, 18 nt, Human
ccaugggcacugugggua

SEQ ID NO: 3002629 - RNA, 17 nt, Human
ccaugggccuccugugu

SEQ ID NO: 3002630 - RNA, 15 nt, Human
cccaccgcagacagg

SEQ ID NO: 3002631 - RNA, 18 nt, Human
cccaccgcagacaggacc

SEQ ID NO: 3002632 - RNA, 17 nt, Human
cccaagcucugcuccuc

SEQ ID NO: 3002633 - RNA, 15 nt, Human
cccaagcucugcucc

SEQ ID NO: 3002634 - RNA, 15 nt, Human
cccacccaagggccu

SEQ ID NO: 3002635 - RNA, 18 nt, Human
cccaccaucaugucuggc

SEQ ID NO: 3002636 - RNA, 13 nt, Human
ccauuuaaagcuu

SEQ ID NO: 3002637 - RNA, 19 nt, Human
ccauuggggcucccagcca

SEQ ID NO: 3002638 - RNA, 21 nt, Human
ccauuggggcucccagccagg

SEQ ID NO: 3002639 - RNA, 20 nt, Human
ccauuggggcucccagccag

SEQ ID NO: 3002640 - RNA, 22 nt, Human
ccauuggggcucccagccaggc

SEQ ID NO: 3002641 - RNA, 22 nt, Human
ccauuguggucacaggaaguag

SEQ ID NO: 3002642 - RNA, 13 nt, Human
ccucaugcugcca

SEQ ID NO: 3002643 - RNA, 15 nt, Human
ccucaugcugccaau

SEQ ID NO: 3002644 - RNA, 11 nt, Human
ccucaggcagg

SEQ ID NO: 3002645 - RNA, 17 nt, Human
ccucccaacucacccca

SEQ ID NO: 3002646 - RNA, 20 nt, Human
ccucccaacucaccccagcc

SEQ ID NO: 3002647 - RNA, 21 nt, Human
ccucccaacucaccccagccc

SEQ ID NO: 3002648 - RNA, 16 nt, Human
ccucaugcugccaaua

SEQ ID NO: 3002649 - RNA, 16 nt, Human
ccucuccugggcagcu

SEQ ID NO: 3002650 - RNA, 15 nt, Human
ccucuccugggcagc

SEQ ID NO: 3002651 - RNA, 14 nt, Human
ccucuccugggcag

SEQ ID NO: 3002652 - RNA, 20 nt, Human
ccucuccugggcagcugccu

SEQ ID NO: 3002653 - RNA, 19 nt, Human
ccucuccugggcagcugcc

SEQ ID NO: 3002654 - RNA, 18 nt, Human
ccucuccugggcagcugc

SEQ ID NO: 3002655 - RNA, 17 nt, Human
ccucuccugggcagcug

SEQ ID NO: 3002656 - RNA, 22 nt, Human
ccucuccugggcagcugccucc

SEQ ID NO: 3002657 - RNA, 21 nt, Human
ccucuccugggcagcugccuc

SEQ ID NO: 3002658 - RNA, 20 nt, Human
ccucugccugaagucacaca

SEQ ID NO: 3002659 - RNA, 11 nt, Human
ccucugccuga

SEQ ID NO: 3002660 - RNA, 23 nt, Human
ccucugccucugacacacagcuc

SEQ ID NO: 3002661 - RNA, 21 nt, Human
ccucugccucugacacacagc

SEQ ID NO: 3002662 - RNA, 20 nt, Human
ccucugccucugacacacag

SEQ ID NO: 3002663 - RNA, 19 nt, Human
ccuccuuugugaggaagcc

SEQ ID NO: 3002664 - RNA, 20 nt, Human
ccuccuuugugaggaagccg

SEQ ID NO: 3002665 - RNA, 18 nt, Human
ccuccuuugugaggaagc

SEQ ID NO: 3002666 - RNA, 15 nt, Human
ccucgaacuggcugc

SEQ ID NO: 3002667 - RNA, 16 nt, Human
ccucgaacuggcugca

SEQ ID NO: 3002668 - RNA, 14 nt, Human
ccuccuaaaacaac

SEQ ID NO: 3002669 - RNA, 23 nt, Human
ccugccuccuuugugaggaagcc

SEQ ID NO: 3002670 - RNA, 21 nt, Human
ccugccuccuuugugaggaag

SEQ ID NO: 3002671 - RNA, 22 nt, Human
ccugccuccuuugugaggaagc

SEQ ID NO: 3002672 - RNA, 13 nt, Human
ccugccuccuuug

SEQ ID NO: 3002673 - RNA, 15 nt, Human
ccugccuccuuugug

SEQ ID NO: 3002674 - RNA, 19 nt, Human
ccugccuccuuugugagga

SEQ ID NO: 3002675 - RNA, 20 nt, Human
ccugccuccuuugugaggaa

SEQ ID NO: 3002676 - RNA, 15 nt, Human
ccugccucuucucua

SEQ ID NO: 3002677 - RNA, 12 nt, Human
ccugcugcaguu

SEQ ID NO: 3002678 - RNA, 16 nt, Human
ccugcugcaguugcca

SEQ ID NO: 3002679 - RNA, 11 nt, Human
ccugcugcagu

SEQ ID NO: 3002680 - RNA, 22 nt, Human
ccugcugcaguugccagucacc

SEQ ID NO: 3002681 - RNA, 21 nt, Human
ccugcugcaguugccagucac

SEQ ID NO: 3002682 - RNA, 16 nt, Human
ccucuuugagugaagc

SEQ ID NO: 3002683 - RNA, 19 nt, Human
ccucuuuggucuacacugu

SEQ ID NO: 3002684 - RNA, 23 nt, Human
ccugcaggcagccaggccacaag

SEQ ID NO: 3002685 - RNA, 18 nt, Human
ccugcaggcagccaggcc

SEQ ID NO: 3002686 - RNA, 19 nt, Human
ccugcaggcagccaggcca

SEQ ID NO: 3002687 - RNA, 20 nt, Human
ccugcaggcagccaggccac

SEQ ID NO: 3002688 - RNA, 21 nt, Human
ccugcaggcagccaggccaca

SEQ ID NO: 3002689 - RNA, 15 nt, Human
ccugcaggcagccag

SEQ ID NO: 3002690 - RNA, 12 nt, Human
ccugcagagggc

SEQ ID NO: 3002691 - RNA, 16 nt, Human
ccugcaggcagccagg

SEQ ID NO: 3002692 - RNA, 17 nt, Human
ccugcaggcagccaggc

SEQ ID NO: 3002693 - RNA, 16 nt, Human
ccugaggcugggcucc

SEQ ID NO: 3002694 - RNA, 17 nt, Human
ccugaggcugggcuccc

SEQ ID NO: 3002695 - RNA, 19 nt, Human
ccugaggcugggcucccuu

SEQ ID NO: 3002696 - RNA, 21 nt, Human
ccugaggcugggcucccuucc

SEQ ID NO: 3002697 - RNA, 16 nt, Human
ccugaggggccucuua

SEQ ID NO: 3002698 - RNA, 12 nt, Human
ccugaggggccu

SEQ ID NO: 3002699 - RNA, 17 nt, Human
ccgucuaccugaggggc

SEQ ID NO: 3002700 - RNA, 12 nt, Human
ccgugaggccag

SEQ ID NO: 3002701 - RNA, 13 nt, Human
ccgugaggccaga

SEQ ID NO: 3002702 - RNA, 14 nt, Human
ccgugaggccagag

SEQ ID NO: 3002703 - RNA, 16 nt, Human
ccgugaggccagagac

SEQ ID NO: 3002704 - RNA, 20 nt, Human
ccuaacgaaguauccuucag

SEQ ID NO: 3002705 - RNA, 15 nt, Human
ccuaacgaaguaucc

SEQ ID NO: 3002706 - RNA, 14 nt, Human
ccgucuaccugagg

SEQ ID NO: 3002707 - RNA, 15 nt, Human
ccgucuaccugaggg

SEQ ID NO: 3002708 - RNA, 15 nt, Human
ccggcuccaggcucc

SEQ ID NO: 3002709 - RNA, 14 nt, Human
ccggcuccaggcuc

SEQ ID NO: 3002710 - RNA, 13 nt, Human
ccggcuccaggcu

SEQ ID NO: 3002711 - RNA, 12 nt, Human
ccggcuccaggc

SEQ ID NO: 3002712 - RNA, 14 nt, Human
ccuaaucuucugaa

SEQ ID NO: 3002713 - RNA, 20 nt, Human
ccuagccugugccucuggga

SEQ ID NO: 3002714 - RNA, 17 nt, Human
ccuagcacuuugggagg

SEQ ID NO: 3002715 - RNA, 19 nt, Human
ccuagcauacguacacauu

SEQ ID NO: 3002716 - RNA, 16 nt, Human
ccggccaccugcggug

SEQ ID NO: 3002717 - RNA, 15 nt, Human
ccggccccugcuggu

SEQ ID NO: 3002718 - RNA, 16 nt, Human
ccggcccuccagagcc

SEQ ID NO: 3002719 - RNA, 13 nt, Human
ccggcccuccaga

SEQ ID NO: 3002720 - RNA, 17 nt, Human
ccggcccuccagagccc

SEQ ID NO: 3002721 - RNA, 18 nt, Human
ccggcaggguccuagaaa

SEQ ID NO: 3002722 - RNA, 21 nt, Human
cccugugauggggcccugccu

SEQ ID NO: 3002723 - RNA, 22 nt, Human
cccugugauggggcccugccuc

SEQ ID NO: 3002724 - RNA, 23 nt, Human
cccugugauggggcccugccucc

SEQ ID NO: 3002725 - RNA, 16 nt, Human
ccgcagacaggaccag

SEQ ID NO: 3002726 - RNA, 17 nt, Human
ccgcagacaggaccagg

SEQ ID NO: 3002727 - RNA, 17 nt, Human
ccgcccaaggccuuccc

SEQ ID NO: 3002728 - RNA, 14 nt, Human
ccgcccaaggccuu

SEQ ID NO: 3002729 - RNA, 13 nt, Human
ccgcccaaggccu

SEQ ID NO: 3002730 - RNA, 12 nt, Human
ccgcccaaggcc

SEQ ID NO: 3002731 - RNA, 12 nt, Human
ccgcccaggcuu

SEQ ID NO: 3002732 - RNA, 17 nt, Human
ccgaccagacaccuuga

SEQ ID NO: 3002733 - RNA, 13 nt, Human
ccgaccagacacc

SEQ ID NO: 3002734 - RNA, 15 nt, Human
ccgcagacaggacca

SEQ ID NO: 3002735 - RNA, 17 nt, Human
ccgaauagcugggacua

SEQ ID NO: 3002736 - RNA, 16 nt, Human
ccgaauagcugggacu

SEQ ID NO: 3002737 - RNA, 16 nt, Human
ccgaaaacguggcugc

SEQ ID NO: 3002738 - RNA, 17 nt, Human
ccgaaaacguggcugcu

SEQ ID NO: 3002739 - RNA, 19 nt, Human
ccgaaagggacuuggaagc

SEQ ID NO: 3002740 - RNA, 15 nt, Human
cccuuccucuuucca

SEQ ID NO: 3002741 - RNA, 16 nt, Human
cccugagcuuucugcu

SEQ ID NO: 3002742 - RNA, 20 nt, Human
cccugcccaccuggccucug

SEQ ID NO: 3002743 - RNA, 14 nt, Human
cccugagcaggauu

SEQ ID NO: 3002744 - RNA, 17 nt, Human
cccugcccggcugcgga

SEQ ID NO: 3002745 - RNA, 14 nt, Human
cccugcccggcugc

SEQ ID NO: 3002746 - RNA, 22 nt, Human
cccugcccaccuggccucugca

SEQ ID NO: 3002747 - RNA, 17 nt, Human
cccuggaugcagccuca

SEQ ID NO: 3002748 - RNA, 21 nt, Human
cccuggaugcagccucacagu

SEQ ID NO: 3002749 - RNA, 13 nt, Human
cccuggaugcagc

SEQ ID NO: 3002750 - RNA, 13 nt, Human
cccuggcacuggc

SEQ ID NO: 3002751 - RNA, 16 nt, Human
cccuggcacuggcaaa

SEQ ID NO: 3002752 - RNA, 20 nt, Human
cccuggcacuggcaaacagg

SEQ ID NO: 3002753 - RNA, 13 nt, Human
cccucggagaaga

SEQ ID NO: 3002754 - RNA, 18 nt, Human
cccugaaagcccugagcu

SEQ ID NO: 3002755 - RNA, 16 nt, Human
cccugacaacacucau

SEQ ID NO: 3002756 - RNA, 22 nt, Human
cccugacaacacucauugaccu

SEQ ID NO: 3002757 - RNA, 20 nt, Human
cccugaauuuaaauagcuuu

SEQ ID NO: 3002758 - RNA, 20 nt, Human
cccugaaggccccgcccagg

SEQ ID NO: 3002759 - RNA, 22 nt, Human
cccugaaggccccgcccaggcu

SEQ ID NO: 3002760 - RNA, 14 nt, Human
cccugacaacacuc

SEQ ID NO: 3002761 - RNA, 13 nt, Human
cccugaaggcccc

SEQ ID NO: 3002762 - RNA, 14 nt, Human
cccugaaggccccg

SEQ ID NO: 3002763 - RNA, 16 nt, Human
cccugaaggccccgcc

SEQ ID NO: 3002764 - RNA, 19 nt, Human
cccugaaggccccgcccag

SEQ ID NO: 3002765 - RNA, 12 nt, Human
cccugaaggccc

SEQ ID NO: 3002766 - RNA, 16 nt, Human
cccugaaagcccugag

SEQ ID NO: 3002767 - RNA, 13 nt, Human
ccuuucccuuggu

SEQ ID NO: 3002768 - RNA, 17 nt, Human
ccuuucaauaggaaaaa

SEQ ID NO: 3002769 - RNA, 15 nt, Human
ccuuucaauaggaaa

SEQ ID NO: 3002770 - RNA, 13 nt, Human
ccuuccccuggca

SEQ ID NO: 3002771 - RNA, 20 nt, Human
ccuucucuccagccccugga

SEQ ID NO: 3002772 - RNA, 16 nt, Human
ccuucucugaaggaca

SEQ ID NO: 3002773 - RNA, 14 nt, Human
ccuucucugaagga

SEQ ID NO: 3002774 - RNA, 21 nt, Human
ccuucucuccagccccuggau

SEQ ID NO: 3002775 - RNA, 23 nt, Human
ccuucucuccagccccuggaugc

SEQ ID NO: 3002776 - RNA, 17 nt, Human
ccuucucuucacaguca

SEQ ID NO: 3002777 - RNA, 21 nt, Human
ccuucuguccuacucuguguc

SEQ ID NO: 3002778 - RNA, 20 nt, Human
ccuucuguccuacucugugu

SEQ ID NO: 3002779 - RNA, 22 nt, Human
ccuucuguccuacucuguguca

SEQ ID NO: 3002780 - RNA, 12 nt, Human
ccuuauggaaca

SEQ ID NO: 3002781 - RNA, 22 nt, Human
ccuuauggaacacucugagacu

SEQ ID NO: 3002782 - RNA, 19 nt, Human
ccuuauggaacacucugag

SEQ ID NO: 3002783 - RNA, 20 nt, Human
ccuuauggaacacucugaga

SEQ ID NO: 3002784 - RNA, 14 nt, Human
ccuuauggaacacu

SEQ ID NO: 3002785 - RNA, 16 nt, Human
ccuuauggaacacucu

SEQ ID NO: 3002786 - RNA, 17 nt, Human
ccuuauggaacacucug

SEQ ID NO: 3002787 - RNA, 18 nt, Human
ccuuauggaacacucuga

SEQ ID NO: 3002788 - RNA, 14 nt, Human
ccuucccaccucuc

SEQ ID NO: 3002789 - RNA, 19 nt, Human
ccuucccaccucucucacu

SEQ ID NO: 3002790 - RNA, 12 nt, Human
ccuucccaccuc

SEQ ID NO: 3002791 - RNA, 20 nt, Human
ccuuagcagggaaacagcua

SEQ ID NO: 3002792 - RNA, 19 nt, Human
ccuuagcagggaaacagcu

SEQ ID NO: 3002793 - RNA, 16 nt, Human
ccuuagcaaauucugu

SEQ ID NO: 3002794 - RNA, 17 nt, Human
ccuguugggccaggagc

SEQ ID NO: 3002795 - RNA, 18 nt, Human
ccuguugggccaggagcc

SEQ ID NO: 3002796 - RNA, 19 nt, Human
ccuguugggccaggagccu

SEQ ID NO: 3002797 - RNA, 20 nt, Human
ccuguugggccaggagccuc

SEQ ID NO: 3002798 - RNA, 16 nt, Human
ccuguugggccaggag

SEQ ID NO: 3002799 - RNA, 19 nt, Human
ccuguucagcuccagcuca

SEQ ID NO: 3002800 - RNA, 16 nt, Human
ccuguucagcuccagc

SEQ ID NO: 3002801 - RNA, 15 nt, Human
ccuguucagcuccag

SEQ ID NO: 3002802 - RNA, 14 nt, Human
ccuguucagcucca

SEQ ID NO: 3002803 - RNA, 21 nt, Human
ccuguucagcuccagcucacc

SEQ ID NO: 3002804 - RNA, 20 nt, Human
ccuguucagcuccagcucac

SEQ ID NO: 3002805 - RNA, 23 nt, Human
ccuguucagcuccagcucaccag

SEQ ID NO: 3002806 - RNA, 12 nt, Human
ccuguucuggca

SEQ ID NO: 3002807 - RNA, 17 nt, Human
ccuguucuggcagaguu

SEQ ID NO: 3002808 - RNA, 18 nt, Human
ccuguucccaugagauga

SEQ ID NO: 3002809 - RNA, 13 nt, Human
ccuguucagcucc

SEQ ID NO: 3002810 - RNA, 13 nt, Human
cuaacuuggguua

SEQ ID NO: 3002811 - RNA, 14 nt, Human
cuaacuugucuuug

SEQ ID NO: 3002812 - RNA, 22 nt, Human
cuaacuugucuuuggacccuga

SEQ ID NO: 3002813 - RNA, 20 nt, Human
cuaacgaaguauccuucagc

SEQ ID NO: 3002814 - RNA, 11 nt, Human
cuaaagcugcc

SEQ ID NO: 3002815 - RNA, 19 nt, Human
cgugaguccuggcauggga

SEQ ID NO: 3002816 - RNA, 18 nt, Human
cgugaguccuggcauggg

SEQ ID NO: 3002817 - RNA, 19 nt, Human
cguguuaugacuccagaau

SEQ ID NO: 3002818 - RNA, 15 nt, Human
cguguuaugacucca

SEQ ID NO: 3002819 - RNA, 12 nt, Human
cgugacaacacu

SEQ ID NO: 3002820 - RNA, 15 nt, Human
cgugacaacacuugu

SEQ ID NO: 3002821 - RNA, 14 nt, Human
cgugacaacacuug

SEQ ID NO: 3002822 - RNA, 20 nt, Human
cgugagccacugcaccgggc

SEQ ID NO: 3002823 - RNA, 15 nt, Human
cgugagccacugcac

SEQ ID NO: 3002824 - RNA, 14 nt, Human
cgugagccacugca

SEQ ID NO: 3002825 - RNA, 14 nt, Human
cgugaggccagaga
